United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 138

SEQ ID NO: 5854626 - DNA, 21 bp, Homo sapiens
caaggggtggccgtcctgagg

SEQ ID NO: 5854627 - DNA, 23 bp, Homo sapiens
caaggggtggccgtcctgagggg

SEQ ID NO: 5854628 - DNA, 19 bp, Homo sapiens
caagggtagggtctgcgtg

SEQ ID NO: 5854629 - DNA, 23 bp, Homo sapiens
caagggtcattatgggttaggca

SEQ ID NO: 5854630 - DNA, 19 bp, Homo sapiens
caagggtccgtggaccagg

SEQ ID NO: 5854631 - DNA, 15 bp, Homo sapiens
caagggtcctcaccc

SEQ ID NO: 5854632 - DNA, 16 bp, Homo sapiens
caagggtctagggaga

SEQ ID NO: 5854633 - DNA, 21 bp, Homo sapiens
caagggtgatgggaaagcatt

SEQ ID NO: 5854634 - DNA, 16 bp, Homo sapiens
caagggtgcctcagga

SEQ ID NO: 5854635 - DNA, 18 bp, Homo sapiens
caagggtgcctcaggacc

SEQ ID NO: 5854636 - DNA, 16 bp, Homo sapiens
caagggtggcatccca

SEQ ID NO: 5854637 - DNA, 23 bp, Homo sapiens
caagggttaaccattttttttaa

SEQ ID NO: 5854638 - DNA, 16 bp, Homo sapiens
caagggttaaggcctg

SEQ ID NO: 5854639 - DNA, 21 bp, Homo sapiens
caagggttgcttctgagtggt

SEQ ID NO: 5854640 - DNA, 20 bp, Homo sapiens
caagggtttcgactggtcca

SEQ ID NO: 5854641 - DNA, 23 bp, Homo sapiens
caagggtttcgactggtccagct

SEQ ID NO: 5854642 - DNA, 22 bp, Homo sapiens
caaggtaactgtactgggccat

SEQ ID NO: 5854643 - DNA, 14 bp, Homo sapiens
caaggtaaggaggg

SEQ ID NO: 5854644 - DNA, 23 bp, Homo sapiens
caaggtaattgttttttaaagca

SEQ ID NO: 5854645 - DNA, 21 bp, Homo sapiens
caaggtaatttttttttgtaa

SEQ ID NO: 5854646 - DNA, 16 bp, Homo sapiens
caaggtacaaaatctt

SEQ ID NO: 5854647 - DNA, 15 bp, Homo sapiens
caaggtaccatccta

SEQ ID NO: 5854648 - DNA, 23 bp, Homo sapiens
caaggtagccctggccagaggct

SEQ ID NO: 5854649 - DNA, 9 bp, Homo sapiens
caaggtata

SEQ ID NO: 5854650 - DNA, 17 bp, Homo sapiens
caaggtataataaaatt

SEQ ID NO: 5854651 - DNA, 19 bp, Homo sapiens
caaggtataataaaattat

SEQ ID NO: 5854652 - DNA, 14 bp, Homo sapiens
caaggtataataag

SEQ ID NO: 5854653 - DNA, 21 bp, Homo sapiens
caaggtattgagacatattac

SEQ ID NO: 5854654 - DNA, 17 bp, Homo sapiens
caaggtcacatagctgg

SEQ ID NO: 5854655 - DNA, 16 bp, Homo sapiens
caaggtcacctgggct

SEQ ID NO: 5854656 - DNA, 15 bp, Homo sapiens
caaggtcactcttgg

SEQ ID NO: 5854657 - DNA, 24 bp, Homo sapiens
caaggtcagggagcaagaggtgtg

SEQ ID NO: 5854658 - DNA, 17 bp, Homo sapiens
caaggtcatggccacac

SEQ ID NO: 5854659 - DNA, 20 bp, Homo sapiens
caaggtcatggccacactgt

SEQ ID NO: 5854660 - DNA, 15 bp, Homo sapiens
caaggtcatttcttc

SEQ ID NO: 5854661 - DNA, 20 bp, Homo sapiens
caaggtccactccctgctcc

SEQ ID NO: 5854662 - DNA, 14 bp, Homo sapiens
caaggtcccctcca

SEQ ID NO: 5854663 - DNA, 15 bp, Homo sapiens
caaggtcctgctcaa

SEQ ID NO: 5854664 - DNA, 19 bp, Homo sapiens
caaggtcgtttttttcatt

SEQ ID NO: 5854665 - DNA, 12 bp, Homo sapiens
caaggtctcaca

SEQ ID NO: 5854666 - DNA, 21 bp, Homo sapiens
caaggtctcacactcctcctg

SEQ ID NO: 5854667 - DNA, 23 bp, Homo sapiens
caaggtctcgggggtccggaagg

SEQ ID NO: 5854668 - DNA, 22 bp, Homo sapiens
caaggtgaaacgactcaaaatg

SEQ ID NO: 5854669 - DNA, 17 bp, Homo sapiens
caaggtgaaatgaagca

SEQ ID NO: 5854670 - DNA, 16 bp, Homo sapiens
caaggtgaatagcaca

SEQ ID NO: 5854671 - DNA, 20 bp, Homo sapiens
caaggtgacagaaggaccag

SEQ ID NO: 5854672 - DNA, 19 bp, Homo sapiens
caaggtgagaattaagttt

SEQ ID NO: 5854673 - DNA, 19 bp, Homo sapiens
caaggtgaggtgaactcca

SEQ ID NO: 5854674 - DNA, 20 bp, Homo sapiens
caaggtgaggtgaactccag

SEQ ID NO: 5854675 - DNA, 21 bp, Homo sapiens
caaggtgataggaaaactgaa

SEQ ID NO: 5854676 - DNA, 22 bp, Homo sapiens
caaggtgataggaaaactgaat

SEQ ID NO: 5854677 - DNA, 23 bp, Homo sapiens
caaggtgatttcagactgcagag

SEQ ID NO: 5854678 - DNA, 15 bp, Homo sapiens
caaggtgcaaatcaa

SEQ ID NO: 5854679 - DNA, 17 bp, Homo sapiens
caaggtgcaggcaggct

SEQ ID NO: 5854680 - DNA, 17 bp, Homo sapiens
caaggtgcatatagaaa

SEQ ID NO: 5854681 - DNA, 18 bp, Homo sapiens
caaggtgcatatagaaaa

SEQ ID NO: 5854682 - DNA, 19 bp, Homo sapiens
caaggtgctaaaaggaata

SEQ ID NO: 5854683 - DNA, 14 bp, Homo sapiens
caaggtgctaacat

SEQ ID NO: 5854684 - DNA, 13 bp, Homo sapiens
caaggtgctcaca

SEQ ID NO: 5854685 - DNA, 14 bp, Homo sapiens
caaggtgctctgtg

SEQ ID NO: 5854686 - DNA, 15 bp, Homo sapiens
caaggtgctctgtgt

SEQ ID NO: 5854687 - DNA, 15 bp, Homo sapiens
caaggtgctgatgtc

SEQ ID NO: 5854688 - DNA, 22 bp, Homo sapiens
caaggtgctggtgggtctgagc

SEQ ID NO: 5854689 - DNA, 17 bp, Homo sapiens
caaggtgctgttgtcat

SEQ ID NO: 5854690 - DNA, 14 bp, Homo sapiens
caaggtggagtgga

SEQ ID NO: 5854691 - DNA, 15 bp, Homo sapiens
caaggtggcagatgt

SEQ ID NO: 5854692 - DNA, 15 bp, Homo sapiens
caaggtggcagcaag

SEQ ID NO: 5854693 - DNA, 19 bp, Homo sapiens
caaggtggccaaattattt

SEQ ID NO: 5854694 - DNA, 18 bp, Homo sapiens
caaggtggcctctgcctg

SEQ ID NO: 5854695 - DNA, 22 bp, Homo sapiens
caaggtggcctctgcctggggc

SEQ ID NO: 5854696 - DNA, 13 bp, Homo sapiens
caaggtggcttct

SEQ ID NO: 5854697 - DNA, 21 bp, Homo sapiens
caaggtgggcagggaggcacc

SEQ ID NO: 5854698 - DNA, 22 bp, Homo sapiens
caaggtgggccttgctacctca

SEQ ID NO: 5854699 - DNA, 12 bp, Homo sapiens
caaggtgggctg

SEQ ID NO: 5854700 - DNA, 16 bp, Homo sapiens
caaggtgggctgagcc

SEQ ID NO: 5854701 - DNA, 17 bp, Homo sapiens
caaggtgggctgagccc

SEQ ID NO: 5854702 - DNA, 18 bp, Homo sapiens
caaggtgggctgagccct

SEQ ID NO: 5854703 - DNA, 19 bp, Homo sapiens
caaggtgggctgagccctg

SEQ ID NO: 5854704 - DNA, 20 bp, Homo sapiens
caaggtgggctgagccctgg

SEQ ID NO: 5854705 - DNA, 20 bp, Homo sapiens
caaggtggggattgcccctg

SEQ ID NO: 5854706 - DNA, 15 bp, Homo sapiens
caaggtgggggagcc

SEQ ID NO: 5854707 - DNA, 20 bp, Homo sapiens
caaggtgggggagcctggag

SEQ ID NO: 5854708 - DNA, 21 bp, Homo sapiens
caaggtgggggtcaggctaca

SEQ ID NO: 5854709 - DNA, 22 bp, Homo sapiens
caaggtgggtgattcctcccag

SEQ ID NO: 5854710 - DNA, 23 bp, Homo sapiens
caaggtggtatggttgtatacac

SEQ ID NO: 5854711 - DNA, 23 bp, Homo sapiens
caaggtggtctgctcgggcccag

SEQ ID NO: 5854712 - DNA, 22 bp, Homo sapiens
caaggtggtcttggagaggagg

SEQ ID NO: 5854713 - DNA, 17 bp, Homo sapiens
caaggtgtcatttatgt

SEQ ID NO: 5854714 - DNA, 14 bp, Homo sapiens
caaggtgtccaggg

SEQ ID NO: 5854715 - DNA, 18 bp, Homo sapiens
caaggtgtccagggtcct

SEQ ID NO: 5854716 - DNA, 17 bp, Homo sapiens
caaggtgtccctgcctt

SEQ ID NO: 5854717 - DNA, 19 bp, Homo sapiens
caaggtgtccctgccttca

SEQ ID NO: 5854718 - DNA, 17 bp, Homo sapiens
caaggtgtcctacagaa

SEQ ID NO: 5854719 - DNA, 22 bp, Homo sapiens
caaggtgtctttgaaggaaagc

SEQ ID NO: 5854720 - DNA, 17 bp, Homo sapiens
caaggtgtgcagtggcc

SEQ ID NO: 5854721 - DNA, 16 bp, Homo sapiens
caaggtgtgctctgag

SEQ ID NO: 5854722 - DNA, 21 bp, Homo sapiens
caaggtgtggaggctcctgtg

SEQ ID NO: 5854723 - DNA, 22 bp, Homo sapiens
caaggtgtggaggctcctgtgg

SEQ ID NO: 5854724 - DNA, 21 bp, Homo sapiens
caaggttataattttttttaa

SEQ ID NO: 5854725 - DNA, 22 bp, Homo sapiens
caaggttataattttttttaaa

SEQ ID NO: 5854726 - DNA, 21 bp, Homo sapiens
caaggttatatgcactttctc

SEQ ID NO: 5854727 - DNA, 15 bp, Homo sapiens
caaggttccacagag

SEQ ID NO: 5854728 - DNA, 16 bp, Homo sapiens
caaggttccacagagt

SEQ ID NO: 5854729 - DNA, 16 bp, Homo sapiens
caaggttccctctgag

SEQ ID NO: 5854730 - DNA, 17 bp, Homo sapiens
caaggttccctctgaga

SEQ ID NO: 5854731 - DNA, 18 bp, Homo sapiens
caaggttccctctgagaa

SEQ ID NO: 5854732 - DNA, 13 bp, Homo sapiens
caaggttctaacc

SEQ ID NO: 5854733 - DNA, 16 bp, Homo sapiens
caaggttctagtctct

SEQ ID NO: 5854734 - DNA, 16 bp, Homo sapiens
caaggttgcacagcaa

SEQ ID NO: 5854735 - DNA, 17 bp, Homo sapiens
caaggttgcacagcaag

SEQ ID NO: 5854736 - DNA, 13 bp, Homo sapiens
caaggttgctgtt

SEQ ID NO: 5854737 - DNA, 15 bp, Homo sapiens
caaggttgctgttgt

SEQ ID NO: 5854738 - DNA, 23 bp, Homo sapiens
caaggttgctgttgtgcagtgtg

SEQ ID NO: 5854739 - DNA, 14 bp, Homo sapiens
caaggttggagccc

SEQ ID NO: 5854740 - DNA, 17 bp, Homo sapiens
caaggttggagcccagg

SEQ ID NO: 5854741 - DNA, 21 bp, Homo sapiens
caaggttggagcccagggcat

SEQ ID NO: 5854742 - DNA, 16 bp, Homo sapiens
caaggttggcacccca

SEQ ID NO: 5854743 - DNA, 20 bp, Homo sapiens
caaggtttaaagagtctaga

SEQ ID NO: 5854744 - DNA, 21 bp, Homo sapiens
caaggtttaaagagtctagat

SEQ ID NO: 5854745 - DNA, 15 bp, Homo sapiens
caaggtttaagttat

SEQ ID NO: 5854746 - DNA, 22 bp, Homo sapiens
caaggtttaggctggtggccca

SEQ ID NO: 5854747 - DNA, 18 bp, Homo sapiens
caaggtttataaagcaga

SEQ ID NO: 5854748 - DNA, 19 bp, Homo sapiens
caaggtttataaagcagat

SEQ ID NO: 5854749 - DNA, 23 bp, Homo sapiens
caaggtttcccagtgagcctctg

SEQ ID NO: 5854750 - DNA, 23 bp, Homo sapiens
caaggtttcgtggcagcacggcc

SEQ ID NO: 5854751 - DNA, 23 bp, Homo sapiens
caaggttttaggttctaaagttc

SEQ ID NO: 5854752 - DNA, 19 bp, Homo sapiens
caaggttttataaggctga

SEQ ID NO: 5854753 - DNA, 17 bp, Homo sapiens
caaggttttggagtcag

SEQ ID NO: 5854754 - DNA, 10 bp, Homo sapiens
caagtaaaaa

SEQ ID NO: 5854755 - DNA, 14 bp, Homo sapiens
caagtaaaagaaaa

SEQ ID NO: 5854756 - DNA, 13 bp, Homo sapiens
caagtaaaatgtt

SEQ ID NO: 5854757 - DNA, 14 bp, Homo sapiens
caagtaaaatgttt

SEQ ID NO: 5854758 - DNA, 23 bp, Homo sapiens
caagtaaatagcaacatgcttca

SEQ ID NO: 5854759 - DNA, 13 bp, Homo sapiens
caagtaaatatat

SEQ ID NO: 5854760 - DNA, 15 bp, Homo sapiens
caagtaacacatttg

SEQ ID NO: 5854761 - DNA, 16 bp, Homo sapiens
caagtaacactttaaa

SEQ ID NO: 5854762 - DNA, 19 bp, Homo sapiens
caagtaacatgacttcctt

SEQ ID NO: 5854763 - DNA, 20 bp, Homo sapiens
caagtaaccaggccccagcc

SEQ ID NO: 5854764 - DNA, 14 bp, Homo sapiens
caagtaacttctga

SEQ ID NO: 5854765 - DNA, 14 bp, Homo sapiens
caagtaagaagaca

SEQ ID NO: 5854766 - DNA, 18 bp, Homo sapiens
caagtaagaagacatgaa

SEQ ID NO: 5854767 - DNA, 18 bp, Homo sapiens
caagtaagaataaaattg

SEQ ID NO: 5854768 - DNA, 22 bp, Homo sapiens
caagtaagacatctcaaataca

SEQ ID NO: 5854769 - DNA, 20 bp, Homo sapiens
caagtaaggcttttaatttt

SEQ ID NO: 5854770 - DNA, 22 bp, Homo sapiens
caagtaatccacctgcctcggc

SEQ ID NO: 5854771 - DNA, 12 bp, Homo sapiens
caagtaatgaat

SEQ ID NO: 5854772 - DNA, 14 bp, Homo sapiens
caagtaatgaattt

SEQ ID NO: 5854773 - DNA, 18 bp, Homo sapiens
caagtaatggaggtccca

SEQ ID NO: 5854774 - DNA, 15 bp, Homo sapiens
caagtaattttcata

SEQ ID NO: 5854775 - DNA, 19 bp, Homo sapiens
caagtacaaccacacccac

SEQ ID NO: 5854776 - DNA, 16 bp, Homo sapiens
caagtacaagtatata

SEQ ID NO: 5854777 - DNA, 14 bp, Homo sapiens
caagtacagccttc

SEQ ID NO: 5854778 - DNA, 20 bp, Homo sapiens
caagtaccaccaagggatct

SEQ ID NO: 5854779 - DNA, 17 bp, Homo sapiens
caagtactaaagcacct

SEQ ID NO: 5854780 - DNA, 17 bp, Homo sapiens
caagtactatctgttcc

SEQ ID NO: 5854781 - DNA, 21 bp, Homo sapiens
caagtactggctctttattca

SEQ ID NO: 5854782 - DNA, 17 bp, Homo sapiens
caagtactgttttgaag

SEQ ID NO: 5854783 - DNA, 22 bp, Homo sapiens
caagtacttaactatctgttcc

SEQ ID NO: 5854784 - DNA, 19 bp, Homo sapiens
caagttctttcccagcctc

SEQ ID NO: 5854785 - DNA, 19 bp, Homo sapiens
caagttctttttaaaatcc

SEQ ID NO: 5854786 - DNA, 20 bp, Homo sapiens
caagttgaaaaatagcatat

SEQ ID NO: 5854787 - DNA, 16 bp, Homo sapiens
caagttgaagaagctg

SEQ ID NO: 5854788 - DNA, 14 bp, Homo sapiens
caagttgaagggaa

SEQ ID NO: 5854789 - DNA, 15 bp, Homo sapiens
caagttgagaacaaa

SEQ ID NO: 5854790 - DNA, 19 bp, Homo sapiens
caagttgagatttttaaga

SEQ ID NO: 5854791 - DNA, 17 bp, Homo sapiens
caagttgcagtgagcag

SEQ ID NO: 5854792 - DNA, 20 bp, Homo sapiens
caagttgccacattgcttca

SEQ ID NO: 5854793 - DNA, 21 bp, Homo sapiens
caagttgccacattgcttcat

SEQ ID NO: 5854794 - DNA, 16 bp, Homo sapiens
caagttgccattttgt

SEQ ID NO: 5854795 - DNA, 15 bp, Homo sapiens
caagttgcgacggag

SEQ ID NO: 5854796 - DNA, 20 bp, Homo sapiens
caagttgctgtcactgtttt

SEQ ID NO: 5854797 - DNA, 19 bp, Homo sapiens
caagttggtcttactttgt

SEQ ID NO: 5854798 - DNA, 22 bp, Homo sapiens
caagttggtcttactttgttaa

SEQ ID NO: 5854799 - DNA, 23 bp, Homo sapiens
caagttggtcttatagaaagcac

SEQ ID NO: 5854800 - DNA, 12 bp, Homo sapiens
caagttgtaaat

SEQ ID NO: 5854801 - DNA, 20 bp, Homo sapiens
caagttgtactgtatgcagt

SEQ ID NO: 5854802 - DNA, 16 bp, Homo sapiens
caagttgtcaggttat

SEQ ID NO: 5854803 - DNA, 21 bp, Homo sapiens
caagttgtgacagtcactgca

SEQ ID NO: 5854804 - DNA, 18 bp, Homo sapiens
caagttgtgccaaattat

SEQ ID NO: 5854805 - DNA, 19 bp, Homo sapiens
caagttgtgccaaattatt

SEQ ID NO: 5854806 - DNA, 14 bp, Homo sapiens
caagttgtgccttt

SEQ ID NO: 5854807 - DNA, 15 bp, Homo sapiens
caagttgtgcctttc

SEQ ID NO: 5854808 - DNA, 12 bp, Homo sapiens
caagttgtgctt

SEQ ID NO: 5854809 - DNA, 13 bp, Homo sapiens
caagttgtgcttg

SEQ ID NO: 5854810 - DNA, 17 bp, Homo sapiens
caagttgtgcttgttta

SEQ ID NO: 5854811 - DNA, 21 bp, Homo sapiens
caagttgtgtgctattcgtaa

SEQ ID NO: 5854812 - DNA, 22 bp, Homo sapiens
caagttgttaaaacatttaata

SEQ ID NO: 5854813 - DNA, 18 bp, Homo sapiens
caagttgttattgttgaa

SEQ ID NO: 5854814 - DNA, 20 bp, Homo sapiens
caagttgttattgttgaaca

SEQ ID NO: 5854815 - DNA, 17 bp, Homo sapiens
caagttgttcaaacatt

SEQ ID NO: 5854816 - DNA, 22 bp, Homo sapiens
caagttgttgactgtgattaga

SEQ ID NO: 5854817 - DNA, 20 bp, Homo sapiens
caagttgtttattccaaaga

SEQ ID NO: 5854818 - DNA, 13 bp, Homo sapiens
caagttgtttgag

SEQ ID NO: 5854819 - DNA, 19 bp, Homo sapiens
caagttgtttggtactttt

SEQ ID NO: 5854820 - DNA, 16 bp, Homo sapiens
caagtttaaaagccat

SEQ ID NO: 5854821 - DNA, 12 bp, Homo sapiens
caagtttaaagt

SEQ ID NO: 5854822 - DNA, 19 bp, Homo sapiens
caagtttacacttcatata

SEQ ID NO: 5854823 - DNA, 13 bp, Homo sapiens
caagtttactttt

SEQ ID NO: 5854824 - DNA, 13 bp, Homo sapiens
caagtttataagc

SEQ ID NO: 5854825 - DNA, 15 bp, Homo sapiens
caagtttatatatat

SEQ ID NO: 5854826 - DNA, 17 bp, Homo sapiens
caagtttattcagtaaa

SEQ ID NO: 5854827 - DNA, 18 bp, Homo sapiens
caagtttattcagtaaac

SEQ ID NO: 5854828 - DNA, 15 bp, Homo sapiens
caagtttcagacagg

SEQ ID NO: 5854829 - DNA, 13 bp, Homo sapiens
caagtttcagtaa

SEQ ID NO: 5854830 - DNA, 16 bp, Homo sapiens
caagtttcagtaatag

SEQ ID NO: 5854831 - DNA, 18 bp, Homo sapiens
caagtttcatcagcccta

SEQ ID NO: 5854832 - DNA, 20 bp, Homo sapiens
caagtttcatccagaactac

SEQ ID NO: 5854833 - DNA, 17 bp, Homo sapiens
caagtttccaagcaaat

SEQ ID NO: 5854834 - DNA, 18 bp, Homo sapiens
caagtttccaagcaaatg

SEQ ID NO: 5854835 - DNA, 21 bp, Homo sapiens
caagtttcccgccaggaggtc

SEQ ID NO: 5854836 - DNA, 23 bp, Homo sapiens
caagtttctagctagaaatatga

SEQ ID NO: 5854837 - DNA, 17 bp, Homo sapiens
caagtttgaccagtgca

SEQ ID NO: 5854838 - DNA, 18 bp, Homo sapiens
caagtttgcaaacctgca

SEQ ID NO: 5854839 - DNA, 12 bp, Homo sapiens
caagtttgctaa

SEQ ID NO: 5854840 - DNA, 13 bp, Homo sapiens
caagtttgctaaa

SEQ ID NO: 5854841 - DNA, 18 bp, Homo sapiens
caagtttgctaaaagaag

SEQ ID NO: 5854842 - DNA, 14 bp, Homo sapiens
caagttttagttaa

SEQ ID NO: 5854843 - DNA, 18 bp, Homo sapiens
caagttttagttaaaact

SEQ ID NO: 5854844 - DNA, 12 bp, Homo sapiens
caagttttgtat

SEQ ID NO: 5854845 - DNA, 13 bp, Homo sapiens
caagttttgtgaa

SEQ ID NO: 5854846 - DNA, 16 bp, Homo sapiens
caagttttgtgaaatt

SEQ ID NO: 5854847 - DNA, 22 bp, Homo sapiens
caagttttgtgaaatttttcat

SEQ ID NO: 5854848 - DNA, 19 bp, Homo sapiens
caagtttttaatcgttttt

SEQ ID NO: 5854849 - DNA, 14 bp, Homo sapiens
caagtttttcagaa

SEQ ID NO: 5854850 - DNA, 15 bp, Homo sapiens
caagtttttcatact

SEQ ID NO: 5854851 - DNA, 19 bp, Homo sapiens
caagtttttcatactgtac

SEQ ID NO: 5854852 - DNA, 17 bp, Homo sapiens
caagtttttctaacagt

SEQ ID NO: 5854853 - DNA, 14 bp, Homo sapiens
caagtttttctctc

SEQ ID NO: 5854854 - DNA, 21 bp, Homo sapiens
caagttttttaattaagcaga

SEQ ID NO: 5854855 - DNA, 18 bp, Homo sapiens
caagtttttttgttcata

SEQ ID NO: 5854856 - DNA, 21 bp, Homo sapiens
caagtttttttgttcatactt

SEQ ID NO: 5854857 - DNA, 18 bp, Homo sapiens
caataaaaaacaaatata

SEQ ID NO: 5854858 - DNA, 17 bp, Homo sapiens
caataaaaaagtgagct

SEQ ID NO: 5854859 - DNA, 11 bp, Homo sapiens
caataaaaaat

SEQ ID NO: 5854860 - DNA, 13 bp, Homo sapiens
caataaaaaatta

SEQ ID NO: 5854861 - DNA, 16 bp, Homo sapiens
caataaaaaattatga

SEQ ID NO: 5854862 - DNA, 17 bp, Homo sapiens
caataaaaaattatgac

SEQ ID NO: 5854863 - DNA, 19 bp, Homo sapiens
caataaaaacattttgaag

SEQ ID NO: 5854864 - DNA, 16 bp, Homo sapiens
caataaaaagttcaga

SEQ ID NO: 5854865 - DNA, 19 bp, Homo sapiens
caataaaaagttcagagtt

SEQ ID NO: 5854866 - DNA, 18 bp, Homo sapiens
caataaaaatcaggagcc

SEQ ID NO: 5854867 - DNA, 22 bp, Homo sapiens
caataaaaatctttgattcaga

SEQ ID NO: 5854868 - DNA, 15 bp, Homo sapiens
caataaaaatggcat

SEQ ID NO: 5854869 - DNA, 13 bp, Homo sapiens
caataaaaatgtt

SEQ ID NO: 5854870 - DNA, 13 bp, Homo sapiens
caataaaacaaat

SEQ ID NO: 5854871 - DNA, 15 bp, Homo sapiens
caataaaacaagaat

SEQ ID NO: 5854872 - DNA, 14 bp, Homo sapiens
caataaaacattaa

SEQ ID NO: 5854873 - DNA, 21 bp, Homo sapiens
caataaaaccaagcctctgga

SEQ ID NO: 5854874 - DNA, 18 bp, Homo sapiens
caataaaactaaatgtgt

SEQ ID NO: 5854875 - DNA, 21 bp, Homo sapiens
caataaaactaaatgtgtaca

SEQ ID NO: 5854876 - DNA, 19 bp, Homo sapiens
caataaaagagctgtctga

SEQ ID NO: 5854877 - DNA, 22 bp, Homo sapiens
caataaaagagctgtctgactg

SEQ ID NO: 5854878 - DNA, 15 bp, Homo sapiens
caataaaagagcttt

SEQ ID NO: 5854879 - DNA, 16 bp, Homo sapiens
caataaaagagcttta

SEQ ID NO: 5854880 - DNA, 17 bp, Homo sapiens
caataaaagcccaggag

SEQ ID NO: 5854881 - DNA, 22 bp, Homo sapiens
caataaaagcccaggagcccat

SEQ ID NO: 5854882 - DNA, 23 bp, Homo sapiens
caataaaagcctttgaaaatact

SEQ ID NO: 5854883 - DNA, 11 bp, Homo sapiens
caataaaagtg

SEQ ID NO: 5854884 - DNA, 19 bp, Homo sapiens
caataaaagtgactctcag

SEQ ID NO: 5854885 - DNA, 13 bp, Homo sapiens
caataaaatagta

SEQ ID NO: 5854886 - DNA, 14 bp, Homo sapiens
caataaaatattat

SEQ ID NO: 5854887 - DNA, 21 bp, Homo sapiens
caataaaatattattgaacta

SEQ ID NO: 5854888 - DNA, 13 bp, Homo sapiens
caataaaatcatg

SEQ ID NO: 5854889 - DNA, 17 bp, Homo sapiens
caataaaatgaacctga

SEQ ID NO: 5854890 - DNA, 18 bp, Homo sapiens
caataaaatgcactgacc

SEQ ID NO: 5854891 - DNA, 13 bp, Homo sapiens
caataaaatgtat

SEQ ID NO: 5854892 - DNA, 15 bp, Homo sapiens
caataaaatgtgatt

SEQ ID NO: 5854893 - DNA, 16 bp, Homo sapiens
caataaaatgtgattt

SEQ ID NO: 5854894 - DNA, 20 bp, Homo sapiens
caataaaatgtgatttttct

SEQ ID NO: 5854895 - DNA, 19 bp, Homo sapiens
caataaaattatttgcagg

SEQ ID NO: 5854896 - DNA, 17 bp, Homo sapiens
caataaaattctgtaat

SEQ ID NO: 5854897 - DNA, 13 bp, Homo sapiens
caataaaatttaa

SEQ ID NO: 5854898 - DNA, 17 bp, Homo sapiens
caataaaatttctaaga

SEQ ID NO: 5854899 - DNA, 20 bp, Homo sapiens
caataaaattttcaaacttt

SEQ ID NO: 5854900 - DNA, 18 bp, Homo sapiens
caataaaatttttttaaa

SEQ ID NO: 5854901 - DNA, 19 bp, Homo sapiens
caataaaattttttttcat

SEQ ID NO: 5854902 - DNA, 12 bp, Homo sapiens
caataaacagct

SEQ ID NO: 5854903 - DNA, 14 bp, Homo sapiens
caataaacagctcc

SEQ ID NO: 5854904 - DNA, 15 bp, Homo sapiens
caataaacaggaatt

SEQ ID NO: 5854905 - DNA, 13 bp, Homo sapiens
caataaacagtca

SEQ ID NO: 5854906 - DNA, 17 bp, Homo sapiens
caataaacatagcttgt

SEQ ID NO: 5854907 - DNA, 22 bp, Homo sapiens
caataaaccaaacccagccact

SEQ ID NO: 5854908 - DNA, 14 bp, Homo sapiens
caataaaccagtgt

SEQ ID NO: 5854909 - DNA, 15 bp, Homo sapiens
caataaaccagtgtg

SEQ ID NO: 5854910 - DNA, 16 bp, Homo sapiens
caataaaccagtgtga

SEQ ID NO: 5854911 - DNA, 15 bp, Homo sapiens
caataaaccctcaga

SEQ ID NO: 5854912 - DNA, 17 bp, Homo sapiens
caataaaccttgaacag

SEQ ID NO: 5854913 - DNA, 21 bp, Homo sapiens
caataaacgaaacacagaact

SEQ ID NO: 5854914 - DNA, 19 bp, Homo sapiens
caataaacgatttaattct

SEQ ID NO: 5854915 - DNA, 21 bp, Homo sapiens
caataaacgatttaattctct

SEQ ID NO: 5854916 - DNA, 19 bp, Homo sapiens
caataaactgaatttttct

SEQ ID NO: 5854917 - DNA, 15 bp, Homo sapiens
caataaactgagcga

SEQ ID NO: 5854918 - DNA, 20 bp, Homo sapiens
caataaactgagcgacccca

SEQ ID NO: 5854919 - DNA, 14 bp, Homo sapiens
caataaacttagag

SEQ ID NO: 5854920 - DNA, 12 bp, Homo sapiens
caataaacttgt

SEQ ID NO: 5854921 - DNA, 16 bp, Homo sapiens
caataaacttgtgcct

SEQ ID NO: 5854922 - DNA, 18 bp, Homo sapiens
caataaacttgtgcctcc

SEQ ID NO: 5854923 - DNA, 12 bp, Homo sapiens
caataaagaaaa

SEQ ID NO: 5854924 - DNA, 21 bp, Homo sapiens
caataaagaaaaaaatagttt

SEQ ID NO: 5854925 - DNA, 19 bp, Homo sapiens
caataaagagaaccatgtg

SEQ ID NO: 5854926 - DNA, 13 bp, Homo sapiens
caataaagcaatg

SEQ ID NO: 5854927 - DNA, 19 bp, Homo sapiens
caataaagcacgcagttat

SEQ ID NO: 5854928 - DNA, 15 bp, Homo sapiens
caataaagcactgag

SEQ ID NO: 5854929 - DNA, 16 bp, Homo sapiens
caataaagcactgagc

SEQ ID NO: 5854930 - DNA, 17 bp, Homo sapiens
caataaagcactgagca

SEQ ID NO: 5854931 - DNA, 13 bp, Homo sapiens
caataaagcagag

SEQ ID NO: 5854932 - DNA, 16 bp, Homo sapiens
caataaagcagagcca

SEQ ID NO: 5854933 - DNA, 19 bp, Homo sapiens
caataaagcagcgtttcta

SEQ ID NO: 5854934 - DNA, 17 bp, Homo sapiens
caataaagcagtcctgt

SEQ ID NO: 5854935 - DNA, 19 bp, Homo sapiens
caataaagcattttgcaaa

SEQ ID NO: 5854936 - DNA, 15 bp, Homo sapiens
caataaagcctttta

SEQ ID NO: 5854937 - DNA, 16 bp, Homo sapiens
caataaagctcacact

SEQ ID NO: 5854938 - DNA, 15 bp, Homo sapiens
caataaagctgctga

SEQ ID NO: 5854939 - DNA, 22 bp, Homo sapiens
caataaagctgctgagaatcta

SEQ ID NO: 5854940 - DNA, 12 bp, Homo sapiens
caataaagctgg

SEQ ID NO: 5854941 - DNA, 13 bp, Homo sapiens
caataaagctgga

SEQ ID NO: 5854942 - DNA, 17 bp, Homo sapiens
caataaagctggacaag

SEQ ID NO: 5854943 - DNA, 14 bp, Homo sapiens
caataaagcttgtt

SEQ ID NO: 5854944 - DNA, 17 bp, Homo sapiens
caataaagcttgttgac

SEQ ID NO: 5854945 - DNA, 14 bp, Homo sapiens
caataaagcttttg

SEQ ID NO: 5854946 - DNA, 17 bp, Homo sapiens
caataaagcttttggaa

SEQ ID NO: 5854947 - DNA, 14 bp, Homo sapiens
caataaaggaggaa

SEQ ID NO: 5854948 - DNA, 13 bp, Homo sapiens
caataaaggcagc

SEQ ID NO: 5854949 - DNA, 22 bp, Homo sapiens
caataaaggcagctgcctctgc

SEQ ID NO: 5854950 - DNA, 23 bp, Homo sapiens
caataaaggcagctgcctctgct

SEQ ID NO: 5854951 - DNA, 23 bp, Homo sapiens
caataaaggtcccttagccccga

SEQ ID NO: 5854952 - DNA, 22 bp, Homo sapiens
caataaagtactgcaaaatgct

SEQ ID NO: 5854953 - DNA, 16 bp, Homo sapiens
caataaagtataatgt

SEQ ID NO: 5854954 - DNA, 20 bp, Homo sapiens
caataaagtataatgtttat

SEQ ID NO: 5854955 - DNA, 12 bp, Homo sapiens
caataaagtatc

SEQ ID NO: 5854956 - DNA, 17 bp, Homo sapiens
caataaagtatttaatt

SEQ ID NO: 5854957 - DNA, 16 bp, Homo sapiens
caataaagtgccttct

SEQ ID NO: 5854958 - DNA, 19 bp, Homo sapiens
caataaagtgccttctggg

SEQ ID NO: 5854959 - DNA, 10 bp, Homo sapiens
caataaagtt

SEQ ID NO: 5854960 - DNA, 17 bp, Homo sapiens
caataaagttattcaga

SEQ ID NO: 5854961 - DNA, 17 bp, Homo sapiens
caataaagttgttgcat

SEQ ID NO: 5854962 - DNA, 14 bp, Homo sapiens
caataaagtttaca

SEQ ID NO: 5854963 - DNA, 14 bp, Homo sapiens
caataaagtttgat

SEQ ID NO: 5854964 - DNA, 23 bp, Homo sapiens
caatcatgcctacattagtgaga

SEQ ID NO: 5854965 - DNA, 20 bp, Homo sapiens
caatcatgggaattttaact

SEQ ID NO: 5854966 - DNA, 13 bp, Homo sapiens
caatcatgtcagt

SEQ ID NO: 5854967 - DNA, 22 bp, Homo sapiens
caatcattgaagtatattctta

SEQ ID NO: 5854968 - DNA, 16 bp, Homo sapiens
caatcattgctgaaaa

SEQ ID NO: 5854969 - DNA, 13 bp, Homo sapiens
caatcattgtaca

SEQ ID NO: 5854970 - DNA, 20 bp, Homo sapiens
caatcattgtacagtttgtt

SEQ ID NO: 5854971 - DNA, 22 bp, Homo sapiens
caatcattgtacagtttgttta

SEQ ID NO: 5854972 - DNA, 23 bp, Homo sapiens
caatcattgtacagtttgtttac

SEQ ID NO: 5854973 - DNA, 17 bp, Homo sapiens
caatcattgtcagagat

SEQ ID NO: 5854974 - DNA, 12 bp, Homo sapiens
caatcattgttt

SEQ ID NO: 5854975 - DNA, 12 bp, Homo sapiens
caatcatttctc

SEQ ID NO: 5854976 - DNA, 14 bp, Homo sapiens
caatcatttctcac

SEQ ID NO: 5854977 - DNA, 13 bp, Homo sapiens
caatcattttata

SEQ ID NO: 5854978 - DNA, 23 bp, Homo sapiens
caatcattttctagccctctccc

SEQ ID NO: 5854979 - DNA, 19 bp, Homo sapiens
caatccaaattccctctgg

SEQ ID NO: 5854980 - DNA, 15 bp, Homo sapiens
caatccaacccatgc

SEQ ID NO: 5854981 - DNA, 16 bp, Homo sapiens
caatccacagtattgt

SEQ ID NO: 5854982 - DNA, 18 bp, Homo sapiens
caatccacctgccttggc

SEQ ID NO: 5854983 - DNA, 15 bp, Homo sapiens
caatccactctcagg

SEQ ID NO: 5854984 - DNA, 13 bp, Homo sapiens
caatccagagagc

SEQ ID NO: 5854985 - DNA, 14 bp, Homo sapiens
caatccagccttct

SEQ ID NO: 5854986 - DNA, 16 bp, Homo sapiens
caatccaggagccttg

SEQ ID NO: 5854987 - DNA, 21 bp, Homo sapiens
caatccaggccaaagccccat

SEQ ID NO: 5854988 - DNA, 19 bp, Homo sapiens
caatccaggctgttctcag

SEQ ID NO: 5854989 - DNA, 21 bp, Homo sapiens
caatccaggctgttctcagcg

SEQ ID NO: 5854990 - DNA, 16 bp, Homo sapiens
caatccaggtacgcac

SEQ ID NO: 5854991 - DNA, 19 bp, Homo sapiens
caatccaggtacgcacaga

SEQ ID NO: 5854992 - DNA, 14 bp, Homo sapiens
caatccaggtggga

SEQ ID NO: 5854993 - DNA, 17 bp, Homo sapiens
caatccatgctctcttt

SEQ ID NO: 5854994 - DNA, 15 bp, Homo sapiens
caatccatgcttcac

SEQ ID NO: 5854995 - DNA, 15 bp, Homo sapiens
caatccatgtaaggt

SEQ ID NO: 5854996 - DNA, 17 bp, Homo sapiens
caatccatgtaaggtat

SEQ ID NO: 5854997 - DNA, 23 bp, Homo sapiens
caatccattttttaggtgcttta

SEQ ID NO: 5854998 - DNA, 18 bp, Homo sapiens
caatcccaaaagtcacca

SEQ ID NO: 5854999 - DNA, 17 bp, Homo sapiens
caatcccaattctgtcc

SEQ ID NO: 5855000 - DNA, 14 bp, Homo sapiens
caatcccaccaaat

SEQ ID NO: 5855001 - DNA, 23 bp, Homo sapiens
caatcccaccaaccctcagagcc

SEQ ID NO: 5855002 - DNA, 19 bp, Homo sapiens
caatcccacttagcaggga

SEQ ID NO: 5855003 - DNA, 15 bp, Homo sapiens
caatcccagggctgg

SEQ ID NO: 5855004 - DNA, 22 bp, Homo sapiens
caatcccagggctggctctgca

SEQ ID NO: 5855005 - DNA, 12 bp, Homo sapiens
caatccccactc

SEQ ID NO: 5855006 - DNA, 13 bp, Homo sapiens
caatccccactcc

SEQ ID NO: 5855007 - DNA, 18 bp, Homo sapiens
caatccccagcctaggac

SEQ ID NO: 5855008 - DNA, 22 bp, Homo sapiens
caatcccctcattcaggaaaac

SEQ ID NO: 5855009 - DNA, 12 bp, Homo sapiens
caatcccctcct

SEQ ID NO: 5855010 - DNA, 18 bp, Homo sapiens
caatcccgtgaaagaatt

SEQ ID NO: 5855011 - DNA, 11 bp, Homo sapiens
caatccctctc

SEQ ID NO: 5855012 - DNA, 22 bp, Homo sapiens
caatccctctccactcttctct

SEQ ID NO: 5855013 - DNA, 24 bp, Homo sapiens
caatccctctccactcttctctcc

SEQ ID NO: 5855014 - DNA, 16 bp, Homo sapiens
caatccctgatccctg

SEQ ID NO: 5855015 - DNA, 17 bp, Homo sapiens
caatcctaacacattat

SEQ ID NO: 5855016 - DNA, 22 bp, Homo sapiens
caatcctaacacattatcggga

SEQ ID NO: 5855017 - DNA, 20 bp, Homo sapiens
caatcctactaataaaccag

SEQ ID NO: 5855018 - DNA, 18 bp, Homo sapiens
caatcctagaaccaagct

SEQ ID NO: 5855019 - DNA, 16 bp, Homo sapiens
caatcctaggacagcc

SEQ ID NO: 5855020 - DNA, 15 bp, Homo sapiens
caatcctagtgcttt

SEQ ID NO: 5855021 - DNA, 18 bp, Homo sapiens
caatcctatgcatggttt

SEQ ID NO: 5855022 - DNA, 15 bp, Homo sapiens
caatcctattactct

SEQ ID NO: 5855023 - DNA, 20 bp, Homo sapiens
caatcctcacctaacagtta

SEQ ID NO: 5855024 - DNA, 14 bp, Homo sapiens
caatcctcactggg

SEQ ID NO: 5855025 - DNA, 16 bp, Homo sapiens
caatcctcactgggtg

SEQ ID NO: 5855026 - DNA, 18 bp, Homo sapiens
caatcctcccacttcagc

SEQ ID NO: 5855027 - DNA, 20 bp, Homo sapiens
caatcctccccaccagtctc

SEQ ID NO: 5855028 - DNA, 13 bp, Homo sapiens
caatcctccctgg

SEQ ID NO: 5855029 - DNA, 13 bp, Homo sapiens
caatcctcctgag

SEQ ID NO: 5855030 - DNA, 15 bp, Homo sapiens
caatcctcctgcctc

SEQ ID NO: 5855031 - DNA, 24 bp, Homo sapiens
caatcctcctgcctcagcctcctg

SEQ ID NO: 5855032 - DNA, 13 bp, Homo sapiens
caatcctctctcc

SEQ ID NO: 5855033 - DNA, 21 bp, Homo sapiens
caatcctgattcctctctaag

SEQ ID NO: 5855034 - DNA, 12 bp, Homo sapiens
caatcctgcccc

SEQ ID NO: 5855035 - DNA, 20 bp, Homo sapiens
caatcctgggcaatcagaca

SEQ ID NO: 5855036 - DNA, 15 bp, Homo sapiens
caatcctgtcaatgt

SEQ ID NO: 5855037 - DNA, 22 bp, Homo sapiens
caatcctgtgtggtttagtgta

SEQ ID NO: 5855038 - DNA, 21 bp, Homo sapiens
caatcctgttaagagataatt

SEQ ID NO: 5855039 - DNA, 22 bp, Homo sapiens
caatcctgtttataatctgaag

SEQ ID NO: 5855040 - DNA, 14 bp, Homo sapiens
caatccttaaatat

SEQ ID NO: 5855041 - DNA, 11 bp, Homo sapiens
caatccttaca

SEQ ID NO: 5855042 - DNA, 14 bp, Homo sapiens
caatccttacaaat

SEQ ID NO: 5855043 - DNA, 22 bp, Homo sapiens
caatccttccctgctcttgcag

SEQ ID NO: 5855044 - DNA, 23 bp, Homo sapiens
caatcgacatcctagccccaccc

SEQ ID NO: 5855045 - DNA, 21 bp, Homo sapiens
caatcgagatttgggagctga

SEQ ID NO: 5855046 - DNA, 15 bp, Homo sapiens
caatcgcaaatcaaa

SEQ ID NO: 5855047 - DNA, 16 bp, Homo sapiens
caatcgcatcccggct

SEQ ID NO: 5855048 - DNA, 16 bp, Homo sapiens
caatcggactgccaaa

SEQ ID NO: 5855049 - DNA, 15 bp, Homo sapiens
caatcgggagtagca

SEQ ID NO: 5855050 - DNA, 16 bp, Homo sapiens
caatcgggagtagcaa

SEQ ID NO: 5855051 - DNA, 16 bp, Homo sapiens
caatcgggtccagaga

SEQ ID NO: 5855052 - DNA, 23 bp, Homo sapiens
caatcggtgtgtagtgatgtttc

SEQ ID NO: 5855053 - DNA, 23 bp, Homo sapiens
caatcgtcttaagttttttatgc

SEQ ID NO: 5855054 - DNA, 14 bp, Homo sapiens
caatcgttctgtgt

SEQ ID NO: 5855055 - DNA, 10 bp, Homo sapiens
caatctaaaa

SEQ ID NO: 5855056 - DNA, 14 bp, Homo sapiens
caatctaacaataa

SEQ ID NO: 5855057 - DNA, 21 bp, Homo sapiens
caatctaacaataatatttca

SEQ ID NO: 5855058 - DNA, 22 bp, Homo sapiens
caatctagaggcaagcctggcc

SEQ ID NO: 5855059 - DNA, 20 bp, Homo sapiens
caatctagtaatgtctaagt

SEQ ID NO: 5855060 - DNA, 20 bp, Homo sapiens
caatctatggcttatttcta

SEQ ID NO: 5855061 - DNA, 23 bp, Homo sapiens
caatctattatttctctaattat

SEQ ID NO: 5855062 - DNA, 19 bp, Homo sapiens
caatctattgcttcaccat

SEQ ID NO: 5855063 - DNA, 19 bp, Homo sapiens
caatctatttattggacat

SEQ ID NO: 5855064 - DNA, 21 bp, Homo sapiens
caatctcaaattctcaaccta

SEQ ID NO: 5855065 - DNA, 17 bp, Homo sapiens
caatctcaatacagcct

SEQ ID NO: 5855066 - DNA, 16 bp, Homo sapiens
caatctcacacagctg

SEQ ID NO: 5855067 - DNA, 19 bp, Homo sapiens
caatctcacaccttagcta

SEQ ID NO: 5855068 - DNA, 16 bp, Homo sapiens
caatctcagctcactg

SEQ ID NO: 5855069 - DNA, 21 bp, Homo sapiens
caatctccatgtgtacttatt

SEQ ID NO: 5855070 - DNA, 22 bp, Homo sapiens
caatctccatgtgtacttatta

SEQ ID NO: 5855071 - DNA, 18 bp, Homo sapiens
caatctcggctcactgca

SEQ ID NO: 5855072 - DNA, 19 bp, Homo sapiens
caatctcgtcaggctgcca

SEQ ID NO: 5855073 - DNA, 19 bp, Homo sapiens
caatctcgtttagtgccaa

SEQ ID NO: 5855074 - DNA, 11 bp, Homo sapiens
caatctctctc

SEQ ID NO: 5855075 - DNA, 15 bp, Homo sapiens
caatctctggtgcct

SEQ ID NO: 5855076 - DNA, 15 bp, Homo sapiens
caatctctgtgactc

SEQ ID NO: 5855077 - DNA, 11 bp, Homo sapiens
caatctctgtt

SEQ ID NO: 5855078 - DNA, 18 bp, Homo sapiens
caatctcttaaattgggt

SEQ ID NO: 5855079 - DNA, 21 bp, Homo sapiens
caatctcttgctgttaaatca

SEQ ID NO: 5855080 - DNA, 18 bp, Homo sapiens
caatctgaaattcaaaat

SEQ ID NO: 5855081 - DNA, 22 bp, Homo sapiens
caatctgaaattcaaaatgctc

SEQ ID NO: 5855082 - DNA, 17 bp, Homo sapiens
caatctgcacactccag

SEQ ID NO: 5855083 - DNA, 21 bp, Homo sapiens
caatctgcacactccaggcct

SEQ ID NO: 5855084 - DNA, 17 bp, Homo sapiens
caatctgcattttaaca

SEQ ID NO: 5855085 - DNA, 13 bp, Homo sapiens
caatctgcctgta

SEQ ID NO: 5855086 - DNA, 12 bp, Homo sapiens
caatctggaaaa

SEQ ID NO: 5855087 - DNA, 13 bp, Homo sapiens
caatctggaagaa

SEQ ID NO: 5855088 - DNA, 21 bp, Homo sapiens
caatctggaagaaagccctgt

SEQ ID NO: 5855089 - DNA, 16 bp, Homo sapiens
caatctggattcatat

SEQ ID NO: 5855090 - DNA, 21 bp, Homo sapiens
caatctggcccttacacactc

SEQ ID NO: 5855091 - DNA, 13 bp, Homo sapiens
caatctggctcac

SEQ ID NO: 5855092 - DNA, 21 bp, Homo sapiens
caatctggctcctcctggaaa

SEQ ID NO: 5855093 - DNA, 13 bp, Homo sapiens
caatctggcttct

SEQ ID NO: 5855094 - DNA, 21 bp, Homo sapiens
caatctgggcactttggccaa

SEQ ID NO: 5855095 - DNA, 19 bp, Homo sapiens
caatctggggaaataataa

SEQ ID NO: 5855096 - DNA, 23 bp, Homo sapiens
caatctgggtggtaactgccagc

SEQ ID NO: 5855097 - DNA, 16 bp, Homo sapiens
caatctgtaaattttt

SEQ ID NO: 5855098 - DNA, 14 bp, Homo sapiens
caatctgtaatttc

SEQ ID NO: 5855099 - DNA, 16 bp, Homo sapiens
caatctgtacaaaatg

SEQ ID NO: 5855100 - DNA, 22 bp, Homo sapiens
caatctgtcacataaaagtctg

SEQ ID NO: 5855101 - DNA, 15 bp, Homo sapiens
caatctgtccagaca

SEQ ID NO: 5855102 - DNA, 14 bp, Homo sapiens
caatctgtgagaag

SEQ ID NO: 5855103 - DNA, 15 bp, Homo sapiens
caatctgtgagaagt

SEQ ID NO: 5855104 - DNA, 17 bp, Homo sapiens
caatctgtgagaagttt

SEQ ID NO: 5855105 - DNA, 20 bp, Homo sapiens
caatctgtgtaagaaaacaa

SEQ ID NO: 5855106 - DNA, 21 bp, Homo sapiens
caatctgttctactcttaatg

SEQ ID NO: 5855107 - DNA, 23 bp, Homo sapiens
caatcttaagcagagataaataa

SEQ ID NO: 5855108 - DNA, 19 bp, Homo sapiens
caatcttaccagatgctac

SEQ ID NO: 5855109 - DNA, 17 bp, Homo sapiens
caatcttactttgtaaa

SEQ ID NO: 5855110 - DNA, 12 bp, Homo sapiens
caatcttccaaa

SEQ ID NO: 5855111 - DNA, 21 bp, Homo sapiens
caatcttcggggtgtgatgaa

SEQ ID NO: 5855112 - DNA, 21 bp, Homo sapiens
caatcttctacttttaactaa

SEQ ID NO: 5855113 - DNA, 18 bp, Homo sapiens
caatcttctttttcaggc

SEQ ID NO: 5855114 - DNA, 13 bp, Homo sapiens
caatcttgcatgt

SEQ ID NO: 5855115 - DNA, 17 bp, Homo sapiens
caatcttgcccactggc

SEQ ID NO: 5855116 - DNA, 13 bp, Homo sapiens
caatcttgctgtg

SEQ ID NO: 5855117 - DNA, 18 bp, Homo sapiens
caatcttggagctgcttg

SEQ ID NO: 5855118 - DNA, 19 bp, Homo sapiens
caatcttggagctgcttgg

SEQ ID NO: 5855119 - DNA, 20 bp, Homo sapiens
caatcttggggctgatgaag

SEQ ID NO: 5855120 - DNA, 22 bp, Homo sapiens
caatcttggtttgtcagtttat

SEQ ID NO: 5855121 - DNA, 13 bp, Homo sapiens
caatcttgttact

SEQ ID NO: 5855122 - DNA, 23 bp, Homo sapiens
caatcttgttactgctgattctt

SEQ ID NO: 5855123 - DNA, 14 bp, Homo sapiens
caatcttgtttata

SEQ ID NO: 5855124 - DNA, 15 bp, Homo sapiens
caatcttgtttatag

SEQ ID NO: 5855125 - DNA, 16 bp, Homo sapiens
caatcttgtttatagc

SEQ ID NO: 5855126 - DNA, 23 bp, Homo sapiens
caatctttaacaacctctgagcc

SEQ ID NO: 5855127 - DNA, 18 bp, Homo sapiens
caatctttagaaaaggca

SEQ ID NO: 5855128 - DNA, 16 bp, Homo sapiens
caatctttattatgca

SEQ ID NO: 5855129 - DNA, 16 bp, Homo sapiens
caatctttgaaagact

SEQ ID NO: 5855130 - DNA, 12 bp, Homo sapiens
caatctttgctg

SEQ ID NO: 5855131 - DNA, 16 bp, Homo sapiens
caatcttttttactct

SEQ ID NO: 5855132 - DNA, 15 bp, Homo sapiens
caatgaaaaaatgta

SEQ ID NO: 5855133 - DNA, 16 bp, Homo sapiens
caatgaaaacaaaatt

SEQ ID NO: 5855134 - DNA, 20 bp, Homo sapiens
caatgaaaacaaaattccat

SEQ ID NO: 5855135 - DNA, 14 bp, Homo sapiens
caatgaaaacatgt

SEQ ID NO: 5855136 - DNA, 19 bp, Homo sapiens
caatgaaaaggtgattgtc

SEQ ID NO: 5855137 - DNA, 12 bp, Homo sapiens
caatgaaaattt

SEQ ID NO: 5855138 - DNA, 15 bp, Homo sapiens
caatgaaaattttaa

SEQ ID NO: 5855139 - DNA, 15 bp, Homo sapiens
caatgaaacagatga

SEQ ID NO: 5855140 - DNA, 20 bp, Homo sapiens
caatgaaacagatgataaat

SEQ ID NO: 5855141 - DNA, 23 bp, Homo sapiens
caatgaaaccttcctcttgaggg

SEQ ID NO: 5855142 - DNA, 22 bp, Homo sapiens
caatgtgtctttctaagaaatc

SEQ ID NO: 5855143 - DNA, 15 bp, Homo sapiens
caatgtgtgtatatg

SEQ ID NO: 5855144 - DNA, 16 bp, Homo sapiens
caatgtgtttaatttt

SEQ ID NO: 5855145 - DNA, 17 bp, Homo sapiens
caatgtgtttaattttg

SEQ ID NO: 5855146 - DNA, 22 bp, Homo sapiens
caatgtgtttctggtatgaaac

SEQ ID NO: 5855147 - DNA, 16 bp, Homo sapiens
caatgtgttttctgta

SEQ ID NO: 5855148 - DNA, 16 bp, Homo sapiens
caatgtgtttttctcc

SEQ ID NO: 5855149 - DNA, 14 bp, Homo sapiens
caatgttaaatcta

SEQ ID NO: 5855150 - DNA, 21 bp, Homo sapiens
caatgttaaatctacaaactt

SEQ ID NO: 5855151 - DNA, 15 bp, Homo sapiens
caatgttaaattaat

SEQ ID NO: 5855152 - DNA, 14 bp, Homo sapiens
caatgttaacattt

SEQ ID NO: 5855153 - DNA, 14 bp, Homo sapiens
caatgttaaggaaa

SEQ ID NO: 5855154 - DNA, 19 bp, Homo sapiens
caatgttaaggaaactctt

SEQ ID NO: 5855155 - DNA, 17 bp, Homo sapiens
caatgttaatcagcccc

SEQ ID NO: 5855156 - DNA, 22 bp, Homo sapiens
caatgttagcctcaatttctga

SEQ ID NO: 5855157 - DNA, 18 bp, Homo sapiens
caatgttatgccagctcc

SEQ ID NO: 5855158 - DNA, 19 bp, Homo sapiens
caatgttatgccagctcca

SEQ ID NO: 5855159 - DNA, 12 bp, Homo sapiens
caatgttccatt

SEQ ID NO: 5855160 - DNA, 22 bp, Homo sapiens
caatgttctttatatacaataa

SEQ ID NO: 5855161 - DNA, 18 bp, Homo sapiens
caatgttctttgtctcaa

SEQ ID NO: 5855162 - DNA, 23 bp, Homo sapiens
caatgttgagaagttcccattat

SEQ ID NO: 5855163 - DNA, 19 bp, Homo sapiens
caatgttgcactgaaaacc

SEQ ID NO: 5855164 - DNA, 20 bp, Homo sapiens
caatgttggagcagcaggcc

SEQ ID NO: 5855165 - DNA, 23 bp, Homo sapiens
caatgttggcctgtcagagcttg

SEQ ID NO: 5855166 - DNA, 18 bp, Homo sapiens
caatgttggttactaaat

SEQ ID NO: 5855167 - DNA, 15 bp, Homo sapiens
caatgttgtccaaca

SEQ ID NO: 5855168 - DNA, 18 bp, Homo sapiens
caatgttgtccaacaata

SEQ ID NO: 5855169 - DNA, 19 bp, Homo sapiens
caatgttgtccaacaataa

SEQ ID NO: 5855170 - DNA, 18 bp, Homo sapiens
caatgttgtgtgttgcac

SEQ ID NO: 5855171 - DNA, 16 bp, Homo sapiens
caatgtttaaaaaagt

SEQ ID NO: 5855172 - DNA, 21 bp, Homo sapiens
caatgtttaaaaaagtttaaa

SEQ ID NO: 5855173 - DNA, 22 bp, Homo sapiens
caatgtttagcagatttaagat

SEQ ID NO: 5855174 - DNA, 11 bp, Homo sapiens
caatgtttctg

SEQ ID NO: 5855175 - DNA, 16 bp, Homo sapiens
caatgtttctggacat

SEQ ID NO: 5855176 - DNA, 21 bp, Homo sapiens
caatgtttctggacattctct

SEQ ID NO: 5855177 - DNA, 15 bp, Homo sapiens
caatgtttcttcatt

SEQ ID NO: 5855178 - DNA, 22 bp, Homo sapiens
caatgtttcttcatttctctgc

SEQ ID NO: 5855179 - DNA, 16 bp, Homo sapiens
caatgtttcttttatc

SEQ ID NO: 5855180 - DNA, 16 bp, Homo sapiens
caatgtttgggggaaa

SEQ ID NO: 5855181 - DNA, 23 bp, Homo sapiens
caatgtttgggggaaaaaaaaga

SEQ ID NO: 5855182 - DNA, 20 bp, Homo sapiens
caattaaaaacgaaaacctg

SEQ ID NO: 5855183 - DNA, 12 bp, Homo sapiens
caattaaaaata

SEQ ID NO: 5855184 - DNA, 11 bp, Homo sapiens
caattaaaata

SEQ ID NO: 5855185 - DNA, 18 bp, Homo sapiens
caattaaaatactatgca

SEQ ID NO: 5855186 - DNA, 19 bp, Homo sapiens
caattaaaatatatataaa

SEQ ID NO: 5855187 - DNA, 20 bp, Homo sapiens
caattaaaatatatataaat

SEQ ID NO: 5855188 - DNA, 21 bp, Homo sapiens
caattaaaatatatataaata

SEQ ID NO: 5855189 - DNA, 22 bp, Homo sapiens
caattaaaatatatataaatat

SEQ ID NO: 5855190 - DNA, 14 bp, Homo sapiens
caattaaacagctg

SEQ ID NO: 5855191 - DNA, 14 bp, Homo sapiens
caattaaacggatt

SEQ ID NO: 5855192 - DNA, 13 bp, Homo sapiens
caattaaagaaat

SEQ ID NO: 5855193 - DNA, 17 bp, Homo sapiens
caattaaaggtcctgcc

SEQ ID NO: 5855194 - DNA, 12 bp, Homo sapiens
caattaaatgta

SEQ ID NO: 5855195 - DNA, 14 bp, Homo sapiens
caattaaatgtagg

SEQ ID NO: 5855196 - DNA, 22 bp, Homo sapiens
caattaaatgtaggtatgaata

SEQ ID NO: 5855197 - DNA, 13 bp, Homo sapiens
caattaaatttat

SEQ ID NO: 5855198 - DNA, 17 bp, Homo sapiens
caattaaatttatttta

SEQ ID NO: 5855199 - DNA, 13 bp, Homo sapiens
caattaacataca

SEQ ID NO: 5855200 - DNA, 16 bp, Homo sapiens
caattaagaaattcca

SEQ ID NO: 5855201 - DNA, 21 bp, Homo sapiens
caattaagtgttgaaaaatat

SEQ ID NO: 5855202 - DNA, 22 bp, Homo sapiens
caattaagttacaattacatct

SEQ ID NO: 5855203 - DNA, 21 bp, Homo sapiens
caattaagttattaacatttg

SEQ ID NO: 5855204 - DNA, 15 bp, Homo sapiens
caattaataaaaaat

SEQ ID NO: 5855205 - DNA, 20 bp, Homo sapiens
caattaatattaattttcta

SEQ ID NO: 5855206 - DNA, 15 bp, Homo sapiens
caattaattaaaagt

SEQ ID NO: 5855207 - DNA, 19 bp, Homo sapiens
caattaattatcttttcaa

SEQ ID NO: 5855208 - DNA, 17 bp, Homo sapiens
caattaattcatccctt

SEQ ID NO: 5855209 - DNA, 19 bp, Homo sapiens
caattaattgctattgtgt

SEQ ID NO: 5855210 - DNA, 18 bp, Homo sapiens
caattaattgtcttgcac

SEQ ID NO: 5855211 - DNA, 12 bp, Homo sapiens
caattaattttt

SEQ ID NO: 5855212 - DNA, 19 bp, Homo sapiens
caattaatttttttattgt

SEQ ID NO: 5855213 - DNA, 15 bp, Homo sapiens
caattacagcaaaaa

SEQ ID NO: 5855214 - DNA, 22 bp, Homo sapiens
caattacatctctaattttgga

SEQ ID NO: 5855215 - DNA, 17 bp, Homo sapiens
caattactactttgtta

SEQ ID NO: 5855216 - DNA, 12 bp, Homo sapiens
caattactgtga

SEQ ID NO: 5855217 - DNA, 13 bp, Homo sapiens
caattactgtgag

SEQ ID NO: 5855218 - DNA, 15 bp, Homo sapiens
caattactgtgagaa

SEQ ID NO: 5855219 - DNA, 18 bp, Homo sapiens
caattactgtgagaactg

SEQ ID NO: 5855220 - DNA, 19 bp, Homo sapiens
caattactgtgagaactgt

SEQ ID NO: 5855221 - DNA, 13 bp, Homo sapiens
caattagacttga

SEQ ID NO: 5855222 - DNA, 14 bp, Homo sapiens
caattagacttgaa

SEQ ID NO: 5855223 - DNA, 15 bp, Homo sapiens
caattagacttgaaa

SEQ ID NO: 5855224 - DNA, 20 bp, Homo sapiens
caattagagaagccttttcc

SEQ ID NO: 5855225 - DNA, 22 bp, Homo sapiens
caattagatttaaaataaacat

SEQ ID NO: 5855226 - DNA, 15 bp, Homo sapiens
caattagatttctca

SEQ ID NO: 5855227 - DNA, 12 bp, Homo sapiens
caattagcagaa

SEQ ID NO: 5855228 - DNA, 15 bp, Homo sapiens
caattagcagaatgg

SEQ ID NO: 5855229 - DNA, 23 bp, Homo sapiens
caattagcagaatggagaaagta

SEQ ID NO: 5855230 - DNA, 15 bp, Homo sapiens
caattagcattctgt

SEQ ID NO: 5855231 - DNA, 16 bp, Homo sapiens
caattagcttatgtta

SEQ ID NO: 5855232 - DNA, 15 bp, Homo sapiens
caattaggaagtgta

SEQ ID NO: 5855233 - DNA, 16 bp, Homo sapiens
caattagggcctagcc

SEQ ID NO: 5855234 - DNA, 17 bp, Homo sapiens
caattaggtctgcattt

SEQ ID NO: 5855235 - DNA, 14 bp, Homo sapiens
caattagtacagta

SEQ ID NO: 5855236 - DNA, 15 bp, Homo sapiens
caattagtacagtag

SEQ ID NO: 5855237 - DNA, 21 bp, Homo sapiens
caattagtctgaaactggctt

SEQ ID NO: 5855238 - DNA, 20 bp, Homo sapiens
caattagtgatatagtgctg

SEQ ID NO: 5855239 - DNA, 19 bp, Homo sapiens
caattagtggtcataaaat

SEQ ID NO: 5855240 - DNA, 23 bp, Homo sapiens
caattagttcccctactacactt

SEQ ID NO: 5855241 - DNA, 15 bp, Homo sapiens
caattatagtttctg

SEQ ID NO: 5855242 - DNA, 17 bp, Homo sapiens
caattatagtttgacag

SEQ ID NO: 5855243 - DNA, 23 bp, Homo sapiens
caattatatcagtcctctttcaa

SEQ ID NO: 5855244 - DNA, 17 bp, Homo sapiens
caattatatctattatg

SEQ ID NO: 5855245 - DNA, 16 bp, Homo sapiens
caattatatctccccc

SEQ ID NO: 5855246 - DNA, 23 bp, Homo sapiens
caattatatctcccccactccac

SEQ ID NO: 5855247 - DNA, 12 bp, Homo sapiens
caattatattgt

SEQ ID NO: 5855248 - DNA, 11 bp, Homo sapiens
caattatgaaa

SEQ ID NO: 5855249 - DNA, 15 bp, Homo sapiens
caattatgaaaataa

SEQ ID NO: 5855250 - DNA, 16 bp, Homo sapiens
caattatgtctcttga

SEQ ID NO: 5855251 - DNA, 17 bp, Homo sapiens
caattatgtctcttgag

SEQ ID NO: 5855252 - DNA, 15 bp, Homo sapiens
caattatgtgacaac

SEQ ID NO: 5855253 - DNA, 20 bp, Homo sapiens
caattatgtgacaacctttg

SEQ ID NO: 5855254 - DNA, 21 bp, Homo sapiens
caattatgtgacaacctttgt

SEQ ID NO: 5855255 - DNA, 15 bp, Homo sapiens
caattattaaattgt

SEQ ID NO: 5855256 - DNA, 20 bp, Homo sapiens
caattattacagtccttcaa

SEQ ID NO: 5855257 - DNA, 18 bp, Homo sapiens
caattattgatatatatt

SEQ ID NO: 5855258 - DNA, 22 bp, Homo sapiens
caattattgatatatattataa

SEQ ID NO: 5855259 - DNA, 14 bp, Homo sapiens
caattattgtatat

SEQ ID NO: 5855260 - DNA, 20 bp, Homo sapiens
caattatttaaagaaagtga

SEQ ID NO: 5855261 - DNA, 21 bp, Homo sapiens
caattatttgaagatttaatt

SEQ ID NO: 5855262 - DNA, 22 bp, Homo sapiens
caattatttgaagatttaatta

SEQ ID NO: 5855263 - DNA, 13 bp, Homo sapiens
caattatttttac

SEQ ID NO: 5855264 - DNA, 16 bp, Homo sapiens
caattcaaaaatgtac

SEQ ID NO: 5855265 - DNA, 13 bp, Homo sapiens
caattcaaaagct

SEQ ID NO: 5855266 - DNA, 19 bp, Homo sapiens
caattcaaaagctctcttt

SEQ ID NO: 5855267 - DNA, 22 bp, Homo sapiens
caattcaacacattacttgcac

SEQ ID NO: 5855268 - DNA, 19 bp, Homo sapiens
caattcaactttttatttt

SEQ ID NO: 5855269 - DNA, 13 bp, Homo sapiens
caattcaatcaaa

SEQ ID NO: 5855270 - DNA, 16 bp, Homo sapiens
caattcaatcaaagct

SEQ ID NO: 5855271 - DNA, 13 bp, Homo sapiens
caattcaatgcaa

SEQ ID NO: 5855272 - DNA, 14 bp, Homo sapiens
caattcaatgcaat

SEQ ID NO: 5855273 - DNA, 15 bp, Homo sapiens
caattcaatgcaatg

SEQ ID NO: 5855274 - DNA, 21 bp, Homo sapiens
caattcacagcctttctgaac

SEQ ID NO: 5855275 - DNA, 18 bp, Homo sapiens
caattcacccagaaaaaa

SEQ ID NO: 5855276 - DNA, 15 bp, Homo sapiens
caattcactttagag

SEQ ID NO: 5855277 - DNA, 13 bp, Homo sapiens
caattcagacagg

SEQ ID NO: 5855278 - DNA, 14 bp, Homo sapiens
caattcagacccct

SEQ ID NO: 5855279 - DNA, 13 bp, Homo sapiens
caattcaggactg

SEQ ID NO: 5855280 - DNA, 17 bp, Homo sapiens
caattcaggactggctc

SEQ ID NO: 5855281 - DNA, 18 bp, Homo sapiens
caattcaggactggctca

SEQ ID NO: 5855282 - DNA, 16 bp, Homo sapiens
caattcagtctgctct

SEQ ID NO: 5855283 - DNA, 13 bp, Homo sapiens
caattcataatat

SEQ ID NO: 5855284 - DNA, 18 bp, Homo sapiens
caattcatcctcactcag

SEQ ID NO: 5855285 - DNA, 14 bp, Homo sapiens
caattcatgaactt

SEQ ID NO: 5855286 - DNA, 14 bp, Homo sapiens
caattcatgaagtg

SEQ ID NO: 5855287 - DNA, 18 bp, Homo sapiens
caattcatgtagtttctg

SEQ ID NO: 5855288 - DNA, 18 bp, Homo sapiens
caattcattaataaaata

SEQ ID NO: 5855289 - DNA, 22 bp, Homo sapiens
caattcattgttaaaaaacaac

SEQ ID NO: 5855290 - DNA, 19 bp, Homo sapiens
caattcatttcactttaaa

SEQ ID NO: 5855291 - DNA, 16 bp, Homo sapiens
caattccaaaattcca

SEQ ID NO: 5855292 - DNA, 15 bp, Homo sapiens
caattccaagaaaat

SEQ ID NO: 5855293 - DNA, 17 bp, Homo sapiens
caattccaagaaaatat

SEQ ID NO: 5855294 - DNA, 17 bp, Homo sapiens
caattccacagtctctg

SEQ ID NO: 5855295 - DNA, 17 bp, Homo sapiens
caattccaccagggcca

SEQ ID NO: 5855296 - DNA, 18 bp, Homo sapiens
caattccacccctcctcg

SEQ ID NO: 5855297 - DNA, 13 bp, Homo sapiens
caattccactctg

SEQ ID NO: 5855298 - DNA, 21 bp, Homo sapiens
caattccactctgatagaatt

SEQ ID NO: 5855299 - DNA, 23 bp, Homo sapiens
caattccacttcctgccccaact

SEQ ID NO: 5855300 - DNA, 18 bp, Homo sapiens
caattccagagctgtctg

SEQ ID NO: 5855301 - DNA, 12 bp, Homo sapiens
caattccaggct

SEQ ID NO: 5855302 - DNA, 23 bp, Homo sapiens
caattccaggctgagccatgagg

SEQ ID NO: 5855303 - DNA, 19 bp, Homo sapiens
caattccagggaaccagag

SEQ ID NO: 5855304 - DNA, 14 bp, Homo sapiens
caattccatcaccc

SEQ ID NO: 5855305 - DNA, 18 bp, Homo sapiens
caattccatgctataaaa

SEQ ID NO: 5855306 - DNA, 16 bp, Homo sapiens
caattccatttctttc

SEQ ID NO: 5855307 - DNA, 18 bp, Homo sapiens
caattcccccatccttca

SEQ ID NO: 5855308 - DNA, 15 bp, Homo sapiens
caattccctgctgtc

SEQ ID NO: 5855309 - DNA, 13 bp, Homo sapiens
caattcctctggg

SEQ ID NO: 5855310 - DNA, 14 bp, Homo sapiens
caattcctcttcat

SEQ ID NO: 5855311 - DNA, 12 bp, Homo sapiens
caattcctgggc

SEQ ID NO: 5855312 - DNA, 16 bp, Homo sapiens
caattcctgggcccca

SEQ ID NO: 5855313 - DNA, 20 bp, Homo sapiens
caattcctgtgctcaaaaat

SEQ ID NO: 5855314 - DNA, 18 bp, Homo sapiens
caattcggggcctgctgg

SEQ ID NO: 5855315 - DNA, 11 bp, Homo sapiens
caattctaaat

SEQ ID NO: 5855316 - DNA, 13 bp, Homo sapiens
caattctaaatcc

SEQ ID NO: 5855317 - DNA, 16 bp, Homo sapiens
caattctaatggtaac

SEQ ID NO: 5855318 - DNA, 17 bp, Homo sapiens
caattctaatggtaact

SEQ ID NO: 5855319 - DNA, 22 bp, Homo sapiens
caattctaatggtaacttttgt

SEQ ID NO: 5855320 - DNA, 13 bp, Homo sapiens
caattctactagt

SEQ ID NO: 5855321 - DNA, 14 bp, Homo sapiens
cacaaggcagcaag

SEQ ID NO: 5855322 - DNA, 16 bp, Homo sapiens
cacaaggcagcaaggc

SEQ ID NO: 5855323 - DNA, 16 bp, Homo sapiens
cacaaggccagaaaaa

SEQ ID NO: 5855324 - DNA, 18 bp, Homo sapiens
cacaaggcccagccctgg

SEQ ID NO: 5855325 - DNA, 21 bp, Homo sapiens
cacaaggcccagccctgggca

SEQ ID NO: 5855326 - DNA, 19 bp, Homo sapiens
cacaaggcctggtctggga

SEQ ID NO: 5855327 - DNA, 16 bp, Homo sapiens
cacaaggctgaaaagt

SEQ ID NO: 5855328 - DNA, 18 bp, Homo sapiens
cacaaggctgaaaagtgc

SEQ ID NO: 5855329 - DNA, 21 bp, Homo sapiens
cacaaggctgaaaagtgcttt

SEQ ID NO: 5855330 - DNA, 14 bp, Homo sapiens
cacaaggctgacca

SEQ ID NO: 5855331 - DNA, 18 bp, Homo sapiens
cacaaggctgaccaagag

SEQ ID NO: 5855332 - DNA, 19 bp, Homo sapiens
cacaaggctgaccaagaga

SEQ ID NO: 5855333 - DNA, 16 bp, Homo sapiens
cacaaggctggccagc

SEQ ID NO: 5855334 - DNA, 17 bp, Homo sapiens
cacaaggctggccagca

SEQ ID NO: 5855335 - DNA, 20 bp, Homo sapiens
cacaaggctggccagcaagg

SEQ ID NO: 5855336 - DNA, 12 bp, Homo sapiens
cacaaggctggg

SEQ ID NO: 5855337 - DNA, 16 bp, Homo sapiens
cacaaggctgttgcat

SEQ ID NO: 5855338 - DNA, 16 bp, Homo sapiens
cacaagggatataaaa

SEQ ID NO: 5855339 - DNA, 16 bp, Homo sapiens
cacaagggcacattgc

SEQ ID NO: 5855340 - DNA, 12 bp, Homo sapiens
cacaagggctct

SEQ ID NO: 5855341 - DNA, 17 bp, Homo sapiens
cacaagggtgcaagccc

SEQ ID NO: 5855342 - DNA, 20 bp, Homo sapiens
cacaaggtataataaggaaa

SEQ ID NO: 5855343 - DNA, 18 bp, Homo sapiens
cacaaggtcatggccaca

SEQ ID NO: 5855344 - DNA, 19 bp, Homo sapiens
cacaaggtcatggccacac

SEQ ID NO: 5855345 - DNA, 22 bp, Homo sapiens
cacaaggtcatggccacactgt

SEQ ID NO: 5855346 - DNA, 23 bp, Homo sapiens
cacaaggtcatggccacactgtg

SEQ ID NO: 5855347 - DNA, 22 bp, Homo sapiens
cacaaggtccactccctgctcc

SEQ ID NO: 5855348 - DNA, 12 bp, Homo sapiens
cacaaggtcccc

SEQ ID NO: 5855349 - DNA, 17 bp, Homo sapiens
cacaaggtgcaaatcaa

SEQ ID NO: 5855350 - DNA, 14 bp, Homo sapiens
cacaaggtgctcag

SEQ ID NO: 5855351 - DNA, 18 bp, Homo sapiens
cacaaggtggcagcaagc

SEQ ID NO: 5855352 - DNA, 13 bp, Homo sapiens
cacaagtaaacat

SEQ ID NO: 5855353 - DNA, 22 bp, Homo sapiens
cacaagtaagagactcagcctg

SEQ ID NO: 5855354 - DNA, 15 bp, Homo sapiens
cacaagtaggagaca

SEQ ID NO: 5855355 - DNA, 18 bp, Homo sapiens
cacaagtatctaaatttg

SEQ ID NO: 5855356 - DNA, 21 bp, Homo sapiens
cacaagtctaaacaatgaatt

SEQ ID NO: 5855357 - DNA, 19 bp, Homo sapiens
cacaagtctcctagacact

SEQ ID NO: 5855358 - DNA, 14 bp, Homo sapiens
cacaagtcttccag

SEQ ID NO: 5855359 - DNA, 14 bp, Homo sapiens
cacaagtgaaaact

SEQ ID NO: 5855360 - DNA, 12 bp, Homo sapiens
cacaagtgagcc

SEQ ID NO: 5855361 - DNA, 21 bp, Homo sapiens
cacaagtgccctccaggcttt

SEQ ID NO: 5855362 - DNA, 19 bp, Homo sapiens
cacaagtgccgcaaattgt

SEQ ID NO: 5855363 - DNA, 21 bp, Homo sapiens
cacaagtgccgcaaattgtac

SEQ ID NO: 5855364 - DNA, 16 bp, Homo sapiens
cacaagtggcagacat

SEQ ID NO: 5855365 - DNA, 22 bp, Homo sapiens
cacaagtgggtacccccaggac

SEQ ID NO: 5855366 - DNA, 14 bp, Homo sapiens
cacaagtggtggta

SEQ ID NO: 5855367 - DNA, 19 bp, Homo sapiens
cacaagttaagattcttgg

SEQ ID NO: 5855368 - DNA, 20 bp, Homo sapiens
cacaagttaagattcttggt

SEQ ID NO: 5855369 - DNA, 19 bp, Homo sapiens
cacaagttccagctggtct

SEQ ID NO: 5855370 - DNA, 22 bp, Homo sapiens
cacaagtttacttgtctttgat

SEQ ID NO: 5855371 - DNA, 22 bp, Homo sapiens
cacaataaagagaaccatgtgc

SEQ ID NO: 5855372 - DNA, 16 bp, Homo sapiens
cacaataaatggccag

SEQ ID NO: 5855373 - DNA, 21 bp, Homo sapiens
cacaataaatggccagtgctg

SEQ ID NO: 5855374 - DNA, 21 bp, Homo sapiens
cacaataaggtcaatgccaga

SEQ ID NO: 5855375 - DNA, 16 bp, Homo sapiens
cacaataatgaataat

SEQ ID NO: 5855376 - DNA, 17 bp, Homo sapiens
cacaatacagtattata

SEQ ID NO: 5855377 - DNA, 22 bp, Homo sapiens
cacaatacctacaataaactgg

SEQ ID NO: 5855378 - DNA, 21 bp, Homo sapiens
cacaataccttatttaagtaa

SEQ ID NO: 5855379 - DNA, 14 bp, Homo sapiens
cacaatagaattat

SEQ ID NO: 5855380 - DNA, 17 bp, Homo sapiens
cacaatagggttcaaat

SEQ ID NO: 5855381 - DNA, 14 bp, Homo sapiens
cacaataggtcttt

SEQ ID NO: 5855382 - DNA, 19 bp, Homo sapiens
cacaataggtctttctctc

SEQ ID NO: 5855383 - DNA, 20 bp, Homo sapiens
cacaatatgagtaatgttta

SEQ ID NO: 5855384 - DNA, 19 bp, Homo sapiens
cacaatattaagtgttgta

SEQ ID NO: 5855385 - DNA, 23 bp, Homo sapiens
cacaatattaagtgttgtacaat

SEQ ID NO: 5855386 - DNA, 21 bp, Homo sapiens
cacaatattcaatcaaaattt

SEQ ID NO: 5855387 - DNA, 22 bp, Homo sapiens
cacaatcaccgatgcaaacatt

SEQ ID NO: 5855388 - DNA, 21 bp, Homo sapiens
cacaatcactaaactttattt

SEQ ID NO: 5855389 - DNA, 23 bp, Homo sapiens
cacaatcactaaatatctagtgc

SEQ ID NO: 5855390 - DNA, 13 bp, Homo sapiens
cacaatcagacca

SEQ ID NO: 5855391 - DNA, 15 bp, Homo sapiens
cacaatcagtttatc

SEQ ID NO: 5855392 - DNA, 24 bp, Homo sapiens
cacaatcatggctcactgcagcct

SEQ ID NO: 5855393 - DNA, 12 bp, Homo sapiens
cacaatcattgg

SEQ ID NO: 5855394 - DNA, 13 bp, Homo sapiens
cacaatcccacct

SEQ ID NO: 5855395 - DNA, 22 bp, Homo sapiens
cacaatcccacctagcccagga

SEQ ID NO: 5855396 - DNA, 21 bp, Homo sapiens
cacaatccctggggctgtgca

SEQ ID NO: 5855397 - DNA, 23 bp, Homo sapiens
cacaatcctaacacattatcggg

SEQ ID NO: 5855398 - DNA, 17 bp, Homo sapiens
cacaatcctattactct

SEQ ID NO: 5855399 - DNA, 21 bp, Homo sapiens
cacaatcctccaagaatttga

SEQ ID NO: 5855400 - DNA, 15 bp, Homo sapiens
cacaatctacactgc

SEQ ID NO: 5855401 - DNA, 22 bp, Homo sapiens
cacaatctcattgaggagcatt

SEQ ID NO: 5855402 - DNA, 15 bp, Homo sapiens
cacaatctcggctca

SEQ ID NO: 5855403 - DNA, 24 bp, Homo sapiens
cacaatctcggctcactgcatcct

SEQ ID NO: 5855404 - DNA, 19 bp, Homo sapiens
cacaatctgacattctcag

SEQ ID NO: 5855405 - DNA, 13 bp, Homo sapiens
cacaatctgagca

SEQ ID NO: 5855406 - DNA, 19 bp, Homo sapiens
cacaatctgtaaattttta

SEQ ID NO: 5855407 - DNA, 21 bp, Homo sapiens
cacaatctgttctactcttaa

SEQ ID NO: 5855408 - DNA, 19 bp, Homo sapiens
cacaatcttaaggggcagc

SEQ ID NO: 5855409 - DNA, 16 bp, Homo sapiens
cacaatcttggggctg

SEQ ID NO: 5855410 - DNA, 18 bp, Homo sapiens
cacaatctttccttgtct

SEQ ID NO: 5855411 - DNA, 19 bp, Homo sapiens
cacaatctttccttgtctc

SEQ ID NO: 5855412 - DNA, 17 bp, Homo sapiens
cacaatgagaaaaataa

SEQ ID NO: 5855413 - DNA, 22 bp, Homo sapiens
cacaatgagaatgatgcacact

SEQ ID NO: 5855414 - DNA, 18 bp, Homo sapiens
cacaatgcagttctgagc

SEQ ID NO: 5855415 - DNA, 19 bp, Homo sapiens
cacaatggaaaacctgggg

SEQ ID NO: 5855416 - DNA, 21 bp, Homo sapiens
cacaatggaaaacctggggga

SEQ ID NO: 5855417 - DNA, 17 bp, Homo sapiens
cacaatggtttcaaaga

SEQ ID NO: 5855418 - DNA, 19 bp, Homo sapiens
cacaatggtttcaaagaaa

SEQ ID NO: 5855419 - DNA, 12 bp, Homo sapiens
cacaatgtgata

SEQ ID NO: 5855420 - DNA, 22 bp, Homo sapiens
cacaatgtgatatgtgtaatat

SEQ ID NO: 5855421 - DNA, 22 bp, Homo sapiens
cacaatgttccttttttgtata

SEQ ID NO: 5855422 - DNA, 16 bp, Homo sapiens
cacaatgttctttata

SEQ ID NO: 5855423 - DNA, 18 bp, Homo sapiens
cacaatgttctttatata

SEQ ID NO: 5855424 - DNA, 20 bp, Homo sapiens
cacaatgttgcactgaaaac

SEQ ID NO: 5855425 - DNA, 16 bp, Homo sapiens
cacaatgttgctagtt

SEQ ID NO: 5855426 - DNA, 15 bp, Homo sapiens
cacaatgttggagca

SEQ ID NO: 5855427 - DNA, 16 bp, Homo sapiens
cacaatgttggagcag

SEQ ID NO: 5855428 - DNA, 21 bp, Homo sapiens
cacaattaaatgacttagaaa

SEQ ID NO: 5855429 - DNA, 16 bp, Homo sapiens
cacaattagatttctc

SEQ ID NO: 5855430 - DNA, 17 bp, Homo sapiens
cacaattagatttctca

SEQ ID NO: 5855431 - DNA, 17 bp, Homo sapiens
cacaattatgctgtgaa

SEQ ID NO: 5855432 - DNA, 18 bp, Homo sapiens
cacaattcattggctcct

SEQ ID NO: 5855433 - DNA, 11 bp, Homo sapiens
cacaattccat

SEQ ID NO: 5855434 - DNA, 23 bp, Homo sapiens
cacaattccatttccagttcatc

SEQ ID NO: 5855435 - DNA, 13 bp, Homo sapiens
cacaattcctgtg

SEQ ID NO: 5855436 - DNA, 18 bp, Homo sapiens
cacaattcctgtgctcaa

SEQ ID NO: 5855437 - DNA, 23 bp, Homo sapiens
cacaattctctgattttgagctc

SEQ ID NO: 5855438 - DNA, 18 bp, Homo sapiens
cacaattctgtccctgtc

SEQ ID NO: 5855439 - DNA, 19 bp, Homo sapiens
cacaattctgtccctgtcc

SEQ ID NO: 5855440 - DNA, 23 bp, Homo sapiens
cacaattctgtccctgtccctgc

SEQ ID NO: 5855441 - DNA, 15 bp, Homo sapiens
cacaattcttttgaa

SEQ ID NO: 5855442 - DNA, 19 bp, Homo sapiens
cacaattgaacttccagga

SEQ ID NO: 5855443 - DNA, 21 bp, Homo sapiens
cacaattgatacttcaggtgc

SEQ ID NO: 5855444 - DNA, 22 bp, Homo sapiens
cacaattgatacttcaggtgct

SEQ ID NO: 5855445 - DNA, 20 bp, Homo sapiens
cacaattgatctctttttat

SEQ ID NO: 5855446 - DNA, 12 bp, Homo sapiens
cacaatttagaa

SEQ ID NO: 5855447 - DNA, 13 bp, Homo sapiens
cacaatttcattt

SEQ ID NO: 5855448 - DNA, 14 bp, Homo sapiens
cacaatttctttaa

SEQ ID NO: 5855449 - DNA, 16 bp, Homo sapiens
cacaatttctttaaaa

SEQ ID NO: 5855450 - DNA, 19 bp, Homo sapiens
cacaatttctttaaaaaag

SEQ ID NO: 5855451 - DNA, 20 bp, Homo sapiens
cacaatttgagactgaaatt

SEQ ID NO: 5855452 - DNA, 19 bp, Homo sapiens
cacaatttgagcaattcat

SEQ ID NO: 5855453 - DNA, 20 bp, Homo sapiens
cacaatttgagcaattcatt

SEQ ID NO: 5855454 - DNA, 22 bp, Homo sapiens
cacaatttgagcaattcatttc

SEQ ID NO: 5855455 - DNA, 10 bp, Homo sapiens
cacacaaaaa

SEQ ID NO: 5855456 - DNA, 16 bp, Homo sapiens
cacacaaaaaccttgg

SEQ ID NO: 5855457 - DNA, 11 bp, Homo sapiens
cacacaaaaag

SEQ ID NO: 5855458 - DNA, 18 bp, Homo sapiens
cacacaaaaaggagcggg

SEQ ID NO: 5855459 - DNA, 21 bp, Homo sapiens
cacacaaaaaggagcgggcag

SEQ ID NO: 5855460 - DNA, 21 bp, Homo sapiens
cacacaaaaataaagactaga

SEQ ID NO: 5855461 - DNA, 13 bp, Homo sapiens
cacacaaaacaac

SEQ ID NO: 5855462 - DNA, 22 bp, Homo sapiens
cacacaaaacatcttaggcact

SEQ ID NO: 5855463 - DNA, 14 bp, Homo sapiens
cacacaaaatgtca

SEQ ID NO: 5855464 - DNA, 20 bp, Homo sapiens
cacacaaaatgtcacacttg

SEQ ID NO: 5855465 - DNA, 18 bp, Homo sapiens
cacacaaacacctcctag

SEQ ID NO: 5855466 - DNA, 15 bp, Homo sapiens
cacacaaaccatttt

SEQ ID NO: 5855467 - DNA, 18 bp, Homo sapiens
cacacaaacctactgccc

SEQ ID NO: 5855468 - DNA, 14 bp, Homo sapiens
cacacaaagagagt

SEQ ID NO: 5855469 - DNA, 17 bp, Homo sapiens
cacacaaagagagttaa

SEQ ID NO: 5855470 - DNA, 12 bp, Homo sapiens
cacacaaagcag

SEQ ID NO: 5855471 - DNA, 16 bp, Homo sapiens
cacacaaaggcatgct

SEQ ID NO: 5855472 - DNA, 20 bp, Homo sapiens
cacacaaaggcatgctggag

SEQ ID NO: 5855473 - DNA, 13 bp, Homo sapiens
cacacaaaggtat

SEQ ID NO: 5855474 - DNA, 19 bp, Homo sapiens
cacacaaatgcagacacac

SEQ ID NO: 5855475 - DNA, 20 bp, Homo sapiens
cacacaaatgcagacacaca

SEQ ID NO: 5855476 - DNA, 15 bp, Homo sapiens
cacacaacaccagga

SEQ ID NO: 5855477 - DNA, 15 bp, Homo sapiens
cacacaacagccaac

SEQ ID NO: 5855478 - DNA, 22 bp, Homo sapiens
cacacaacgtaaaaataaaagc

SEQ ID NO: 5855479 - DNA, 13 bp, Homo sapiens
cacacaaggagaa

SEQ ID NO: 5855480 - DNA, 14 bp, Homo sapiens
cacacaaggctggg

SEQ ID NO: 5855481 - DNA, 12 bp, Homo sapiens
cacacaaggtgc

SEQ ID NO: 5855482 - DNA, 17 bp, Homo sapiens
cacacaaggtgctcaga

SEQ ID NO: 5855483 - DNA, 20 bp, Homo sapiens
cacacaagtaagagactcag

SEQ ID NO: 5855484 - DNA, 16 bp, Homo sapiens
cacacaagtttgtgct

SEQ ID NO: 5855485 - DNA, 21 bp, Homo sapiens
cacacaagtttgtgctatcta

SEQ ID NO: 5855486 - DNA, 15 bp, Homo sapiens
cacacaataaagaac

SEQ ID NO: 5855487 - DNA, 15 bp, Homo sapiens
cacacaatcagacca

SEQ ID NO: 5855488 - DNA, 22 bp, Homo sapiens
cacacaatgcccaacttactgt

SEQ ID NO: 5855489 - DNA, 23 bp, Homo sapiens
cacacaatgctattgaaattact

SEQ ID NO: 5855490 - DNA, 23 bp, Homo sapiens
cacacaatgtggacgtgcactga

SEQ ID NO: 5855491 - DNA, 18 bp, Homo sapiens
cacacaatgtgtctgaga

SEQ ID NO: 5855492 - DNA, 16 bp, Homo sapiens
cacacaattagatttc

SEQ ID NO: 5855493 - DNA, 15 bp, Homo sapiens
cacacaattttttct

SEQ ID NO: 5855494 - DNA, 14 bp, Homo sapiens
cacacacaaaccat

SEQ ID NO: 5855495 - DNA, 22 bp, Homo sapiens
cacacacaaacctactgcccac

SEQ ID NO: 5855496 - DNA, 15 bp, Homo sapiens
cacacacaaagagag

SEQ ID NO: 5855497 - DNA, 19 bp, Homo sapiens
cacacctgcaatcccagca

SEQ ID NO: 5855498 - DNA, 20 bp, Homo sapiens
cacacctgcacacccctgca

SEQ ID NO: 5855499 - DNA, 17 bp, Homo sapiens
cacacctgcacaccgtc

SEQ ID NO: 5855500 - DNA, 18 bp, Homo sapiens
cacacctgcagcctccct

SEQ ID NO: 5855501 - DNA, 16 bp, Homo sapiens
cacacctgcagtgcca

SEQ ID NO: 5855502 - DNA, 14 bp, Homo sapiens
cacacctgcctgcg

SEQ ID NO: 5855503 - DNA, 12 bp, Homo sapiens
cacacctggccc

SEQ ID NO: 5855504 - DNA, 14 bp, Homo sapiens
cacacctggccctg

SEQ ID NO: 5855505 - DNA, 21 bp, Homo sapiens
cacacctggctaattttttgt

SEQ ID NO: 5855506 - DNA, 16 bp, Homo sapiens
cacacctgggcccggg

SEQ ID NO: 5855507 - DNA, 12 bp, Homo sapiens
cacacctggtgg

SEQ ID NO: 5855508 - DNA, 17 bp, Homo sapiens
cacacctgtaatcccag

SEQ ID NO: 5855509 - DNA, 20 bp, Homo sapiens
cacacctgtaatcccagcac

SEQ ID NO: 5855510 - DNA, 21 bp, Homo sapiens
cacacctgtaatcccagcact

SEQ ID NO: 5855511 - DNA, 16 bp, Homo sapiens
cacacctgtaattcca

SEQ ID NO: 5855512 - DNA, 16 bp, Homo sapiens
cacacctgtagcactt

SEQ ID NO: 5855513 - DNA, 19 bp, Homo sapiens
cacacctgtagtcccagct

SEQ ID NO: 5855514 - DNA, 12 bp, Homo sapiens
cacacctgtcct

SEQ ID NO: 5855515 - DNA, 15 bp, Homo sapiens
cacacctgtctgtgc

SEQ ID NO: 5855516 - DNA, 16 bp, Homo sapiens
cacacctgtctgtgca

SEQ ID NO: 5855517 - DNA, 13 bp, Homo sapiens
cacacctgtgtcc

SEQ ID NO: 5855518 - DNA, 14 bp, Homo sapiens
cacacctgtgtcca

SEQ ID NO: 5855519 - DNA, 14 bp, Homo sapiens
cacaccttaaaaca

SEQ ID NO: 5855520 - DNA, 18 bp, Homo sapiens
cacaccttacaaagccag

SEQ ID NO: 5855521 - DNA, 13 bp, Homo sapiens
cacaccttggaga

SEQ ID NO: 5855522 - DNA, 22 bp, Homo sapiens
cacaccttttatgaatcaaata

SEQ ID NO: 5855523 - DNA, 22 bp, Homo sapiens
cacaccttttattgacacagaa

SEQ ID NO: 5855524 - DNA, 23 bp, Homo sapiens
cacaccttttattgacacagaaa

SEQ ID NO: 5855525 - DNA, 14 bp, Homo sapiens
cacaccttttcccc

SEQ ID NO: 5855526 - DNA, 19 bp, Homo sapiens
cacaccttttccccaggag

SEQ ID NO: 5855527 - DNA, 20 bp, Homo sapiens
cacacgaccggggccagcac

SEQ ID NO: 5855528 - DNA, 23 bp, Homo sapiens
cacacgagcaaacccagaggtgg

SEQ ID NO: 5855529 - DNA, 10 bp, Homo sapiens
cacacgatgc

SEQ ID NO: 5855530 - DNA, 19 bp, Homo sapiens
cacacgatgcatttaataa

SEQ ID NO: 5855531 - DNA, 24 bp, Homo sapiens
cacacgatgcatttaataaagatg

SEQ ID NO: 5855532 - DNA, 17 bp, Homo sapiens
cacacgattagctttat

SEQ ID NO: 5855533 - DNA, 23 bp, Homo sapiens
cacacgcaaaagcgactcccagc

SEQ ID NO: 5855534 - DNA, 19 bp, Homo sapiens
cacacgcacaaacacacac

SEQ ID NO: 5855535 - DNA, 22 bp, Homo sapiens
cacacgcacaaacacacacact

SEQ ID NO: 5855536 - DNA, 15 bp, Homo sapiens
cacacgcacacacac

SEQ ID NO: 5855537 - DNA, 23 bp, Homo sapiens
cacacgcacacacacacacagga

SEQ ID NO: 5855538 - DNA, 21 bp, Homo sapiens
cacacgcacgcacacacacaa

SEQ ID NO: 5855539 - DNA, 18 bp, Homo sapiens
cacacgcactgcgcctgt

SEQ ID NO: 5855540 - DNA, 15 bp, Homo sapiens
cacacgcagacacac

SEQ ID NO: 5855541 - DNA, 20 bp, Homo sapiens
cacacgcaggaactcccagc

SEQ ID NO: 5855542 - DNA, 23 bp, Homo sapiens
cacacgcaggcctccctgcctca

SEQ ID NO: 5855543 - DNA, 14 bp, Homo sapiens
cacacgcaggcggc

SEQ ID NO: 5855544 - DNA, 16 bp, Homo sapiens
cacacgcaggcggcca

SEQ ID NO: 5855545 - DNA, 19 bp, Homo sapiens
cacacgcaggcggccaggg

SEQ ID NO: 5855546 - DNA, 13 bp, Homo sapiens
cacacgcatgggc

SEQ ID NO: 5855547 - DNA, 22 bp, Homo sapiens
cacacgcatgggcattgcagcc

SEQ ID NO: 5855548 - DNA, 14 bp, Homo sapiens
cacacgccagctcc

SEQ ID NO: 5855549 - DNA, 16 bp, Homo sapiens
cacacgccagctcctc

SEQ ID NO: 5855550 - DNA, 15 bp, Homo sapiens
cacacgccggggctg

SEQ ID NO: 5855551 - DNA, 19 bp, Homo sapiens
cacacgccggggctggccc

SEQ ID NO: 5855552 - DNA, 21 bp, Homo sapiens
cacacgccggggctggccctg

SEQ ID NO: 5855553 - DNA, 17 bp, Homo sapiens
cacacgcctcccactgg

SEQ ID NO: 5855554 - DNA, 13 bp, Homo sapiens
cacacgcctctgt

SEQ ID NO: 5855555 - DNA, 15 bp, Homo sapiens
cacacgcctctgtgt

SEQ ID NO: 5855556 - DNA, 18 bp, Homo sapiens
cacacgcctgtaatccca

SEQ ID NO: 5855557 - DNA, 17 bp, Homo sapiens
cacacgccttcatgcca

SEQ ID NO: 5855558 - DNA, 21 bp, Homo sapiens
cacacgccttcatgccagtgc

SEQ ID NO: 5855559 - DNA, 19 bp, Homo sapiens
cacacgctccctggaagct

SEQ ID NO: 5855560 - DNA, 20 bp, Homo sapiens
cacacgctccctggaagctg

SEQ ID NO: 5855561 - DNA, 14 bp, Homo sapiens
cacacgctgcccag

SEQ ID NO: 5855562 - DNA, 20 bp, Homo sapiens
cacacgctgcccaggctctg

SEQ ID NO: 5855563 - DNA, 21 bp, Homo sapiens
cacacgctgcccaggctctgc

SEQ ID NO: 5855564 - DNA, 14 bp, Homo sapiens
cacacgctgccttc

SEQ ID NO: 5855565 - DNA, 22 bp, Homo sapiens
cacacggaccatctttagcagt

SEQ ID NO: 5855566 - DNA, 17 bp, Homo sapiens
cacacggactcccgggc

SEQ ID NO: 5855567 - DNA, 18 bp, Homo sapiens
cacacggagctcctggca

SEQ ID NO: 5855568 - DNA, 18 bp, Homo sapiens
cacacggaggcatctgca

SEQ ID NO: 5855569 - DNA, 19 bp, Homo sapiens
cacacggccacccgccccg

SEQ ID NO: 5855570 - DNA, 22 bp, Homo sapiens
cacacggccctgccccatcctg

SEQ ID NO: 5855571 - DNA, 20 bp, Homo sapiens
cacacggctcccccaggcct

SEQ ID NO: 5855572 - DNA, 19 bp, Homo sapiens
cacacggctggtcactctg

SEQ ID NO: 5855573 - DNA, 18 bp, Homo sapiens
cacacggggcacccagcc

SEQ ID NO: 5855574 - DNA, 20 bp, Homo sapiens
cacacggttttggcagctga

SEQ ID NO: 5855575 - DNA, 20 bp, Homo sapiens
cacacgtaatgaaacttgga

SEQ ID NO: 5855576 - DNA, 17 bp, Homo sapiens
cacacgtacttaaatga

SEQ ID NO: 5855577 - DNA, 22 bp, Homo sapiens
cacacgtaggacgcatgaaggt

SEQ ID NO: 5855578 - DNA, 17 bp, Homo sapiens
cacacgtccatgtttat

SEQ ID NO: 5855579 - DNA, 20 bp, Homo sapiens
cacacgtctgaccctctcca

SEQ ID NO: 5855580 - DNA, 19 bp, Homo sapiens
cacacgtgctcgcagcctg

SEQ ID NO: 5855581 - DNA, 20 bp, Homo sapiens
cacacgtgctctctgctgga

SEQ ID NO: 5855582 - DNA, 10 bp, Homo sapiens
cacacgtgtg

SEQ ID NO: 5855583 - DNA, 18 bp, Homo sapiens
cacacgtgtgatgtatgt

SEQ ID NO: 5855584 - DNA, 14 bp, Homo sapiens
cacacgtgtgtatg

SEQ ID NO: 5855585 - DNA, 17 bp, Homo sapiens
cacacgtttaatcccag

SEQ ID NO: 5855586 - DNA, 18 bp, Homo sapiens
cacacgtttaatcccagc

SEQ ID NO: 5855587 - DNA, 22 bp, Homo sapiens
cacacgtttaatcccagcactt

SEQ ID NO: 5855588 - DNA, 23 bp, Homo sapiens
cacacgtttaatcccagcacttt

SEQ ID NO: 5855589 - DNA, 13 bp, Homo sapiens
cacactaaaacat

SEQ ID NO: 5855590 - DNA, 21 bp, Homo sapiens
cacactaaaacattgtctaca

SEQ ID NO: 5855591 - DNA, 16 bp, Homo sapiens
cacactacaccacaca

SEQ ID NO: 5855592 - DNA, 18 bp, Homo sapiens
cacactacaccacacaca

SEQ ID NO: 5855593 - DNA, 19 bp, Homo sapiens
cacactacaccacacacaa

SEQ ID NO: 5855594 - DNA, 18 bp, Homo sapiens
cacactaccgaatgtgtc

SEQ ID NO: 5855595 - DNA, 21 bp, Homo sapiens
cacactaccgaatgtgtcttt

SEQ ID NO: 5855596 - DNA, 16 bp, Homo sapiens
cacactacgcagaaga

SEQ ID NO: 5855597 - DNA, 22 bp, Homo sapiens
cacactacgcagaagagaaagt

SEQ ID NO: 5855598 - DNA, 12 bp, Homo sapiens
cacactactgta

SEQ ID NO: 5855599 - DNA, 19 bp, Homo sapiens
cacactagcctctccagga

SEQ ID NO: 5855600 - DNA, 19 bp, Homo sapiens
cacactatgcacagagccc

SEQ ID NO: 5855601 - DNA, 14 bp, Homo sapiens
cacactatgtgtgt

SEQ ID NO: 5855602 - DNA, 22 bp, Homo sapiens
cacactatttgagttggccaag

SEQ ID NO: 5855603 - DNA, 14 bp, Homo sapiens
cacactattttaga

SEQ ID NO: 5855604 - DNA, 20 bp, Homo sapiens
cacactcaaaagacaaacat

SEQ ID NO: 5855605 - DNA, 22 bp, Homo sapiens
cacactcaaaagacaaacatgc

SEQ ID NO: 5855606 - DNA, 17 bp, Homo sapiens
cacactcactcctgaga

SEQ ID NO: 5855607 - DNA, 18 bp, Homo sapiens
cacactcactcctgagac

SEQ ID NO: 5855608 - DNA, 12 bp, Homo sapiens
cacactcactgc

SEQ ID NO: 5855609 - DNA, 22 bp, Homo sapiens
cacactcagcacccccttctct

SEQ ID NO: 5855610 - DNA, 23 bp, Homo sapiens
cacactcaggcctgtgcccactc

SEQ ID NO: 5855611 - DNA, 13 bp, Homo sapiens
cacactcagtccc

SEQ ID NO: 5855612 - DNA, 13 bp, Homo sapiens
cacactcagtgca

SEQ ID NO: 5855613 - DNA, 12 bp, Homo sapiens
cacactcagtgg

SEQ ID NO: 5855614 - DNA, 20 bp, Homo sapiens
cacactcatgcattgtcctc

SEQ ID NO: 5855615 - DNA, 16 bp, Homo sapiens
cacactccaagatatg

SEQ ID NO: 5855616 - DNA, 13 bp, Homo sapiens
cacactccactct

SEQ ID NO: 5855617 - DNA, 15 bp, Homo sapiens
cacactccactctga

SEQ ID NO: 5855618 - DNA, 16 bp, Homo sapiens
cacactccactctgat

SEQ ID NO: 5855619 - DNA, 11 bp, Homo sapiens
cacactccagt

SEQ ID NO: 5855620 - DNA, 17 bp, Homo sapiens
cacactccatctcctgc

SEQ ID NO: 5855621 - DNA, 20 bp, Homo sapiens
cacactccatctcctgctca

SEQ ID NO: 5855622 - DNA, 18 bp, Homo sapiens
cacactccccacttcact

SEQ ID NO: 5855623 - DNA, 10 bp, Homo sapiens
cacactccta

SEQ ID NO: 5855624 - DNA, 13 bp, Homo sapiens
cacactcctcctg

SEQ ID NO: 5855625 - DNA, 14 bp, Homo sapiens
cacactcctcctgc

SEQ ID NO: 5855626 - DNA, 15 bp, Homo sapiens
cacactcctcctgcc

SEQ ID NO: 5855627 - DNA, 19 bp, Homo sapiens
cacactcctcctgccagct

SEQ ID NO: 5855628 - DNA, 21 bp, Homo sapiens
cacactcctgggctctgaaca

SEQ ID NO: 5855629 - DNA, 21 bp, Homo sapiens
cacactcgggttaagaaatac

SEQ ID NO: 5855630 - DNA, 16 bp, Homo sapiens
cacactctaaaccccg

SEQ ID NO: 5855631 - DNA, 20 bp, Homo sapiens
cacactctcatgtccccttc

SEQ ID NO: 5855632 - DNA, 14 bp, Homo sapiens
cacactctctgcag

SEQ ID NO: 5855633 - DNA, 16 bp, Homo sapiens
cacactctctgcagcc

SEQ ID NO: 5855634 - DNA, 22 bp, Homo sapiens
cacactctcttctccattccct

SEQ ID NO: 5855635 - DNA, 19 bp, Homo sapiens
cacactctgccagcaaaga

SEQ ID NO: 5855636 - DNA, 22 bp, Homo sapiens
cacactcttcagtgactcctgc

SEQ ID NO: 5855637 - DNA, 23 bp, Homo sapiens
cacactcttcagtgactcctgct

SEQ ID NO: 5855638 - DNA, 13 bp, Homo sapiens
cacactgaaattc

SEQ ID NO: 5855639 - DNA, 15 bp, Homo sapiens
cacactgaataagag

SEQ ID NO: 5855640 - DNA, 22 bp, Homo sapiens
cacactgaatcagctgctgact

SEQ ID NO: 5855641 - DNA, 14 bp, Homo sapiens
cacactgaccacac

SEQ ID NO: 5855642 - DNA, 17 bp, Homo sapiens
cacactgagctgggcac

SEQ ID NO: 5855643 - DNA, 13 bp, Homo sapiens
cacactgaggcag

SEQ ID NO: 5855644 - DNA, 14 bp, Homo sapiens
cacactgaggcagg

SEQ ID NO: 5855645 - DNA, 15 bp, Homo sapiens
cacactgaggcaggg

SEQ ID NO: 5855646 - DNA, 12 bp, Homo sapiens
cacactgagtga

SEQ ID NO: 5855647 - DNA, 20 bp, Homo sapiens
cacactgagtgaggagtgga

SEQ ID NO: 5855648 - DNA, 14 bp, Homo sapiens
cacactgagttcta

SEQ ID NO: 5855649 - DNA, 15 bp, Homo sapiens
cacactgagttctat

SEQ ID NO: 5855650 - DNA, 19 bp, Homo sapiens
cacactgatacataaaaat

SEQ ID NO: 5855651 - DNA, 22 bp, Homo sapiens
cacactgatacataaaaattaa

SEQ ID NO: 5855652 - DNA, 14 bp, Homo sapiens
cacactgatgctta

SEQ ID NO: 5855653 - DNA, 18 bp, Homo sapiens
cacactgatgcttagatg

SEQ ID NO: 5855654 - DNA, 19 bp, Homo sapiens
cacactgatggctcaagac

SEQ ID NO: 5855655 - DNA, 16 bp, Homo sapiens
cacactgatgggctgg

SEQ ID NO: 5855656 - DNA, 21 bp, Homo sapiens
cacactgatgggctggggcag

SEQ ID NO: 5855657 - DNA, 20 bp, Homo sapiens
cacactgcaagagccttggt

SEQ ID NO: 5855658 - DNA, 15 bp, Homo sapiens
cacactgcagggctg

SEQ ID NO: 5855659 - DNA, 21 bp, Homo sapiens
cacactgccaaataaacagct

SEQ ID NO: 5855660 - DNA, 23 bp, Homo sapiens
cacactgcctcccatccttccct

SEQ ID NO: 5855661 - DNA, 13 bp, Homo sapiens
cacactgctacac

SEQ ID NO: 5855662 - DNA, 15 bp, Homo sapiens
cacactgctcatttg

SEQ ID NO: 5855663 - DNA, 14 bp, Homo sapiens
cacactgctccagt

SEQ ID NO: 5855664 - DNA, 20 bp, Homo sapiens
cacactgctgctaggggctg

SEQ ID NO: 5855665 - DNA, 23 bp, Homo sapiens
cacactgctgtcctctccccctt

SEQ ID NO: 5855666 - DNA, 18 bp, Homo sapiens
cacactggaatataaaac

SEQ ID NO: 5855667 - DNA, 20 bp, Homo sapiens
cacactggactccggccctc

SEQ ID NO: 5855668 - DNA, 12 bp, Homo sapiens
cacactggagga

SEQ ID NO: 5855669 - DNA, 19 bp, Homo sapiens
cacactggcatctccctga

SEQ ID NO: 5855670 - DNA, 17 bp, Homo sapiens
cacactggccacaagga

SEQ ID NO: 5855671 - DNA, 19 bp, Homo sapiens
cacactggctcacccagtc

SEQ ID NO: 5855672 - DNA, 12 bp, Homo sapiens
cacactggctcc

SEQ ID NO: 5855673 - DNA, 16 bp, Homo sapiens
cacactggctcctgga

SEQ ID NO: 5855674 - DNA, 15 bp, Homo sapiens
cacagccaacaaaca

SEQ ID NO: 5855675 - DNA, 19 bp, Homo sapiens
cacagccaacgagacacat

SEQ ID NO: 5855676 - DNA, 19 bp, Homo sapiens
cacagccaataaacaccag

SEQ ID NO: 5855677 - DNA, 21 bp, Homo sapiens
cacagccaatctccaggctcc

SEQ ID NO: 5855678 - DNA, 11 bp, Homo sapiens
cacagccacac

SEQ ID NO: 5855679 - DNA, 12 bp, Homo sapiens
cacagccacaca

SEQ ID NO: 5855680 - DNA, 15 bp, Homo sapiens
cacagccacacacac

SEQ ID NO: 5855681 - DNA, 19 bp, Homo sapiens
cacagccacacacacagaa

SEQ ID NO: 5855682 - DNA, 22 bp, Homo sapiens
cacagccacacacacagaaaat

SEQ ID NO: 5855683 - DNA, 16 bp, Homo sapiens
cacagccacacctgga

SEQ ID NO: 5855684 - DNA, 13 bp, Homo sapiens
cacagccacccct

SEQ ID NO: 5855685 - DNA, 12 bp, Homo sapiens
cacagccacctc

SEQ ID NO: 5855686 - DNA, 16 bp, Homo sapiens
cacagccacctccacc

SEQ ID NO: 5855687 - DNA, 17 bp, Homo sapiens
cacagccacctccgcca

SEQ ID NO: 5855688 - DNA, 17 bp, Homo sapiens
cacagccactaaaacac

SEQ ID NO: 5855689 - DNA, 11 bp, Homo sapiens
cacagccagaa

SEQ ID NO: 5855690 - DNA, 13 bp, Homo sapiens
cacagccagaacc

SEQ ID NO: 5855691 - DNA, 16 bp, Homo sapiens
cacagccagaggaggg

SEQ ID NO: 5855692 - DNA, 19 bp, Homo sapiens
cacagccagaggagggcag

SEQ ID NO: 5855693 - DNA, 15 bp, Homo sapiens
cacagccagcacctg

SEQ ID NO: 5855694 - DNA, 11 bp, Homo sapiens
cacagccagcc

SEQ ID NO: 5855695 - DNA, 16 bp, Homo sapiens
cacagccagcccagct

SEQ ID NO: 5855696 - DNA, 18 bp, Homo sapiens
cacagccagcccagctcc

SEQ ID NO: 5855697 - DNA, 21 bp, Homo sapiens
cacagccagcccagctccact

SEQ ID NO: 5855698 - DNA, 17 bp, Homo sapiens
cacagccaggtgccttg

SEQ ID NO: 5855699 - DNA, 20 bp, Homo sapiens
cacagccaggtgccttggag

SEQ ID NO: 5855700 - DNA, 19 bp, Homo sapiens
cacagccatcccagccttg

SEQ ID NO: 5855701 - DNA, 20 bp, Homo sapiens
cacagccatcccagccttgg

SEQ ID NO: 5855702 - DNA, 15 bp, Homo sapiens
cacagccatgccctt

SEQ ID NO: 5855703 - DNA, 19 bp, Homo sapiens
cacagccattcatctgggc

SEQ ID NO: 5855704 - DNA, 22 bp, Homo sapiens
cacagccattcatctgggctgg

SEQ ID NO: 5855705 - DNA, 14 bp, Homo sapiens
cacagccatttcaa

SEQ ID NO: 5855706 - DNA, 17 bp, Homo sapiens
cacagcccaaaatttga

SEQ ID NO: 5855707 - DNA, 19 bp, Homo sapiens
cacagcccaaagaaggaaa

SEQ ID NO: 5855708 - DNA, 17 bp, Homo sapiens
cacagcccaaccaggag

SEQ ID NO: 5855709 - DNA, 18 bp, Homo sapiens
cacagcccaaccaggagg

SEQ ID NO: 5855710 - DNA, 23 bp, Homo sapiens
cacagcccaaccaggaggggtct

SEQ ID NO: 5855711 - DNA, 13 bp, Homo sapiens
cacagcccaagag

SEQ ID NO: 5855712 - DNA, 16 bp, Homo sapiens
cacagcccacacatga

SEQ ID NO: 5855713 - DNA, 18 bp, Homo sapiens
cacagcccaccctctgtg

SEQ ID NO: 5855714 - DNA, 17 bp, Homo sapiens
cacagcccacggggatc

SEQ ID NO: 5855715 - DNA, 20 bp, Homo sapiens
cacagcccacgtcctgtcag

SEQ ID NO: 5855716 - DNA, 18 bp, Homo sapiens
cacagcccagaaggccag

SEQ ID NO: 5855717 - DNA, 19 bp, Homo sapiens
cacagcccagaaggccaga

SEQ ID NO: 5855718 - DNA, 18 bp, Homo sapiens
cacagcccagacaagatg

SEQ ID NO: 5855719 - DNA, 14 bp, Homo sapiens
cacagcccaggcct

SEQ ID NO: 5855720 - DNA, 16 bp, Homo sapiens
cacagcccaggcctcc

SEQ ID NO: 5855721 - DNA, 12 bp, Homo sapiens
cacagcccaggg

SEQ ID NO: 5855722 - DNA, 19 bp, Homo sapiens
cacagcccagttcccgtga

SEQ ID NO: 5855723 - DNA, 21 bp, Homo sapiens
cacagccccaaacaagcgcca

SEQ ID NO: 5855724 - DNA, 16 bp, Homo sapiens
cacagccccacagcac

SEQ ID NO: 5855725 - DNA, 19 bp, Homo sapiens
cacagccccacagcaccca

SEQ ID NO: 5855726 - DNA, 20 bp, Homo sapiens
cacagccccacccttgtccc

SEQ ID NO: 5855727 - DNA, 14 bp, Homo sapiens
cacagccccatctg

SEQ ID NO: 5855728 - DNA, 14 bp, Homo sapiens
cacagcccccaccc

SEQ ID NO: 5855729 - DNA, 15 bp, Homo sapiens
cacagcccccacccc

SEQ ID NO: 5855730 - DNA, 23 bp, Homo sapiens
cacagcccccaccccagcacagc

SEQ ID NO: 5855731 - DNA, 15 bp, Homo sapiens
cacagcccctggagc

SEQ ID NO: 5855732 - DNA, 21 bp, Homo sapiens
cacagcccctggagcctcaga

SEQ ID NO: 5855733 - DNA, 22 bp, Homo sapiens
cacagcccctggagcctcagaa

SEQ ID NO: 5855734 - DNA, 14 bp, Homo sapiens
cacagcccctggca

SEQ ID NO: 5855735 - DNA, 15 bp, Homo sapiens
cacagcccctggcac

SEQ ID NO: 5855736 - DNA, 17 bp, Homo sapiens
cacagcccgctctctgg

SEQ ID NO: 5855737 - DNA, 15 bp, Homo sapiens
cacagccctcagcgt

SEQ ID NO: 5855738 - DNA, 20 bp, Homo sapiens
cacagccctcccgccccttc

SEQ ID NO: 5855739 - DNA, 14 bp, Homo sapiens
cacagccctccgac

SEQ ID NO: 5855740 - DNA, 22 bp, Homo sapiens
cacagccctgaaacgagaagtg

SEQ ID NO: 5855741 - DNA, 14 bp, Homo sapiens
cacagccctgagtg

SEQ ID NO: 5855742 - DNA, 14 bp, Homo sapiens
cacagccctggaat

SEQ ID NO: 5855743 - DNA, 14 bp, Homo sapiens
cacagccctgggag

SEQ ID NO: 5855744 - DNA, 18 bp, Homo sapiens
cacagccctgtcagcatg

SEQ ID NO: 5855745 - DNA, 19 bp, Homo sapiens
cacagccctgtcagcatga

SEQ ID NO: 5855746 - DNA, 22 bp, Homo sapiens
cacagccctgtcagcatgaatt

SEQ ID NO: 5855747 - DNA, 23 bp, Homo sapiens
cacagccctgtcagcatgaattt

SEQ ID NO: 5855748 - DNA, 18 bp, Homo sapiens
cacagccctgtcagtgca

SEQ ID NO: 5855749 - DNA, 21 bp, Homo sapiens
cacagccctgtcagtgcagcc

SEQ ID NO: 5855750 - DNA, 20 bp, Homo sapiens
cacagccgattcacctgagc

SEQ ID NO: 5855751 - DNA, 22 bp, Homo sapiens
cacagccgcagcctccctctga

SEQ ID NO: 5855752 - DNA, 19 bp, Homo sapiens
cacagccgcctttgggttc

SEQ ID NO: 5855753 - DNA, 19 bp, Homo sapiens
cacagccgcgggccaggag

SEQ ID NO: 5855754 - DNA, 20 bp, Homo sapiens
cacagccgcgggccaggagg

SEQ ID NO: 5855755 - DNA, 18 bp, Homo sapiens
cacagccggggcctgcct

SEQ ID NO: 5855756 - DNA, 18 bp, Homo sapiens
cacagcctagcacagcag

SEQ ID NO: 5855757 - DNA, 18 bp, Homo sapiens
cacagcctaggaccagtt

SEQ ID NO: 5855758 - DNA, 15 bp, Homo sapiens
cacagcctcacccct

SEQ ID NO: 5855759 - DNA, 16 bp, Homo sapiens
cacagcctcacccctg

SEQ ID NO: 5855760 - DNA, 19 bp, Homo sapiens
cacagcctcacccctgcag

SEQ ID NO: 5855761 - DNA, 19 bp, Homo sapiens
cacagcctcacccctgccc

SEQ ID NO: 5855762 - DNA, 17 bp, Homo sapiens
cacagcctcccctgcca

SEQ ID NO: 5855763 - DNA, 21 bp, Homo sapiens
cacagcctcccctgccagggc

SEQ ID NO: 5855764 - DNA, 14 bp, Homo sapiens
cacagcctccctga

SEQ ID NO: 5855765 - DNA, 18 bp, Homo sapiens
cacagcctccctgagcct

SEQ ID NO: 5855766 - DNA, 20 bp, Homo sapiens
cacagcctccctgagcctgc

SEQ ID NO: 5855767 - DNA, 22 bp, Homo sapiens
cacagcctccctgagcctgcat

SEQ ID NO: 5855768 - DNA, 14 bp, Homo sapiens
cacagcctcctctg

SEQ ID NO: 5855769 - DNA, 15 bp, Homo sapiens
cacagcctcctctgt

SEQ ID NO: 5855770 - DNA, 21 bp, Homo sapiens
cacagcctcctctgtctgccc

SEQ ID NO: 5855771 - DNA, 16 bp, Homo sapiens
cacagcctccttctgt

SEQ ID NO: 5855772 - DNA, 12 bp, Homo sapiens
cacagcctcggg

SEQ ID NO: 5855773 - DNA, 14 bp, Homo sapiens
cacagcctcgggga

SEQ ID NO: 5855774 - DNA, 22 bp, Homo sapiens
cacagcctctaagcgtgctgac

SEQ ID NO: 5855775 - DNA, 12 bp, Homo sapiens
cacagcctctcc

SEQ ID NO: 5855776 - DNA, 12 bp, Homo sapiens
cacagcctctga

SEQ ID NO: 5855777 - DNA, 14 bp, Homo sapiens
cacagcctctgacc

SEQ ID NO: 5855778 - DNA, 20 bp, Homo sapiens
cacagcctctgacccctcct

SEQ ID NO: 5855779 - DNA, 22 bp, Homo sapiens
cacagcctctgacccctcctca

SEQ ID NO: 5855780 - DNA, 18 bp, Homo sapiens
cacagcctctggctccac

SEQ ID NO: 5855781 - DNA, 19 bp, Homo sapiens
cacagcctctggctccaca

SEQ ID NO: 5855782 - DNA, 17 bp, Homo sapiens
cacagcctcttagatgc

SEQ ID NO: 5855783 - DNA, 21 bp, Homo sapiens
cacagcctgacacagtgctcg

SEQ ID NO: 5855784 - DNA, 23 bp, Homo sapiens
cacagcctgcacttgggggctca

SEQ ID NO: 5855785 - DNA, 19 bp, Homo sapiens
cacagcctgctggcagggc

SEQ ID NO: 5855786 - DNA, 20 bp, Homo sapiens
cacagcctgctggcagggcc

SEQ ID NO: 5855787 - DNA, 13 bp, Homo sapiens
cacagcctggcct

SEQ ID NO: 5855788 - DNA, 18 bp, Homo sapiens
cacagcctgggaccaggg

SEQ ID NO: 5855789 - DNA, 21 bp, Homo sapiens
cacagcctgggaccagggcat

SEQ ID NO: 5855790 - DNA, 14 bp, Homo sapiens
cacagcctgggccc

SEQ ID NO: 5855791 - DNA, 16 bp, Homo sapiens
cacagcctggggaggg

SEQ ID NO: 5855792 - DNA, 12 bp, Homo sapiens
cacagcctgggt

SEQ ID NO: 5855793 - DNA, 14 bp, Homo sapiens
cacagcctgtcttc

SEQ ID NO: 5855794 - DNA, 23 bp, Homo sapiens
cacagcctgtcttgtcaggtgga

SEQ ID NO: 5855795 - DNA, 11 bp, Homo sapiens
cacagccttcc

SEQ ID NO: 5855796 - DNA, 12 bp, Homo sapiens
cacagccttccc

SEQ ID NO: 5855797 - DNA, 17 bp, Homo sapiens
cacagccttccctctgc

SEQ ID NO: 5855798 - DNA, 13 bp, Homo sapiens
cacagccttcctt

SEQ ID NO: 5855799 - DNA, 17 bp, Homo sapiens
cacagccttccttctgc

SEQ ID NO: 5855800 - DNA, 19 bp, Homo sapiens
cacagccttccttctgctc

SEQ ID NO: 5855801 - DNA, 17 bp, Homo sapiens
cacagccttgcagcggc

SEQ ID NO: 5855802 - DNA, 21 bp, Homo sapiens
cacagccttggctcctgagaa

SEQ ID NO: 5855803 - DNA, 22 bp, Homo sapiens
cacagccttggctcctgagaaa

SEQ ID NO: 5855804 - DNA, 23 bp, Homo sapiens
cacagcctttcgttctgctgacc

SEQ ID NO: 5855805 - DNA, 15 bp, Homo sapiens
cacagcctttctgaa

SEQ ID NO: 5855806 - DNA, 21 bp, Homo sapiens
cacagcctttgcgctctgggt

SEQ ID NO: 5855807 - DNA, 22 bp, Homo sapiens
cacagcctttgcttccaggtgg

SEQ ID NO: 5855808 - DNA, 16 bp, Homo sapiens
cacagcgagcctgtgc

SEQ ID NO: 5855809 - DNA, 16 bp, Homo sapiens
cacagcgagggcagct

SEQ ID NO: 5855810 - DNA, 16 bp, Homo sapiens
cacagcgccagcctca

SEQ ID NO: 5855811 - DNA, 13 bp, Homo sapiens
cacagcgcctcct

SEQ ID NO: 5855812 - DNA, 14 bp, Homo sapiens
cacagcgcctcctg

SEQ ID NO: 5855813 - DNA, 15 bp, Homo sapiens
cacagcgcctcctgg

SEQ ID NO: 5855814 - DNA, 16 bp, Homo sapiens
cacagcgcctcctgga

SEQ ID NO: 5855815 - DNA, 19 bp, Homo sapiens
cacagcgctcgatggacct

SEQ ID NO: 5855816 - DNA, 16 bp, Homo sapiens
cacagcggaggagacc

SEQ ID NO: 5855817 - DNA, 21 bp, Homo sapiens
cacagcggaggagaccagctc

SEQ ID NO: 5855818 - DNA, 21 bp, Homo sapiens
cacagcggagtctgtcctgtg

SEQ ID NO: 5855819 - DNA, 23 bp, Homo sapiens
cacagcggagtctgtcctgtgac

SEQ ID NO: 5855820 - DNA, 15 bp, Homo sapiens
cacagcggctgcctc

SEQ ID NO: 5855821 - DNA, 18 bp, Homo sapiens
cacagcggggaagctggg

SEQ ID NO: 5855822 - DNA, 18 bp, Homo sapiens
cacagcgtccctggcgca

SEQ ID NO: 5855823 - DNA, 20 bp, Homo sapiens
cacagcgtgctggcgacact

SEQ ID NO: 5855824 - DNA, 20 bp, Homo sapiens
cacagctaacaattgtgaag

SEQ ID NO: 5855825 - DNA, 21 bp, Homo sapiens
cacagctaataaaagtcagag

SEQ ID NO: 5855826 - DNA, 18 bp, Homo sapiens
cacagctactcagatctg

SEQ ID NO: 5855827 - DNA, 16 bp, Homo sapiens
cacagctaggcatgcc

SEQ ID NO: 5855828 - DNA, 12 bp, Homo sapiens
cacagctatgaa

SEQ ID NO: 5855829 - DNA, 22 bp, Homo sapiens
cacagctatgaaggctgtacac

SEQ ID NO: 5855830 - DNA, 21 bp, Homo sapiens
cacagctcaagcattctgttt

SEQ ID NO: 5855831 - DNA, 20 bp, Homo sapiens
cacagctcacggcagcctca

SEQ ID NO: 5855832 - DNA, 22 bp, Homo sapiens
cacagctcacggcagcctcaac

SEQ ID NO: 5855833 - DNA, 12 bp, Homo sapiens
cacagctcagct

SEQ ID NO: 5855834 - DNA, 21 bp, Homo sapiens
cacagctcagctgcccatccc

SEQ ID NO: 5855835 - DNA, 23 bp, Homo sapiens
cacagctcagctgcccatcccag

SEQ ID NO: 5855836 - DNA, 17 bp, Homo sapiens
cacagctcccaccccac

SEQ ID NO: 5855837 - DNA, 15 bp, Homo sapiens
cacagctccctgcca

SEQ ID NO: 5855838 - DNA, 17 bp, Homo sapiens
cacagctcccttctgtt

SEQ ID NO: 5855839 - DNA, 19 bp, Homo sapiens
cacagctcctccatgcctg

SEQ ID NO: 5855840 - DNA, 15 bp, Homo sapiens
cacagctcctcccct

SEQ ID NO: 5855841 - DNA, 18 bp, Homo sapiens
cacagctcctcccctgcc

SEQ ID NO: 5855842 - DNA, 19 bp, Homo sapiens
cacagctcctcccctgccg

SEQ ID NO: 5855843 - DNA, 13 bp, Homo sapiens
cacagctcctgcc

SEQ ID NO: 5855844 - DNA, 15 bp, Homo sapiens
cacagctcctgccag

SEQ ID NO: 5855845 - DNA, 12 bp, Homo sapiens
cacagctccttt

SEQ ID NO: 5855846 - DNA, 21 bp, Homo sapiens
cacagctctcactggccagta

SEQ ID NO: 5855847 - DNA, 13 bp, Homo sapiens
cacagctctgctg

SEQ ID NO: 5855848 - DNA, 16 bp, Homo sapiens
cacagctctgctggaa

SEQ ID NO: 5855849 - DNA, 16 bp, Homo sapiens
cacagctctgggcctc

SEQ ID NO: 5855850 - DNA, 17 bp, Homo sapiens
cacagctctgggcctct

SEQ ID NO: 5855851 - DNA, 19 bp, Homo sapiens
cacagctctgggcctcttt

SEQ ID NO: 5855852 - DNA, 19 bp, Homo sapiens
cacagtgaatgtgtgtatg

SEQ ID NO: 5855853 - DNA, 17 bp, Homo sapiens
cacagtgacccttccca

SEQ ID NO: 5855854 - DNA, 18 bp, Homo sapiens
cacagtgactcgggctcc

SEQ ID NO: 5855855 - DNA, 19 bp, Homo sapiens
cacagtgactcgggctcct

SEQ ID NO: 5855856 - DNA, 19 bp, Homo sapiens
cacagtgactgggccctgt

SEQ ID NO: 5855857 - DNA, 17 bp, Homo sapiens
cacagtgagactgtaca

SEQ ID NO: 5855858 - DNA, 18 bp, Homo sapiens
cacagtgagaggggaggg

SEQ ID NO: 5855859 - DNA, 19 bp, Homo sapiens
cacagtgagagtactcact

SEQ ID NO: 5855860 - DNA, 13 bp, Homo sapiens
cacagtgagctga

SEQ ID NO: 5855861 - DNA, 14 bp, Homo sapiens
cacagtgagctgat

SEQ ID NO: 5855862 - DNA, 22 bp, Homo sapiens
cacagtgagtcgaggacaggga

SEQ ID NO: 5855863 - DNA, 21 bp, Homo sapiens
cacagtgatgccgggcgccag

SEQ ID NO: 5855864 - DNA, 22 bp, Homo sapiens
cacagtgatgccgggcgccagg

SEQ ID NO: 5855865 - DNA, 17 bp, Homo sapiens
cacagtgcatctcagcc

SEQ ID NO: 5855866 - DNA, 19 bp, Homo sapiens
cacagtgcatctcagccca

SEQ ID NO: 5855867 - DNA, 17 bp, Homo sapiens
cacagtgcccacctgct

SEQ ID NO: 5855868 - DNA, 18 bp, Homo sapiens
cacagtgcccagctaatt

SEQ ID NO: 5855869 - DNA, 18 bp, Homo sapiens
cacagtgccccagtggtg

SEQ ID NO: 5855870 - DNA, 17 bp, Homo sapiens
cacagtgccttcaataa

SEQ ID NO: 5855871 - DNA, 19 bp, Homo sapiens
cacagtgccttcaataaat

SEQ ID NO: 5855872 - DNA, 18 bp, Homo sapiens
cacagtgctcttttctcc

SEQ ID NO: 5855873 - DNA, 12 bp, Homo sapiens
cacagtgctgcc

SEQ ID NO: 5855874 - DNA, 16 bp, Homo sapiens
cacagtgctgcccctt

SEQ ID NO: 5855875 - DNA, 20 bp, Homo sapiens
cacagtgctgccccttgcaa

SEQ ID NO: 5855876 - DNA, 21 bp, Homo sapiens
cacagtgctgccccttgcaag

SEQ ID NO: 5855877 - DNA, 17 bp, Homo sapiens
cacagtgctgcttctct

SEQ ID NO: 5855878 - DNA, 14 bp, Homo sapiens
cacagtgctgggat

SEQ ID NO: 5855879 - DNA, 22 bp, Homo sapiens
cacagtggaaagacagcttctc

SEQ ID NO: 5855880 - DNA, 23 bp, Homo sapiens
cacagtggactcagcagtgacca

SEQ ID NO: 5855881 - DNA, 17 bp, Homo sapiens
cacagtggagagggcta

SEQ ID NO: 5855882 - DNA, 21 bp, Homo sapiens
cacagtggattccagtgcatg

SEQ ID NO: 5855883 - DNA, 20 bp, Homo sapiens
cacagtggcacaaaaaaata

SEQ ID NO: 5855884 - DNA, 21 bp, Homo sapiens
cacagtggccggggctgaagc

SEQ ID NO: 5855885 - DNA, 23 bp, Homo sapiens
cacagtggccggggctgaagcca

SEQ ID NO: 5855886 - DNA, 17 bp, Homo sapiens
cacagtggcgagaggag

SEQ ID NO: 5855887 - DNA, 18 bp, Homo sapiens
cacagtggcgagaggaga

SEQ ID NO: 5855888 - DNA, 19 bp, Homo sapiens
cacagtggcgggcccactc

SEQ ID NO: 5855889 - DNA, 19 bp, Homo sapiens
cacagtgggagccagggct

SEQ ID NO: 5855890 - DNA, 20 bp, Homo sapiens
cacagtgggatgaaccagcc

SEQ ID NO: 5855891 - DNA, 18 bp, Homo sapiens
cacagtgggccggcccca

SEQ ID NO: 5855892 - DNA, 20 bp, Homo sapiens
cacagtgggccggccccagg

SEQ ID NO: 5855893 - DNA, 19 bp, Homo sapiens
cacagtgggcctgtgtgtg

SEQ ID NO: 5855894 - DNA, 22 bp, Homo sapiens
cacagtgggcctgtgtgtgtgc

SEQ ID NO: 5855895 - DNA, 19 bp, Homo sapiens
cacagtgggcggcttccct

SEQ ID NO: 5855896 - DNA, 20 bp, Homo sapiens
cacagtggggcccatggccc

SEQ ID NO: 5855897 - DNA, 18 bp, Homo sapiens
cacagtggggctgcaggc

SEQ ID NO: 5855898 - DNA, 20 bp, Homo sapiens
cacagtggggctgcaggcag

SEQ ID NO: 5855899 - DNA, 23 bp, Homo sapiens
cacagtggtcagcgattcctgcc

SEQ ID NO: 5855900 - DNA, 19 bp, Homo sapiens
cacagtgtaccattaaaat

SEQ ID NO: 5855901 - DNA, 22 bp, Homo sapiens
cacagtgtaccattaaaatatg

SEQ ID NO: 5855902 - DNA, 17 bp, Homo sapiens
cacagtgtcaggcactg

SEQ ID NO: 5855903 - DNA, 13 bp, Homo sapiens
cacagtgtctggg

SEQ ID NO: 5855904 - DNA, 20 bp, Homo sapiens
cacagtgtctgtaaatcaag

SEQ ID NO: 5855905 - DNA, 21 bp, Homo sapiens
cacagtgtctgtaaatcaaga

SEQ ID NO: 5855906 - DNA, 20 bp, Homo sapiens
cacagtgtctgttcagcaaa

SEQ ID NO: 5855907 - DNA, 13 bp, Homo sapiens
cacagtgtgaata

SEQ ID NO: 5855908 - DNA, 15 bp, Homo sapiens
cacagtgtgtgaact

SEQ ID NO: 5855909 - DNA, 23 bp, Homo sapiens
cacagtgttaaatgaaattgtaa

SEQ ID NO: 5855910 - DNA, 10 bp, Homo sapiens
cacagtgttt

SEQ ID NO: 5855911 - DNA, 19 bp, Homo sapiens
cacagtgttttataggaga

SEQ ID NO: 5855912 - DNA, 22 bp, Homo sapiens
cacagtgtttttgtaaagtgtg

SEQ ID NO: 5855913 - DNA, 23 bp, Homo sapiens
cacagtgtttttgtaaagtgtgg

SEQ ID NO: 5855914 - DNA, 22 bp, Homo sapiens
cacagttaaataaatagaaaga

SEQ ID NO: 5855915 - DNA, 22 bp, Homo sapiens
cacagttcagtggcagggctca

SEQ ID NO: 5855916 - DNA, 23 bp, Homo sapiens
cacagttccacaattttgtctct

SEQ ID NO: 5855917 - DNA, 16 bp, Homo sapiens
cacagttcctctttgt

SEQ ID NO: 5855918 - DNA, 14 bp, Homo sapiens
cacagttcctggga

SEQ ID NO: 5855919 - DNA, 17 bp, Homo sapiens
cacagttccttgcatgt

SEQ ID NO: 5855920 - DNA, 18 bp, Homo sapiens
cacagttctttgggccag

SEQ ID NO: 5855921 - DNA, 21 bp, Homo sapiens
cacagttctttgggccagaca

SEQ ID NO: 5855922 - DNA, 15 bp, Homo sapiens
cacagttgaccctat

SEQ ID NO: 5855923 - DNA, 17 bp, Homo sapiens
cacagttgccaccacct

SEQ ID NO: 5855924 - DNA, 20 bp, Homo sapiens
cacagttgccaccacctctg

SEQ ID NO: 5855925 - DNA, 22 bp, Homo sapiens
cacagttgccaccacctctgtg

SEQ ID NO: 5855926 - DNA, 18 bp, Homo sapiens
cacagttgctctatgctt

SEQ ID NO: 5855927 - DNA, 20 bp, Homo sapiens
cacagttggcccgggtgcag

SEQ ID NO: 5855928 - DNA, 15 bp, Homo sapiens
cacagttggccttca

SEQ ID NO: 5855929 - DNA, 23 bp, Homo sapiens
cacagttggccttcagaaccatc

SEQ ID NO: 5855930 - DNA, 17 bp, Homo sapiens
cacagttggctggatga

SEQ ID NO: 5855931 - DNA, 23 bp, Homo sapiens
cacagttgtctattctgagcctt

SEQ ID NO: 5855932 - DNA, 24 bp, Homo sapiens
cacagttgtctattctgagccttg

SEQ ID NO: 5855933 - DNA, 14 bp, Homo sapiens
cacagttgtgttca

SEQ ID NO: 5855934 - DNA, 21 bp, Homo sapiens
cacagttgttgaatgactgac

SEQ ID NO: 5855935 - DNA, 13 bp, Homo sapiens
cacagttgtttca

SEQ ID NO: 5855936 - DNA, 19 bp, Homo sapiens
cacagtttacccagcatga

SEQ ID NO: 5855937 - DNA, 20 bp, Homo sapiens
cacagtttagtgctttacat

SEQ ID NO: 5855938 - DNA, 21 bp, Homo sapiens
cacagtttcaggcttttatga

SEQ ID NO: 5855939 - DNA, 12 bp, Homo sapiens
cacagtttcatt

SEQ ID NO: 5855940 - DNA, 19 bp, Homo sapiens
cacagtttctattgtaaat

SEQ ID NO: 5855941 - DNA, 13 bp, Homo sapiens
cacagtttgaaat

SEQ ID NO: 5855942 - DNA, 16 bp, Homo sapiens
cacagtttgagaccag

SEQ ID NO: 5855943 - DNA, 19 bp, Homo sapiens
cacagtttgagaccagcct

SEQ ID NO: 5855944 - DNA, 21 bp, Homo sapiens
cacagtttgagaccagcctgg

SEQ ID NO: 5855945 - DNA, 20 bp, Homo sapiens
cacagtttgatgtcattaat

SEQ ID NO: 5855946 - DNA, 14 bp, Homo sapiens
cacagtttgcaatc

SEQ ID NO: 5855947 - DNA, 19 bp, Homo sapiens
cacagtttgctatttgctt

SEQ ID NO: 5855948 - DNA, 22 bp, Homo sapiens
cacagtttgctatttgctttag

SEQ ID NO: 5855949 - DNA, 12 bp, Homo sapiens
cacagtttgttc

SEQ ID NO: 5855950 - DNA, 18 bp, Homo sapiens
cacagttttaataagaac

SEQ ID NO: 5855951 - DNA, 22 bp, Homo sapiens
cacagttttagaataaggagga

SEQ ID NO: 5855952 - DNA, 23 bp, Homo sapiens
cacagtttttgtaaagcccttgc

SEQ ID NO: 5855953 - DNA, 20 bp, Homo sapiens
cacataaaaaagaagcactt

SEQ ID NO: 5855954 - DNA, 22 bp, Homo sapiens
cacataaaacgtatagtcaata

SEQ ID NO: 5855955 - DNA, 12 bp, Homo sapiens
cacataaaactt

SEQ ID NO: 5855956 - DNA, 16 bp, Homo sapiens
cacataaaagccccag

SEQ ID NO: 5855957 - DNA, 18 bp, Homo sapiens
cacataaaagccccagct

SEQ ID NO: 5855958 - DNA, 20 bp, Homo sapiens
cacataaaagccccagcttg

SEQ ID NO: 5855959 - DNA, 20 bp, Homo sapiens
cacataaacacttctcctta

SEQ ID NO: 5855960 - DNA, 23 bp, Homo sapiens
cacataaacacttctccttaacc

SEQ ID NO: 5855961 - DNA, 10 bp, Homo sapiens
cacataaagg

SEQ ID NO: 5855962 - DNA, 13 bp, Homo sapiens
cacataaatctgt

SEQ ID NO: 5855963 - DNA, 13 bp, Homo sapiens
cacataaatgaaa

SEQ ID NO: 5855964 - DNA, 17 bp, Homo sapiens
cacataaatgcagccca

SEQ ID NO: 5855965 - DNA, 12 bp, Homo sapiens
cacataaatgct

SEQ ID NO: 5855966 - DNA, 16 bp, Homo sapiens
cacataaattttaatt

SEQ ID NO: 5855967 - DNA, 13 bp, Homo sapiens
cacataacagaat

SEQ ID NO: 5855968 - DNA, 18 bp, Homo sapiens
cacataactggattttga

SEQ ID NO: 5855969 - DNA, 15 bp, Homo sapiens
cacataagagagatg

SEQ ID NO: 5855970 - DNA, 14 bp, Homo sapiens
cacataagcactag

SEQ ID NO: 5855971 - DNA, 19 bp, Homo sapiens
cacataagccaaaactgag

SEQ ID NO: 5855972 - DNA, 14 bp, Homo sapiens
cacataagttttct

SEQ ID NO: 5855973 - DNA, 15 bp, Homo sapiens
cacataagttttctc

SEQ ID NO: 5855974 - DNA, 23 bp, Homo sapiens
cacataatacattccatcacagc

SEQ ID NO: 5855975 - DNA, 18 bp, Homo sapiens
cacataattaaagtgtcc

SEQ ID NO: 5855976 - DNA, 15 bp, Homo sapiens
cacataattaacact

SEQ ID NO: 5855977 - DNA, 18 bp, Homo sapiens
cacataattccagtcaca

SEQ ID NO: 5855978 - DNA, 14 bp, Homo sapiens
cacataatttctgt

SEQ ID NO: 5855979 - DNA, 16 bp, Homo sapiens
cacataatttctgttt

SEQ ID NO: 5855980 - DNA, 14 bp, Homo sapiens
cacataatttgcat

SEQ ID NO: 5855981 - DNA, 14 bp, Homo sapiens
cacataatttttct

SEQ ID NO: 5855982 - DNA, 15 bp, Homo sapiens
cacataatttttgta

SEQ ID NO: 5855983 - DNA, 19 bp, Homo sapiens
cacataatttttgtacatc

SEQ ID NO: 5855984 - DNA, 19 bp, Homo sapiens
cacatacaaaaaaaatctt

SEQ ID NO: 5855985 - DNA, 21 bp, Homo sapiens
cacatacaacttcatataact

SEQ ID NO: 5855986 - DNA, 14 bp, Homo sapiens
cacatacacacaca

SEQ ID NO: 5855987 - DNA, 15 bp, Homo sapiens
cacatacactgcatt

SEQ ID NO: 5855988 - DNA, 15 bp, Homo sapiens
cacatacaggtgctc

SEQ ID NO: 5855989 - DNA, 17 bp, Homo sapiens
cacatacaggtgctcaa

SEQ ID NO: 5855990 - DNA, 16 bp, Homo sapiens
cacatacatacacata

SEQ ID NO: 5855991 - DNA, 20 bp, Homo sapiens
cacatacatacacatacata

SEQ ID NO: 5855992 - DNA, 22 bp, Homo sapiens
cacatacatacacatacataca

SEQ ID NO: 5855993 - DNA, 13 bp, Homo sapiens
cacatacatacat

SEQ ID NO: 5855994 - DNA, 17 bp, Homo sapiens
cacatacatacatacat

SEQ ID NO: 5855995 - DNA, 14 bp, Homo sapiens
cacatacatatata

SEQ ID NO: 5855996 - DNA, 18 bp, Homo sapiens
cacataccagagtctgga

SEQ ID NO: 5855997 - DNA, 21 bp, Homo sapiens
cacataccaggcaacctccca

SEQ ID NO: 5855998 - DNA, 20 bp, Homo sapiens
cacataccatgtggatgcag

SEQ ID NO: 5855999 - DNA, 22 bp, Homo sapiens
cacataccatgtggatgcagca

SEQ ID NO: 5856000 - DNA, 15 bp, Homo sapiens
cacataccctccccc

SEQ ID NO: 5856001 - DNA, 22 bp, Homo sapiens
cacatacgcagggggaaggctt

SEQ ID NO: 5856002 - DNA, 16 bp, Homo sapiens
cacatacgtgcacagg

SEQ ID NO: 5856003 - DNA, 20 bp, Homo sapiens
cacatacgtgttaggaggct

SEQ ID NO: 5856004 - DNA, 19 bp, Homo sapiens
cacatactcatttttcatg

SEQ ID NO: 5856005 - DNA, 20 bp, Homo sapiens
cacatactgacttcagtggg

SEQ ID NO: 5856006 - DNA, 22 bp, Homo sapiens
cacatactgcggaccaagggac

SEQ ID NO: 5856007 - DNA, 11 bp, Homo sapiens
cacatactgtc

SEQ ID NO: 5856008 - DNA, 16 bp, Homo sapiens
cacatactgtgttcca

SEQ ID NO: 5856009 - DNA, 21 bp, Homo sapiens
cacatagactttatgcaataa

SEQ ID NO: 5856010 - DNA, 17 bp, Homo sapiens
cacatagagctttttaa

SEQ ID NO: 5856011 - DNA, 21 bp, Homo sapiens
cacatagattaatggcactga

SEQ ID NO: 5856012 - DNA, 22 bp, Homo sapiens
cacatagattaatggcactgat

SEQ ID NO: 5856013 - DNA, 14 bp, Homo sapiens
cacatagattcacc

SEQ ID NO: 5856014 - DNA, 14 bp, Homo sapiens
cacatagcataggc

SEQ ID NO: 5856015 - DNA, 19 bp, Homo sapiens
cacatagcataggctgggg

SEQ ID NO: 5856016 - DNA, 17 bp, Homo sapiens
cacatagcatgcttcct

SEQ ID NO: 5856017 - DNA, 23 bp, Homo sapiens
cacatagcatgcttcctttctct

SEQ ID NO: 5856018 - DNA, 15 bp, Homo sapiens
cacatagccaactct

SEQ ID NO: 5856019 - DNA, 17 bp, Homo sapiens
cacatagcccacttaca

SEQ ID NO: 5856020 - DNA, 22 bp, Homo sapiens
cacatagccctgttgacctgcc

SEQ ID NO: 5856021 - DNA, 19 bp, Homo sapiens
cacatagcgccgtgctgta

SEQ ID NO: 5856022 - DNA, 22 bp, Homo sapiens
cacatagctacccaaaagagaa

SEQ ID NO: 5856023 - DNA, 23 bp, Homo sapiens
cacatagctacccaaaagagaaa

SEQ ID NO: 5856024 - DNA, 13 bp, Homo sapiens
cacatagctgtct

SEQ ID NO: 5856025 - DNA, 18 bp, Homo sapiens
cacataggctggtggcct

SEQ ID NO: 5856026 - DNA, 21 bp, Homo sapiens
cacatagtgggccttcattaa

SEQ ID NO: 5856027 - DNA, 21 bp, Homo sapiens
caccacctgacggctggggac

SEQ ID NO: 5856028 - DNA, 11 bp, Homo sapiens
caccacctgcc

SEQ ID NO: 5856029 - DNA, 14 bp, Homo sapiens
caccacctgcctct

SEQ ID NO: 5856030 - DNA, 17 bp, Homo sapiens
caccacctgctcactgg

SEQ ID NO: 5856031 - DNA, 13 bp, Homo sapiens
caccacctggagt

SEQ ID NO: 5856032 - DNA, 20 bp, Homo sapiens
caccaccttatacatcactt

SEQ ID NO: 5856033 - DNA, 13 bp, Homo sapiens
caccaccttccca

SEQ ID NO: 5856034 - DNA, 18 bp, Homo sapiens
caccaccttcccagctct

SEQ ID NO: 5856035 - DNA, 20 bp, Homo sapiens
caccaccttggactcctccc

SEQ ID NO: 5856036 - DNA, 19 bp, Homo sapiens
caccacgatgtggccctgg

SEQ ID NO: 5856037 - DNA, 20 bp, Homo sapiens
caccacgatgtggccctggc

SEQ ID NO: 5856038 - DNA, 14 bp, Homo sapiens
caccacgcccggct

SEQ ID NO: 5856039 - DNA, 15 bp, Homo sapiens
caccacgcctggcta

SEQ ID NO: 5856040 - DNA, 13 bp, Homo sapiens
caccacggccaga

SEQ ID NO: 5856041 - DNA, 17 bp, Homo sapiens
caccacggctcactgca

SEQ ID NO: 5856042 - DNA, 15 bp, Homo sapiens
caccacgtccagctg

SEQ ID NO: 5856043 - DNA, 11 bp, Homo sapiens
caccacgtctg

SEQ ID NO: 5856044 - DNA, 19 bp, Homo sapiens
caccacgtctggctccctg

SEQ ID NO: 5856045 - DNA, 15 bp, Homo sapiens
caccacgtgcagtat

SEQ ID NO: 5856046 - DNA, 16 bp, Homo sapiens
caccactaaccatccc

SEQ ID NO: 5856047 - DNA, 22 bp, Homo sapiens
caccactaaccatccccaactc

SEQ ID NO: 5856048 - DNA, 17 bp, Homo sapiens
caccactacattctgtt

SEQ ID NO: 5856049 - DNA, 19 bp, Homo sapiens
caccactacattctgttaa

SEQ ID NO: 5856050 - DNA, 20 bp, Homo sapiens
caccactacattctgttaat

SEQ ID NO: 5856051 - DNA, 18 bp, Homo sapiens
caccactaccagccagcc

SEQ ID NO: 5856052 - DNA, 20 bp, Homo sapiens
caccactaggaatcccagag

SEQ ID NO: 5856053 - DNA, 13 bp, Homo sapiens
caccactagggtc

SEQ ID NO: 5856054 - DNA, 21 bp, Homo sapiens
caccactataaaatgtcttca

SEQ ID NO: 5856055 - DNA, 22 bp, Homo sapiens
caccactatagtgtaataatgt

SEQ ID NO: 5856056 - DNA, 22 bp, Homo sapiens
caccactcaaaggccagacctg

SEQ ID NO: 5856057 - DNA, 11 bp, Homo sapiens
caccactcagg

SEQ ID NO: 5856058 - DNA, 16 bp, Homo sapiens
caccactcaggccaca

SEQ ID NO: 5856059 - DNA, 14 bp, Homo sapiens
caccactccactcc

SEQ ID NO: 5856060 - DNA, 14 bp, Homo sapiens
caccactccattcc

SEQ ID NO: 5856061 - DNA, 12 bp, Homo sapiens
caccactcctct

SEQ ID NO: 5856062 - DNA, 13 bp, Homo sapiens
caccactcctgcc

SEQ ID NO: 5856063 - DNA, 14 bp, Homo sapiens
caccactcctgcca

SEQ ID NO: 5856064 - DNA, 17 bp, Homo sapiens
caccactcctgccagcc

SEQ ID NO: 5856065 - DNA, 14 bp, Homo sapiens
caccactcctgcct

SEQ ID NO: 5856066 - DNA, 16 bp, Homo sapiens
caccactcctgcctgc

SEQ ID NO: 5856067 - DNA, 15 bp, Homo sapiens
caccactctggcagc

SEQ ID NO: 5856068 - DNA, 14 bp, Homo sapiens
caccactctgggca

SEQ ID NO: 5856069 - DNA, 16 bp, Homo sapiens
caccactgagctctgc

SEQ ID NO: 5856070 - DNA, 20 bp, Homo sapiens
caccactgagctctgcctca

SEQ ID NO: 5856071 - DNA, 16 bp, Homo sapiens
caccactgcactccag

SEQ ID NO: 5856072 - DNA, 19 bp, Homo sapiens
caccactgcactccagcct

SEQ ID NO: 5856073 - DNA, 12 bp, Homo sapiens
caccactgcagc

SEQ ID NO: 5856074 - DNA, 23 bp, Homo sapiens
caccactgccccctgctgccatg

SEQ ID NO: 5856075 - DNA, 14 bp, Homo sapiens
caccactgccctgc

SEQ ID NO: 5856076 - DNA, 20 bp, Homo sapiens
caccactgccctgcctgccc

SEQ ID NO: 5856077 - DNA, 14 bp, Homo sapiens
caccactgcctgac

SEQ ID NO: 5856078 - DNA, 13 bp, Homo sapiens
caccactgctgag

SEQ ID NO: 5856079 - DNA, 16 bp, Homo sapiens
caccactgctgaggag

SEQ ID NO: 5856080 - DNA, 19 bp, Homo sapiens
caccactgctgaggagtct

SEQ ID NO: 5856081 - DNA, 15 bp, Homo sapiens
caccactgcttccca

SEQ ID NO: 5856082 - DNA, 18 bp, Homo sapiens
caccactgcttcccactg

SEQ ID NO: 5856083 - DNA, 13 bp, Homo sapiens
caccactggaagc

SEQ ID NO: 5856084 - DNA, 24 bp, Homo sapiens
caccactggaagcaggatggagct

SEQ ID NO: 5856085 - DNA, 13 bp, Homo sapiens
caccactggccac

SEQ ID NO: 5856086 - DNA, 14 bp, Homo sapiens
caccactggccacc

SEQ ID NO: 5856087 - DNA, 18 bp, Homo sapiens
caccactggccaccaggc

SEQ ID NO: 5856088 - DNA, 14 bp, Homo sapiens
caccactgggaacc

SEQ ID NO: 5856089 - DNA, 23 bp, Homo sapiens
caccactgtgctcaaccagacag

SEQ ID NO: 5856090 - DNA, 12 bp, Homo sapiens
caccactgtgtc

SEQ ID NO: 5856091 - DNA, 16 bp, Homo sapiens
caccactgttgccttt

SEQ ID NO: 5856092 - DNA, 22 bp, Homo sapiens
caccacttatttattgttgcct

SEQ ID NO: 5856093 - DNA, 16 bp, Homo sapiens
caccacttccagagcc

SEQ ID NO: 5856094 - DNA, 13 bp, Homo sapiens
caccacttcctct

SEQ ID NO: 5856095 - DNA, 15 bp, Homo sapiens
caccacttcctctgt

SEQ ID NO: 5856096 - DNA, 16 bp, Homo sapiens
caccacttcttttata

SEQ ID NO: 5856097 - DNA, 21 bp, Homo sapiens
caccacttgtccattgcgtta

SEQ ID NO: 5856098 - DNA, 21 bp, Homo sapiens
caccactttgtaaaaggactc

SEQ ID NO: 5856099 - DNA, 19 bp, Homo sapiens
caccagaagatgtgaaatt

SEQ ID NO: 5856100 - DNA, 13 bp, Homo sapiens
caccagaagccca

SEQ ID NO: 5856101 - DNA, 14 bp, Homo sapiens
caccagaagcccag

SEQ ID NO: 5856102 - DNA, 19 bp, Homo sapiens
caccagaaggatgcctctg

SEQ ID NO: 5856103 - DNA, 22 bp, Homo sapiens
caccagaattagtcctcacagc

SEQ ID NO: 5856104 - DNA, 18 bp, Homo sapiens
caccagaattgtgcaaat

SEQ ID NO: 5856105 - DNA, 20 bp, Homo sapiens
caccagacacccaggactta

SEQ ID NO: 5856106 - DNA, 21 bp, Homo sapiens
caccagacccacctggagccc

SEQ ID NO: 5856107 - DNA, 23 bp, Homo sapiens
caccagacccacctggagcccgc

SEQ ID NO: 5856108 - DNA, 15 bp, Homo sapiens
caccagacctgttct

SEQ ID NO: 5856109 - DNA, 21 bp, Homo sapiens
caccagacctgttctgacctc

SEQ ID NO: 5856110 - DNA, 16 bp, Homo sapiens
caccagacggggctgg

SEQ ID NO: 5856111 - DNA, 19 bp, Homo sapiens
caccagacgtcaggccctg

SEQ ID NO: 5856112 - DNA, 18 bp, Homo sapiens
caccagacttggcctcca

SEQ ID NO: 5856113 - DNA, 15 bp, Homo sapiens
caccagagacaagca

SEQ ID NO: 5856114 - DNA, 11 bp, Homo sapiens
caccagagacc

SEQ ID NO: 5856115 - DNA, 22 bp, Homo sapiens
caccagagcaacctctcactcc

SEQ ID NO: 5856116 - DNA, 18 bp, Homo sapiens
caccagagcagatgcaga

SEQ ID NO: 5856117 - DNA, 20 bp, Homo sapiens
caccagagcagatgcagaga

SEQ ID NO: 5856118 - DNA, 19 bp, Homo sapiens
caccagagcaggggctgct

SEQ ID NO: 5856119 - DNA, 21 bp, Homo sapiens
caccagagcaggggctgctgg

SEQ ID NO: 5856120 - DNA, 22 bp, Homo sapiens
caccagagcaggggctgctggg

SEQ ID NO: 5856121 - DNA, 15 bp, Homo sapiens
caccagagcccacct

SEQ ID NO: 5856122 - DNA, 17 bp, Homo sapiens
caccagagcccaccttg

SEQ ID NO: 5856123 - DNA, 18 bp, Homo sapiens
caccagagcccaccttgg

SEQ ID NO: 5856124 - DNA, 20 bp, Homo sapiens
caccagagcccaccttggct

SEQ ID NO: 5856125 - DNA, 16 bp, Homo sapiens
caccagagcccatgct

SEQ ID NO: 5856126 - DNA, 13 bp, Homo sapiens
caccagagccggg

SEQ ID NO: 5856127 - DNA, 23 bp, Homo sapiens
caccagagcctccctcagccacg

SEQ ID NO: 5856128 - DNA, 11 bp, Homo sapiens
caccagagctg

SEQ ID NO: 5856129 - DNA, 17 bp, Homo sapiens
caccagagctgcctccc

SEQ ID NO: 5856130 - DNA, 19 bp, Homo sapiens
caccagagctgcctcccca

SEQ ID NO: 5856131 - DNA, 23 bp, Homo sapiens
caccagagctgcctccccaatcc

SEQ ID NO: 5856132 - DNA, 16 bp, Homo sapiens
caccagagcttctctg

SEQ ID NO: 5856133 - DNA, 22 bp, Homo sapiens
caccagagcttctctgggctga

SEQ ID NO: 5856134 - DNA, 17 bp, Homo sapiens
caccagaggtcaggagt

SEQ ID NO: 5856135 - DNA, 15 bp, Homo sapiens
caccagagtgtatgc

SEQ ID NO: 5856136 - DNA, 17 bp, Homo sapiens
caccagatgagaagtta

SEQ ID NO: 5856137 - DNA, 23 bp, Homo sapiens
caccagatgcaacctcactatgg

SEQ ID NO: 5856138 - DNA, 21 bp, Homo sapiens
caccagatgggatgggctttc

SEQ ID NO: 5856139 - DNA, 20 bp, Homo sapiens
caccagcaaggggaccccga

SEQ ID NO: 5856140 - DNA, 16 bp, Homo sapiens
caccagcaatgccctg

SEQ ID NO: 5856141 - DNA, 16 bp, Homo sapiens
caccagcagcacaatt

SEQ ID NO: 5856142 - DNA, 14 bp, Homo sapiens
caccagcagcctgg

SEQ ID NO: 5856143 - DNA, 14 bp, Homo sapiens
caccagcaggcagg

SEQ ID NO: 5856144 - DNA, 15 bp, Homo sapiens
caccagcatcacctg

SEQ ID NO: 5856145 - DNA, 20 bp, Homo sapiens
caccagcatgtcactcccag

SEQ ID NO: 5856146 - DNA, 13 bp, Homo sapiens
caccagccagccc

SEQ ID NO: 5856147 - DNA, 16 bp, Homo sapiens
caccagccagccctgg

SEQ ID NO: 5856148 - DNA, 17 bp, Homo sapiens
caccagccagccctggc

SEQ ID NO: 5856149 - DNA, 18 bp, Homo sapiens
caccagccagccctggcc

SEQ ID NO: 5856150 - DNA, 20 bp, Homo sapiens
caccagccagccctggccca

SEQ ID NO: 5856151 - DNA, 16 bp, Homo sapiens
caccagccaggctctg

SEQ ID NO: 5856152 - DNA, 21 bp, Homo sapiens
caccagccaggctctgtgctg

SEQ ID NO: 5856153 - DNA, 20 bp, Homo sapiens
caccagcccacatccagtgg

SEQ ID NO: 5856154 - DNA, 12 bp, Homo sapiens
caccagccccac

SEQ ID NO: 5856155 - DNA, 20 bp, Homo sapiens
caccagccccactgccagca

SEQ ID NO: 5856156 - DNA, 16 bp, Homo sapiens
caccagccccagcaag

SEQ ID NO: 5856157 - DNA, 16 bp, Homo sapiens
caccagccccctggat

SEQ ID NO: 5856158 - DNA, 20 bp, Homo sapiens
caccagccccctggatgggc

SEQ ID NO: 5856159 - DNA, 13 bp, Homo sapiens
caccagcccctgc

SEQ ID NO: 5856160 - DNA, 14 bp, Homo sapiens
caccagcccctgcc

SEQ ID NO: 5856161 - DNA, 21 bp, Homo sapiens
caccagcccctgccccagccc

SEQ ID NO: 5856162 - DNA, 15 bp, Homo sapiens
caccagcccggcctg

SEQ ID NO: 5856163 - DNA, 17 bp, Homo sapiens
caccagcccggcctgct

SEQ ID NO: 5856164 - DNA, 16 bp, Homo sapiens
caccagccctgagcca

SEQ ID NO: 5856165 - DNA, 14 bp, Homo sapiens
caccagccctgcag

SEQ ID NO: 5856166 - DNA, 16 bp, Homo sapiens
caccagccctgcagcc

SEQ ID NO: 5856167 - DNA, 20 bp, Homo sapiens
caccagccctggtggccaag

SEQ ID NO: 5856168 - DNA, 21 bp, Homo sapiens
caccagcccttagcagggaaa

SEQ ID NO: 5856169 - DNA, 17 bp, Homo sapiens
caccagccgccccagcc

SEQ ID NO: 5856170 - DNA, 19 bp, Homo sapiens
caccagccgccccagcccc

SEQ ID NO: 5856171 - DNA, 14 bp, Homo sapiens
caccagccgctgca

SEQ ID NO: 5856172 - DNA, 23 bp, Homo sapiens
caccagccgctgcagggctccca

SEQ ID NO: 5856173 - DNA, 14 bp, Homo sapiens
caccagcctaagaa

SEQ ID NO: 5856174 - DNA, 19 bp, Homo sapiens
caccagcctcagtgcagcc

SEQ ID NO: 5856175 - DNA, 20 bp, Homo sapiens
caccagcctcagtgcagccc

SEQ ID NO: 5856176 - DNA, 11 bp, Homo sapiens
caccagcctga

SEQ ID NO: 5856177 - DNA, 16 bp, Homo sapiens
caccagcctgactgca

SEQ ID NO: 5856178 - DNA, 13 bp, Homo sapiens
caccagcctgagc

SEQ ID NO: 5856179 - DNA, 21 bp, Homo sapiens
caccagcctggtgcccatcct

SEQ ID NO: 5856180 - DNA, 23 bp, Homo sapiens
caccagcctggtgcccatcctcc

SEQ ID NO: 5856181 - DNA, 11 bp, Homo sapiens
caccagccttg

SEQ ID NO: 5856182 - DNA, 22 bp, Homo sapiens
caccagccttgaactgtggcca

SEQ ID NO: 5856183 - DNA, 23 bp, Homo sapiens
caccagccttgaactgtggccac

SEQ ID NO: 5856184 - DNA, 19 bp, Homo sapiens
caccagccttgctctcttc

SEQ ID NO: 5856185 - DNA, 22 bp, Homo sapiens
caccagccttgctctcttcaat

SEQ ID NO: 5856186 - DNA, 16 bp, Homo sapiens
caccagccttggtgcc

SEQ ID NO: 5856187 - DNA, 20 bp, Homo sapiens
caccagcctttctcccaggc

SEQ ID NO: 5856188 - DNA, 21 bp, Homo sapiens
caccagcgcccccactcctcc

SEQ ID NO: 5856189 - DNA, 18 bp, Homo sapiens
caccagcggccttgaaga

SEQ ID NO: 5856190 - DNA, 13 bp, Homo sapiens
caccagctcagcc

SEQ ID NO: 5856191 - DNA, 14 bp, Homo sapiens
caccagctcagccc

SEQ ID NO: 5856192 - DNA, 15 bp, Homo sapiens
caccagctccacaca

SEQ ID NO: 5856193 - DNA, 15 bp, Homo sapiens
caccagctcctccct

SEQ ID NO: 5856194 - DNA, 17 bp, Homo sapiens
caccagctcctcccttg

SEQ ID NO: 5856195 - DNA, 11 bp, Homo sapiens
caccagctcgt

SEQ ID NO: 5856196 - DNA, 11 bp, Homo sapiens
caccagctctg

SEQ ID NO: 5856197 - DNA, 14 bp, Homo sapiens
caccagctctgtgg

SEQ ID NO: 5856198 - DNA, 18 bp, Homo sapiens
caccagctctgtggcctg

SEQ ID NO: 5856199 - DNA, 19 bp, Homo sapiens
caccagctctgtggcctgt

SEQ ID NO: 5856200 - DNA, 21 bp, Homo sapiens
caccagctctgtggcctgtgt

SEQ ID NO: 5856201 - DNA, 14 bp, Homo sapiens
caccagctgcaaag

SEQ ID NO: 5856202 - DNA, 12 bp, Homo sapiens
caccagctgcag

SEQ ID NO: 5856203 - DNA, 16 bp, Homo sapiens
caccagctgctctgcc

SEQ ID NO: 5856204 - DNA, 12 bp, Homo sapiens
caccagctgctg

SEQ ID NO: 5856205 - DNA, 15 bp, Homo sapiens
caccagctggctctg

SEQ ID NO: 5856206 - DNA, 15 bp, Homo sapiens
cacccagaccctcct

SEQ ID NO: 5856207 - DNA, 20 bp, Homo sapiens
cacccagactggagtgcagt

SEQ ID NO: 5856208 - DNA, 15 bp, Homo sapiens
cacccagagcacccc

SEQ ID NO: 5856209 - DNA, 14 bp, Homo sapiens
cacccagagctgcc

SEQ ID NO: 5856210 - DNA, 16 bp, Homo sapiens
cacccagagctgccta

SEQ ID NO: 5856211 - DNA, 19 bp, Homo sapiens
cacccagaggtggccctcc

SEQ ID NO: 5856212 - DNA, 16 bp, Homo sapiens
cacccagatcaggaac

SEQ ID NO: 5856213 - DNA, 17 bp, Homo sapiens
cacccagatcaggaacc

SEQ ID NO: 5856214 - DNA, 20 bp, Homo sapiens
cacccagatgcccctttctg

SEQ ID NO: 5856215 - DNA, 21 bp, Homo sapiens
cacccagcaaggcacaggctc

SEQ ID NO: 5856216 - DNA, 12 bp, Homo sapiens
cacccagcaccc

SEQ ID NO: 5856217 - DNA, 16 bp, Homo sapiens
cacccagcaccttgca

SEQ ID NO: 5856218 - DNA, 17 bp, Homo sapiens
cacccagcagaaataca

SEQ ID NO: 5856219 - DNA, 19 bp, Homo sapiens
cacccagcagcgcccgagg

SEQ ID NO: 5856220 - DNA, 14 bp, Homo sapiens
cacccagccagctc

SEQ ID NO: 5856221 - DNA, 10 bp, Homo sapiens
cacccagccc

SEQ ID NO: 5856222 - DNA, 12 bp, Homo sapiens
cacccagcccac

SEQ ID NO: 5856223 - DNA, 20 bp, Homo sapiens
cacccagcccactaactgag

SEQ ID NO: 5856224 - DNA, 16 bp, Homo sapiens
cacccagcccacttct

SEQ ID NO: 5856225 - DNA, 17 bp, Homo sapiens
cacccagcccacttctg

SEQ ID NO: 5856226 - DNA, 13 bp, Homo sapiens
cacccagccccag

SEQ ID NO: 5856227 - DNA, 19 bp, Homo sapiens
cacccagccccagccaggg

SEQ ID NO: 5856228 - DNA, 23 bp, Homo sapiens
cacccagccccagcgagtctgga

SEQ ID NO: 5856229 - DNA, 15 bp, Homo sapiens
cacccagcccttcct

SEQ ID NO: 5856230 - DNA, 18 bp, Homo sapiens
cacccagcccttccttgg

SEQ ID NO: 5856231 - DNA, 11 bp, Homo sapiens
cacccagcctc

SEQ ID NO: 5856232 - DNA, 15 bp, Homo sapiens
cacccagcctgtccc

SEQ ID NO: 5856233 - DNA, 20 bp, Homo sapiens
cacccagcctgtcccactgg

SEQ ID NO: 5856234 - DNA, 22 bp, Homo sapiens
cacccagcctgtcccactggct

SEQ ID NO: 5856235 - DNA, 14 bp, Homo sapiens
cacccagctcagca

SEQ ID NO: 5856236 - DNA, 13 bp, Homo sapiens
cacccagctccag

SEQ ID NO: 5856237 - DNA, 14 bp, Homo sapiens
cacccagctccagg

SEQ ID NO: 5856238 - DNA, 21 bp, Homo sapiens
cacccagctggtcctgtggat

SEQ ID NO: 5856239 - DNA, 19 bp, Homo sapiens
cacccagcttcaaagctta

SEQ ID NO: 5856240 - DNA, 17 bp, Homo sapiens
cacccaggaaaggagga

SEQ ID NO: 5856241 - DNA, 18 bp, Homo sapiens
cacccaggaactcctgac

SEQ ID NO: 5856242 - DNA, 11 bp, Homo sapiens
cacccaggaag

SEQ ID NO: 5856243 - DNA, 21 bp, Homo sapiens
cacccaggacctctgggggtt

SEQ ID NO: 5856244 - DNA, 16 bp, Homo sapiens
cacccaggagccccga

SEQ ID NO: 5856245 - DNA, 11 bp, Homo sapiens
cacccaggagg

SEQ ID NO: 5856246 - DNA, 22 bp, Homo sapiens
cacccaggcaatcttgccttct

SEQ ID NO: 5856247 - DNA, 14 bp, Homo sapiens
cacccaggcctccc

SEQ ID NO: 5856248 - DNA, 18 bp, Homo sapiens
cacccaggcctccctgca

SEQ ID NO: 5856249 - DNA, 22 bp, Homo sapiens
cacccaggctctggagccagag

SEQ ID NO: 5856250 - DNA, 23 bp, Homo sapiens
cacccaggctctggagccagaga

SEQ ID NO: 5856251 - DNA, 12 bp, Homo sapiens
cacccaggctgc

SEQ ID NO: 5856252 - DNA, 13 bp, Homo sapiens
cacccaggctgca

SEQ ID NO: 5856253 - DNA, 17 bp, Homo sapiens
cacccaggctgcactgc

SEQ ID NO: 5856254 - DNA, 19 bp, Homo sapiens
cacccaggctgcactgcag

SEQ ID NO: 5856255 - DNA, 21 bp, Homo sapiens
cacccaggctgcactgcagtg

SEQ ID NO: 5856256 - DNA, 18 bp, Homo sapiens
cacccaggctgcagtgca

SEQ ID NO: 5856257 - DNA, 20 bp, Homo sapiens
cacccaggctgcagtgcaat

SEQ ID NO: 5856258 - DNA, 13 bp, Homo sapiens
cacccaggctgga

SEQ ID NO: 5856259 - DNA, 14 bp, Homo sapiens
cacccaggctggag

SEQ ID NO: 5856260 - DNA, 20 bp, Homo sapiens
cacccaggctggagtacagt

SEQ ID NO: 5856261 - DNA, 23 bp, Homo sapiens
cacccaggctggagtgcagtggc

SEQ ID NO: 5856262 - DNA, 17 bp, Homo sapiens
cacccagggacactcca

SEQ ID NO: 5856263 - DNA, 21 bp, Homo sapiens
cacccagggacactccaactc

SEQ ID NO: 5856264 - DNA, 21 bp, Homo sapiens
cacccagggctccctcctgga

SEQ ID NO: 5856265 - DNA, 22 bp, Homo sapiens
cacccagggctccctcctggag

SEQ ID NO: 5856266 - DNA, 23 bp, Homo sapiens
cacccaggggaaggccctgaggc

SEQ ID NO: 5856267 - DNA, 23 bp, Homo sapiens
cacccagggtctagccgctgccc

SEQ ID NO: 5856268 - DNA, 23 bp, Homo sapiens
cacccaggtcccccgactgcctg

SEQ ID NO: 5856269 - DNA, 21 bp, Homo sapiens
cacccaggtctcttcctttgc

SEQ ID NO: 5856270 - DNA, 22 bp, Homo sapiens
cacccaggtctcttcctttgct

SEQ ID NO: 5856271 - DNA, 19 bp, Homo sapiens
cacccaggtgatttcctct

SEQ ID NO: 5856272 - DNA, 20 bp, Homo sapiens
cacccaggttggagtgcagt

SEQ ID NO: 5856273 - DNA, 18 bp, Homo sapiens
cacccagtccatgctcca

SEQ ID NO: 5856274 - DNA, 21 bp, Homo sapiens
cacccagtccatgctccaggg

SEQ ID NO: 5856275 - DNA, 14 bp, Homo sapiens
cacccagtccccac

SEQ ID NO: 5856276 - DNA, 17 bp, Homo sapiens
cacccagtcctctgcct

SEQ ID NO: 5856277 - DNA, 14 bp, Homo sapiens
cacccagtcctggc

SEQ ID NO: 5856278 - DNA, 15 bp, Homo sapiens
cacccagtcctggcc

SEQ ID NO: 5856279 - DNA, 18 bp, Homo sapiens
cacccagtctctgctcca

SEQ ID NO: 5856280 - DNA, 19 bp, Homo sapiens
cacccagtctctgctccac

SEQ ID NO: 5856281 - DNA, 17 bp, Homo sapiens
cacccagtctgttcccc

SEQ ID NO: 5856282 - DNA, 22 bp, Homo sapiens
cacccagtctgttgctgctcca

SEQ ID NO: 5856283 - DNA, 13 bp, Homo sapiens
cacccagtgctgc

SEQ ID NO: 5856284 - DNA, 15 bp, Homo sapiens
cacccagtgctgcca

SEQ ID NO: 5856285 - DNA, 18 bp, Homo sapiens
cacccagtgctgccatgc

SEQ ID NO: 5856286 - DNA, 18 bp, Homo sapiens
cacccagtggaaccaaaa

SEQ ID NO: 5856287 - DNA, 14 bp, Homo sapiens
cacccagtggaagg

SEQ ID NO: 5856288 - DNA, 16 bp, Homo sapiens
cacccagtgggaagag

SEQ ID NO: 5856289 - DNA, 22 bp, Homo sapiens
cacccagtttccttgggagttg

SEQ ID NO: 5856290 - DNA, 19 bp, Homo sapiens
cacccatagtgcacacttg

SEQ ID NO: 5856291 - DNA, 23 bp, Homo sapiens
cacccatagtgcttcacaaaatg

SEQ ID NO: 5856292 - DNA, 19 bp, Homo sapiens
cacccatatctgtgtgccc

SEQ ID NO: 5856293 - DNA, 22 bp, Homo sapiens
cacccatatctgtgtgccctag

SEQ ID NO: 5856294 - DNA, 16 bp, Homo sapiens
cacccatccctgtggt

SEQ ID NO: 5856295 - DNA, 19 bp, Homo sapiens
cacccatcctaggaaccag

SEQ ID NO: 5856296 - DNA, 20 bp, Homo sapiens
cacccatcgtccaccccagt

SEQ ID NO: 5856297 - DNA, 20 bp, Homo sapiens
cacccatctcactctcccca

SEQ ID NO: 5856298 - DNA, 11 bp, Homo sapiens
cacccatctgt

SEQ ID NO: 5856299 - DNA, 20 bp, Homo sapiens
cacccatcttcctgctgctg

SEQ ID NO: 5856300 - DNA, 21 bp, Homo sapiens
cacccatcttcctgctgctgt

SEQ ID NO: 5856301 - DNA, 19 bp, Homo sapiens
cacccatgaatcaaagaca

SEQ ID NO: 5856302 - DNA, 16 bp, Homo sapiens
cacccatgactgcccc

SEQ ID NO: 5856303 - DNA, 22 bp, Homo sapiens
cacccatgactgccccttgctt

SEQ ID NO: 5856304 - DNA, 17 bp, Homo sapiens
cacccatgcagctgctc

SEQ ID NO: 5856305 - DNA, 14 bp, Homo sapiens
cacccatgccagag

SEQ ID NO: 5856306 - DNA, 13 bp, Homo sapiens
cacccatgccagc

SEQ ID NO: 5856307 - DNA, 17 bp, Homo sapiens
cacccatgccagcgcag

SEQ ID NO: 5856308 - DNA, 13 bp, Homo sapiens
cacccatggcctc

SEQ ID NO: 5856309 - DNA, 15 bp, Homo sapiens
cacccatggcctcag

SEQ ID NO: 5856310 - DNA, 18 bp, Homo sapiens
cacccatggcctcagccc

SEQ ID NO: 5856311 - DNA, 21 bp, Homo sapiens
cacccatggcctcagccctgc

SEQ ID NO: 5856312 - DNA, 22 bp, Homo sapiens
cacccatggcctcagccctgct

SEQ ID NO: 5856313 - DNA, 18 bp, Homo sapiens
cacccatgggctctgaca

SEQ ID NO: 5856314 - DNA, 13 bp, Homo sapiens
cacccatggggag

SEQ ID NO: 5856315 - DNA, 13 bp, Homo sapiens
cacccatggtacc

SEQ ID NO: 5856316 - DNA, 20 bp, Homo sapiens
cacccatgtgggcgcccacc

SEQ ID NO: 5856317 - DNA, 22 bp, Homo sapiens
cacccatgttgagacctcagct

SEQ ID NO: 5856318 - DNA, 14 bp, Homo sapiens
cacccattatctgg

SEQ ID NO: 5856319 - DNA, 22 bp, Homo sapiens
cacccattcccccatgtggctg

SEQ ID NO: 5856320 - DNA, 15 bp, Homo sapiens
cacccattcttcccg

SEQ ID NO: 5856321 - DNA, 13 bp, Homo sapiens
cacccattgtctc

SEQ ID NO: 5856322 - DNA, 17 bp, Homo sapiens
cacccattgtctcattg

SEQ ID NO: 5856323 - DNA, 12 bp, Homo sapiens
cacccatttaaa

SEQ ID NO: 5856324 - DNA, 16 bp, Homo sapiens
cacccatttagtgggg

SEQ ID NO: 5856325 - DNA, 18 bp, Homo sapiens
cacccatttttccttttg

SEQ ID NO: 5856326 - DNA, 16 bp, Homo sapiens
caccccaaacttccag

SEQ ID NO: 5856327 - DNA, 18 bp, Homo sapiens
caccccaaagctttcctg

SEQ ID NO: 5856328 - DNA, 16 bp, Homo sapiens
caccccaacctgctct

SEQ ID NO: 5856329 - DNA, 21 bp, Homo sapiens
caccccaacctgctctcctct

SEQ ID NO: 5856330 - DNA, 22 bp, Homo sapiens
caccccaacctgctctcctctt

SEQ ID NO: 5856331 - DNA, 18 bp, Homo sapiens
caccccaacttggcagct

SEQ ID NO: 5856332 - DNA, 21 bp, Homo sapiens
caccccaacttggcagctttt

SEQ ID NO: 5856333 - DNA, 13 bp, Homo sapiens
caccccaatccct

SEQ ID NO: 5856334 - DNA, 16 bp, Homo sapiens
caccccaatccctgcc

SEQ ID NO: 5856335 - DNA, 16 bp, Homo sapiens
caccccaattaactga

SEQ ID NO: 5856336 - DNA, 15 bp, Homo sapiens
caccccacaccccag

SEQ ID NO: 5856337 - DNA, 19 bp, Homo sapiens
caccccacagactccggcc

SEQ ID NO: 5856338 - DNA, 12 bp, Homo sapiens
caccccacagat

SEQ ID NO: 5856339 - DNA, 15 bp, Homo sapiens
caccccacagctggg

SEQ ID NO: 5856340 - DNA, 10 bp, Homo sapiens
caccccaccc

SEQ ID NO: 5856341 - DNA, 14 bp, Homo sapiens
caccccacccacct

SEQ ID NO: 5856342 - DNA, 16 bp, Homo sapiens
caccccacccaccttt

SEQ ID NO: 5856343 - DNA, 19 bp, Homo sapiens
caccccaccctccctggag

SEQ ID NO: 5856344 - DNA, 14 bp, Homo sapiens
caccccacccttcc

SEQ ID NO: 5856345 - DNA, 16 bp, Homo sapiens
caccccacctccactc

SEQ ID NO: 5856346 - DNA, 16 bp, Homo sapiens
caccccacctcttcct

SEQ ID NO: 5856347 - DNA, 15 bp, Homo sapiens
caccccacctcttgt

SEQ ID NO: 5856348 - DNA, 16 bp, Homo sapiens
caccccacctgcgctt

SEQ ID NO: 5856349 - DNA, 19 bp, Homo sapiens
caccccacgccctgttcac

SEQ ID NO: 5856350 - DNA, 14 bp, Homo sapiens
caccccactccagc

SEQ ID NO: 5856351 - DNA, 17 bp, Homo sapiens
caccccactccagccct

SEQ ID NO: 5856352 - DNA, 12 bp, Homo sapiens
caccccactcct

SEQ ID NO: 5856353 - DNA, 16 bp, Homo sapiens
caccccactcctcagt

SEQ ID NO: 5856354 - DNA, 17 bp, Homo sapiens
caccccactcctgtcag

SEQ ID NO: 5856355 - DNA, 15 bp, Homo sapiens
caccccactctacct

SEQ ID NO: 5856356 - DNA, 14 bp, Homo sapiens
caccccactgagag

SEQ ID NO: 5856357 - DNA, 16 bp, Homo sapiens
caccccactgagagct

SEQ ID NO: 5856358 - DNA, 23 bp, Homo sapiens
caccccactgagagctgctcctt

SEQ ID NO: 5856359 - DNA, 17 bp, Homo sapiens
caccccagaaatcactg

SEQ ID NO: 5856360 - DNA, 20 bp, Homo sapiens
caccccagaatcccctgggg

SEQ ID NO: 5856361 - DNA, 14 bp, Homo sapiens
caccccagactcca

SEQ ID NO: 5856362 - DNA, 17 bp, Homo sapiens
caccccagactccaggc

SEQ ID NO: 5856363 - DNA, 11 bp, Homo sapiens
caccccagagc

SEQ ID NO: 5856364 - DNA, 19 bp, Homo sapiens
caccccagaggacacaggc

SEQ ID NO: 5856365 - DNA, 21 bp, Homo sapiens
caccccagaggacacaggcag

SEQ ID NO: 5856366 - DNA, 17 bp, Homo sapiens
caccccagaggccttgt

SEQ ID NO: 5856367 - DNA, 23 bp, Homo sapiens
caccccagagtgggagaggctgg

SEQ ID NO: 5856368 - DNA, 13 bp, Homo sapiens
caccccagagttg

SEQ ID NO: 5856369 - DNA, 23 bp, Homo sapiens
caccccagagttgggatgcgggg

SEQ ID NO: 5856370 - DNA, 17 bp, Homo sapiens
caccccagcacagccac

SEQ ID NO: 5856371 - DNA, 16 bp, Homo sapiens
caccccagcattccag

SEQ ID NO: 5856372 - DNA, 12 bp, Homo sapiens
caccccagccca

SEQ ID NO: 5856373 - DNA, 18 bp, Homo sapiens
caccccagcccaccctgc

SEQ ID NO: 5856374 - DNA, 12 bp, Homo sapiens
caccccagcccc

SEQ ID NO: 5856375 - DNA, 13 bp, Homo sapiens
caccccagcccca

SEQ ID NO: 5856376 - DNA, 13 bp, Homo sapiens
caccccagccccc

SEQ ID NO: 5856377 - DNA, 14 bp, Homo sapiens
caccccagccccca

SEQ ID NO: 5856378 - DNA, 21 bp, Homo sapiens
caccccagcccccacagccct

SEQ ID NO: 5856379 - DNA, 14 bp, Homo sapiens
caccccagccctcg

SEQ ID NO: 5856380 - DNA, 16 bp, Homo sapiens
caccccagcctcattg

SEQ ID NO: 5856381 - DNA, 16 bp, Homo sapiens
caccccagcctcgcct

SEQ ID NO: 5856382 - DNA, 17 bp, Homo sapiens
caccccagcctcgcctg

SEQ ID NO: 5856383 - DNA, 19 bp, Homo sapiens
caccccagcgtcaggccta

SEQ ID NO: 5856384 - DNA, 13 bp, Homo sapiens
caccccagctgct

SEQ ID NO: 5856385 - DNA, 12 bp, Homo sapiens
cacccttccctc

SEQ ID NO: 5856386 - DNA, 17 bp, Homo sapiens
cacccttccctgcctcc

SEQ ID NO: 5856387 - DNA, 21 bp, Homo sapiens
cacccttccctgcctccagct

SEQ ID NO: 5856388 - DNA, 23 bp, Homo sapiens
cacccttccctgcctccagctgt

SEQ ID NO: 5856389 - DNA, 20 bp, Homo sapiens
cacccttccgacaggagcac

SEQ ID NO: 5856390 - DNA, 15 bp, Homo sapiens
cacccttctcccact

SEQ ID NO: 5856391 - DNA, 16 bp, Homo sapiens
cacccttctcccactc

SEQ ID NO: 5856392 - DNA, 17 bp, Homo sapiens
cacccttctcccactct

SEQ ID NO: 5856393 - DNA, 17 bp, Homo sapiens
cacccttctcccctgcc

SEQ ID NO: 5856394 - DNA, 13 bp, Homo sapiens
cacccttctttcc

SEQ ID NO: 5856395 - DNA, 15 bp, Homo sapiens
cacccttctttcctc

SEQ ID NO: 5856396 - DNA, 19 bp, Homo sapiens
cacccttctttcctcttcc

SEQ ID NO: 5856397 - DNA, 20 bp, Homo sapiens
cacccttcttttctcatgtg

SEQ ID NO: 5856398 - DNA, 21 bp, Homo sapiens
cacccttgaaaactctcagtc

SEQ ID NO: 5856399 - DNA, 22 bp, Homo sapiens
cacccttgcaccgtcctcagca

SEQ ID NO: 5856400 - DNA, 17 bp, Homo sapiens
cacccttggaggctgtc

SEQ ID NO: 5856401 - DNA, 19 bp, Homo sapiens
cacccttggaggctgtctt

SEQ ID NO: 5856402 - DNA, 19 bp, Homo sapiens
cacccttggcccatcccgc

SEQ ID NO: 5856403 - DNA, 13 bp, Homo sapiens
cacccttggcctg

SEQ ID NO: 5856404 - DNA, 15 bp, Homo sapiens
cacccttggcctgtc

SEQ ID NO: 5856405 - DNA, 23 bp, Homo sapiens
cacccttggcctgtctcatcccc

SEQ ID NO: 5856406 - DNA, 20 bp, Homo sapiens
cacccttggtagagtttatt

SEQ ID NO: 5856407 - DNA, 19 bp, Homo sapiens
cacccttggtctcatgccc

SEQ ID NO: 5856408 - DNA, 22 bp, Homo sapiens
caccctttcatagagaggcctg

SEQ ID NO: 5856409 - DNA, 20 bp, Homo sapiens
caccctttccggcacactgc

SEQ ID NO: 5856410 - DNA, 22 bp, Homo sapiens
caccctttccggcacactgcca

SEQ ID NO: 5856411 - DNA, 23 bp, Homo sapiens
caccctttccggcacactgccaa

SEQ ID NO: 5856412 - DNA, 15 bp, Homo sapiens
caccctttctgccag

SEQ ID NO: 5856413 - DNA, 17 bp, Homo sapiens
caccctttctgccaggg

SEQ ID NO: 5856414 - DNA, 15 bp, Homo sapiens
caccctttctggcac

SEQ ID NO: 5856415 - DNA, 14 bp, Homo sapiens
caccctttgcctta

SEQ ID NO: 5856416 - DNA, 19 bp, Homo sapiens
caccctttttttggggtgc

SEQ ID NO: 5856417 - DNA, 14 bp, Homo sapiens
caccgaaaaactaa

SEQ ID NO: 5856418 - DNA, 19 bp, Homo sapiens
caccgaaaacgtggctgct

SEQ ID NO: 5856419 - DNA, 14 bp, Homo sapiens
caccgaagagccct

SEQ ID NO: 5856420 - DNA, 16 bp, Homo sapiens
caccgaagagccctga

SEQ ID NO: 5856421 - DNA, 15 bp, Homo sapiens
caccgaagcccagag

SEQ ID NO: 5856422 - DNA, 22 bp, Homo sapiens
caccgaagtggactggcccctg

SEQ ID NO: 5856423 - DNA, 17 bp, Homo sapiens
caccgaccaactgccct

SEQ ID NO: 5856424 - DNA, 23 bp, Homo sapiens
caccgaccaactgccctaagccc

SEQ ID NO: 5856425 - DNA, 18 bp, Homo sapiens
caccgaccccctttctaa

SEQ ID NO: 5856426 - DNA, 20 bp, Homo sapiens
caccgacccgacactctcac

SEQ ID NO: 5856427 - DNA, 18 bp, Homo sapiens
caccgacccgaggcccag

SEQ ID NO: 5856428 - DNA, 18 bp, Homo sapiens
caccgacgcgtctcctgt

SEQ ID NO: 5856429 - DNA, 20 bp, Homo sapiens
caccgactagacacacaaag

SEQ ID NO: 5856430 - DNA, 14 bp, Homo sapiens
caccgactcacctg

SEQ ID NO: 5856431 - DNA, 15 bp, Homo sapiens
caccgactcacctgc

SEQ ID NO: 5856432 - DNA, 21 bp, Homo sapiens
caccgactgcccagccactcc

SEQ ID NO: 5856433 - DNA, 20 bp, Homo sapiens
caccgacttcaatttcccac

SEQ ID NO: 5856434 - DNA, 13 bp, Homo sapiens
caccgagaatgtt

SEQ ID NO: 5856435 - DNA, 18 bp, Homo sapiens
caccgagacggctggacc

SEQ ID NO: 5856436 - DNA, 14 bp, Homo sapiens
caccgagccagctt

SEQ ID NO: 5856437 - DNA, 17 bp, Homo sapiens
caccgagccagcttggt

SEQ ID NO: 5856438 - DNA, 20 bp, Homo sapiens
caccgagctctgtgggaaaa

SEQ ID NO: 5856439 - DNA, 15 bp, Homo sapiens
caccgagctggagcg

SEQ ID NO: 5856440 - DNA, 13 bp, Homo sapiens
caccgaggagccc

SEQ ID NO: 5856441 - DNA, 21 bp, Homo sapiens
caccgaggagccccagccccg

SEQ ID NO: 5856442 - DNA, 14 bp, Homo sapiens
caccgaggttccca

SEQ ID NO: 5856443 - DNA, 19 bp, Homo sapiens
caccgagtgatttccatct

SEQ ID NO: 5856444 - DNA, 21 bp, Homo sapiens
caccgagtgatttccatctct

SEQ ID NO: 5856445 - DNA, 23 bp, Homo sapiens
caccgatattagtcctacaccaa

SEQ ID NO: 5856446 - DNA, 14 bp, Homo sapiens
caccgatggagccc

SEQ ID NO: 5856447 - DNA, 17 bp, Homo sapiens
caccgatggagccccca

SEQ ID NO: 5856448 - DNA, 18 bp, Homo sapiens
caccgattcttccttgcc

SEQ ID NO: 5856449 - DNA, 18 bp, Homo sapiens
caccgcaccgggctggcc

SEQ ID NO: 5856450 - DNA, 19 bp, Homo sapiens
caccgcaccgggctggcct

SEQ ID NO: 5856451 - DNA, 22 bp, Homo sapiens
caccgcaccgggctggcctgac

SEQ ID NO: 5856452 - DNA, 15 bp, Homo sapiens
caccgcagaaggaag

SEQ ID NO: 5856453 - DNA, 13 bp, Homo sapiens
caccgcagacagg

SEQ ID NO: 5856454 - DNA, 14 bp, Homo sapiens
caccgcagcatgtg

SEQ ID NO: 5856455 - DNA, 21 bp, Homo sapiens
caccgcagcgtcccccgccgc

SEQ ID NO: 5856456 - DNA, 14 bp, Homo sapiens
caccgcagctgctg

SEQ ID NO: 5856457 - DNA, 17 bp, Homo sapiens
caccgcagctgctgcca

SEQ ID NO: 5856458 - DNA, 13 bp, Homo sapiens
caccgcaggtgct

SEQ ID NO: 5856459 - DNA, 23 bp, Homo sapiens
caccgcaggtgctcatgctgctc

SEQ ID NO: 5856460 - DNA, 19 bp, Homo sapiens
caccgcatatgcatgccag

SEQ ID NO: 5856461 - DNA, 21 bp, Homo sapiens
caccgcatatgcatgccaggc

SEQ ID NO: 5856462 - DNA, 22 bp, Homo sapiens
caccgcatatgcatgccaggct

SEQ ID NO: 5856463 - DNA, 18 bp, Homo sapiens
caccgccacatggcttcc

SEQ ID NO: 5856464 - DNA, 15 bp, Homo sapiens
caccgccaccccact

SEQ ID NO: 5856465 - DNA, 23 bp, Homo sapiens
caccgccaccgtgtgcctttccc

SEQ ID NO: 5856466 - DNA, 19 bp, Homo sapiens
caccgccacgtcccagcat

SEQ ID NO: 5856467 - DNA, 14 bp, Homo sapiens
caccgccagaggac

SEQ ID NO: 5856468 - DNA, 19 bp, Homo sapiens
caccgccagagtgtcctgc

SEQ ID NO: 5856469 - DNA, 12 bp, Homo sapiens
caccgccagctt

SEQ ID NO: 5856470 - DNA, 13 bp, Homo sapiens
caccgccatgcaa

SEQ ID NO: 5856471 - DNA, 19 bp, Homo sapiens
caccgccatgcaactccat

SEQ ID NO: 5856472 - DNA, 22 bp, Homo sapiens
caccgccatgcaactccatgcc

SEQ ID NO: 5856473 - DNA, 20 bp, Homo sapiens
caccgccatgcatgatgggt

SEQ ID NO: 5856474 - DNA, 12 bp, Homo sapiens
caccgcccaccc

SEQ ID NO: 5856475 - DNA, 13 bp, Homo sapiens
caccgcccaccca

SEQ ID NO: 5856476 - DNA, 16 bp, Homo sapiens
caccgcccacccacac

SEQ ID NO: 5856477 - DNA, 21 bp, Homo sapiens
caccgcccactctccacctca

SEQ ID NO: 5856478 - DNA, 12 bp, Homo sapiens
caccgcccccac

SEQ ID NO: 5856479 - DNA, 21 bp, Homo sapiens
caccgcccccaccccttcccc

SEQ ID NO: 5856480 - DNA, 14 bp, Homo sapiens
caccgcccctggcc

SEQ ID NO: 5856481 - DNA, 19 bp, Homo sapiens
caccgccccttctccaaca

SEQ ID NO: 5856482 - DNA, 12 bp, Homo sapiens
caccgccctgcc

SEQ ID NO: 5856483 - DNA, 14 bp, Homo sapiens
caccgccctgcctc

SEQ ID NO: 5856484 - DNA, 16 bp, Homo sapiens
caccgccctgcctctt

SEQ ID NO: 5856485 - DNA, 19 bp, Homo sapiens
caccgccgcagaagcagcc

SEQ ID NO: 5856486 - DNA, 21 bp, Homo sapiens
caccgccgccaccagcccgca

SEQ ID NO: 5856487 - DNA, 15 bp, Homo sapiens
caccgccgccaccct

SEQ ID NO: 5856488 - DNA, 19 bp, Homo sapiens
caccgccggccagctggga

SEQ ID NO: 5856489 - DNA, 20 bp, Homo sapiens
caccgccggctttcagggca

SEQ ID NO: 5856490 - DNA, 22 bp, Homo sapiens
caccgccggctttcagggcagc

SEQ ID NO: 5856491 - DNA, 14 bp, Homo sapiens
caccgccggggtcc

SEQ ID NO: 5856492 - DNA, 17 bp, Homo sapiens
caccgccggggtcctgg

SEQ ID NO: 5856493 - DNA, 19 bp, Homo sapiens
caccgcctccccacctcca

SEQ ID NO: 5856494 - DNA, 21 bp, Homo sapiens
caccgcctctggccgccaccc

SEQ ID NO: 5856495 - DNA, 13 bp, Homo sapiens
caccgcctcttcc

SEQ ID NO: 5856496 - DNA, 15 bp, Homo sapiens
caccgcctcttcccg

SEQ ID NO: 5856497 - DNA, 14 bp, Homo sapiens
caccgcctgaaggc

SEQ ID NO: 5856498 - DNA, 14 bp, Homo sapiens
caccgcgcccctct

SEQ ID NO: 5856499 - DNA, 16 bp, Homo sapiens
caccgcgcccctctgc

SEQ ID NO: 5856500 - DNA, 13 bp, Homo sapiens
caccgcgcctggc

SEQ ID NO: 5856501 - DNA, 20 bp, Homo sapiens
caccgcggacgtgctggcct

SEQ ID NO: 5856502 - DNA, 21 bp, Homo sapiens
caccgcggacgtgctggcctt

SEQ ID NO: 5856503 - DNA, 14 bp, Homo sapiens
caccgcgtcccagc

SEQ ID NO: 5856504 - DNA, 18 bp, Homo sapiens
caccgcgtcccagctccc

SEQ ID NO: 5856505 - DNA, 20 bp, Homo sapiens
caccgcgtcccagctcccct

SEQ ID NO: 5856506 - DNA, 14 bp, Homo sapiens
caccgctcaccctc

SEQ ID NO: 5856507 - DNA, 16 bp, Homo sapiens
caccgctcagtgtcag

SEQ ID NO: 5856508 - DNA, 13 bp, Homo sapiens
caccgctccccag

SEQ ID NO: 5856509 - DNA, 20 bp, Homo sapiens
caccgctccccagcccaggg

SEQ ID NO: 5856510 - DNA, 13 bp, Homo sapiens
caccgctggctcc

SEQ ID NO: 5856511 - DNA, 20 bp, Homo sapiens
caccgctgggtggttttttc

SEQ ID NO: 5856512 - DNA, 15 bp, Homo sapiens
caccgctgggttctg

SEQ ID NO: 5856513 - DNA, 23 bp, Homo sapiens
caccgctggttggaaagagtgtt

SEQ ID NO: 5856514 - DNA, 18 bp, Homo sapiens
caccgcttctgccttttc

SEQ ID NO: 5856515 - DNA, 18 bp, Homo sapiens
caccggaactgggctggc

SEQ ID NO: 5856516 - DNA, 16 bp, Homo sapiens
caccggacgctggaga

SEQ ID NO: 5856517 - DNA, 22 bp, Homo sapiens
caccggacgctggagaccctgc

SEQ ID NO: 5856518 - DNA, 22 bp, Homo sapiens
caccggagctttcaaagaagga

SEQ ID NO: 5856519 - DNA, 12 bp, Homo sapiens
caccggaggagc

SEQ ID NO: 5856520 - DNA, 17 bp, Homo sapiens
caccggaggtcactcca

SEQ ID NO: 5856521 - DNA, 16 bp, Homo sapiens
caccggagtatgtgca

SEQ ID NO: 5856522 - DNA, 22 bp, Homo sapiens
caccggatcctgggtggtctgc

SEQ ID NO: 5856523 - DNA, 15 bp, Homo sapiens
caccggcatgctggc

SEQ ID NO: 5856524 - DNA, 17 bp, Homo sapiens
caccggcatgctggcct

SEQ ID NO: 5856525 - DNA, 22 bp, Homo sapiens
caccggccccatttacccaact

SEQ ID NO: 5856526 - DNA, 16 bp, Homo sapiens
caccggcccctggcag

SEQ ID NO: 5856527 - DNA, 19 bp, Homo sapiens
caccggcctggctgcagct

SEQ ID NO: 5856528 - DNA, 21 bp, Homo sapiens
caccggcctgtgggtctctga

SEQ ID NO: 5856529 - DNA, 12 bp, Homo sapiens
caccggcgcgct

SEQ ID NO: 5856530 - DNA, 13 bp, Homo sapiens
caccggcgctgca

SEQ ID NO: 5856531 - DNA, 14 bp, Homo sapiens
caccggcgctgcag

SEQ ID NO: 5856532 - DNA, 14 bp, Homo sapiens
caccggctggcctg

SEQ ID NO: 5856533 - DNA, 20 bp, Homo sapiens
caccggctggcctggcccct

SEQ ID NO: 5856534 - DNA, 18 bp, Homo sapiens
caccgggaccccctcacc

SEQ ID NO: 5856535 - DNA, 15 bp, Homo sapiens
caccgggagcctccc

SEQ ID NO: 5856536 - DNA, 22 bp, Homo sapiens
caccgggcactcagaagacact

SEQ ID NO: 5856537 - DNA, 21 bp, Homo sapiens
caccgggcatgtctgcctgga

SEQ ID NO: 5856538 - DNA, 22 bp, Homo sapiens
caccgggcatgtctgcctggag

SEQ ID NO: 5856539 - DNA, 15 bp, Homo sapiens
caccgggccacagag

SEQ ID NO: 5856540 - DNA, 18 bp, Homo sapiens
caccgggccacagagaaa

SEQ ID NO: 5856541 - DNA, 19 bp, Homo sapiens
caccgggccactccttcct

SEQ ID NO: 5856542 - DNA, 23 bp, Homo sapiens
caccgggccactccttcctgccc

SEQ ID NO: 5856543 - DNA, 14 bp, Homo sapiens
caccgggctgcagg

SEQ ID NO: 5856544 - DNA, 17 bp, Homo sapiens
caccgggctgcaggtgc

SEQ ID NO: 5856545 - DNA, 20 bp, Homo sapiens
caccgggctggctgcttgca

SEQ ID NO: 5856546 - DNA, 15 bp, Homo sapiens
caccggggcactggc

SEQ ID NO: 5856547 - DNA, 18 bp, Homo sapiens
caccggggcactggctgc

SEQ ID NO: 5856548 - DNA, 17 bp, Homo sapiens
caccgggggtggctctg

SEQ ID NO: 5856549 - DNA, 17 bp, Homo sapiens
caccggtaccctcctcc

SEQ ID NO: 5856550 - DNA, 18 bp, Homo sapiens
caccggtaccctcctccc

SEQ ID NO: 5856551 - DNA, 13 bp, Homo sapiens
caccggtgggcag

SEQ ID NO: 5856552 - DNA, 17 bp, Homo sapiens
caccggtgggcagtggg

SEQ ID NO: 5856553 - DNA, 19 bp, Homo sapiens
caccgtacaaccccctcca

SEQ ID NO: 5856554 - DNA, 22 bp, Homo sapiens
caccgtacatctgcaatatgaa

SEQ ID NO: 5856555 - DNA, 19 bp, Homo sapiens
caccgtattagccaggatg

SEQ ID NO: 5856556 - DNA, 23 bp, Homo sapiens
caccgtcatggcttaatgtttat

SEQ ID NO: 5856557 - DNA, 13 bp, Homo sapiens
caccgtcccctcc

SEQ ID NO: 5856558 - DNA, 17 bp, Homo sapiens
caccgtcccgcacagtg

SEQ ID NO: 5856559 - DNA, 15 bp, Homo sapiens
caccgtccctcagtg

SEQ ID NO: 5856560 - DNA, 17 bp, Homo sapiens
caccgtccctctccccg

SEQ ID NO: 5856561 - DNA, 19 bp, Homo sapiens
caccgtccctctccccgga

SEQ ID NO: 5856562 - DNA, 12 bp, Homo sapiens
cacctccacctg

SEQ ID NO: 5856563 - DNA, 17 bp, Homo sapiens
cacctccacctgtgaga

SEQ ID NO: 5856564 - DNA, 14 bp, Homo sapiens
cacctccacgccac

SEQ ID NO: 5856565 - DNA, 17 bp, Homo sapiens
cacctccacgccactgc

SEQ ID NO: 5856566 - DNA, 14 bp, Homo sapiens
cacctccagcccac

SEQ ID NO: 5856567 - DNA, 16 bp, Homo sapiens
cacctccagcccacag

SEQ ID NO: 5856568 - DNA, 14 bp, Homo sapiens
cacctccagcccgg

SEQ ID NO: 5856569 - DNA, 22 bp, Homo sapiens
cacctccagcccgggagcctag

SEQ ID NO: 5856570 - DNA, 14 bp, Homo sapiens
cacctccagctgcc

SEQ ID NO: 5856571 - DNA, 18 bp, Homo sapiens
cacctccaggcaggccag

SEQ ID NO: 5856572 - DNA, 13 bp, Homo sapiens
cacctccagtccc

SEQ ID NO: 5856573 - DNA, 13 bp, Homo sapiens
cacctccatatca

SEQ ID NO: 5856574 - DNA, 17 bp, Homo sapiens
cacctccatttcttggt

SEQ ID NO: 5856575 - DNA, 12 bp, Homo sapiens
cacctcccacca

SEQ ID NO: 5856576 - DNA, 16 bp, Homo sapiens
cacctcccaccccact

SEQ ID NO: 5856577 - DNA, 17 bp, Homo sapiens
cacctcccactcctgct

SEQ ID NO: 5856578 - DNA, 23 bp, Homo sapiens
cacctcccactcctgctgcacag

SEQ ID NO: 5856579 - DNA, 15 bp, Homo sapiens
cacctcccagcccct

SEQ ID NO: 5856580 - DNA, 15 bp, Homo sapiens
cacctcccaggggac

SEQ ID NO: 5856581 - DNA, 20 bp, Homo sapiens
cacctcccatttctgttgct

SEQ ID NO: 5856582 - DNA, 22 bp, Homo sapiens
cacctcccatttctgttgctgg

SEQ ID NO: 5856583 - DNA, 12 bp, Homo sapiens
cacctccccaca

SEQ ID NO: 5856584 - DNA, 22 bp, Homo sapiens
cacctccccacacacaggcctt

SEQ ID NO: 5856585 - DNA, 13 bp, Homo sapiens
cacctccccacat

SEQ ID NO: 5856586 - DNA, 21 bp, Homo sapiens
cacctccccacgccctcccct

SEQ ID NO: 5856587 - DNA, 15 bp, Homo sapiens
cacctccccactcca

SEQ ID NO: 5856588 - DNA, 19 bp, Homo sapiens
cacctccccactccagcag

SEQ ID NO: 5856589 - DNA, 15 bp, Homo sapiens
cacctccccagacag

SEQ ID NO: 5856590 - DNA, 19 bp, Homo sapiens
cacctccccagagccctgc

SEQ ID NO: 5856591 - DNA, 14 bp, Homo sapiens
cacctccccaggcc

SEQ ID NO: 5856592 - DNA, 15 bp, Homo sapiens
cacctccccaggccg

SEQ ID NO: 5856593 - DNA, 11 bp, Homo sapiens
cacctccccca

SEQ ID NO: 5856594 - DNA, 18 bp, Homo sapiens
cacctcccccaaaccctg

SEQ ID NO: 5856595 - DNA, 15 bp, Homo sapiens
cacctccccccactg

SEQ ID NO: 5856596 - DNA, 17 bp, Homo sapiens
cacctccccccactgca

SEQ ID NO: 5856597 - DNA, 18 bp, Homo sapiens
cacctccccccactgcag

SEQ ID NO: 5856598 - DNA, 15 bp, Homo sapiens
cacctccccctaccc

SEQ ID NO: 5856599 - DNA, 16 bp, Homo sapiens
cacctccccctaccca

SEQ ID NO: 5856600 - DNA, 18 bp, Homo sapiens
cacctccccctacccata

SEQ ID NO: 5856601 - DNA, 21 bp, Homo sapiens
cacctccccctacccatatcc

SEQ ID NO: 5856602 - DNA, 20 bp, Homo sapiens
cacctccccctcccccttct

SEQ ID NO: 5856603 - DNA, 18 bp, Homo sapiens
cacctccccctccccggc

SEQ ID NO: 5856604 - DNA, 22 bp, Homo sapiens
cacctccccctccccggccaca

SEQ ID NO: 5856605 - DNA, 23 bp, Homo sapiens
cacctccccctccccggccacat

SEQ ID NO: 5856606 - DNA, 16 bp, Homo sapiens
cacctccccctgcccc

SEQ ID NO: 5856607 - DNA, 17 bp, Homo sapiens
cacctccccctgcgccc

SEQ ID NO: 5856608 - DNA, 12 bp, Homo sapiens
cacctccccctt

SEQ ID NO: 5856609 - DNA, 20 bp, Homo sapiens
cacctccccctttcacactg

SEQ ID NO: 5856610 - DNA, 22 bp, Homo sapiens
cacctccccctttcacactgga

SEQ ID NO: 5856611 - DNA, 14 bp, Homo sapiens
cacctcccctatcc

SEQ ID NO: 5856612 - DNA, 14 bp, Homo sapiens
cacctcccctcctt

SEQ ID NO: 5856613 - DNA, 23 bp, Homo sapiens
cacctcccctccttgcctcctgt

SEQ ID NO: 5856614 - DNA, 15 bp, Homo sapiens
cacctccccttgcca

SEQ ID NO: 5856615 - DNA, 18 bp, Homo sapiens
cacctccccttgccagct

SEQ ID NO: 5856616 - DNA, 19 bp, Homo sapiens
cacctccccttgccagctg

SEQ ID NO: 5856617 - DNA, 22 bp, Homo sapiens
cacctcccggtgtatgcagtgg

SEQ ID NO: 5856618 - DNA, 17 bp, Homo sapiens
cacctccctcaacctca

SEQ ID NO: 5856619 - DNA, 12 bp, Homo sapiens
cacctccctccc

SEQ ID NO: 5856620 - DNA, 20 bp, Homo sapiens
cacctccctccccagctccg

SEQ ID NO: 5856621 - DNA, 23 bp, Homo sapiens
cacctccctccccagctccggag

SEQ ID NO: 5856622 - DNA, 17 bp, Homo sapiens
cacctccctctgccagt

SEQ ID NO: 5856623 - DNA, 13 bp, Homo sapiens
cacctccctgcag

SEQ ID NO: 5856624 - DNA, 16 bp, Homo sapiens
cacctccctgcagctt

SEQ ID NO: 5856625 - DNA, 13 bp, Homo sapiens
cacctccctgccc

SEQ ID NO: 5856626 - DNA, 23 bp, Homo sapiens
cacctccctgcccaggccggcca

SEQ ID NO: 5856627 - DNA, 18 bp, Homo sapiens
cacctccctgctcagtgc

SEQ ID NO: 5856628 - DNA, 22 bp, Homo sapiens
cacctccctgctcagtgcttgg

SEQ ID NO: 5856629 - DNA, 14 bp, Homo sapiens
cacctcccttccct

SEQ ID NO: 5856630 - DNA, 20 bp, Homo sapiens
cacctcccttccctccctga

SEQ ID NO: 5856631 - DNA, 22 bp, Homo sapiens
cacctccgagacagtccagtgt

SEQ ID NO: 5856632 - DNA, 13 bp, Homo sapiens
cacctccgccaga

SEQ ID NO: 5856633 - DNA, 19 bp, Homo sapiens
cacctccgccccagacaca

SEQ ID NO: 5856634 - DNA, 17 bp, Homo sapiens
cacctccggctgcctag

SEQ ID NO: 5856635 - DNA, 19 bp, Homo sapiens
cacctccggctgcctagcc

SEQ ID NO: 5856636 - DNA, 22 bp, Homo sapiens
cacctccggctgcctagccctc

SEQ ID NO: 5856637 - DNA, 16 bp, Homo sapiens
cacctccgggactgac

SEQ ID NO: 5856638 - DNA, 20 bp, Homo sapiens
cacctccgggactgaccttc

SEQ ID NO: 5856639 - DNA, 21 bp, Homo sapiens
cacctcctagaggtgggcagc

SEQ ID NO: 5856640 - DNA, 14 bp, Homo sapiens
cacctcctcatgta

SEQ ID NO: 5856641 - DNA, 20 bp, Homo sapiens
cacctcctccactcactcca

SEQ ID NO: 5856642 - DNA, 13 bp, Homo sapiens
cacctcctccagc

SEQ ID NO: 5856643 - DNA, 15 bp, Homo sapiens
cacctcctccagcga

SEQ ID NO: 5856644 - DNA, 20 bp, Homo sapiens
cacctcctcccgaaaaatgt

SEQ ID NO: 5856645 - DNA, 18 bp, Homo sapiens
cacctcctcctgctgctc

SEQ ID NO: 5856646 - DNA, 19 bp, Homo sapiens
cacctcctcgaacccactc

SEQ ID NO: 5856647 - DNA, 14 bp, Homo sapiens
cacctcctctgcca

SEQ ID NO: 5856648 - DNA, 20 bp, Homo sapiens
cacctcctctgccagcagga

SEQ ID NO: 5856649 - DNA, 17 bp, Homo sapiens
cacctcctctgtgattt

SEQ ID NO: 5856650 - DNA, 14 bp, Homo sapiens
cacctcctgagaag

SEQ ID NO: 5856651 - DNA, 11 bp, Homo sapiens
cacctcctgcc

SEQ ID NO: 5856652 - DNA, 18 bp, Homo sapiens
cacctcctgcggctcagc

SEQ ID NO: 5856653 - DNA, 22 bp, Homo sapiens
cacctcctgcggctcagccttg

SEQ ID NO: 5856654 - DNA, 22 bp, Homo sapiens
cacctcctgggttcaagcgatt

SEQ ID NO: 5856655 - DNA, 17 bp, Homo sapiens
cacctccttccagcact

SEQ ID NO: 5856656 - DNA, 16 bp, Homo sapiens
cacctccttccccagc

SEQ ID NO: 5856657 - DNA, 13 bp, Homo sapiens
cacctccttccct

SEQ ID NO: 5856658 - DNA, 21 bp, Homo sapiens
cacctccttcctcagtcctgg

SEQ ID NO: 5856659 - DNA, 16 bp, Homo sapiens
cacctccttctgcagt

SEQ ID NO: 5856660 - DNA, 23 bp, Homo sapiens
cacctccttctgcagtcagactg

SEQ ID NO: 5856661 - DNA, 23 bp, Homo sapiens
cacctccttttcttctagctttg

SEQ ID NO: 5856662 - DNA, 17 bp, Homo sapiens
cacctcgcccttcagcc

SEQ ID NO: 5856663 - DNA, 20 bp, Homo sapiens
cacctcgcggcgcagcccct

SEQ ID NO: 5856664 - DNA, 15 bp, Homo sapiens
cacctcgctcccctc

SEQ ID NO: 5856665 - DNA, 16 bp, Homo sapiens
cacctcgctcccctct

SEQ ID NO: 5856666 - DNA, 18 bp, Homo sapiens
cacctcgctcccctctgg

SEQ ID NO: 5856667 - DNA, 19 bp, Homo sapiens
cacctcgctcccctctgga

SEQ ID NO: 5856668 - DNA, 22 bp, Homo sapiens
cacctcgctgttgtcacatctc

SEQ ID NO: 5856669 - DNA, 14 bp, Homo sapiens
cacctcggagcatg

SEQ ID NO: 5856670 - DNA, 18 bp, Homo sapiens
cacctcggatcccactga

SEQ ID NO: 5856671 - DNA, 14 bp, Homo sapiens
cacctcggcctccc

SEQ ID NO: 5856672 - DNA, 18 bp, Homo sapiens
cacctcggggacaccaga

SEQ ID NO: 5856673 - DNA, 20 bp, Homo sapiens
cacctcgtcaagagcatgca

SEQ ID NO: 5856674 - DNA, 22 bp, Homo sapiens
cacctcgtcccgttctccattc

SEQ ID NO: 5856675 - DNA, 19 bp, Homo sapiens
cacctcgtctccctggtgc

SEQ ID NO: 5856676 - DNA, 23 bp, Homo sapiens
cacctcgttactctcacctcgtg

SEQ ID NO: 5856677 - DNA, 16 bp, Homo sapiens
cacctctaacagcacc

SEQ ID NO: 5856678 - DNA, 17 bp, Homo sapiens
cacctctaacagcacca

SEQ ID NO: 5856679 - DNA, 18 bp, Homo sapiens
cacctctacccaaaccct

SEQ ID NO: 5856680 - DNA, 21 bp, Homo sapiens
cacctctacccaaaccctagg

SEQ ID NO: 5856681 - DNA, 14 bp, Homo sapiens
cacctctactgtct

SEQ ID NO: 5856682 - DNA, 16 bp, Homo sapiens
cacctctactgtctcc

SEQ ID NO: 5856683 - DNA, 19 bp, Homo sapiens
cacctctactgtctcctcc

SEQ ID NO: 5856684 - DNA, 14 bp, Homo sapiens
cacctctaggcctc

SEQ ID NO: 5856685 - DNA, 16 bp, Homo sapiens
cacctctaggcctcag

SEQ ID NO: 5856686 - DNA, 22 bp, Homo sapiens
cacctctaggtccccatactcc

SEQ ID NO: 5856687 - DNA, 19 bp, Homo sapiens
cacctctatattagtttat

SEQ ID NO: 5856688 - DNA, 13 bp, Homo sapiens
cacctctcaatat

SEQ ID NO: 5856689 - DNA, 22 bp, Homo sapiens
cacctctcaatattcaataaag

SEQ ID NO: 5856690 - DNA, 23 bp, Homo sapiens
cacctctcaatattcaataaagc

SEQ ID NO: 5856691 - DNA, 15 bp, Homo sapiens
cacctctcagctgct

SEQ ID NO: 5856692 - DNA, 17 bp, Homo sapiens
cacctctcagctgctgg

SEQ ID NO: 5856693 - DNA, 22 bp, Homo sapiens
cacctctcaggattgctaggag

SEQ ID NO: 5856694 - DNA, 18 bp, Homo sapiens
cacctctccaagggcttc

SEQ ID NO: 5856695 - DNA, 13 bp, Homo sapiens
cacctctccaggt

SEQ ID NO: 5856696 - DNA, 13 bp, Homo sapiens
cacctctcccagc

SEQ ID NO: 5856697 - DNA, 16 bp, Homo sapiens
cacctctcccagccct

SEQ ID NO: 5856698 - DNA, 19 bp, Homo sapiens
cacctctccctgaccctgt

SEQ ID NO: 5856699 - DNA, 20 bp, Homo sapiens
cacctctccctgcatcctga

SEQ ID NO: 5856700 - DNA, 12 bp, Homo sapiens
cacctctctcag

SEQ ID NO: 5856701 - DNA, 13 bp, Homo sapiens
cacctctctcaga

SEQ ID NO: 5856702 - DNA, 17 bp, Homo sapiens
cacctctctcagagcat

SEQ ID NO: 5856703 - DNA, 15 bp, Homo sapiens
cacctctctgcctgt

SEQ ID NO: 5856704 - DNA, 18 bp, Homo sapiens
cacctctctgcctgttcc

SEQ ID NO: 5856705 - DNA, 14 bp, Homo sapiens
cacctctctggaag

SEQ ID NO: 5856706 - DNA, 19 bp, Homo sapiens
cacctctctggcttccatg

SEQ ID NO: 5856707 - DNA, 12 bp, Homo sapiens
cacctctcttga

SEQ ID NO: 5856708 - DNA, 14 bp, Homo sapiens
cacctctcttttcc

SEQ ID NO: 5856709 - DNA, 17 bp, Homo sapiens
cacctctcttttcctct

SEQ ID NO: 5856710 - DNA, 21 bp, Homo sapiens
cacctctcttttcctctctgt

SEQ ID NO: 5856711 - DNA, 22 bp, Homo sapiens
cacctctgaaaacggccctctt

SEQ ID NO: 5856712 - DNA, 20 bp, Homo sapiens
cacctctgacgcaccactgc

SEQ ID NO: 5856713 - DNA, 18 bp, Homo sapiens
cacctctgagccggaggg

SEQ ID NO: 5856714 - DNA, 17 bp, Homo sapiens
cacctctgaggactctg

SEQ ID NO: 5856715 - DNA, 19 bp, Homo sapiens
cacctctgaggactctgga

SEQ ID NO: 5856716 - DNA, 14 bp, Homo sapiens
cacctctgattaca

SEQ ID NO: 5856717 - DNA, 18 bp, Homo sapiens
cacctctgcacaagctgc

SEQ ID NO: 5856718 - DNA, 20 bp, Homo sapiens
cacctctgccccttgggcct

SEQ ID NO: 5856719 - DNA, 12 bp, Homo sapiens
cacctctgccct

SEQ ID NO: 5856720 - DNA, 19 bp, Homo sapiens
cacctctgcccttcccctc

SEQ ID NO: 5856721 - DNA, 22 bp, Homo sapiens
cacctctgcctctagtccccaa

SEQ ID NO: 5856722 - DNA, 18 bp, Homo sapiens
cacctctgcggaccccag

SEQ ID NO: 5856723 - DNA, 21 bp, Homo sapiens
cacctctgcggaccccagctg

SEQ ID NO: 5856724 - DNA, 17 bp, Homo sapiens
cacctctgctgcccacg

SEQ ID NO: 5856725 - DNA, 20 bp, Homo sapiens
cacctctgctgcccacggcc

SEQ ID NO: 5856726 - DNA, 19 bp, Homo sapiens
cacctctggactggctaga

SEQ ID NO: 5856727 - DNA, 18 bp, Homo sapiens
cacctctggatccctgga

SEQ ID NO: 5856728 - DNA, 14 bp, Homo sapiens
cacctctggccctg

SEQ ID NO: 5856729 - DNA, 15 bp, Homo sapiens
cacctctggccctgt

SEQ ID NO: 5856730 - DNA, 18 bp, Homo sapiens
cacctctggccctgttgt

SEQ ID NO: 5856731 - DNA, 17 bp, Homo sapiens
cacctctggctagagcc

SEQ ID NO: 5856732 - DNA, 18 bp, Homo sapiens
cacctctggctagagccg

SEQ ID NO: 5856733 - DNA, 21 bp, Homo sapiens
cacctctggctagagccgagg

SEQ ID NO: 5856734 - DNA, 13 bp, Homo sapiens
cacctctggcttt

SEQ ID NO: 5856735 - DNA, 18 bp, Homo sapiens
cacctctggctttgtctc

SEQ ID NO: 5856736 - DNA, 20 bp, Homo sapiens
cacctctgggaccccagctg

SEQ ID NO: 5856737 - DNA, 15 bp, Homo sapiens
cacctctgggccctg

SEQ ID NO: 5856738 - DNA, 17 bp, Homo sapiens
cacctctgggccctgca

SEQ ID NO: 5856739 - DNA, 20 bp, Homo sapiens
cacctctgggccctgcagga

SEQ ID NO: 5856740 - DNA, 14 bp, Homo sapiens
cacctgctctgctg

SEQ ID NO: 5856741 - DNA, 19 bp, Homo sapiens
cacctgctgagagacccaa

SEQ ID NO: 5856742 - DNA, 17 bp, Homo sapiens
cacctgctgatgtggca

SEQ ID NO: 5856743 - DNA, 21 bp, Homo sapiens
cacctgctgcgggggagccag

SEQ ID NO: 5856744 - DNA, 22 bp, Homo sapiens
cacctgctgcgggggagccagt

SEQ ID NO: 5856745 - DNA, 16 bp, Homo sapiens
cacctgctgcgtcccc

SEQ ID NO: 5856746 - DNA, 22 bp, Homo sapiens
cacctgctgcgtccccactccc

SEQ ID NO: 5856747 - DNA, 12 bp, Homo sapiens
cacctgctgctt

SEQ ID NO: 5856748 - DNA, 13 bp, Homo sapiens
cacctgctggccc

SEQ ID NO: 5856749 - DNA, 21 bp, Homo sapiens
cacctgcttcccccacttcac

SEQ ID NO: 5856750 - DNA, 14 bp, Homo sapiens
cacctgcttctcag

SEQ ID NO: 5856751 - DNA, 14 bp, Homo sapiens
cacctgcttctgaa

SEQ ID NO: 5856752 - DNA, 16 bp, Homo sapiens
cacctgctttctcctg

SEQ ID NO: 5856753 - DNA, 18 bp, Homo sapiens
cacctggaaagccaggtt

SEQ ID NO: 5856754 - DNA, 21 bp, Homo sapiens
cacctggaagcatttgtttct

SEQ ID NO: 5856755 - DNA, 22 bp, Homo sapiens
cacctggaagcatttgtttcta

SEQ ID NO: 5856756 - DNA, 12 bp, Homo sapiens
cacctggacccc

SEQ ID NO: 5856757 - DNA, 15 bp, Homo sapiens
cacctggaccccctg

SEQ ID NO: 5856758 - DNA, 19 bp, Homo sapiens
cacctggacccctgcattg

SEQ ID NO: 5856759 - DNA, 19 bp, Homo sapiens
cacctggacgaagagcagg

SEQ ID NO: 5856760 - DNA, 21 bp, Homo sapiens
cacctggacgaagagcaggcc

SEQ ID NO: 5856761 - DNA, 18 bp, Homo sapiens
cacctggactgaccctgc

SEQ ID NO: 5856762 - DNA, 22 bp, Homo sapiens
cacctggactgagccaaggagg

SEQ ID NO: 5856763 - DNA, 10 bp, Homo sapiens
cacctggaga

SEQ ID NO: 5856764 - DNA, 14 bp, Homo sapiens
cacctggagactgt

SEQ ID NO: 5856765 - DNA, 11 bp, Homo sapiens
cacctggagag

SEQ ID NO: 5856766 - DNA, 21 bp, Homo sapiens
cacctggagcccgcttcaagc

SEQ ID NO: 5856767 - DNA, 22 bp, Homo sapiens
cacctggaggcaagagggaggg

SEQ ID NO: 5856768 - DNA, 20 bp, Homo sapiens
cacctggatggatctgctcc

SEQ ID NO: 5856769 - DNA, 22 bp, Homo sapiens
cacctggattgcgcctaatgtg

SEQ ID NO: 5856770 - DNA, 19 bp, Homo sapiens
cacctggcacaccagaagt

SEQ ID NO: 5856771 - DNA, 17 bp, Homo sapiens
cacctggcactgctgtg

SEQ ID NO: 5856772 - DNA, 20 bp, Homo sapiens
cacctggcagggctcacact

SEQ ID NO: 5856773 - DNA, 23 bp, Homo sapiens
cacctggcagggctcacactcct

SEQ ID NO: 5856774 - DNA, 22 bp, Homo sapiens
cacctggcatggtgcagggaga

SEQ ID NO: 5856775 - DNA, 12 bp, Homo sapiens
cacctggccacc

SEQ ID NO: 5856776 - DNA, 15 bp, Homo sapiens
cacctggccacctga

SEQ ID NO: 5856777 - DNA, 21 bp, Homo sapiens
cacctggccacctgaggtggg

SEQ ID NO: 5856778 - DNA, 21 bp, Homo sapiens
cacctggccccctcagctctg

SEQ ID NO: 5856779 - DNA, 21 bp, Homo sapiens
cacctggccccttctccagca

SEQ ID NO: 5856780 - DNA, 24 bp, Homo sapiens
cacctggccccttctccagcaagc

SEQ ID NO: 5856781 - DNA, 17 bp, Homo sapiens
cacctggccctctctga

SEQ ID NO: 5856782 - DNA, 19 bp, Homo sapiens
cacctggccctctctgaag

SEQ ID NO: 5856783 - DNA, 20 bp, Homo sapiens
cacctggccctgcttcctgc

SEQ ID NO: 5856784 - DNA, 13 bp, Homo sapiens
cacctggccctgg

SEQ ID NO: 5856785 - DNA, 14 bp, Homo sapiens
cacctggccctggg

SEQ ID NO: 5856786 - DNA, 18 bp, Homo sapiens
cacctggccgcctccagg

SEQ ID NO: 5856787 - DNA, 22 bp, Homo sapiens
cacctggccgcctccaggagcc

SEQ ID NO: 5856788 - DNA, 20 bp, Homo sapiens
cacctggccgggtcaccctg

SEQ ID NO: 5856789 - DNA, 18 bp, Homo sapiens
cacctggcctctgcactc

SEQ ID NO: 5856790 - DNA, 23 bp, Homo sapiens
cacctggcctctgcactcccctg

SEQ ID NO: 5856791 - DNA, 12 bp, Homo sapiens
cacctggcctgc

SEQ ID NO: 5856792 - DNA, 13 bp, Homo sapiens
cacctggcctgct

SEQ ID NO: 5856793 - DNA, 23 bp, Homo sapiens
cacctggcggagctctcctccgc

SEQ ID NO: 5856794 - DNA, 22 bp, Homo sapiens
cacctggcggccctaagccact

SEQ ID NO: 5856795 - DNA, 19 bp, Homo sapiens
cacctggctctcacctcta

SEQ ID NO: 5856796 - DNA, 14 bp, Homo sapiens
cacctggctctgtg

SEQ ID NO: 5856797 - DNA, 23 bp, Homo sapiens
cacctggctctgtggcgagccat

SEQ ID NO: 5856798 - DNA, 15 bp, Homo sapiens
cacctggctgagcag

SEQ ID NO: 5856799 - DNA, 18 bp, Homo sapiens
cacctggctgagcagttc

SEQ ID NO: 5856800 - DNA, 19 bp, Homo sapiens
cacctggctgagcctggct

SEQ ID NO: 5856801 - DNA, 21 bp, Homo sapiens
cacctggctgaggttcctctg

SEQ ID NO: 5856802 - DNA, 22 bp, Homo sapiens
cacctggctgaggttcctctgc

SEQ ID NO: 5856803 - DNA, 18 bp, Homo sapiens
cacctggctgctaggcca

SEQ ID NO: 5856804 - DNA, 19 bp, Homo sapiens
cacctggctgctaggccag

SEQ ID NO: 5856805 - DNA, 18 bp, Homo sapiens
cacctggcttcccaggac

SEQ ID NO: 5856806 - DNA, 22 bp, Homo sapiens
cacctggcttcccaggaccctg

SEQ ID NO: 5856807 - DNA, 23 bp, Homo sapiens
cacctggcttcccaggaccctgg

SEQ ID NO: 5856808 - DNA, 16 bp, Homo sapiens
cacctggcttgtttat

SEQ ID NO: 5856809 - DNA, 21 bp, Homo sapiens
cacctggcttgtttattttgt

SEQ ID NO: 5856810 - DNA, 20 bp, Homo sapiens
cacctgggaaaacagaggaa

SEQ ID NO: 5856811 - DNA, 16 bp, Homo sapiens
cacctgggaacacagt

SEQ ID NO: 5856812 - DNA, 16 bp, Homo sapiens
cacctgggagaaatct

SEQ ID NO: 5856813 - DNA, 23 bp, Homo sapiens
cacctgggagaaggtctccaagg

SEQ ID NO: 5856814 - DNA, 18 bp, Homo sapiens
cacctgggagatgctggg

SEQ ID NO: 5856815 - DNA, 19 bp, Homo sapiens
cacctgggagatgctggga

SEQ ID NO: 5856816 - DNA, 11 bp, Homo sapiens
cacctgggcac

SEQ ID NO: 5856817 - DNA, 19 bp, Homo sapiens
cacctgggcacctggggag

SEQ ID NO: 5856818 - DNA, 19 bp, Homo sapiens
cacctgggccccactggac

SEQ ID NO: 5856819 - DNA, 20 bp, Homo sapiens
cacctgggccccactggaca

SEQ ID NO: 5856820 - DNA, 13 bp, Homo sapiens
cacctgggcccta

SEQ ID NO: 5856821 - DNA, 20 bp, Homo sapiens
cacctgggccctaggcatac

SEQ ID NO: 5856822 - DNA, 15 bp, Homo sapiens
cacctgggccgggct

SEQ ID NO: 5856823 - DNA, 13 bp, Homo sapiens
cacctgggctggg

SEQ ID NO: 5856824 - DNA, 14 bp, Homo sapiens
cacctgggctggga

SEQ ID NO: 5856825 - DNA, 22 bp, Homo sapiens
cacctgggctgggagaaggtgc

SEQ ID NO: 5856826 - DNA, 16 bp, Homo sapiens
cacctgggcttaagaa

SEQ ID NO: 5856827 - DNA, 17 bp, Homo sapiens
cacctggggagtgggac

SEQ ID NO: 5856828 - DNA, 22 bp, Homo sapiens
cacctggggagtgggacagagt

SEQ ID NO: 5856829 - DNA, 20 bp, Homo sapiens
cacctggggcagtcacctgc

SEQ ID NO: 5856830 - DNA, 23 bp, Homo sapiens
cacctggggcagtcacctgccca

SEQ ID NO: 5856831 - DNA, 14 bp, Homo sapiens
cacctggggtctct

SEQ ID NO: 5856832 - DNA, 17 bp, Homo sapiens
cacctggggtgctgcct

SEQ ID NO: 5856833 - DNA, 22 bp, Homo sapiens
cacctggggtgctgcctctcac

SEQ ID NO: 5856834 - DNA, 18 bp, Homo sapiens
cacctggggtgtgggagg

SEQ ID NO: 5856835 - DNA, 15 bp, Homo sapiens
cacctgggtgtgctc

SEQ ID NO: 5856836 - DNA, 19 bp, Homo sapiens
cacctgggttcagcctctc

SEQ ID NO: 5856837 - DNA, 16 bp, Homo sapiens
cacctggtacctggac

SEQ ID NO: 5856838 - DNA, 20 bp, Homo sapiens
cacctggtactgcacatttt

SEQ ID NO: 5856839 - DNA, 19 bp, Homo sapiens
cacctggtgcgggcctggc

SEQ ID NO: 5856840 - DNA, 23 bp, Homo sapiens
cacctggtgcgggcctggccctc

SEQ ID NO: 5856841 - DNA, 14 bp, Homo sapiens
cacctggtggccct

SEQ ID NO: 5856842 - DNA, 18 bp, Homo sapiens
cacctggttatgagccga

SEQ ID NO: 5856843 - DNA, 17 bp, Homo sapiens
cacctgtaaaactttat

SEQ ID NO: 5856844 - DNA, 18 bp, Homo sapiens
cacctgtaaagtgcctta

SEQ ID NO: 5856845 - DNA, 20 bp, Homo sapiens
cacctgtaatcccagcacac

SEQ ID NO: 5856846 - DNA, 20 bp, Homo sapiens
cacctgtaattccagcactt

SEQ ID NO: 5856847 - DNA, 14 bp, Homo sapiens
cacctgtacataca

SEQ ID NO: 5856848 - DNA, 14 bp, Homo sapiens
cacctgtacattct

SEQ ID NO: 5856849 - DNA, 22 bp, Homo sapiens
cacctgtactcaggaggctgag

SEQ ID NO: 5856850 - DNA, 23 bp, Homo sapiens
cacctgtactcaggaggctgagg

SEQ ID NO: 5856851 - DNA, 14 bp, Homo sapiens
cacctgtactggag

SEQ ID NO: 5856852 - DNA, 15 bp, Homo sapiens
cacctgtactggaga

SEQ ID NO: 5856853 - DNA, 15 bp, Homo sapiens
cacctgtagccatct

SEQ ID NO: 5856854 - DNA, 16 bp, Homo sapiens
cacctgtagccatctg

SEQ ID NO: 5856855 - DNA, 11 bp, Homo sapiens
cacctgtagct

SEQ ID NO: 5856856 - DNA, 12 bp, Homo sapiens
cacctgtagctg

SEQ ID NO: 5856857 - DNA, 12 bp, Homo sapiens
cacctgtatacc

SEQ ID NO: 5856858 - DNA, 23 bp, Homo sapiens
cacctgtcaaacaaagccagaag

SEQ ID NO: 5856859 - DNA, 13 bp, Homo sapiens
cacctgtcacctt

SEQ ID NO: 5856860 - DNA, 21 bp, Homo sapiens
cacctgtccccaccctccact

SEQ ID NO: 5856861 - DNA, 22 bp, Homo sapiens
cacctgtccccaccctccactc

SEQ ID NO: 5856862 - DNA, 18 bp, Homo sapiens
cacctgtccggcccagtg

SEQ ID NO: 5856863 - DNA, 23 bp, Homo sapiens
cacctgtccggcccagtgccagc

SEQ ID NO: 5856864 - DNA, 15 bp, Homo sapiens
cacctgtctcagcct

SEQ ID NO: 5856865 - DNA, 18 bp, Homo sapiens
cacctgtctcatagcctc

SEQ ID NO: 5856866 - DNA, 15 bp, Homo sapiens
cacctgtctgctcca

SEQ ID NO: 5856867 - DNA, 21 bp, Homo sapiens
cacctgtctgctccagctctg

SEQ ID NO: 5856868 - DNA, 23 bp, Homo sapiens
cacctgtctgctccagctctggc

SEQ ID NO: 5856869 - DNA, 11 bp, Homo sapiens
cacctgtctgg

SEQ ID NO: 5856870 - DNA, 16 bp, Homo sapiens
cacctgtctgtctgtc

SEQ ID NO: 5856871 - DNA, 17 bp, Homo sapiens
cacctgtcttgcctttt

SEQ ID NO: 5856872 - DNA, 17 bp, Homo sapiens
cacctgtgagaaaggaa

SEQ ID NO: 5856873 - DNA, 18 bp, Homo sapiens
cacctgtgagaaaggaaa

SEQ ID NO: 5856874 - DNA, 15 bp, Homo sapiens
cacctgtgagaccaa

SEQ ID NO: 5856875 - DNA, 13 bp, Homo sapiens
cacctgtgagatc

SEQ ID NO: 5856876 - DNA, 20 bp, Homo sapiens
cacctgtgagtttaaagcaa

SEQ ID NO: 5856877 - DNA, 18 bp, Homo sapiens
cacctgtgcaccccatga

SEQ ID NO: 5856878 - DNA, 23 bp, Homo sapiens
cacctgtgccctcaccaccacac

SEQ ID NO: 5856879 - DNA, 13 bp, Homo sapiens
cacctgtgctgct

SEQ ID NO: 5856880 - DNA, 14 bp, Homo sapiens
cacctgtgctgctg

SEQ ID NO: 5856881 - DNA, 13 bp, Homo sapiens
cacctgtgctgga

SEQ ID NO: 5856882 - DNA, 19 bp, Homo sapiens
cacctgtgcttcgggccct

SEQ ID NO: 5856883 - DNA, 18 bp, Homo sapiens
cacctgtgcttggaacca

SEQ ID NO: 5856884 - DNA, 23 bp, Homo sapiens
cacctgtggccagagcacctcag

SEQ ID NO: 5856885 - DNA, 12 bp, Homo sapiens
cacctgtggctg

SEQ ID NO: 5856886 - DNA, 14 bp, Homo sapiens
cacctgtgggccag

SEQ ID NO: 5856887 - DNA, 17 bp, Homo sapiens
cacctgtgggccagccg

SEQ ID NO: 5856888 - DNA, 21 bp, Homo sapiens
cacctgtgggccagccgattc

SEQ ID NO: 5856889 - DNA, 14 bp, Homo sapiens
cacctgtggggcct

SEQ ID NO: 5856890 - DNA, 16 bp, Homo sapiens
cacctgtggggcctgg

SEQ ID NO: 5856891 - DNA, 17 bp, Homo sapiens
cacctgtggggcctggg

SEQ ID NO: 5856892 - DNA, 14 bp, Homo sapiens
cacctgtgtccaag

SEQ ID NO: 5856893 - DNA, 16 bp, Homo sapiens
cacctgtgtgcccagc

SEQ ID NO: 5856894 - DNA, 21 bp, Homo sapiens
cacctgtgtgcccagcacctg

SEQ ID NO: 5856895 - DNA, 19 bp, Homo sapiens
cacctgttaaaatgtacac

SEQ ID NO: 5856896 - DNA, 20 bp, Homo sapiens
cacctgttaaaatgtacact

SEQ ID NO: 5856897 - DNA, 23 bp, Homo sapiens
cacctgttaaggtggaaaatgga

SEQ ID NO: 5856898 - DNA, 15 bp, Homo sapiens
cacctgttatgtatg

SEQ ID NO: 5856899 - DNA, 16 bp, Homo sapiens
cacctgttatgtatga

SEQ ID NO: 5856900 - DNA, 19 bp, Homo sapiens
cacctgttcacagaaaaag

SEQ ID NO: 5856901 - DNA, 18 bp, Homo sapiens
cacctgttcaggagctga

SEQ ID NO: 5856902 - DNA, 15 bp, Homo sapiens
cacctgttgcacctc

SEQ ID NO: 5856903 - DNA, 19 bp, Homo sapiens
cacctgtttctggaagact

SEQ ID NO: 5856904 - DNA, 15 bp, Homo sapiens
cacctgttttctgaa

SEQ ID NO: 5856905 - DNA, 14 bp, Homo sapiens
caccttaatatgct

SEQ ID NO: 5856906 - DNA, 18 bp, Homo sapiens
caccttacaaagccagct

SEQ ID NO: 5856907 - DNA, 14 bp, Homo sapiens
caccttacattcct

SEQ ID NO: 5856908 - DNA, 18 bp, Homo sapiens
caccttaccctactggct

SEQ ID NO: 5856909 - DNA, 13 bp, Homo sapiens
caccttagaaaaa

SEQ ID NO: 5856910 - DNA, 18 bp, Homo sapiens
caccttagacagtccctg

SEQ ID NO: 5856911 - DNA, 19 bp, Homo sapiens
caccttagacagtccctgc

SEQ ID NO: 5856912 - DNA, 19 bp, Homo sapiens
caccttagaccaccaagcc

SEQ ID NO: 5856913 - DNA, 21 bp, Homo sapiens
caccttagaccaccaagcctt

SEQ ID NO: 5856914 - DNA, 23 bp, Homo sapiens
caccttagacggaggtgcctgag

SEQ ID NO: 5856915 - DNA, 18 bp, Homo sapiens
caccttagagaagctacc

SEQ ID NO: 5856916 - DNA, 12 bp, Homo sapiens
cacggggacctg

SEQ ID NO: 5856917 - DNA, 14 bp, Homo sapiens
cacggggacctgga

SEQ ID NO: 5856918 - DNA, 19 bp, Homo sapiens
cacggggatcatctctgtg

SEQ ID NO: 5856919 - DNA, 21 bp, Homo sapiens
cacggggatcatctctgtgac

SEQ ID NO: 5856920 - DNA, 13 bp, Homo sapiens
cacggggcaaagc

SEQ ID NO: 5856921 - DNA, 15 bp, Homo sapiens
cacggggcaaagctg

SEQ ID NO: 5856922 - DNA, 20 bp, Homo sapiens
cacggggcaaagctgctggg

SEQ ID NO: 5856923 - DNA, 21 bp, Homo sapiens
cacggggcaggaccttccttc

SEQ ID NO: 5856924 - DNA, 22 bp, Homo sapiens
cacggggccgacattgtctccc

SEQ ID NO: 5856925 - DNA, 20 bp, Homo sapiens
cacgggggaggccgaggcag

SEQ ID NO: 5856926 - DNA, 21 bp, Homo sapiens
cacgggggagtgagacaggct

SEQ ID NO: 5856927 - DNA, 15 bp, Homo sapiens
cacgggggcagctga

SEQ ID NO: 5856928 - DNA, 22 bp, Homo sapiens
cacgggggcagctgatacaaat

SEQ ID NO: 5856929 - DNA, 21 bp, Homo sapiens
cacgggggctgtggctctggg

SEQ ID NO: 5856930 - DNA, 21 bp, Homo sapiens
cacggggttggctgttccaga

SEQ ID NO: 5856931 - DNA, 23 bp, Homo sapiens
cacggggttggctgttccagact

SEQ ID NO: 5856932 - DNA, 15 bp, Homo sapiens
cacgggtctgccatg

SEQ ID NO: 5856933 - DNA, 17 bp, Homo sapiens
cacgggtgtcacggcca

SEQ ID NO: 5856934 - DNA, 14 bp, Homo sapiens
cacgggtttccctc

SEQ ID NO: 5856935 - DNA, 22 bp, Homo sapiens
cacggtatttatagagagagac

SEQ ID NO: 5856936 - DNA, 22 bp, Homo sapiens
cacggtcacacctcactgtcat

SEQ ID NO: 5856937 - DNA, 20 bp, Homo sapiens
cacggtcacacggccacccg

SEQ ID NO: 5856938 - DNA, 20 bp, Homo sapiens
cacggtccaatccagccttc

SEQ ID NO: 5856939 - DNA, 21 bp, Homo sapiens
cacggtccaatccagccttct

SEQ ID NO: 5856940 - DNA, 21 bp, Homo sapiens
cacggtcccccaggaggcagc

SEQ ID NO: 5856941 - DNA, 19 bp, Homo sapiens
cacggtcctttgagtgtca

SEQ ID NO: 5856942 - DNA, 18 bp, Homo sapiens
cacggtctggaggccgag

SEQ ID NO: 5856943 - DNA, 16 bp, Homo sapiens
cacggtcttccctctt

SEQ ID NO: 5856944 - DNA, 14 bp, Homo sapiens
cacggtcttctgca

SEQ ID NO: 5856945 - DNA, 18 bp, Homo sapiens
cacggtgacacaggtcag

SEQ ID NO: 5856946 - DNA, 17 bp, Homo sapiens
cacggtgactctgtcca

SEQ ID NO: 5856947 - DNA, 16 bp, Homo sapiens
cacggtgcgtggctgt

SEQ ID NO: 5856948 - DNA, 19 bp, Homo sapiens
cacggtgcgtggctgtggc

SEQ ID NO: 5856949 - DNA, 20 bp, Homo sapiens
cacggtgcgtggctgtggca

SEQ ID NO: 5856950 - DNA, 23 bp, Homo sapiens
cacggtgcgtggctgtggcacag

SEQ ID NO: 5856951 - DNA, 16 bp, Homo sapiens
cacggtgggccttgct

SEQ ID NO: 5856952 - DNA, 23 bp, Homo sapiens
cacggtggtccccaaaacactgt

SEQ ID NO: 5856953 - DNA, 14 bp, Homo sapiens
cacggttatttaag

SEQ ID NO: 5856954 - DNA, 15 bp, Homo sapiens
cacggttatttaagc

SEQ ID NO: 5856955 - DNA, 16 bp, Homo sapiens
cacggttatttaagca

SEQ ID NO: 5856956 - DNA, 18 bp, Homo sapiens
cacggtttaactgtccca

SEQ ID NO: 5856957 - DNA, 22 bp, Homo sapiens
cacggtttaactgtcccagcga

SEQ ID NO: 5856958 - DNA, 23 bp, Homo sapiens
cacggtttcgaagtcattaaact

SEQ ID NO: 5856959 - DNA, 13 bp, Homo sapiens
cacggtttctgtt

SEQ ID NO: 5856960 - DNA, 18 bp, Homo sapiens
cacggtttgaagcctgga

SEQ ID NO: 5856961 - DNA, 19 bp, Homo sapiens
cacggtttgaagcctggaa

SEQ ID NO: 5856962 - DNA, 13 bp, Homo sapiens
cacggtttgtgag

SEQ ID NO: 5856963 - DNA, 15 bp, Homo sapiens
cacgtaaatattcat

SEQ ID NO: 5856964 - DNA, 20 bp, Homo sapiens
cacgtacaaaactctgtata

SEQ ID NO: 5856965 - DNA, 15 bp, Homo sapiens
cacgtacaaaatcca

SEQ ID NO: 5856966 - DNA, 14 bp, Homo sapiens
cacgtacacacaca

SEQ ID NO: 5856967 - DNA, 23 bp, Homo sapiens
cacgtagcccccaggctgctgga

SEQ ID NO: 5856968 - DNA, 19 bp, Homo sapiens
cacgtaggttccccagaga

SEQ ID NO: 5856969 - DNA, 21 bp, Homo sapiens
cacgtagtagggtcaggccac

SEQ ID NO: 5856970 - DNA, 16 bp, Homo sapiens
cacgtatacacccaga

SEQ ID NO: 5856971 - DNA, 15 bp, Homo sapiens
cacgtatagtcctag

SEQ ID NO: 5856972 - DNA, 18 bp, Homo sapiens
cacgtatagtcctagctg

SEQ ID NO: 5856973 - DNA, 15 bp, Homo sapiens
cacgtattccccttc

SEQ ID NO: 5856974 - DNA, 20 bp, Homo sapiens
cacgtcaaatgcatacaagt

SEQ ID NO: 5856975 - DNA, 14 bp, Homo sapiens
cacgtcaggcctgg

SEQ ID NO: 5856976 - DNA, 19 bp, Homo sapiens
cacgtcaggcctggcctca

SEQ ID NO: 5856977 - DNA, 20 bp, Homo sapiens
cacgtcaggcctggcctcat

SEQ ID NO: 5856978 - DNA, 18 bp, Homo sapiens
cacgtcatgtctctaaac

SEQ ID NO: 5856979 - DNA, 14 bp, Homo sapiens
cacgtcattgtgta

SEQ ID NO: 5856980 - DNA, 15 bp, Homo sapiens
cacgtcattgtgtaa

SEQ ID NO: 5856981 - DNA, 16 bp, Homo sapiens
cacgtcattgtgtaag

SEQ ID NO: 5856982 - DNA, 22 bp, Homo sapiens
cacgtccaaaggagtgcatggc

SEQ ID NO: 5856983 - DNA, 20 bp, Homo sapiens
cacgtcccagcatccctgga

SEQ ID NO: 5856984 - DNA, 22 bp, Homo sapiens
cacgtcccagcatccctggagc

SEQ ID NO: 5856985 - DNA, 12 bp, Homo sapiens
cacgtcccatgt

SEQ ID NO: 5856986 - DNA, 13 bp, Homo sapiens
cacgtcccatgtg

SEQ ID NO: 5856987 - DNA, 15 bp, Homo sapiens
cacgtccccctgggg

SEQ ID NO: 5856988 - DNA, 16 bp, Homo sapiens
cacgtccccctggggc

SEQ ID NO: 5856989 - DNA, 20 bp, Homo sapiens
cacgtccccctggggcttct

SEQ ID NO: 5856990 - DNA, 13 bp, Homo sapiens
cacgtcccgctgc

SEQ ID NO: 5856991 - DNA, 19 bp, Homo sapiens
cacgtcccgctgcctcctg

SEQ ID NO: 5856992 - DNA, 21 bp, Homo sapiens
cacgtcccgctgcctcctgct

SEQ ID NO: 5856993 - DNA, 20 bp, Homo sapiens
cacgtccctcgagctctgta

SEQ ID NO: 5856994 - DNA, 22 bp, Homo sapiens
cacgtccctgcggaagccacag

SEQ ID NO: 5856995 - DNA, 16 bp, Homo sapiens
cacgtcctcgaattct

SEQ ID NO: 5856996 - DNA, 19 bp, Homo sapiens
cacgtcctgtcagtgccgc

SEQ ID NO: 5856997 - DNA, 19 bp, Homo sapiens
cacgtctatttcatcagaa

SEQ ID NO: 5856998 - DNA, 15 bp, Homo sapiens
cacgtctcctcctcg

SEQ ID NO: 5856999 - DNA, 13 bp, Homo sapiens
cacgtctcctgct

SEQ ID NO: 5857000 - DNA, 16 bp, Homo sapiens
cacgtctcctgctgcg

SEQ ID NO: 5857001 - DNA, 18 bp, Homo sapiens
cacgtctctctgcctgct

SEQ ID NO: 5857002 - DNA, 19 bp, Homo sapiens
cacgtctctctgcctgctg

SEQ ID NO: 5857003 - DNA, 22 bp, Homo sapiens
cacgtctctctgcctgctgggc

SEQ ID NO: 5857004 - DNA, 23 bp, Homo sapiens
cacgtctctctgcctgctgggct

SEQ ID NO: 5857005 - DNA, 17 bp, Homo sapiens
cacgtctctgccgcctg

SEQ ID NO: 5857006 - DNA, 18 bp, Homo sapiens
cacgtctctgccgcctgc

SEQ ID NO: 5857007 - DNA, 15 bp, Homo sapiens
cacgtctgacaaatg

SEQ ID NO: 5857008 - DNA, 17 bp, Homo sapiens
cacgtctgaccctctcc

SEQ ID NO: 5857009 - DNA, 18 bp, Homo sapiens
cacgtctgaccctctcca

SEQ ID NO: 5857010 - DNA, 13 bp, Homo sapiens
cacgtctgccagg

SEQ ID NO: 5857011 - DNA, 21 bp, Homo sapiens
cacgtctgccaggcccatctc

SEQ ID NO: 5857012 - DNA, 18 bp, Homo sapiens
cacgtctggccaggcact

SEQ ID NO: 5857013 - DNA, 18 bp, Homo sapiens
cacgtctgtaatcccagc

SEQ ID NO: 5857014 - DNA, 14 bp, Homo sapiens
cacgtctgtcctcc

SEQ ID NO: 5857015 - DNA, 15 bp, Homo sapiens
cacgtctgtcttcac

SEQ ID NO: 5857016 - DNA, 14 bp, Homo sapiens
cacgtctgtgctct

SEQ ID NO: 5857017 - DNA, 16 bp, Homo sapiens
cacgtctgtgctctgt

SEQ ID NO: 5857018 - DNA, 20 bp, Homo sapiens
cacgtcttcttgctgcagcc

SEQ ID NO: 5857019 - DNA, 14 bp, Homo sapiens
cacgtgaaactgct

SEQ ID NO: 5857020 - DNA, 15 bp, Homo sapiens
cacgtgaaactgctg

SEQ ID NO: 5857021 - DNA, 12 bp, Homo sapiens
cacgtgaatggc

SEQ ID NO: 5857022 - DNA, 14 bp, Homo sapiens
cacgtgacacaaac

SEQ ID NO: 5857023 - DNA, 13 bp, Homo sapiens
cacgtgacaggct

SEQ ID NO: 5857024 - DNA, 22 bp, Homo sapiens
cacgtgacaggctcgtcagcca

SEQ ID NO: 5857025 - DNA, 16 bp, Homo sapiens
cacgtgaccagccccg

SEQ ID NO: 5857026 - DNA, 16 bp, Homo sapiens
cacgtgaccctgtgcc

SEQ ID NO: 5857027 - DNA, 20 bp, Homo sapiens
cacgtgaggcccctgtgcag

SEQ ID NO: 5857028 - DNA, 19 bp, Homo sapiens
cacgtgatggaccaaagcc

SEQ ID NO: 5857029 - DNA, 20 bp, Homo sapiens
cacgtgatggaccaaagcca

SEQ ID NO: 5857030 - DNA, 19 bp, Homo sapiens
cacgtgcaaggactcccgg

SEQ ID NO: 5857031 - DNA, 16 bp, Homo sapiens
cacgtgcacacacctg

SEQ ID NO: 5857032 - DNA, 19 bp, Homo sapiens
cacgtgcacacacctgcac

SEQ ID NO: 5857033 - DNA, 21 bp, Homo sapiens
cacgtgcacagcttcctgagt

SEQ ID NO: 5857034 - DNA, 20 bp, Homo sapiens
cacgtgcagcacctgtcacc

SEQ ID NO: 5857035 - DNA, 14 bp, Homo sapiens
cacgtgcagccacg

SEQ ID NO: 5857036 - DNA, 19 bp, Homo sapiens
cacgtgcaggacagctctt

SEQ ID NO: 5857037 - DNA, 20 bp, Homo sapiens
cacgtgcaggacagctcttg

SEQ ID NO: 5857038 - DNA, 21 bp, Homo sapiens
cacgtgcctgtagtcccagct

SEQ ID NO: 5857039 - DNA, 14 bp, Homo sapiens
cacgtgccttagga

SEQ ID NO: 5857040 - DNA, 15 bp, Homo sapiens
cacgtgccttaggaa

SEQ ID NO: 5857041 - DNA, 19 bp, Homo sapiens
cacgtgctacccccatgct

SEQ ID NO: 5857042 - DNA, 18 bp, Homo sapiens
cacgtgctctctgctgga

SEQ ID NO: 5857043 - DNA, 19 bp, Homo sapiens
cacgtgctcttctgttctc

SEQ ID NO: 5857044 - DNA, 18 bp, Homo sapiens
cacgtgctggagagtaga

SEQ ID NO: 5857045 - DNA, 16 bp, Homo sapiens
cacgtggactctgtgc

SEQ ID NO: 5857046 - DNA, 13 bp, Homo sapiens
cacgtggagagct

SEQ ID NO: 5857047 - DNA, 15 bp, Homo sapiens
cacgtggagagctgg

SEQ ID NO: 5857048 - DNA, 17 bp, Homo sapiens
cacgtggagatagtgcc

SEQ ID NO: 5857049 - DNA, 21 bp, Homo sapiens
cacgtggaggtgaagtccctg

SEQ ID NO: 5857050 - DNA, 15 bp, Homo sapiens
cacgtggcacctcct

SEQ ID NO: 5857051 - DNA, 14 bp, Homo sapiens
cacgtggccaggag

SEQ ID NO: 5857052 - DNA, 20 bp, Homo sapiens
cacgtggctagggttccact

SEQ ID NO: 5857053 - DNA, 15 bp, Homo sapiens
cacgtggcttctgat

SEQ ID NO: 5857054 - DNA, 16 bp, Homo sapiens
cacgtggcttctgatg

SEQ ID NO: 5857055 - DNA, 17 bp, Homo sapiens
cacgtgggctcccctct

SEQ ID NO: 5857056 - DNA, 19 bp, Homo sapiens
cacgtgggctcccctcttc

SEQ ID NO: 5857057 - DNA, 17 bp, Homo sapiens
cacgtggggagcggtgg

SEQ ID NO: 5857058 - DNA, 15 bp, Homo sapiens
cacgtggggtggaat

SEQ ID NO: 5857059 - DNA, 20 bp, Homo sapiens
cacgtggtcaaggcccggcc

SEQ ID NO: 5857060 - DNA, 22 bp, Homo sapiens
cacgtggtcactgtgcactgcc

SEQ ID NO: 5857061 - DNA, 23 bp, Homo sapiens
cacgtggtgacctcacacacctc

SEQ ID NO: 5857062 - DNA, 18 bp, Homo sapiens
cacgtggtggcccagctc

SEQ ID NO: 5857063 - DNA, 23 bp, Homo sapiens
cacgtggttggggccctgccctg

SEQ ID NO: 5857064 - DNA, 13 bp, Homo sapiens
cacgtgtactggc

SEQ ID NO: 5857065 - DNA, 16 bp, Homo sapiens
cacgtgtactggctcc

SEQ ID NO: 5857066 - DNA, 22 bp, Homo sapiens
cacgtgtccgtccacccttcca

SEQ ID NO: 5857067 - DNA, 16 bp, Homo sapiens
cacgtgtcctgtagtt

SEQ ID NO: 5857068 - DNA, 23 bp, Homo sapiens
cacgtgtctggaatcccagctcc

SEQ ID NO: 5857069 - DNA, 14 bp, Homo sapiens
cacgtgtcttccac

SEQ ID NO: 5857070 - DNA, 16 bp, Homo sapiens
cacgtgtgatgtatgt

SEQ ID NO: 5857071 - DNA, 15 bp, Homo sapiens
cacgtgtgctgggat

SEQ ID NO: 5857072 - DNA, 24 bp, Homo sapiens
cacgtgtgctgggatctactttcc

SEQ ID NO: 5857073 - DNA, 20 bp, Homo sapiens
cacgtgtgctgtggccaggc

SEQ ID NO: 5857074 - DNA, 14 bp, Homo sapiens
cacgtgtggcctcc

SEQ ID NO: 5857075 - DNA, 11 bp, Homo sapiens
cacgtgtgtga

SEQ ID NO: 5857076 - DNA, 17 bp, Homo sapiens
cacgtgtgtttttctat

SEQ ID NO: 5857077 - DNA, 18 bp, Homo sapiens
cacgtgtgtttttctatt

SEQ ID NO: 5857078 - DNA, 16 bp, Homo sapiens
cacgtgttctcacact

SEQ ID NO: 5857079 - DNA, 16 bp, Homo sapiens
cacgtgtttgtgctgt

SEQ ID NO: 5857080 - DNA, 18 bp, Homo sapiens
cacgtgttttccatccca

SEQ ID NO: 5857081 - DNA, 21 bp, Homo sapiens
cacgttaaaaattaaaagaag

SEQ ID NO: 5857082 - DNA, 14 bp, Homo sapiens
cacgttactcccct

SEQ ID NO: 5857083 - DNA, 18 bp, Homo sapiens
cacgttatggtgtttctc

SEQ ID NO: 5857084 - DNA, 16 bp, Homo sapiens
cacgttcagggagggg

SEQ ID NO: 5857085 - DNA, 15 bp, Homo sapiens
cacgttcataaccaa

SEQ ID NO: 5857086 - DNA, 22 bp, Homo sapiens
cacgttcgaggcggtttccagg

SEQ ID NO: 5857087 - DNA, 12 bp, Homo sapiens
cacgttctgatt

SEQ ID NO: 5857088 - DNA, 22 bp, Homo sapiens
cacgttgacagtacctagctgt

SEQ ID NO: 5857089 - DNA, 14 bp, Homo sapiens
cacgttgcagaaaa

SEQ ID NO: 5857090 - DNA, 22 bp, Homo sapiens
cacgttgcccaaggttgcacag

SEQ ID NO: 5857091 - DNA, 18 bp, Homo sapiens
cacgtttaatcccagcac

SEQ ID NO: 5857092 - DNA, 20 bp, Homo sapiens
cacgtttaatcccagcactt

SEQ ID NO: 5857093 - DNA, 16 bp, Homo sapiens
cactcagcccctagga

SEQ ID NO: 5857094 - DNA, 17 bp, Homo sapiens
cactcagcccctaggag

SEQ ID NO: 5857095 - DNA, 18 bp, Homo sapiens
cactcagccccttcccgg

SEQ ID NO: 5857096 - DNA, 21 bp, Homo sapiens
cactcagccgcagacaagtaa

SEQ ID NO: 5857097 - DNA, 13 bp, Homo sapiens
cactcagcctcat

SEQ ID NO: 5857098 - DNA, 21 bp, Homo sapiens
cactcagcttaattctccttc

SEQ ID NO: 5857099 - DNA, 22 bp, Homo sapiens
cactcagcttaattctccttcc

SEQ ID NO: 5857100 - DNA, 17 bp, Homo sapiens
cactcaggaaccctgga

SEQ ID NO: 5857101 - DNA, 20 bp, Homo sapiens
cactcaggaaccctggagac

SEQ ID NO: 5857102 - DNA, 14 bp, Homo sapiens
cactcaggactttg

SEQ ID NO: 5857103 - DNA, 17 bp, Homo sapiens
cactcaggagcacagcc

SEQ ID NO: 5857104 - DNA, 12 bp, Homo sapiens
cactcaggccac

SEQ ID NO: 5857105 - DNA, 14 bp, Homo sapiens
cactcaggccacag

SEQ ID NO: 5857106 - DNA, 18 bp, Homo sapiens
cactcaggcctctgcaga

SEQ ID NO: 5857107 - DNA, 12 bp, Homo sapiens
cactcaggcctg

SEQ ID NO: 5857108 - DNA, 16 bp, Homo sapiens
cactcaggcctgtgcc

SEQ ID NO: 5857109 - DNA, 22 bp, Homo sapiens
cactcaggcctgtgcccactcc

SEQ ID NO: 5857110 - DNA, 13 bp, Homo sapiens
cactcaggctgga

SEQ ID NO: 5857111 - DNA, 14 bp, Homo sapiens
cactcaggctggag

SEQ ID NO: 5857112 - DNA, 13 bp, Homo sapiens
cactcagggcagc

SEQ ID NO: 5857113 - DNA, 18 bp, Homo sapiens
cactcaggggaccccact

SEQ ID NO: 5857114 - DNA, 20 bp, Homo sapiens
cactcaggggaccccactcc

SEQ ID NO: 5857115 - DNA, 22 bp, Homo sapiens
cactcaggggaccccactcccc

SEQ ID NO: 5857116 - DNA, 15 bp, Homo sapiens
cactcaggtacttgg

SEQ ID NO: 5857117 - DNA, 16 bp, Homo sapiens
cactcaggtctgtttt

SEQ ID NO: 5857118 - DNA, 18 bp, Homo sapiens
cactcagtccactgttga

SEQ ID NO: 5857119 - DNA, 13 bp, Homo sapiens
cactcagtgcctc

SEQ ID NO: 5857120 - DNA, 21 bp, Homo sapiens
cactcagtgcctccacatgct

SEQ ID NO: 5857121 - DNA, 14 bp, Homo sapiens
cactcagtgcttct

SEQ ID NO: 5857122 - DNA, 17 bp, Homo sapiens
cactcatagggtgctct

SEQ ID NO: 5857123 - DNA, 23 bp, Homo sapiens
cactcatataaaaggtgagctca

SEQ ID NO: 5857124 - DNA, 23 bp, Homo sapiens
cactcatgcggcccagccatggg

SEQ ID NO: 5857125 - DNA, 14 bp, Homo sapiens
cactcatgctgaaa

SEQ ID NO: 5857126 - DNA, 17 bp, Homo sapiens
cactcatgctgaaagcc

SEQ ID NO: 5857127 - DNA, 18 bp, Homo sapiens
cactcatggaacactcat

SEQ ID NO: 5857128 - DNA, 19 bp, Homo sapiens
cactcatgggaatgcattt

SEQ ID NO: 5857129 - DNA, 16 bp, Homo sapiens
cactcatgtgactctt

SEQ ID NO: 5857130 - DNA, 13 bp, Homo sapiens
cactcattcctgt

SEQ ID NO: 5857131 - DNA, 18 bp, Homo sapiens
cactcattgacctgaggc

SEQ ID NO: 5857132 - DNA, 19 bp, Homo sapiens
cactcattgacctgaggcc

SEQ ID NO: 5857133 - DNA, 24 bp, Homo sapiens
cactcattgcagatcccagcccac

SEQ ID NO: 5857134 - DNA, 16 bp, Homo sapiens
cactcatttatttcca

SEQ ID NO: 5857135 - DNA, 18 bp, Homo sapiens
cactcatttcatctcatt

SEQ ID NO: 5857136 - DNA, 19 bp, Homo sapiens
cactcatttcatctcattt

SEQ ID NO: 5857137 - DNA, 14 bp, Homo sapiens
cactcatttccaat

SEQ ID NO: 5857138 - DNA, 22 bp, Homo sapiens
cactcattttctataacagata

SEQ ID NO: 5857139 - DNA, 13 bp, Homo sapiens
cactccaagacca

SEQ ID NO: 5857140 - DNA, 14 bp, Homo sapiens
cactccaagaccac

SEQ ID NO: 5857141 - DNA, 18 bp, Homo sapiens
cactccaagaccaccagg

SEQ ID NO: 5857142 - DNA, 19 bp, Homo sapiens
cactccaagaccaccaggg

SEQ ID NO: 5857143 - DNA, 19 bp, Homo sapiens
cactccaagatatggacac

SEQ ID NO: 5857144 - DNA, 16 bp, Homo sapiens
cactccaagcccagcc

SEQ ID NO: 5857145 - DNA, 15 bp, Homo sapiens
cactccaagccccct

SEQ ID NO: 5857146 - DNA, 23 bp, Homo sapiens
cactccaagtgccccaccactcc

SEQ ID NO: 5857147 - DNA, 21 bp, Homo sapiens
cactccaatgtctgctgagga

SEQ ID NO: 5857148 - DNA, 14 bp, Homo sapiens
cactccacaaatga

SEQ ID NO: 5857149 - DNA, 15 bp, Homo sapiens
cactccacagagtga

SEQ ID NO: 5857150 - DNA, 14 bp, Homo sapiens
cactccacagtgtt

SEQ ID NO: 5857151 - DNA, 19 bp, Homo sapiens
cactccacagtgtttatat

SEQ ID NO: 5857152 - DNA, 11 bp, Homo sapiens
cactccaccac

SEQ ID NO: 5857153 - DNA, 15 bp, Homo sapiens
cactccaccctccac

SEQ ID NO: 5857154 - DNA, 19 bp, Homo sapiens
cactccacgcagctggcag

SEQ ID NO: 5857155 - DNA, 22 bp, Homo sapiens
cactccacgcagctggcagaga

SEQ ID NO: 5857156 - DNA, 15 bp, Homo sapiens
cactccactcccctc

SEQ ID NO: 5857157 - DNA, 14 bp, Homo sapiens
cactccactgacaa

SEQ ID NO: 5857158 - DNA, 23 bp, Homo sapiens
cactccagaattacccttcctca

SEQ ID NO: 5857159 - DNA, 17 bp, Homo sapiens
cactccagacccctggc

SEQ ID NO: 5857160 - DNA, 11 bp, Homo sapiens
cactccagact

SEQ ID NO: 5857161 - DNA, 14 bp, Homo sapiens
cactccagactctg

SEQ ID NO: 5857162 - DNA, 16 bp, Homo sapiens
cactccagactctggg

SEQ ID NO: 5857163 - DNA, 18 bp, Homo sapiens
cactccagactctggggg

SEQ ID NO: 5857164 - DNA, 11 bp, Homo sapiens
cactccagccc

SEQ ID NO: 5857165 - DNA, 13 bp, Homo sapiens
cactccagcccaa

SEQ ID NO: 5857166 - DNA, 12 bp, Homo sapiens
cactccagccct

SEQ ID NO: 5857167 - DNA, 15 bp, Homo sapiens
cactccagcctgagc

SEQ ID NO: 5857168 - DNA, 15 bp, Homo sapiens
cactccagcctgggc

SEQ ID NO: 5857169 - DNA, 22 bp, Homo sapiens
cactccagcctgggtcacagag

SEQ ID NO: 5857170 - DNA, 16 bp, Homo sapiens
cactccagcctgggtg

SEQ ID NO: 5857171 - DNA, 23 bp, Homo sapiens
cactccagctgacagccacaccg

SEQ ID NO: 5857172 - DNA, 15 bp, Homo sapiens
cactccagctgggat

SEQ ID NO: 5857173 - DNA, 13 bp, Homo sapiens
cactccaggccct

SEQ ID NO: 5857174 - DNA, 18 bp, Homo sapiens
cactccaggccctgcccc

SEQ ID NO: 5857175 - DNA, 20 bp, Homo sapiens
cactccagggacacacagcc

SEQ ID NO: 5857176 - DNA, 14 bp, Homo sapiens
cactccagtcaaca

SEQ ID NO: 5857177 - DNA, 17 bp, Homo sapiens
cactccagtcctgccac

SEQ ID NO: 5857178 - DNA, 18 bp, Homo sapiens
cactccagtcctgccacc

SEQ ID NO: 5857179 - DNA, 19 bp, Homo sapiens
cactccagtcctgccacca

SEQ ID NO: 5857180 - DNA, 16 bp, Homo sapiens
cactccagtgagacag

SEQ ID NO: 5857181 - DNA, 11 bp, Homo sapiens
cactccagtgc

SEQ ID NO: 5857182 - DNA, 16 bp, Homo sapiens
cactccagtgccagca

SEQ ID NO: 5857183 - DNA, 19 bp, Homo sapiens
cactccagttttctcctct

SEQ ID NO: 5857184 - DNA, 18 bp, Homo sapiens
cactccatcactgagagc

SEQ ID NO: 5857185 - DNA, 15 bp, Homo sapiens
cactccatggccacc

SEQ ID NO: 5857186 - DNA, 22 bp, Homo sapiens
cactccattattcctctcaccc

SEQ ID NO: 5857187 - DNA, 12 bp, Homo sapiens
cactccattccc

SEQ ID NO: 5857188 - DNA, 14 bp, Homo sapiens
cactcccaaccctg

SEQ ID NO: 5857189 - DNA, 12 bp, Homo sapiens
cactcccaagcc

SEQ ID NO: 5857190 - DNA, 14 bp, Homo sapiens
cactcccaagccac

SEQ ID NO: 5857191 - DNA, 17 bp, Homo sapiens
cactcccacatgggccc

SEQ ID NO: 5857192 - DNA, 20 bp, Homo sapiens
cactcccacctcacccggcc

SEQ ID NO: 5857193 - DNA, 22 bp, Homo sapiens
cactcccacctgacacaccagg

SEQ ID NO: 5857194 - DNA, 14 bp, Homo sapiens
cactcccacgcctg

SEQ ID NO: 5857195 - DNA, 18 bp, Homo sapiens
cactcccagcagctcaac

SEQ ID NO: 5857196 - DNA, 13 bp, Homo sapiens
cactcccaggcag

SEQ ID NO: 5857197 - DNA, 13 bp, Homo sapiens
cactcccagggac

SEQ ID NO: 5857198 - DNA, 13 bp, Homo sapiens
cactcccagggcc

SEQ ID NO: 5857199 - DNA, 15 bp, Homo sapiens
cactcccagggcccg

SEQ ID NO: 5857200 - DNA, 21 bp, Homo sapiens
cactcccaggggcctttgcag

SEQ ID NO: 5857201 - DNA, 15 bp, Homo sapiens
cactcccatttttac

SEQ ID NO: 5857202 - DNA, 17 bp, Homo sapiens
cactccccaacccctct

SEQ ID NO: 5857203 - DNA, 14 bp, Homo sapiens
cactccccaaggaa

SEQ ID NO: 5857204 - DNA, 14 bp, Homo sapiens
cactccccacatcc

SEQ ID NO: 5857205 - DNA, 17 bp, Homo sapiens
cactccccagagctgtg

SEQ ID NO: 5857206 - DNA, 19 bp, Homo sapiens
cactccccagcctgggccc

SEQ ID NO: 5857207 - DNA, 13 bp, Homo sapiens
cactccccaggga

SEQ ID NO: 5857208 - DNA, 18 bp, Homo sapiens
cactccccatgccacgtt

SEQ ID NO: 5857209 - DNA, 18 bp, Homo sapiens
cactcccccacccatggg

SEQ ID NO: 5857210 - DNA, 23 bp, Homo sapiens
cactcccccacccatggggagga

SEQ ID NO: 5857211 - DNA, 12 bp, Homo sapiens
cactcccccagg

SEQ ID NO: 5857212 - DNA, 15 bp, Homo sapiens
cactcccccttccct

SEQ ID NO: 5857213 - DNA, 19 bp, Homo sapiens
cactccccgaagtcttttg

SEQ ID NO: 5857214 - DNA, 17 bp, Homo sapiens
cactccccgcctgtcct

SEQ ID NO: 5857215 - DNA, 17 bp, Homo sapiens
cactcccctaaactcca

SEQ ID NO: 5857216 - DNA, 14 bp, Homo sapiens
cactcccctagggg

SEQ ID NO: 5857217 - DNA, 12 bp, Homo sapiens
cactcccctcat

SEQ ID NO: 5857218 - DNA, 12 bp, Homo sapiens
cactcccctgct

SEQ ID NO: 5857219 - DNA, 14 bp, Homo sapiens
cactccccttgcct

SEQ ID NO: 5857220 - DNA, 15 bp, Homo sapiens
cactccccttgcctt

SEQ ID NO: 5857221 - DNA, 22 bp, Homo sapiens
cactccccttgccttcccctgt

SEQ ID NO: 5857222 - DNA, 20 bp, Homo sapiens
cactcccgaaagcctttcct

SEQ ID NO: 5857223 - DNA, 21 bp, Homo sapiens
cactcccgaaagcctttcctc

SEQ ID NO: 5857224 - DNA, 22 bp, Homo sapiens
cactcccgagacggcactgaga

SEQ ID NO: 5857225 - DNA, 14 bp, Homo sapiens
cactcccgctgagc

SEQ ID NO: 5857226 - DNA, 23 bp, Homo sapiens
cactcccgctgcacacagacggc

SEQ ID NO: 5857227 - DNA, 20 bp, Homo sapiens
cactcccggcctaggcacct

SEQ ID NO: 5857228 - DNA, 23 bp, Homo sapiens
cactcccggcctaggcacctccc

SEQ ID NO: 5857229 - DNA, 18 bp, Homo sapiens
cactcccgggatgggtgg

SEQ ID NO: 5857230 - DNA, 19 bp, Homo sapiens
cactcccgggatgggtgga

SEQ ID NO: 5857231 - DNA, 21 bp, Homo sapiens
cactcccgggccaagacagat

SEQ ID NO: 5857232 - DNA, 22 bp, Homo sapiens
cactcccgggccaagacagatg

SEQ ID NO: 5857233 - DNA, 20 bp, Homo sapiens
cactccctaaccaaatgctg

SEQ ID NO: 5857234 - DNA, 20 bp, Homo sapiens
cactccctaagaaaccccag

SEQ ID NO: 5857235 - DNA, 16 bp, Homo sapiens
cactccctatctcctt

SEQ ID NO: 5857236 - DNA, 21 bp, Homo sapiens
cactccctatctccttcccac

SEQ ID NO: 5857237 - DNA, 15 bp, Homo sapiens
cactccctccatcaa

SEQ ID NO: 5857238 - DNA, 11 bp, Homo sapiens
cactccctccc

SEQ ID NO: 5857239 - DNA, 14 bp, Homo sapiens
cactccctcctaac

SEQ ID NO: 5857240 - DNA, 13 bp, Homo sapiens
cactccctcctgg

SEQ ID NO: 5857241 - DNA, 12 bp, Homo sapiens
cactccctgcaa

SEQ ID NO: 5857242 - DNA, 13 bp, Homo sapiens
cactccctgcaac

SEQ ID NO: 5857243 - DNA, 16 bp, Homo sapiens
cactccctgcaacctg

SEQ ID NO: 5857244 - DNA, 12 bp, Homo sapiens
cactccctgctc

SEQ ID NO: 5857245 - DNA, 12 bp, Homo sapiens
cactccctggcc

SEQ ID NO: 5857246 - DNA, 17 bp, Homo sapiens
cactccctggccttgcc

SEQ ID NO: 5857247 - DNA, 15 bp, Homo sapiens
cactccctgtccatc

SEQ ID NO: 5857248 - DNA, 14 bp, Homo sapiens
cactccctgtctga

SEQ ID NO: 5857249 - DNA, 17 bp, Homo sapiens
cactcccttctacctgc

SEQ ID NO: 5857250 - DNA, 20 bp, Homo sapiens
cactcccttctacctgccac

SEQ ID NO: 5857251 - DNA, 22 bp, Homo sapiens
cactcccttctacctgccactc

SEQ ID NO: 5857252 - DNA, 14 bp, Homo sapiens
cactcccttgctgg

SEQ ID NO: 5857253 - DNA, 20 bp, Homo sapiens
cactcccttgggctccctgt

SEQ ID NO: 5857254 - DNA, 17 bp, Homo sapiens
cactccctttcccctct

SEQ ID NO: 5857255 - DNA, 23 bp, Homo sapiens
cactccctttgcgtcaggagcag

SEQ ID NO: 5857256 - DNA, 23 bp, Homo sapiens
cactccctttgtggactttattt

SEQ ID NO: 5857257 - DNA, 19 bp, Homo sapiens
cactccgactccccctccc

SEQ ID NO: 5857258 - DNA, 16 bp, Homo sapiens
cactccgccagccaca

SEQ ID NO: 5857259 - DNA, 18 bp, Homo sapiens
cactccgccagccacagg

SEQ ID NO: 5857260 - DNA, 21 bp, Homo sapiens
cactccgcgccgatgccaccg

SEQ ID NO: 5857261 - DNA, 24 bp, Homo sapiens
cactccggattccggccctggctg

SEQ ID NO: 5857262 - DNA, 20 bp, Homo sapiens
cactccggtcagcccctggc

SEQ ID NO: 5857263 - DNA, 19 bp, Homo sapiens
cactccggtgtgcctgcag

SEQ ID NO: 5857264 - DNA, 14 bp, Homo sapiens
cactccgtctgctc

SEQ ID NO: 5857265 - DNA, 18 bp, Homo sapiens
cactcctacacctaactc

SEQ ID NO: 5857266 - DNA, 14 bp, Homo sapiens
cactcctactgagt

SEQ ID NO: 5857267 - DNA, 19 bp, Homo sapiens
cactcctagagaacgcagc

SEQ ID NO: 5857268 - DNA, 19 bp, Homo sapiens
cactcctaggagagccaac

SEQ ID NO: 5857269 - DNA, 21 bp, Homo sapiens
cactcctaggagagccaacct

SEQ ID NO: 5857270 - DNA, 15 bp, Homo sapiens
cactcctcaagactt

SEQ ID NO: 5857271 - DNA, 12 bp, Homo sapiens
cactcctcacac

SEQ ID NO: 5857272 - DNA, 13 bp, Homo sapiens
cactcctcacaca

SEQ ID NO: 5857273 - DNA, 22 bp, Homo sapiens
cactgagcactgttttctagtg

SEQ ID NO: 5857274 - DNA, 14 bp, Homo sapiens
cactgagcagggat

SEQ ID NO: 5857275 - DNA, 18 bp, Homo sapiens
cactgagcatcacaataa

SEQ ID NO: 5857276 - DNA, 22 bp, Homo sapiens
cactgagcatcacaataaagag

SEQ ID NO: 5857277 - DNA, 21 bp, Homo sapiens
cactgagccaggcttttctca

SEQ ID NO: 5857278 - DNA, 14 bp, Homo sapiens
cactgagccccacc

SEQ ID NO: 5857279 - DNA, 13 bp, Homo sapiens
cactgagcccccc

SEQ ID NO: 5857280 - DNA, 19 bp, Homo sapiens
cactgagcccttgcacagg

SEQ ID NO: 5857281 - DNA, 23 bp, Homo sapiens
cactgagcccttgcacaggccac

SEQ ID NO: 5857282 - DNA, 16 bp, Homo sapiens
cactgagctccccaga

SEQ ID NO: 5857283 - DNA, 14 bp, Homo sapiens
cactgagctctgcc

SEQ ID NO: 5857284 - DNA, 17 bp, Homo sapiens
cactgagctctgcctca

SEQ ID NO: 5857285 - DNA, 13 bp, Homo sapiens
cactgagctgggc

SEQ ID NO: 5857286 - DNA, 18 bp, Homo sapiens
cactgagctgtgacccag

SEQ ID NO: 5857287 - DNA, 20 bp, Homo sapiens
cactgagctgtgacccagag

SEQ ID NO: 5857288 - DNA, 21 bp, Homo sapiens
cactgagctgtgacccagagg

SEQ ID NO: 5857289 - DNA, 15 bp, Homo sapiens
cactgaggaagaacg

SEQ ID NO: 5857290 - DNA, 17 bp, Homo sapiens
cactgaggaagaacggg

SEQ ID NO: 5857291 - DNA, 12 bp, Homo sapiens
cactgaggactg

SEQ ID NO: 5857292 - DNA, 13 bp, Homo sapiens
cactgaggactgt

SEQ ID NO: 5857293 - DNA, 14 bp, Homo sapiens
cactgaggagacag

SEQ ID NO: 5857294 - DNA, 21 bp, Homo sapiens
cactgaggagacagaaagcct

SEQ ID NO: 5857295 - DNA, 22 bp, Homo sapiens
cactgaggagacagaaagcctc

SEQ ID NO: 5857296 - DNA, 14 bp, Homo sapiens
cactgaggatgtga

SEQ ID NO: 5857297 - DNA, 18 bp, Homo sapiens
cactgaggatgtgagcct

SEQ ID NO: 5857298 - DNA, 16 bp, Homo sapiens
cactgaggcagccttg

SEQ ID NO: 5857299 - DNA, 20 bp, Homo sapiens
cactgaggcagccttgggga

SEQ ID NO: 5857300 - DNA, 20 bp, Homo sapiens
cactgaggcagcgacctcaa

SEQ ID NO: 5857301 - DNA, 13 bp, Homo sapiens
cactgaggcaggg

SEQ ID NO: 5857302 - DNA, 21 bp, Homo sapiens
cactgaggcctgagacccagg

SEQ ID NO: 5857303 - DNA, 22 bp, Homo sapiens
cactgaggcctgagacccagga

SEQ ID NO: 5857304 - DNA, 20 bp, Homo sapiens
cactgaggcgctcgctccca

SEQ ID NO: 5857305 - DNA, 23 bp, Homo sapiens
cactgaggcgctcgctcccatgc

SEQ ID NO: 5857306 - DNA, 14 bp, Homo sapiens
cactgagggatctg

SEQ ID NO: 5857307 - DNA, 15 bp, Homo sapiens
cactgaggggtggca

SEQ ID NO: 5857308 - DNA, 17 bp, Homo sapiens
cactgagggtctggtgc

SEQ ID NO: 5857309 - DNA, 16 bp, Homo sapiens
cactgaggtccacaga

SEQ ID NO: 5857310 - DNA, 16 bp, Homo sapiens
cactgagtacaaatgt

SEQ ID NO: 5857311 - DNA, 17 bp, Homo sapiens
cactgagtacaaatgtg

SEQ ID NO: 5857312 - DNA, 18 bp, Homo sapiens
cactgagtaccaggggct

SEQ ID NO: 5857313 - DNA, 23 bp, Homo sapiens
cactgagtaccaggggctgggct

SEQ ID NO: 5857314 - DNA, 16 bp, Homo sapiens
cactgagtctcattcc

SEQ ID NO: 5857315 - DNA, 14 bp, Homo sapiens
cactgagtctggag

SEQ ID NO: 5857316 - DNA, 15 bp, Homo sapiens
cactgagtgaaatat

SEQ ID NO: 5857317 - DNA, 15 bp, Homo sapiens
cactgagtgaaggaa

SEQ ID NO: 5857318 - DNA, 22 bp, Homo sapiens
cactgagtgaggagtggacgct

SEQ ID NO: 5857319 - DNA, 23 bp, Homo sapiens
cactgagtgaggagtggacgctg

SEQ ID NO: 5857320 - DNA, 15 bp, Homo sapiens
cactgagttgcacat

SEQ ID NO: 5857321 - DNA, 12 bp, Homo sapiens
cactgagtttct

SEQ ID NO: 5857322 - DNA, 13 bp, Homo sapiens
cactgagtttcta

SEQ ID NO: 5857323 - DNA, 22 bp, Homo sapiens
cactgagtttctatttagacac

SEQ ID NO: 5857324 - DNA, 15 bp, Homo sapiens
cactgagttttccat

SEQ ID NO: 5857325 - DNA, 20 bp, Homo sapiens
cactgagttttgtttcactt

SEQ ID NO: 5857326 - DNA, 21 bp, Homo sapiens
cactgagttttgtttcacttt

SEQ ID NO: 5857327 - DNA, 18 bp, Homo sapiens
cactgataaaagttttga

SEQ ID NO: 5857328 - DNA, 14 bp, Homo sapiens
cactgataagactg

SEQ ID NO: 5857329 - DNA, 17 bp, Homo sapiens
cactgataatcacactg

SEQ ID NO: 5857330 - DNA, 18 bp, Homo sapiens
cactgataatcacactgc

SEQ ID NO: 5857331 - DNA, 16 bp, Homo sapiens
cactgatacataaaaa

SEQ ID NO: 5857332 - DNA, 13 bp, Homo sapiens
cactgatagtcct

SEQ ID NO: 5857333 - DNA, 20 bp, Homo sapiens
cactgatatatcatgagtga

SEQ ID NO: 5857334 - DNA, 18 bp, Homo sapiens
cactgatatattttccag

SEQ ID NO: 5857335 - DNA, 13 bp, Homo sapiens
cactgatattcag

SEQ ID NO: 5857336 - DNA, 15 bp, Homo sapiens
cactgatcacccaat

SEQ ID NO: 5857337 - DNA, 16 bp, Homo sapiens
cactgatccagccctg

SEQ ID NO: 5857338 - DNA, 22 bp, Homo sapiens
cactgatctctactaccacaag

SEQ ID NO: 5857339 - DNA, 24 bp, Homo sapiens
cactgatctctactaccacaagga

SEQ ID NO: 5857340 - DNA, 18 bp, Homo sapiens
cactgatctgaacatctg

SEQ ID NO: 5857341 - DNA, 19 bp, Homo sapiens
cactgatctgaacatctgg

SEQ ID NO: 5857342 - DNA, 12 bp, Homo sapiens
cactgatgctgc

SEQ ID NO: 5857343 - DNA, 14 bp, Homo sapiens
cactgatggctcaa

SEQ ID NO: 5857344 - DNA, 13 bp, Homo sapiens
cactgatgggaat

SEQ ID NO: 5857345 - DNA, 17 bp, Homo sapiens
cactgatgggaataaaa

SEQ ID NO: 5857346 - DNA, 14 bp, Homo sapiens
cactgatgggcaac

SEQ ID NO: 5857347 - DNA, 18 bp, Homo sapiens
cactgatgggcaaccccc

SEQ ID NO: 5857348 - DNA, 18 bp, Homo sapiens
cactgatgggctggggca

SEQ ID NO: 5857349 - DNA, 20 bp, Homo sapiens
cactgatgggctggggcagg

SEQ ID NO: 5857350 - DNA, 22 bp, Homo sapiens
cactgatgggctggggcagggg

SEQ ID NO: 5857351 - DNA, 16 bp, Homo sapiens
cactgatgggtcctgc

SEQ ID NO: 5857352 - DNA, 19 bp, Homo sapiens
cactgatgggtcctgctgc

SEQ ID NO: 5857353 - DNA, 20 bp, Homo sapiens
cactgatgggtcctgctgct

SEQ ID NO: 5857354 - DNA, 22 bp, Homo sapiens
cactgatgttgttactgattct

SEQ ID NO: 5857355 - DNA, 17 bp, Homo sapiens
cactgattcctggagag

SEQ ID NO: 5857356 - DNA, 22 bp, Homo sapiens
cactgattgggtgccatgtgga

SEQ ID NO: 5857357 - DNA, 15 bp, Homo sapiens
cactgatttagccat

SEQ ID NO: 5857358 - DNA, 15 bp, Homo sapiens
cactgatttcccctt

SEQ ID NO: 5857359 - DNA, 21 bp, Homo sapiens
cactgatttgacatagtctgg

SEQ ID NO: 5857360 - DNA, 23 bp, Homo sapiens
cactgatttgacatagtctggct

SEQ ID NO: 5857361 - DNA, 20 bp, Homo sapiens
cactgcaaacacaccttgga

SEQ ID NO: 5857362 - DNA, 21 bp, Homo sapiens
cactgcaaacacaccttggag

SEQ ID NO: 5857363 - DNA, 20 bp, Homo sapiens
cactgcaaaccctgctgcct

SEQ ID NO: 5857364 - DNA, 21 bp, Homo sapiens
cactgcaaaccgccacctccc

SEQ ID NO: 5857365 - DNA, 13 bp, Homo sapiens
cactgcaaagaga

SEQ ID NO: 5857366 - DNA, 16 bp, Homo sapiens
cactgcaaattttaac

SEQ ID NO: 5857367 - DNA, 13 bp, Homo sapiens
cactgcaacatga

SEQ ID NO: 5857368 - DNA, 13 bp, Homo sapiens
cactgcaacctcc

SEQ ID NO: 5857369 - DNA, 20 bp, Homo sapiens
cactgcaacctccacctccg

SEQ ID NO: 5857370 - DNA, 21 bp, Homo sapiens
cactgcaacctccacctcctg

SEQ ID NO: 5857371 - DNA, 22 bp, Homo sapiens
cactgcaacctccacctcctga

SEQ ID NO: 5857372 - DNA, 19 bp, Homo sapiens
cactgcaacctccacctcg

SEQ ID NO: 5857373 - DNA, 19 bp, Homo sapiens
cactgcaacctctgcctcc

SEQ ID NO: 5857374 - DNA, 21 bp, Homo sapiens
cactgcaacctctgcctcctg

SEQ ID NO: 5857375 - DNA, 14 bp, Homo sapiens
cactgcaaccttcg

SEQ ID NO: 5857376 - DNA, 23 bp, Homo sapiens
cactgcaaccttcgccacctggg

SEQ ID NO: 5857377 - DNA, 20 bp, Homo sapiens
cactgcaacttctacctccg

SEQ ID NO: 5857378 - DNA, 15 bp, Homo sapiens
cactgcaacttgtga

SEQ ID NO: 5857379 - DNA, 22 bp, Homo sapiens
cactgcaacttgtgaactccat

SEQ ID NO: 5857380 - DNA, 17 bp, Homo sapiens
cactgcaagaagtcttg

SEQ ID NO: 5857381 - DNA, 18 bp, Homo sapiens
cactgcaagaagtcttga

SEQ ID NO: 5857382 - DNA, 17 bp, Homo sapiens
cactgcaagagccttgg

SEQ ID NO: 5857383 - DNA, 20 bp, Homo sapiens
cactgcaagagccttggtgt

SEQ ID NO: 5857384 - DNA, 12 bp, Homo sapiens
cactgcaagtcc

SEQ ID NO: 5857385 - DNA, 21 bp, Homo sapiens
cactgcaagtccttttgtaaa

SEQ ID NO: 5857386 - DNA, 16 bp, Homo sapiens
cactgcaatcctgtct

SEQ ID NO: 5857387 - DNA, 18 bp, Homo sapiens
cactgcacaataactcct

SEQ ID NO: 5857388 - DNA, 13 bp, Homo sapiens
cactgcacagagc

SEQ ID NO: 5857389 - DNA, 14 bp, Homo sapiens
cactgcacagagct

SEQ ID NO: 5857390 - DNA, 21 bp, Homo sapiens
cactgcacagagctctccagc

SEQ ID NO: 5857391 - DNA, 23 bp, Homo sapiens
cactgcacagtgcatctcagccc

SEQ ID NO: 5857392 - DNA, 16 bp, Homo sapiens
cactgcacataatttg

SEQ ID NO: 5857393 - DNA, 15 bp, Homo sapiens
cactgcaccaccgag

SEQ ID NO: 5857394 - DNA, 13 bp, Homo sapiens
cactgcaccccct

SEQ ID NO: 5857395 - DNA, 19 bp, Homo sapiens
cactgcaccccctcctgct

SEQ ID NO: 5857396 - DNA, 22 bp, Homo sapiens
cactgcaccccctcctgctgca

SEQ ID NO: 5857397 - DNA, 16 bp, Homo sapiens
cactgcacccctgccc

SEQ ID NO: 5857398 - DNA, 19 bp, Homo sapiens
cactgcaccctcaacctcc

SEQ ID NO: 5857399 - DNA, 17 bp, Homo sapiens
cactgcaccctccacag

SEQ ID NO: 5857400 - DNA, 14 bp, Homo sapiens
cactgcaccgcctc

SEQ ID NO: 5857401 - DNA, 15 bp, Homo sapiens
cactgcaccgcctca

SEQ ID NO: 5857402 - DNA, 19 bp, Homo sapiens
cactgcaccgggccacaga

SEQ ID NO: 5857403 - DNA, 17 bp, Homo sapiens
cactgcacctgcctcca

SEQ ID NO: 5857404 - DNA, 17 bp, Homo sapiens
cactgcactcaacctta

SEQ ID NO: 5857405 - DNA, 21 bp, Homo sapiens
cactgcactcaaccttaagac

SEQ ID NO: 5857406 - DNA, 12 bp, Homo sapiens
cactgcactcca

SEQ ID NO: 5857407 - DNA, 15 bp, Homo sapiens
cactgcactctagcc

SEQ ID NO: 5857408 - DNA, 20 bp, Homo sapiens
cactgcactctagcctggca

SEQ ID NO: 5857409 - DNA, 16 bp, Homo sapiens
cactgcactgcatgca

SEQ ID NO: 5857410 - DNA, 15 bp, Homo sapiens
cactgcactgttcag

SEQ ID NO: 5857411 - DNA, 14 bp, Homo sapiens
cactgcacttcagt

SEQ ID NO: 5857412 - DNA, 18 bp, Homo sapiens
cactgcagacgggaatgc

SEQ ID NO: 5857413 - DNA, 22 bp, Homo sapiens
cactgcagacgggaatgcctag

SEQ ID NO: 5857414 - DNA, 23 bp, Homo sapiens
cactgcagacgggaatgcctagg

SEQ ID NO: 5857415 - DNA, 12 bp, Homo sapiens
cactgcagaggg

SEQ ID NO: 5857416 - DNA, 20 bp, Homo sapiens
cactgcagatttctcacctg

SEQ ID NO: 5857417 - DNA, 14 bp, Homo sapiens
cactgcagcagaaa

SEQ ID NO: 5857418 - DNA, 17 bp, Homo sapiens
cactgcagcagaaaaca

SEQ ID NO: 5857419 - DNA, 13 bp, Homo sapiens
cactgcagcccag

SEQ ID NO: 5857420 - DNA, 18 bp, Homo sapiens
cactgcagccccacccag

SEQ ID NO: 5857421 - DNA, 17 bp, Homo sapiens
cactgcagcccctgaga

SEQ ID NO: 5857422 - DNA, 15 bp, Homo sapiens
cactgcagccctctc

SEQ ID NO: 5857423 - DNA, 21 bp, Homo sapiens
cactgcagcctcaacctcctg

SEQ ID NO: 5857424 - DNA, 23 bp, Homo sapiens
cactgcagcctcaacctcctggg

SEQ ID NO: 5857425 - DNA, 21 bp, Homo sapiens
cactgcagcctccgcttccct

SEQ ID NO: 5857426 - DNA, 14 bp, Homo sapiens
cactgcagcctcga

SEQ ID NO: 5857427 - DNA, 22 bp, Homo sapiens
cactgcagcctcgaactcctgg

SEQ ID NO: 5857428 - DNA, 20 bp, Homo sapiens
cactgcaggcatcacagcta

SEQ ID NO: 5857429 - DNA, 17 bp, Homo sapiens
cactgcagggctgctgt

SEQ ID NO: 5857430 - DNA, 18 bp, Homo sapiens
cactgcagggctgctgtg

SEQ ID NO: 5857431 - DNA, 23 bp, Homo sapiens
cactgcagggctgctgtggccca

SEQ ID NO: 5857432 - DNA, 20 bp, Homo sapiens
cactgcaggtgagaaccccg

SEQ ID NO: 5857433 - DNA, 21 bp, Homo sapiens
cactgcaggtggcctccctcc

SEQ ID NO: 5857434 - DNA, 20 bp, Homo sapiens
cactgcagtcacctcttcta

SEQ ID NO: 5857435 - DNA, 17 bp, Homo sapiens
cactgcagtctgcagag

SEQ ID NO: 5857436 - DNA, 18 bp, Homo sapiens
cactgcagtctgcagagt

SEQ ID NO: 5857437 - DNA, 24 bp, Homo sapiens
cactgcagtctgcagagttctcct

SEQ ID NO: 5857438 - DNA, 16 bp, Homo sapiens
cactgcagtttcctgg

SEQ ID NO: 5857439 - DNA, 14 bp, Homo sapiens
cactgcatcctccg

SEQ ID NO: 5857440 - DNA, 18 bp, Homo sapiens
cactgcatgagcttttat

SEQ ID NO: 5857441 - DNA, 22 bp, Homo sapiens
cactgcatgcagaaacttggat

SEQ ID NO: 5857442 - DNA, 11 bp, Homo sapiens
cactgcatgtt

SEQ ID NO: 5857443 - DNA, 20 bp, Homo sapiens
cactgcatgttcctggacac

SEQ ID NO: 5857444 - DNA, 19 bp, Homo sapiens
cactgcattatcttgctca

SEQ ID NO: 5857445 - DNA, 18 bp, Homo sapiens
cactgcattattctcttt

SEQ ID NO: 5857446 - DNA, 21 bp, Homo sapiens
cactgcattcattctgagccc

SEQ ID NO: 5857447 - DNA, 17 bp, Homo sapiens
cactgcattcctgtgcc

SEQ ID NO: 5857448 - DNA, 22 bp, Homo sapiens
cactgcattcctgtgccctaga

SEQ ID NO: 5857449 - DNA, 14 bp, Homo sapiens
cactgggagaagag

SEQ ID NO: 5857450 - DNA, 16 bp, Homo sapiens
cactgggagaagagaa

SEQ ID NO: 5857451 - DNA, 16 bp, Homo sapiens
cactgggagaggtgcc

SEQ ID NO: 5857452 - DNA, 12 bp, Homo sapiens
cactgggagagt

SEQ ID NO: 5857453 - DNA, 20 bp, Homo sapiens
cactgggaggctccccttct

SEQ ID NO: 5857454 - DNA, 12 bp, Homo sapiens
cactgggatcac

SEQ ID NO: 5857455 - DNA, 23 bp, Homo sapiens
cactgggatgagccgctgtgagc

SEQ ID NO: 5857456 - DNA, 18 bp, Homo sapiens
cactgggcaggttcctgg

SEQ ID NO: 5857457 - DNA, 20 bp, Homo sapiens
cactgggcaggttcctgggg

SEQ ID NO: 5857458 - DNA, 15 bp, Homo sapiens
cactgggccacggag

SEQ ID NO: 5857459 - DNA, 18 bp, Homo sapiens
cactgggccacggaggag

SEQ ID NO: 5857460 - DNA, 21 bp, Homo sapiens
cactgggccagccctgcagcc

SEQ ID NO: 5857461 - DNA, 13 bp, Homo sapiens
cactgggcccaga

SEQ ID NO: 5857462 - DNA, 17 bp, Homo sapiens
cactgggccccattctc

SEQ ID NO: 5857463 - DNA, 21 bp, Homo sapiens
cactgggccccattctccctc

SEQ ID NO: 5857464 - DNA, 15 bp, Homo sapiens
cactgggcccctcag

SEQ ID NO: 5857465 - DNA, 16 bp, Homo sapiens
cactgggcccctgtcc

SEQ ID NO: 5857466 - DNA, 19 bp, Homo sapiens
cactgggccggcagcctgg

SEQ ID NO: 5857467 - DNA, 20 bp, Homo sapiens
cactgggccggcagcctggt

SEQ ID NO: 5857468 - DNA, 15 bp, Homo sapiens
cactgggcctgctag

SEQ ID NO: 5857469 - DNA, 16 bp, Homo sapiens
cactgggctcactgca

SEQ ID NO: 5857470 - DNA, 20 bp, Homo sapiens
cactgggctcactgcaggca

SEQ ID NO: 5857471 - DNA, 15 bp, Homo sapiens
cactgggctcccggg

SEQ ID NO: 5857472 - DNA, 16 bp, Homo sapiens
cactgggctcccgggc

SEQ ID NO: 5857473 - DNA, 14 bp, Homo sapiens
cactgggctctgga

SEQ ID NO: 5857474 - DNA, 15 bp, Homo sapiens
cactgggctctggac

SEQ ID NO: 5857475 - DNA, 23 bp, Homo sapiens
cactgggcttggggaccagagct

SEQ ID NO: 5857476 - DNA, 17 bp, Homo sapiens
cactggggaaaaataaa

SEQ ID NO: 5857477 - DNA, 21 bp, Homo sapiens
cactggggaaataacagctgt

SEQ ID NO: 5857478 - DNA, 21 bp, Homo sapiens
cactggggacttggcctctct

SEQ ID NO: 5857479 - DNA, 16 bp, Homo sapiens
cactggggagtgctgg

SEQ ID NO: 5857480 - DNA, 19 bp, Homo sapiens
cactggggatcccgtgctg

SEQ ID NO: 5857481 - DNA, 16 bp, Homo sapiens
cactggggatggtggc

SEQ ID NO: 5857482 - DNA, 15 bp, Homo sapiens
cactggggcaggggc

SEQ ID NO: 5857483 - DNA, 23 bp, Homo sapiens
cactggggccccgggttcagcct

SEQ ID NO: 5857484 - DNA, 16 bp, Homo sapiens
cactggggcctacagc

SEQ ID NO: 5857485 - DNA, 16 bp, Homo sapiens
cactggggctcagagc

SEQ ID NO: 5857486 - DNA, 17 bp, Homo sapiens
cactggggctcagagcc

SEQ ID NO: 5857487 - DNA, 19 bp, Homo sapiens
cactggggctcagagccgg

SEQ ID NO: 5857488 - DNA, 22 bp, Homo sapiens
cactggggctcagagccggggt

SEQ ID NO: 5857489 - DNA, 20 bp, Homo sapiens
cactggggctgacacccagg

SEQ ID NO: 5857490 - DNA, 19 bp, Homo sapiens
cactgggggaacagatgct

SEQ ID NO: 5857491 - DNA, 21 bp, Homo sapiens
cactgggggacactgtggcag

SEQ ID NO: 5857492 - DNA, 23 bp, Homo sapiens
cactgggggacactgtggcagca

SEQ ID NO: 5857493 - DNA, 18 bp, Homo sapiens
cactgggggaggggacat

SEQ ID NO: 5857494 - DNA, 21 bp, Homo sapiens
cactgggggaggggacattga

SEQ ID NO: 5857495 - DNA, 15 bp, Homo sapiens
cactggggtcctggg

SEQ ID NO: 5857496 - DNA, 18 bp, Homo sapiens
cactggggtcctggggcc

SEQ ID NO: 5857497 - DNA, 20 bp, Homo sapiens
cactggggtcctggggcctc

SEQ ID NO: 5857498 - DNA, 18 bp, Homo sapiens
cactggggtgccgcctgc

SEQ ID NO: 5857499 - DNA, 21 bp, Homo sapiens
cactggggtgggagggggcag

SEQ ID NO: 5857500 - DNA, 21 bp, Homo sapiens
cactgggtctcactcctgagt

SEQ ID NO: 5857501 - DNA, 13 bp, Homo sapiens
cactgggtgagag

SEQ ID NO: 5857502 - DNA, 13 bp, Homo sapiens
cactgggtgccaa

SEQ ID NO: 5857503 - DNA, 22 bp, Homo sapiens
cactgggtgcccaagctcagaa

SEQ ID NO: 5857504 - DNA, 19 bp, Homo sapiens
cactgggtgcgtctccagt

SEQ ID NO: 5857505 - DNA, 14 bp, Homo sapiens
cactgggtggtggc

SEQ ID NO: 5857506 - DNA, 20 bp, Homo sapiens
cactgggtggtggcctggtc

SEQ ID NO: 5857507 - DNA, 18 bp, Homo sapiens
cactgggtgtggcctggc

SEQ ID NO: 5857508 - DNA, 23 bp, Homo sapiens
cactgggtgttgatcttacaaga

SEQ ID NO: 5857509 - DNA, 21 bp, Homo sapiens
cactgggttgcgggacagagt

SEQ ID NO: 5857510 - DNA, 22 bp, Homo sapiens
cactggtacttagagtttctgt

SEQ ID NO: 5857511 - DNA, 18 bp, Homo sapiens
cactggtaggttgggaca

SEQ ID NO: 5857512 - DNA, 20 bp, Homo sapiens
cactggtattcctgcctcca

SEQ ID NO: 5857513 - DNA, 13 bp, Homo sapiens
cactggtcagggc

SEQ ID NO: 5857514 - DNA, 14 bp, Homo sapiens
cactggtcagggca

SEQ ID NO: 5857515 - DNA, 20 bp, Homo sapiens
cactggtcagggcagtggcc

SEQ ID NO: 5857516 - DNA, 21 bp, Homo sapiens
cactggtcagggcagtggcca

SEQ ID NO: 5857517 - DNA, 20 bp, Homo sapiens
cactggtccatttctcagtg

SEQ ID NO: 5857518 - DNA, 22 bp, Homo sapiens
cactggtccatttctcagtggc

SEQ ID NO: 5857519 - DNA, 22 bp, Homo sapiens
cactggtccccaacaatgtgag

SEQ ID NO: 5857520 - DNA, 18 bp, Homo sapiens
cactggtctaatgtttgt

SEQ ID NO: 5857521 - DNA, 14 bp, Homo sapiens
cactggtctcagag

SEQ ID NO: 5857522 - DNA, 16 bp, Homo sapiens
cactggtctgctgttc

SEQ ID NO: 5857523 - DNA, 21 bp, Homo sapiens
cactggtctgctgttccagtg

SEQ ID NO: 5857524 - DNA, 23 bp, Homo sapiens
cactggtctgggaagactgttgt

SEQ ID NO: 5857525 - DNA, 20 bp, Homo sapiens
cactggtctgtttgcatttg

SEQ ID NO: 5857526 - DNA, 17 bp, Homo sapiens
cactggtgaactgagct

SEQ ID NO: 5857527 - DNA, 17 bp, Homo sapiens
cactggtgacatgtctt

SEQ ID NO: 5857528 - DNA, 22 bp, Homo sapiens
cactggtgactgcgatcttcag

SEQ ID NO: 5857529 - DNA, 19 bp, Homo sapiens
cactggtgagacaatgaaa

SEQ ID NO: 5857530 - DNA, 14 bp, Homo sapiens
cactggtgagacag

SEQ ID NO: 5857531 - DNA, 14 bp, Homo sapiens
cactggtgcattta

SEQ ID NO: 5857532 - DNA, 14 bp, Homo sapiens
cactggtggcatcg

SEQ ID NO: 5857533 - DNA, 21 bp, Homo sapiens
cactggtggcccgacagcctg

SEQ ID NO: 5857534 - DNA, 23 bp, Homo sapiens
cactggtggcccgacagcctggc

SEQ ID NO: 5857535 - DNA, 18 bp, Homo sapiens
cactggtgtaaaaaacaa

SEQ ID NO: 5857536 - DNA, 20 bp, Homo sapiens
cactggtgtgacctgagggc

SEQ ID NO: 5857537 - DNA, 15 bp, Homo sapiens
cactggttaaattaa

SEQ ID NO: 5857538 - DNA, 12 bp, Homo sapiens
cactggttctca

SEQ ID NO: 5857539 - DNA, 17 bp, Homo sapiens
cactggttgtaagtaat

SEQ ID NO: 5857540 - DNA, 16 bp, Homo sapiens
cactggtttcaagaat

SEQ ID NO: 5857541 - DNA, 17 bp, Homo sapiens
cactggtttgtttctca

SEQ ID NO: 5857542 - DNA, 15 bp, Homo sapiens
cactggttttaaata

SEQ ID NO: 5857543 - DNA, 16 bp, Homo sapiens
cactggttttaaatat

SEQ ID NO: 5857544 - DNA, 21 bp, Homo sapiens
cactggttttggccacccctt

SEQ ID NO: 5857545 - DNA, 13 bp, Homo sapiens
cactgtaaaatag

SEQ ID NO: 5857546 - DNA, 13 bp, Homo sapiens
cactgtaaaatgt

SEQ ID NO: 5857547 - DNA, 18 bp, Homo sapiens
cactgtaaacccctgggt

SEQ ID NO: 5857548 - DNA, 20 bp, Homo sapiens
cactgtaaagacaaataaat

SEQ ID NO: 5857549 - DNA, 19 bp, Homo sapiens
cactgtaaatatccacaga

SEQ ID NO: 5857550 - DNA, 15 bp, Homo sapiens
cactgtaaatatccc

SEQ ID NO: 5857551 - DNA, 18 bp, Homo sapiens
cactgtaaattgctggca

SEQ ID NO: 5857552 - DNA, 17 bp, Homo sapiens
cactgtaacatttacga

SEQ ID NO: 5857553 - DNA, 14 bp, Homo sapiens
cactgtaacctgat

SEQ ID NO: 5857554 - DNA, 18 bp, Homo sapiens
cactgtaacctgattcat

SEQ ID NO: 5857555 - DNA, 16 bp, Homo sapiens
cactgtaagcttttaa

SEQ ID NO: 5857556 - DNA, 22 bp, Homo sapiens
cactgtaatacgtagctctctt

SEQ ID NO: 5857557 - DNA, 16 bp, Homo sapiens
cactgtaatcttaaaa

SEQ ID NO: 5857558 - DNA, 21 bp, Homo sapiens
cactgtaatgaggaaaaaatg

SEQ ID NO: 5857559 - DNA, 22 bp, Homo sapiens
cactgtaatgaggaaaaaatgg

SEQ ID NO: 5857560 - DNA, 18 bp, Homo sapiens
cactgtacacacccgcct

SEQ ID NO: 5857561 - DNA, 13 bp, Homo sapiens
cactgtacagttt

SEQ ID NO: 5857562 - DNA, 17 bp, Homo sapiens
cactgtaccatatagca

SEQ ID NO: 5857563 - DNA, 15 bp, Homo sapiens
cactgtactgcatgt

SEQ ID NO: 5857564 - DNA, 18 bp, Homo sapiens
cactgtacttgctcttga

SEQ ID NO: 5857565 - DNA, 14 bp, Homo sapiens
cactgtagcaggtt

SEQ ID NO: 5857566 - DNA, 22 bp, Homo sapiens
cactgtagctacattttcagaa

SEQ ID NO: 5857567 - DNA, 22 bp, Homo sapiens
cactgtagtaaatggcaattct

SEQ ID NO: 5857568 - DNA, 17 bp, Homo sapiens
cactgtagttctaagac

SEQ ID NO: 5857569 - DNA, 19 bp, Homo sapiens
cactgtagtttagttctgt

SEQ ID NO: 5857570 - DNA, 18 bp, Homo sapiens
cactgtagttttgagtgt

SEQ ID NO: 5857571 - DNA, 19 bp, Homo sapiens
cactgtagtttttgaaaat

SEQ ID NO: 5857572 - DNA, 14 bp, Homo sapiens
cactgtataaactt

SEQ ID NO: 5857573 - DNA, 18 bp, Homo sapiens
cactgtataaataggaga

SEQ ID NO: 5857574 - DNA, 19 bp, Homo sapiens
cactgtataaataggagag

SEQ ID NO: 5857575 - DNA, 23 bp, Homo sapiens
cactgtataaataggagaggatg

SEQ ID NO: 5857576 - DNA, 14 bp, Homo sapiens
cactgtataactgt

SEQ ID NO: 5857577 - DNA, 16 bp, Homo sapiens
cactgtatataaacat

SEQ ID NO: 5857578 - DNA, 22 bp, Homo sapiens
cactgtatcatttcatgctttg

SEQ ID NO: 5857579 - DNA, 23 bp, Homo sapiens
cactgtatcatttcatgctttga

SEQ ID NO: 5857580 - DNA, 14 bp, Homo sapiens
cactgtatccaggt

SEQ ID NO: 5857581 - DNA, 15 bp, Homo sapiens
cactgtatgatttat

SEQ ID NO: 5857582 - DNA, 22 bp, Homo sapiens
cactgtatgatttataaacaga

SEQ ID NO: 5857583 - DNA, 18 bp, Homo sapiens
cactgtatgctggacggc

SEQ ID NO: 5857584 - DNA, 20 bp, Homo sapiens
cactgtatgttatagaactt

SEQ ID NO: 5857585 - DNA, 18 bp, Homo sapiens
cactgtattacataaata

SEQ ID NO: 5857586 - DNA, 23 bp, Homo sapiens
cactgtattacataaataaatta

SEQ ID NO: 5857587 - DNA, 21 bp, Homo sapiens
cactgtattagagcgccagct

SEQ ID NO: 5857588 - DNA, 22 bp, Homo sapiens
cactgtattagagcgccagctc

SEQ ID NO: 5857589 - DNA, 14 bp, Homo sapiens
cactgtatttgtat

SEQ ID NO: 5857590 - DNA, 13 bp, Homo sapiens
cactgtatttgtt

SEQ ID NO: 5857591 - DNA, 15 bp, Homo sapiens
cactgtatttgttaa

SEQ ID NO: 5857592 - DNA, 16 bp, Homo sapiens
cactgtatttgttaat

SEQ ID NO: 5857593 - DNA, 21 bp, Homo sapiens
cactgtattttcattttaatt

SEQ ID NO: 5857594 - DNA, 22 bp, Homo sapiens
cactgtattttcattttaattt

SEQ ID NO: 5857595 - DNA, 22 bp, Homo sapiens
cactgtatttttttattcgcca

SEQ ID NO: 5857596 - DNA, 14 bp, Homo sapiens
cactgtcaagatga

SEQ ID NO: 5857597 - DNA, 15 bp, Homo sapiens
cactgtcaagtgttt

SEQ ID NO: 5857598 - DNA, 13 bp, Homo sapiens
cactgtcacaggc

SEQ ID NO: 5857599 - DNA, 15 bp, Homo sapiens
cactgtcacaggcat

SEQ ID NO: 5857600 - DNA, 21 bp, Homo sapiens
cactgtcaccaccctgctcat

SEQ ID NO: 5857601 - DNA, 11 bp, Homo sapiens
cactgtcaccg

SEQ ID NO: 5857602 - DNA, 22 bp, Homo sapiens
cactgtcactgtttctctgctg

SEQ ID NO: 5857603 - DNA, 13 bp, Homo sapiens
cactgtcactttg

SEQ ID NO: 5857604 - DNA, 17 bp, Homo sapiens
cactgtcactttgctct

SEQ ID NO: 5857605 - DNA, 21 bp, Homo sapiens
cactgtcagccctcactgtca

SEQ ID NO: 5857606 - DNA, 15 bp, Homo sapiens
cactgtcaggaagaa

SEQ ID NO: 5857607 - DNA, 21 bp, Homo sapiens
cactgtcagtcccactgcacc

SEQ ID NO: 5857608 - DNA, 13 bp, Homo sapiens
cactgtcatctgt

SEQ ID NO: 5857609 - DNA, 22 bp, Homo sapiens
cactgtcatgtgcgaacacagt

SEQ ID NO: 5857610 - DNA, 15 bp, Homo sapiens
cactgtccagagtct

SEQ ID NO: 5857611 - DNA, 13 bp, Homo sapiens
cactgtccagggc

SEQ ID NO: 5857612 - DNA, 21 bp, Homo sapiens
cactgtcccccaagaaactag

SEQ ID NO: 5857613 - DNA, 20 bp, Homo sapiens
cactgtccccctacccaccg

SEQ ID NO: 5857614 - DNA, 19 bp, Homo sapiens
cactgtccctaccactgag

SEQ ID NO: 5857615 - DNA, 18 bp, Homo sapiens
cactgtccctcaaatgac

SEQ ID NO: 5857616 - DNA, 14 bp, Homo sapiens
cactgtccctcctg

SEQ ID NO: 5857617 - DNA, 16 bp, Homo sapiens
cactgtccctcctggt

SEQ ID NO: 5857618 - DNA, 14 bp, Homo sapiens
cactgtccctgtcc

SEQ ID NO: 5857619 - DNA, 19 bp, Homo sapiens
cactgtccctgtccttcta

SEQ ID NO: 5857620 - DNA, 22 bp, Homo sapiens
cactgtccctgtccttctacag

SEQ ID NO: 5857621 - DNA, 22 bp, Homo sapiens
cactgtccgctgtctccctcct

SEQ ID NO: 5857622 - DNA, 22 bp, Homo sapiens
cactgtcctaccagttgcccta

SEQ ID NO: 5857623 - DNA, 20 bp, Homo sapiens
cactgtcctccttggcggca

SEQ ID NO: 5857624 - DNA, 11 bp, Homo sapiens
cactgtcctgc

SEQ ID NO: 5857625 - DNA, 20 bp, Homo sapiens
cacttgctagtgatacactg

SEQ ID NO: 5857626 - DNA, 12 bp, Homo sapiens
cacttgctcaga

SEQ ID NO: 5857627 - DNA, 17 bp, Homo sapiens
cacttgctcccaaccca

SEQ ID NO: 5857628 - DNA, 14 bp, Homo sapiens
cacttgctgagtga

SEQ ID NO: 5857629 - DNA, 20 bp, Homo sapiens
cacttgctgcactcttgcac

SEQ ID NO: 5857630 - DNA, 14 bp, Homo sapiens
cacttgctgctttt

SEQ ID NO: 5857631 - DNA, 17 bp, Homo sapiens
cacttgctgctttttct

SEQ ID NO: 5857632 - DNA, 18 bp, Homo sapiens
cacttgctggctgtgaaa

SEQ ID NO: 5857633 - DNA, 13 bp, Homo sapiens
cacttgctggggc

SEQ ID NO: 5857634 - DNA, 20 bp, Homo sapiens
cacttgctggggctcacggg

SEQ ID NO: 5857635 - DNA, 22 bp, Homo sapiens
cacttgctttatttttcattac

SEQ ID NO: 5857636 - DNA, 14 bp, Homo sapiens
cacttggaaataaa

SEQ ID NO: 5857637 - DNA, 16 bp, Homo sapiens
cacttggacatgggcc

SEQ ID NO: 5857638 - DNA, 17 bp, Homo sapiens
cacttggactcttgctc

SEQ ID NO: 5857639 - DNA, 15 bp, Homo sapiens
cacttggcagccttg

SEQ ID NO: 5857640 - DNA, 21 bp, Homo sapiens
cacttggcatacaaaatattt

SEQ ID NO: 5857641 - DNA, 17 bp, Homo sapiens
cacttggccagttttct

SEQ ID NO: 5857642 - DNA, 16 bp, Homo sapiens
cacttggcctcagctg

SEQ ID NO: 5857643 - DNA, 20 bp, Homo sapiens
cacttggcctcagctggctg

SEQ ID NO: 5857644 - DNA, 18 bp, Homo sapiens
cacttggcctcttcggga

SEQ ID NO: 5857645 - DNA, 14 bp, Homo sapiens
cacttggctgctca

SEQ ID NO: 5857646 - DNA, 21 bp, Homo sapiens
cacttgggagctgctgggcta

SEQ ID NO: 5857647 - DNA, 16 bp, Homo sapiens
cacttgggctggcacc

SEQ ID NO: 5857648 - DNA, 19 bp, Homo sapiens
cacttgggctggcacccac

SEQ ID NO: 5857649 - DNA, 19 bp, Homo sapiens
cacttggggagatttgcca

SEQ ID NO: 5857650 - DNA, 16 bp, Homo sapiens
cacttgggggactggg

SEQ ID NO: 5857651 - DNA, 18 bp, Homo sapiens
cacttgggggctcagcaa

SEQ ID NO: 5857652 - DNA, 19 bp, Homo sapiens
cacttgggggctcagcaag

SEQ ID NO: 5857653 - DNA, 21 bp, Homo sapiens
cacttgggggctcagcaaggc

SEQ ID NO: 5857654 - DNA, 21 bp, Homo sapiens
cacttggggtcaccaccctcc

SEQ ID NO: 5857655 - DNA, 16 bp, Homo sapiens
cacttgggtctctgga

SEQ ID NO: 5857656 - DNA, 16 bp, Homo sapiens
cacttgggtcttccct

SEQ ID NO: 5857657 - DNA, 15 bp, Homo sapiens
cacttggtctgccag

SEQ ID NO: 5857658 - DNA, 16 bp, Homo sapiens
cacttggtctgccagg

SEQ ID NO: 5857659 - DNA, 20 bp, Homo sapiens
cacttggtgctgcgcccagg

SEQ ID NO: 5857660 - DNA, 16 bp, Homo sapiens
cacttggttgggtcct

SEQ ID NO: 5857661 - DNA, 14 bp, Homo sapiens
cacttgtaaataaa

SEQ ID NO: 5857662 - DNA, 17 bp, Homo sapiens
cacttgtaaataaatag

SEQ ID NO: 5857663 - DNA, 20 bp, Homo sapiens
cacttgtaattttgtatctt

SEQ ID NO: 5857664 - DNA, 17 bp, Homo sapiens
cacttgtacaaaataaa

SEQ ID NO: 5857665 - DNA, 12 bp, Homo sapiens
cacttgtacaat

SEQ ID NO: 5857666 - DNA, 16 bp, Homo sapiens
cacttgtagatttgat

SEQ ID NO: 5857667 - DNA, 17 bp, Homo sapiens
cacttgtagatttgatt

SEQ ID NO: 5857668 - DNA, 14 bp, Homo sapiens
cacttgtaggataa

SEQ ID NO: 5857669 - DNA, 24 bp, Homo sapiens
cacttgtaggtttctctgcctcca

SEQ ID NO: 5857670 - DNA, 12 bp, Homo sapiens
cacttgtataaa

SEQ ID NO: 5857671 - DNA, 15 bp, Homo sapiens
cacttgtattgactt

SEQ ID NO: 5857672 - DNA, 16 bp, Homo sapiens
cacttgtcaataaaat

SEQ ID NO: 5857673 - DNA, 16 bp, Homo sapiens
cacttgtcaggagtgt

SEQ ID NO: 5857674 - DNA, 20 bp, Homo sapiens
cacttgtcaggagtgtgtgt

SEQ ID NO: 5857675 - DNA, 18 bp, Homo sapiens
cacttgtcattgttatat

SEQ ID NO: 5857676 - DNA, 19 bp, Homo sapiens
cacttgtccttagcctgga

SEQ ID NO: 5857677 - DNA, 17 bp, Homo sapiens
cacttgtcggctccagt

SEQ ID NO: 5857678 - DNA, 21 bp, Homo sapiens
cacttgtcggctccagtcccc

SEQ ID NO: 5857679 - DNA, 17 bp, Homo sapiens
cacttgtcgggggccca

SEQ ID NO: 5857680 - DNA, 18 bp, Homo sapiens
cacttgtcgggggcccaa

SEQ ID NO: 5857681 - DNA, 16 bp, Homo sapiens
cacttgtctcatttta

SEQ ID NO: 5857682 - DNA, 15 bp, Homo sapiens
cacttgtctcctttc

SEQ ID NO: 5857683 - DNA, 20 bp, Homo sapiens
cacttgtctcctttctgact

SEQ ID NO: 5857684 - DNA, 16 bp, Homo sapiens
cacttgtcttgctctt

SEQ ID NO: 5857685 - DNA, 13 bp, Homo sapiens
cacttgtgacttt

SEQ ID NO: 5857686 - DNA, 22 bp, Homo sapiens
cacttgtgcaccctctatccca

SEQ ID NO: 5857687 - DNA, 22 bp, Homo sapiens
cacttgtgccaacactcaagaa

SEQ ID NO: 5857688 - DNA, 15 bp, Homo sapiens
cacttgtgccagccc

SEQ ID NO: 5857689 - DNA, 16 bp, Homo sapiens
cacttgtgccagcccg

SEQ ID NO: 5857690 - DNA, 15 bp, Homo sapiens
cacttgtgctttgct

SEQ ID NO: 5857691 - DNA, 19 bp, Homo sapiens
cacttgtggcagcttccct

SEQ ID NO: 5857692 - DNA, 21 bp, Homo sapiens
cacttgtgggcttcaggtgtt

SEQ ID NO: 5857693 - DNA, 16 bp, Homo sapiens
cacttgtgggtcctgg

SEQ ID NO: 5857694 - DNA, 19 bp, Homo sapiens
cacttgtgtgtgggctgtg

SEQ ID NO: 5857695 - DNA, 21 bp, Homo sapiens
cacttgtgtgtgggctgtgag

SEQ ID NO: 5857696 - DNA, 22 bp, Homo sapiens
cacttgtgtgtgggctgtgagt

SEQ ID NO: 5857697 - DNA, 24 bp, Homo sapiens
cacttgtgtgtgtacctgtggctg

SEQ ID NO: 5857698 - DNA, 18 bp, Homo sapiens
cacttgtgttatgaagca

SEQ ID NO: 5857699 - DNA, 21 bp, Homo sapiens
cacttgtgtttaagcaccatg

SEQ ID NO: 5857700 - DNA, 13 bp, Homo sapiens
cacttgttccagc

SEQ ID NO: 5857701 - DNA, 16 bp, Homo sapiens
cacttgttccagctct

SEQ ID NO: 5857702 - DNA, 14 bp, Homo sapiens
cacttgttgtttta

SEQ ID NO: 5857703 - DNA, 14 bp, Homo sapiens
cacttgtttgcact

SEQ ID NO: 5857704 - DNA, 15 bp, Homo sapiens
cacttgtttgcactg

SEQ ID NO: 5857705 - DNA, 12 bp, Homo sapiens
cacttgttttct

SEQ ID NO: 5857706 - DNA, 15 bp, Homo sapiens
cacttgttttctttg

SEQ ID NO: 5857707 - DNA, 17 bp, Homo sapiens
cacttgtttttcttttt

SEQ ID NO: 5857708 - DNA, 14 bp, Homo sapiens
cactttaaagcatt

SEQ ID NO: 5857709 - DNA, 19 bp, Homo sapiens
cactttaaatggaataatt

SEQ ID NO: 5857710 - DNA, 16 bp, Homo sapiens
cactttaacacagtgt

SEQ ID NO: 5857711 - DNA, 18 bp, Homo sapiens
cactttaaccctctcttc

SEQ ID NO: 5857712 - DNA, 15 bp, Homo sapiens
cactttaagctcctt

SEQ ID NO: 5857713 - DNA, 14 bp, Homo sapiens
cactttaagttttg

SEQ ID NO: 5857714 - DNA, 16 bp, Homo sapiens
cactttaatgataaaa

SEQ ID NO: 5857715 - DNA, 17 bp, Homo sapiens
cactttaatgataaaat

SEQ ID NO: 5857716 - DNA, 12 bp, Homo sapiens
cactttaatggg

SEQ ID NO: 5857717 - DNA, 20 bp, Homo sapiens
cactttacattcttgctctg

SEQ ID NO: 5857718 - DNA, 14 bp, Homo sapiens
cactttacccacct

SEQ ID NO: 5857719 - DNA, 20 bp, Homo sapiens
cactttagaaagccagcacc

SEQ ID NO: 5857720 - DNA, 23 bp, Homo sapiens
cactttagaaagccagcacctgg

SEQ ID NO: 5857721 - DNA, 18 bp, Homo sapiens
cactttagaatatgcctt

SEQ ID NO: 5857722 - DNA, 14 bp, Homo sapiens
cactttagacattt

SEQ ID NO: 5857723 - DNA, 17 bp, Homo sapiens
cactttagacatttttg

SEQ ID NO: 5857724 - DNA, 20 bp, Homo sapiens
cactttagacatttttgtgc

SEQ ID NO: 5857725 - DNA, 14 bp, Homo sapiens
cactttagatgctg

SEQ ID NO: 5857726 - DNA, 17 bp, Homo sapiens
cactttagggctgtaaa

SEQ ID NO: 5857727 - DNA, 18 bp, Homo sapiens
cactttagtgtattttct

SEQ ID NO: 5857728 - DNA, 20 bp, Homo sapiens
cactttagtgtattttctgt

SEQ ID NO: 5857729 - DNA, 14 bp, Homo sapiens
cactttatattttc

SEQ ID NO: 5857730 - DNA, 15 bp, Homo sapiens
cactttatcttggga

SEQ ID NO: 5857731 - DNA, 20 bp, Homo sapiens
cactttattgccaaaaccca

SEQ ID NO: 5857732 - DNA, 14 bp, Homo sapiens
cactttatttactt

SEQ ID NO: 5857733 - DNA, 14 bp, Homo sapiens
cactttcaagacag

SEQ ID NO: 5857734 - DNA, 21 bp, Homo sapiens
cactttcaatcttcaatcctt

SEQ ID NO: 5857735 - DNA, 24 bp, Homo sapiens
cactttcagagcccccagccctgg

SEQ ID NO: 5857736 - DNA, 11 bp, Homo sapiens
cactttcagct

SEQ ID NO: 5857737 - DNA, 12 bp, Homo sapiens
cactttcagctg

SEQ ID NO: 5857738 - DNA, 15 bp, Homo sapiens
cactttcagctgtct

SEQ ID NO: 5857739 - DNA, 14 bp, Homo sapiens
cactttcaggaaca

SEQ ID NO: 5857740 - DNA, 17 bp, Homo sapiens
cactttcaggaacactc

SEQ ID NO: 5857741 - DNA, 17 bp, Homo sapiens
cactttcagtgaaagca

SEQ ID NO: 5857742 - DNA, 19 bp, Homo sapiens
cactttcagtgaaagcatc

SEQ ID NO: 5857743 - DNA, 15 bp, Homo sapiens
cactttcataatctt

SEQ ID NO: 5857744 - DNA, 19 bp, Homo sapiens
cactttcatctggggtggg

SEQ ID NO: 5857745 - DNA, 13 bp, Homo sapiens
cactttcattttt

SEQ ID NO: 5857746 - DNA, 17 bp, Homo sapiens
cactttccaatgccaca

SEQ ID NO: 5857747 - DNA, 19 bp, Homo sapiens
cactttccacttcttcctt

SEQ ID NO: 5857748 - DNA, 20 bp, Homo sapiens
cactttccatctctgcctgt

SEQ ID NO: 5857749 - DNA, 16 bp, Homo sapiens
cactttcccccttccc

SEQ ID NO: 5857750 - DNA, 13 bp, Homo sapiens
cactttccctaga

SEQ ID NO: 5857751 - DNA, 18 bp, Homo sapiens
cactttccctgatcctgc

SEQ ID NO: 5857752 - DNA, 21 bp, Homo sapiens
cactttcctggataaaaaaga

SEQ ID NO: 5857753 - DNA, 23 bp, Homo sapiens
cactttcctggataaaaaagaaa

SEQ ID NO: 5857754 - DNA, 16 bp, Homo sapiens
cactttcctttcaata

SEQ ID NO: 5857755 - DNA, 15 bp, Homo sapiens
cactttcgcctcctc

SEQ ID NO: 5857756 - DNA, 17 bp, Homo sapiens
cactttcgcctcctcca

SEQ ID NO: 5857757 - DNA, 21 bp, Homo sapiens
cactttcgcctcctccagctc

SEQ ID NO: 5857758 - DNA, 17 bp, Homo sapiens
cactttctaatgtttct

SEQ ID NO: 5857759 - DNA, 23 bp, Homo sapiens
cactttctacaatgtgaacttta

SEQ ID NO: 5857760 - DNA, 13 bp, Homo sapiens
cactttctagcca

SEQ ID NO: 5857761 - DNA, 16 bp, Homo sapiens
cactttctagccagag

SEQ ID NO: 5857762 - DNA, 20 bp, Homo sapiens
cactttctagccagaggaga

SEQ ID NO: 5857763 - DNA, 16 bp, Homo sapiens
cactttctatagcaga

SEQ ID NO: 5857764 - DNA, 14 bp, Homo sapiens
cactttctcactta

SEQ ID NO: 5857765 - DNA, 17 bp, Homo sapiens
cactttctcctggtgtt

SEQ ID NO: 5857766 - DNA, 14 bp, Homo sapiens
cactttctctctta

SEQ ID NO: 5857767 - DNA, 13 bp, Homo sapiens
cactttctgttcc

SEQ ID NO: 5857768 - DNA, 19 bp, Homo sapiens
cactttctgttccttcctc

SEQ ID NO: 5857769 - DNA, 11 bp, Homo sapiens
cactttcttat

SEQ ID NO: 5857770 - DNA, 18 bp, Homo sapiens
cactttcttattctgtat

SEQ ID NO: 5857771 - DNA, 17 bp, Homo sapiens
cactttgaaaagttgga

SEQ ID NO: 5857772 - DNA, 18 bp, Homo sapiens
cactttgaaaatatttct

SEQ ID NO: 5857773 - DNA, 21 bp, Homo sapiens
cactttgaaaatatttctatg

SEQ ID NO: 5857774 - DNA, 15 bp, Homo sapiens
cactttgaaatacct

SEQ ID NO: 5857775 - DNA, 22 bp, Homo sapiens
cactttgaaatacctcatgttt

SEQ ID NO: 5857776 - DNA, 20 bp, Homo sapiens
cactttgaagcaaatacaat

SEQ ID NO: 5857777 - DNA, 18 bp, Homo sapiens
cactttgaagtctataaa

SEQ ID NO: 5857778 - DNA, 13 bp, Homo sapiens
cactttgacactt

SEQ ID NO: 5857779 - DNA, 16 bp, Homo sapiens
cactttgacaggttcc

SEQ ID NO: 5857780 - DNA, 19 bp, Homo sapiens
cactttgagcctgggaaat

SEQ ID NO: 5857781 - DNA, 17 bp, Homo sapiens
cactttgcaactccctg

SEQ ID NO: 5857782 - DNA, 14 bp, Homo sapiens
cactttgcacagct

SEQ ID NO: 5857783 - DNA, 13 bp, Homo sapiens
cactttgcacatt

SEQ ID NO: 5857784 - DNA, 21 bp, Homo sapiens
cactttgcacgacgccctctc

SEQ ID NO: 5857785 - DNA, 15 bp, Homo sapiens
cactttgctcaaaat

SEQ ID NO: 5857786 - DNA, 12 bp, Homo sapiens
cactttgctctg

SEQ ID NO: 5857787 - DNA, 13 bp, Homo sapiens
cactttgctctgg

SEQ ID NO: 5857788 - DNA, 19 bp, Homo sapiens
cactttgctctgggtggaa

SEQ ID NO: 5857789 - DNA, 18 bp, Homo sapiens
cactttgctttaatataa

SEQ ID NO: 5857790 - DNA, 18 bp, Homo sapiens
cactttggagctttagct

SEQ ID NO: 5857791 - DNA, 14 bp, Homo sapiens
cactttggccacag

SEQ ID NO: 5857792 - DNA, 16 bp, Homo sapiens
cactttggcccagggt

SEQ ID NO: 5857793 - DNA, 16 bp, Homo sapiens
cactttggcttaaagc

SEQ ID NO: 5857794 - DNA, 19 bp, Homo sapiens
cactttggcttctcctgtg

SEQ ID NO: 5857795 - DNA, 22 bp, Homo sapiens
cactttggcttctcctgtgacc

SEQ ID NO: 5857796 - DNA, 13 bp, Homo sapiens
cactttgggaggc

SEQ ID NO: 5857797 - DNA, 14 bp, Homo sapiens
cactttgggaggct

SEQ ID NO: 5857798 - DNA, 23 bp, Homo sapiens
cactttgggaggctgaggcaggc

SEQ ID NO: 5857799 - DNA, 23 bp, Homo sapiens
cactttgggagtttttgtttgtt

SEQ ID NO: 5857800 - DNA, 12 bp, Homo sapiens
cactttggggga

SEQ ID NO: 5857801 - DNA, 17 bp, Homo sapiens
cactttgggtttttaac

SEQ ID NO: 5857802 - DNA, 19 bp, Homo sapiens
cactttggtacatggccag

SEQ ID NO: 5857803 - DNA, 20 bp, Homo sapiens
cactttggtacatggccagt

SEQ ID NO: 5857804 - DNA, 18 bp, Homo sapiens
cagaacactttgctagga

SEQ ID NO: 5857805 - DNA, 13 bp, Homo sapiens
cagaacagaggca

SEQ ID NO: 5857806 - DNA, 15 bp, Homo sapiens
cagaacagaggcatt

SEQ ID NO: 5857807 - DNA, 15 bp, Homo sapiens
cagaacagagggcca

SEQ ID NO: 5857808 - DNA, 20 bp, Homo sapiens
cagaacagagggccagagct

SEQ ID NO: 5857809 - DNA, 20 bp, Homo sapiens
cagaacagccgctcctgtct

SEQ ID NO: 5857810 - DNA, 13 bp, Homo sapiens
cagaacagctgtt

SEQ ID NO: 5857811 - DNA, 12 bp, Homo sapiens
cagaacagcttc

SEQ ID NO: 5857812 - DNA, 13 bp, Homo sapiens
cagaacagcttca

SEQ ID NO: 5857813 - DNA, 15 bp, Homo sapiens
cagaacagcttcagg

SEQ ID NO: 5857814 - DNA, 19 bp, Homo sapiens
cagaacagcttcaggttat

SEQ ID NO: 5857815 - DNA, 19 bp, Homo sapiens
cagaacaggaggtgtgaat

SEQ ID NO: 5857816 - DNA, 21 bp, Homo sapiens
cagaacaggaggtgtgaatgc

SEQ ID NO: 5857817 - DNA, 13 bp, Homo sapiens
cagaacaggggca

SEQ ID NO: 5857818 - DNA, 14 bp, Homo sapiens
cagaacagggtcat

SEQ ID NO: 5857819 - DNA, 14 bp, Homo sapiens
cagaacagtatctt

SEQ ID NO: 5857820 - DNA, 13 bp, Homo sapiens
cagaacagtgaaa

SEQ ID NO: 5857821 - DNA, 12 bp, Homo sapiens
cagaacagtgat

SEQ ID NO: 5857822 - DNA, 12 bp, Homo sapiens
cagaacataaat

SEQ ID NO: 5857823 - DNA, 20 bp, Homo sapiens
cagaacatacactgtgaact

SEQ ID NO: 5857824 - DNA, 16 bp, Homo sapiens
cagaacatatgttgca

SEQ ID NO: 5857825 - DNA, 15 bp, Homo sapiens
cagaacatcattaga

SEQ ID NO: 5857826 - DNA, 18 bp, Homo sapiens
cagaacatcattagaaca

SEQ ID NO: 5857827 - DNA, 21 bp, Homo sapiens
cagaacatcgcgatgggaacc

SEQ ID NO: 5857828 - DNA, 17 bp, Homo sapiens
cagaacatgaagaagac

SEQ ID NO: 5857829 - DNA, 18 bp, Homo sapiens
cagaacatgagtgctgat

SEQ ID NO: 5857830 - DNA, 13 bp, Homo sapiens
cagaacatgagtt

SEQ ID NO: 5857831 - DNA, 12 bp, Homo sapiens
cagaacatgtta

SEQ ID NO: 5857832 - DNA, 15 bp, Homo sapiens
cagaacatgttaaga

SEQ ID NO: 5857833 - DNA, 17 bp, Homo sapiens
cagaacatgttaagata

SEQ ID NO: 5857834 - DNA, 16 bp, Homo sapiens
cagaacattcagctct

SEQ ID NO: 5857835 - DNA, 19 bp, Homo sapiens
cagaacattcagctctgga

SEQ ID NO: 5857836 - DNA, 23 bp, Homo sapiens
cagaacattcagctctggagaac

SEQ ID NO: 5857837 - DNA, 13 bp, Homo sapiens
cagaacatttctc

SEQ ID NO: 5857838 - DNA, 14 bp, Homo sapiens
cagaacatttctca

SEQ ID NO: 5857839 - DNA, 21 bp, Homo sapiens
cagaacatttctcatgtgctt

SEQ ID NO: 5857840 - DNA, 17 bp, Homo sapiens
cagaaccaattattttc

SEQ ID NO: 5857841 - DNA, 20 bp, Homo sapiens
cagaaccaattattttcatc

SEQ ID NO: 5857842 - DNA, 20 bp, Homo sapiens
cagaaccaatttacactcaa

SEQ ID NO: 5857843 - DNA, 15 bp, Homo sapiens
cagaaccacaaacaa

SEQ ID NO: 5857844 - DNA, 14 bp, Homo sapiens
cagaaccacactgt

SEQ ID NO: 5857845 - DNA, 18 bp, Homo sapiens
cagaaccagatgagtaaa

SEQ ID NO: 5857846 - DNA, 21 bp, Homo sapiens
cagaaccagcactaaggtgga

SEQ ID NO: 5857847 - DNA, 18 bp, Homo sapiens
cagaaccagcactcccag

SEQ ID NO: 5857848 - DNA, 15 bp, Homo sapiens
cagaaccagcctcaa

SEQ ID NO: 5857849 - DNA, 13 bp, Homo sapiens
cagaaccagctct

SEQ ID NO: 5857850 - DNA, 15 bp, Homo sapiens
cagaaccatccatag

SEQ ID NO: 5857851 - DNA, 20 bp, Homo sapiens
cagaaccatttaagagactc

SEQ ID NO: 5857852 - DNA, 13 bp, Homo sapiens
cagaacccacagt

SEQ ID NO: 5857853 - DNA, 22 bp, Homo sapiens
cagaacccacataaaagcccca

SEQ ID NO: 5857854 - DNA, 12 bp, Homo sapiens
cagaacccaggg

SEQ ID NO: 5857855 - DNA, 22 bp, Homo sapiens
cagaacccatcggtaggcaaag

SEQ ID NO: 5857856 - DNA, 18 bp, Homo sapiens
cagaaccccaactcccag

SEQ ID NO: 5857857 - DNA, 19 bp, Homo sapiens
cagaaccccaactcccagc

SEQ ID NO: 5857858 - DNA, 17 bp, Homo sapiens
cagaacccccaggtggc

SEQ ID NO: 5857859 - DNA, 20 bp, Homo sapiens
cagaacccccaggtggcctg

SEQ ID NO: 5857860 - DNA, 23 bp, Homo sapiens
cagaacccctggctccaggccag

SEQ ID NO: 5857861 - DNA, 19 bp, Homo sapiens
cagaaccgagaagggggtg

SEQ ID NO: 5857862 - DNA, 17 bp, Homo sapiens
cagaaccggtcccagcc

SEQ ID NO: 5857863 - DNA, 22 bp, Homo sapiens
cagaaccggtcccagcctgggc

SEQ ID NO: 5857864 - DNA, 18 bp, Homo sapiens
cagaacctactgttcctt

SEQ ID NO: 5857865 - DNA, 15 bp, Homo sapiens
cagaacctcccaaat

SEQ ID NO: 5857866 - DNA, 20 bp, Homo sapiens
cagaacctctaagtgctgct

SEQ ID NO: 5857867 - DNA, 14 bp, Homo sapiens
cagaacctcttccc

SEQ ID NO: 5857868 - DNA, 21 bp, Homo sapiens
cagaacctcttccccagaaag

SEQ ID NO: 5857869 - DNA, 18 bp, Homo sapiens
cagaacctgagctatttt

SEQ ID NO: 5857870 - DNA, 22 bp, Homo sapiens
cagaacctgagctattttcctc

SEQ ID NO: 5857871 - DNA, 12 bp, Homo sapiens
cagaacctgagg

SEQ ID NO: 5857872 - DNA, 17 bp, Homo sapiens
cagaacctgcacacagg

SEQ ID NO: 5857873 - DNA, 12 bp, Homo sapiens
cagaacctggag

SEQ ID NO: 5857874 - DNA, 18 bp, Homo sapiens
cagaacctggtggctgga

SEQ ID NO: 5857875 - DNA, 21 bp, Homo sapiens
cagaacctggtggctggaggc

SEQ ID NO: 5857876 - DNA, 21 bp, Homo sapiens
cagaacctgtaggatcttatt

SEQ ID NO: 5857877 - DNA, 14 bp, Homo sapiens
cagaaccttactgg

SEQ ID NO: 5857878 - DNA, 21 bp, Homo sapiens
cagaaccttcaacccagtggg

SEQ ID NO: 5857879 - DNA, 18 bp, Homo sapiens
cagaaccttgtcccagcc

SEQ ID NO: 5857880 - DNA, 17 bp, Homo sapiens
cagaaccttgttatttc

SEQ ID NO: 5857881 - DNA, 18 bp, Homo sapiens
cagaaccttgttatttct

SEQ ID NO: 5857882 - DNA, 21 bp, Homo sapiens
cagaaccttgttatttctcag

SEQ ID NO: 5857883 - DNA, 18 bp, Homo sapiens
cagaacctttggacaaga

SEQ ID NO: 5857884 - DNA, 14 bp, Homo sapiens
cagaacctttgtca

SEQ ID NO: 5857885 - DNA, 19 bp, Homo sapiens
cagaacgatgcctgcaggc

SEQ ID NO: 5857886 - DNA, 14 bp, Homo sapiens
cagaacgcacccca

SEQ ID NO: 5857887 - DNA, 16 bp, Homo sapiens
cagaacgcatgcaggg

SEQ ID NO: 5857888 - DNA, 19 bp, Homo sapiens
cagaacgcatgcagggccc

SEQ ID NO: 5857889 - DNA, 15 bp, Homo sapiens
cagaacgccctgtgt

SEQ ID NO: 5857890 - DNA, 16 bp, Homo sapiens
cagaacgccctgtgtc

SEQ ID NO: 5857891 - DNA, 16 bp, Homo sapiens
cagaacgggcctcccc

SEQ ID NO: 5857892 - DNA, 17 bp, Homo sapiens
cagaacgggcctccccg

SEQ ID NO: 5857893 - DNA, 18 bp, Homo sapiens
cagaacgggcctccccgg

SEQ ID NO: 5857894 - DNA, 14 bp, Homo sapiens
cagaacgggttctc

SEQ ID NO: 5857895 - DNA, 19 bp, Homo sapiens
cagaacgtatttagccatt

SEQ ID NO: 5857896 - DNA, 13 bp, Homo sapiens
cagaacgtggctc

SEQ ID NO: 5857897 - DNA, 17 bp, Homo sapiens
cagaactaaactcattt

SEQ ID NO: 5857898 - DNA, 12 bp, Homo sapiens
cagaactaaatg

SEQ ID NO: 5857899 - DNA, 17 bp, Homo sapiens
cagaactacatatttgt

SEQ ID NO: 5857900 - DNA, 15 bp, Homo sapiens
cagaactaccaaaat

SEQ ID NO: 5857901 - DNA, 13 bp, Homo sapiens
cagaactacttct

SEQ ID NO: 5857902 - DNA, 13 bp, Homo sapiens
cagaactagaatt

SEQ ID NO: 5857903 - DNA, 15 bp, Homo sapiens
cagaactagaatttg

SEQ ID NO: 5857904 - DNA, 15 bp, Homo sapiens
cagaactataacatt

SEQ ID NO: 5857905 - DNA, 17 bp, Homo sapiens
cagaactatgtttttgt

SEQ ID NO: 5857906 - DNA, 17 bp, Homo sapiens
cagaactatttaaaata

SEQ ID NO: 5857907 - DNA, 22 bp, Homo sapiens
cagaactcaaatggggccagat

SEQ ID NO: 5857908 - DNA, 15 bp, Homo sapiens
cagaactcagcctta

SEQ ID NO: 5857909 - DNA, 16 bp, Homo sapiens
cagaactcctacctga

SEQ ID NO: 5857910 - DNA, 12 bp, Homo sapiens
cagaactcctgt

SEQ ID NO: 5857911 - DNA, 22 bp, Homo sapiens
cagaactcggtgtccccaccat

SEQ ID NO: 5857912 - DNA, 15 bp, Homo sapiens
cagaactctcagact

SEQ ID NO: 5857913 - DNA, 15 bp, Homo sapiens
cagaactctgcctgc

SEQ ID NO: 5857914 - DNA, 14 bp, Homo sapiens
cagaactctgtgtc

SEQ ID NO: 5857915 - DNA, 19 bp, Homo sapiens
cagaactcttaaaaatgtt

SEQ ID NO: 5857916 - DNA, 20 bp, Homo sapiens
cagaactcttaaaaatgttt

SEQ ID NO: 5857917 - DNA, 13 bp, Homo sapiens
cagaactcttcct

SEQ ID NO: 5857918 - DNA, 14 bp, Homo sapiens
cagaactcttcctc

SEQ ID NO: 5857919 - DNA, 15 bp, Homo sapiens
cagaactcttcctcc

SEQ ID NO: 5857920 - DNA, 16 bp, Homo sapiens
cagaactcttcctcca

SEQ ID NO: 5857921 - DNA, 20 bp, Homo sapiens
cagaactcttcctcctccca

SEQ ID NO: 5857922 - DNA, 22 bp, Homo sapiens
cagaactcttcctcctcccaag

SEQ ID NO: 5857923 - DNA, 16 bp, Homo sapiens
cagaactctttcaaaa

SEQ ID NO: 5857924 - DNA, 16 bp, Homo sapiens
cagaactgaagccact

SEQ ID NO: 5857925 - DNA, 15 bp, Homo sapiens
cagaactgaggtcac

SEQ ID NO: 5857926 - DNA, 17 bp, Homo sapiens
cagaactgaggtcactg

SEQ ID NO: 5857927 - DNA, 21 bp, Homo sapiens
cagaactgaggtcactgggtt

SEQ ID NO: 5857928 - DNA, 23 bp, Homo sapiens
cagaactgaggtcactgggttct

SEQ ID NO: 5857929 - DNA, 11 bp, Homo sapiens
cagaactgcca

SEQ ID NO: 5857930 - DNA, 12 bp, Homo sapiens
cagaactgccat

SEQ ID NO: 5857931 - DNA, 21 bp, Homo sapiens
cagaactgccattattttctg

SEQ ID NO: 5857932 - DNA, 16 bp, Homo sapiens
cagaactgcccccact

SEQ ID NO: 5857933 - DNA, 17 bp, Homo sapiens
cagaactgcccccactg

SEQ ID NO: 5857934 - DNA, 19 bp, Homo sapiens
cagaactgcccttgctgcc

SEQ ID NO: 5857935 - DNA, 15 bp, Homo sapiens
cagaactgctaccat

SEQ ID NO: 5857936 - DNA, 13 bp, Homo sapiens
cagaactgctggg

SEQ ID NO: 5857937 - DNA, 14 bp, Homo sapiens
cagaactgctgggg

SEQ ID NO: 5857938 - DNA, 15 bp, Homo sapiens
cagaactgctggggc

SEQ ID NO: 5857939 - DNA, 18 bp, Homo sapiens
cagaactgctggggctgg

SEQ ID NO: 5857940 - DNA, 20 bp, Homo sapiens
cagaactgctggggctggtg

SEQ ID NO: 5857941 - DNA, 19 bp, Homo sapiens
cagaactgcttactagccc

SEQ ID NO: 5857942 - DNA, 13 bp, Homo sapiens
cagaactggactc

SEQ ID NO: 5857943 - DNA, 18 bp, Homo sapiens
cagaactggactcaggat

SEQ ID NO: 5857944 - DNA, 15 bp, Homo sapiens
cagaactggaggcag

SEQ ID NO: 5857945 - DNA, 23 bp, Homo sapiens
cagaactggaggcagtccatcta

SEQ ID NO: 5857946 - DNA, 19 bp, Homo sapiens
cagaactggcaggagcctc

SEQ ID NO: 5857947 - DNA, 14 bp, Homo sapiens
cagaactggctggg

SEQ ID NO: 5857948 - DNA, 18 bp, Homo sapiens
cagaactggctgggcccc

SEQ ID NO: 5857949 - DNA, 19 bp, Homo sapiens
cagaactggctgggcccct

SEQ ID NO: 5857950 - DNA, 23 bp, Homo sapiens
cagaactggctgggcccctgggg

SEQ ID NO: 5857951 - DNA, 16 bp, Homo sapiens
cagaactgggaaaaca

SEQ ID NO: 5857952 - DNA, 17 bp, Homo sapiens
cagaactgggaaaacag

SEQ ID NO: 5857953 - DNA, 17 bp, Homo sapiens
cagaactgtcccatccc

SEQ ID NO: 5857954 - DNA, 19 bp, Homo sapiens
cagaactgtcccatcccca

SEQ ID NO: 5857955 - DNA, 17 bp, Homo sapiens
cagaactgtgccacaat

SEQ ID NO: 5857956 - DNA, 19 bp, Homo sapiens
cagaacttcagaaagactt

SEQ ID NO: 5857957 - DNA, 19 bp, Homo sapiens
cagaacttcagcattgtaa

SEQ ID NO: 5857958 - DNA, 19 bp, Homo sapiens
cagaacttcaggtgtgact

SEQ ID NO: 5857959 - DNA, 23 bp, Homo sapiens
cagaacttcgaccctttctctga

SEQ ID NO: 5857960 - DNA, 18 bp, Homo sapiens
cagaacttgaagcctgct

SEQ ID NO: 5857961 - DNA, 15 bp, Homo sapiens
cagaacttgaatgtg

SEQ ID NO: 5857962 - DNA, 21 bp, Homo sapiens
cagaacttgaccctgagctga

SEQ ID NO: 5857963 - DNA, 19 bp, Homo sapiens
cagaacttgtgccctccct

SEQ ID NO: 5857964 - DNA, 16 bp, Homo sapiens
cagaactttttcctct

SEQ ID NO: 5857965 - DNA, 22 bp, Homo sapiens
cagaagaaaaagaagctgagga

SEQ ID NO: 5857966 - DNA, 17 bp, Homo sapiens
cagaagaaaacttttgt

SEQ ID NO: 5857967 - DNA, 15 bp, Homo sapiens
cagaagaaaataata

SEQ ID NO: 5857968 - DNA, 11 bp, Homo sapiens
cagaagaaaga

SEQ ID NO: 5857969 - DNA, 12 bp, Homo sapiens
cagaagaaaggc

SEQ ID NO: 5857970 - DNA, 15 bp, Homo sapiens
cagaagaaataaata

SEQ ID NO: 5857971 - DNA, 17 bp, Homo sapiens
cagaagaagagaagctg

SEQ ID NO: 5857972 - DNA, 23 bp, Homo sapiens
cagaagaagagaagctgctgacc

SEQ ID NO: 5857973 - DNA, 15 bp, Homo sapiens
cagaagaagctggga

SEQ ID NO: 5857974 - DNA, 17 bp, Homo sapiens
cagaagaagctgggagg

SEQ ID NO: 5857975 - DNA, 19 bp, Homo sapiens
cagaagaagctgggaggga

SEQ ID NO: 5857976 - DNA, 15 bp, Homo sapiens
cagaagaagtgggag

SEQ ID NO: 5857977 - DNA, 17 bp, Homo sapiens
cagaagaagtgggagca

SEQ ID NO: 5857978 - DNA, 12 bp, Homo sapiens
cagaagaatatt

SEQ ID NO: 5857979 - DNA, 14 bp, Homo sapiens
cagaagaatattca

SEQ ID NO: 5857980 - DNA, 20 bp, Homo sapiens
cagaagaatcttcctggcac

SEQ ID NO: 5857981 - DNA, 17 bp, Homo sapiens
cagaagaatctttcttc

SEQ ID NO: 5857982 - DNA, 21 bp, Homo sapiens
cagaagaattgaacccaggag

SEQ ID NO: 5857983 - DNA, 14 bp, Homo sapiens
cagaagacaaaatt

SEQ ID NO: 5857984 - DNA, 18 bp, Homo sapiens
cagaatgcattaaaaaaa

SEQ ID NO: 5857985 - DNA, 12 bp, Homo sapiens
cagaatgccctg

SEQ ID NO: 5857986 - DNA, 21 bp, Homo sapiens
cagaatgctaaagtttcctaa

SEQ ID NO: 5857987 - DNA, 18 bp, Homo sapiens
cagaatgctgaactcctt

SEQ ID NO: 5857988 - DNA, 18 bp, Homo sapiens
cagaatgctgcaggactt

SEQ ID NO: 5857989 - DNA, 17 bp, Homo sapiens
cagaatggaatccatct

SEQ ID NO: 5857990 - DNA, 19 bp, Homo sapiens
cagaatggaatccatctgt

SEQ ID NO: 5857991 - DNA, 22 bp, Homo sapiens
cagaatggaatccatctgtctc

SEQ ID NO: 5857992 - DNA, 14 bp, Homo sapiens
cagaatggatataa

SEQ ID NO: 5857993 - DNA, 20 bp, Homo sapiens
cagaatggatataatctgaa

SEQ ID NO: 5857994 - DNA, 21 bp, Homo sapiens
cagaatggcagtcctggaggc

SEQ ID NO: 5857995 - DNA, 13 bp, Homo sapiens
cagaatggcattt

SEQ ID NO: 5857996 - DNA, 20 bp, Homo sapiens
cagaatggctatcaaaagaa

SEQ ID NO: 5857997 - DNA, 22 bp, Homo sapiens
cagaatggctatcaaaagaaat

SEQ ID NO: 5857998 - DNA, 17 bp, Homo sapiens
cagaatgggggctttcg

SEQ ID NO: 5857999 - DNA, 18 bp, Homo sapiens
cagaatggggtgcatgaa

SEQ ID NO: 5858000 - DNA, 16 bp, Homo sapiens
cagaatgtaaaaaaga

SEQ ID NO: 5858001 - DNA, 22 bp, Homo sapiens
cagaatgtaagtgggcccaccc

SEQ ID NO: 5858002 - DNA, 22 bp, Homo sapiens
cagaatgtcagattcctttccc

SEQ ID NO: 5858003 - DNA, 21 bp, Homo sapiens
cagaatgtcattttggtactt

SEQ ID NO: 5858004 - DNA, 18 bp, Homo sapiens
cagaatgtgaaaaaggaa

SEQ ID NO: 5858005 - DNA, 17 bp, Homo sapiens
cagaatgtgctgccttt

SEQ ID NO: 5858006 - DNA, 17 bp, Homo sapiens
cagaatgtgtctcagga

SEQ ID NO: 5858007 - DNA, 12 bp, Homo sapiens
cagaatgtgttc

SEQ ID NO: 5858008 - DNA, 20 bp, Homo sapiens
cagaatgtgttcttttctcc

SEQ ID NO: 5858009 - DNA, 15 bp, Homo sapiens
cagaatgttgtactt

SEQ ID NO: 5858010 - DNA, 21 bp, Homo sapiens
cagaatgttgtgttggtattt

SEQ ID NO: 5858011 - DNA, 20 bp, Homo sapiens
cagaatgttttactgtgaaa

SEQ ID NO: 5858012 - DNA, 15 bp, Homo sapiens
cagaattaaaatgtc

SEQ ID NO: 5858013 - DNA, 16 bp, Homo sapiens
cagaattaaagaccta

SEQ ID NO: 5858014 - DNA, 22 bp, Homo sapiens
cagaattaagaaatactcatgt

SEQ ID NO: 5858015 - DNA, 17 bp, Homo sapiens
cagaattaatggtcatt

SEQ ID NO: 5858016 - DNA, 22 bp, Homo sapiens
cagaattactgtaactgattac

SEQ ID NO: 5858017 - DNA, 15 bp, Homo sapiens
cagaattagtcctca

SEQ ID NO: 5858018 - DNA, 19 bp, Homo sapiens
cagaattagtcctcacagc

SEQ ID NO: 5858019 - DNA, 20 bp, Homo sapiens
cagaattagtcctcacagcc

SEQ ID NO: 5858020 - DNA, 23 bp, Homo sapiens
cagaattagtcctcacagcctag

SEQ ID NO: 5858021 - DNA, 13 bp, Homo sapiens
cagaattatccat

SEQ ID NO: 5858022 - DNA, 17 bp, Homo sapiens
cagaattattcatagct

SEQ ID NO: 5858023 - DNA, 12 bp, Homo sapiens
cagaattcacta

SEQ ID NO: 5858024 - DNA, 15 bp, Homo sapiens
cagaattcccagctg

SEQ ID NO: 5858025 - DNA, 23 bp, Homo sapiens
cagaattcccagctgtctgtgtc

SEQ ID NO: 5858026 - DNA, 16 bp, Homo sapiens
cagaattcggtgtgct

SEQ ID NO: 5858027 - DNA, 17 bp, Homo sapiens
cagaattcggtgtgctg

SEQ ID NO: 5858028 - DNA, 22 bp, Homo sapiens
cagaattcggtgtgctgccaac

SEQ ID NO: 5858029 - DNA, 18 bp, Homo sapiens
cagaattctctagtttga

SEQ ID NO: 5858030 - DNA, 15 bp, Homo sapiens
cagaattgaaacact

SEQ ID NO: 5858031 - DNA, 22 bp, Homo sapiens
cagaattgaaccgtcaatgtga

SEQ ID NO: 5858032 - DNA, 18 bp, Homo sapiens
cagaattgactgcagttg

SEQ ID NO: 5858033 - DNA, 23 bp, Homo sapiens
cagaattgcattctgaatgaata

SEQ ID NO: 5858034 - DNA, 23 bp, Homo sapiens
cagaattgctacaatcccaaagc

SEQ ID NO: 5858035 - DNA, 22 bp, Homo sapiens
cagaattgctaggtaaagaggt

SEQ ID NO: 5858036 - DNA, 14 bp, Homo sapiens
cagaattggaaaag

SEQ ID NO: 5858037 - DNA, 17 bp, Homo sapiens
cagaattggaaaagact

SEQ ID NO: 5858038 - DNA, 18 bp, Homo sapiens
cagaattggcataatttg

SEQ ID NO: 5858039 - DNA, 19 bp, Homo sapiens
cagaattgtgcaaatggaa

SEQ ID NO: 5858040 - DNA, 18 bp, Homo sapiens
cagaattgtgtctgcagg

SEQ ID NO: 5858041 - DNA, 19 bp, Homo sapiens
cagaatttaccatcatctc

SEQ ID NO: 5858042 - DNA, 13 bp, Homo sapiens
cagaatttataga

SEQ ID NO: 5858043 - DNA, 20 bp, Homo sapiens
cagaatttattagtttaaaa

SEQ ID NO: 5858044 - DNA, 13 bp, Homo sapiens
cagaatttccact

SEQ ID NO: 5858045 - DNA, 15 bp, Homo sapiens
cagaatttccactgt

SEQ ID NO: 5858046 - DNA, 14 bp, Homo sapiens
cagaatttcccaaa

SEQ ID NO: 5858047 - DNA, 24 bp, Homo sapiens
cagaatttcccaaagcagtgcatg

SEQ ID NO: 5858048 - DNA, 17 bp, Homo sapiens
cagaatttccctctgat

SEQ ID NO: 5858049 - DNA, 18 bp, Homo sapiens
cagaatttgaatattaac

SEQ ID NO: 5858050 - DNA, 13 bp, Homo sapiens
cagaatttgaatt

SEQ ID NO: 5858051 - DNA, 11 bp, Homo sapiens
cagaatttgag

SEQ ID NO: 5858052 - DNA, 14 bp, Homo sapiens
cagaatttgagaac

SEQ ID NO: 5858053 - DNA, 22 bp, Homo sapiens
cagaatttggaaatcctagttt

SEQ ID NO: 5858054 - DNA, 22 bp, Homo sapiens
cagaatttgtgttgaaggaact

SEQ ID NO: 5858055 - DNA, 18 bp, Homo sapiens
cagaattttaatgtgaag

SEQ ID NO: 5858056 - DNA, 23 bp, Homo sapiens
cagaattttaatgtgaagacatt

SEQ ID NO: 5858057 - DNA, 18 bp, Homo sapiens
cagaattttaccaaaatt

SEQ ID NO: 5858058 - DNA, 21 bp, Homo sapiens
cagaattttaggaacttcaga

SEQ ID NO: 5858059 - DNA, 23 bp, Homo sapiens
cagaattttatactttccctacc

SEQ ID NO: 5858060 - DNA, 21 bp, Homo sapiens
cagaattttccttcttcagct

SEQ ID NO: 5858061 - DNA, 23 bp, Homo sapiens
cagaattttggaaaaatgtcact

SEQ ID NO: 5858062 - DNA, 16 bp, Homo sapiens
cagaattttggaagat

SEQ ID NO: 5858063 - DNA, 12 bp, Homo sapiens
cagaatttttaa

SEQ ID NO: 5858064 - DNA, 13 bp, Homo sapiens
cagaatttttaat

SEQ ID NO: 5858065 - DNA, 16 bp, Homo sapiens
cagaatttttaatgac

SEQ ID NO: 5858066 - DNA, 18 bp, Homo sapiens
cagaatttttaatgactt

SEQ ID NO: 5858067 - DNA, 17 bp, Homo sapiens
cagaatttttccctcca

SEQ ID NO: 5858068 - DNA, 17 bp, Homo sapiens
cagaattttttgagtaa

SEQ ID NO: 5858069 - DNA, 19 bp, Homo sapiens
cagaattttttttgttgtt

SEQ ID NO: 5858070 - DNA, 13 bp, Homo sapiens
cagacaaaaacaa

SEQ ID NO: 5858071 - DNA, 18 bp, Homo sapiens
cagacaaaaacagcctca

SEQ ID NO: 5858072 - DNA, 19 bp, Homo sapiens
cagacaaaaacagcctcac

SEQ ID NO: 5858073 - DNA, 21 bp, Homo sapiens
cagacaaaaacagcctcacag

SEQ ID NO: 5858074 - DNA, 22 bp, Homo sapiens
cagacaaaaacagcctcacaga

SEQ ID NO: 5858075 - DNA, 16 bp, Homo sapiens
cagacaaaacaatccc

SEQ ID NO: 5858076 - DNA, 19 bp, Homo sapiens
cagacaaaacaatccccat

SEQ ID NO: 5858077 - DNA, 20 bp, Homo sapiens
cagacaaaacaatccccatc

SEQ ID NO: 5858078 - DNA, 22 bp, Homo sapiens
cagacaaaacaatccccatcag

SEQ ID NO: 5858079 - DNA, 16 bp, Homo sapiens
cagacaaaatttgaga

SEQ ID NO: 5858080 - DNA, 18 bp, Homo sapiens
cagacaaaatttgagaat

SEQ ID NO: 5858081 - DNA, 15 bp, Homo sapiens
cagacaaagatgtct

SEQ ID NO: 5858082 - DNA, 16 bp, Homo sapiens
cagacaaagccctgtc

SEQ ID NO: 5858083 - DNA, 12 bp, Homo sapiens
cagacaaagcgt

SEQ ID NO: 5858084 - DNA, 15 bp, Homo sapiens
cagacaaatgaaata

SEQ ID NO: 5858085 - DNA, 11 bp, Homo sapiens
cagacaaatta

SEQ ID NO: 5858086 - DNA, 16 bp, Homo sapiens
cagacaacaaacctgt

SEQ ID NO: 5858087 - DNA, 20 bp, Homo sapiens
cagacaacaaacctgtttct

SEQ ID NO: 5858088 - DNA, 18 bp, Homo sapiens
cagacaacaccttcctcc

SEQ ID NO: 5858089 - DNA, 13 bp, Homo sapiens
cagacaacagaag

SEQ ID NO: 5858090 - DNA, 17 bp, Homo sapiens
cagacaacagaagtcat

SEQ ID NO: 5858091 - DNA, 16 bp, Homo sapiens
cagacaacagcccagg

SEQ ID NO: 5858092 - DNA, 17 bp, Homo sapiens
cagacaacagcccaggc

SEQ ID NO: 5858093 - DNA, 14 bp, Homo sapiens
cagacaacattatg

SEQ ID NO: 5858094 - DNA, 19 bp, Homo sapiens
cagacaacattatgatcta

SEQ ID NO: 5858095 - DNA, 16 bp, Homo sapiens
cagacaacctcatcag

SEQ ID NO: 5858096 - DNA, 13 bp, Homo sapiens
cagacaaccttgt

SEQ ID NO: 5858097 - DNA, 22 bp, Homo sapiens
cagacaacgggcccatggcctt

SEQ ID NO: 5858098 - DNA, 19 bp, Homo sapiens
cagacaactctagaaatgc

SEQ ID NO: 5858099 - DNA, 14 bp, Homo sapiens
cagacaagagctgc

SEQ ID NO: 5858100 - DNA, 16 bp, Homo sapiens
cagacaagagctgctg

SEQ ID NO: 5858101 - DNA, 18 bp, Homo sapiens
cagacaagagctgctgtc

SEQ ID NO: 5858102 - DNA, 23 bp, Homo sapiens
cagacaagcaacaggttttataa

SEQ ID NO: 5858103 - DNA, 21 bp, Homo sapiens
cagacaagcaacccaaactga

SEQ ID NO: 5858104 - DNA, 12 bp, Homo sapiens
cagacaagcagc

SEQ ID NO: 5858105 - DNA, 14 bp, Homo sapiens
cagacaagcagccc

SEQ ID NO: 5858106 - DNA, 16 bp, Homo sapiens
cagacaagcagccctt

SEQ ID NO: 5858107 - DNA, 19 bp, Homo sapiens
cagacaagcagcccttgct

SEQ ID NO: 5858108 - DNA, 14 bp, Homo sapiens
cagacaagccctgc

SEQ ID NO: 5858109 - DNA, 15 bp, Homo sapiens
cagacaagccctgct

SEQ ID NO: 5858110 - DNA, 17 bp, Homo sapiens
cagacaaggagagcgga

SEQ ID NO: 5858111 - DNA, 12 bp, Homo sapiens
cagacaaggagg

SEQ ID NO: 5858112 - DNA, 23 bp, Homo sapiens
cagacaaggtagccctggccaga

SEQ ID NO: 5858113 - DNA, 11 bp, Homo sapiens
cagacaaggtt

SEQ ID NO: 5858114 - DNA, 21 bp, Homo sapiens
cagacaagtcttgctgtgctt

SEQ ID NO: 5858115 - DNA, 21 bp, Homo sapiens
cagacaagtgactgtatctgt

SEQ ID NO: 5858116 - DNA, 18 bp, Homo sapiens
cagacaataaaccctcag

SEQ ID NO: 5858117 - DNA, 22 bp, Homo sapiens
cagacaataaaccctcagagcc

SEQ ID NO: 5858118 - DNA, 20 bp, Homo sapiens
cagacaatagtatagaagtc

SEQ ID NO: 5858119 - DNA, 17 bp, Homo sapiens
cagacaatatgtgagtg

SEQ ID NO: 5858120 - DNA, 19 bp, Homo sapiens
cagacaatccactctcagg

SEQ ID NO: 5858121 - DNA, 22 bp, Homo sapiens
cagacaatccactctcaggagg

SEQ ID NO: 5858122 - DNA, 15 bp, Homo sapiens
cagacaattctaatg

SEQ ID NO: 5858123 - DNA, 20 bp, Homo sapiens
cagacaatttatccaaagca

SEQ ID NO: 5858124 - DNA, 16 bp, Homo sapiens
cagacacaattagaga

SEQ ID NO: 5858125 - DNA, 17 bp, Homo sapiens
cagacacaattagagaa

SEQ ID NO: 5858126 - DNA, 14 bp, Homo sapiens
cagacacacaacat

SEQ ID NO: 5858127 - DNA, 17 bp, Homo sapiens
cagacacacaacatcaa

SEQ ID NO: 5858128 - DNA, 13 bp, Homo sapiens
cagacacacacac

SEQ ID NO: 5858129 - DNA, 23 bp, Homo sapiens
cagacacacacacacacacacat

SEQ ID NO: 5858130 - DNA, 14 bp, Homo sapiens
cagacacacacacg

SEQ ID NO: 5858131 - DNA, 18 bp, Homo sapiens
cagacacacactggctcc

SEQ ID NO: 5858132 - DNA, 19 bp, Homo sapiens
cagacacacactggctcct

SEQ ID NO: 5858133 - DNA, 19 bp, Homo sapiens
cagacacacatgggcagcc

SEQ ID NO: 5858134 - DNA, 15 bp, Homo sapiens
cagacacagactggc

SEQ ID NO: 5858135 - DNA, 21 bp, Homo sapiens
cagacacagactggcaataaa

SEQ ID NO: 5858136 - DNA, 23 bp, Homo sapiens
cagacacagattatgttcctgct

SEQ ID NO: 5858137 - DNA, 16 bp, Homo sapiens
cagacacaggaaaaat

SEQ ID NO: 5858138 - DNA, 14 bp, Homo sapiens
cagacacaggcccg

SEQ ID NO: 5858139 - DNA, 22 bp, Homo sapiens
cagacacaggcccggctccagg

SEQ ID NO: 5858140 - DNA, 23 bp, Homo sapiens
cagacacaggcccggctccaggc

SEQ ID NO: 5858141 - DNA, 15 bp, Homo sapiens
cagacacaggccctc

SEQ ID NO: 5858142 - DNA, 16 bp, Homo sapiens
cagacacaggccgtgg

SEQ ID NO: 5858143 - DNA, 18 bp, Homo sapiens
cagacacagggacttgaa

SEQ ID NO: 5858144 - DNA, 14 bp, Homo sapiens
cagacacatgctgt

SEQ ID NO: 5858145 - DNA, 14 bp, Homo sapiens
cagacacatgtcca

SEQ ID NO: 5858146 - DNA, 21 bp, Homo sapiens
cagacacatgtccaagaagcc

SEQ ID NO: 5858147 - DNA, 22 bp, Homo sapiens
cagacacatgtccaagaagccc

SEQ ID NO: 5858148 - DNA, 23 bp, Homo sapiens
cagacacatgtccaagaagccca

SEQ ID NO: 5858149 - DNA, 22 bp, Homo sapiens
cagacacattgtcatcagaggg

SEQ ID NO: 5858150 - DNA, 18 bp, Homo sapiens
cagacaccacagacgcca

SEQ ID NO: 5858151 - DNA, 23 bp, Homo sapiens
cagacaccacagacgccacctgg

SEQ ID NO: 5858152 - DNA, 16 bp, Homo sapiens
cagacaccacagcctc

SEQ ID NO: 5858153 - DNA, 18 bp, Homo sapiens
cagacaccacagcctccc

SEQ ID NO: 5858154 - DNA, 22 bp, Homo sapiens
cagacaccacagcctccccttc

SEQ ID NO: 5858155 - DNA, 15 bp, Homo sapiens
cagacaccatcacca

SEQ ID NO: 5858156 - DNA, 18 bp, Homo sapiens
cagacaccattcattcca

SEQ ID NO: 5858157 - DNA, 13 bp, Homo sapiens
cagacacccaccc

SEQ ID NO: 5858158 - DNA, 15 bp, Homo sapiens
cagacaccctcaacc

SEQ ID NO: 5858159 - DNA, 13 bp, Homo sapiens
cagacaccctcca

SEQ ID NO: 5858160 - DNA, 18 bp, Homo sapiens
cagacccctaccctttcc

SEQ ID NO: 5858161 - DNA, 13 bp, Homo sapiens
cagacccctcagc

SEQ ID NO: 5858162 - DNA, 15 bp, Homo sapiens
cagacccctcagccc

SEQ ID NO: 5858163 - DNA, 13 bp, Homo sapiens
cagacccctctgg

SEQ ID NO: 5858164 - DNA, 18 bp, Homo sapiens
cagacccctctggccagg

SEQ ID NO: 5858165 - DNA, 22 bp, Homo sapiens
cagacccctctggccaggatgg

SEQ ID NO: 5858166 - DNA, 11 bp, Homo sapiens
cagacccctgc

SEQ ID NO: 5858167 - DNA, 14 bp, Homo sapiens
cagacccctgcctg

SEQ ID NO: 5858168 - DNA, 14 bp, Homo sapiens
cagacccctggctt

SEQ ID NO: 5858169 - DNA, 21 bp, Homo sapiens
cagacccctggcttttcactg

SEQ ID NO: 5858170 - DNA, 17 bp, Homo sapiens
cagacccctgggagctt

SEQ ID NO: 5858171 - DNA, 20 bp, Homo sapiens
cagacccctgggagcttccg

SEQ ID NO: 5858172 - DNA, 23 bp, Homo sapiens
cagacccctgggggaggcttcca

SEQ ID NO: 5858173 - DNA, 21 bp, Homo sapiens
cagacccctgtggcagaccgg

SEQ ID NO: 5858174 - DNA, 13 bp, Homo sapiens
cagaccccttggc

SEQ ID NO: 5858175 - DNA, 15 bp, Homo sapiens
cagaccccttggcca

SEQ ID NO: 5858176 - DNA, 16 bp, Homo sapiens
cagaccccttggccag

SEQ ID NO: 5858177 - DNA, 16 bp, Homo sapiens
cagaccctaccccacc

SEQ ID NO: 5858178 - DNA, 15 bp, Homo sapiens
cagaccctccttccc

SEQ ID NO: 5858179 - DNA, 17 bp, Homo sapiens
cagaccctccttcccca

SEQ ID NO: 5858180 - DNA, 19 bp, Homo sapiens
cagaccctccttccccacc

SEQ ID NO: 5858181 - DNA, 14 bp, Homo sapiens
cagaccctgaaccc

SEQ ID NO: 5858182 - DNA, 12 bp, Homo sapiens
cagaccctgaag

SEQ ID NO: 5858183 - DNA, 18 bp, Homo sapiens
cagaccctgcccacccca

SEQ ID NO: 5858184 - DNA, 15 bp, Homo sapiens
cagaccctgccctgt

SEQ ID NO: 5858185 - DNA, 12 bp, Homo sapiens
cagaccctgcct

SEQ ID NO: 5858186 - DNA, 15 bp, Homo sapiens
cagaccctgcctgag

SEQ ID NO: 5858187 - DNA, 11 bp, Homo sapiens
cagaccctgga

SEQ ID NO: 5858188 - DNA, 13 bp, Homo sapiens
cagaccctggagg

SEQ ID NO: 5858189 - DNA, 13 bp, Homo sapiens
cagaccctgggca

SEQ ID NO: 5858190 - DNA, 21 bp, Homo sapiens
cagacccttcttgcctgctgg

SEQ ID NO: 5858191 - DNA, 21 bp, Homo sapiens
cagaccgaactgttgtataaa

SEQ ID NO: 5858192 - DNA, 17 bp, Homo sapiens
cagaccgcagagaggct

SEQ ID NO: 5858193 - DNA, 14 bp, Homo sapiens
cagaccgcgcccct

SEQ ID NO: 5858194 - DNA, 18 bp, Homo sapiens
cagaccgcgcccctggga

SEQ ID NO: 5858195 - DNA, 19 bp, Homo sapiens
cagaccgcgcccctgggac

SEQ ID NO: 5858196 - DNA, 20 bp, Homo sapiens
cagaccgcgggcactgccgc

SEQ ID NO: 5858197 - DNA, 14 bp, Homo sapiens
cagaccgggggcca

SEQ ID NO: 5858198 - DNA, 22 bp, Homo sapiens
cagaccgggggccagacacaga

SEQ ID NO: 5858199 - DNA, 18 bp, Homo sapiens
cagaccggggtggagtca

SEQ ID NO: 5858200 - DNA, 15 bp, Homo sapiens
cagaccgtcttcctc

SEQ ID NO: 5858201 - DNA, 19 bp, Homo sapiens
cagaccgtcttcctccaac

SEQ ID NO: 5858202 - DNA, 14 bp, Homo sapiens
cagacctaagccct

SEQ ID NO: 5858203 - DNA, 19 bp, Homo sapiens
cagacctaatatcatttta

SEQ ID NO: 5858204 - DNA, 18 bp, Homo sapiens
cagacctaatgctccttg

SEQ ID NO: 5858205 - DNA, 15 bp, Homo sapiens
cagacctagacctgg

SEQ ID NO: 5858206 - DNA, 16 bp, Homo sapiens
cagacctagacctggg

SEQ ID NO: 5858207 - DNA, 17 bp, Homo sapiens
cagacctagacctgggc

SEQ ID NO: 5858208 - DNA, 20 bp, Homo sapiens
cagacctatatctggagtga

SEQ ID NO: 5858209 - DNA, 18 bp, Homo sapiens
cagacctattcctcctgg

SEQ ID NO: 5858210 - DNA, 19 bp, Homo sapiens
cagacctattcctcctggg

SEQ ID NO: 5858211 - DNA, 18 bp, Homo sapiens
cagacctcaagggacagg

SEQ ID NO: 5858212 - DNA, 20 bp, Homo sapiens
cagacctcactgctttgtag

SEQ ID NO: 5858213 - DNA, 14 bp, Homo sapiens
cagacctcactgtc

SEQ ID NO: 5858214 - DNA, 21 bp, Homo sapiens
cagacctcactgtcagggtct

SEQ ID NO: 5858215 - DNA, 12 bp, Homo sapiens
cagacctcccca

SEQ ID NO: 5858216 - DNA, 14 bp, Homo sapiens
cagacctccccagc

SEQ ID NO: 5858217 - DNA, 19 bp, Homo sapiens
cagacctccccagccccta

SEQ ID NO: 5858218 - DNA, 17 bp, Homo sapiens
cagacctcccctcttcc

SEQ ID NO: 5858219 - DNA, 17 bp, Homo sapiens
cagacctcgagtttctg

SEQ ID NO: 5858220 - DNA, 11 bp, Homo sapiens
cagacctctga

SEQ ID NO: 5858221 - DNA, 14 bp, Homo sapiens
cagacctctgatcc

SEQ ID NO: 5858222 - DNA, 18 bp, Homo sapiens
cagacctctgatccctcg

SEQ ID NO: 5858223 - DNA, 12 bp, Homo sapiens
cagacctctgga

SEQ ID NO: 5858224 - DNA, 17 bp, Homo sapiens
cagacctgagctcccca

SEQ ID NO: 5858225 - DNA, 13 bp, Homo sapiens
cagacctgatcct

SEQ ID NO: 5858226 - DNA, 14 bp, Homo sapiens
cagacctgatcctg

SEQ ID NO: 5858227 - DNA, 20 bp, Homo sapiens
cagacctgatcctggaggcc

SEQ ID NO: 5858228 - DNA, 22 bp, Homo sapiens
cagacctgatcctggaggccca

SEQ ID NO: 5858229 - DNA, 14 bp, Homo sapiens
cagacctgcagtga

SEQ ID NO: 5858230 - DNA, 22 bp, Homo sapiens
cagacctgcatggtcaagcctc

SEQ ID NO: 5858231 - DNA, 23 bp, Homo sapiens
cagacctgcatggtcaagcctct

SEQ ID NO: 5858232 - DNA, 13 bp, Homo sapiens
cagacctgcctct

SEQ ID NO: 5858233 - DNA, 12 bp, Homo sapiens
cagacctgcctg

SEQ ID NO: 5858234 - DNA, 16 bp, Homo sapiens
cagacctgctctggac

SEQ ID NO: 5858235 - DNA, 22 bp, Homo sapiens
cagacctgctctggacacttgc

SEQ ID NO: 5858236 - DNA, 20 bp, Homo sapiens
cagacctgcttcctgaaata

SEQ ID NO: 5858237 - DNA, 22 bp, Homo sapiens
cagacctgcttcctgaaataaa

SEQ ID NO: 5858238 - DNA, 13 bp, Homo sapiens
cagacctggaaga

SEQ ID NO: 5858239 - DNA, 21 bp, Homo sapiens
cagacctggaagaacaggcct

SEQ ID NO: 5858240 - DNA, 17 bp, Homo sapiens
cagacctggagcccctg

SEQ ID NO: 5858241 - DNA, 13 bp, Homo sapiens
cagacctggagct

SEQ ID NO: 5858242 - DNA, 16 bp, Homo sapiens
cagacctggagcttca

SEQ ID NO: 5858243 - DNA, 23 bp, Homo sapiens
cagacctggagcttcagccaggt

SEQ ID NO: 5858244 - DNA, 16 bp, Homo sapiens
cagacctggcctctgc

SEQ ID NO: 5858245 - DNA, 16 bp, Homo sapiens
cagacctggctctcag

SEQ ID NO: 5858246 - DNA, 14 bp, Homo sapiens
cagacctgggactt

SEQ ID NO: 5858247 - DNA, 18 bp, Homo sapiens
cagacctgggccctggtt

SEQ ID NO: 5858248 - DNA, 13 bp, Homo sapiens
cagacctgtcacc

SEQ ID NO: 5858249 - DNA, 19 bp, Homo sapiens
cagacctgtcaccctgcag

SEQ ID NO: 5858250 - DNA, 12 bp, Homo sapiens
cagacctgtcct

SEQ ID NO: 5858251 - DNA, 18 bp, Homo sapiens
cagacctgtcgtctctcc

SEQ ID NO: 5858252 - DNA, 16 bp, Homo sapiens
cagacctgtcttccaa

SEQ ID NO: 5858253 - DNA, 19 bp, Homo sapiens
cagacctgtcttccaagga

SEQ ID NO: 5858254 - DNA, 20 bp, Homo sapiens
cagacctgttagcagacagg

SEQ ID NO: 5858255 - DNA, 15 bp, Homo sapiens
cagacctgttctgac

SEQ ID NO: 5858256 - DNA, 14 bp, Homo sapiens
cagaccttgaaagt

SEQ ID NO: 5858257 - DNA, 20 bp, Homo sapiens
cagaccttttaactcctcaa

SEQ ID NO: 5858258 - DNA, 15 bp, Homo sapiens
cagaccttttttagg

SEQ ID NO: 5858259 - DNA, 21 bp, Homo sapiens
cagacgaagagtttaaagaga

SEQ ID NO: 5858260 - DNA, 22 bp, Homo sapiens
cagacgacacctggagactgtc

SEQ ID NO: 5858261 - DNA, 16 bp, Homo sapiens
cagacgactagcccag

SEQ ID NO: 5858262 - DNA, 14 bp, Homo sapiens
cagacgagatcctg

SEQ ID NO: 5858263 - DNA, 20 bp, Homo sapiens
cagacgcagcagctgggacc

SEQ ID NO: 5858264 - DNA, 16 bp, Homo sapiens
cagacgcctgaggaac

SEQ ID NO: 5858265 - DNA, 20 bp, Homo sapiens
cagacgcctgcttttgcaaa

SEQ ID NO: 5858266 - DNA, 13 bp, Homo sapiens
cagacgcctggct

SEQ ID NO: 5858267 - DNA, 15 bp, Homo sapiens
cagacgcctggctgc

SEQ ID NO: 5858268 - DNA, 17 bp, Homo sapiens
cagacgctgctgtcaca

SEQ ID NO: 5858269 - DNA, 17 bp, Homo sapiens
cagacggacgggacagc

SEQ ID NO: 5858270 - DNA, 23 bp, Homo sapiens
cagacggatgcccattcctgcct

SEQ ID NO: 5858271 - DNA, 16 bp, Homo sapiens
cagacggcacccaccc

SEQ ID NO: 5858272 - DNA, 19 bp, Homo sapiens
cagacggccggccggacct

SEQ ID NO: 5858273 - DNA, 21 bp, Homo sapiens
cagacggccggccggacctct

SEQ ID NO: 5858274 - DNA, 13 bp, Homo sapiens
cagacggcctagg

SEQ ID NO: 5858275 - DNA, 14 bp, Homo sapiens
cagacggcggccag

SEQ ID NO: 5858276 - DNA, 15 bp, Homo sapiens
cagacggcggccagg

SEQ ID NO: 5858277 - DNA, 16 bp, Homo sapiens
cagacggcggccaggc

SEQ ID NO: 5858278 - DNA, 18 bp, Homo sapiens
cagacggcggccaggcac

SEQ ID NO: 5858279 - DNA, 19 bp, Homo sapiens
cagacggcggccaggcaca

SEQ ID NO: 5858280 - DNA, 23 bp, Homo sapiens
cagacggcggccaggcacagggc

SEQ ID NO: 5858281 - DNA, 18 bp, Homo sapiens
cagacgggaatgcctagg

SEQ ID NO: 5858282 - DNA, 22 bp, Homo sapiens
cagacgggaatgcctaggtccc

SEQ ID NO: 5858283 - DNA, 16 bp, Homo sapiens
cagacgggcacagaca

SEQ ID NO: 5858284 - DNA, 18 bp, Homo sapiens
cagacgggtctgagactg

SEQ ID NO: 5858285 - DNA, 19 bp, Homo sapiens
cagacggtctgtgtgctgt

SEQ ID NO: 5858286 - DNA, 20 bp, Homo sapiens
cagacgtatgcttattttaa

SEQ ID NO: 5858287 - DNA, 18 bp, Homo sapiens
cagacgtccatagctcct

SEQ ID NO: 5858288 - DNA, 22 bp, Homo sapiens
cagacgtctgtcaggggcttgg

SEQ ID NO: 5858289 - DNA, 16 bp, Homo sapiens
cagacgtgctccctcc

SEQ ID NO: 5858290 - DNA, 19 bp, Homo sapiens
cagacgtgtgacctccata

SEQ ID NO: 5858291 - DNA, 22 bp, Homo sapiens
cagacgttaggcatttcctgct

SEQ ID NO: 5858292 - DNA, 23 bp, Homo sapiens
cagacgttaggcatttcctgctg

SEQ ID NO: 5858293 - DNA, 15 bp, Homo sapiens
cagacgttgcctgag

SEQ ID NO: 5858294 - DNA, 18 bp, Homo sapiens
cagacgttggtcccaagt

SEQ ID NO: 5858295 - DNA, 14 bp, Homo sapiens
cagactaaaaagaa

SEQ ID NO: 5858296 - DNA, 15 bp, Homo sapiens
cagactaaaaagaat

SEQ ID NO: 5858297 - DNA, 19 bp, Homo sapiens
cagactaaaaatacaccgt

SEQ ID NO: 5858298 - DNA, 22 bp, Homo sapiens
cagactaaaggatccagagagc

SEQ ID NO: 5858299 - DNA, 22 bp, Homo sapiens
cagactaagccagcaccggacc

SEQ ID NO: 5858300 - DNA, 23 bp, Homo sapiens
cagactaagccagcaccggacca

SEQ ID NO: 5858301 - DNA, 14 bp, Homo sapiens
cagactacacagga

SEQ ID NO: 5858302 - DNA, 16 bp, Homo sapiens
cagactacacaggatg

SEQ ID NO: 5858303 - DNA, 12 bp, Homo sapiens
cagactacagct

SEQ ID NO: 5858304 - DNA, 18 bp, Homo sapiens
cagactagacaccttctg

SEQ ID NO: 5858305 - DNA, 22 bp, Homo sapiens
cagactagatggacctgcctgc

SEQ ID NO: 5858306 - DNA, 20 bp, Homo sapiens
cagactagatgtagtatttt

SEQ ID NO: 5858307 - DNA, 15 bp, Homo sapiens
cagactagccactcc

SEQ ID NO: 5858308 - DNA, 19 bp, Homo sapiens
cagactagccactcctgcc

SEQ ID NO: 5858309 - DNA, 17 bp, Homo sapiens
cagactagctaattagc

SEQ ID NO: 5858310 - DNA, 21 bp, Homo sapiens
cagactaggataatgtccaac

SEQ ID NO: 5858311 - DNA, 18 bp, Homo sapiens
cagactatttaacttgag

SEQ ID NO: 5858312 - DNA, 21 bp, Homo sapiens
cagactatttgctaatgtata

SEQ ID NO: 5858313 - DNA, 15 bp, Homo sapiens
cagactatttttaga

SEQ ID NO: 5858314 - DNA, 17 bp, Homo sapiens
cagactcaaggggctgg

SEQ ID NO: 5858315 - DNA, 18 bp, Homo sapiens
cagactcaagtacccatt

SEQ ID NO: 5858316 - DNA, 19 bp, Homo sapiens
cagactcaatgtccccctc

SEQ ID NO: 5858317 - DNA, 17 bp, Homo sapiens
cagactcaatgtgctct

SEQ ID NO: 5858318 - DNA, 19 bp, Homo sapiens
cagactcaatgtgctctgt

SEQ ID NO: 5858319 - DNA, 21 bp, Homo sapiens
cagactcacaacctgaaccta

SEQ ID NO: 5858320 - DNA, 13 bp, Homo sapiens
cagactcactggg

SEQ ID NO: 5858321 - DNA, 21 bp, Homo sapiens
cagactcactgggaagctccc

SEQ ID NO: 5858322 - DNA, 23 bp, Homo sapiens
cagactcactgggaagctcccac

SEQ ID NO: 5858323 - DNA, 17 bp, Homo sapiens
cagactcagagctctct

SEQ ID NO: 5858324 - DNA, 18 bp, Homo sapiens
cagactcagagctctctc

SEQ ID NO: 5858325 - DNA, 14 bp, Homo sapiens
cagactcagaggga

SEQ ID NO: 5858326 - DNA, 14 bp, Homo sapiens
cagactcagcagag

SEQ ID NO: 5858327 - DNA, 16 bp, Homo sapiens
cagactcagctccaga

SEQ ID NO: 5858328 - DNA, 17 bp, Homo sapiens
cagactcagctccagaa

SEQ ID NO: 5858329 - DNA, 16 bp, Homo sapiens
cagactcaggttccag

SEQ ID NO: 5858330 - DNA, 22 bp, Homo sapiens
cagactcaggttccagaacagc

SEQ ID NO: 5858331 - DNA, 16 bp, Homo sapiens
cagactcagttttttg

SEQ ID NO: 5858332 - DNA, 19 bp, Homo sapiens
cagactcagttttttgtaa

SEQ ID NO: 5858333 - DNA, 16 bp, Homo sapiens
cagactcatacagaag

SEQ ID NO: 5858334 - DNA, 18 bp, Homo sapiens
cagactcatacagaaggt

SEQ ID NO: 5858335 - DNA, 21 bp, Homo sapiens
cagactcatacagaaggtggg

SEQ ID NO: 5858336 - DNA, 18 bp, Homo sapiens
cagactcatcctgaacag

SEQ ID NO: 5858337 - DNA, 20 bp, Homo sapiens
cagactcatcctgaacagca

SEQ ID NO: 5858338 - DNA, 21 bp, Homo sapiens
cagagcaggggctgctggggg

SEQ ID NO: 5858339 - DNA, 17 bp, Homo sapiens
cagagcaggtctgcagg

SEQ ID NO: 5858340 - DNA, 20 bp, Homo sapiens
cagagcagtgggcctggcca

SEQ ID NO: 5858341 - DNA, 22 bp, Homo sapiens
cagagcagtgggcctggccagc

SEQ ID NO: 5858342 - DNA, 16 bp, Homo sapiens
cagagcatacaacaga

SEQ ID NO: 5858343 - DNA, 19 bp, Homo sapiens
cagagcatacaacagaggg

SEQ ID NO: 5858344 - DNA, 19 bp, Homo sapiens
cagagcatcaaaaacatca

SEQ ID NO: 5858345 - DNA, 15 bp, Homo sapiens
cagagcatccgtctc

SEQ ID NO: 5858346 - DNA, 15 bp, Homo sapiens
cagagcatctgcccc

SEQ ID NO: 5858347 - DNA, 21 bp, Homo sapiens
cagagcatctgccccaggtac

SEQ ID NO: 5858348 - DNA, 14 bp, Homo sapiens
cagagcatctggct

SEQ ID NO: 5858349 - DNA, 23 bp, Homo sapiens
cagagcatctggctgtttagcag

SEQ ID NO: 5858350 - DNA, 18 bp, Homo sapiens
cagagcatgtgtcagagt

SEQ ID NO: 5858351 - DNA, 18 bp, Homo sapiens
cagagcattacgtgagcc

SEQ ID NO: 5858352 - DNA, 18 bp, Homo sapiens
cagagcatttaaggaaac

SEQ ID NO: 5858353 - DNA, 21 bp, Homo sapiens
cagagcatttattttggggag

SEQ ID NO: 5858354 - DNA, 15 bp, Homo sapiens
cagagcattttttat

SEQ ID NO: 5858355 - DNA, 18 bp, Homo sapiens
cagagccaaattggtaga

SEQ ID NO: 5858356 - DNA, 20 bp, Homo sapiens
cagagccaacctggacttcc

SEQ ID NO: 5858357 - DNA, 16 bp, Homo sapiens
cagagccaagcactgc

SEQ ID NO: 5858358 - DNA, 20 bp, Homo sapiens
cagagccaagcactgctcac

SEQ ID NO: 5858359 - DNA, 14 bp, Homo sapiens
cagagccaagcctt

SEQ ID NO: 5858360 - DNA, 13 bp, Homo sapiens
cagagccaagctg

SEQ ID NO: 5858361 - DNA, 16 bp, Homo sapiens
cagagccaaggccacc

SEQ ID NO: 5858362 - DNA, 17 bp, Homo sapiens
cagagccacagggtctg

SEQ ID NO: 5858363 - DNA, 12 bp, Homo sapiens
cagagccactct

SEQ ID NO: 5858364 - DNA, 17 bp, Homo sapiens
cagagccactctatgag

SEQ ID NO: 5858365 - DNA, 13 bp, Homo sapiens
cagagccagatgc

SEQ ID NO: 5858366 - DNA, 14 bp, Homo sapiens
cagagccagatgca

SEQ ID NO: 5858367 - DNA, 19 bp, Homo sapiens
cagagccagatgcaggaca

SEQ ID NO: 5858368 - DNA, 12 bp, Homo sapiens
cagagccagcct

SEQ ID NO: 5858369 - DNA, 15 bp, Homo sapiens
cagagccagcctggc

SEQ ID NO: 5858370 - DNA, 17 bp, Homo sapiens
cagagccagcctggctc

SEQ ID NO: 5858371 - DNA, 18 bp, Homo sapiens
cagagccagcctggctct

SEQ ID NO: 5858372 - DNA, 22 bp, Homo sapiens
cagagccagcctggctctgccc

SEQ ID NO: 5858373 - DNA, 19 bp, Homo sapiens
cagagccagcctgggactc

SEQ ID NO: 5858374 - DNA, 10 bp, Homo sapiens
cagagccagg

SEQ ID NO: 5858375 - DNA, 13 bp, Homo sapiens
cagagccaggaag

SEQ ID NO: 5858376 - DNA, 12 bp, Homo sapiens
cagagccaggag

SEQ ID NO: 5858377 - DNA, 17 bp, Homo sapiens
cagagccaggagaagct

SEQ ID NO: 5858378 - DNA, 15 bp, Homo sapiens
cagagccaggctctg

SEQ ID NO: 5858379 - DNA, 19 bp, Homo sapiens
cagagccaggctctgcctg

SEQ ID NO: 5858380 - DNA, 11 bp, Homo sapiens
cagagccaggg

SEQ ID NO: 5858381 - DNA, 13 bp, Homo sapiens
cagagccagggca

SEQ ID NO: 5858382 - DNA, 15 bp, Homo sapiens
cagagccagggcagg

SEQ ID NO: 5858383 - DNA, 20 bp, Homo sapiens
cagagccagggctgtcctta

SEQ ID NO: 5858384 - DNA, 17 bp, Homo sapiens
cagagccatccaccctg

SEQ ID NO: 5858385 - DNA, 21 bp, Homo sapiens
cagagccatccaccctgagga

SEQ ID NO: 5858386 - DNA, 15 bp, Homo sapiens
cagagccatgccagg

SEQ ID NO: 5858387 - DNA, 17 bp, Homo sapiens
cagagccatgccaggct

SEQ ID NO: 5858388 - DNA, 17 bp, Homo sapiens
cagagccatgggcctgg

SEQ ID NO: 5858389 - DNA, 20 bp, Homo sapiens
cagagccatgggcctgggcc

SEQ ID NO: 5858390 - DNA, 18 bp, Homo sapiens
cagagccatgtcttctcc

SEQ ID NO: 5858391 - DNA, 16 bp, Homo sapiens
cagagcccaagtgcca

SEQ ID NO: 5858392 - DNA, 18 bp, Homo sapiens
cagagcccaagtgccatc

SEQ ID NO: 5858393 - DNA, 23 bp, Homo sapiens
cagagcccaatgcatagagccct

SEQ ID NO: 5858394 - DNA, 17 bp, Homo sapiens
cagagcccaccagccag

SEQ ID NO: 5858395 - DNA, 17 bp, Homo sapiens
cagagcccaccttggct

SEQ ID NO: 5858396 - DNA, 19 bp, Homo sapiens
cagagcccaccttggctca

SEQ ID NO: 5858397 - DNA, 20 bp, Homo sapiens
cagagcccaccttggctcaa

SEQ ID NO: 5858398 - DNA, 16 bp, Homo sapiens
cagagcccacgccccc

SEQ ID NO: 5858399 - DNA, 19 bp, Homo sapiens
cagagcccacgcccccact

SEQ ID NO: 5858400 - DNA, 14 bp, Homo sapiens
cagagcccagcatc

SEQ ID NO: 5858401 - DNA, 16 bp, Homo sapiens
cagagcccagcatccc

SEQ ID NO: 5858402 - DNA, 14 bp, Homo sapiens
cagagcccagctcc

SEQ ID NO: 5858403 - DNA, 16 bp, Homo sapiens
cagagcccagctcttg

SEQ ID NO: 5858404 - DNA, 19 bp, Homo sapiens
cagagcccagctcttgctc

SEQ ID NO: 5858405 - DNA, 14 bp, Homo sapiens
cagagcccaggctc

SEQ ID NO: 5858406 - DNA, 22 bp, Homo sapiens
cagagcccagggcatcccatgg

SEQ ID NO: 5858407 - DNA, 14 bp, Homo sapiens
cagagcccagggga

SEQ ID NO: 5858408 - DNA, 16 bp, Homo sapiens
cagagcccaggggaga

SEQ ID NO: 5858409 - DNA, 15 bp, Homo sapiens
cagagcccatgctca

SEQ ID NO: 5858410 - DNA, 16 bp, Homo sapiens
cagagccccaagcagg

SEQ ID NO: 5858411 - DNA, 15 bp, Homo sapiens
cagagccccacagcc

SEQ ID NO: 5858412 - DNA, 16 bp, Homo sapiens
cagagccccacagccc

SEQ ID NO: 5858413 - DNA, 16 bp, Homo sapiens
cagagccccacgctgt

SEQ ID NO: 5858414 - DNA, 21 bp, Homo sapiens
cagagcccccaagcctctgcc

SEQ ID NO: 5858415 - DNA, 17 bp, Homo sapiens
cagagcccccagccctg

SEQ ID NO: 5858416 - DNA, 15 bp, Homo sapiens
cagagccccccacaa

SEQ ID NO: 5858417 - DNA, 14 bp, Homo sapiens
cagagcccccctag

SEQ ID NO: 5858418 - DNA, 17 bp, Homo sapiens
cagagccccgccccacc

SEQ ID NO: 5858419 - DNA, 15 bp, Homo sapiens
cagagccccggagca

SEQ ID NO: 5858420 - DNA, 16 bp, Homo sapiens
cagagccccggagcac

SEQ ID NO: 5858421 - DNA, 17 bp, Homo sapiens
cagagccccggagcacc

SEQ ID NO: 5858422 - DNA, 19 bp, Homo sapiens
cagagccccggagcaccac

SEQ ID NO: 5858423 - DNA, 21 bp, Homo sapiens
cagagcccctacagcattgtt

SEQ ID NO: 5858424 - DNA, 20 bp, Homo sapiens
cagagcccctcatgccacag

SEQ ID NO: 5858425 - DNA, 17 bp, Homo sapiens
cagagcccctcctccag

SEQ ID NO: 5858426 - DNA, 18 bp, Homo sapiens
cagagcccctcctccagc

SEQ ID NO: 5858427 - DNA, 22 bp, Homo sapiens
cagagcccctcctccagcccct

SEQ ID NO: 5858428 - DNA, 21 bp, Homo sapiens
cagagcccctttaaccctgat

SEQ ID NO: 5858429 - DNA, 22 bp, Homo sapiens
cagagcccgcccacctgggccc

SEQ ID NO: 5858430 - DNA, 14 bp, Homo sapiens
cagagcccgggaga

SEQ ID NO: 5858431 - DNA, 17 bp, Homo sapiens
cagagcccgggagagac

SEQ ID NO: 5858432 - DNA, 18 bp, Homo sapiens
cagagcccgggagagact

SEQ ID NO: 5858433 - DNA, 19 bp, Homo sapiens
cagagccctatctatgtcc

SEQ ID NO: 5858434 - DNA, 23 bp, Homo sapiens
cagagccctatctatgtcctgga

SEQ ID NO: 5858435 - DNA, 16 bp, Homo sapiens
cagagccctccaggcc

SEQ ID NO: 5858436 - DNA, 20 bp, Homo sapiens
cagagccctccaggcctgca

SEQ ID NO: 5858437 - DNA, 22 bp, Homo sapiens
cagagccctccaggcctgcagg

SEQ ID NO: 5858438 - DNA, 18 bp, Homo sapiens
cagagccctgaggggctg

SEQ ID NO: 5858439 - DNA, 19 bp, Homo sapiens
cagagccctgaggggctgg

SEQ ID NO: 5858440 - DNA, 12 bp, Homo sapiens
cagagccctgca

SEQ ID NO: 5858441 - DNA, 14 bp, Homo sapiens
cagagccctgcagt

SEQ ID NO: 5858442 - DNA, 16 bp, Homo sapiens
cagagccctgccctgc

SEQ ID NO: 5858443 - DNA, 15 bp, Homo sapiens
cagagccctgctccc

SEQ ID NO: 5858444 - DNA, 12 bp, Homo sapiens
cagagccctggc

SEQ ID NO: 5858445 - DNA, 16 bp, Homo sapiens
cagagccctggctggg

SEQ ID NO: 5858446 - DNA, 17 bp, Homo sapiens
cagagccctggctgggt

SEQ ID NO: 5858447 - DNA, 20 bp, Homo sapiens
cagagccgcaccctggctgg

SEQ ID NO: 5858448 - DNA, 18 bp, Homo sapiens
cagagccggcatccttgc

SEQ ID NO: 5858449 - DNA, 22 bp, Homo sapiens
cagagccggcatccttgcctgt

SEQ ID NO: 5858450 - DNA, 20 bp, Homo sapiens
cagagccggcccgcctctcc

SEQ ID NO: 5858451 - DNA, 22 bp, Homo sapiens
cagagccgggaggaaaaggccc

SEQ ID NO: 5858452 - DNA, 20 bp, Homo sapiens
cagagccgtaaaaactgaag

SEQ ID NO: 5858453 - DNA, 23 bp, Homo sapiens
cagagccgtaaaaactgaagttc

SEQ ID NO: 5858454 - DNA, 17 bp, Homo sapiens
cagagccgttcctggga

SEQ ID NO: 5858455 - DNA, 21 bp, Homo sapiens
cagagcctacagaagggcagt

SEQ ID NO: 5858456 - DNA, 17 bp, Homo sapiens
cagagcctagccacctc

SEQ ID NO: 5858457 - DNA, 20 bp, Homo sapiens
cagagcctagccacctccca

SEQ ID NO: 5858458 - DNA, 14 bp, Homo sapiens
cagagcctcagctt

SEQ ID NO: 5858459 - DNA, 16 bp, Homo sapiens
cagagcctccacttag

SEQ ID NO: 5858460 - DNA, 19 bp, Homo sapiens
cagagcctcccaaggagaa

SEQ ID NO: 5858461 - DNA, 12 bp, Homo sapiens
cagagcctccct

SEQ ID NO: 5858462 - DNA, 15 bp, Homo sapiens
cagagcctccctcag

SEQ ID NO: 5858463 - DNA, 13 bp, Homo sapiens
cagagcctcctgg

SEQ ID NO: 5858464 - DNA, 16 bp, Homo sapiens
cagagcctcctgggaa

SEQ ID NO: 5858465 - DNA, 14 bp, Homo sapiens
cagagcctcgctct

SEQ ID NO: 5858466 - DNA, 13 bp, Homo sapiens
cagagcctctggc

SEQ ID NO: 5858467 - DNA, 15 bp, Homo sapiens
cagagcctctggccc

SEQ ID NO: 5858468 - DNA, 23 bp, Homo sapiens
cagagcctgacgctcagccccag

SEQ ID NO: 5858469 - DNA, 13 bp, Homo sapiens
cagagcctgcagg

SEQ ID NO: 5858470 - DNA, 17 bp, Homo sapiens
cagagcctgcagggtga

SEQ ID NO: 5858471 - DNA, 13 bp, Homo sapiens
cagagcctgcccc

SEQ ID NO: 5858472 - DNA, 19 bp, Homo sapiens
cagagcctgccccagcgct

SEQ ID NO: 5858473 - DNA, 21 bp, Homo sapiens
cagagcctgcctaaccaggcc

SEQ ID NO: 5858474 - DNA, 23 bp, Homo sapiens
cagagcctgcctaaccaggccca

SEQ ID NO: 5858475 - DNA, 15 bp, Homo sapiens
cagagcctgcctcag

SEQ ID NO: 5858476 - DNA, 11 bp, Homo sapiens
cagagcctggc

SEQ ID NO: 5858477 - DNA, 14 bp, Homo sapiens
cagagcctggcccc

SEQ ID NO: 5858478 - DNA, 19 bp, Homo sapiens
cagagcctggccccaggcc

SEQ ID NO: 5858479 - DNA, 12 bp, Homo sapiens
cagagcctggct

SEQ ID NO: 5858480 - DNA, 17 bp, Homo sapiens
cagagcctggctgccca

SEQ ID NO: 5858481 - DNA, 24 bp, Homo sapiens
cagagcctggggcatcccagagcc

SEQ ID NO: 5858482 - DNA, 20 bp, Homo sapiens
cagagcctggggtgttctct

SEQ ID NO: 5858483 - DNA, 14 bp, Homo sapiens
cagagcctgtcccc

SEQ ID NO: 5858484 - DNA, 19 bp, Homo sapiens
cagagcctgtgtgaaaata

SEQ ID NO: 5858485 - DNA, 19 bp, Homo sapiens
cagagcctgttttaaaaaa

SEQ ID NO: 5858486 - DNA, 21 bp, Homo sapiens
cagagccttcaagtgccaaac

SEQ ID NO: 5858487 - DNA, 23 bp, Homo sapiens
cagagccttcacaaccagccaca

SEQ ID NO: 5858488 - DNA, 15 bp, Homo sapiens
cagagccttctcaga

SEQ ID NO: 5858489 - DNA, 21 bp, Homo sapiens
cagagccttctcagaagcaca

SEQ ID NO: 5858490 - DNA, 13 bp, Homo sapiens
cagagccttctcc

SEQ ID NO: 5858491 - DNA, 19 bp, Homo sapiens
cagagccttctcctgccta

SEQ ID NO: 5858492 - DNA, 23 bp, Homo sapiens
cagagccttctgaggacattcca

SEQ ID NO: 5858493 - DNA, 18 bp, Homo sapiens
cagagccttggaggacac

SEQ ID NO: 5858494 - DNA, 19 bp, Homo sapiens
cagagcctttggatgacca

SEQ ID NO: 5858495 - DNA, 22 bp, Homo sapiens
cagagcctttttacctggccta

SEQ ID NO: 5858496 - DNA, 20 bp, Homo sapiens
cagagcctttttcacaattc

SEQ ID NO: 5858497 - DNA, 16 bp, Homo sapiens
cagagcgagactccat

SEQ ID NO: 5858498 - DNA, 13 bp, Homo sapiens
cagagcgagactg

SEQ ID NO: 5858499 - DNA, 16 bp, Homo sapiens
cagagcgcagccccca

SEQ ID NO: 5858500 - DNA, 13 bp, Homo sapiens
cagagcgccagga

SEQ ID NO: 5858501 - DNA, 20 bp, Homo sapiens
cagagcgccaggaagccaga

SEQ ID NO: 5858502 - DNA, 20 bp, Homo sapiens
cagagcgccgtgagttctca

SEQ ID NO: 5858503 - DNA, 14 bp, Homo sapiens
cagagcgcctcacc

SEQ ID NO: 5858504 - DNA, 20 bp, Homo sapiens
cagagcgcctcacctgcatc

SEQ ID NO: 5858505 - DNA, 18 bp, Homo sapiens
cagagcgcgcccctagcc

SEQ ID NO: 5858506 - DNA, 15 bp, Homo sapiens
cagagcggaactatg

SEQ ID NO: 5858507 - DNA, 17 bp, Homo sapiens
cagagcggaggctgtgt

SEQ ID NO: 5858508 - DNA, 13 bp, Homo sapiens
cagagcggggagg

SEQ ID NO: 5858509 - DNA, 16 bp, Homo sapiens
cagagcggggaggtgc

SEQ ID NO: 5858510 - DNA, 21 bp, Homo sapiens
cagagcggggtcccctctgtg

SEQ ID NO: 5858511 - DNA, 18 bp, Homo sapiens
cagagcggtatctctggc

SEQ ID NO: 5858512 - DNA, 17 bp, Homo sapiens
cagagcgtccttccccc

SEQ ID NO: 5858513 - DNA, 21 bp, Homo sapiens
cagagcgtccttggctgccgt

SEQ ID NO: 5858514 - DNA, 22 bp, Homo sapiens
cagagcgtgagctgagcaggcc

SEQ ID NO: 5858515 - DNA, 21 bp, Homo sapiens
cagagcgtggctgtgctctca

SEQ ID NO: 5858516 - DNA, 18 bp, Homo sapiens
cagagtcttgctacctca

SEQ ID NO: 5858517 - DNA, 15 bp, Homo sapiens
cagagtgaaagggct

SEQ ID NO: 5858518 - DNA, 20 bp, Homo sapiens
cagagtgaaagggctatggc

SEQ ID NO: 5858519 - DNA, 19 bp, Homo sapiens
cagagtgaaattcaattca

SEQ ID NO: 5858520 - DNA, 11 bp, Homo sapiens
cagagtgaacc

SEQ ID NO: 5858521 - DNA, 16 bp, Homo sapiens
cagagtgaagaatctt

SEQ ID NO: 5858522 - DNA, 14 bp, Homo sapiens
cagagtgaagagtg

SEQ ID NO: 5858523 - DNA, 21 bp, Homo sapiens
cagagtgaatgtcccccatca

SEQ ID NO: 5858524 - DNA, 19 bp, Homo sapiens
cagagtgacagtcataaat

SEQ ID NO: 5858525 - DNA, 15 bp, Homo sapiens
cagagtgaccagcac

SEQ ID NO: 5858526 - DNA, 14 bp, Homo sapiens
cagagtgaccctca

SEQ ID NO: 5858527 - DNA, 16 bp, Homo sapiens
cagagtgaccctcagc

SEQ ID NO: 5858528 - DNA, 20 bp, Homo sapiens
cagagtgaccctcagctgtc

SEQ ID NO: 5858529 - DNA, 20 bp, Homo sapiens
cagagtgagacccagccctc

SEQ ID NO: 5858530 - DNA, 19 bp, Homo sapiens
cagagtgagaccctgtctc

SEQ ID NO: 5858531 - DNA, 15 bp, Homo sapiens
cagagtgagccagtg

SEQ ID NO: 5858532 - DNA, 23 bp, Homo sapiens
cagagtgaggatgtgttttgcac

SEQ ID NO: 5858533 - DNA, 17 bp, Homo sapiens
cagagtgattcaggggc

SEQ ID NO: 5858534 - DNA, 13 bp, Homo sapiens
cagagtgattcta

SEQ ID NO: 5858535 - DNA, 18 bp, Homo sapiens
cagagtgcaagcccctgc

SEQ ID NO: 5858536 - DNA, 14 bp, Homo sapiens
cagagtgcagaggc

SEQ ID NO: 5858537 - DNA, 11 bp, Homo sapiens
cagagtgccac

SEQ ID NO: 5858538 - DNA, 15 bp, Homo sapiens
cagagtgccactgcg

SEQ ID NO: 5858539 - DNA, 19 bp, Homo sapiens
cagagtgccatccctgaga

SEQ ID NO: 5858540 - DNA, 14 bp, Homo sapiens
cagagtgcccagaa

SEQ ID NO: 5858541 - DNA, 15 bp, Homo sapiens
cagagtgccccacct

SEQ ID NO: 5858542 - DNA, 14 bp, Homo sapiens
cagagtgccctggg

SEQ ID NO: 5858543 - DNA, 17 bp, Homo sapiens
cagagtgccctggggca

SEQ ID NO: 5858544 - DNA, 20 bp, Homo sapiens
cagagtgctggcacttagta

SEQ ID NO: 5858545 - DNA, 16 bp, Homo sapiens
cagagtgctgtcggga

SEQ ID NO: 5858546 - DNA, 18 bp, Homo sapiens
cagagtgctgtcgggacc

SEQ ID NO: 5858547 - DNA, 18 bp, Homo sapiens
cagagtggaataagacag

SEQ ID NO: 5858548 - DNA, 12 bp, Homo sapiens
cagagtggactc

SEQ ID NO: 5858549 - DNA, 16 bp, Homo sapiens
cagagtggactgcatt

SEQ ID NO: 5858550 - DNA, 19 bp, Homo sapiens
cagagtggagcccagggtg

SEQ ID NO: 5858551 - DNA, 20 bp, Homo sapiens
cagagtggagcccagggtgc

SEQ ID NO: 5858552 - DNA, 17 bp, Homo sapiens
cagagtggagccctcag

SEQ ID NO: 5858553 - DNA, 12 bp, Homo sapiens
cagagtggaggc

SEQ ID NO: 5858554 - DNA, 13 bp, Homo sapiens
cagagtggagtct

SEQ ID NO: 5858555 - DNA, 20 bp, Homo sapiens
cagagtggatctggagtctg

SEQ ID NO: 5858556 - DNA, 18 bp, Homo sapiens
cagagtggattaaaggca

SEQ ID NO: 5858557 - DNA, 13 bp, Homo sapiens
cagagtggcccac

SEQ ID NO: 5858558 - DNA, 14 bp, Homo sapiens
cagagtggcccacc

SEQ ID NO: 5858559 - DNA, 16 bp, Homo sapiens
cagagtggcctagagc

SEQ ID NO: 5858560 - DNA, 16 bp, Homo sapiens
cagagtggcctccctg

SEQ ID NO: 5858561 - DNA, 18 bp, Homo sapiens
cagagtggcctccctgct

SEQ ID NO: 5858562 - DNA, 19 bp, Homo sapiens
cagagtggcctccctgctg

SEQ ID NO: 5858563 - DNA, 12 bp, Homo sapiens
cagagtggcctg

SEQ ID NO: 5858564 - DNA, 13 bp, Homo sapiens
cagagtggcctgt

SEQ ID NO: 5858565 - DNA, 21 bp, Homo sapiens
cagagtggcgtgagctgcccg

SEQ ID NO: 5858566 - DNA, 19 bp, Homo sapiens
cagagtggcgtggcctccc

SEQ ID NO: 5858567 - DNA, 23 bp, Homo sapiens
cagagtggctcactggctgggag

SEQ ID NO: 5858568 - DNA, 23 bp, Homo sapiens
cagagtgggacttggagagcaaa

SEQ ID NO: 5858569 - DNA, 14 bp, Homo sapiens
cagagtgggagagg

SEQ ID NO: 5858570 - DNA, 20 bp, Homo sapiens
cagagtgggagaggctggga

SEQ ID NO: 5858571 - DNA, 22 bp, Homo sapiens
cagagtgggagaggctgggagg

SEQ ID NO: 5858572 - DNA, 18 bp, Homo sapiens
cagagtgggccccgggct

SEQ ID NO: 5858573 - DNA, 17 bp, Homo sapiens
cagagtgggctgcctgg

SEQ ID NO: 5858574 - DNA, 19 bp, Homo sapiens
cagagtgggctgcctgggg

SEQ ID NO: 5858575 - DNA, 18 bp, Homo sapiens
cagagtgggctttggtgg

SEQ ID NO: 5858576 - DNA, 19 bp, Homo sapiens
cagagtgggctttggtggc

SEQ ID NO: 5858577 - DNA, 19 bp, Homo sapiens
cagagtgggtcttggacca

SEQ ID NO: 5858578 - DNA, 18 bp, Homo sapiens
cagagtggtcgagtgaca

SEQ ID NO: 5858579 - DNA, 15 bp, Homo sapiens
cagagtggtctttct

SEQ ID NO: 5858580 - DNA, 15 bp, Homo sapiens
cagagtggtggggga

SEQ ID NO: 5858581 - DNA, 17 bp, Homo sapiens
cagagtgtagccaggtc

SEQ ID NO: 5858582 - DNA, 19 bp, Homo sapiens
cagagtgtagccaggtccc

SEQ ID NO: 5858583 - DNA, 23 bp, Homo sapiens
cagagtgtccccagagacatgca

SEQ ID NO: 5858584 - DNA, 22 bp, Homo sapiens
cagagtgtccctttttgcaggg

SEQ ID NO: 5858585 - DNA, 19 bp, Homo sapiens
cagagtgtgcagactgatg

SEQ ID NO: 5858586 - DNA, 16 bp, Homo sapiens
cagagtgtgctgctat

SEQ ID NO: 5858587 - DNA, 23 bp, Homo sapiens
cagagtgtggccttcggacaact

SEQ ID NO: 5858588 - DNA, 19 bp, Homo sapiens
cagagtgtgggaagggaga

SEQ ID NO: 5858589 - DNA, 20 bp, Homo sapiens
cagagtgtgggaagggagag

SEQ ID NO: 5858590 - DNA, 19 bp, Homo sapiens
cagagtgttataacaccat

SEQ ID NO: 5858591 - DNA, 22 bp, Homo sapiens
cagagtgttttgaccagtttaa

SEQ ID NO: 5858592 - DNA, 19 bp, Homo sapiens
cagagttaaaatgtttact

SEQ ID NO: 5858593 - DNA, 22 bp, Homo sapiens
cagagttaaaatgtttactgta

SEQ ID NO: 5858594 - DNA, 13 bp, Homo sapiens
cagagttaaagca

SEQ ID NO: 5858595 - DNA, 20 bp, Homo sapiens
cagagttaaatatgcatctg

SEQ ID NO: 5858596 - DNA, 17 bp, Homo sapiens
cagagttacagttctgt

SEQ ID NO: 5858597 - DNA, 12 bp, Homo sapiens
cagagttacttg

SEQ ID NO: 5858598 - DNA, 18 bp, Homo sapiens
cagagttagatattattt

SEQ ID NO: 5858599 - DNA, 17 bp, Homo sapiens
cagagttattagtgcca

SEQ ID NO: 5858600 - DNA, 16 bp, Homo sapiens
cagagttattgaatct

SEQ ID NO: 5858601 - DNA, 22 bp, Homo sapiens
cagagttattgaatcttaattt

SEQ ID NO: 5858602 - DNA, 19 bp, Homo sapiens
cagagttcacaggaggcca

SEQ ID NO: 5858603 - DNA, 20 bp, Homo sapiens
cagagttcacaggaggccag

SEQ ID NO: 5858604 - DNA, 14 bp, Homo sapiens
cagagttcactata

SEQ ID NO: 5858605 - DNA, 20 bp, Homo sapiens
cagagttcactataaatggt

SEQ ID NO: 5858606 - DNA, 16 bp, Homo sapiens
cagagttcagggaggg

SEQ ID NO: 5858607 - DNA, 20 bp, Homo sapiens
cagagttccacaaatctata

SEQ ID NO: 5858608 - DNA, 15 bp, Homo sapiens
cagagttccacagtt

SEQ ID NO: 5858609 - DNA, 22 bp, Homo sapiens
cagagttcctgcggagtgaaga

SEQ ID NO: 5858610 - DNA, 23 bp, Homo sapiens
cagagttctcctggaggcagggg

SEQ ID NO: 5858611 - DNA, 20 bp, Homo sapiens
cagagttctgtgaagaggaa

SEQ ID NO: 5858612 - DNA, 20 bp, Homo sapiens
cagagttgaagacagagcta

SEQ ID NO: 5858613 - DNA, 22 bp, Homo sapiens
cagagttgaagacagagctaca

SEQ ID NO: 5858614 - DNA, 22 bp, Homo sapiens
cagagttgggggctaggggagg

SEQ ID NO: 5858615 - DNA, 17 bp, Homo sapiens
cagagttggtgttcata

SEQ ID NO: 5858616 - DNA, 18 bp, Homo sapiens
cagagttgtaaatatata

SEQ ID NO: 5858617 - DNA, 22 bp, Homo sapiens
cagagttgttaaccagaaagtc

SEQ ID NO: 5858618 - DNA, 19 bp, Homo sapiens
cagagtttgatatgggctt

SEQ ID NO: 5858619 - DNA, 22 bp, Homo sapiens
cagagtttgatatgggctttct

SEQ ID NO: 5858620 - DNA, 20 bp, Homo sapiens
cagagtttgcctccctgcac

SEQ ID NO: 5858621 - DNA, 15 bp, Homo sapiens
cagagtttgtgtgta

SEQ ID NO: 5858622 - DNA, 18 bp, Homo sapiens
cagagtttgtgtgtattt

SEQ ID NO: 5858623 - DNA, 21 bp, Homo sapiens
cagagtttgtgtgtatttgta

SEQ ID NO: 5858624 - DNA, 23 bp, Homo sapiens
cagagttttcattaaatcctttt

SEQ ID NO: 5858625 - DNA, 17 bp, Homo sapiens
cagagtttttaaagcct

SEQ ID NO: 5858626 - DNA, 18 bp, Homo sapiens
cagagtttttaaagcctt

SEQ ID NO: 5858627 - DNA, 19 bp, Homo sapiens
cagagtttttaaagccttc

SEQ ID NO: 5858628 - DNA, 15 bp, Homo sapiens
cagagtttttatgta

SEQ ID NO: 5858629 - DNA, 21 bp, Homo sapiens
cagagttttttaaacaaatga

SEQ ID NO: 5858630 - DNA, 14 bp, Homo sapiens
cagataaaaacaat

SEQ ID NO: 5858631 - DNA, 16 bp, Homo sapiens
cagataaacaaacaag

SEQ ID NO: 5858632 - DNA, 20 bp, Homo sapiens
cagataaagaaactgaggcc

SEQ ID NO: 5858633 - DNA, 22 bp, Homo sapiens
cagataaagaaactgaggccca

SEQ ID NO: 5858634 - DNA, 22 bp, Homo sapiens
cagataaagacagctgacagat

SEQ ID NO: 5858635 - DNA, 13 bp, Homo sapiens
cagataaatacat

SEQ ID NO: 5858636 - DNA, 16 bp, Homo sapiens
cagataaatacattta

SEQ ID NO: 5858637 - DNA, 13 bp, Homo sapiens
cagataaatagaa

SEQ ID NO: 5858638 - DNA, 15 bp, Homo sapiens
cagataaatagaact

SEQ ID NO: 5858639 - DNA, 16 bp, Homo sapiens
cagataaatagaacta

SEQ ID NO: 5858640 - DNA, 15 bp, Homo sapiens
cagataaatcatggg

SEQ ID NO: 5858641 - DNA, 23 bp, Homo sapiens
cagataaatgattcaaaaagtca

SEQ ID NO: 5858642 - DNA, 22 bp, Homo sapiens
cagataacaatgcagcaaggcc

SEQ ID NO: 5858643 - DNA, 13 bp, Homo sapiens
cagataacctaat

SEQ ID NO: 5858644 - DNA, 21 bp, Homo sapiens
cagataacctaataattgtat

SEQ ID NO: 5858645 - DNA, 21 bp, Homo sapiens
cagataactaaggtgaagaat

SEQ ID NO: 5858646 - DNA, 13 bp, Homo sapiens
cagataactgagg

SEQ ID NO: 5858647 - DNA, 16 bp, Homo sapiens
cagataactgttattt

SEQ ID NO: 5858648 - DNA, 21 bp, Homo sapiens
cagataactgttatttataat

SEQ ID NO: 5858649 - DNA, 16 bp, Homo sapiens
cagataacttagctta

SEQ ID NO: 5858650 - DNA, 12 bp, Homo sapiens
cagataactttt

SEQ ID NO: 5858651 - DNA, 13 bp, Homo sapiens
cagataacttttt

SEQ ID NO: 5858652 - DNA, 20 bp, Homo sapiens
cagataacttttttttttct

SEQ ID NO: 5858653 - DNA, 12 bp, Homo sapiens
cagataaggctt

SEQ ID NO: 5858654 - DNA, 18 bp, Homo sapiens
cagataaggctttaggat

SEQ ID NO: 5858655 - DNA, 16 bp, Homo sapiens
cagataagtgtaaata

SEQ ID NO: 5858656 - DNA, 19 bp, Homo sapiens
cagataatcagcctcttaa

SEQ ID NO: 5858657 - DNA, 15 bp, Homo sapiens
cagataatccctgta

SEQ ID NO: 5858658 - DNA, 17 bp, Homo sapiens
cagataatggtaattta

SEQ ID NO: 5858659 - DNA, 13 bp, Homo sapiens
cagataatgtgaa

SEQ ID NO: 5858660 - DNA, 14 bp, Homo sapiens
cagataatgtgaaa

SEQ ID NO: 5858661 - DNA, 18 bp, Homo sapiens
cagataattcatttgtat

SEQ ID NO: 5858662 - DNA, 15 bp, Homo sapiens
cagataattctggac

SEQ ID NO: 5858663 - DNA, 18 bp, Homo sapiens
cagataatttattttgta

SEQ ID NO: 5858664 - DNA, 16 bp, Homo sapiens
cagatacatagatgga

SEQ ID NO: 5858665 - DNA, 13 bp, Homo sapiens
cagatacatcact

SEQ ID NO: 5858666 - DNA, 17 bp, Homo sapiens
cagatacatggttgtga

SEQ ID NO: 5858667 - DNA, 16 bp, Homo sapiens
cagataccagcccctg

SEQ ID NO: 5858668 - DNA, 18 bp, Homo sapiens
cagatacccagtggaatt

SEQ ID NO: 5858669 - DNA, 17 bp, Homo sapiens
cagatacctcatcatcc

SEQ ID NO: 5858670 - DNA, 21 bp, Homo sapiens
cagatacggacagagaccaag

SEQ ID NO: 5858671 - DNA, 22 bp, Homo sapiens
cagatacggacagagaccaaga

SEQ ID NO: 5858672 - DNA, 22 bp, Homo sapiens
cagatactactgaccagacaag

SEQ ID NO: 5858673 - DNA, 15 bp, Homo sapiens
cagatactgaaacat

SEQ ID NO: 5858674 - DNA, 17 bp, Homo sapiens
cagatactgaaacattt

SEQ ID NO: 5858675 - DNA, 18 bp, Homo sapiens
cagatactgaaacatttg

SEQ ID NO: 5858676 - DNA, 18 bp, Homo sapiens
cagatactggaagttttg

SEQ ID NO: 5858677 - DNA, 21 bp, Homo sapiens
cagatactggaagttttgcat

SEQ ID NO: 5858678 - DNA, 18 bp, Homo sapiens
cagatactggattgtact

SEQ ID NO: 5858679 - DNA, 21 bp, Homo sapiens
cagatactgtgagcttacatt

SEQ ID NO: 5858680 - DNA, 23 bp, Homo sapiens
cagatactttgaagtgcagctca

SEQ ID NO: 5858681 - DNA, 22 bp, Homo sapiens
cagatagaaaacagcccccact

SEQ ID NO: 5858682 - DNA, 16 bp, Homo sapiens
cagatagaatcaatca

SEQ ID NO: 5858683 - DNA, 20 bp, Homo sapiens
cagatagaatttggcccaga

SEQ ID NO: 5858684 - DNA, 18 bp, Homo sapiens
cagatagacagtgctgcc

SEQ ID NO: 5858685 - DNA, 21 bp, Homo sapiens
cagatagacagtgctgccctg

SEQ ID NO: 5858686 - DNA, 24 bp, Homo sapiens
cagatagacagtgctgccctgcga

SEQ ID NO: 5858687 - DNA, 24 bp, Homo sapiens
cagatagacctgtgacctggtctg

SEQ ID NO: 5858688 - DNA, 21 bp, Homo sapiens
cagatagagagttgttgtgta

SEQ ID NO: 5858689 - DNA, 16 bp, Homo sapiens
cagatagagctgggtg

SEQ ID NO: 5858690 - DNA, 19 bp, Homo sapiens
cagatagatgttgctcttt

SEQ ID NO: 5858691 - DNA, 12 bp, Homo sapiens
cagatagccaga

SEQ ID NO: 5858692 - DNA, 14 bp, Homo sapiens
cagattttaaaaag

SEQ ID NO: 5858693 - DNA, 19 bp, Homo sapiens
cagattttaaaaagggtaa

SEQ ID NO: 5858694 - DNA, 19 bp, Homo sapiens
cagattttaagggggaaaa

SEQ ID NO: 5858695 - DNA, 19 bp, Homo sapiens
cagattttacaaaagatgt

SEQ ID NO: 5858696 - DNA, 17 bp, Homo sapiens
cagattttagttttatt

SEQ ID NO: 5858697 - DNA, 17 bp, Homo sapiens
cagattttatattttct

SEQ ID NO: 5858698 - DNA, 15 bp, Homo sapiens
cagattttattatgt

SEQ ID NO: 5858699 - DNA, 17 bp, Homo sapiens
cagattttatttatgcg

SEQ ID NO: 5858700 - DNA, 15 bp, Homo sapiens
cagattttcagcaaa

SEQ ID NO: 5858701 - DNA, 22 bp, Homo sapiens
cagattttcctcagattagatg

SEQ ID NO: 5858702 - DNA, 15 bp, Homo sapiens
cagattttcctgaaa

SEQ ID NO: 5858703 - DNA, 16 bp, Homo sapiens
cagattttctcctgtg

SEQ ID NO: 5858704 - DNA, 12 bp, Homo sapiens
cagattttgata

SEQ ID NO: 5858705 - DNA, 16 bp, Homo sapiens
cagattttgctgtata

SEQ ID NO: 5858706 - DNA, 17 bp, Homo sapiens
cagattttgctgtatat

SEQ ID NO: 5858707 - DNA, 21 bp, Homo sapiens
cagattttggggttgtgttgt

SEQ ID NO: 5858708 - DNA, 23 bp, Homo sapiens
cagattttggggttgtgttgtca

SEQ ID NO: 5858709 - DNA, 19 bp, Homo sapiens
cagattttggttggttttt

SEQ ID NO: 5858710 - DNA, 14 bp, Homo sapiens
cagatttttacaaa

SEQ ID NO: 5858711 - DNA, 15 bp, Homo sapiens
cagatttttacaaat

SEQ ID NO: 5858712 - DNA, 22 bp, Homo sapiens
cagatttttatgttttctttct

SEQ ID NO: 5858713 - DNA, 20 bp, Homo sapiens
cagatttttatgttttgaaa

SEQ ID NO: 5858714 - DNA, 16 bp, Homo sapiens
cagatttttatttatg

SEQ ID NO: 5858715 - DNA, 18 bp, Homo sapiens
cagatttttcggaggccc

SEQ ID NO: 5858716 - DNA, 16 bp, Homo sapiens
cagatttttgggctcc

SEQ ID NO: 5858717 - DNA, 17 bp, Homo sapiens
cagatttttgtaataaa

SEQ ID NO: 5858718 - DNA, 15 bp, Homo sapiens
cagattttttaaaat

SEQ ID NO: 5858719 - DNA, 19 bp, Homo sapiens
cagattttttacagctgcc

SEQ ID NO: 5858720 - DNA, 21 bp, Homo sapiens
cagattttttctttaaataaa

SEQ ID NO: 5858721 - DNA, 13 bp, Homo sapiens
cagattttttgta

SEQ ID NO: 5858722 - DNA, 14 bp, Homo sapiens
cagatttttttgta

SEQ ID NO: 5858723 - DNA, 16 bp, Homo sapiens
cagatttttttgtaag

SEQ ID NO: 5858724 - DNA, 14 bp, Homo sapiens
cagcaaaaagcaaa

SEQ ID NO: 5858725 - DNA, 15 bp, Homo sapiens
cagcaaaaatataaa

SEQ ID NO: 5858726 - DNA, 19 bp, Homo sapiens
cagcaaaaccattgcttca

SEQ ID NO: 5858727 - DNA, 19 bp, Homo sapiens
cagcaaaatccaaactgct

SEQ ID NO: 5858728 - DNA, 21 bp, Homo sapiens
cagcaaaatccttacttccag

SEQ ID NO: 5858729 - DNA, 23 bp, Homo sapiens
cagcaaaatccttacttccagca

SEQ ID NO: 5858730 - DNA, 13 bp, Homo sapiens
cagcaaaatggaa

SEQ ID NO: 5858731 - DNA, 22 bp, Homo sapiens
cagcaaaatggaagcaaagaca

SEQ ID NO: 5858732 - DNA, 23 bp, Homo sapiens
cagcaaaatggaagcaaagacaa

SEQ ID NO: 5858733 - DNA, 15 bp, Homo sapiens
cagcaaaatgttgaa

SEQ ID NO: 5858734 - DNA, 15 bp, Homo sapiens
cagcaaacacaataa

SEQ ID NO: 5858735 - DNA, 16 bp, Homo sapiens
cagcaaacacaataag

SEQ ID NO: 5858736 - DNA, 15 bp, Homo sapiens
cagcaaacacagtca

SEQ ID NO: 5858737 - DNA, 14 bp, Homo sapiens
cagcaaacagctga

SEQ ID NO: 5858738 - DNA, 22 bp, Homo sapiens
cagcaaacccaaagatgttaac

SEQ ID NO: 5858739 - DNA, 21 bp, Homo sapiens
cagcaaacctaattgcacaac

SEQ ID NO: 5858740 - DNA, 21 bp, Homo sapiens
cagcaaagaggactcgcttgt

SEQ ID NO: 5858741 - DNA, 14 bp, Homo sapiens
cagcaaagaggggc

SEQ ID NO: 5858742 - DNA, 17 bp, Homo sapiens
cagcaaagaggggcgct

SEQ ID NO: 5858743 - DNA, 23 bp, Homo sapiens
cagcaaagaggggcgctgtcctg

SEQ ID NO: 5858744 - DNA, 19 bp, Homo sapiens
cagcaaagagtgggctgca

SEQ ID NO: 5858745 - DNA, 12 bp, Homo sapiens
cagcaaagccat

SEQ ID NO: 5858746 - DNA, 14 bp, Homo sapiens
cagcaaagccatat

SEQ ID NO: 5858747 - DNA, 22 bp, Homo sapiens
cagcaaagccccatgctggagc

SEQ ID NO: 5858748 - DNA, 13 bp, Homo sapiens
cagcaaagccccc

SEQ ID NO: 5858749 - DNA, 23 bp, Homo sapiens
cagcaaagcccccagagcccagg

SEQ ID NO: 5858750 - DNA, 17 bp, Homo sapiens
cagcaaagcctccagca

SEQ ID NO: 5858751 - DNA, 13 bp, Homo sapiens
cagcaaaggaaga

SEQ ID NO: 5858752 - DNA, 17 bp, Homo sapiens
cagcaaagtgtcagtgt

SEQ ID NO: 5858753 - DNA, 15 bp, Homo sapiens
cagcaaagttttcag

SEQ ID NO: 5858754 - DNA, 13 bp, Homo sapiens
cagcaaataaata

SEQ ID NO: 5858755 - DNA, 19 bp, Homo sapiens
cagcaaatagcaaatgaaa

SEQ ID NO: 5858756 - DNA, 14 bp, Homo sapiens
cagcaaatgccttt

SEQ ID NO: 5858757 - DNA, 16 bp, Homo sapiens
cagcaaatgccttttc

SEQ ID NO: 5858758 - DNA, 16 bp, Homo sapiens
cagcaaatgggcattt

SEQ ID NO: 5858759 - DNA, 22 bp, Homo sapiens
cagcaaattaattggcagcaga

SEQ ID NO: 5858760 - DNA, 23 bp, Homo sapiens
cagcaaattaattggcagcagat

SEQ ID NO: 5858761 - DNA, 17 bp, Homo sapiens
cagcaaatttataattt

SEQ ID NO: 5858762 - DNA, 13 bp, Homo sapiens
cagcaaattttca

SEQ ID NO: 5858763 - DNA, 15 bp, Homo sapiens
cagcaacaaagcata

SEQ ID NO: 5858764 - DNA, 12 bp, Homo sapiens
cagcaacaacaa

SEQ ID NO: 5858765 - DNA, 15 bp, Homo sapiens
cagcaacaagactgc

SEQ ID NO: 5858766 - DNA, 22 bp, Homo sapiens
cagcaacaagactgccaggtgg

SEQ ID NO: 5858767 - DNA, 14 bp, Homo sapiens
cagcaacaataaat

SEQ ID NO: 5858768 - DNA, 14 bp, Homo sapiens
cagcaacacagcct

SEQ ID NO: 5858769 - DNA, 16 bp, Homo sapiens
cagcaacacagcctgg

SEQ ID NO: 5858770 - DNA, 18 bp, Homo sapiens
cagcaacacagcctgggc

SEQ ID NO: 5858771 - DNA, 16 bp, Homo sapiens
cagcaacactccggtc

SEQ ID NO: 5858772 - DNA, 19 bp, Homo sapiens
cagcaacactccggtcagc

SEQ ID NO: 5858773 - DNA, 17 bp, Homo sapiens
cagcaacagcaagaaat

SEQ ID NO: 5858774 - DNA, 18 bp, Homo sapiens
cagcaacagcaagaaata

SEQ ID NO: 5858775 - DNA, 20 bp, Homo sapiens
cagcaacaggaatctcagag

SEQ ID NO: 5858776 - DNA, 22 bp, Homo sapiens
cagcaacaggaatctcagagac

SEQ ID NO: 5858777 - DNA, 18 bp, Homo sapiens
cagcaacaggaccaggag

SEQ ID NO: 5858778 - DNA, 14 bp, Homo sapiens
cagcaacattttct

SEQ ID NO: 5858779 - DNA, 22 bp, Homo sapiens
cagcaacattttcttgaatttt

SEQ ID NO: 5858780 - DNA, 14 bp, Homo sapiens
cagcaaccagagca

SEQ ID NO: 5858781 - DNA, 15 bp, Homo sapiens
cagcaaccagagcac

SEQ ID NO: 5858782 - DNA, 16 bp, Homo sapiens
cagcaaccagagcact

SEQ ID NO: 5858783 - DNA, 17 bp, Homo sapiens
cagcaaccagagcactg

SEQ ID NO: 5858784 - DNA, 19 bp, Homo sapiens
cagcaaccagagcactgta

SEQ ID NO: 5858785 - DNA, 21 bp, Homo sapiens
cagcaaccagagcactgtata

SEQ ID NO: 5858786 - DNA, 14 bp, Homo sapiens
cagcaaccctccta

SEQ ID NO: 5858787 - DNA, 13 bp, Homo sapiens
cagcaacctgtaa

SEQ ID NO: 5858788 - DNA, 16 bp, Homo sapiens
cagcaacgatcacaaa

SEQ ID NO: 5858789 - DNA, 20 bp, Homo sapiens
cagcaacgatcacaaatgac

SEQ ID NO: 5858790 - DNA, 22 bp, Homo sapiens
cagcaacgatcacaaatgactt

SEQ ID NO: 5858791 - DNA, 23 bp, Homo sapiens
cagcaacgatcacaaatgacttt

SEQ ID NO: 5858792 - DNA, 13 bp, Homo sapiens
cagcaacgcccct

SEQ ID NO: 5858793 - DNA, 16 bp, Homo sapiens
cagcaacgcccctcca

SEQ ID NO: 5858794 - DNA, 18 bp, Homo sapiens
cagcaacgcccctccaaa

SEQ ID NO: 5858795 - DNA, 18 bp, Homo sapiens
cagcaacgcttgtagaac

SEQ ID NO: 5858796 - DNA, 21 bp, Homo sapiens
cagcaactatcagactaagcc

SEQ ID NO: 5858797 - DNA, 14 bp, Homo sapiens
cagcaactccaact

SEQ ID NO: 5858798 - DNA, 13 bp, Homo sapiens
cagcaactcccac

SEQ ID NO: 5858799 - DNA, 13 bp, Homo sapiens
cagcaactgaaaa

SEQ ID NO: 5858800 - DNA, 16 bp, Homo sapiens
cagcaactgaaaatga

SEQ ID NO: 5858801 - DNA, 13 bp, Homo sapiens
cagcaactgaata

SEQ ID NO: 5858802 - DNA, 21 bp, Homo sapiens
cagcaactgaataaatacctc

SEQ ID NO: 5858803 - DNA, 17 bp, Homo sapiens
cagcaactgcccttcca

SEQ ID NO: 5858804 - DNA, 20 bp, Homo sapiens
cagcaacttcttctccatcc

SEQ ID NO: 5858805 - DNA, 22 bp, Homo sapiens
cagcaacttcttctccatccct

SEQ ID NO: 5858806 - DNA, 18 bp, Homo sapiens
cagcaacttgtctttttc

SEQ ID NO: 5858807 - DNA, 15 bp, Homo sapiens
cagcaactttccctt

SEQ ID NO: 5858808 - DNA, 23 bp, Homo sapiens
cagcaactttcccttgccctggg

SEQ ID NO: 5858809 - DNA, 19 bp, Homo sapiens
cagcaagaaaaaaaaatgc

SEQ ID NO: 5858810 - DNA, 22 bp, Homo sapiens
cagcaagaaaaaaaaatgccat

SEQ ID NO: 5858811 - DNA, 12 bp, Homo sapiens
cagcaagaaata

SEQ ID NO: 5858812 - DNA, 19 bp, Homo sapiens
cagcaagaagcagcctgtt

SEQ ID NO: 5858813 - DNA, 12 bp, Homo sapiens
cagcaagaagct

SEQ ID NO: 5858814 - DNA, 14 bp, Homo sapiens
cagcaagaataaaa

SEQ ID NO: 5858815 - DNA, 15 bp, Homo sapiens
cagcaagaatattgt

SEQ ID NO: 5858816 - DNA, 12 bp, Homo sapiens
cagcaagagaga

SEQ ID NO: 5858817 - DNA, 23 bp, Homo sapiens
cagcaagagggaacaaaactgtt

SEQ ID NO: 5858818 - DNA, 18 bp, Homo sapiens
cagcaagagtaagcagtg

SEQ ID NO: 5858819 - DNA, 19 bp, Homo sapiens
cagcaagagtaagcagtgt

SEQ ID NO: 5858820 - DNA, 13 bp, Homo sapiens
cagcaagatgttt

SEQ ID NO: 5858821 - DNA, 17 bp, Homo sapiens
cagcaagcaattctgcc

SEQ ID NO: 5858822 - DNA, 14 bp, Homo sapiens
cagcaagcagtgcc

SEQ ID NO: 5858823 - DNA, 21 bp, Homo sapiens
cagcaagccctacagagctgt

SEQ ID NO: 5858824 - DNA, 21 bp, Homo sapiens
cagcaagccggccccccctct

SEQ ID NO: 5858825 - DNA, 13 bp, Homo sapiens
cagcaagcctggc

SEQ ID NO: 5858826 - DNA, 19 bp, Homo sapiens
cagcaagctgcccagccct

SEQ ID NO: 5858827 - DNA, 22 bp, Homo sapiens
cagcaaggaaatgtcctgcatg

SEQ ID NO: 5858828 - DNA, 18 bp, Homo sapiens
cagcaaggagatttacaa

SEQ ID NO: 5858829 - DNA, 19 bp, Homo sapiens
cagcaaggaggctggctgg

SEQ ID NO: 5858830 - DNA, 20 bp, Homo sapiens
cagcaaggaggctggctggg

SEQ ID NO: 5858831 - DNA, 21 bp, Homo sapiens
cagcaaggaggctggctgggg

SEQ ID NO: 5858832 - DNA, 22 bp, Homo sapiens
cagcaaggaggctggctggggc

SEQ ID NO: 5858833 - DNA, 12 bp, Homo sapiens
cagcaaggcaga

SEQ ID NO: 5858834 - DNA, 13 bp, Homo sapiens
cagcaaggcaggt

SEQ ID NO: 5858835 - DNA, 15 bp, Homo sapiens
cagcaaggcagtgag

SEQ ID NO: 5858836 - DNA, 16 bp, Homo sapiens
cagcaaggcagtgagc

SEQ ID NO: 5858837 - DNA, 10 bp, Homo sapiens
cagcaaggcc

SEQ ID NO: 5858838 - DNA, 17 bp, Homo sapiens
cagcaaggccacctctt

SEQ ID NO: 5858839 - DNA, 19 bp, Homo sapiens
cagcaaggccacctcttcc

SEQ ID NO: 5858840 - DNA, 20 bp, Homo sapiens
cagcaaggccacctcttcct

SEQ ID NO: 5858841 - DNA, 15 bp, Homo sapiens
cagcaaggcccgagc

SEQ ID NO: 5858842 - DNA, 19 bp, Homo sapiens
cagcaaggcccgagcagct

SEQ ID NO: 5858843 - DNA, 21 bp, Homo sapiens
cagcaaggcccgagcagctga

SEQ ID NO: 5858844 - DNA, 12 bp, Homo sapiens
cagcaaggccct

SEQ ID NO: 5858845 - DNA, 22 bp, Homo sapiens
cagcaaggccttggtggagcag

SEQ ID NO: 5858846 - DNA, 20 bp, Homo sapiens
cagcaaggcgcctgccttgg

SEQ ID NO: 5858847 - DNA, 18 bp, Homo sapiens
cagcaaggcgctaacttg

SEQ ID NO: 5858848 - DNA, 12 bp, Homo sapiens
cagcaaggctgc

SEQ ID NO: 5858849 - DNA, 13 bp, Homo sapiens
cagcaagggacct

SEQ ID NO: 5858850 - DNA, 17 bp, Homo sapiens
cagcaagggacctgctc

SEQ ID NO: 5858851 - DNA, 12 bp, Homo sapiens
cagcaagggctt

SEQ ID NO: 5858852 - DNA, 12 bp, Homo sapiens
cagcaaggggct

SEQ ID NO: 5858853 - DNA, 14 bp, Homo sapiens
cagcaaggggctct

SEQ ID NO: 5858854 - DNA, 22 bp, Homo sapiens
cagcaagggtgatgggaaagca

SEQ ID NO: 5858855 - DNA, 23 bp, Homo sapiens
cagcaaggtattggtaggttact

SEQ ID NO: 5858856 - DNA, 16 bp, Homo sapiens
cagcaaggtcttgctc

SEQ ID NO: 5858857 - DNA, 15 bp, Homo sapiens
cagcaaggtggagtg

SEQ ID NO: 5858858 - DNA, 21 bp, Homo sapiens
cagcaaggtgtggaggctcct

SEQ ID NO: 5858859 - DNA, 23 bp, Homo sapiens
cagcaaggtgtggaggctcctgt

SEQ ID NO: 5858860 - DNA, 15 bp, Homo sapiens
cagcaagtacagaga

SEQ ID NO: 5858861 - DNA, 17 bp, Homo sapiens
cagcaagtacagcggct

SEQ ID NO: 5858862 - DNA, 19 bp, Homo sapiens
cagcaagtacagcggctcc

SEQ ID NO: 5858863 - DNA, 15 bp, Homo sapiens
cagcaagtcagggtt

SEQ ID NO: 5858864 - DNA, 13 bp, Homo sapiens
cagcaagtcccag

SEQ ID NO: 5858865 - DNA, 21 bp, Homo sapiens
cagcaagtcccagacaaggag

SEQ ID NO: 5858866 - DNA, 16 bp, Homo sapiens
cagcaagtgagagctg

SEQ ID NO: 5858867 - DNA, 19 bp, Homo sapiens
cagcaagtgagagctgggt

SEQ ID NO: 5858868 - DNA, 14 bp, Homo sapiens
cagcaagtgcccag

SEQ ID NO: 5858869 - DNA, 18 bp, Homo sapiens
cagcaagtgcccagtgga

SEQ ID NO: 5858870 - DNA, 20 bp, Homo sapiens
cagcaagtgtttgtgggaca

SEQ ID NO: 5858871 - DNA, 12 bp, Homo sapiens
cagcagcccccc

SEQ ID NO: 5858872 - DNA, 21 bp, Homo sapiens
cagcagccccccagcactaag

SEQ ID NO: 5858873 - DNA, 23 bp, Homo sapiens
cagcagcccctctttaacctcat

SEQ ID NO: 5858874 - DNA, 20 bp, Homo sapiens
cagcagcccctgagagcctg

SEQ ID NO: 5858875 - DNA, 16 bp, Homo sapiens
cagcagcccctgcaca

SEQ ID NO: 5858876 - DNA, 11 bp, Homo sapiens
cagcagcccta

SEQ ID NO: 5858877 - DNA, 20 bp, Homo sapiens
cagcagccctaaggatctct

SEQ ID NO: 5858878 - DNA, 20 bp, Homo sapiens
cagcagccctagcggctgct

SEQ ID NO: 5858879 - DNA, 22 bp, Homo sapiens
cagcagccctagcggctgctcc

SEQ ID NO: 5858880 - DNA, 21 bp, Homo sapiens
cagcagccctcaacaggccca

SEQ ID NO: 5858881 - DNA, 22 bp, Homo sapiens
cagcagccctcaacaggcccag

SEQ ID NO: 5858882 - DNA, 13 bp, Homo sapiens
cagcagccctcct

SEQ ID NO: 5858883 - DNA, 18 bp, Homo sapiens
cagcagcccttgtttata

SEQ ID NO: 5858884 - DNA, 21 bp, Homo sapiens
cagcagccgccttaagctgat

SEQ ID NO: 5858885 - DNA, 22 bp, Homo sapiens
cagcagccgccttaagctgatc

SEQ ID NO: 5858886 - DNA, 21 bp, Homo sapiens
cagcagccggaatagagcctc

SEQ ID NO: 5858887 - DNA, 12 bp, Homo sapiens
cagcagcctccc

SEQ ID NO: 5858888 - DNA, 24 bp, Homo sapiens
cagcagcctccctgtcactcagct

SEQ ID NO: 5858889 - DNA, 14 bp, Homo sapiens
cagcagcctcgcac

SEQ ID NO: 5858890 - DNA, 17 bp, Homo sapiens
cagcagcctcgcacagg

SEQ ID NO: 5858891 - DNA, 18 bp, Homo sapiens
cagcagcctcgcccctgg

SEQ ID NO: 5858892 - DNA, 19 bp, Homo sapiens
cagcagcctcgcccctggc

SEQ ID NO: 5858893 - DNA, 17 bp, Homo sapiens
cagcagcctctgatctg

SEQ ID NO: 5858894 - DNA, 22 bp, Homo sapiens
cagcagcctctgatctgtgcag

SEQ ID NO: 5858895 - DNA, 15 bp, Homo sapiens
cagcagcctgcacct

SEQ ID NO: 5858896 - DNA, 23 bp, Homo sapiens
cagcagcctgcacctgccccgtg

SEQ ID NO: 5858897 - DNA, 13 bp, Homo sapiens
cagcagcctgcca

SEQ ID NO: 5858898 - DNA, 20 bp, Homo sapiens
cagcagcctgcttcccacct

SEQ ID NO: 5858899 - DNA, 13 bp, Homo sapiens
cagcagcctgtga

SEQ ID NO: 5858900 - DNA, 17 bp, Homo sapiens
cagcagcctgtgaggga

SEQ ID NO: 5858901 - DNA, 20 bp, Homo sapiens
cagcagcctgtgagggagtg

SEQ ID NO: 5858902 - DNA, 11 bp, Homo sapiens
cagcagccttc

SEQ ID NO: 5858903 - DNA, 14 bp, Homo sapiens
cagcagccttccag

SEQ ID NO: 5858904 - DNA, 20 bp, Homo sapiens
cagcagcgaccacccctgcc

SEQ ID NO: 5858905 - DNA, 15 bp, Homo sapiens
cagcagcgcagccga

SEQ ID NO: 5858906 - DNA, 17 bp, Homo sapiens
cagcagcgcagccgagc

SEQ ID NO: 5858907 - DNA, 15 bp, Homo sapiens
cagcagcgcccgagg

SEQ ID NO: 5858908 - DNA, 17 bp, Homo sapiens
cagcagcgcctttccca

SEQ ID NO: 5858909 - DNA, 19 bp, Homo sapiens
cagcagcgcgcaggcctgc

SEQ ID NO: 5858910 - DNA, 22 bp, Homo sapiens
cagcagcgctcggcccggagca

SEQ ID NO: 5858911 - DNA, 18 bp, Homo sapiens
cagcagcggcagcagcag

SEQ ID NO: 5858912 - DNA, 19 bp, Homo sapiens
cagcagcggcagcagcagc

SEQ ID NO: 5858913 - DNA, 20 bp, Homo sapiens
cagcagcgggggcggcccag

SEQ ID NO: 5858914 - DNA, 18 bp, Homo sapiens
cagcagctagaaagagaa

SEQ ID NO: 5858915 - DNA, 17 bp, Homo sapiens
cagcagctaggactgag

SEQ ID NO: 5858916 - DNA, 22 bp, Homo sapiens
cagcagctaggactgaggagtg

SEQ ID NO: 5858917 - DNA, 18 bp, Homo sapiens
cagcagctcaacctaccc

SEQ ID NO: 5858918 - DNA, 19 bp, Homo sapiens
cagcagctcaacctaccct

SEQ ID NO: 5858919 - DNA, 11 bp, Homo sapiens
cagcagctcac

SEQ ID NO: 5858920 - DNA, 16 bp, Homo sapiens
cagcagctcagcctcc

SEQ ID NO: 5858921 - DNA, 16 bp, Homo sapiens
cagcagctcaggcaca

SEQ ID NO: 5858922 - DNA, 11 bp, Homo sapiens
cagcagctcca

SEQ ID NO: 5858923 - DNA, 14 bp, Homo sapiens
cagcagctccaacc

SEQ ID NO: 5858924 - DNA, 20 bp, Homo sapiens
cagcagctccaacctggagg

SEQ ID NO: 5858925 - DNA, 16 bp, Homo sapiens
cagcagctccgcctgg

SEQ ID NO: 5858926 - DNA, 19 bp, Homo sapiens
cagcagctccgcctggcac

SEQ ID NO: 5858927 - DNA, 12 bp, Homo sapiens
cagcagctctga

SEQ ID NO: 5858928 - DNA, 15 bp, Homo sapiens
cagcagctctggctc

SEQ ID NO: 5858929 - DNA, 18 bp, Homo sapiens
cagcagctgaagtctctt

SEQ ID NO: 5858930 - DNA, 20 bp, Homo sapiens
cagcagctgaggccccaggg

SEQ ID NO: 5858931 - DNA, 15 bp, Homo sapiens
cagcagctgatgctg

SEQ ID NO: 5858932 - DNA, 17 bp, Homo sapiens
cagcagctgatgctgta

SEQ ID NO: 5858933 - DNA, 19 bp, Homo sapiens
cagcagctgatgctgtact

SEQ ID NO: 5858934 - DNA, 14 bp, Homo sapiens
cagcagctgcaccc

SEQ ID NO: 5858935 - DNA, 23 bp, Homo sapiens
cagcagctgcgggtctgaaggaa

SEQ ID NO: 5858936 - DNA, 23 bp, Homo sapiens
cagcagctggtgccccacctgcc

SEQ ID NO: 5858937 - DNA, 15 bp, Homo sapiens
cagcagcttataatg

SEQ ID NO: 5858938 - DNA, 23 bp, Homo sapiens
cagcagcttataatgggctctcc

SEQ ID NO: 5858939 - DNA, 12 bp, Homo sapiens
cagcagcttcac

SEQ ID NO: 5858940 - DNA, 17 bp, Homo sapiens
cagcagcttcaccagag

SEQ ID NO: 5858941 - DNA, 15 bp, Homo sapiens
cagcagcttctccag

SEQ ID NO: 5858942 - DNA, 16 bp, Homo sapiens
cagcagcttctccagg

SEQ ID NO: 5858943 - DNA, 20 bp, Homo sapiens
cagcagcttggggagaggga

SEQ ID NO: 5858944 - DNA, 20 bp, Homo sapiens
cagcaggaagccaggctgag

SEQ ID NO: 5858945 - DNA, 15 bp, Homo sapiens
cagcaggaaggaccc

SEQ ID NO: 5858946 - DNA, 16 bp, Homo sapiens
cagcaggaaggacccc

SEQ ID NO: 5858947 - DNA, 20 bp, Homo sapiens
cagcaggaaggaccccacat

SEQ ID NO: 5858948 - DNA, 15 bp, Homo sapiens
cagcaggaagggtgg

SEQ ID NO: 5858949 - DNA, 16 bp, Homo sapiens
cagcaggaagggtggg

SEQ ID NO: 5858950 - DNA, 20 bp, Homo sapiens
cagcaggaagggtgggaagg

SEQ ID NO: 5858951 - DNA, 14 bp, Homo sapiens
cagcaggaataaag

SEQ ID NO: 5858952 - DNA, 14 bp, Homo sapiens
cagcaggactgtcc

SEQ ID NO: 5858953 - DNA, 22 bp, Homo sapiens
cagcaggacttgctaaagcact

SEQ ID NO: 5858954 - DNA, 20 bp, Homo sapiens
cagcaggagagactgagcag

SEQ ID NO: 5858955 - DNA, 21 bp, Homo sapiens
cagcaggagagactgagcagc

SEQ ID NO: 5858956 - DNA, 12 bp, Homo sapiens
cagcaggagagg

SEQ ID NO: 5858957 - DNA, 22 bp, Homo sapiens
cagcaggaggacagagtgccct

SEQ ID NO: 5858958 - DNA, 14 bp, Homo sapiens
cagcaggaggcaca

SEQ ID NO: 5858959 - DNA, 16 bp, Homo sapiens
cagcaggaggcacagc

SEQ ID NO: 5858960 - DNA, 14 bp, Homo sapiens
cagcaggaggccag

SEQ ID NO: 5858961 - DNA, 12 bp, Homo sapiens
cagcaggaggga

SEQ ID NO: 5858962 - DNA, 13 bp, Homo sapiens
cagcaggagggaa

SEQ ID NO: 5858963 - DNA, 16 bp, Homo sapiens
cagcaggagggaagga

SEQ ID NO: 5858964 - DNA, 15 bp, Homo sapiens
cagcaggagggacag

SEQ ID NO: 5858965 - DNA, 16 bp, Homo sapiens
cagcaggagggactct

SEQ ID NO: 5858966 - DNA, 15 bp, Homo sapiens
cagcaggagggattg

SEQ ID NO: 5858967 - DNA, 18 bp, Homo sapiens
cagcaggaggggggaggg

SEQ ID NO: 5858968 - DNA, 16 bp, Homo sapiens
cagcaggagtggtgca

SEQ ID NO: 5858969 - DNA, 21 bp, Homo sapiens
cagcaggagtggtgcagacag

SEQ ID NO: 5858970 - DNA, 18 bp, Homo sapiens
cagcaggatgggctgagc

SEQ ID NO: 5858971 - DNA, 20 bp, Homo sapiens
cagcaggatgggctgagcta

SEQ ID NO: 5858972 - DNA, 14 bp, Homo sapiens
cagcaggcagagga

SEQ ID NO: 5858973 - DNA, 12 bp, Homo sapiens
cagcaggcagcc

SEQ ID NO: 5858974 - DNA, 13 bp, Homo sapiens
cagcaggcagcct

SEQ ID NO: 5858975 - DNA, 19 bp, Homo sapiens
cagcaggcagccttggcgg

SEQ ID NO: 5858976 - DNA, 15 bp, Homo sapiens
cagcaggcagcgcca

SEQ ID NO: 5858977 - DNA, 15 bp, Homo sapiens
cagcaggcagcgcct

SEQ ID NO: 5858978 - DNA, 20 bp, Homo sapiens
cagcaggcagcgcctgtccc

SEQ ID NO: 5858979 - DNA, 12 bp, Homo sapiens
cagcaggcaggc

SEQ ID NO: 5858980 - DNA, 14 bp, Homo sapiens
cagcaggcaggctg

SEQ ID NO: 5858981 - DNA, 14 bp, Homo sapiens
cagcaggcaggtgg

SEQ ID NO: 5858982 - DNA, 15 bp, Homo sapiens
cagcaggcaggtgga

SEQ ID NO: 5858983 - DNA, 19 bp, Homo sapiens
cagcaggccaaacatggcc

SEQ ID NO: 5858984 - DNA, 12 bp, Homo sapiens
cagcaggccaga

SEQ ID NO: 5858985 - DNA, 16 bp, Homo sapiens
cagcaggccagagaaa

SEQ ID NO: 5858986 - DNA, 19 bp, Homo sapiens
cagcaggccagggactcag

SEQ ID NO: 5858987 - DNA, 23 bp, Homo sapiens
cagcaggccaggtccagagagac

SEQ ID NO: 5858988 - DNA, 18 bp, Homo sapiens
cagcaggccatcttttta

SEQ ID NO: 5858989 - DNA, 11 bp, Homo sapiens
cagcaggccca

SEQ ID NO: 5858990 - DNA, 14 bp, Homo sapiens
cagcaggcccacct

SEQ ID NO: 5858991 - DNA, 13 bp, Homo sapiens
cagcaggcccagg

SEQ ID NO: 5858992 - DNA, 16 bp, Homo sapiens
cagcaggcccaggaga

SEQ ID NO: 5858993 - DNA, 14 bp, Homo sapiens
cagcaggcccatgg

SEQ ID NO: 5858994 - DNA, 21 bp, Homo sapiens
cagcaggcccttcccattctg

SEQ ID NO: 5858995 - DNA, 11 bp, Homo sapiens
cagcaggcctc

SEQ ID NO: 5858996 - DNA, 14 bp, Homo sapiens
cagcaggcctctgg

SEQ ID NO: 5858997 - DNA, 15 bp, Homo sapiens
cagcaggcctctggg

SEQ ID NO: 5858998 - DNA, 13 bp, Homo sapiens
cagcaggcctgtt

SEQ ID NO: 5858999 - DNA, 21 bp, Homo sapiens
cagcaggcctgttgctttttt

SEQ ID NO: 5859000 - DNA, 23 bp, Homo sapiens
cagcaggcggcctttgttgctca

SEQ ID NO: 5859001 - DNA, 17 bp, Homo sapiens
cagcaggctagacagaa

SEQ ID NO: 5859002 - DNA, 11 bp, Homo sapiens
cagcaggctca

SEQ ID NO: 5859003 - DNA, 13 bp, Homo sapiens
cagcaggctcagg

SEQ ID NO: 5859004 - DNA, 16 bp, Homo sapiens
cagcaggctcaggcac

SEQ ID NO: 5859005 - DNA, 12 bp, Homo sapiens
cagcaggctcct

SEQ ID NO: 5859006 - DNA, 22 bp, Homo sapiens
cagcaggctcctcagccctctc

SEQ ID NO: 5859007 - DNA, 23 bp, Homo sapiens
cagcaggctcctcagccctctct

SEQ ID NO: 5859008 - DNA, 15 bp, Homo sapiens
cagcaggctcctggc

SEQ ID NO: 5859009 - DNA, 14 bp, Homo sapiens
cagcaggctctcag

SEQ ID NO: 5859010 - DNA, 18 bp, Homo sapiens
cagcaggctctcaggcca

SEQ ID NO: 5859011 - DNA, 19 bp, Homo sapiens
cagcaggctctcaggccag

SEQ ID NO: 5859012 - DNA, 20 bp, Homo sapiens
cagcaggctgccagtgcctg

SEQ ID NO: 5859013 - DNA, 14 bp, Homo sapiens
cagcaggctggcct

SEQ ID NO: 5859014 - DNA, 16 bp, Homo sapiens
cagcagggaaggccca

SEQ ID NO: 5859015 - DNA, 19 bp, Homo sapiens
cagcagggacaagatacat

SEQ ID NO: 5859016 - DNA, 23 bp, Homo sapiens
cagcagggaccgggcgcagccct

SEQ ID NO: 5859017 - DNA, 21 bp, Homo sapiens
cagcagggactgtaaacacag

SEQ ID NO: 5859018 - DNA, 15 bp, Homo sapiens
cagcagggatgccct

SEQ ID NO: 5859019 - DNA, 18 bp, Homo sapiens
cagcagggatgccctgga

SEQ ID NO: 5859020 - DNA, 11 bp, Homo sapiens
cagcagggcag

SEQ ID NO: 5859021 - DNA, 18 bp, Homo sapiens
cagcagggcaggaagggg

SEQ ID NO: 5859022 - DNA, 15 bp, Homo sapiens
cagcagggcagtagc

SEQ ID NO: 5859023 - DNA, 15 bp, Homo sapiens
cagcagggccttctg

SEQ ID NO: 5859024 - DNA, 23 bp, Homo sapiens
cagcagggccttctgcctgctga

SEQ ID NO: 5859025 - DNA, 19 bp, Homo sapiens
cagcagggctaccctgagc

SEQ ID NO: 5859026 - DNA, 21 bp, Homo sapiens
cagcagggctaccctgagctg

SEQ ID NO: 5859027 - DNA, 11 bp, Homo sapiens
cagcagggctg

SEQ ID NO: 5859028 - DNA, 15 bp, Homo sapiens
cagcagggctgggcc

SEQ ID NO: 5859029 - DNA, 18 bp, Homo sapiens
cagcagggctgggcctgc

SEQ ID NO: 5859030 - DNA, 21 bp, Homo sapiens
cagcaggggaaagattatatt

SEQ ID NO: 5859031 - DNA, 12 bp, Homo sapiens
cagcaggggagc

SEQ ID NO: 5859032 - DNA, 13 bp, Homo sapiens
cagcaggggatgg

SEQ ID NO: 5859033 - DNA, 16 bp, Homo sapiens
cagcaggggcagaagg

SEQ ID NO: 5859034 - DNA, 16 bp, Homo sapiens
cagcaggggccaagca

SEQ ID NO: 5859035 - DNA, 17 bp, Homo sapiens
cagcaggggccctcact

SEQ ID NO: 5859036 - DNA, 19 bp, Homo sapiens
cagcaggggccctcactct

SEQ ID NO: 5859037 - DNA, 20 bp, Homo sapiens
cagcaggggccctcactctt

SEQ ID NO: 5859038 - DNA, 22 bp, Homo sapiens
cagcaggggctgcccgagtctg

SEQ ID NO: 5859039 - DNA, 16 bp, Homo sapiens
cagcaggggctggccc

SEQ ID NO: 5859040 - DNA, 15 bp, Homo sapiens
cagcaggggggctgt

SEQ ID NO: 5859041 - DNA, 14 bp, Homo sapiens
cagcaggggtgtga

SEQ ID NO: 5859042 - DNA, 18 bp, Homo sapiens
cagcagggtcttttcatc

SEQ ID NO: 5859043 - DNA, 23 bp, Homo sapiens
cagcagggtttgagcacaatctg

SEQ ID NO: 5859044 - DNA, 18 bp, Homo sapiens
cagcaggtagcctgctgg

SEQ ID NO: 5859045 - DNA, 19 bp, Homo sapiens
cagcaggtagcctgctggt

SEQ ID NO: 5859046 - DNA, 18 bp, Homo sapiens
cagcaggtaggggcacag

SEQ ID NO: 5859047 - DNA, 15 bp, Homo sapiens
cagcaggtcacactg

SEQ ID NO: 5859048 - DNA, 18 bp, Homo sapiens
cagcaggtgattggacca

SEQ ID NO: 5859049 - DNA, 20 bp, Homo sapiens
cagcaggtgattggaccagg

SEQ ID NO: 5859050 - DNA, 21 bp, Homo sapiens
cagccacccgtggggtgctgc

SEQ ID NO: 5859051 - DNA, 19 bp, Homo sapiens
cagccaccctaactgagct

SEQ ID NO: 5859052 - DNA, 20 bp, Homo sapiens
cagccaccctaactgagctg

SEQ ID NO: 5859053 - DNA, 20 bp, Homo sapiens
cagccaccctcaccgcggct

SEQ ID NO: 5859054 - DNA, 12 bp, Homo sapiens
cagccaccctga

SEQ ID NO: 5859055 - DNA, 18 bp, Homo sapiens
cagccaccctgaggagtc

SEQ ID NO: 5859056 - DNA, 21 bp, Homo sapiens
cagccacccttggtctcatgc

SEQ ID NO: 5859057 - DNA, 21 bp, Homo sapiens
cagccaccctttctggcacga

SEQ ID NO: 5859058 - DNA, 16 bp, Homo sapiens
cagccaccgtttcttc

SEQ ID NO: 5859059 - DNA, 17 bp, Homo sapiens
cagccaccgtttcttcc

SEQ ID NO: 5859060 - DNA, 17 bp, Homo sapiens
cagccacctaaaaacat

SEQ ID NO: 5859061 - DNA, 10 bp, Homo sapiens
cagccacctc

SEQ ID NO: 5859062 - DNA, 13 bp, Homo sapiens
cagccacctccca

SEQ ID NO: 5859063 - DNA, 17 bp, Homo sapiens
cagccacctccctctgc

SEQ ID NO: 5859064 - DNA, 20 bp, Homo sapiens
cagccacctccgccagaccc

SEQ ID NO: 5859065 - DNA, 13 bp, Homo sapiens
cagccacctggga

SEQ ID NO: 5859066 - DNA, 22 bp, Homo sapiens
cagccacctgggaacacagttc

SEQ ID NO: 5859067 - DNA, 17 bp, Homo sapiens
cagccaccttcctgact

SEQ ID NO: 5859068 - DNA, 19 bp, Homo sapiens
cagccaccttcctgactgg

SEQ ID NO: 5859069 - DNA, 21 bp, Homo sapiens
cagccaccttcctgactggga

SEQ ID NO: 5859070 - DNA, 23 bp, Homo sapiens
cagccaccttcctgactgggaag

SEQ ID NO: 5859071 - DNA, 17 bp, Homo sapiens
cagccacgaacagcccg

SEQ ID NO: 5859072 - DNA, 15 bp, Homo sapiens
cagccacgaccagcc

SEQ ID NO: 5859073 - DNA, 17 bp, Homo sapiens
cagccacgaccagcccc

SEQ ID NO: 5859074 - DNA, 16 bp, Homo sapiens
cagccacgactgccat

SEQ ID NO: 5859075 - DNA, 16 bp, Homo sapiens
cagccacgattggaga

SEQ ID NO: 5859076 - DNA, 12 bp, Homo sapiens
cagccacgcagg

SEQ ID NO: 5859077 - DNA, 15 bp, Homo sapiens
cagccacgcagggcc

SEQ ID NO: 5859078 - DNA, 21 bp, Homo sapiens
cagccacgcagggccatccac

SEQ ID NO: 5859079 - DNA, 17 bp, Homo sapiens
cagccacgcctctctca

SEQ ID NO: 5859080 - DNA, 18 bp, Homo sapiens
cagccacgcctctctcag

SEQ ID NO: 5859081 - DNA, 20 bp, Homo sapiens
cagccacggacgctggctcc

SEQ ID NO: 5859082 - DNA, 21 bp, Homo sapiens
cagccacggagggaggcacca

SEQ ID NO: 5859083 - DNA, 21 bp, Homo sapiens
cagccacggccaggccagagg

SEQ ID NO: 5859084 - DNA, 23 bp, Homo sapiens
cagccacggccaggccagaggga

SEQ ID NO: 5859085 - DNA, 21 bp, Homo sapiens
cagccacggccccgggtccag

SEQ ID NO: 5859086 - DNA, 15 bp, Homo sapiens
cagccactaagaacc

SEQ ID NO: 5859087 - DNA, 14 bp, Homo sapiens
cagccactcagaaa

SEQ ID NO: 5859088 - DNA, 16 bp, Homo sapiens
cagccactccaagccc

SEQ ID NO: 5859089 - DNA, 15 bp, Homo sapiens
cagccactgcacagg

SEQ ID NO: 5859090 - DNA, 21 bp, Homo sapiens
cagccactgccaagcttcctg

SEQ ID NO: 5859091 - DNA, 15 bp, Homo sapiens
cagccactgtcacag

SEQ ID NO: 5859092 - DNA, 17 bp, Homo sapiens
cagccactgtcacaggc

SEQ ID NO: 5859093 - DNA, 18 bp, Homo sapiens
cagccactgtcacaggca

SEQ ID NO: 5859094 - DNA, 15 bp, Homo sapiens
cagccacttggcctc

SEQ ID NO: 5859095 - DNA, 13 bp, Homo sapiens
cagccacttggtt

SEQ ID NO: 5859096 - DNA, 20 bp, Homo sapiens
cagccacttttagctactgc

SEQ ID NO: 5859097 - DNA, 17 bp, Homo sapiens
cagccagaaccccgagc

SEQ ID NO: 5859098 - DNA, 16 bp, Homo sapiens
cagccagaactctgtg

SEQ ID NO: 5859099 - DNA, 23 bp, Homo sapiens
cagccagaagccacccaaagcag

SEQ ID NO: 5859100 - DNA, 20 bp, Homo sapiens
cagccagaaggggctgcttg

SEQ ID NO: 5859101 - DNA, 18 bp, Homo sapiens
cagccagaccccacgctg

SEQ ID NO: 5859102 - DNA, 22 bp, Homo sapiens
cagccagaccccacgctgacca

SEQ ID NO: 5859103 - DNA, 18 bp, Homo sapiens
cagccagactggcacagt

SEQ ID NO: 5859104 - DNA, 20 bp, Homo sapiens
cagccagactggcacagttt

SEQ ID NO: 5859105 - DNA, 18 bp, Homo sapiens
cagccagacttgcttcct

SEQ ID NO: 5859106 - DNA, 14 bp, Homo sapiens
cagccagagctggg

SEQ ID NO: 5859107 - DNA, 13 bp, Homo sapiens
cagccagagctgt

SEQ ID NO: 5859108 - DNA, 23 bp, Homo sapiens
cagccagagctgtgcctgctcag

SEQ ID NO: 5859109 - DNA, 17 bp, Homo sapiens
cagccagaggagggcag

SEQ ID NO: 5859110 - DNA, 19 bp, Homo sapiens
cagccagaggagggcagag

SEQ ID NO: 5859111 - DNA, 14 bp, Homo sapiens
cagccagaggtgga

SEQ ID NO: 5859112 - DNA, 22 bp, Homo sapiens
cagccagaggtggagccaagtg

SEQ ID NO: 5859113 - DNA, 18 bp, Homo sapiens
cagccagagtttgcctcc

SEQ ID NO: 5859114 - DNA, 20 bp, Homo sapiens
cagccagagtttgcctccct

SEQ ID NO: 5859115 - DNA, 18 bp, Homo sapiens
cagccagatccccagggc

SEQ ID NO: 5859116 - DNA, 17 bp, Homo sapiens
cagccagatcctcttgg

SEQ ID NO: 5859117 - DNA, 20 bp, Homo sapiens
cagccagcaatgatgtccag

SEQ ID NO: 5859118 - DNA, 12 bp, Homo sapiens
cagccagcacct

SEQ ID NO: 5859119 - DNA, 14 bp, Homo sapiens
cagccagcacctgg

SEQ ID NO: 5859120 - DNA, 14 bp, Homo sapiens
cagccagcagaggg

SEQ ID NO: 5859121 - DNA, 19 bp, Homo sapiens
cagccagcagcagcaacct

SEQ ID NO: 5859122 - DNA, 12 bp, Homo sapiens
cagccagcaggt

SEQ ID NO: 5859123 - DNA, 20 bp, Homo sapiens
cagccagcaggttctctcct

SEQ ID NO: 5859124 - DNA, 22 bp, Homo sapiens
cagccagcagttcagagctgcc

SEQ ID NO: 5859125 - DNA, 14 bp, Homo sapiens
cagccagcatctgg

SEQ ID NO: 5859126 - DNA, 15 bp, Homo sapiens
cagccagcatctggg

SEQ ID NO: 5859127 - DNA, 16 bp, Homo sapiens
cagccagcatctgggc

SEQ ID NO: 5859128 - DNA, 14 bp, Homo sapiens
cagccagccacccc

SEQ ID NO: 5859129 - DNA, 12 bp, Homo sapiens
cagccagccact

SEQ ID NO: 5859130 - DNA, 14 bp, Homo sapiens
cagccagccactct

SEQ ID NO: 5859131 - DNA, 16 bp, Homo sapiens
cagccagccactctac

SEQ ID NO: 5859132 - DNA, 22 bp, Homo sapiens
cagccagccaggaactggctcc

SEQ ID NO: 5859133 - DNA, 20 bp, Homo sapiens
cagccagcccaaaccttggg

SEQ ID NO: 5859134 - DNA, 13 bp, Homo sapiens
cagccagcccagc

SEQ ID NO: 5859135 - DNA, 15 bp, Homo sapiens
cagccagcccagccc

SEQ ID NO: 5859136 - DNA, 14 bp, Homo sapiens
cagccagcccagct

SEQ ID NO: 5859137 - DNA, 12 bp, Homo sapiens
cagccagccctg

SEQ ID NO: 5859138 - DNA, 19 bp, Homo sapiens
cagccagccctgcctggag

SEQ ID NO: 5859139 - DNA, 15 bp, Homo sapiens
cagccagccctggag

SEQ ID NO: 5859140 - DNA, 16 bp, Homo sapiens
cagccagccctggagg

SEQ ID NO: 5859141 - DNA, 15 bp, Homo sapiens
cagccagccctggcc

SEQ ID NO: 5859142 - DNA, 16 bp, Homo sapiens
cagccagccctggccc

SEQ ID NO: 5859143 - DNA, 15 bp, Homo sapiens
cagccagcccttccc

SEQ ID NO: 5859144 - DNA, 16 bp, Homo sapiens
cagccagccgccctgg

SEQ ID NO: 5859145 - DNA, 23 bp, Homo sapiens
cagccagcctcgcccatcccctt

SEQ ID NO: 5859146 - DNA, 14 bp, Homo sapiens
cagccagccttccc

SEQ ID NO: 5859147 - DNA, 17 bp, Homo sapiens
cagccagcgcctccctc

SEQ ID NO: 5859148 - DNA, 20 bp, Homo sapiens
cagccagcgcctccctccac

SEQ ID NO: 5859149 - DNA, 23 bp, Homo sapiens
cagccagcgcctccctccacccc

SEQ ID NO: 5859150 - DNA, 12 bp, Homo sapiens
cagccagcggca

SEQ ID NO: 5859151 - DNA, 17 bp, Homo sapiens
cagccagctcctgggca

SEQ ID NO: 5859152 - DNA, 16 bp, Homo sapiens
cagccagctcctttcc

SEQ ID NO: 5859153 - DNA, 18 bp, Homo sapiens
cagccagctctcagccaa

SEQ ID NO: 5859154 - DNA, 21 bp, Homo sapiens
cagccagctctcagccaacga

SEQ ID NO: 5859155 - DNA, 17 bp, Homo sapiens
cagccagctgcagggca

SEQ ID NO: 5859156 - DNA, 18 bp, Homo sapiens
cagccagctgcagggcac

SEQ ID NO: 5859157 - DNA, 19 bp, Homo sapiens
cagccagctgcagggcacg

SEQ ID NO: 5859158 - DNA, 12 bp, Homo sapiens
cagccagctgcc

SEQ ID NO: 5859159 - DNA, 16 bp, Homo sapiens
cagccagctgcccaca

SEQ ID NO: 5859160 - DNA, 15 bp, Homo sapiens
cagccagcttggtgg

SEQ ID NO: 5859161 - DNA, 19 bp, Homo sapiens
cagccaggaactggctcct

SEQ ID NO: 5859162 - DNA, 16 bp, Homo sapiens
cagccaggacaccggg

SEQ ID NO: 5859163 - DNA, 19 bp, Homo sapiens
cagccaggacccgcctgct

SEQ ID NO: 5859164 - DNA, 11 bp, Homo sapiens
cagccaggagc

SEQ ID NO: 5859165 - DNA, 13 bp, Homo sapiens
cagccaggagcag

SEQ ID NO: 5859166 - DNA, 14 bp, Homo sapiens
cagccaggagcaga

SEQ ID NO: 5859167 - DNA, 20 bp, Homo sapiens
cagccaggaggggctgtcca

SEQ ID NO: 5859168 - DNA, 23 bp, Homo sapiens
cagccaggccaacagcacctccc

SEQ ID NO: 5859169 - DNA, 21 bp, Homo sapiens
cagccaggcccagccgacccc

SEQ ID NO: 5859170 - DNA, 17 bp, Homo sapiens
cagccaggcccaggcca

SEQ ID NO: 5859171 - DNA, 15 bp, Homo sapiens
cagccaggccccagg

SEQ ID NO: 5859172 - DNA, 12 bp, Homo sapiens
cagccaggccct

SEQ ID NO: 5859173 - DNA, 15 bp, Homo sapiens
cagccaggccctgcc

SEQ ID NO: 5859174 - DNA, 15 bp, Homo sapiens
cagccaggcctcgcc

SEQ ID NO: 5859175 - DNA, 17 bp, Homo sapiens
cagccaggcctcgcctg

SEQ ID NO: 5859176 - DNA, 19 bp, Homo sapiens
cagccaggcctcgcctgcc

SEQ ID NO: 5859177 - DNA, 21 bp, Homo sapiens
cagccaggcctcgcctgccct

SEQ ID NO: 5859178 - DNA, 13 bp, Homo sapiens
cagccaggcgggc

SEQ ID NO: 5859179 - DNA, 15 bp, Homo sapiens
cagccaggcgggctc

SEQ ID NO: 5859180 - DNA, 16 bp, Homo sapiens
cagccaggcgggctca

SEQ ID NO: 5859181 - DNA, 11 bp, Homo sapiens
cagccaggcta

SEQ ID NO: 5859182 - DNA, 22 bp, Homo sapiens
cagccaggctatggttgccacc

SEQ ID NO: 5859183 - DNA, 12 bp, Homo sapiens
cagccaggctcc

SEQ ID NO: 5859184 - DNA, 21 bp, Homo sapiens
cagccaggctcctacctgtct

SEQ ID NO: 5859185 - DNA, 14 bp, Homo sapiens
cagccaggctctgt

SEQ ID NO: 5859186 - DNA, 18 bp, Homo sapiens
cagccaggctctgtgctg

SEQ ID NO: 5859187 - DNA, 13 bp, Homo sapiens
cagccaggctgcc

SEQ ID NO: 5859188 - DNA, 15 bp, Homo sapiens
cagccaggctgggcc

SEQ ID NO: 5859189 - DNA, 17 bp, Homo sapiens
cagccaggctgggccgc

SEQ ID NO: 5859190 - DNA, 18 bp, Homo sapiens
cagccagggacccccaga

SEQ ID NO: 5859191 - DNA, 16 bp, Homo sapiens
cagccagggagagccc

SEQ ID NO: 5859192 - DNA, 21 bp, Homo sapiens
cagccagggagagcccaggag

SEQ ID NO: 5859193 - DNA, 22 bp, Homo sapiens
cagccagggagagcccaggagc

SEQ ID NO: 5859194 - DNA, 16 bp, Homo sapiens
cagccagggagcccgg

SEQ ID NO: 5859195 - DNA, 16 bp, Homo sapiens
cagccagggagcttgc

SEQ ID NO: 5859196 - DNA, 17 bp, Homo sapiens
cagccagggagcttgcc

SEQ ID NO: 5859197 - DNA, 18 bp, Homo sapiens
cagccagggagcttgcca

SEQ ID NO: 5859198 - DNA, 22 bp, Homo sapiens
cagccagggagcttgccacact

SEQ ID NO: 5859199 - DNA, 17 bp, Homo sapiens
cagccagggcaagagag

SEQ ID NO: 5859200 - DNA, 14 bp, Homo sapiens
cagccagggcaggg

SEQ ID NO: 5859201 - DNA, 11 bp, Homo sapiens
cagccagggct

SEQ ID NO: 5859202 - DNA, 12 bp, Homo sapiens
cagccagggctg

SEQ ID NO: 5859203 - DNA, 15 bp, Homo sapiens
cagccagggctgcta

SEQ ID NO: 5859204 - DNA, 23 bp, Homo sapiens
cagccagggctgctagacggagg

SEQ ID NO: 5859205 - DNA, 12 bp, Homo sapiens
cagccaggggct

SEQ ID NO: 5859206 - DNA, 13 bp, Homo sapiens
cagccaggggctg

SEQ ID NO: 5859207 - DNA, 14 bp, Homo sapiens
cagccaggggctgc

SEQ ID NO: 5859208 - DNA, 15 bp, Homo sapiens
cagccaggggctgct

SEQ ID NO: 5859209 - DNA, 20 bp, Homo sapiens
cagccaggggctgctcatca

SEQ ID NO: 5859210 - DNA, 12 bp, Homo sapiens
cagccagggtgt

SEQ ID NO: 5859211 - DNA, 19 bp, Homo sapiens
cagccaggtctgactccaa

SEQ ID NO: 5859212 - DNA, 13 bp, Homo sapiens
cagccaggtgcct

SEQ ID NO: 5859213 - DNA, 15 bp, Homo sapiens
cagccaggtggcacc

SEQ ID NO: 5859214 - DNA, 16 bp, Homo sapiens
cagccagtaaggcagc

SEQ ID NO: 5859215 - DNA, 20 bp, Homo sapiens
cagccagtaaggcagctctg

SEQ ID NO: 5859216 - DNA, 16 bp, Homo sapiens
cagccagtagcctaaa

SEQ ID NO: 5859217 - DNA, 12 bp, Homo sapiens
cagccagtctca

SEQ ID NO: 5859218 - DNA, 15 bp, Homo sapiens
cagccagtctcagag

SEQ ID NO: 5859219 - DNA, 17 bp, Homo sapiens
cagccagtctcagagac

SEQ ID NO: 5859220 - DNA, 23 bp, Homo sapiens
cagccagtctcagagaccagcac

SEQ ID NO: 5859221 - DNA, 15 bp, Homo sapiens
cagccagtcttgcct

SEQ ID NO: 5859222 - DNA, 18 bp, Homo sapiens
cagccagtcttgcctagg

SEQ ID NO: 5859223 - DNA, 20 bp, Homo sapiens
cagccagtgacctgaggaag

SEQ ID NO: 5859224 - DNA, 16 bp, Homo sapiens
cagccagtgacctttg

SEQ ID NO: 5859225 - DNA, 24 bp, Homo sapiens
cagccagtgccattccactccact

SEQ ID NO: 5859226 - DNA, 19 bp, Homo sapiens
cagccagtgccctgagcca

SEQ ID NO: 5859227 - DNA, 16 bp, Homo sapiens
cagccagtggcacagg

SEQ ID NO: 5859228 - DNA, 15 bp, Homo sapiens
cagccagttcaaaaa

SEQ ID NO: 5859229 - DNA, 18 bp, Homo sapiens
cagcccctggagcctcag

SEQ ID NO: 5859230 - DNA, 12 bp, Homo sapiens
cagcccctggat

SEQ ID NO: 5859231 - DNA, 17 bp, Homo sapiens
cagcccctggatgcagc

SEQ ID NO: 5859232 - DNA, 21 bp, Homo sapiens
cagcccctggatgcagcctca

SEQ ID NO: 5859233 - DNA, 23 bp, Homo sapiens
cagcccctggatgcagcctcaca

SEQ ID NO: 5859234 - DNA, 15 bp, Homo sapiens
cagcccctggcactg

SEQ ID NO: 5859235 - DNA, 17 bp, Homo sapiens
cagcccctggcactgca

SEQ ID NO: 5859236 - DNA, 19 bp, Homo sapiens
cagcccctggcactgcagg

SEQ ID NO: 5859237 - DNA, 13 bp, Homo sapiens
cagcccctgggaa

SEQ ID NO: 5859238 - DNA, 16 bp, Homo sapiens
cagcccctgggaacag

SEQ ID NO: 5859239 - DNA, 20 bp, Homo sapiens
cagcccctgggaacaggccc

SEQ ID NO: 5859240 - DNA, 20 bp, Homo sapiens
cagcccctgggcccttgtgc

SEQ ID NO: 5859241 - DNA, 12 bp, Homo sapiens
cagcccctgggg

SEQ ID NO: 5859242 - DNA, 22 bp, Homo sapiens
cagcccctggggcccagcccct

SEQ ID NO: 5859243 - DNA, 22 bp, Homo sapiens
cagcccctggggtacttctgtg

SEQ ID NO: 5859244 - DNA, 20 bp, Homo sapiens
cagcccctgtatggcactgg

SEQ ID NO: 5859245 - DNA, 23 bp, Homo sapiens
cagccccttaagcatgcttctat

SEQ ID NO: 5859246 - DNA, 15 bp, Homo sapiens
cagccccttaaggga

SEQ ID NO: 5859247 - DNA, 17 bp, Homo sapiens
cagccccttcccggtcc

SEQ ID NO: 5859248 - DNA, 16 bp, Homo sapiens
cagccccttcctgggt

SEQ ID NO: 5859249 - DNA, 22 bp, Homo sapiens
cagccccttctcagaatctacc

SEQ ID NO: 5859250 - DNA, 16 bp, Homo sapiens
cagccccttctcccag

SEQ ID NO: 5859251 - DNA, 18 bp, Homo sapiens
cagccccttctcccagca

SEQ ID NO: 5859252 - DNA, 21 bp, Homo sapiens
cagccccttctcccagcacac

SEQ ID NO: 5859253 - DNA, 16 bp, Homo sapiens
cagccccttctgaccc

SEQ ID NO: 5859254 - DNA, 21 bp, Homo sapiens
cagccccttctgacccatgct

SEQ ID NO: 5859255 - DNA, 15 bp, Homo sapiens
cagccccttctggcc

SEQ ID NO: 5859256 - DNA, 16 bp, Homo sapiens
cagccccttctggccg

SEQ ID NO: 5859257 - DNA, 19 bp, Homo sapiens
cagccccttctggccggtg

SEQ ID NO: 5859258 - DNA, 21 bp, Homo sapiens
cagccccttctggccggtgct

SEQ ID NO: 5859259 - DNA, 22 bp, Homo sapiens
cagccccttctggccggtgctg

SEQ ID NO: 5859260 - DNA, 16 bp, Homo sapiens
cagccccttgctctca

SEQ ID NO: 5859261 - DNA, 22 bp, Homo sapiens
cagccccttgcttctaagggat

SEQ ID NO: 5859262 - DNA, 15 bp, Homo sapiens
cagcccctttccaaa

SEQ ID NO: 5859263 - DNA, 17 bp, Homo sapiens
cagcccctttgcctctg

SEQ ID NO: 5859264 - DNA, 19 bp, Homo sapiens
cagcccctttgcctctgtc

SEQ ID NO: 5859265 - DNA, 22 bp, Homo sapiens
cagcccctttgcctctgtcctc

SEQ ID NO: 5859266 - DNA, 13 bp, Homo sapiens
cagccccttttct

SEQ ID NO: 5859267 - DNA, 19 bp, Homo sapiens
cagccccttttctctgctc

SEQ ID NO: 5859268 - DNA, 15 bp, Homo sapiens
cagcccgaagcccag

SEQ ID NO: 5859269 - DNA, 21 bp, Homo sapiens
cagcccgacagtgccatcccc

SEQ ID NO: 5859270 - DNA, 14 bp, Homo sapiens
cagcccgagcccct

SEQ ID NO: 5859271 - DNA, 15 bp, Homo sapiens
cagcccgatgtccct

SEQ ID NO: 5859272 - DNA, 17 bp, Homo sapiens
cagcccgatgtccctgt

SEQ ID NO: 5859273 - DNA, 16 bp, Homo sapiens
cagcccgcaactctcc

SEQ ID NO: 5859274 - DNA, 19 bp, Homo sapiens
cagcccgcatgcagcagct

SEQ ID NO: 5859275 - DNA, 14 bp, Homo sapiens
cagcccgcctgccg

SEQ ID NO: 5859276 - DNA, 22 bp, Homo sapiens
cagcccgcctgccgtgcatggc

SEQ ID NO: 5859277 - DNA, 19 bp, Homo sapiens
cagcccgctaggctcgcct

SEQ ID NO: 5859278 - DNA, 15 bp, Homo sapiens
cagcccgctctctgg

SEQ ID NO: 5859279 - DNA, 21 bp, Homo sapiens
cagcccgctctctggctgtct

SEQ ID NO: 5859280 - DNA, 15 bp, Homo sapiens
cagcccgctgagtgg

SEQ ID NO: 5859281 - DNA, 17 bp, Homo sapiens
cagcccgctgagtggac

SEQ ID NO: 5859282 - DNA, 14 bp, Homo sapiens
cagcccggacctct

SEQ ID NO: 5859283 - DNA, 16 bp, Homo sapiens
cagcccggacctctgg

SEQ ID NO: 5859284 - DNA, 15 bp, Homo sapiens
cagcccggaccttgg

SEQ ID NO: 5859285 - DNA, 12 bp, Homo sapiens
cagcccggcctg

SEQ ID NO: 5859286 - DNA, 14 bp, Homo sapiens
cagcccggcctgct

SEQ ID NO: 5859287 - DNA, 23 bp, Homo sapiens
cagcccggcctgctcccagcagc

SEQ ID NO: 5859288 - DNA, 19 bp, Homo sapiens
cagcccggctcggcccagc

SEQ ID NO: 5859289 - DNA, 20 bp, Homo sapiens
cagcccggctcggcccagca

SEQ ID NO: 5859290 - DNA, 15 bp, Homo sapiens
cagcccggctgctgc

SEQ ID NO: 5859291 - DNA, 19 bp, Homo sapiens
cagcccggctgctgcttgg

SEQ ID NO: 5859292 - DNA, 22 bp, Homo sapiens
cagcccgggagctttgagacag

SEQ ID NO: 5859293 - DNA, 15 bp, Homo sapiens
cagcccgggatcctg

SEQ ID NO: 5859294 - DNA, 13 bp, Homo sapiens
cagcccgggctct

SEQ ID NO: 5859295 - DNA, 20 bp, Homo sapiens
cagcccgggctctgcctccc

SEQ ID NO: 5859296 - DNA, 20 bp, Homo sapiens
cagcccggggccagcttggc

SEQ ID NO: 5859297 - DNA, 15 bp, Homo sapiens
cagcccggtgtgagg

SEQ ID NO: 5859298 - DNA, 17 bp, Homo sapiens
cagcccggtgtgaggag

SEQ ID NO: 5859299 - DNA, 18 bp, Homo sapiens
cagcccgtgaagcagtgc

SEQ ID NO: 5859300 - DNA, 20 bp, Homo sapiens
cagcccgtgaagcagtgcct

SEQ ID NO: 5859301 - DNA, 21 bp, Homo sapiens
cagcccgtgaagcagtgcctc

SEQ ID NO: 5859302 - DNA, 17 bp, Homo sapiens
cagcccgtgtccaggag

SEQ ID NO: 5859303 - DNA, 18 bp, Homo sapiens
cagcccgtgtggcccctt

SEQ ID NO: 5859304 - DNA, 21 bp, Homo sapiens
cagcccgtgtggccccttcac

SEQ ID NO: 5859305 - DNA, 21 bp, Homo sapiens
cagccctaaggatctctcagg

SEQ ID NO: 5859306 - DNA, 16 bp, Homo sapiens
cagccctacatcttca

SEQ ID NO: 5859307 - DNA, 23 bp, Homo sapiens
cagccctacatcttcagctccca

SEQ ID NO: 5859308 - DNA, 16 bp, Homo sapiens
cagccctactcctgcg

SEQ ID NO: 5859309 - DNA, 17 bp, Homo sapiens
cagccctactctgtgta

SEQ ID NO: 5859310 - DNA, 15 bp, Homo sapiens
cagccctagagcctg

SEQ ID NO: 5859311 - DNA, 16 bp, Homo sapiens
cagccctagagcctgc

SEQ ID NO: 5859312 - DNA, 18 bp, Homo sapiens
cagccctagagcctgcct

SEQ ID NO: 5859313 - DNA, 20 bp, Homo sapiens
cagccctagagcctgcctgg

SEQ ID NO: 5859314 - DNA, 16 bp, Homo sapiens
cagccctagccctcag

SEQ ID NO: 5859315 - DNA, 23 bp, Homo sapiens
cagccctagccctcagcccacct

SEQ ID NO: 5859316 - DNA, 21 bp, Homo sapiens
cagccctagcggctgctcctt

SEQ ID NO: 5859317 - DNA, 12 bp, Homo sapiens
cagccctaggct

SEQ ID NO: 5859318 - DNA, 21 bp, Homo sapiens
cagccctagtgggagcccagc

SEQ ID NO: 5859319 - DNA, 22 bp, Homo sapiens
cagccctagtgggagcccagca

SEQ ID NO: 5859320 - DNA, 19 bp, Homo sapiens
cagccctatccattctctc

SEQ ID NO: 5859321 - DNA, 20 bp, Homo sapiens
cagccctatggatgtggggt

SEQ ID NO: 5859322 - DNA, 19 bp, Homo sapiens
cagccctcaacaggcccag

SEQ ID NO: 5859323 - DNA, 20 bp, Homo sapiens
cagccctcaacaggcccagg

SEQ ID NO: 5859324 - DNA, 14 bp, Homo sapiens
cagccctcacccct

SEQ ID NO: 5859325 - DNA, 12 bp, Homo sapiens
cagccctcacct

SEQ ID NO: 5859326 - DNA, 15 bp, Homo sapiens
cagccctcacctctg

SEQ ID NO: 5859327 - DNA, 16 bp, Homo sapiens
cagccctcacctctga

SEQ ID NO: 5859328 - DNA, 13 bp, Homo sapiens
cagccctcagaat

SEQ ID NO: 5859329 - DNA, 14 bp, Homo sapiens
cagccctcagactg

SEQ ID NO: 5859330 - DNA, 20 bp, Homo sapiens
cagccctcaggccagtgcca

SEQ ID NO: 5859331 - DNA, 21 bp, Homo sapiens
cagccctcaggccagtgccag

SEQ ID NO: 5859332 - DNA, 13 bp, Homo sapiens
cagccctcatccc

SEQ ID NO: 5859333 - DNA, 17 bp, Homo sapiens
cagccctcatcccgagc

SEQ ID NO: 5859334 - DNA, 16 bp, Homo sapiens
cagccctccactccag

SEQ ID NO: 5859335 - DNA, 23 bp, Homo sapiens
cagccctccatctaaactgcccc

SEQ ID NO: 5859336 - DNA, 14 bp, Homo sapiens
cagccctccatggc

SEQ ID NO: 5859337 - DNA, 19 bp, Homo sapiens
cagccctccatggcctggc

SEQ ID NO: 5859338 - DNA, 14 bp, Homo sapiens
cagccctcccagca

SEQ ID NO: 5859339 - DNA, 17 bp, Homo sapiens
cagccctccccacctgc

SEQ ID NO: 5859340 - DNA, 23 bp, Homo sapiens
cagccctccccacctgctcacca

SEQ ID NO: 5859341 - DNA, 20 bp, Homo sapiens
cagccctccccatggagcca

SEQ ID NO: 5859342 - DNA, 21 bp, Homo sapiens
cagccctccccatggagccag

SEQ ID NO: 5859343 - DNA, 17 bp, Homo sapiens
cagccctccctgcccct

SEQ ID NO: 5859344 - DNA, 13 bp, Homo sapiens
cagccctccctgt

SEQ ID NO: 5859345 - DNA, 14 bp, Homo sapiens
cagccctccctgtc

SEQ ID NO: 5859346 - DNA, 16 bp, Homo sapiens
cagccctccctgtcct

SEQ ID NO: 5859347 - DNA, 19 bp, Homo sapiens
cagccctccgccagccctg

SEQ ID NO: 5859348 - DNA, 21 bp, Homo sapiens
cagccctccgccagccctgtt

SEQ ID NO: 5859349 - DNA, 20 bp, Homo sapiens
cagccctcctacgcagatgc

SEQ ID NO: 5859350 - DNA, 18 bp, Homo sapiens
cagccctcctctgcactc

SEQ ID NO: 5859351 - DNA, 18 bp, Homo sapiens
cagccctctcactgtgtc

SEQ ID NO: 5859352 - DNA, 12 bp, Homo sapiens
cagccctctcca

SEQ ID NO: 5859353 - DNA, 16 bp, Homo sapiens
cagccctctccaccca

SEQ ID NO: 5859354 - DNA, 20 bp, Homo sapiens
cagccctctccacccagagg

SEQ ID NO: 5859355 - DNA, 14 bp, Homo sapiens
cagccctctcttgc

SEQ ID NO: 5859356 - DNA, 16 bp, Homo sapiens
cagccctctcttgcca

SEQ ID NO: 5859357 - DNA, 16 bp, Homo sapiens
cagccctctgtggcca

SEQ ID NO: 5859358 - DNA, 17 bp, Homo sapiens
cagccctcttgcccgca

SEQ ID NO: 5859359 - DNA, 13 bp, Homo sapiens
cagccctgaccct

SEQ ID NO: 5859360 - DNA, 12 bp, Homo sapiens
cagccctgagcc

SEQ ID NO: 5859361 - DNA, 22 bp, Homo sapiens
cagccctgagctagtgtcacct

SEQ ID NO: 5859362 - DNA, 23 bp, Homo sapiens
cagccctgagctggcctcacctg

SEQ ID NO: 5859363 - DNA, 17 bp, Homo sapiens
cagccctgagtgtccca

SEQ ID NO: 5859364 - DNA, 21 bp, Homo sapiens
cagccctgagttcctagccac

SEQ ID NO: 5859365 - DNA, 15 bp, Homo sapiens
cagccctgcaccatg

SEQ ID NO: 5859366 - DNA, 16 bp, Homo sapiens
cagccctgcagcccaa

SEQ ID NO: 5859367 - DNA, 23 bp, Homo sapiens
cagccctgcagcccaaaacccag

SEQ ID NO: 5859368 - DNA, 12 bp, Homo sapiens
cagccctgccag

SEQ ID NO: 5859369 - DNA, 14 bp, Homo sapiens
cagccctgccagga

SEQ ID NO: 5859370 - DNA, 15 bp, Homo sapiens
cagccctgccaggag

SEQ ID NO: 5859371 - DNA, 16 bp, Homo sapiens
cagccctgccaggagg

SEQ ID NO: 5859372 - DNA, 13 bp, Homo sapiens
cagccctgcctat

SEQ ID NO: 5859373 - DNA, 17 bp, Homo sapiens
cagccctgcctgagaag

SEQ ID NO: 5859374 - DNA, 19 bp, Homo sapiens
cagccctgcctggaggacc

SEQ ID NO: 5859375 - DNA, 20 bp, Homo sapiens
cagccctgcctggaggacct

SEQ ID NO: 5859376 - DNA, 21 bp, Homo sapiens
cagccctgctagacgcaccgc

SEQ ID NO: 5859377 - DNA, 16 bp, Homo sapiens
cagccctgctccctgc

SEQ ID NO: 5859378 - DNA, 17 bp, Homo sapiens
cagccctgctccctgcc

SEQ ID NO: 5859379 - DNA, 19 bp, Homo sapiens
cagccctgctccctgcctc

SEQ ID NO: 5859380 - DNA, 18 bp, Homo sapiens
cagccctgctgcttccta

SEQ ID NO: 5859381 - DNA, 16 bp, Homo sapiens
cagccctgctggccgc

SEQ ID NO: 5859382 - DNA, 15 bp, Homo sapiens
cagccctgctgggga

SEQ ID NO: 5859383 - DNA, 11 bp, Homo sapiens
cagccctgctt

SEQ ID NO: 5859384 - DNA, 19 bp, Homo sapiens
cagccctgctttgggctgc

SEQ ID NO: 5859385 - DNA, 21 bp, Homo sapiens
cagccctgctttgggctgccc

SEQ ID NO: 5859386 - DNA, 22 bp, Homo sapiens
cagccctgctttgggctgccct

SEQ ID NO: 5859387 - DNA, 22 bp, Homo sapiens
cagccctggaggctggatggct

SEQ ID NO: 5859388 - DNA, 23 bp, Homo sapiens
cagccctggaggctggatggctc

SEQ ID NO: 5859389 - DNA, 19 bp, Homo sapiens
cagccctggaggtgccagc

SEQ ID NO: 5859390 - DNA, 22 bp, Homo sapiens
cagccctggaggtgccagcaaa

SEQ ID NO: 5859391 - DNA, 12 bp, Homo sapiens
cagccctggcaa

SEQ ID NO: 5859392 - DNA, 12 bp, Homo sapiens
cagccctggccc

SEQ ID NO: 5859393 - DNA, 17 bp, Homo sapiens
cagccctggcccacccc

SEQ ID NO: 5859394 - DNA, 14 bp, Homo sapiens
cagccctggcccag

SEQ ID NO: 5859395 - DNA, 15 bp, Homo sapiens
cagccctggccccca

SEQ ID NO: 5859396 - DNA, 20 bp, Homo sapiens
cagccctggcccccatcagc

SEQ ID NO: 5859397 - DNA, 17 bp, Homo sapiens
cagccctggcccctcca

SEQ ID NO: 5859398 - DNA, 13 bp, Homo sapiens
cagccctggccct

SEQ ID NO: 5859399 - DNA, 18 bp, Homo sapiens
cagccctggccctgccca

SEQ ID NO: 5859400 - DNA, 13 bp, Homo sapiens
cagccctggcctt

SEQ ID NO: 5859401 - DNA, 18 bp, Homo sapiens
cagccctggcctttttct

SEQ ID NO: 5859402 - DNA, 16 bp, Homo sapiens
cagccctggctctgca

SEQ ID NO: 5859403 - DNA, 16 bp, Homo sapiens
cagccctggctgaagg

SEQ ID NO: 5859404 - DNA, 12 bp, Homo sapiens
cagccctggctt

SEQ ID NO: 5859405 - DNA, 14 bp, Homo sapiens
cagccctggcttcc

SEQ ID NO: 5859406 - DNA, 15 bp, Homo sapiens
cagcctctgacccct

SEQ ID NO: 5859407 - DNA, 21 bp, Homo sapiens
cagcctctgacccctcctcac

SEQ ID NO: 5859408 - DNA, 22 bp, Homo sapiens
cagcctctgacccctcctcact

SEQ ID NO: 5859409 - DNA, 23 bp, Homo sapiens
cagcctctgacccctcctcactg

SEQ ID NO: 5859410 - DNA, 19 bp, Homo sapiens
cagcctctgactcaccacg

SEQ ID NO: 5859411 - DNA, 23 bp, Homo sapiens
cagcctctgacttaagctgcctc

SEQ ID NO: 5859412 - DNA, 18 bp, Homo sapiens
cagcctctgagcccctgg

SEQ ID NO: 5859413 - DNA, 23 bp, Homo sapiens
cagcctctgagtcccgtggggcc

SEQ ID NO: 5859414 - DNA, 19 bp, Homo sapiens
cagcctctgcaactgcaag

SEQ ID NO: 5859415 - DNA, 11 bp, Homo sapiens
cagcctctgcc

SEQ ID NO: 5859416 - DNA, 14 bp, Homo sapiens
cagcctctgccagg

SEQ ID NO: 5859417 - DNA, 13 bp, Homo sapiens
cagcctctgcccc

SEQ ID NO: 5859418 - DNA, 16 bp, Homo sapiens
cagcctctgccgctgc

SEQ ID NO: 5859419 - DNA, 17 bp, Homo sapiens
cagcctctgccgctgcc

SEQ ID NO: 5859420 - DNA, 21 bp, Homo sapiens
cagcctctgccgctgccatgc

SEQ ID NO: 5859421 - DNA, 22 bp, Homo sapiens
cagcctctgccgctgccatgct

SEQ ID NO: 5859422 - DNA, 14 bp, Homo sapiens
cagcctctgcctcc

SEQ ID NO: 5859423 - DNA, 15 bp, Homo sapiens
cagcctctgcctccc

SEQ ID NO: 5859424 - DNA, 15 bp, Homo sapiens
cagcctctgctggag

SEQ ID NO: 5859425 - DNA, 12 bp, Homo sapiens
cagcctctggac

SEQ ID NO: 5859426 - DNA, 14 bp, Homo sapiens
cagcctctggccag

SEQ ID NO: 5859427 - DNA, 15 bp, Homo sapiens
cagcctctggctcca

SEQ ID NO: 5859428 - DNA, 16 bp, Homo sapiens
cagcctctggctccac

SEQ ID NO: 5859429 - DNA, 13 bp, Homo sapiens
cagcctctggggc

SEQ ID NO: 5859430 - DNA, 23 bp, Homo sapiens
cagcctctggggggtggccaggc

SEQ ID NO: 5859431 - DNA, 20 bp, Homo sapiens
cagcctctgtcaggccttca

SEQ ID NO: 5859432 - DNA, 17 bp, Homo sapiens
cagcctctgtccctctt

SEQ ID NO: 5859433 - DNA, 21 bp, Homo sapiens
cagcctctgtccctctttgcc

SEQ ID NO: 5859434 - DNA, 14 bp, Homo sapiens
cagcctctgttccc

SEQ ID NO: 5859435 - DNA, 21 bp, Homo sapiens
cagcctcttaaagctgcctgt

SEQ ID NO: 5859436 - DNA, 21 bp, Homo sapiens
cagcctcttccattccctttc

SEQ ID NO: 5859437 - DNA, 16 bp, Homo sapiens
cagcctcttccccacc

SEQ ID NO: 5859438 - DNA, 13 bp, Homo sapiens
cagcctcttcctc

SEQ ID NO: 5859439 - DNA, 14 bp, Homo sapiens
cagcctcttctctg

SEQ ID NO: 5859440 - DNA, 15 bp, Homo sapiens
cagcctcttctctgc

SEQ ID NO: 5859441 - DNA, 12 bp, Homo sapiens
cagcctcttgaa

SEQ ID NO: 5859442 - DNA, 12 bp, Homo sapiens
cagcctcttgcc

SEQ ID NO: 5859443 - DNA, 16 bp, Homo sapiens
cagcctctttctgtcc

SEQ ID NO: 5859444 - DNA, 17 bp, Homo sapiens
cagcctgaacagaagct

SEQ ID NO: 5859445 - DNA, 18 bp, Homo sapiens
cagcctgaacagaagctc

SEQ ID NO: 5859446 - DNA, 15 bp, Homo sapiens
cagcctgaagcctgg

SEQ ID NO: 5859447 - DNA, 21 bp, Homo sapiens
cagcctgaagcctggattcca

SEQ ID NO: 5859448 - DNA, 17 bp, Homo sapiens
cagcctgaataaaccaa

SEQ ID NO: 5859449 - DNA, 19 bp, Homo sapiens
cagcctgaataaaccaaga

SEQ ID NO: 5859450 - DNA, 18 bp, Homo sapiens
cagcctgaatcatttctt

SEQ ID NO: 5859451 - DNA, 21 bp, Homo sapiens
cagcctgacaacagcctgaga

SEQ ID NO: 5859452 - DNA, 18 bp, Homo sapiens
cagcctgaccccaggcag

SEQ ID NO: 5859453 - DNA, 22 bp, Homo sapiens
cagcctgaccttccttcctgtt

SEQ ID NO: 5859454 - DNA, 17 bp, Homo sapiens
cagcctgactagaactc

SEQ ID NO: 5859455 - DNA, 21 bp, Homo sapiens
cagcctgactagaactcctgt

SEQ ID NO: 5859456 - DNA, 24 bp, Homo sapiens
cagcctgactaggtacaggcaagc

SEQ ID NO: 5859457 - DNA, 12 bp, Homo sapiens
cagcctgagaaa

SEQ ID NO: 5859458 - DNA, 13 bp, Homo sapiens
cagcctgagaaat

SEQ ID NO: 5859459 - DNA, 22 bp, Homo sapiens
cagcctgagatggatggacaga

SEQ ID NO: 5859460 - DNA, 16 bp, Homo sapiens
cagcctgagcaactct

SEQ ID NO: 5859461 - DNA, 20 bp, Homo sapiens
cagcctgagcaactcttgat

SEQ ID NO: 5859462 - DNA, 18 bp, Homo sapiens
cagcctgagccacagtgg

SEQ ID NO: 5859463 - DNA, 20 bp, Homo sapiens
cagcctgagccacagtgggg

SEQ ID NO: 5859464 - DNA, 18 bp, Homo sapiens
cagcctgagcgacagtga

SEQ ID NO: 5859465 - DNA, 22 bp, Homo sapiens
cagcctgagcgacagtgagact

SEQ ID NO: 5859466 - DNA, 19 bp, Homo sapiens
cagcctgagctccaccctc

SEQ ID NO: 5859467 - DNA, 15 bp, Homo sapiens
cagcctgaggctgag

SEQ ID NO: 5859468 - DNA, 13 bp, Homo sapiens
cagcctgaggtgc

SEQ ID NO: 5859469 - DNA, 22 bp, Homo sapiens
cagcctgaggtgcccactccgc

SEQ ID NO: 5859470 - DNA, 14 bp, Homo sapiens
cagcctgagtctcc

SEQ ID NO: 5859471 - DNA, 17 bp, Homo sapiens
cagcctgagtctcctgt

SEQ ID NO: 5859472 - DNA, 18 bp, Homo sapiens
cagcctgagtgcaccacc

SEQ ID NO: 5859473 - DNA, 19 bp, Homo sapiens
cagcctgatcaggcttcct

SEQ ID NO: 5859474 - DNA, 22 bp, Homo sapiens
cagcctgatcaggcttcctggt

SEQ ID NO: 5859475 - DNA, 14 bp, Homo sapiens
cagcctgatggcca

SEQ ID NO: 5859476 - DNA, 22 bp, Homo sapiens
cagcctgattcggggctgacct

SEQ ID NO: 5859477 - DNA, 15 bp, Homo sapiens
cagcctgcacacacc

SEQ ID NO: 5859478 - DNA, 12 bp, Homo sapiens
cagcctgcacag

SEQ ID NO: 5859479 - DNA, 13 bp, Homo sapiens
cagcctgcaccct

SEQ ID NO: 5859480 - DNA, 12 bp, Homo sapiens
cagcctgcacct

SEQ ID NO: 5859481 - DNA, 15 bp, Homo sapiens
cagcctgcacctgcc

SEQ ID NO: 5859482 - DNA, 17 bp, Homo sapiens
cagcctgcacctgcccc

SEQ ID NO: 5859483 - DNA, 22 bp, Homo sapiens
cagcctgcacctgccccgtgtg

SEQ ID NO: 5859484 - DNA, 14 bp, Homo sapiens
cagcctgcacctgg

SEQ ID NO: 5859485 - DNA, 18 bp, Homo sapiens
cagcctgcagactcactg

SEQ ID NO: 5859486 - DNA, 20 bp, Homo sapiens
cagcctgcatctagctggag

SEQ ID NO: 5859487 - DNA, 11 bp, Homo sapiens
cagcctgccac

SEQ ID NO: 5859488 - DNA, 16 bp, Homo sapiens
cagcctgccactcagg

SEQ ID NO: 5859489 - DNA, 23 bp, Homo sapiens
cagcctgccagcagttactgtga

SEQ ID NO: 5859490 - DNA, 12 bp, Homo sapiens
cagcctgccagg

SEQ ID NO: 5859491 - DNA, 13 bp, Homo sapiens
cagcctgccaggc

SEQ ID NO: 5859492 - DNA, 12 bp, Homo sapiens
cagcctgcccac

SEQ ID NO: 5859493 - DNA, 13 bp, Homo sapiens
cagcctgcccacc

SEQ ID NO: 5859494 - DNA, 21 bp, Homo sapiens
cagcctgcccacctctccctg

SEQ ID NO: 5859495 - DNA, 23 bp, Homo sapiens
cagcctgccccagcctcccagct

SEQ ID NO: 5859496 - DNA, 14 bp, Homo sapiens
cagcctgccccgga

SEQ ID NO: 5859497 - DNA, 14 bp, Homo sapiens
cagcctgcccctag

SEQ ID NO: 5859498 - DNA, 15 bp, Homo sapiens
cagcctgcccctaga

SEQ ID NO: 5859499 - DNA, 20 bp, Homo sapiens
cagcctgccctccagctgct

SEQ ID NO: 5859500 - DNA, 14 bp, Homo sapiens
cagcctgcctctgc

SEQ ID NO: 5859501 - DNA, 19 bp, Homo sapiens
cagcctgcctgaagagagg

SEQ ID NO: 5859502 - DNA, 20 bp, Homo sapiens
cagcctgcctgaagagagga

SEQ ID NO: 5859503 - DNA, 19 bp, Homo sapiens
cagcctgcctggcaggctg

SEQ ID NO: 5859504 - DNA, 16 bp, Homo sapiens
cagcctgcctgggaga

SEQ ID NO: 5859505 - DNA, 18 bp, Homo sapiens
cagcctgccttgcccact

SEQ ID NO: 5859506 - DNA, 18 bp, Homo sapiens
cagcctgcgcctgctgca

SEQ ID NO: 5859507 - DNA, 22 bp, Homo sapiens
cagcctgcgggaagctgacctt

SEQ ID NO: 5859508 - DNA, 16 bp, Homo sapiens
cagcctgcgtggctga

SEQ ID NO: 5859509 - DNA, 19 bp, Homo sapiens
cagcctgcgtggctgaccc

SEQ ID NO: 5859510 - DNA, 19 bp, Homo sapiens
cagcctgctaattccccag

SEQ ID NO: 5859511 - DNA, 16 bp, Homo sapiens
cagcctgctagctagc

SEQ ID NO: 5859512 - DNA, 18 bp, Homo sapiens
cagcctgctagctagctc

SEQ ID NO: 5859513 - DNA, 17 bp, Homo sapiens
cagcctgctcagcaggt

SEQ ID NO: 5859514 - DNA, 12 bp, Homo sapiens
cagcctgctcca

SEQ ID NO: 5859515 - DNA, 19 bp, Homo sapiens
cagcctgctccagctgttc

SEQ ID NO: 5859516 - DNA, 20 bp, Homo sapiens
cagcctgctccttcccagga

SEQ ID NO: 5859517 - DNA, 22 bp, Homo sapiens
cagcctgctccttcccaggagt

SEQ ID NO: 5859518 - DNA, 12 bp, Homo sapiens
cagcctgctctg

SEQ ID NO: 5859519 - DNA, 22 bp, Homo sapiens
cagcctgctgagagcccccacc

SEQ ID NO: 5859520 - DNA, 14 bp, Homo sapiens
cagcctgctgccca

SEQ ID NO: 5859521 - DNA, 12 bp, Homo sapiens
cagcctgctggc

SEQ ID NO: 5859522 - DNA, 14 bp, Homo sapiens
cagcctgctggcag

SEQ ID NO: 5859523 - DNA, 23 bp, Homo sapiens
cagcctgctggcagggccagggc

SEQ ID NO: 5859524 - DNA, 14 bp, Homo sapiens
cagcctgctggggc

SEQ ID NO: 5859525 - DNA, 23 bp, Homo sapiens
cagcctgcttcccacctccctgc

SEQ ID NO: 5859526 - DNA, 23 bp, Homo sapiens
cagcctgcttcttccccagggtt

SEQ ID NO: 5859527 - DNA, 15 bp, Homo sapiens
cagcctgctttggcc

SEQ ID NO: 5859528 - DNA, 18 bp, Homo sapiens
cagcctgctttggccttt

SEQ ID NO: 5859529 - DNA, 12 bp, Homo sapiens
cagcctggaagg

SEQ ID NO: 5859530 - DNA, 15 bp, Homo sapiens
cagcctggaccccca

SEQ ID NO: 5859531 - DNA, 17 bp, Homo sapiens
cagcctggacccccagc

SEQ ID NO: 5859532 - DNA, 14 bp, Homo sapiens
cagcctggagaggc

SEQ ID NO: 5859533 - DNA, 15 bp, Homo sapiens
cagcctggagaggcc

SEQ ID NO: 5859534 - DNA, 18 bp, Homo sapiens
cagcctggagaggcctgg

SEQ ID NO: 5859535 - DNA, 20 bp, Homo sapiens
cagcctggagaggcctgggg

SEQ ID NO: 5859536 - DNA, 16 bp, Homo sapiens
cagcctggagatgaaa

SEQ ID NO: 5859537 - DNA, 19 bp, Homo sapiens
cagcctggagccctggaga

SEQ ID NO: 5859538 - DNA, 13 bp, Homo sapiens
cagcctggagccg

SEQ ID NO: 5859539 - DNA, 12 bp, Homo sapiens
cagcctggaggc

SEQ ID NO: 5859540 - DNA, 17 bp, Homo sapiens
cagcctggatctcctca

SEQ ID NO: 5859541 - DNA, 15 bp, Homo sapiens
cagcctggatgccat

SEQ ID NO: 5859542 - DNA, 16 bp, Homo sapiens
cagcctggatgccatc

SEQ ID NO: 5859543 - DNA, 17 bp, Homo sapiens
cagcctggatgccatcc

SEQ ID NO: 5859544 - DNA, 13 bp, Homo sapiens
cagcctggcacag

SEQ ID NO: 5859545 - DNA, 14 bp, Homo sapiens
cagcctggcatcag

SEQ ID NO: 5859546 - DNA, 13 bp, Homo sapiens
cagcctggcatct

SEQ ID NO: 5859547 - DNA, 13 bp, Homo sapiens
cagcctggccaga

SEQ ID NO: 5859548 - DNA, 15 bp, Homo sapiens
cagcctggccagaca

SEQ ID NO: 5859549 - DNA, 17 bp, Homo sapiens
cagcctggccagacaca

SEQ ID NO: 5859550 - DNA, 11 bp, Homo sapiens
cagcctggccc

SEQ ID NO: 5859551 - DNA, 19 bp, Homo sapiens
cagcctggcccagctcccc

SEQ ID NO: 5859552 - DNA, 14 bp, Homo sapiens
cagcctggccccaa

SEQ ID NO: 5859553 - DNA, 13 bp, Homo sapiens
cagcctggcctcc

SEQ ID NO: 5859554 - DNA, 17 bp, Homo sapiens
cagcctggcctcccctg

SEQ ID NO: 5859555 - DNA, 20 bp, Homo sapiens
cagcctggcctcccctgcgg

SEQ ID NO: 5859556 - DNA, 16 bp, Homo sapiens
cagcctggcctcctgc

SEQ ID NO: 5859557 - DNA, 21 bp, Homo sapiens
cagcctggcctcctgcctcta

SEQ ID NO: 5859558 - DNA, 14 bp, Homo sapiens
cagcctggcctgcc

SEQ ID NO: 5859559 - DNA, 23 bp, Homo sapiens
cagcctggcgaaaccccatctct

SEQ ID NO: 5859560 - DNA, 16 bp, Homo sapiens
cagcctggcggggcag

SEQ ID NO: 5859561 - DNA, 18 bp, Homo sapiens
cagcctggcggggcagga

SEQ ID NO: 5859562 - DNA, 19 bp, Homo sapiens
cagcctggcggggcaggag

SEQ ID NO: 5859563 - DNA, 12 bp, Homo sapiens
cagcctggctcc

SEQ ID NO: 5859564 - DNA, 21 bp, Homo sapiens
cagcctggctcccacaggcag

SEQ ID NO: 5859565 - DNA, 20 bp, Homo sapiens
cagcctggctcccaggacac

SEQ ID NO: 5859566 - DNA, 21 bp, Homo sapiens
cagcctggctcccaggacacg

SEQ ID NO: 5859567 - DNA, 19 bp, Homo sapiens
cagcctggctcccctgggg

SEQ ID NO: 5859568 - DNA, 18 bp, Homo sapiens
cagcctggctctgccccc

SEQ ID NO: 5859569 - DNA, 17 bp, Homo sapiens
cagcctggctggtcctc

SEQ ID NO: 5859570 - DNA, 23 bp, Homo sapiens
cagcctggctgtggcctaacctg

SEQ ID NO: 5859571 - DNA, 19 bp, Homo sapiens
cagcctggcttctggagcc

SEQ ID NO: 5859572 - DNA, 17 bp, Homo sapiens
cagcctgggaccagggc

SEQ ID NO: 5859573 - DNA, 19 bp, Homo sapiens
cagcctgggaccagggcat

SEQ ID NO: 5859574 - DNA, 16 bp, Homo sapiens
cagcctgggactccca

SEQ ID NO: 5859575 - DNA, 21 bp, Homo sapiens
cagcctgggactcccagtgaa

SEQ ID NO: 5859576 - DNA, 20 bp, Homo sapiens
cagcctgggaggcacagcaa

SEQ ID NO: 5859577 - DNA, 20 bp, Homo sapiens
cagcctgggataggggcaga

SEQ ID NO: 5859578 - DNA, 19 bp, Homo sapiens
cagcctgggcaacagagca

SEQ ID NO: 5859579 - DNA, 20 bp, Homo sapiens
cagcctgggcaacagagcaa

SEQ ID NO: 5859580 - DNA, 21 bp, Homo sapiens
cagcctgggcagccaggctgc

SEQ ID NO: 5859581 - DNA, 20 bp, Homo sapiens
cagcctgggccatctcttag

SEQ ID NO: 5859582 - DNA, 12 bp, Homo sapiens
cagcctgggccc

SEQ ID NO: 5859583 - DNA, 21 bp, Homo sapiens
cagcctgggcccatctccctg

SEQ ID NO: 5859584 - DNA, 22 bp, Homo sapiens
cagcgtcccctgctactcctgt

SEQ ID NO: 5859585 - DNA, 17 bp, Homo sapiens
cagcgtccctagcagtg

SEQ ID NO: 5859586 - DNA, 18 bp, Homo sapiens
cagcgtccggggtggtgg

SEQ ID NO: 5859587 - DNA, 13 bp, Homo sapiens
cagcgtcctcagc

SEQ ID NO: 5859588 - DNA, 17 bp, Homo sapiens
cagcgtcctcagcaccc

SEQ ID NO: 5859589 - DNA, 15 bp, Homo sapiens
cagcgtcctcctctg

SEQ ID NO: 5859590 - DNA, 22 bp, Homo sapiens
cagcgtcctcgttcaaaacatt

SEQ ID NO: 5859591 - DNA, 24 bp, Homo sapiens
cagcgtctccccatgctgggctca

SEQ ID NO: 5859592 - DNA, 18 bp, Homo sapiens
cagcgtctgcagggtgac

SEQ ID NO: 5859593 - DNA, 23 bp, Homo sapiens
cagcgtctgctcataggacctgc

SEQ ID NO: 5859594 - DNA, 21 bp, Homo sapiens
cagcgtctttttaacctcaga

SEQ ID NO: 5859595 - DNA, 16 bp, Homo sapiens
cagcgtgaaggacctg

SEQ ID NO: 5859596 - DNA, 17 bp, Homo sapiens
cagcgtgcaccccgccg

SEQ ID NO: 5859597 - DNA, 19 bp, Homo sapiens
cagcgtgcaggagcaaggc

SEQ ID NO: 5859598 - DNA, 21 bp, Homo sapiens
cagcgtgcccgcttccgctgt

SEQ ID NO: 5859599 - DNA, 21 bp, Homo sapiens
cagcgtgctggcgacactcag

SEQ ID NO: 5859600 - DNA, 19 bp, Homo sapiens
cagcgtgctttaaaaaata

SEQ ID NO: 5859601 - DNA, 16 bp, Homo sapiens
cagcgtggcaacaggc

SEQ ID NO: 5859602 - DNA, 14 bp, Homo sapiens
cagcgtggcccagg

SEQ ID NO: 5859603 - DNA, 15 bp, Homo sapiens
cagcgtggcccaggc

SEQ ID NO: 5859604 - DNA, 14 bp, Homo sapiens
cagcgtggcctccg

SEQ ID NO: 5859605 - DNA, 17 bp, Homo sapiens
cagcgtggcctccgtga

SEQ ID NO: 5859606 - DNA, 14 bp, Homo sapiens
cagcgtggccttgt

SEQ ID NO: 5859607 - DNA, 14 bp, Homo sapiens
cagcgtggcttaga

SEQ ID NO: 5859608 - DNA, 15 bp, Homo sapiens
cagcgtgggctctgc

SEQ ID NO: 5859609 - DNA, 18 bp, Homo sapiens
cagcgtgggggtggccac

SEQ ID NO: 5859610 - DNA, 21 bp, Homo sapiens
cagcgtgggggtggccactcc

SEQ ID NO: 5859611 - DNA, 16 bp, Homo sapiens
cagcgtggtttttatg

SEQ ID NO: 5859612 - DNA, 21 bp, Homo sapiens
cagcgtggtttttatgtgtat

SEQ ID NO: 5859613 - DNA, 14 bp, Homo sapiens
cagcgtgtggagca

SEQ ID NO: 5859614 - DNA, 18 bp, Homo sapiens
cagcgtgtggagcagagc

SEQ ID NO: 5859615 - DNA, 17 bp, Homo sapiens
cagcgttcccttctccc

SEQ ID NO: 5859616 - DNA, 18 bp, Homo sapiens
cagcgttcccttctcccc

SEQ ID NO: 5859617 - DNA, 21 bp, Homo sapiens
cagcgttcccttctccccctt

SEQ ID NO: 5859618 - DNA, 14 bp, Homo sapiens
cagcgttcttcagg

SEQ ID NO: 5859619 - DNA, 15 bp, Homo sapiens
cagcgttcttcagga

SEQ ID NO: 5859620 - DNA, 17 bp, Homo sapiens
cagcgttcttcaggaga

SEQ ID NO: 5859621 - DNA, 13 bp, Homo sapiens
cagcgttgcatgt

SEQ ID NO: 5859622 - DNA, 14 bp, Homo sapiens
cagcgtttacatat

SEQ ID NO: 5859623 - DNA, 18 bp, Homo sapiens
cagcgtttacatatttac

SEQ ID NO: 5859624 - DNA, 14 bp, Homo sapiens
cagcgtttctatga

SEQ ID NO: 5859625 - DNA, 16 bp, Homo sapiens
cagcgtttctatgaca

SEQ ID NO: 5859626 - DNA, 20 bp, Homo sapiens
cagcgtttgaggggctggcc

SEQ ID NO: 5859627 - DNA, 22 bp, Homo sapiens
cagcgtttgaggggctggcctt

SEQ ID NO: 5859628 - DNA, 17 bp, Homo sapiens
cagctaaaagcatccct

SEQ ID NO: 5859629 - DNA, 21 bp, Homo sapiens
cagctaaaagcatccctgtga

SEQ ID NO: 5859630 - DNA, 15 bp, Homo sapiens
cagctaaagaggtgg

SEQ ID NO: 5859631 - DNA, 15 bp, Homo sapiens
cagctaaagatgaga

SEQ ID NO: 5859632 - DNA, 21 bp, Homo sapiens
cagctaaatgcagggaaactc

SEQ ID NO: 5859633 - DNA, 17 bp, Homo sapiens
cagctaacaattgtgaa

SEQ ID NO: 5859634 - DNA, 17 bp, Homo sapiens
cagctaacacacagctc

SEQ ID NO: 5859635 - DNA, 18 bp, Homo sapiens
cagctaacatggaagtac

SEQ ID NO: 5859636 - DNA, 23 bp, Homo sapiens
cagctaaccacttcgcacacacc

SEQ ID NO: 5859637 - DNA, 21 bp, Homo sapiens
cagctaacccgtgcagaacca

SEQ ID NO: 5859638 - DNA, 23 bp, Homo sapiens
cagctaactccagtctcctgaca

SEQ ID NO: 5859639 - DNA, 15 bp, Homo sapiens
cagctaactccgaga

SEQ ID NO: 5859640 - DNA, 13 bp, Homo sapiens
cagctaagaacct

SEQ ID NO: 5859641 - DNA, 14 bp, Homo sapiens
cagctaagaacctg

SEQ ID NO: 5859642 - DNA, 19 bp, Homo sapiens
cagctaagaacctggaact

SEQ ID NO: 5859643 - DNA, 18 bp, Homo sapiens
cagctaagatagaaagct

SEQ ID NO: 5859644 - DNA, 21 bp, Homo sapiens
cagctaagatgccatgtgcag

SEQ ID NO: 5859645 - DNA, 18 bp, Homo sapiens
cagctaagcctgatgatg

SEQ ID NO: 5859646 - DNA, 13 bp, Homo sapiens
cagctaagctcac

SEQ ID NO: 5859647 - DNA, 14 bp, Homo sapiens
cagctaagctcacg

SEQ ID NO: 5859648 - DNA, 21 bp, Homo sapiens
cagctaagggaagacatttct

SEQ ID NO: 5859649 - DNA, 19 bp, Homo sapiens
cagctaaggggtggggctg

SEQ ID NO: 5859650 - DNA, 23 bp, Homo sapiens
cagctaataaaagtcagagctca

SEQ ID NO: 5859651 - DNA, 13 bp, Homo sapiens
cagctaataaacc

SEQ ID NO: 5859652 - DNA, 15 bp, Homo sapiens
cagctaataaaccag

SEQ ID NO: 5859653 - DNA, 18 bp, Homo sapiens
cagctaatacccagagca

SEQ ID NO: 5859654 - DNA, 19 bp, Homo sapiens
cagctaatacccagagcac

SEQ ID NO: 5859655 - DNA, 23 bp, Homo sapiens
cagctaatctccacccaatgaat

SEQ ID NO: 5859656 - DNA, 21 bp, Homo sapiens
cagctaatctgtagggctgga

SEQ ID NO: 5859657 - DNA, 22 bp, Homo sapiens
cagctaattctactcacagtgc

SEQ ID NO: 5859658 - DNA, 16 bp, Homo sapiens
cagctaatttttgtat

SEQ ID NO: 5859659 - DNA, 21 bp, Homo sapiens
cagctaatttttgtattttta

SEQ ID NO: 5859660 - DNA, 12 bp, Homo sapiens
cagctacaacag

SEQ ID NO: 5859661 - DNA, 20 bp, Homo sapiens
cagctacaaccctaccctgg

SEQ ID NO: 5859662 - DNA, 18 bp, Homo sapiens
cagctacacctttctcct

SEQ ID NO: 5859663 - DNA, 15 bp, Homo sapiens
cagctacagctttct

SEQ ID NO: 5859664 - DNA, 18 bp, Homo sapiens
cagctacataagactgga

SEQ ID NO: 5859665 - DNA, 14 bp, Homo sapiens
cagctacattcctc

SEQ ID NO: 5859666 - DNA, 16 bp, Homo sapiens
cagctacattcctcag

SEQ ID NO: 5859667 - DNA, 21 bp, Homo sapiens
cagctacattcctcagctgcc

SEQ ID NO: 5859668 - DNA, 16 bp, Homo sapiens
cagctaccaagtcaga

SEQ ID NO: 5859669 - DNA, 16 bp, Homo sapiens
cagctacccaggaggc

SEQ ID NO: 5859670 - DNA, 17 bp, Homo sapiens
cagctacccaggaggct

SEQ ID NO: 5859671 - DNA, 19 bp, Homo sapiens
cagctacccaggaggctga

SEQ ID NO: 5859672 - DNA, 22 bp, Homo sapiens
cagctacccaggaggctgaggc

SEQ ID NO: 5859673 - DNA, 13 bp, Homo sapiens
cagctaccccttc

SEQ ID NO: 5859674 - DNA, 19 bp, Homo sapiens
cagctaccccttgtgggca

SEQ ID NO: 5859675 - DNA, 14 bp, Homo sapiens
cagctaccctcagc

SEQ ID NO: 5859676 - DNA, 15 bp, Homo sapiens
cagctaccctcagcc

SEQ ID NO: 5859677 - DNA, 18 bp, Homo sapiens
cagctaccctcagcctcc

SEQ ID NO: 5859678 - DNA, 17 bp, Homo sapiens
cagctaccctgtgtata

SEQ ID NO: 5859679 - DNA, 12 bp, Homo sapiens
cagctacctgag

SEQ ID NO: 5859680 - DNA, 13 bp, Homo sapiens
cagctacctgaga

SEQ ID NO: 5859681 - DNA, 20 bp, Homo sapiens
cagctacctgagacgggcat

SEQ ID NO: 5859682 - DNA, 16 bp, Homo sapiens
cagctactaacctgga

SEQ ID NO: 5859683 - DNA, 18 bp, Homo sapiens
cagctactaacctggaga

SEQ ID NO: 5859684 - DNA, 22 bp, Homo sapiens
cagctactaacctggagacagt

SEQ ID NO: 5859685 - DNA, 16 bp, Homo sapiens
cagctactcagaagcc

SEQ ID NO: 5859686 - DNA, 19 bp, Homo sapiens
cagctactcagaagcctga

SEQ ID NO: 5859687 - DNA, 20 bp, Homo sapiens
cagctactcagaagcctgag

SEQ ID NO: 5859688 - DNA, 23 bp, Homo sapiens
cagctactcagatctgcactcct

SEQ ID NO: 5859689 - DNA, 18 bp, Homo sapiens
cagctactcaggaggctg

SEQ ID NO: 5859690 - DNA, 20 bp, Homo sapiens
cagctactcaggaggctgag

SEQ ID NO: 5859691 - DNA, 19 bp, Homo sapiens
cagctactcagtggggctg

SEQ ID NO: 5859692 - DNA, 24 bp, Homo sapiens
cagctactcagtggggctggcatc

SEQ ID NO: 5859693 - DNA, 14 bp, Homo sapiens
cagctactctgatc

SEQ ID NO: 5859694 - DNA, 15 bp, Homo sapiens
cagctactgtaactt

SEQ ID NO: 5859695 - DNA, 15 bp, Homo sapiens
cagctacttagctgg

SEQ ID NO: 5859696 - DNA, 17 bp, Homo sapiens
cagctacttagctggcc

SEQ ID NO: 5859697 - DNA, 18 bp, Homo sapiens
cagctacttagctggcca

SEQ ID NO: 5859698 - DNA, 20 bp, Homo sapiens
cagctacttagctggccaag

SEQ ID NO: 5859699 - DNA, 18 bp, Homo sapiens
cagctacttctgggaaaa

SEQ ID NO: 5859700 - DNA, 22 bp, Homo sapiens
cagctacttctgggaaaaacaa

SEQ ID NO: 5859701 - DNA, 16 bp, Homo sapiens
cagctacttgggaggc

SEQ ID NO: 5859702 - DNA, 17 bp, Homo sapiens
cagctactttaacacca

SEQ ID NO: 5859703 - DNA, 14 bp, Homo sapiens
cagctactttccat

SEQ ID NO: 5859704 - DNA, 20 bp, Homo sapiens
cagctactttccatttggta

SEQ ID NO: 5859705 - DNA, 18 bp, Homo sapiens
cagctagaaaacattttt

SEQ ID NO: 5859706 - DNA, 23 bp, Homo sapiens
cagctagaaataagcccaacaga

SEQ ID NO: 5859707 - DNA, 15 bp, Homo sapiens
cagctagaatttctg

SEQ ID NO: 5859708 - DNA, 21 bp, Homo sapiens
cagctagattttgctgatttt

SEQ ID NO: 5859709 - DNA, 15 bp, Homo sapiens
cagctagcaaaagaa

SEQ ID NO: 5859710 - DNA, 12 bp, Homo sapiens
cagctagcaagg

SEQ ID NO: 5859711 - DNA, 17 bp, Homo sapiens
cagctaggaacaaatct

SEQ ID NO: 5859712 - DNA, 20 bp, Homo sapiens
cagctaggaacaaatcttcc

SEQ ID NO: 5859713 - DNA, 16 bp, Homo sapiens
cagctaggaagagcag

SEQ ID NO: 5859714 - DNA, 20 bp, Homo sapiens
cagctaggactgaggagtgg

SEQ ID NO: 5859715 - DNA, 12 bp, Homo sapiens
cagctaggcagg

SEQ ID NO: 5859716 - DNA, 14 bp, Homo sapiens
cagctaggcaggga

SEQ ID NO: 5859717 - DNA, 13 bp, Homo sapiens
cagctaggcatgc

SEQ ID NO: 5859718 - DNA, 14 bp, Homo sapiens
cagctaggctgaga

SEQ ID NO: 5859719 - DNA, 15 bp, Homo sapiens
cagctaggctgagat

SEQ ID NO: 5859720 - DNA, 17 bp, Homo sapiens
cagctaggctgagatgc

SEQ ID NO: 5859721 - DNA, 13 bp, Homo sapiens
cagctagggctgg

SEQ ID NO: 5859722 - DNA, 19 bp, Homo sapiens
cagctagggggcgttattt

SEQ ID NO: 5859723 - DNA, 23 bp, Homo sapiens
cagctagtgaagaccagagcagt

SEQ ID NO: 5859724 - DNA, 13 bp, Homo sapiens
cagctagtgaccc

SEQ ID NO: 5859725 - DNA, 13 bp, Homo sapiens
cagctagtgcctt

SEQ ID NO: 5859726 - DNA, 18 bp, Homo sapiens
cagctataacagtaggga

SEQ ID NO: 5859727 - DNA, 13 bp, Homo sapiens
cagctatacagga

SEQ ID NO: 5859728 - DNA, 18 bp, Homo sapiens
cagctatacctgcacgtt

SEQ ID NO: 5859729 - DNA, 15 bp, Homo sapiens
cagctatacctgtgc

SEQ ID NO: 5859730 - DNA, 16 bp, Homo sapiens
cagctatacctgtgcc

SEQ ID NO: 5859731 - DNA, 22 bp, Homo sapiens
cagctatacctgtgcctcggct

SEQ ID NO: 5859732 - DNA, 14 bp, Homo sapiens
cagctatatttgat

SEQ ID NO: 5859733 - DNA, 19 bp, Homo sapiens
cagctatcgaacttcacaa

SEQ ID NO: 5859734 - DNA, 17 bp, Homo sapiens
cagctatctctcagtga

SEQ ID NO: 5859735 - DNA, 18 bp, Homo sapiens
cagctatctctcagtgaa

SEQ ID NO: 5859736 - DNA, 17 bp, Homo sapiens
cagctatctgcactcta

SEQ ID NO: 5859737 - DNA, 13 bp, Homo sapiens
cagctatctgcct

SEQ ID NO: 5859738 - DNA, 15 bp, Homo sapiens
cagctatctgcctga

SEQ ID NO: 5859739 - DNA, 23 bp, Homo sapiens
cagctatctgcctgacaggctgt

SEQ ID NO: 5859740 - DNA, 22 bp, Homo sapiens
cagctatctgtcatctctctgg

SEQ ID NO: 5859741 - DNA, 16 bp, Homo sapiens
cagctatgaagtgctg

SEQ ID NO: 5859742 - DNA, 14 bp, Homo sapiens
cagctatgagagga

SEQ ID NO: 5859743 - DNA, 13 bp, Homo sapiens
cagctatgctggt

SEQ ID NO: 5859744 - DNA, 15 bp, Homo sapiens
cagctatgggagccc

SEQ ID NO: 5859745 - DNA, 23 bp, Homo sapiens
cagctatgggagccccagggtct

SEQ ID NO: 5859746 - DNA, 16 bp, Homo sapiens
cagctatgtagcaaag

SEQ ID NO: 5859747 - DNA, 20 bp, Homo sapiens
cagctatgttatattgaaaa

SEQ ID NO: 5859748 - DNA, 18 bp, Homo sapiens
cagctattaagaaaatca

SEQ ID NO: 5859749 - DNA, 17 bp, Homo sapiens
cagctattcacacacac

SEQ ID NO: 5859750 - DNA, 16 bp, Homo sapiens
cagctattcaggaggc

SEQ ID NO: 5859751 - DNA, 18 bp, Homo sapiens
cagctattgatataaata

SEQ ID NO: 5859752 - DNA, 12 bp, Homo sapiens
cagctatttaag

SEQ ID NO: 5859753 - DNA, 19 bp, Homo sapiens
cagctatttcccttttctg

SEQ ID NO: 5859754 - DNA, 14 bp, Homo sapiens
cagctatttctcat

SEQ ID NO: 5859755 - DNA, 12 bp, Homo sapiens
cagctattttct

SEQ ID NO: 5859756 - DNA, 13 bp, Homo sapiens
cagctattttctg

SEQ ID NO: 5859757 - DNA, 18 bp, Homo sapiens
cagctattttctgaccaa

SEQ ID NO: 5859758 - DNA, 15 bp, Homo sapiens
cagctcaacctaccc

SEQ ID NO: 5859759 - DNA, 16 bp, Homo sapiens
cagctcaacctaccct

SEQ ID NO: 5859760 - DNA, 20 bp, Homo sapiens
cagctcaactcacagcttct

SEQ ID NO: 5859761 - DNA, 19 bp, Homo sapiens
cagctcaaggaaaggcctg

SEQ ID NO: 5859762 - DNA, 18 bp, Homo sapiens
cagctgaagccagctccc

SEQ ID NO: 5859763 - DNA, 14 bp, Homo sapiens
cagctgaagcctgg

SEQ ID NO: 5859764 - DNA, 15 bp, Homo sapiens
cagctgaagcctgga

SEQ ID NO: 5859765 - DNA, 22 bp, Homo sapiens
cagctgaagcctggacgcagcc

SEQ ID NO: 5859766 - DNA, 17 bp, Homo sapiens
cagctgaatagagggag

SEQ ID NO: 5859767 - DNA, 14 bp, Homo sapiens
cagctgacagctgc

SEQ ID NO: 5859768 - DNA, 20 bp, Homo sapiens
cagctgaccagaagtggcag

SEQ ID NO: 5859769 - DNA, 21 bp, Homo sapiens
cagctgaccagaagtggcagg

SEQ ID NO: 5859770 - DNA, 23 bp, Homo sapiens
cagctgaccagaagtggcaggag

SEQ ID NO: 5859771 - DNA, 17 bp, Homo sapiens
cagctgaccatggaaga

SEQ ID NO: 5859772 - DNA, 15 bp, Homo sapiens
cagctgaccccctcc

SEQ ID NO: 5859773 - DNA, 18 bp, Homo sapiens
cagctgaccccctccccc

SEQ ID NO: 5859774 - DNA, 22 bp, Homo sapiens
cagctgacccggcctctctgcc

SEQ ID NO: 5859775 - DNA, 13 bp, Homo sapiens
cagctgacctctg

SEQ ID NO: 5859776 - DNA, 14 bp, Homo sapiens
cagctgacggcagt

SEQ ID NO: 5859777 - DNA, 19 bp, Homo sapiens
cagctgactccagtataat

SEQ ID NO: 5859778 - DNA, 15 bp, Homo sapiens
cagctgactgtggcc

SEQ ID NO: 5859779 - DNA, 15 bp, Homo sapiens
cagctgactgttggc

SEQ ID NO: 5859780 - DNA, 20 bp, Homo sapiens
cagctgactgttggctctct

SEQ ID NO: 5859781 - DNA, 22 bp, Homo sapiens
cagctgactgttggctctctga

SEQ ID NO: 5859782 - DNA, 21 bp, Homo sapiens
cagctgacttggttctgaagc

SEQ ID NO: 5859783 - DNA, 22 bp, Homo sapiens
cagctgacttggttctgaagcc

SEQ ID NO: 5859784 - DNA, 17 bp, Homo sapiens
cagctgagagaaaataa

SEQ ID NO: 5859785 - DNA, 14 bp, Homo sapiens
cagctgagaggctg

SEQ ID NO: 5859786 - DNA, 14 bp, Homo sapiens
cagctgagatgtgg

SEQ ID NO: 5859787 - DNA, 13 bp, Homo sapiens
cagctgagcaggg

SEQ ID NO: 5859788 - DNA, 14 bp, Homo sapiens
cagctgagcagggc

SEQ ID NO: 5859789 - DNA, 20 bp, Homo sapiens
cagctgagcagggccgggga

SEQ ID NO: 5859790 - DNA, 11 bp, Homo sapiens
cagctgagcat

SEQ ID NO: 5859791 - DNA, 14 bp, Homo sapiens
cagctgagcatgga

SEQ ID NO: 5859792 - DNA, 20 bp, Homo sapiens
cagctgagcattctcatttt

SEQ ID NO: 5859793 - DNA, 13 bp, Homo sapiens
cagctgagccctg

SEQ ID NO: 5859794 - DNA, 15 bp, Homo sapiens
cagctgagccctggg

SEQ ID NO: 5859795 - DNA, 17 bp, Homo sapiens
cagctgagccttctgag

SEQ ID NO: 5859796 - DNA, 14 bp, Homo sapiens
cagctgagcgccag

SEQ ID NO: 5859797 - DNA, 18 bp, Homo sapiens
cagctgagcgccaggatg

SEQ ID NO: 5859798 - DNA, 17 bp, Homo sapiens
cagctgagcttgagctc

SEQ ID NO: 5859799 - DNA, 22 bp, Homo sapiens
cagctgaggacacaccccacac

SEQ ID NO: 5859800 - DNA, 15 bp, Homo sapiens
cagctgaggaccctc

SEQ ID NO: 5859801 - DNA, 15 bp, Homo sapiens
cagctgaggccccag

SEQ ID NO: 5859802 - DNA, 12 bp, Homo sapiens
cagctgaggctg

SEQ ID NO: 5859803 - DNA, 20 bp, Homo sapiens
cagctgaggctgggggcggg

SEQ ID NO: 5859804 - DNA, 19 bp, Homo sapiens
cagctgagggtgagtgggt

SEQ ID NO: 5859805 - DNA, 19 bp, Homo sapiens
cagctgaggtctcttgagg

SEQ ID NO: 5859806 - DNA, 20 bp, Homo sapiens
cagctgaggtctcttgaggg

SEQ ID NO: 5859807 - DNA, 15 bp, Homo sapiens
cagctgagtcctggg

SEQ ID NO: 5859808 - DNA, 23 bp, Homo sapiens
cagctgagtgaaaaatctgtgga

SEQ ID NO: 5859809 - DNA, 12 bp, Homo sapiens
cagctgagttgt

SEQ ID NO: 5859810 - DNA, 20 bp, Homo sapiens
cagctgatacttcatttaaa

SEQ ID NO: 5859811 - DNA, 21 bp, Homo sapiens
cagctgatattatggcaagtg

SEQ ID NO: 5859812 - DNA, 20 bp, Homo sapiens
cagctgatccataggactac

SEQ ID NO: 5859813 - DNA, 22 bp, Homo sapiens
cagctgatgactcaagattccc

SEQ ID NO: 5859814 - DNA, 23 bp, Homo sapiens
cagctgatgactcaagattccca

SEQ ID NO: 5859815 - DNA, 14 bp, Homo sapiens
cagctgatgagtta

SEQ ID NO: 5859816 - DNA, 20 bp, Homo sapiens
cagctgatgttggaagagaa

SEQ ID NO: 5859817 - DNA, 21 bp, Homo sapiens
cagctgattttgtcactgtct

SEQ ID NO: 5859818 - DNA, 19 bp, Homo sapiens
cagctgcaagccagggatg

SEQ ID NO: 5859819 - DNA, 22 bp, Homo sapiens
cagctgcaaggtactctggtga

SEQ ID NO: 5859820 - DNA, 21 bp, Homo sapiens
cagctgcacattcctggcccc

SEQ ID NO: 5859821 - DNA, 14 bp, Homo sapiens
cagctgcaccagag

SEQ ID NO: 5859822 - DNA, 19 bp, Homo sapiens
cagctgcaccccagcgtca

SEQ ID NO: 5859823 - DNA, 16 bp, Homo sapiens
cagctgcacctgccag

SEQ ID NO: 5859824 - DNA, 20 bp, Homo sapiens
cagctgcacctgccagcctg

SEQ ID NO: 5859825 - DNA, 14 bp, Homo sapiens
cagctgcagcccct

SEQ ID NO: 5859826 - DNA, 14 bp, Homo sapiens
cagctgcagcctgg

SEQ ID NO: 5859827 - DNA, 19 bp, Homo sapiens
cagctgcagcctggttggc

SEQ ID NO: 5859828 - DNA, 13 bp, Homo sapiens
cagctgcagctga

SEQ ID NO: 5859829 - DNA, 16 bp, Homo sapiens
cagctgcagctgggcc

SEQ ID NO: 5859830 - DNA, 17 bp, Homo sapiens
cagctgcagctgggccc

SEQ ID NO: 5859831 - DNA, 23 bp, Homo sapiens
cagctgcagctgggccccatgct

SEQ ID NO: 5859832 - DNA, 17 bp, Homo sapiens
cagctgcagctgggctg

SEQ ID NO: 5859833 - DNA, 11 bp, Homo sapiens
cagctgcaggg

SEQ ID NO: 5859834 - DNA, 14 bp, Homo sapiens
cagctgcaggtgcc

SEQ ID NO: 5859835 - DNA, 22 bp, Homo sapiens
cagctgcagtcaacagttcaaa

SEQ ID NO: 5859836 - DNA, 21 bp, Homo sapiens
cagctgcatggagcctggaac

SEQ ID NO: 5859837 - DNA, 20 bp, Homo sapiens
cagctgcatggcacatacca

SEQ ID NO: 5859838 - DNA, 17 bp, Homo sapiens
cagctgcattccagagc

SEQ ID NO: 5859839 - DNA, 23 bp, Homo sapiens
cagctgccaagcactcgagacca

SEQ ID NO: 5859840 - DNA, 19 bp, Homo sapiens
cagctgccaagtgctcttt

SEQ ID NO: 5859841 - DNA, 12 bp, Homo sapiens
cagctgccacct

SEQ ID NO: 5859842 - DNA, 14 bp, Homo sapiens
cagctgccagagaa

SEQ ID NO: 5859843 - DNA, 15 bp, Homo sapiens
cagctgccagagaag

SEQ ID NO: 5859844 - DNA, 15 bp, Homo sapiens
cagctgccaggagca

SEQ ID NO: 5859845 - DNA, 19 bp, Homo sapiens
cagctgccaggagcacggc

SEQ ID NO: 5859846 - DNA, 15 bp, Homo sapiens
cagctgccaggcggc

SEQ ID NO: 5859847 - DNA, 21 bp, Homo sapiens
cagctgccagggaagacagag

SEQ ID NO: 5859848 - DNA, 22 bp, Homo sapiens
cagctgccagggaagacagagc

SEQ ID NO: 5859849 - DNA, 24 bp, Homo sapiens
cagctgccagggaagacagagcag

SEQ ID NO: 5859850 - DNA, 15 bp, Homo sapiens
cagctgccagtgtcc

SEQ ID NO: 5859851 - DNA, 16 bp, Homo sapiens
cagctgcccacaagcc

SEQ ID NO: 5859852 - DNA, 11 bp, Homo sapiens
cagctgcccag

SEQ ID NO: 5859853 - DNA, 22 bp, Homo sapiens
cagctgcccagcccctcctccc

SEQ ID NO: 5859854 - DNA, 15 bp, Homo sapiens
cagctgcccatccca

SEQ ID NO: 5859855 - DNA, 20 bp, Homo sapiens
cagctgcccatcccagtccc

SEQ ID NO: 5859856 - DNA, 21 bp, Homo sapiens
cagctgcccatcccagtccct

SEQ ID NO: 5859857 - DNA, 22 bp, Homo sapiens
cagctgcccatcccagtccctc

SEQ ID NO: 5859858 - DNA, 22 bp, Homo sapiens
cagctgcccccagagccacagt

SEQ ID NO: 5859859 - DNA, 20 bp, Homo sapiens
cagctgccccgggatgcgag

SEQ ID NO: 5859860 - DNA, 13 bp, Homo sapiens
cagctgcccctcc

SEQ ID NO: 5859861 - DNA, 23 bp, Homo sapiens
cagctgcccctccctcagggagc

SEQ ID NO: 5859862 - DNA, 19 bp, Homo sapiens
cagctgcccctccctgcca

SEQ ID NO: 5859863 - DNA, 17 bp, Homo sapiens
cagctgcccctcctgga

SEQ ID NO: 5859864 - DNA, 20 bp, Homo sapiens
cagctgcccctcctggagca

SEQ ID NO: 5859865 - DNA, 21 bp, Homo sapiens
cagctgcccctcctggagcag

SEQ ID NO: 5859866 - DNA, 22 bp, Homo sapiens
cagctgcccctcctggagcaga

SEQ ID NO: 5859867 - DNA, 13 bp, Homo sapiens
cagctgcccctgg

SEQ ID NO: 5859868 - DNA, 16 bp, Homo sapiens
cagctgcccctggcac

SEQ ID NO: 5859869 - DNA, 14 bp, Homo sapiens
cagctgccctagct

SEQ ID NO: 5859870 - DNA, 20 bp, Homo sapiens
cagctgccctatgggcctgc

SEQ ID NO: 5859871 - DNA, 18 bp, Homo sapiens
cagctgccctgctgccac

SEQ ID NO: 5859872 - DNA, 15 bp, Homo sapiens
cagctgcccttgcag

SEQ ID NO: 5859873 - DNA, 19 bp, Homo sapiens
cagctgccgaccagagccc

SEQ ID NO: 5859874 - DNA, 22 bp, Homo sapiens
cagctgccggtcgccctttgct

SEQ ID NO: 5859875 - DNA, 17 bp, Homo sapiens
cagctgcctcacttcct

SEQ ID NO: 5859876 - DNA, 11 bp, Homo sapiens
cagctgcctcc

SEQ ID NO: 5859877 - DNA, 15 bp, Homo sapiens
cagctgcctcccctc

SEQ ID NO: 5859878 - DNA, 18 bp, Homo sapiens
cagctgcctcccctcctc

SEQ ID NO: 5859879 - DNA, 19 bp, Homo sapiens
cagctgcctcccctcctct

SEQ ID NO: 5859880 - DNA, 20 bp, Homo sapiens
cagctgcctccgggcctcgg

SEQ ID NO: 5859881 - DNA, 21 bp, Homo sapiens
cagctgcctctgccactgact

SEQ ID NO: 5859882 - DNA, 16 bp, Homo sapiens
cagctgcctctgctcc

SEQ ID NO: 5859883 - DNA, 17 bp, Homo sapiens
cagctgcctctgctccc

SEQ ID NO: 5859884 - DNA, 19 bp, Homo sapiens
cagctgcctctgctccctc

SEQ ID NO: 5859885 - DNA, 11 bp, Homo sapiens
cagctgcctgg

SEQ ID NO: 5859886 - DNA, 14 bp, Homo sapiens
cagctgcctggaga

SEQ ID NO: 5859887 - DNA, 13 bp, Homo sapiens
cagctgcctggcc

SEQ ID NO: 5859888 - DNA, 14 bp, Homo sapiens
cagctgcctggcca

SEQ ID NO: 5859889 - DNA, 19 bp, Homo sapiens
cagctgcctggccatgctg

SEQ ID NO: 5859890 - DNA, 22 bp, Homo sapiens
cagctgcctggccatgctgtcc

SEQ ID NO: 5859891 - DNA, 12 bp, Homo sapiens
cagctgcctggg

SEQ ID NO: 5859892 - DNA, 13 bp, Homo sapiens
cagctgcctgggc

SEQ ID NO: 5859893 - DNA, 15 bp, Homo sapiens
cagctgcctgggccc

SEQ ID NO: 5859894 - DNA, 17 bp, Homo sapiens
cagctgcctggggccca

SEQ ID NO: 5859895 - DNA, 22 bp, Homo sapiens
cagctgcctgtgcctgccatgg

SEQ ID NO: 5859896 - DNA, 15 bp, Homo sapiens
cagctgccttagctt

SEQ ID NO: 5859897 - DNA, 18 bp, Homo sapiens
cagctgccttcctcatcc

SEQ ID NO: 5859898 - DNA, 17 bp, Homo sapiens
cagctgccttcctgggg

SEQ ID NO: 5859899 - DNA, 20 bp, Homo sapiens
cagctgcggcatccctgtgt

SEQ ID NO: 5859900 - DNA, 19 bp, Homo sapiens
cagctgcgggtctgaagga

SEQ ID NO: 5859901 - DNA, 23 bp, Homo sapiens
cagctgcggtccacccaggagcc

SEQ ID NO: 5859902 - DNA, 15 bp, Homo sapiens
cagctgcgttctgag

SEQ ID NO: 5859903 - DNA, 17 bp, Homo sapiens
cagctgcgttctgaggg

SEQ ID NO: 5859904 - DNA, 23 bp, Homo sapiens
cagctgctatccccatctccctg

SEQ ID NO: 5859905 - DNA, 13 bp, Homo sapiens
cagctgctcagaa

SEQ ID NO: 5859906 - DNA, 14 bp, Homo sapiens
cagctgctcagagc

SEQ ID NO: 5859907 - DNA, 12 bp, Homo sapiens
cagctgctccca

SEQ ID NO: 5859908 - DNA, 13 bp, Homo sapiens
cagctgctcccca

SEQ ID NO: 5859909 - DNA, 18 bp, Homo sapiens
cagctgctccccaggcca

SEQ ID NO: 5859910 - DNA, 19 bp, Homo sapiens
cagctgctcccctgccacg

SEQ ID NO: 5859911 - DNA, 16 bp, Homo sapiens
cagctgctcccctgga

SEQ ID NO: 5859912 - DNA, 18 bp, Homo sapiens
cagctgctccctggcatt

SEQ ID NO: 5859913 - DNA, 11 bp, Homo sapiens
cagctgctcct

SEQ ID NO: 5859914 - DNA, 21 bp, Homo sapiens
cagctgctctaagcccaggat

SEQ ID NO: 5859915 - DNA, 12 bp, Homo sapiens
cagctgctctgc

SEQ ID NO: 5859916 - DNA, 14 bp, Homo sapiens
cagctgctctgccc

SEQ ID NO: 5859917 - DNA, 15 bp, Homo sapiens
cagctgctctgcccc

SEQ ID NO: 5859918 - DNA, 16 bp, Homo sapiens
cagctgctctgcccct

SEQ ID NO: 5859919 - DNA, 20 bp, Homo sapiens
cagctgctctgccccttggg

SEQ ID NO: 5859920 - DNA, 21 bp, Homo sapiens
cagctgctctgccccttgggc

SEQ ID NO: 5859921 - DNA, 12 bp, Homo sapiens
cagctgctcttg

SEQ ID NO: 5859922 - DNA, 18 bp, Homo sapiens
cagctgctgaagggaggg

SEQ ID NO: 5859923 - DNA, 17 bp, Homo sapiens
cagctgctgacaatcct

SEQ ID NO: 5859924 - DNA, 12 bp, Homo sapiens
cagctgctgaga

SEQ ID NO: 5859925 - DNA, 16 bp, Homo sapiens
cagctgctgagccgca

SEQ ID NO: 5859926 - DNA, 18 bp, Homo sapiens
cagctgctgagccgcaga

SEQ ID NO: 5859927 - DNA, 14 bp, Homo sapiens
cagctgctgccact

SEQ ID NO: 5859928 - DNA, 16 bp, Homo sapiens
cagctgctgccactct

SEQ ID NO: 5859929 - DNA, 23 bp, Homo sapiens
cagctgctgccactctgctgcct

SEQ ID NO: 5859930 - DNA, 14 bp, Homo sapiens
cagctgctgctctc

SEQ ID NO: 5859931 - DNA, 13 bp, Homo sapiens
cagctgctggaga

SEQ ID NO: 5859932 - DNA, 14 bp, Homo sapiens
cagctgctggagac

SEQ ID NO: 5859933 - DNA, 19 bp, Homo sapiens
cagctgctggagactccta

SEQ ID NO: 5859934 - DNA, 19 bp, Homo sapiens
cagctgctggctgtgacaa

SEQ ID NO: 5859935 - DNA, 13 bp, Homo sapiens
cagctgctgggac

SEQ ID NO: 5859936 - DNA, 20 bp, Homo sapiens
cagctgctgggacccacctc

SEQ ID NO: 5859937 - DNA, 14 bp, Homo sapiens
cagctgctgtctga

SEQ ID NO: 5859938 - DNA, 14 bp, Homo sapiens
cagctgctgtgcca

SEQ ID NO: 5859939 - DNA, 13 bp, Homo sapiens
cagctgctgtggg

SEQ ID NO: 5859940 - DNA, 20 bp, Homo sapiens
cagcttctctctccctgtca

SEQ ID NO: 5859941 - DNA, 12 bp, Homo sapiens
cagcttctctgc

SEQ ID NO: 5859942 - DNA, 23 bp, Homo sapiens
cagcttctctgctagatttctac

SEQ ID NO: 5859943 - DNA, 11 bp, Homo sapiens
cagcttctgcc

SEQ ID NO: 5859944 - DNA, 19 bp, Homo sapiens
cagcttctgccacataaaa

SEQ ID NO: 5859945 - DNA, 15 bp, Homo sapiens
cagcttctgccactt

SEQ ID NO: 5859946 - DNA, 23 bp, Homo sapiens
cagcttctgccacttcccaggta

SEQ ID NO: 5859947 - DNA, 14 bp, Homo sapiens
cagcttctggagca

SEQ ID NO: 5859948 - DNA, 21 bp, Homo sapiens
cagcttctggagcagaacttt

SEQ ID NO: 5859949 - DNA, 21 bp, Homo sapiens
cagcttctggtactctcctag

SEQ ID NO: 5859950 - DNA, 19 bp, Homo sapiens
cagcttcttcacaggcact

SEQ ID NO: 5859951 - DNA, 14 bp, Homo sapiens
cagcttcttcatct

SEQ ID NO: 5859952 - DNA, 15 bp, Homo sapiens
cagcttcttcatctt

SEQ ID NO: 5859953 - DNA, 17 bp, Homo sapiens
cagcttcttcctaggtc

SEQ ID NO: 5859954 - DNA, 24 bp, Homo sapiens
cagcttcttgcactccttccctaa

SEQ ID NO: 5859955 - DNA, 14 bp, Homo sapiens
cagcttcttgggct

SEQ ID NO: 5859956 - DNA, 14 bp, Homo sapiens
cagcttctttctcg

SEQ ID NO: 5859957 - DNA, 15 bp, Homo sapiens
cagcttcttttgcca

SEQ ID NO: 5859958 - DNA, 20 bp, Homo sapiens
cagcttcttttgtctcccag

SEQ ID NO: 5859959 - DNA, 16 bp, Homo sapiens
cagcttgaacctgctt

SEQ ID NO: 5859960 - DNA, 23 bp, Homo sapiens
cagcttgaacctgcttcctggct

SEQ ID NO: 5859961 - DNA, 21 bp, Homo sapiens
cagcttgacattatgttttat

SEQ ID NO: 5859962 - DNA, 22 bp, Homo sapiens
cagcttgacattatgttttatt

SEQ ID NO: 5859963 - DNA, 16 bp, Homo sapiens
cagcttgaccagacct

SEQ ID NO: 5859964 - DNA, 17 bp, Homo sapiens
cagcttgaccagaccta

SEQ ID NO: 5859965 - DNA, 18 bp, Homo sapiens
cagcttgaccagacctag

SEQ ID NO: 5859966 - DNA, 21 bp, Homo sapiens
cagcttgacctgaggctgtgg

SEQ ID NO: 5859967 - DNA, 21 bp, Homo sapiens
cagcttgactctactcccagc

SEQ ID NO: 5859968 - DNA, 22 bp, Homo sapiens
cagcttgagccgggcccctggg

SEQ ID NO: 5859969 - DNA, 15 bp, Homo sapiens
cagcttgagggttgg

SEQ ID NO: 5859970 - DNA, 18 bp, Homo sapiens
cagcttgagggttgggct

SEQ ID NO: 5859971 - DNA, 19 bp, Homo sapiens
cagcttgagggttgggctg

SEQ ID NO: 5859972 - DNA, 21 bp, Homo sapiens
cagcttgagggttgggctggt

SEQ ID NO: 5859973 - DNA, 12 bp, Homo sapiens
cagcttgagttt

SEQ ID NO: 5859974 - DNA, 18 bp, Homo sapiens
cagcttgcacatttggta

SEQ ID NO: 5859975 - DNA, 14 bp, Homo sapiens
cagcttgccaggga

SEQ ID NO: 5859976 - DNA, 15 bp, Homo sapiens
cagcttgcccccgct

SEQ ID NO: 5859977 - DNA, 23 bp, Homo sapiens
cagcttgctcttcagtgggagaa

SEQ ID NO: 5859978 - DNA, 16 bp, Homo sapiens
cagcttgctgggcttt

SEQ ID NO: 5859979 - DNA, 21 bp, Homo sapiens
cagcttgctgggctttgggaa

SEQ ID NO: 5859980 - DNA, 22 bp, Homo sapiens
cagcttgctgggctttgggaag

SEQ ID NO: 5859981 - DNA, 23 bp, Homo sapiens
cagcttgctgggctttgggaagt

SEQ ID NO: 5859982 - DNA, 14 bp, Homo sapiens
cagcttgcttctct

SEQ ID NO: 5859983 - DNA, 15 bp, Homo sapiens
cagcttggacatcag

SEQ ID NO: 5859984 - DNA, 16 bp, Homo sapiens
cagcttggacatcagt

SEQ ID NO: 5859985 - DNA, 19 bp, Homo sapiens
cagcttggacatcagtgtt

SEQ ID NO: 5859986 - DNA, 15 bp, Homo sapiens
cagcttggagacagg

SEQ ID NO: 5859987 - DNA, 14 bp, Homo sapiens
cagcttggagtgcc

SEQ ID NO: 5859988 - DNA, 17 bp, Homo sapiens
cagcttggagtgccaca

SEQ ID NO: 5859989 - DNA, 12 bp, Homo sapiens
cagcttggctca

SEQ ID NO: 5859990 - DNA, 21 bp, Homo sapiens
cagcttggctcacaaggccca

SEQ ID NO: 5859991 - DNA, 23 bp, Homo sapiens
cagcttggctcacaaggcccagg

SEQ ID NO: 5859992 - DNA, 12 bp, Homo sapiens
cagcttggctga

SEQ ID NO: 5859993 - DNA, 15 bp, Homo sapiens
cagcttggctgagcc

SEQ ID NO: 5859994 - DNA, 14 bp, Homo sapiens
cagcttgggagagc

SEQ ID NO: 5859995 - DNA, 23 bp, Homo sapiens
cagcttgggagagcccctggggc

SEQ ID NO: 5859996 - DNA, 16 bp, Homo sapiens
cagcttgggcccagct

SEQ ID NO: 5859997 - DNA, 23 bp, Homo sapiens
cagcttgggcccagctgggctct

SEQ ID NO: 5859998 - DNA, 21 bp, Homo sapiens
cagcttggggccaccaaagct

SEQ ID NO: 5859999 - DNA, 17 bp, Homo sapiens
cagcttggggccatcgg

SEQ ID NO: 5860000 - DNA, 18 bp, Homo sapiens
cagcttgggtcaggttct

SEQ ID NO: 5860001 - DNA, 18 bp, Homo sapiens
cagcttgtaaatagctca

SEQ ID NO: 5860002 - DNA, 22 bp, Homo sapiens
cagcttgtaaatagctcaggtg

SEQ ID NO: 5860003 - DNA, 16 bp, Homo sapiens
cagcttgtagccagcc

SEQ ID NO: 5860004 - DNA, 18 bp, Homo sapiens
cagcttgtagccagccgg

SEQ ID NO: 5860005 - DNA, 19 bp, Homo sapiens
cagcttgtagccagccggg

SEQ ID NO: 5860006 - DNA, 15 bp, Homo sapiens
cagcttgtaggagct

SEQ ID NO: 5860007 - DNA, 19 bp, Homo sapiens
cagcttgtatgcaatggat

SEQ ID NO: 5860008 - DNA, 13 bp, Homo sapiens
cagcttgtatttt

SEQ ID NO: 5860009 - DNA, 23 bp, Homo sapiens
cagcttgtccaacaactccagga

SEQ ID NO: 5860010 - DNA, 15 bp, Homo sapiens
cagcttgtccttgct

SEQ ID NO: 5860011 - DNA, 20 bp, Homo sapiens
cagcttgtccttgctcctgg

SEQ ID NO: 5860012 - DNA, 21 bp, Homo sapiens
cagcttgtccttgctcctgga

SEQ ID NO: 5860013 - DNA, 16 bp, Homo sapiens
cagcttgtctcttgcc

SEQ ID NO: 5860014 - DNA, 20 bp, Homo sapiens
cagcttgtctcttgcctgcc

SEQ ID NO: 5860015 - DNA, 13 bp, Homo sapiens
cagcttgtgaatg

SEQ ID NO: 5860016 - DNA, 22 bp, Homo sapiens
cagcttgtgattcctacccctc

SEQ ID NO: 5860017 - DNA, 13 bp, Homo sapiens
cagcttgtgcctt

SEQ ID NO: 5860018 - DNA, 19 bp, Homo sapiens
cagcttgtgctgagcctgc

SEQ ID NO: 5860019 - DNA, 22 bp, Homo sapiens
cagcttgtgctgagcctgccca

SEQ ID NO: 5860020 - DNA, 17 bp, Homo sapiens
cagcttgtggagcccca

SEQ ID NO: 5860021 - DNA, 20 bp, Homo sapiens
cagcttgtggcaagtgaatt

SEQ ID NO: 5860022 - DNA, 15 bp, Homo sapiens
cagcttgtgttgtca

SEQ ID NO: 5860023 - DNA, 17 bp, Homo sapiens
cagcttgttatttataa

SEQ ID NO: 5860024 - DNA, 18 bp, Homo sapiens
cagcttgtttacatgctt

SEQ ID NO: 5860025 - DNA, 15 bp, Homo sapiens
cagctttaaaaaaat

SEQ ID NO: 5860026 - DNA, 20 bp, Homo sapiens
cagctttaaccattaaaact

SEQ ID NO: 5860027 - DNA, 22 bp, Homo sapiens
cagctttactgccttcctcctt

SEQ ID NO: 5860028 - DNA, 14 bp, Homo sapiens
cagctttagccaag

SEQ ID NO: 5860029 - DNA, 19 bp, Homo sapiens
cagctttaggggtggtggg

SEQ ID NO: 5860030 - DNA, 20 bp, Homo sapiens
cagctttataataaactgtt

SEQ ID NO: 5860031 - DNA, 22 bp, Homo sapiens
cagctttataataaactgttta

SEQ ID NO: 5860032 - DNA, 23 bp, Homo sapiens
cagctttataataaactgtttaa

SEQ ID NO: 5860033 - DNA, 18 bp, Homo sapiens
cagctttatctgtcacac

SEQ ID NO: 5860034 - DNA, 11 bp, Homo sapiens
cagctttattt

SEQ ID NO: 5860035 - DNA, 19 bp, Homo sapiens
cagctttattttaaatgtg

SEQ ID NO: 5860036 - DNA, 20 bp, Homo sapiens
cagctttatttttctttaaa

SEQ ID NO: 5860037 - DNA, 16 bp, Homo sapiens
cagctttccatctgag

SEQ ID NO: 5860038 - DNA, 17 bp, Homo sapiens
cagctttccctccccag

SEQ ID NO: 5860039 - DNA, 15 bp, Homo sapiens
cagctttccctgcca

SEQ ID NO: 5860040 - DNA, 18 bp, Homo sapiens
cagctttccctgccaggc

SEQ ID NO: 5860041 - DNA, 15 bp, Homo sapiens
cagctttccctggct

SEQ ID NO: 5860042 - DNA, 18 bp, Homo sapiens
cagctttccctggctcag

SEQ ID NO: 5860043 - DNA, 19 bp, Homo sapiens
cagctttccctggctcagg

SEQ ID NO: 5860044 - DNA, 23 bp, Homo sapiens
cagctttcctcaaaaagcagaag

SEQ ID NO: 5860045 - DNA, 14 bp, Homo sapiens
cagctttcctgtat

SEQ ID NO: 5860046 - DNA, 18 bp, Homo sapiens
cagctttccttctgccct

SEQ ID NO: 5860047 - DNA, 22 bp, Homo sapiens
cagctttctgaccttcagctca

SEQ ID NO: 5860048 - DNA, 21 bp, Homo sapiens
cagctttctgcagactggcag

SEQ ID NO: 5860049 - DNA, 15 bp, Homo sapiens
cagctttctgggatg

SEQ ID NO: 5860050 - DNA, 21 bp, Homo sapiens
cagctttctgggatgtcacag

SEQ ID NO: 5860051 - DNA, 19 bp, Homo sapiens
cagctttcttgctcccttc

SEQ ID NO: 5860052 - DNA, 15 bp, Homo sapiens
cagctttgaaggctg

SEQ ID NO: 5860053 - DNA, 19 bp, Homo sapiens
cagctttgacgtattatct

SEQ ID NO: 5860054 - DNA, 22 bp, Homo sapiens
cagctttgactttatctcctgc

SEQ ID NO: 5860055 - DNA, 16 bp, Homo sapiens
cagctttgaggctggc

SEQ ID NO: 5860056 - DNA, 23 bp, Homo sapiens
cagctttgaggttgacctgtttc

SEQ ID NO: 5860057 - DNA, 14 bp, Homo sapiens
cagctttgatattt

SEQ ID NO: 5860058 - DNA, 13 bp, Homo sapiens
cagctttgccctc

SEQ ID NO: 5860059 - DNA, 15 bp, Homo sapiens
cagctttgccttcca

SEQ ID NO: 5860060 - DNA, 21 bp, Homo sapiens
cagctttgctcatatttccca

SEQ ID NO: 5860061 - DNA, 22 bp, Homo sapiens
cagctttggattgctggggcca

SEQ ID NO: 5860062 - DNA, 14 bp, Homo sapiens
cagctttggctgca

SEQ ID NO: 5860063 - DNA, 15 bp, Homo sapiens
cagctttgggaaagc

SEQ ID NO: 5860064 - DNA, 11 bp, Homo sapiens
cagctttgtct

SEQ ID NO: 5860065 - DNA, 19 bp, Homo sapiens
cagctttgtgactgtatat

SEQ ID NO: 5860066 - DNA, 12 bp, Homo sapiens
cagctttgtttg

SEQ ID NO: 5860067 - DNA, 18 bp, Homo sapiens
cagcttttaaaagatttt

SEQ ID NO: 5860068 - DNA, 15 bp, Homo sapiens
cagcttttaaccatc

SEQ ID NO: 5860069 - DNA, 21 bp, Homo sapiens
cagcttttaaccatctgatat

SEQ ID NO: 5860070 - DNA, 15 bp, Homo sapiens
cagcttttaataaaa

SEQ ID NO: 5860071 - DNA, 21 bp, Homo sapiens
cagcttttaataaaattgaca

SEQ ID NO: 5860072 - DNA, 23 bp, Homo sapiens
cagcttttacgtagtaaaagtca

SEQ ID NO: 5860073 - DNA, 19 bp, Homo sapiens
cagcttttagtacccacct

SEQ ID NO: 5860074 - DNA, 21 bp, Homo sapiens
cagcttttagtacccacctga

SEQ ID NO: 5860075 - DNA, 13 bp, Homo sapiens
cagcttttccaaa

SEQ ID NO: 5860076 - DNA, 15 bp, Homo sapiens
cagcttttcccagga

SEQ ID NO: 5860077 - DNA, 16 bp, Homo sapiens
cagcttttcctcaggg

SEQ ID NO: 5860078 - DNA, 17 bp, Homo sapiens
cagcttttcctgggaca

SEQ ID NO: 5860079 - DNA, 15 bp, Homo sapiens
cagcttttctgtccc

SEQ ID NO: 5860080 - DNA, 21 bp, Homo sapiens
cagcttttcttattccttttt

SEQ ID NO: 5860081 - DNA, 12 bp, Homo sapiens
cagcttttcttg

SEQ ID NO: 5860082 - DNA, 17 bp, Homo sapiens
cagcttttcttgccagc

SEQ ID NO: 5860083 - DNA, 21 bp, Homo sapiens
cagcttttcttgccagctcag

SEQ ID NO: 5860084 - DNA, 18 bp, Homo sapiens
cagcttttgatggtactg

SEQ ID NO: 5860085 - DNA, 17 bp, Homo sapiens
cagcttttgcagaagca

SEQ ID NO: 5860086 - DNA, 20 bp, Homo sapiens
cagcttttgccttggttctt

SEQ ID NO: 5860087 - DNA, 15 bp, Homo sapiens
cagcttttgcttcat

SEQ ID NO: 5860088 - DNA, 14 bp, Homo sapiens
cagcttttggtctc

SEQ ID NO: 5860089 - DNA, 15 bp, Homo sapiens
cagcttttggtctcc

SEQ ID NO: 5860090 - DNA, 22 bp, Homo sapiens
cagcttttggtctccttgggcc

SEQ ID NO: 5860091 - DNA, 14 bp, Homo sapiens
cagcttttgttcta

SEQ ID NO: 5860092 - DNA, 21 bp, Homo sapiens
cagcttttgttctagacttcc

SEQ ID NO: 5860093 - DNA, 17 bp, Homo sapiens
cagctttttaccaagtt

SEQ ID NO: 5860094 - DNA, 16 bp, Homo sapiens
cagctttttctctcag

SEQ ID NO: 5860095 - DNA, 17 bp, Homo sapiens
cagctttttctctcagg

SEQ ID NO: 5860096 - DNA, 22 bp, Homo sapiens
cagctttttgatcctctactgt

SEQ ID NO: 5860097 - DNA, 19 bp, Homo sapiens
cagctttttgtcttttctg

SEQ ID NO: 5860098 - DNA, 21 bp, Homo sapiens
caggaaaaaaaaaaaaaagac

SEQ ID NO: 5860099 - DNA, 18 bp, Homo sapiens
caggaaaaaaaataatgt

SEQ ID NO: 5860100 - DNA, 18 bp, Homo sapiens
caggaaaaaaaattctgt

SEQ ID NO: 5860101 - DNA, 19 bp, Homo sapiens
caggaaaaaaaattctgtt

SEQ ID NO: 5860102 - DNA, 20 bp, Homo sapiens
caggaaaaaaaattctgttg

SEQ ID NO: 5860103 - DNA, 16 bp, Homo sapiens
caggaaaaaaactttt

SEQ ID NO: 5860104 - DNA, 13 bp, Homo sapiens
caggaaaaaataa

SEQ ID NO: 5860105 - DNA, 14 bp, Homo sapiens
caggaaaaaccaac

SEQ ID NO: 5860106 - DNA, 15 bp, Homo sapiens
caggaaaaacctgtg

SEQ ID NO: 5860107 - DNA, 17 bp, Homo sapiens
caggaaaaacctgtggg

SEQ ID NO: 5860108 - DNA, 14 bp, Homo sapiens
caggaaaaaggaca

SEQ ID NO: 5860109 - DNA, 16 bp, Homo sapiens
caggaaaaaggacagg

SEQ ID NO: 5860110 - DNA, 22 bp, Homo sapiens
caggaaaaaggacaggcagaaa

SEQ ID NO: 5860111 - DNA, 17 bp, Homo sapiens
caggaaaaatgaggaat

SEQ ID NO: 5860112 - DNA, 20 bp, Homo sapiens
caggaaaactgacagaggag

SEQ ID NO: 5860113 - DNA, 17 bp, Homo sapiens
caggaaaactgggacat

SEQ ID NO: 5860114 - DNA, 18 bp, Homo sapiens
caggaaaactgtttttca

SEQ ID NO: 5860115 - DNA, 14 bp, Homo sapiens
caggaaaagaaaaa

SEQ ID NO: 5860116 - DNA, 16 bp, Homo sapiens
caggagacctccagct

SEQ ID NO: 5860117 - DNA, 17 bp, Homo sapiens
caggagacctgctctcc

SEQ ID NO: 5860118 - DNA, 20 bp, Homo sapiens
caggagactccaaggagcta

SEQ ID NO: 5860119 - DNA, 22 bp, Homo sapiens
caggagactggcgtgaacccag

SEQ ID NO: 5860120 - DNA, 23 bp, Homo sapiens
caggagactggcgtgaacccagg

SEQ ID NO: 5860121 - DNA, 14 bp, Homo sapiens
caggagagaaaggg

SEQ ID NO: 5860122 - DNA, 12 bp, Homo sapiens
caggagagagaa

SEQ ID NO: 5860123 - DNA, 18 bp, Homo sapiens
caggagagagaaagccag

SEQ ID NO: 5860124 - DNA, 22 bp, Homo sapiens
caggagagagagagagaaagaa

SEQ ID NO: 5860125 - DNA, 20 bp, Homo sapiens
caggagagagatctagaaag

SEQ ID NO: 5860126 - DNA, 19 bp, Homo sapiens
caggagagagcttcctgtt

SEQ ID NO: 5860127 - DNA, 22 bp, Homo sapiens
caggagagaggctctggggcag

SEQ ID NO: 5860128 - DNA, 14 bp, Homo sapiens
caggagagagtcta

SEQ ID NO: 5860129 - DNA, 20 bp, Homo sapiens
caggagagattatttacaag

SEQ ID NO: 5860130 - DNA, 15 bp, Homo sapiens
caggagagcatcacc

SEQ ID NO: 5860131 - DNA, 15 bp, Homo sapiens
caggagagccagccc

SEQ ID NO: 5860132 - DNA, 19 bp, Homo sapiens
caggagagccagccctccc

SEQ ID NO: 5860133 - DNA, 22 bp, Homo sapiens
caggagagcccccaccagcagc

SEQ ID NO: 5860134 - DNA, 14 bp, Homo sapiens
caggagagcctggg

SEQ ID NO: 5860135 - DNA, 16 bp, Homo sapiens
caggagagcctggggg

SEQ ID NO: 5860136 - DNA, 16 bp, Homo sapiens
caggagagcttagggt

SEQ ID NO: 5860137 - DNA, 23 bp, Homo sapiens
caggagaggaagatttgtctact

SEQ ID NO: 5860138 - DNA, 15 bp, Homo sapiens
caggagaggagagcc

SEQ ID NO: 5860139 - DNA, 19 bp, Homo sapiens
caggagaggagagccagag

SEQ ID NO: 5860140 - DNA, 20 bp, Homo sapiens
caggagaggagcgggacctg

SEQ ID NO: 5860141 - DNA, 13 bp, Homo sapiens
caggagaggcagc

SEQ ID NO: 5860142 - DNA, 21 bp, Homo sapiens
caggagaggcagcatgcttgg

SEQ ID NO: 5860143 - DNA, 12 bp, Homo sapiens
caggagaggctg

SEQ ID NO: 5860144 - DNA, 13 bp, Homo sapiens
caggagaggctgg

SEQ ID NO: 5860145 - DNA, 18 bp, Homo sapiens
caggagaggctgggctgg

SEQ ID NO: 5860146 - DNA, 18 bp, Homo sapiens
caggagagggatacaaga

SEQ ID NO: 5860147 - DNA, 17 bp, Homo sapiens
caggagagggccttccc

SEQ ID NO: 5860148 - DNA, 22 bp, Homo sapiens
caggagagggccttcccctccc

SEQ ID NO: 5860149 - DNA, 15 bp, Homo sapiens
caggagaggggcaga

SEQ ID NO: 5860150 - DNA, 17 bp, Homo sapiens
caggagaggggcagaac

SEQ ID NO: 5860151 - DNA, 24 bp, Homo sapiens
caggagagtaaaaattcatataaa

SEQ ID NO: 5860152 - DNA, 22 bp, Homo sapiens
caggagagtgcagatctgtgct

SEQ ID NO: 5860153 - DNA, 20 bp, Homo sapiens
caggagagtgtgtgggcagg

SEQ ID NO: 5860154 - DNA, 21 bp, Homo sapiens
caggagagtgtgtgggcaggg

SEQ ID NO: 5860155 - DNA, 20 bp, Homo sapiens
caggagatcagtaattacaa

SEQ ID NO: 5860156 - DNA, 22 bp, Homo sapiens
caggagatcgagaccatcctgg

SEQ ID NO: 5860157 - DNA, 24 bp, Homo sapiens
caggagatcgagaccgccctggct

SEQ ID NO: 5860158 - DNA, 17 bp, Homo sapiens
caggagatgatgtgatg

SEQ ID NO: 5860159 - DNA, 17 bp, Homo sapiens
caggagatgctgtgccc

SEQ ID NO: 5860160 - DNA, 19 bp, Homo sapiens
caggagatgctgtgcccct

SEQ ID NO: 5860161 - DNA, 14 bp, Homo sapiens
caggagatggaggg

SEQ ID NO: 5860162 - DNA, 16 bp, Homo sapiens
caggagatggagggct

SEQ ID NO: 5860163 - DNA, 15 bp, Homo sapiens
caggagatggggaat

SEQ ID NO: 5860164 - DNA, 18 bp, Homo sapiens
caggagatgggtccaggg

SEQ ID NO: 5860165 - DNA, 20 bp, Homo sapiens
caggagatgggtccaggggt

SEQ ID NO: 5860166 - DNA, 19 bp, Homo sapiens
caggagattgagaaggaga

SEQ ID NO: 5860167 - DNA, 22 bp, Homo sapiens
caggagattgagaaggagagaa

SEQ ID NO: 5860168 - DNA, 21 bp, Homo sapiens
caggagattggatttgctgtg

SEQ ID NO: 5860169 - DNA, 19 bp, Homo sapiens
caggagcaaatgtttctgc

SEQ ID NO: 5860170 - DNA, 15 bp, Homo sapiens
caggagcaacagcct

SEQ ID NO: 5860171 - DNA, 20 bp, Homo sapiens
caggagcaaccgtgcagcca

SEQ ID NO: 5860172 - DNA, 21 bp, Homo sapiens
caggagcaaggctgccctgtc

SEQ ID NO: 5860173 - DNA, 19 bp, Homo sapiens
caggagcaagtgaggccgg

SEQ ID NO: 5860174 - DNA, 16 bp, Homo sapiens
caggagcacacccagc

SEQ ID NO: 5860175 - DNA, 18 bp, Homo sapiens
caggagcacacggccctg

SEQ ID NO: 5860176 - DNA, 20 bp, Homo sapiens
caggagcacacggccctgcc

SEQ ID NO: 5860177 - DNA, 21 bp, Homo sapiens
caggagcacacggccctgccc

SEQ ID NO: 5860178 - DNA, 17 bp, Homo sapiens
caggagcacaggcagct

SEQ ID NO: 5860179 - DNA, 23 bp, Homo sapiens
caggagcacaggcagctggatga

SEQ ID NO: 5860180 - DNA, 19 bp, Homo sapiens
caggagcacctggaccccc

SEQ ID NO: 5860181 - DNA, 13 bp, Homo sapiens
caggagcagaaga

SEQ ID NO: 5860182 - DNA, 17 bp, Homo sapiens
caggagcagacagagaa

SEQ ID NO: 5860183 - DNA, 17 bp, Homo sapiens
caggagcagatggacag

SEQ ID NO: 5860184 - DNA, 14 bp, Homo sapiens
caggagcagccaca

SEQ ID NO: 5860185 - DNA, 23 bp, Homo sapiens
caggagcagcctcagaacaaagt

SEQ ID NO: 5860186 - DNA, 11 bp, Homo sapiens
caggagcagct

SEQ ID NO: 5860187 - DNA, 16 bp, Homo sapiens
caggagcagctggcac

SEQ ID NO: 5860188 - DNA, 18 bp, Homo sapiens
caggagcagctggcactg

SEQ ID NO: 5860189 - DNA, 21 bp, Homo sapiens
caggagcagctggcactgaca

SEQ ID NO: 5860190 - DNA, 13 bp, Homo sapiens
caggagcagctgt

SEQ ID NO: 5860191 - DNA, 21 bp, Homo sapiens
caggagcagctgtgctgcacc

SEQ ID NO: 5860192 - DNA, 12 bp, Homo sapiens
caggagcagctt

SEQ ID NO: 5860193 - DNA, 19 bp, Homo sapiens
caggagcagcttttggtct

SEQ ID NO: 5860194 - DNA, 21 bp, Homo sapiens
caggagcagcttttggtctcc

SEQ ID NO: 5860195 - DNA, 17 bp, Homo sapiens
caggagcaggaacagag

SEQ ID NO: 5860196 - DNA, 18 bp, Homo sapiens
caggagcaggaacagaga

SEQ ID NO: 5860197 - DNA, 19 bp, Homo sapiens
caggagcaggaacagagac

SEQ ID NO: 5860198 - DNA, 21 bp, Homo sapiens
caggagcaggaacagagactc

SEQ ID NO: 5860199 - DNA, 23 bp, Homo sapiens
caggagcaggaacagagactctg

SEQ ID NO: 5860200 - DNA, 19 bp, Homo sapiens
caggagcagggcggctgcc

SEQ ID NO: 5860201 - DNA, 16 bp, Homo sapiens
caggagcagtatcatg

SEQ ID NO: 5860202 - DNA, 21 bp, Homo sapiens
caggagcatagaagccacatc

SEQ ID NO: 5860203 - DNA, 22 bp, Homo sapiens
caggagcatccacctccttctc

SEQ ID NO: 5860204 - DNA, 11 bp, Homo sapiens
caggagccagc

SEQ ID NO: 5860205 - DNA, 12 bp, Homo sapiens
caggagccagca

SEQ ID NO: 5860206 - DNA, 13 bp, Homo sapiens
caggagccagcag

SEQ ID NO: 5860207 - DNA, 22 bp, Homo sapiens
caggagccagcagggcgggcca

SEQ ID NO: 5860208 - DNA, 23 bp, Homo sapiens
caggagccagcagggcgggccag

SEQ ID NO: 5860209 - DNA, 15 bp, Homo sapiens
caggagccagcctgc

SEQ ID NO: 5860210 - DNA, 13 bp, Homo sapiens
caggagcccagag

SEQ ID NO: 5860211 - DNA, 11 bp, Homo sapiens
caggagcccat

SEQ ID NO: 5860212 - DNA, 12 bp, Homo sapiens
caggagcccatt

SEQ ID NO: 5860213 - DNA, 23 bp, Homo sapiens
caggagcccatttggagggcctg

SEQ ID NO: 5860214 - DNA, 12 bp, Homo sapiens
caggagccccag

SEQ ID NO: 5860215 - DNA, 16 bp, Homo sapiens
caggagccccagccag

SEQ ID NO: 5860216 - DNA, 18 bp, Homo sapiens
caggagccccagccagcc

SEQ ID NO: 5860217 - DNA, 21 bp, Homo sapiens
caggagccccagccagccctt

SEQ ID NO: 5860218 - DNA, 22 bp, Homo sapiens
caggagcccccagctgccaaag

SEQ ID NO: 5860219 - DNA, 18 bp, Homo sapiens
caggagccccgaggcctt

SEQ ID NO: 5860220 - DNA, 20 bp, Homo sapiens
caggagccccgaggccttct

SEQ ID NO: 5860221 - DNA, 18 bp, Homo sapiens
caggagccccgccaggtg

SEQ ID NO: 5860222 - DNA, 21 bp, Homo sapiens
caggagccccgccaggtgccc

SEQ ID NO: 5860223 - DNA, 14 bp, Homo sapiens
caggagcccctggg

SEQ ID NO: 5860224 - DNA, 11 bp, Homo sapiens
caggagcccta

SEQ ID NO: 5860225 - DNA, 24 bp, Homo sapiens
caggagccctactgaagggaacag

SEQ ID NO: 5860226 - DNA, 14 bp, Homo sapiens
caggagccctggga

SEQ ID NO: 5860227 - DNA, 16 bp, Homo sapiens
caggagccctgggagg

SEQ ID NO: 5860228 - DNA, 18 bp, Homo sapiens
caggagccctgggaggct

SEQ ID NO: 5860229 - DNA, 17 bp, Homo sapiens
caggagccgaagcccag

SEQ ID NO: 5860230 - DNA, 18 bp, Homo sapiens
caggagccgaagcccagg

SEQ ID NO: 5860231 - DNA, 21 bp, Homo sapiens
caggagccgaagcccaggggc

SEQ ID NO: 5860232 - DNA, 16 bp, Homo sapiens
caggagccgcagaggc

SEQ ID NO: 5860233 - DNA, 17 bp, Homo sapiens
caggagccgcagaggcc

SEQ ID NO: 5860234 - DNA, 19 bp, Homo sapiens
caggagccgcagaggcccg

SEQ ID NO: 5860235 - DNA, 22 bp, Homo sapiens
caggagccggacacttctcagg

SEQ ID NO: 5860236 - DNA, 16 bp, Homo sapiens
caggagccgggcctcc

SEQ ID NO: 5860237 - DNA, 17 bp, Homo sapiens
caggagccgggcctccc

SEQ ID NO: 5860238 - DNA, 16 bp, Homo sapiens
caggagcctagaggag

SEQ ID NO: 5860239 - DNA, 12 bp, Homo sapiens
caggagcctagc

SEQ ID NO: 5860240 - DNA, 18 bp, Homo sapiens
caggagcctagcggagcc

SEQ ID NO: 5860241 - DNA, 22 bp, Homo sapiens
caggagcctagcggagcccagc

SEQ ID NO: 5860242 - DNA, 15 bp, Homo sapiens
caggagcctcatcca

SEQ ID NO: 5860243 - DNA, 20 bp, Homo sapiens
caggagcctcatccagcctc

SEQ ID NO: 5860244 - DNA, 16 bp, Homo sapiens
caggagcctccctgca

SEQ ID NO: 5860245 - DNA, 23 bp, Homo sapiens
caggagcctcgtgtcctgctagc

SEQ ID NO: 5860246 - DNA, 14 bp, Homo sapiens
caggagcctgctaa

SEQ ID NO: 5860247 - DNA, 17 bp, Homo sapiens
caggagcctgctaagga

SEQ ID NO: 5860248 - DNA, 22 bp, Homo sapiens
caggagcctgctaaggaacaat

SEQ ID NO: 5860249 - DNA, 15 bp, Homo sapiens
caggagcctggaggg

SEQ ID NO: 5860250 - DNA, 14 bp, Homo sapiens
caggagcctggcca

SEQ ID NO: 5860251 - DNA, 20 bp, Homo sapiens
caggagcctggccaggcagg

SEQ ID NO: 5860252 - DNA, 19 bp, Homo sapiens
caggagcctggtccttccc

SEQ ID NO: 5860253 - DNA, 11 bp, Homo sapiens
caggagcctgt

SEQ ID NO: 5860254 - DNA, 24 bp, Homo sapiens
caggagccttcctttctcctgccc

SEQ ID NO: 5860255 - DNA, 16 bp, Homo sapiens
caggagcgcaagatag

SEQ ID NO: 5860256 - DNA, 13 bp, Homo sapiens
caggagcgcatct

SEQ ID NO: 5860257 - DNA, 15 bp, Homo sapiens
caggagcgcatctca

SEQ ID NO: 5860258 - DNA, 16 bp, Homo sapiens
caggagcgctcccttg

SEQ ID NO: 5860259 - DNA, 14 bp, Homo sapiens
caggagcgtgaagg

SEQ ID NO: 5860260 - DNA, 16 bp, Homo sapiens
caggagcgtgaaggac

SEQ ID NO: 5860261 - DNA, 19 bp, Homo sapiens
caggagcgtgaaggactta

SEQ ID NO: 5860262 - DNA, 14 bp, Homo sapiens
caggagcgtgtact

SEQ ID NO: 5860263 - DNA, 16 bp, Homo sapiens
caggagcgtgtcctat

SEQ ID NO: 5860264 - DNA, 20 bp, Homo sapiens
caggagctactgagaacata

SEQ ID NO: 5860265 - DNA, 13 bp, Homo sapiens
caggagctcacac

SEQ ID NO: 5860266 - DNA, 15 bp, Homo sapiens
caggagctcaggaag

SEQ ID NO: 5860267 - DNA, 14 bp, Homo sapiens
caggagctcccctc

SEQ ID NO: 5860268 - DNA, 21 bp, Homo sapiens
caggagctcccctccccaact

SEQ ID NO: 5860269 - DNA, 15 bp, Homo sapiens
caggagctctctgct

SEQ ID NO: 5860270 - DNA, 19 bp, Homo sapiens
caggagctctctgctgagc

SEQ ID NO: 5860271 - DNA, 21 bp, Homo sapiens
caggagctctctgctgagcag

SEQ ID NO: 5860272 - DNA, 15 bp, Homo sapiens
caggagctctgcgcc

SEQ ID NO: 5860273 - DNA, 17 bp, Homo sapiens
caggagctctgcgccag

SEQ ID NO: 5860274 - DNA, 19 bp, Homo sapiens
caggagctctgcgccaggc

SEQ ID NO: 5860275 - DNA, 20 bp, Homo sapiens
caggagctctgcgccaggca

SEQ ID NO: 5860276 - DNA, 19 bp, Homo sapiens
caggagctcttcaggcctc

SEQ ID NO: 5860277 - DNA, 20 bp, Homo sapiens
caggagctgacagagccaga

SEQ ID NO: 5860278 - DNA, 22 bp, Homo sapiens
caggagctgacagagccagagg

SEQ ID NO: 5860279 - DNA, 21 bp, Homo sapiens
caggagctgagtcacctcctc

SEQ ID NO: 5860280 - DNA, 15 bp, Homo sapiens
caggagctgatggca

SEQ ID NO: 5860281 - DNA, 16 bp, Homo sapiens
caggagctgctcctgg

SEQ ID NO: 5860282 - DNA, 14 bp, Homo sapiens
caggagctggagga

SEQ ID NO: 5860283 - DNA, 22 bp, Homo sapiens
caggagctgggatcctaagggc

SEQ ID NO: 5860284 - DNA, 12 bp, Homo sapiens
caggagctgggc

SEQ ID NO: 5860285 - DNA, 15 bp, Homo sapiens
caggagcttcaatga

SEQ ID NO: 5860286 - DNA, 15 bp, Homo sapiens
caggagcttcttcgt

SEQ ID NO: 5860287 - DNA, 19 bp, Homo sapiens
caggagcttcttcgttcct

SEQ ID NO: 5860288 - DNA, 16 bp, Homo sapiens
caggagcttggcagag

SEQ ID NO: 5860289 - DNA, 20 bp, Homo sapiens
caggagcttgggcagtgccc

SEQ ID NO: 5860290 - DNA, 21 bp, Homo sapiens
caggagcttgggtctctctcg

SEQ ID NO: 5860291 - DNA, 16 bp, Homo sapiens
caggagcttttttaca

SEQ ID NO: 5860292 - DNA, 20 bp, Homo sapiens
caggcagctttaaccattaa

SEQ ID NO: 5860293 - DNA, 15 bp, Homo sapiens
caggcaggaagagag

SEQ ID NO: 5860294 - DNA, 16 bp, Homo sapiens
caggcaggaagagaga

SEQ ID NO: 5860295 - DNA, 18 bp, Homo sapiens
caggcaggaagggcagga

SEQ ID NO: 5860296 - DNA, 23 bp, Homo sapiens
caggcaggaatgcggttgggagg

SEQ ID NO: 5860297 - DNA, 14 bp, Homo sapiens
caggcaggagccct

SEQ ID NO: 5860298 - DNA, 11 bp, Homo sapiens
caggcaggagg

SEQ ID NO: 5860299 - DNA, 15 bp, Homo sapiens
caggcaggcactgtg

SEQ ID NO: 5860300 - DNA, 21 bp, Homo sapiens
caggcaggccaaggccttctc

SEQ ID NO: 5860301 - DNA, 20 bp, Homo sapiens
caggcaggccagatggcccc

SEQ ID NO: 5860302 - DNA, 21 bp, Homo sapiens
caggcaggccagatggcccct

SEQ ID NO: 5860303 - DNA, 13 bp, Homo sapiens
caggcaggccagg

SEQ ID NO: 5860304 - DNA, 13 bp, Homo sapiens
caggcaggcccag

SEQ ID NO: 5860305 - DNA, 15 bp, Homo sapiens
caggcaggcccagcc

SEQ ID NO: 5860306 - DNA, 23 bp, Homo sapiens
caggcaggctaaggcgtggagct

SEQ ID NO: 5860307 - DNA, 13 bp, Homo sapiens
caggcaggctgtg

SEQ ID NO: 5860308 - DNA, 22 bp, Homo sapiens
caggcaggctttctgggtgtga

SEQ ID NO: 5860309 - DNA, 18 bp, Homo sapiens
caggcagggagtgtctgc

SEQ ID NO: 5860310 - DNA, 20 bp, Homo sapiens
caggcagggagtgtctgcag

SEQ ID NO: 5860311 - DNA, 21 bp, Homo sapiens
caggcagggagtgtctgcagt

SEQ ID NO: 5860312 - DNA, 23 bp, Homo sapiens
caggcagggcaaaggtcaagact

SEQ ID NO: 5860313 - DNA, 12 bp, Homo sapiens
caggcagggcag

SEQ ID NO: 5860314 - DNA, 22 bp, Homo sapiens
caggcagggccaacccttctcc

SEQ ID NO: 5860315 - DNA, 21 bp, Homo sapiens
caggcagggcctggctccagt

SEQ ID NO: 5860316 - DNA, 12 bp, Homo sapiens
caggcagggctc

SEQ ID NO: 5860317 - DNA, 18 bp, Homo sapiens
caggcagggctctcctgg

SEQ ID NO: 5860318 - DNA, 19 bp, Homo sapiens
caggcagggctctcctggc

SEQ ID NO: 5860319 - DNA, 23 bp, Homo sapiens
caggcagggctgactctaggtgc

SEQ ID NO: 5860320 - DNA, 17 bp, Homo sapiens
caggcagggctgggcca

SEQ ID NO: 5860321 - DNA, 18 bp, Homo sapiens
caggcagggctgggccag

SEQ ID NO: 5860322 - DNA, 19 bp, Homo sapiens
caggcagggctgggccagg

SEQ ID NO: 5860323 - DNA, 11 bp, Homo sapiens
caggcaggggc

SEQ ID NO: 5860324 - DNA, 21 bp, Homo sapiens
caggcaggggcatctgtctgt

SEQ ID NO: 5860325 - DNA, 16 bp, Homo sapiens
caggcaggggcccact

SEQ ID NO: 5860326 - DNA, 22 bp, Homo sapiens
caggcaggggcccacttggggc

SEQ ID NO: 5860327 - DNA, 21 bp, Homo sapiens
caggcaggggcctccatgggc

SEQ ID NO: 5860328 - DNA, 16 bp, Homo sapiens
caggcaggggcttggc

SEQ ID NO: 5860329 - DNA, 18 bp, Homo sapiens
caggcaggggtgggagag

SEQ ID NO: 5860330 - DNA, 20 bp, Homo sapiens
caggcaggggtgggagagcc

SEQ ID NO: 5860331 - DNA, 23 bp, Homo sapiens
caggcaggggtgggggtggaggc

SEQ ID NO: 5860332 - DNA, 15 bp, Homo sapiens
caggcagggtgcagt

SEQ ID NO: 5860333 - DNA, 14 bp, Homo sapiens
caggcaggtcacag

SEQ ID NO: 5860334 - DNA, 17 bp, Homo sapiens
caggcaggtcacagaaa

SEQ ID NO: 5860335 - DNA, 13 bp, Homo sapiens
caggcaggtccag

SEQ ID NO: 5860336 - DNA, 15 bp, Homo sapiens
caggcaggtccaggg

SEQ ID NO: 5860337 - DNA, 20 bp, Homo sapiens
caggcaggtctgaagctcaa

SEQ ID NO: 5860338 - DNA, 12 bp, Homo sapiens
caggcaggtctt

SEQ ID NO: 5860339 - DNA, 17 bp, Homo sapiens
caggcaggtgccaggaa

SEQ ID NO: 5860340 - DNA, 14 bp, Homo sapiens
caggcaggtgcctg

SEQ ID NO: 5860341 - DNA, 13 bp, Homo sapiens
caggcaggtggac

SEQ ID NO: 5860342 - DNA, 16 bp, Homo sapiens
caggcaggtgggggct

SEQ ID NO: 5860343 - DNA, 13 bp, Homo sapiens
caggcaggtttgc

SEQ ID NO: 5860344 - DNA, 18 bp, Homo sapiens
caggcaggtttgccagtg

SEQ ID NO: 5860345 - DNA, 20 bp, Homo sapiens
caggcagtagcagctgtgtt

SEQ ID NO: 5860346 - DNA, 21 bp, Homo sapiens
caggcagtaggcattctttag

SEQ ID NO: 5860347 - DNA, 17 bp, Homo sapiens
caggcagtccaggcctc

SEQ ID NO: 5860348 - DNA, 23 bp, Homo sapiens
caggcagtccaggcctctctctg

SEQ ID NO: 5860349 - DNA, 20 bp, Homo sapiens
caggcagtgatgctggatgc

SEQ ID NO: 5860350 - DNA, 14 bp, Homo sapiens
caggcagtggccca

SEQ ID NO: 5860351 - DNA, 17 bp, Homo sapiens
caggcagtggcccaggg

SEQ ID NO: 5860352 - DNA, 16 bp, Homo sapiens
caggcagtggggctgg

SEQ ID NO: 5860353 - DNA, 23 bp, Homo sapiens
caggcagtggggctggaagcaga

SEQ ID NO: 5860354 - DNA, 18 bp, Homo sapiens
caggcagttaggtgctga

SEQ ID NO: 5860355 - DNA, 20 bp, Homo sapiens
caggcataaaatagagtaaa

SEQ ID NO: 5860356 - DNA, 14 bp, Homo sapiens
caggcatagaggct

SEQ ID NO: 5860357 - DNA, 21 bp, Homo sapiens
caggcatagaggcttctccgc

SEQ ID NO: 5860358 - DNA, 16 bp, Homo sapiens
caggcataggcctggg

SEQ ID NO: 5860359 - DNA, 23 bp, Homo sapiens
caggcatatgtttccccatctct

SEQ ID NO: 5860360 - DNA, 22 bp, Homo sapiens
caggcatattccctgcacacac

SEQ ID NO: 5860361 - DNA, 15 bp, Homo sapiens
caggcatcacagcta

SEQ ID NO: 5860362 - DNA, 13 bp, Homo sapiens
caggcatcaggaa

SEQ ID NO: 5860363 - DNA, 15 bp, Homo sapiens
caggcatcccatccc

SEQ ID NO: 5860364 - DNA, 16 bp, Homo sapiens
caggcatccgtggggg

SEQ ID NO: 5860365 - DNA, 12 bp, Homo sapiens
caggcatctcct

SEQ ID NO: 5860366 - DNA, 18 bp, Homo sapiens
caggcatctccttgggct

SEQ ID NO: 5860367 - DNA, 21 bp, Homo sapiens
caggcatctgtaagaagtaga

SEQ ID NO: 5860368 - DNA, 19 bp, Homo sapiens
caggcatctgttagcagag

SEQ ID NO: 5860369 - DNA, 23 bp, Homo sapiens
caggcatctgttagcagagtctg

SEQ ID NO: 5860370 - DNA, 19 bp, Homo sapiens
caggcatgaatcactgtgc

SEQ ID NO: 5860371 - DNA, 22 bp, Homo sapiens
caggcatgaatcactgtgctca

SEQ ID NO: 5860372 - DNA, 23 bp, Homo sapiens
caggcatgaatcactgtgctcag

SEQ ID NO: 5860373 - DNA, 18 bp, Homo sapiens
caggcatgagccactgca

SEQ ID NO: 5860374 - DNA, 19 bp, Homo sapiens
caggcatgagccactgtgc

SEQ ID NO: 5860375 - DNA, 16 bp, Homo sapiens
caggcatgcagctgcc

SEQ ID NO: 5860376 - DNA, 19 bp, Homo sapiens
caggcatgcagctgcctgg

SEQ ID NO: 5860377 - DNA, 21 bp, Homo sapiens
caggcatgcagctgcctgggg

SEQ ID NO: 5860378 - DNA, 17 bp, Homo sapiens
caggcatgcatgtgctt

SEQ ID NO: 5860379 - DNA, 16 bp, Homo sapiens
caggcatgcctgtgtg

SEQ ID NO: 5860380 - DNA, 21 bp, Homo sapiens
caggcatgcgaatgagctggg

SEQ ID NO: 5860381 - DNA, 15 bp, Homo sapiens
caggcatgctggcct

SEQ ID NO: 5860382 - DNA, 17 bp, Homo sapiens
caggcatggcccagcct

SEQ ID NO: 5860383 - DNA, 15 bp, Homo sapiens
caggcatggctcaga

SEQ ID NO: 5860384 - DNA, 16 bp, Homo sapiens
caggcatggctcagag

SEQ ID NO: 5860385 - DNA, 19 bp, Homo sapiens
caggcatggctggtgcctg

SEQ ID NO: 5860386 - DNA, 14 bp, Homo sapiens
caggcatggcttcc

SEQ ID NO: 5860387 - DNA, 16 bp, Homo sapiens
caggcatgggccacca

SEQ ID NO: 5860388 - DNA, 14 bp, Homo sapiens
caggcatggggggt

SEQ ID NO: 5860389 - DNA, 12 bp, Homo sapiens
caggcatgggtc

SEQ ID NO: 5860390 - DNA, 17 bp, Homo sapiens
caggcatggtggcccac

SEQ ID NO: 5860391 - DNA, 15 bp, Homo sapiens
caggcatgtgccacc

SEQ ID NO: 5860392 - DNA, 15 bp, Homo sapiens
caggcatgttctctg

SEQ ID NO: 5860393 - DNA, 20 bp, Homo sapiens
caggcatgttctctgaggac

SEQ ID NO: 5860394 - DNA, 18 bp, Homo sapiens
caggcatgttggactctg

SEQ ID NO: 5860395 - DNA, 13 bp, Homo sapiens
caggcattcccca

SEQ ID NO: 5860396 - DNA, 16 bp, Homo sapiens
caggcattccccagga

SEQ ID NO: 5860397 - DNA, 15 bp, Homo sapiens
caggcattcctgaag

SEQ ID NO: 5860398 - DNA, 24 bp, Homo sapiens
caggcattgaatgacaagcatcag

SEQ ID NO: 5860399 - DNA, 19 bp, Homo sapiens
caggcattgccaagggctt

SEQ ID NO: 5860400 - DNA, 14 bp, Homo sapiens
caggcatttcctgg

SEQ ID NO: 5860401 - DNA, 15 bp, Homo sapiens
caggcatttgccaag

SEQ ID NO: 5860402 - DNA, 17 bp, Homo sapiens
caggcatttgctaaggc

SEQ ID NO: 5860403 - DNA, 21 bp, Homo sapiens
caggcatttgctaaggcagct

SEQ ID NO: 5860404 - DNA, 13 bp, Homo sapiens
caggcatttgttc

SEQ ID NO: 5860405 - DNA, 19 bp, Homo sapiens
caggcatttttccaaagga

SEQ ID NO: 5860406 - DNA, 19 bp, Homo sapiens
caggccaaacatggccaga

SEQ ID NO: 5860407 - DNA, 15 bp, Homo sapiens
caggccaaagacctc

SEQ ID NO: 5860408 - DNA, 22 bp, Homo sapiens
caggccaaagagtctccagttt

SEQ ID NO: 5860409 - DNA, 19 bp, Homo sapiens
caggccaaagtgccggtga

SEQ ID NO: 5860410 - DNA, 19 bp, Homo sapiens
caggccaagaccccagctt

SEQ ID NO: 5860411 - DNA, 18 bp, Homo sapiens
caggccaagagcagaggc

SEQ ID NO: 5860412 - DNA, 16 bp, Homo sapiens
caggccaagggaccag

SEQ ID NO: 5860413 - DNA, 18 bp, Homo sapiens
caggccaagggaccaggt

SEQ ID NO: 5860414 - DNA, 13 bp, Homo sapiens
caggccaatccct

SEQ ID NO: 5860415 - DNA, 18 bp, Homo sapiens
caggccaatcccttctcc

SEQ ID NO: 5860416 - DNA, 17 bp, Homo sapiens
caggccaatgttgctga

SEQ ID NO: 5860417 - DNA, 23 bp, Homo sapiens
caggccaatgttgctgatggccc

SEQ ID NO: 5860418 - DNA, 18 bp, Homo sapiens
caggccacacgctgccca

SEQ ID NO: 5860419 - DNA, 19 bp, Homo sapiens
caggccacacgctgcccag

SEQ ID NO: 5860420 - DNA, 16 bp, Homo sapiens
caggccacacttcaaa

SEQ ID NO: 5860421 - DNA, 11 bp, Homo sapiens
caggccacagc

SEQ ID NO: 5860422 - DNA, 12 bp, Homo sapiens
caggccacagcc

SEQ ID NO: 5860423 - DNA, 15 bp, Homo sapiens
caggccacagccagg

SEQ ID NO: 5860424 - DNA, 21 bp, Homo sapiens
caggccacagcccctggcact

SEQ ID NO: 5860425 - DNA, 13 bp, Homo sapiens
caggccacagccg

SEQ ID NO: 5860426 - DNA, 13 bp, Homo sapiens
caggccaccagct

SEQ ID NO: 5860427 - DNA, 18 bp, Homo sapiens
caggccaccagctgctgg

SEQ ID NO: 5860428 - DNA, 18 bp, Homo sapiens
caggccacccactgtggg

SEQ ID NO: 5860429 - DNA, 16 bp, Homo sapiens
caggccacccgggctg

SEQ ID NO: 5860430 - DNA, 14 bp, Homo sapiens
caggccaccctcca

SEQ ID NO: 5860431 - DNA, 23 bp, Homo sapiens
caggccacctcagtctcacctgc

SEQ ID NO: 5860432 - DNA, 12 bp, Homo sapiens
caggccacctcc

SEQ ID NO: 5860433 - DNA, 15 bp, Homo sapiens
caggccacctcccca

SEQ ID NO: 5860434 - DNA, 20 bp, Homo sapiens
caggccacctccccagcatt

SEQ ID NO: 5860435 - DNA, 15 bp, Homo sapiens
caggccacgctcagg

SEQ ID NO: 5860436 - DNA, 18 bp, Homo sapiens
caggccacgggaccttct

SEQ ID NO: 5860437 - DNA, 14 bp, Homo sapiens
caggccactagtga

SEQ ID NO: 5860438 - DNA, 14 bp, Homo sapiens
caggccactgacct

SEQ ID NO: 5860439 - DNA, 16 bp, Homo sapiens
caggccactgacctcc

SEQ ID NO: 5860440 - DNA, 15 bp, Homo sapiens
caggccactgggccc

SEQ ID NO: 5860441 - DNA, 13 bp, Homo sapiens
caggccactgtgg

SEQ ID NO: 5860442 - DNA, 14 bp, Homo sapiens
caggccactgtggc

SEQ ID NO: 5860443 - DNA, 16 bp, Homo sapiens
caggccactgtggcca

SEQ ID NO: 5860444 - DNA, 21 bp, Homo sapiens
caggccactgtggccagagct

SEQ ID NO: 5860445 - DNA, 13 bp, Homo sapiens
caggccacttgct

SEQ ID NO: 5860446 - DNA, 16 bp, Homo sapiens
caggccacttgctcag

SEQ ID NO: 5860447 - DNA, 12 bp, Homo sapiens
caggccagagaa

SEQ ID NO: 5860448 - DNA, 13 bp, Homo sapiens
caggccagaggga

SEQ ID NO: 5860449 - DNA, 15 bp, Homo sapiens
caggccagagggagt

SEQ ID NO: 5860450 - DNA, 19 bp, Homo sapiens
caggccagagggagtgaca

SEQ ID NO: 5860451 - DNA, 16 bp, Homo sapiens
caggccagagggcagt

SEQ ID NO: 5860452 - DNA, 20 bp, Homo sapiens
caggccagagggcagtggcc

SEQ ID NO: 5860453 - DNA, 11 bp, Homo sapiens
caggccagatg

SEQ ID NO: 5860454 - DNA, 16 bp, Homo sapiens
caggccagatggcccc

SEQ ID NO: 5860455 - DNA, 13 bp, Homo sapiens
caggccagcccca

SEQ ID NO: 5860456 - DNA, 14 bp, Homo sapiens
caggccagccccat

SEQ ID NO: 5860457 - DNA, 15 bp, Homo sapiens
caggccagccccatc

SEQ ID NO: 5860458 - DNA, 20 bp, Homo sapiens
caggccagcccccccaccca

SEQ ID NO: 5860459 - DNA, 11 bp, Homo sapiens
caggccagcct

SEQ ID NO: 5860460 - DNA, 21 bp, Homo sapiens
caggccagcctccgagaggga

SEQ ID NO: 5860461 - DNA, 23 bp, Homo sapiens
caggccagcctccgagagggaga

SEQ ID NO: 5860462 - DNA, 14 bp, Homo sapiens
caggccagcctgtc

SEQ ID NO: 5860463 - DNA, 17 bp, Homo sapiens
caggccagcctgtccct

SEQ ID NO: 5860464 - DNA, 13 bp, Homo sapiens
caggccagccttg

SEQ ID NO: 5860465 - DNA, 17 bp, Homo sapiens
caggccagcgaggcgag

SEQ ID NO: 5860466 - DNA, 12 bp, Homo sapiens
caggccagctca

SEQ ID NO: 5860467 - DNA, 13 bp, Homo sapiens
caggccagctcag

SEQ ID NO: 5860468 - DNA, 20 bp, Homo sapiens
caggccagctccttttctgt

SEQ ID NO: 5860469 - DNA, 14 bp, Homo sapiens
caggccagctgcgg

SEQ ID NO: 5860470 - DNA, 18 bp, Homo sapiens
caggccagctgcggccag

SEQ ID NO: 5860471 - DNA, 16 bp, Homo sapiens
caggcctggcctcgcc

SEQ ID NO: 5860472 - DNA, 19 bp, Homo sapiens
caggcctggcctcgcctgc

SEQ ID NO: 5860473 - DNA, 21 bp, Homo sapiens
caggcctggcctcgcctgcct

SEQ ID NO: 5860474 - DNA, 18 bp, Homo sapiens
caggcctggcctcggggc

SEQ ID NO: 5860475 - DNA, 22 bp, Homo sapiens
caggcctggcctctgggcagtg

SEQ ID NO: 5860476 - DNA, 14 bp, Homo sapiens
caggcctggctccc

SEQ ID NO: 5860477 - DNA, 22 bp, Homo sapiens
caggcctggctccccgagggct

SEQ ID NO: 5860478 - DNA, 11 bp, Homo sapiens
caggcctggga

SEQ ID NO: 5860479 - DNA, 12 bp, Homo sapiens
caggcctgggac

SEQ ID NO: 5860480 - DNA, 17 bp, Homo sapiens
caggcctgggacccagc

SEQ ID NO: 5860481 - DNA, 15 bp, Homo sapiens
caggcctgggatgca

SEQ ID NO: 5860482 - DNA, 21 bp, Homo sapiens
caggcctgggatgcagtgatg

SEQ ID NO: 5860483 - DNA, 23 bp, Homo sapiens
caggcctgggcaggaccctgctg

SEQ ID NO: 5860484 - DNA, 12 bp, Homo sapiens
caggcctgggcc

SEQ ID NO: 5860485 - DNA, 19 bp, Homo sapiens
caggcctgggtctgtgtct

SEQ ID NO: 5860486 - DNA, 12 bp, Homo sapiens
caggcctgggtt

SEQ ID NO: 5860487 - DNA, 16 bp, Homo sapiens
caggcctgtgcccact

SEQ ID NO: 5860488 - DNA, 18 bp, Homo sapiens
caggcctgtgcccactcc

SEQ ID NO: 5860489 - DNA, 16 bp, Homo sapiens
caggcctgtggcccca

SEQ ID NO: 5860490 - DNA, 18 bp, Homo sapiens
caggcctgtgtagctgtg

SEQ ID NO: 5860491 - DNA, 12 bp, Homo sapiens
caggcctgtgtg

SEQ ID NO: 5860492 - DNA, 17 bp, Homo sapiens
caggcctgttcccttgt

SEQ ID NO: 5860493 - DNA, 22 bp, Homo sapiens
caggccttagtacggctgctgc

SEQ ID NO: 5860494 - DNA, 10 bp, Homo sapiens
caggccttca

SEQ ID NO: 5860495 - DNA, 16 bp, Homo sapiens
caggccttcatcctcc

SEQ ID NO: 5860496 - DNA, 12 bp, Homo sapiens
caggccttccgg

SEQ ID NO: 5860497 - DNA, 18 bp, Homo sapiens
caggccttcctcctctca

SEQ ID NO: 5860498 - DNA, 12 bp, Homo sapiens
caggccttctga

SEQ ID NO: 5860499 - DNA, 14 bp, Homo sapiens
caggccttctgtgg

SEQ ID NO: 5860500 - DNA, 15 bp, Homo sapiens
caggccttctgtggg

SEQ ID NO: 5860501 - DNA, 16 bp, Homo sapiens
caggccttctgtgggg

SEQ ID NO: 5860502 - DNA, 19 bp, Homo sapiens
caggccttctgtggggctg

SEQ ID NO: 5860503 - DNA, 20 bp, Homo sapiens
caggccttctgtggggctgg

SEQ ID NO: 5860504 - DNA, 22 bp, Homo sapiens
caggccttctgtggggctgggc

SEQ ID NO: 5860505 - DNA, 23 bp, Homo sapiens
caggccttctgtggggctgggca

SEQ ID NO: 5860506 - DNA, 15 bp, Homo sapiens
caggccttgagcaca

SEQ ID NO: 5860507 - DNA, 16 bp, Homo sapiens
caggccttgctgactc

SEQ ID NO: 5860508 - DNA, 21 bp, Homo sapiens
caggccttgctgactctctga

SEQ ID NO: 5860509 - DNA, 19 bp, Homo sapiens
caggccttgctggggtcca

SEQ ID NO: 5860510 - DNA, 23 bp, Homo sapiens
caggccttgctggggtccagggc

SEQ ID NO: 5860511 - DNA, 13 bp, Homo sapiens
caggcctttccta

SEQ ID NO: 5860512 - DNA, 18 bp, Homo sapiens
caggcctttgagaaaggg

SEQ ID NO: 5860513 - DNA, 13 bp, Homo sapiens
caggcctttggag

SEQ ID NO: 5860514 - DNA, 16 bp, Homo sapiens
caggcctttggagggg

SEQ ID NO: 5860515 - DNA, 17 bp, Homo sapiens
caggcctttttgagcca

SEQ ID NO: 5860516 - DNA, 18 bp, Homo sapiens
caggcgaccgggcctccc

SEQ ID NO: 5860517 - DNA, 22 bp, Homo sapiens
caggcgaggcccttggcgggca

SEQ ID NO: 5860518 - DNA, 21 bp, Homo sapiens
caggcgatccccgcttcccct

SEQ ID NO: 5860519 - DNA, 22 bp, Homo sapiens
caggcgatggggcaagacagaa

SEQ ID NO: 5860520 - DNA, 13 bp, Homo sapiens
caggcgcacacca

SEQ ID NO: 5860521 - DNA, 18 bp, Homo sapiens
caggcgcagaggtcccag

SEQ ID NO: 5860522 - DNA, 19 bp, Homo sapiens
caggcgcagaggtcccagc

SEQ ID NO: 5860523 - DNA, 12 bp, Homo sapiens
caggcgcagccc

SEQ ID NO: 5860524 - DNA, 20 bp, Homo sapiens
caggcgccgcctcgcccccg

SEQ ID NO: 5860525 - DNA, 17 bp, Homo sapiens
caggcgccggcgggcgg

SEQ ID NO: 5860526 - DNA, 20 bp, Homo sapiens
caggcgcctataatcccagc

SEQ ID NO: 5860527 - DNA, 15 bp, Homo sapiens
caggcgcctggtgtg

SEQ ID NO: 5860528 - DNA, 21 bp, Homo sapiens
caggcgcgcaccgcccaaccc

SEQ ID NO: 5860529 - DNA, 16 bp, Homo sapiens
caggcgcggcggctct

SEQ ID NO: 5860530 - DNA, 22 bp, Homo sapiens
caggcgctagcacagctccctt

SEQ ID NO: 5860531 - DNA, 16 bp, Homo sapiens
caggcgctgcagggcc

SEQ ID NO: 5860532 - DNA, 23 bp, Homo sapiens
caggcgctgcccacctgccggcc

SEQ ID NO: 5860533 - DNA, 21 bp, Homo sapiens
caggcgctgggggctggacct

SEQ ID NO: 5860534 - DNA, 22 bp, Homo sapiens
caggcgctgggggctggacctg

SEQ ID NO: 5860535 - DNA, 13 bp, Homo sapiens
caggcggccaggg

SEQ ID NO: 5860536 - DNA, 20 bp, Homo sapiens
caggcggccagggcggccag

SEQ ID NO: 5860537 - DNA, 15 bp, Homo sapiens
caggcggccctcagt

SEQ ID NO: 5860538 - DNA, 13 bp, Homo sapiens
caggcggccctgg

SEQ ID NO: 5860539 - DNA, 16 bp, Homo sapiens
caggcggccctgggga

SEQ ID NO: 5860540 - DNA, 23 bp, Homo sapiens
caggcggccctggggaggggtgg

SEQ ID NO: 5860541 - DNA, 17 bp, Homo sapiens
caggcggctcctcctca

SEQ ID NO: 5860542 - DNA, 21 bp, Homo sapiens
caggcggctcctcctcaccca

SEQ ID NO: 5860543 - DNA, 17 bp, Homo sapiens
caggcgggacagtgctg

SEQ ID NO: 5860544 - DNA, 16 bp, Homo sapiens
caggcgggaggaggtg

SEQ ID NO: 5860545 - DNA, 18 bp, Homo sapiens
caggcgggcaagtcatcc

SEQ ID NO: 5860546 - DNA, 17 bp, Homo sapiens
caggcgggcccatgaag

SEQ ID NO: 5860547 - DNA, 18 bp, Homo sapiens
caggcgggcgagccgcgg

SEQ ID NO: 5860548 - DNA, 15 bp, Homo sapiens
caggcgggctcggag

SEQ ID NO: 5860549 - DNA, 19 bp, Homo sapiens
caggcggggaggaggagct

SEQ ID NO: 5860550 - DNA, 14 bp, Homo sapiens
caggcggggcagta

SEQ ID NO: 5860551 - DNA, 19 bp, Homo sapiens
caggcggggcagtatgtga

SEQ ID NO: 5860552 - DNA, 23 bp, Homo sapiens
caggcggggcagtatgtgatgga

SEQ ID NO: 5860553 - DNA, 21 bp, Homo sapiens
caggcggggcccagcgctctc

SEQ ID NO: 5860554 - DNA, 14 bp, Homo sapiens
caggcggggctcct

SEQ ID NO: 5860555 - DNA, 22 bp, Homo sapiens
caggcggggggggcgcctggag

SEQ ID NO: 5860556 - DNA, 23 bp, Homo sapiens
caggcggggggggcgcctggaga

SEQ ID NO: 5860557 - DNA, 15 bp, Homo sapiens
caggcggggtgctgt

SEQ ID NO: 5860558 - DNA, 21 bp, Homo sapiens
caggcggtccccatccccacc

SEQ ID NO: 5860559 - DNA, 15 bp, Homo sapiens
caggcgtagggccag

SEQ ID NO: 5860560 - DNA, 19 bp, Homo sapiens
caggcgtagggccagggct

SEQ ID NO: 5860561 - DNA, 16 bp, Homo sapiens
caggcgtgacctgaca

SEQ ID NO: 5860562 - DNA, 21 bp, Homo sapiens
caggcgtgactcagcagcctg

SEQ ID NO: 5860563 - DNA, 21 bp, Homo sapiens
caggcgtgagccaccgtgcct

SEQ ID NO: 5860564 - DNA, 20 bp, Homo sapiens
caggcgtgtggcagccacac

SEQ ID NO: 5860565 - DNA, 22 bp, Homo sapiens
caggcgttcagctcactgttct

SEQ ID NO: 5860566 - DNA, 18 bp, Homo sapiens
caggcgttggtgccactt

SEQ ID NO: 5860567 - DNA, 19 bp, Homo sapiens
caggcgttggtgccacttc

SEQ ID NO: 5860568 - DNA, 20 bp, Homo sapiens
caggcgtttctgaagtgctc

SEQ ID NO: 5860569 - DNA, 14 bp, Homo sapiens
caggctaaagtgat

SEQ ID NO: 5860570 - DNA, 18 bp, Homo sapiens
caggctaagaccctgtgt

SEQ ID NO: 5860571 - DNA, 21 bp, Homo sapiens
caggctaagaccctgtgtcct

SEQ ID NO: 5860572 - DNA, 19 bp, Homo sapiens
caggctaaggcgtggagct

SEQ ID NO: 5860573 - DNA, 23 bp, Homo sapiens
caggctaatgttggcagatgcag

SEQ ID NO: 5860574 - DNA, 17 bp, Homo sapiens
caggctaattagaggat

SEQ ID NO: 5860575 - DNA, 17 bp, Homo sapiens
caggctacaaagcagag

SEQ ID NO: 5860576 - DNA, 19 bp, Homo sapiens
caggctacaatcttcattt

SEQ ID NO: 5860577 - DNA, 18 bp, Homo sapiens
caggctacaggtgcccca

SEQ ID NO: 5860578 - DNA, 22 bp, Homo sapiens
caggctacaggtgccccacctc

SEQ ID NO: 5860579 - DNA, 14 bp, Homo sapiens
caggctaccccttc

SEQ ID NO: 5860580 - DNA, 14 bp, Homo sapiens
caggctactctcct

SEQ ID NO: 5860581 - DNA, 16 bp, Homo sapiens
caggctactctgccca

SEQ ID NO: 5860582 - DNA, 17 bp, Homo sapiens
caggctactctgcccac

SEQ ID NO: 5860583 - DNA, 18 bp, Homo sapiens
caggctactggtttgtat

SEQ ID NO: 5860584 - DNA, 14 bp, Homo sapiens
caggctactgtcag

SEQ ID NO: 5860585 - DNA, 15 bp, Homo sapiens
caggctactgttctt

SEQ ID NO: 5860586 - DNA, 13 bp, Homo sapiens
caggctagatccc

SEQ ID NO: 5860587 - DNA, 17 bp, Homo sapiens
caggctagccctgccct

SEQ ID NO: 5860588 - DNA, 15 bp, Homo sapiens
caggctaggccagca

SEQ ID NO: 5860589 - DNA, 16 bp, Homo sapiens
caggctaggccagcag

SEQ ID NO: 5860590 - DNA, 18 bp, Homo sapiens
caggctagtccggaccca

SEQ ID NO: 5860591 - DNA, 19 bp, Homo sapiens
caggctatatgcagtcctt

SEQ ID NO: 5860592 - DNA, 17 bp, Homo sapiens
caggctatggttgccac

SEQ ID NO: 5860593 - DNA, 17 bp, Homo sapiens
caggctatgtataaaat

SEQ ID NO: 5860594 - DNA, 22 bp, Homo sapiens
caggctattatttattgtatta

SEQ ID NO: 5860595 - DNA, 15 bp, Homo sapiens
caggctatttgttca

SEQ ID NO: 5860596 - DNA, 17 bp, Homo sapiens
caggctcaacataacat

SEQ ID NO: 5860597 - DNA, 15 bp, Homo sapiens
caggctcaagcactt

SEQ ID NO: 5860598 - DNA, 18 bp, Homo sapiens
caggctcactgccaggcc

SEQ ID NO: 5860599 - DNA, 21 bp, Homo sapiens
caggctcactgccaggccagc

SEQ ID NO: 5860600 - DNA, 22 bp, Homo sapiens
caggctcactgccaggccagcc

SEQ ID NO: 5860601 - DNA, 23 bp, Homo sapiens
caggctcactgccaggccagcct

SEQ ID NO: 5860602 - DNA, 14 bp, Homo sapiens
caggctcagcatgc

SEQ ID NO: 5860603 - DNA, 11 bp, Homo sapiens
caggctcagga

SEQ ID NO: 5860604 - DNA, 14 bp, Homo sapiens
caggctcaggagaa

SEQ ID NO: 5860605 - DNA, 16 bp, Homo sapiens
caggctcaggagaagc

SEQ ID NO: 5860606 - DNA, 18 bp, Homo sapiens
caggctcaggagaagcca

SEQ ID NO: 5860607 - DNA, 19 bp, Homo sapiens
caggctcaggagaagccag

SEQ ID NO: 5860608 - DNA, 22 bp, Homo sapiens
caggctcaggagaagccagtgt

SEQ ID NO: 5860609 - DNA, 23 bp, Homo sapiens
caggctcaggagaagccagtgtc

SEQ ID NO: 5860610 - DNA, 15 bp, Homo sapiens
caggctcaggcaggg

SEQ ID NO: 5860611 - DNA, 14 bp, Homo sapiens
caggctcaggctgc

SEQ ID NO: 5860612 - DNA, 16 bp, Homo sapiens
caggctcaggctgccc

SEQ ID NO: 5860613 - DNA, 18 bp, Homo sapiens
caggctccaagaggctga

SEQ ID NO: 5860614 - DNA, 20 bp, Homo sapiens
caggctccaagaggctgagg

SEQ ID NO: 5860615 - DNA, 18 bp, Homo sapiens
caggctccaatggggcgg

SEQ ID NO: 5860616 - DNA, 13 bp, Homo sapiens
caggctccaggct

SEQ ID NO: 5860617 - DNA, 15 bp, Homo sapiens
caggctccaggctga

SEQ ID NO: 5860618 - DNA, 15 bp, Homo sapiens
caggctccagttgaa

SEQ ID NO: 5860619 - DNA, 16 bp, Homo sapiens
caggctccatggggaa

SEQ ID NO: 5860620 - DNA, 19 bp, Homo sapiens
caggctccatggggaagtg

SEQ ID NO: 5860621 - DNA, 16 bp, Homo sapiens
caggctcccaaactca

SEQ ID NO: 5860622 - DNA, 13 bp, Homo sapiens
caggctcccagcc

SEQ ID NO: 5860623 - DNA, 22 bp, Homo sapiens
caggctcccagggacacctggg

SEQ ID NO: 5860624 - DNA, 23 bp, Homo sapiens
caggctcccagggacacctggga

SEQ ID NO: 5860625 - DNA, 13 bp, Homo sapiens
caggctccccaag

SEQ ID NO: 5860626 - DNA, 15 bp, Homo sapiens
caggctccccagaac

SEQ ID NO: 5860627 - DNA, 13 bp, Homo sapiens
caggctccccctg

SEQ ID NO: 5860628 - DNA, 14 bp, Homo sapiens
caggctcccctggt

SEQ ID NO: 5860629 - DNA, 17 bp, Homo sapiens
caggctcccctggtctc

SEQ ID NO: 5860630 - DNA, 12 bp, Homo sapiens
caggctccctcc

SEQ ID NO: 5860631 - DNA, 22 bp, Homo sapiens
caggctccctccctcccagatc

SEQ ID NO: 5860632 - DNA, 23 bp, Homo sapiens
caggctccctccctcccagatcc

SEQ ID NO: 5860633 - DNA, 16 bp, Homo sapiens
caggctccctgaccac

SEQ ID NO: 5860634 - DNA, 12 bp, Homo sapiens
caggctccgccc

SEQ ID NO: 5860635 - DNA, 22 bp, Homo sapiens
caggctccgcccttagtccccc

SEQ ID NO: 5860636 - DNA, 16 bp, Homo sapiens
caggctccgggctttc

SEQ ID NO: 5860637 - DNA, 19 bp, Homo sapiens
caggctcctacctgtctgc

SEQ ID NO: 5860638 - DNA, 16 bp, Homo sapiens
caggctcctcagccct

SEQ ID NO: 5860639 - DNA, 17 bp, Homo sapiens
caggctcctcagccctc

SEQ ID NO: 5860640 - DNA, 22 bp, Homo sapiens
caggctcctcagccctctcttg

SEQ ID NO: 5860641 - DNA, 22 bp, Homo sapiens
caggctcctcatgaggccatgc

SEQ ID NO: 5860642 - DNA, 13 bp, Homo sapiens
caggctcctctcc

SEQ ID NO: 5860643 - DNA, 23 bp, Homo sapiens
caggctcctgaccccgccatgca

SEQ ID NO: 5860644 - DNA, 13 bp, Homo sapiens
caggctcctgcca

SEQ ID NO: 5860645 - DNA, 16 bp, Homo sapiens
caggctcctggctgtg

SEQ ID NO: 5860646 - DNA, 21 bp, Homo sapiens
caggctcctggctgtgcccag

SEQ ID NO: 5860647 - DNA, 19 bp, Homo sapiens
caggctcgccaaggcctag

SEQ ID NO: 5860648 - DNA, 16 bp, Homo sapiens
cagggacagagccatg

SEQ ID NO: 5860649 - DNA, 15 bp, Homo sapiens
cagggacagaggcca

SEQ ID NO: 5860650 - DNA, 14 bp, Homo sapiens
cagggacagcagcc

SEQ ID NO: 5860651 - DNA, 15 bp, Homo sapiens
cagggacagcagcct

SEQ ID NO: 5860652 - DNA, 13 bp, Homo sapiens
cagggacagcctg

SEQ ID NO: 5860653 - DNA, 14 bp, Homo sapiens
cagggacagcctgc

SEQ ID NO: 5860654 - DNA, 18 bp, Homo sapiens
cagggacagcctgcacag

SEQ ID NO: 5860655 - DNA, 19 bp, Homo sapiens
cagggacagcctgcacagt

SEQ ID NO: 5860656 - DNA, 16 bp, Homo sapiens
cagggacagggccctg

SEQ ID NO: 5860657 - DNA, 20 bp, Homo sapiens
cagggacagggccctggagc

SEQ ID NO: 5860658 - DNA, 15 bp, Homo sapiens
cagggacagttgggt

SEQ ID NO: 5860659 - DNA, 20 bp, Homo sapiens
cagggacatgccctgtgtgg

SEQ ID NO: 5860660 - DNA, 19 bp, Homo sapiens
cagggacatggggcaagcc

SEQ ID NO: 5860661 - DNA, 20 bp, Homo sapiens
cagggacatggggcaagcca

SEQ ID NO: 5860662 - DNA, 22 bp, Homo sapiens
cagggacatggggcaagccagg

SEQ ID NO: 5860663 - DNA, 21 bp, Homo sapiens
cagggacatgtatgcttccag

SEQ ID NO: 5860664 - DNA, 19 bp, Homo sapiens
cagggacattgcagagtgg

SEQ ID NO: 5860665 - DNA, 19 bp, Homo sapiens
cagggaccaaggacccctc

SEQ ID NO: 5860666 - DNA, 16 bp, Homo sapiens
cagggaccacaccctg

SEQ ID NO: 5860667 - DNA, 17 bp, Homo sapiens
cagggaccacagcaagg

SEQ ID NO: 5860668 - DNA, 18 bp, Homo sapiens
cagggaccactgggtgag

SEQ ID NO: 5860669 - DNA, 18 bp, Homo sapiens
cagggaccagcaccttca

SEQ ID NO: 5860670 - DNA, 17 bp, Homo sapiens
cagggaccagcccagcc

SEQ ID NO: 5860671 - DNA, 17 bp, Homo sapiens
cagggaccagctccccg

SEQ ID NO: 5860672 - DNA, 23 bp, Homo sapiens
cagggacccacatccaaacatgt

SEQ ID NO: 5860673 - DNA, 16 bp, Homo sapiens
cagggacccaggtgtg

SEQ ID NO: 5860674 - DNA, 20 bp, Homo sapiens
cagggacccaggtgtgcctg

SEQ ID NO: 5860675 - DNA, 18 bp, Homo sapiens
cagggacccccgaggccc

SEQ ID NO: 5860676 - DNA, 20 bp, Homo sapiens
cagggacccccgaggccccc

SEQ ID NO: 5860677 - DNA, 22 bp, Homo sapiens
cagggacccccgaggcccccct

SEQ ID NO: 5860678 - DNA, 23 bp, Homo sapiens
cagggacccccgaggcccccctc

SEQ ID NO: 5860679 - DNA, 16 bp, Homo sapiens
cagggacccctgccct

SEQ ID NO: 5860680 - DNA, 19 bp, Homo sapiens
cagggacccggggtctcct

SEQ ID NO: 5860681 - DNA, 22 bp, Homo sapiens
cagggacccggggtctcctgga

SEQ ID NO: 5860682 - DNA, 16 bp, Homo sapiens
cagggacccttgcctg

SEQ ID NO: 5860683 - DNA, 22 bp, Homo sapiens
cagggacccttgcctgcctcct

SEQ ID NO: 5860684 - DNA, 18 bp, Homo sapiens
cagggaccggcagagctc

SEQ ID NO: 5860685 - DNA, 19 bp, Homo sapiens
cagggaccggcagagctct

SEQ ID NO: 5860686 - DNA, 22 bp, Homo sapiens
cagggaccggcagagctctaca

SEQ ID NO: 5860687 - DNA, 23 bp, Homo sapiens
cagggaccggcggaccccagcca

SEQ ID NO: 5860688 - DNA, 20 bp, Homo sapiens
cagggaccgggcgcagccct

SEQ ID NO: 5860689 - DNA, 18 bp, Homo sapiens
cagggaccggtgctgcag

SEQ ID NO: 5860690 - DNA, 18 bp, Homo sapiens
cagggaccgtccagggga

SEQ ID NO: 5860691 - DNA, 20 bp, Homo sapiens
cagggacctaaagggactac

SEQ ID NO: 5860692 - DNA, 13 bp, Homo sapiens
cagggacctcagg

SEQ ID NO: 5860693 - DNA, 15 bp, Homo sapiens
cagggacctcagggg

SEQ ID NO: 5860694 - DNA, 16 bp, Homo sapiens
cagggacctcaggggc

SEQ ID NO: 5860695 - DNA, 20 bp, Homo sapiens
cagggacctcaggggcacct

SEQ ID NO: 5860696 - DNA, 14 bp, Homo sapiens
cagggacctgagag

SEQ ID NO: 5860697 - DNA, 12 bp, Homo sapiens
cagggacctgct

SEQ ID NO: 5860698 - DNA, 21 bp, Homo sapiens
cagggacctttggagaccatt

SEQ ID NO: 5860699 - DNA, 20 bp, Homo sapiens
cagggacgtctcatctccca

SEQ ID NO: 5860700 - DNA, 18 bp, Homo sapiens
cagggacgtgataatgca

SEQ ID NO: 5860701 - DNA, 21 bp, Homo sapiens
cagggactcaagggtccagaa

SEQ ID NO: 5860702 - DNA, 12 bp, Homo sapiens
cagggactcagg

SEQ ID NO: 5860703 - DNA, 21 bp, Homo sapiens
cagggactcggcccagggccg

SEQ ID NO: 5860704 - DNA, 20 bp, Homo sapiens
cagggactgaaaacctctcc

SEQ ID NO: 5860705 - DNA, 17 bp, Homo sapiens
cagggactgtacctgta

SEQ ID NO: 5860706 - DNA, 22 bp, Homo sapiens
cagggactgtacctgtaggaaa

SEQ ID NO: 5860707 - DNA, 15 bp, Homo sapiens
cagggacttgaagtt

SEQ ID NO: 5860708 - DNA, 16 bp, Homo sapiens
cagggacttgcctcca

SEQ ID NO: 5860709 - DNA, 14 bp, Homo sapiens
cagggacttggaca

SEQ ID NO: 5860710 - DNA, 17 bp, Homo sapiens
cagggacttggacagga

SEQ ID NO: 5860711 - DNA, 20 bp, Homo sapiens
cagggacttggacaggagtc

SEQ ID NO: 5860712 - DNA, 21 bp, Homo sapiens
cagggacttggacaggagtca

SEQ ID NO: 5860713 - DNA, 23 bp, Homo sapiens
cagggacttgtttagagagcctg

SEQ ID NO: 5860714 - DNA, 16 bp, Homo sapiens
cagggactttgctggt

SEQ ID NO: 5860715 - DNA, 23 bp, Homo sapiens
cagggagaaaatccaggtcatgc

SEQ ID NO: 5860716 - DNA, 13 bp, Homo sapiens
cagggagaagctc

SEQ ID NO: 5860717 - DNA, 12 bp, Homo sapiens
cagggagaaggg

SEQ ID NO: 5860718 - DNA, 21 bp, Homo sapiens
cagggagaagtagctagtagc

SEQ ID NO: 5860719 - DNA, 20 bp, Homo sapiens
cagggagaagttgagcaggt

SEQ ID NO: 5860720 - DNA, 12 bp, Homo sapiens
cagggagacaag

SEQ ID NO: 5860721 - DNA, 14 bp, Homo sapiens
cagggagacaagag

SEQ ID NO: 5860722 - DNA, 21 bp, Homo sapiens
cagggagacaggcagggaggg

SEQ ID NO: 5860723 - DNA, 15 bp, Homo sapiens
cagggagacatctgc

SEQ ID NO: 5860724 - DNA, 22 bp, Homo sapiens
cagggagaccctgggagagtga

SEQ ID NO: 5860725 - DNA, 18 bp, Homo sapiens
cagggagactttctgaag

SEQ ID NO: 5860726 - DNA, 19 bp, Homo sapiens
cagggagagagtagctgca

SEQ ID NO: 5860727 - DNA, 22 bp, Homo sapiens
cagggagagagtagctgcagcc

SEQ ID NO: 5860728 - DNA, 19 bp, Homo sapiens
cagggagagcccaggagct

SEQ ID NO: 5860729 - DNA, 19 bp, Homo sapiens
cagggagagcgcctcttcc

SEQ ID NO: 5860730 - DNA, 14 bp, Homo sapiens
cagggagagctggg

SEQ ID NO: 5860731 - DNA, 16 bp, Homo sapiens
cagggagagctgggca

SEQ ID NO: 5860732 - DNA, 17 bp, Homo sapiens
cagggagagctgggcag

SEQ ID NO: 5860733 - DNA, 22 bp, Homo sapiens
cagggagagctgggcagacagg

SEQ ID NO: 5860734 - DNA, 14 bp, Homo sapiens
cagggagaggcctc

SEQ ID NO: 5860735 - DNA, 21 bp, Homo sapiens
cagggagaggcctcggctgtc

SEQ ID NO: 5860736 - DNA, 19 bp, Homo sapiens
cagggagaggctgtgtccc

SEQ ID NO: 5860737 - DNA, 20 bp, Homo sapiens
cagggagaggtcaccagctg

SEQ ID NO: 5860738 - DNA, 15 bp, Homo sapiens
cagggagcaagacag

SEQ ID NO: 5860739 - DNA, 17 bp, Homo sapiens
cagggagcactggaggc

SEQ ID NO: 5860740 - DNA, 21 bp, Homo sapiens
cagggagcaggcggtgggcac

SEQ ID NO: 5860741 - DNA, 14 bp, Homo sapiens
cagggagcagggaa

SEQ ID NO: 5860742 - DNA, 20 bp, Homo sapiens
cagggagcagggaaggcctg

SEQ ID NO: 5860743 - DNA, 18 bp, Homo sapiens
cagggagcatgagaggag

SEQ ID NO: 5860744 - DNA, 13 bp, Homo sapiens
cagggagcccggg

SEQ ID NO: 5860745 - DNA, 12 bp, Homo sapiens
cagggagccctg

SEQ ID NO: 5860746 - DNA, 19 bp, Homo sapiens
cagggagccggcggcctct

SEQ ID NO: 5860747 - DNA, 19 bp, Homo sapiens
cagggagcctagaagctgg

SEQ ID NO: 5860748 - DNA, 12 bp, Homo sapiens
cagggagcctcc

SEQ ID NO: 5860749 - DNA, 16 bp, Homo sapiens
cagggagcctcctgcc

SEQ ID NO: 5860750 - DNA, 17 bp, Homo sapiens
cagggagcggaaagcag

SEQ ID NO: 5860751 - DNA, 22 bp, Homo sapiens
cagggagcggaaagcagctcaa

SEQ ID NO: 5860752 - DNA, 19 bp, Homo sapiens
cagggagcggccggccagc

SEQ ID NO: 5860753 - DNA, 20 bp, Homo sapiens
cagggagctatgagagatgt

SEQ ID NO: 5860754 - DNA, 12 bp, Homo sapiens
cagggagctcaa

SEQ ID NO: 5860755 - DNA, 23 bp, Homo sapiens
cagggagctctggggacagcttc

SEQ ID NO: 5860756 - DNA, 15 bp, Homo sapiens
cagggagctgcaggg

SEQ ID NO: 5860757 - DNA, 17 bp, Homo sapiens
cagggagctgcaggggc

SEQ ID NO: 5860758 - DNA, 16 bp, Homo sapiens
cagggagctgggcccg

SEQ ID NO: 5860759 - DNA, 22 bp, Homo sapiens
cagggagctgggcccgacatgg

SEQ ID NO: 5860760 - DNA, 17 bp, Homo sapiens
cagggaggacgctctct

SEQ ID NO: 5860761 - DNA, 15 bp, Homo sapiens
cagggaggagaggaa

SEQ ID NO: 5860762 - DNA, 23 bp, Homo sapiens
cagggaggaggtggcagccctgt

SEQ ID NO: 5860763 - DNA, 14 bp, Homo sapiens
cagggaggagtcag

SEQ ID NO: 5860764 - DNA, 12 bp, Homo sapiens
cagggaggatgc

SEQ ID NO: 5860765 - DNA, 19 bp, Homo sapiens
cagggaggatgccacagcc

SEQ ID NO: 5860766 - DNA, 20 bp, Homo sapiens
cagggaggatgccacagccc

SEQ ID NO: 5860767 - DNA, 20 bp, Homo sapiens
cagggaggcaacactgctgt

SEQ ID NO: 5860768 - DNA, 23 bp, Homo sapiens
cagggaggcaacactgctgtcca

SEQ ID NO: 5860769 - DNA, 14 bp, Homo sapiens
cagggaggcagagc

SEQ ID NO: 5860770 - DNA, 18 bp, Homo sapiens
cagggaggcagagcggga

SEQ ID NO: 5860771 - DNA, 13 bp, Homo sapiens
cagggaggcagcc

SEQ ID NO: 5860772 - DNA, 21 bp, Homo sapiens
cagggaggcagccgccccatc

SEQ ID NO: 5860773 - DNA, 21 bp, Homo sapiens
cagggaggcagcgtgggctct

SEQ ID NO: 5860774 - DNA, 11 bp, Homo sapiens
cagggaggcca

SEQ ID NO: 5860775 - DNA, 23 bp, Homo sapiens
cagggaggccgaagctaacaggg

SEQ ID NO: 5860776 - DNA, 15 bp, Homo sapiens
cagggaggcgcaggg

SEQ ID NO: 5860777 - DNA, 20 bp, Homo sapiens
cagggaggcgcagggacatg

SEQ ID NO: 5860778 - DNA, 14 bp, Homo sapiens
cagggaggctcccg

SEQ ID NO: 5860779 - DNA, 19 bp, Homo sapiens
cagggaggctcccggggcc

SEQ ID NO: 5860780 - DNA, 22 bp, Homo sapiens
cagggaggctcccggggcctgg

SEQ ID NO: 5860781 - DNA, 16 bp, Homo sapiens
cagggaggctggtcct

SEQ ID NO: 5860782 - DNA, 20 bp, Homo sapiens
cagggagggaaacccgggga

SEQ ID NO: 5860783 - DNA, 12 bp, Homo sapiens
cagggagggaac

SEQ ID NO: 5860784 - DNA, 18 bp, Homo sapiens
cagggagggaagtgtgag

SEQ ID NO: 5860785 - DNA, 22 bp, Homo sapiens
cagggagggaagtgtgagcgcc

SEQ ID NO: 5860786 - DNA, 19 bp, Homo sapiens
cagggagggagggcggtgg

SEQ ID NO: 5860787 - DNA, 11 bp, Homo sapiens
cagggagggcc

SEQ ID NO: 5860788 - DNA, 16 bp, Homo sapiens
cagggagggccaggga

SEQ ID NO: 5860789 - DNA, 19 bp, Homo sapiens
cagggagggccagggaggc

SEQ ID NO: 5860790 - DNA, 21 bp, Homo sapiens
cagggagggccggcggctctg

SEQ ID NO: 5860791 - DNA, 13 bp, Homo sapiens
cagggagggcctg

SEQ ID NO: 5860792 - DNA, 16 bp, Homo sapiens
cagggagggcctgggc

SEQ ID NO: 5860793 - DNA, 18 bp, Homo sapiens
cagggagggcctgggccc

SEQ ID NO: 5860794 - DNA, 10 bp, Homo sapiens
cagggagggg

SEQ ID NO: 5860795 - DNA, 16 bp, Homo sapiens
cagggaggggaagagg

SEQ ID NO: 5860796 - DNA, 21 bp, Homo sapiens
cagggaggggactatttatga

SEQ ID NO: 5860797 - DNA, 13 bp, Homo sapiens
cagggaggggagg

SEQ ID NO: 5860798 - DNA, 11 bp, Homo sapiens
cagggaggggc

SEQ ID NO: 5860799 - DNA, 16 bp, Homo sapiens
cagggaggggcaacca

SEQ ID NO: 5860800 - DNA, 18 bp, Homo sapiens
cagggaggggctggggca

SEQ ID NO: 5860801 - DNA, 22 bp, Homo sapiens
cagggaggggctggggcaggct

SEQ ID NO: 5860802 - DNA, 17 bp, Homo sapiens
cagggagggtgagctgg

SEQ ID NO: 5860803 - DNA, 18 bp, Homo sapiens
cagggagggtgagctggt

SEQ ID NO: 5860804 - DNA, 16 bp, Homo sapiens
cagggaggtccgggag

SEQ ID NO: 5860805 - DNA, 18 bp, Homo sapiens
cagggaggtgaccccagg

SEQ ID NO: 5860806 - DNA, 15 bp, Homo sapiens
cagggaggtggcagg

SEQ ID NO: 5860807 - DNA, 16 bp, Homo sapiens
cagggaggtggcaggg

SEQ ID NO: 5860808 - DNA, 17 bp, Homo sapiens
cagggaggtggctgggt

SEQ ID NO: 5860809 - DNA, 22 bp, Homo sapiens
cagggaggtgggggcctcctca

SEQ ID NO: 5860810 - DNA, 24 bp, Homo sapiens
cagggaggtgggggcctcctcagc

SEQ ID NO: 5860811 - DNA, 22 bp, Homo sapiens
cagggaggtgtgaggcaggaga

SEQ ID NO: 5860812 - DNA, 23 bp, Homo sapiens
cagggaggtgtgaggcaggagag

SEQ ID NO: 5860813 - DNA, 23 bp, Homo sapiens
cagggagtccagggtttctctgc

SEQ ID NO: 5860814 - DNA, 13 bp, Homo sapiens
cagggagtccttg

SEQ ID NO: 5860815 - DNA, 22 bp, Homo sapiens
cagggagtgctggctcacagta

SEQ ID NO: 5860816 - DNA, 14 bp, Homo sapiens
cagggagtggggag

SEQ ID NO: 5860817 - DNA, 16 bp, Homo sapiens
cagggagtgggggagg

SEQ ID NO: 5860818 - DNA, 20 bp, Homo sapiens
cagggagtgtagtaaagccg

SEQ ID NO: 5860819 - DNA, 17 bp, Homo sapiens
cagggagtgtctgcagt

SEQ ID NO: 5860820 - DNA, 18 bp, Homo sapiens
cagggataacaaagaacc

SEQ ID NO: 5860821 - DNA, 19 bp, Homo sapiens
cagggataaggcctgtggg

SEQ ID NO: 5860822 - DNA, 18 bp, Homo sapiens
cagggataccttaattct

SEQ ID NO: 5860823 - DNA, 15 bp, Homo sapiens
cagggatattgcctt

SEQ ID NO: 5860824 - DNA, 12 bp, Homo sapiens
cagggctccagg

SEQ ID NO: 5860825 - DNA, 12 bp, Homo sapiens
cagggctcccat

SEQ ID NO: 5860826 - DNA, 13 bp, Homo sapiens
cagggctcccgga

SEQ ID NO: 5860827 - DNA, 15 bp, Homo sapiens
cagggctcccggaga

SEQ ID NO: 5860828 - DNA, 17 bp, Homo sapiens
cagggctcccggagagg

SEQ ID NO: 5860829 - DNA, 21 bp, Homo sapiens
cagggctccctcctggagcat

SEQ ID NO: 5860830 - DNA, 14 bp, Homo sapiens
cagggctcctaggc

SEQ ID NO: 5860831 - DNA, 16 bp, Homo sapiens
cagggctcctcccagc

SEQ ID NO: 5860832 - DNA, 17 bp, Homo sapiens
cagggctcctcccagct

SEQ ID NO: 5860833 - DNA, 12 bp, Homo sapiens
cagggctcctgc

SEQ ID NO: 5860834 - DNA, 13 bp, Homo sapiens
cagggctcctgcc

SEQ ID NO: 5860835 - DNA, 15 bp, Homo sapiens
cagggctcctgtggc

SEQ ID NO: 5860836 - DNA, 16 bp, Homo sapiens
cagggctcctgtggca

SEQ ID NO: 5860837 - DNA, 23 bp, Homo sapiens
cagggctccttgtgggcctgggc

SEQ ID NO: 5860838 - DNA, 21 bp, Homo sapiens
cagggctcgggcgctgtggct

SEQ ID NO: 5860839 - DNA, 14 bp, Homo sapiens
cagggctctcctgg

SEQ ID NO: 5860840 - DNA, 15 bp, Homo sapiens
cagggctctcctggc

SEQ ID NO: 5860841 - DNA, 19 bp, Homo sapiens
cagggctctcctggcttcc

SEQ ID NO: 5860842 - DNA, 13 bp, Homo sapiens
cagggctctctgg

SEQ ID NO: 5860843 - DNA, 20 bp, Homo sapiens
cagggctctctttccttctt

SEQ ID NO: 5860844 - DNA, 22 bp, Homo sapiens
cagggctctctttccttcttgc

SEQ ID NO: 5860845 - DNA, 23 bp, Homo sapiens
cagggctctgactctgccagggt

SEQ ID NO: 5860846 - DNA, 18 bp, Homo sapiens
cagggctctgcaggccac

SEQ ID NO: 5860847 - DNA, 19 bp, Homo sapiens
cagggctctgccccagagg

SEQ ID NO: 5860848 - DNA, 11 bp, Homo sapiens
cagggctctgg

SEQ ID NO: 5860849 - DNA, 16 bp, Homo sapiens
cagggctctgggggca

SEQ ID NO: 5860850 - DNA, 18 bp, Homo sapiens
cagggctctgggggcaga

SEQ ID NO: 5860851 - DNA, 21 bp, Homo sapiens
cagggctctgggggcagattt

SEQ ID NO: 5860852 - DNA, 21 bp, Homo sapiens
cagggctgagcgtggaagggg

SEQ ID NO: 5860853 - DNA, 12 bp, Homo sapiens
cagggctgagga

SEQ ID NO: 5860854 - DNA, 17 bp, Homo sapiens
cagggctgaggatgggc

SEQ ID NO: 5860855 - DNA, 21 bp, Homo sapiens
cagggctgcaaaactggaagc

SEQ ID NO: 5860856 - DNA, 17 bp, Homo sapiens
cagggctgcatcccgag

SEQ ID NO: 5860857 - DNA, 20 bp, Homo sapiens
cagggctgcattgggagcat

SEQ ID NO: 5860858 - DNA, 14 bp, Homo sapiens
cagggctgccacta

SEQ ID NO: 5860859 - DNA, 12 bp, Homo sapiens
cagggctgccag

SEQ ID NO: 5860860 - DNA, 12 bp, Homo sapiens
cagggctgcccc

SEQ ID NO: 5860861 - DNA, 18 bp, Homo sapiens
cagggctgcccctgtagg

SEQ ID NO: 5860862 - DNA, 16 bp, Homo sapiens
cagggctgccctgaga

SEQ ID NO: 5860863 - DNA, 14 bp, Homo sapiens
cagggctgctagac

SEQ ID NO: 5860864 - DNA, 14 bp, Homo sapiens
cagggctgctcccc

SEQ ID NO: 5860865 - DNA, 13 bp, Homo sapiens
cagggctgctctt

SEQ ID NO: 5860866 - DNA, 12 bp, Homo sapiens
cagggctgctgt

SEQ ID NO: 5860867 - DNA, 15 bp, Homo sapiens
cagggctgctgtggc

SEQ ID NO: 5860868 - DNA, 19 bp, Homo sapiens
cagggctggaaaagtcaca

SEQ ID NO: 5860869 - DNA, 18 bp, Homo sapiens
cagggctggaatgggaga

SEQ ID NO: 5860870 - DNA, 14 bp, Homo sapiens
cagggctggactga

SEQ ID NO: 5860871 - DNA, 12 bp, Homo sapiens
cagggctggagc

SEQ ID NO: 5860872 - DNA, 13 bp, Homo sapiens
cagggctggagcc

SEQ ID NO: 5860873 - DNA, 21 bp, Homo sapiens
cagggctggatggacagacac

SEQ ID NO: 5860874 - DNA, 21 bp, Homo sapiens
cagggctggccctaggcactg

SEQ ID NO: 5860875 - DNA, 12 bp, Homo sapiens
cagggctggctc

SEQ ID NO: 5860876 - DNA, 13 bp, Homo sapiens
cagggctggctcc

SEQ ID NO: 5860877 - DNA, 14 bp, Homo sapiens
cagggctggctctg

SEQ ID NO: 5860878 - DNA, 22 bp, Homo sapiens
cagggctggctctgcactaaga

SEQ ID NO: 5860879 - DNA, 14 bp, Homo sapiens
cagggctgggagga

SEQ ID NO: 5860880 - DNA, 19 bp, Homo sapiens
cagggctgggaggaaggac

SEQ ID NO: 5860881 - DNA, 17 bp, Homo sapiens
cagggctgggccaggtc

SEQ ID NO: 5860882 - DNA, 20 bp, Homo sapiens
cagggctgggccaggtctcc

SEQ ID NO: 5860883 - DNA, 16 bp, Homo sapiens
cagggctggggtgagc

SEQ ID NO: 5860884 - DNA, 15 bp, Homo sapiens
cagggctggggttgc

SEQ ID NO: 5860885 - DNA, 24 bp, Homo sapiens
cagggctggggttgccagaggccc

SEQ ID NO: 5860886 - DNA, 13 bp, Homo sapiens
cagggctgggtca

SEQ ID NO: 5860887 - DNA, 17 bp, Homo sapiens
cagggctgggtcagggg

SEQ ID NO: 5860888 - DNA, 21 bp, Homo sapiens
cagggctggtcacctcccatc

SEQ ID NO: 5860889 - DNA, 23 bp, Homo sapiens
cagggctggtttgttctgacttt

SEQ ID NO: 5860890 - DNA, 13 bp, Homo sapiens
cagggctgtgcac

SEQ ID NO: 5860891 - DNA, 20 bp, Homo sapiens
cagggctgttggaggacccc

SEQ ID NO: 5860892 - DNA, 18 bp, Homo sapiens
cagggcttacctgtacac

SEQ ID NO: 5860893 - DNA, 22 bp, Homo sapiens
cagggcttcagatattttgcac

SEQ ID NO: 5860894 - DNA, 21 bp, Homo sapiens
cagggcttccccatcagctcc

SEQ ID NO: 5860895 - DNA, 17 bp, Homo sapiens
cagggcttctcctctgc

SEQ ID NO: 5860896 - DNA, 18 bp, Homo sapiens
cagggcttctcctctgct

SEQ ID NO: 5860897 - DNA, 22 bp, Homo sapiens
cagggcttctcctctgctaggc

SEQ ID NO: 5860898 - DNA, 16 bp, Homo sapiens
cagggcttctcctgcg

SEQ ID NO: 5860899 - DNA, 14 bp, Homo sapiens
cagggcttctcttt

SEQ ID NO: 5860900 - DNA, 16 bp, Homo sapiens
cagggcttgctcctgc

SEQ ID NO: 5860901 - DNA, 17 bp, Homo sapiens
cagggcttgctcctgcc

SEQ ID NO: 5860902 - DNA, 16 bp, Homo sapiens
cagggcttggggagca

SEQ ID NO: 5860903 - DNA, 19 bp, Homo sapiens
cagggcttgtggactctct

SEQ ID NO: 5860904 - DNA, 13 bp, Homo sapiens
cagggctttaaaa

SEQ ID NO: 5860905 - DNA, 15 bp, Homo sapiens
cagggctttaaaatt

SEQ ID NO: 5860906 - DNA, 16 bp, Homo sapiens
caggggaaactctggt

SEQ ID NO: 5860907 - DNA, 17 bp, Homo sapiens
caggggaagcaggaccc

SEQ ID NO: 5860908 - DNA, 22 bp, Homo sapiens
caggggaagccagtgacactaa

SEQ ID NO: 5860909 - DNA, 18 bp, Homo sapiens
caggggaagctgctaggg

SEQ ID NO: 5860910 - DNA, 19 bp, Homo sapiens
caggggaagctgctagggg

SEQ ID NO: 5860911 - DNA, 11 bp, Homo sapiens
caggggaaggg

SEQ ID NO: 5860912 - DNA, 13 bp, Homo sapiens
caggggaagggca

SEQ ID NO: 5860913 - DNA, 18 bp, Homo sapiens
caggggaagggcaggcac

SEQ ID NO: 5860914 - DNA, 16 bp, Homo sapiens
caggggaatattttat

SEQ ID NO: 5860915 - DNA, 18 bp, Homo sapiens
caggggaatattttattc

SEQ ID NO: 5860916 - DNA, 21 bp, Homo sapiens
caggggaatgctaagccagtt

SEQ ID NO: 5860917 - DNA, 22 bp, Homo sapiens
caggggaattccctccccctcc

SEQ ID NO: 5860918 - DNA, 16 bp, Homo sapiens
caggggacactttgtt

SEQ ID NO: 5860919 - DNA, 14 bp, Homo sapiens
caggggacagctgg

SEQ ID NO: 5860920 - DNA, 22 bp, Homo sapiens
caggggacaggagtccactttg

SEQ ID NO: 5860921 - DNA, 12 bp, Homo sapiens
caggggaccaga

SEQ ID NO: 5860922 - DNA, 20 bp, Homo sapiens
caggggaccagagggatggg

SEQ ID NO: 5860923 - DNA, 13 bp, Homo sapiens
caggggaccccac

SEQ ID NO: 5860924 - DNA, 14 bp, Homo sapiens
caggggaccccact

SEQ ID NO: 5860925 - DNA, 23 bp, Homo sapiens
caggggactcagccctgaggtga

SEQ ID NO: 5860926 - DNA, 11 bp, Homo sapiens
caggggactgg

SEQ ID NO: 5860927 - DNA, 16 bp, Homo sapiens
caggggactgggccat

SEQ ID NO: 5860928 - DNA, 17 bp, Homo sapiens
caggggactgggccatg

SEQ ID NO: 5860929 - DNA, 15 bp, Homo sapiens
caggggactgtctca

SEQ ID NO: 5860930 - DNA, 16 bp, Homo sapiens
caggggactgtctcag

SEQ ID NO: 5860931 - DNA, 21 bp, Homo sapiens
caggggactgtctcagaagac

SEQ ID NO: 5860932 - DNA, 20 bp, Homo sapiens
caggggagaagcgggctggg

SEQ ID NO: 5860933 - DNA, 18 bp, Homo sapiens
caggggagacaggagcct

SEQ ID NO: 5860934 - DNA, 22 bp, Homo sapiens
caggggagacttaggccagagg

SEQ ID NO: 5860935 - DNA, 19 bp, Homo sapiens
caggggagaggcattgcct

SEQ ID NO: 5860936 - DNA, 16 bp, Homo sapiens
caggggagatggggag

SEQ ID NO: 5860937 - DNA, 21 bp, Homo sapiens
caggggagcagaggggcagag

SEQ ID NO: 5860938 - DNA, 14 bp, Homo sapiens
caggggagccagct

SEQ ID NO: 5860939 - DNA, 17 bp, Homo sapiens
caggggagccagctgct

SEQ ID NO: 5860940 - DNA, 19 bp, Homo sapiens
caggggagccagggtagag

SEQ ID NO: 5860941 - DNA, 18 bp, Homo sapiens
caggggagcttgggactc

SEQ ID NO: 5860942 - DNA, 20 bp, Homo sapiens
caggggagcttgggactcag

SEQ ID NO: 5860943 - DNA, 21 bp, Homo sapiens
caggggagcttgggactcagg

SEQ ID NO: 5860944 - DNA, 13 bp, Homo sapiens
caggggaggaaaa

SEQ ID NO: 5860945 - DNA, 19 bp, Homo sapiens
caggggaggaaaaaagaac

SEQ ID NO: 5860946 - DNA, 14 bp, Homo sapiens
caggggaggagcct

SEQ ID NO: 5860947 - DNA, 14 bp, Homo sapiens
caggggaggccatc

SEQ ID NO: 5860948 - DNA, 21 bp, Homo sapiens
caggggaggccatctggagag

SEQ ID NO: 5860949 - DNA, 19 bp, Homo sapiens
caggggaggcggcactcca

SEQ ID NO: 5860950 - DNA, 13 bp, Homo sapiens
caggggaggctga

SEQ ID NO: 5860951 - DNA, 17 bp, Homo sapiens
caggggagggaaaagct

SEQ ID NO: 5860952 - DNA, 22 bp, Homo sapiens
caggggaggggcgcaccccaca

SEQ ID NO: 5860953 - DNA, 17 bp, Homo sapiens
caggggagggggcaaag

SEQ ID NO: 5860954 - DNA, 19 bp, Homo sapiens
caggggagggtagagcgga

SEQ ID NO: 5860955 - DNA, 18 bp, Homo sapiens
caggggagggtcagccag

SEQ ID NO: 5860956 - DNA, 19 bp, Homo sapiens
caggggagggtcagccagg

SEQ ID NO: 5860957 - DNA, 20 bp, Homo sapiens
caggggagggtcagccaggg

SEQ ID NO: 5860958 - DNA, 13 bp, Homo sapiens
caggggagggtcc

SEQ ID NO: 5860959 - DNA, 16 bp, Homo sapiens
caggggaggtgatagc

SEQ ID NO: 5860960 - DNA, 18 bp, Homo sapiens
caggggagtcccgtcagg

SEQ ID NO: 5860961 - DNA, 19 bp, Homo sapiens
caggggatccagctcaagg

SEQ ID NO: 5860962 - DNA, 22 bp, Homo sapiens
caggggatccagctcaagggag

SEQ ID NO: 5860963 - DNA, 17 bp, Homo sapiens
caggggatctgggtgtg

SEQ ID NO: 5860964 - DNA, 22 bp, Homo sapiens
caggggatggcgtggtcaagca

SEQ ID NO: 5860965 - DNA, 21 bp, Homo sapiens
caggggatgtttacctggtgc

SEQ ID NO: 5860966 - DNA, 21 bp, Homo sapiens
caggggattctgtgttttcag

SEQ ID NO: 5860967 - DNA, 16 bp, Homo sapiens
caggggattggcgccc

SEQ ID NO: 5860968 - DNA, 13 bp, Homo sapiens
caggggcaaggtc

SEQ ID NO: 5860969 - DNA, 15 bp, Homo sapiens
caggggcacctccgg

SEQ ID NO: 5860970 - DNA, 21 bp, Homo sapiens
caggggcacctccggctgcct

SEQ ID NO: 5860971 - DNA, 13 bp, Homo sapiens
caggggcagaagg

SEQ ID NO: 5860972 - DNA, 16 bp, Homo sapiens
caggggcagcaaggcc

SEQ ID NO: 5860973 - DNA, 20 bp, Homo sapiens
caggggcagcaaggccttgg

SEQ ID NO: 5860974 - DNA, 23 bp, Homo sapiens
caggggcagccacaccactgcca

SEQ ID NO: 5860975 - DNA, 18 bp, Homo sapiens
caggggcagccccaggcc

SEQ ID NO: 5860976 - DNA, 15 bp, Homo sapiens
caggggcaggactga

SEQ ID NO: 5860977 - DNA, 22 bp, Homo sapiens
caggggcaggcacagcacaggg

SEQ ID NO: 5860978 - DNA, 15 bp, Homo sapiens
caggggcaggcagct

SEQ ID NO: 5860979 - DNA, 16 bp, Homo sapiens
caggggcaggcagcta

SEQ ID NO: 5860980 - DNA, 15 bp, Homo sapiens
caggggcaggcaggg

SEQ ID NO: 5860981 - DNA, 17 bp, Homo sapiens
caggggcaggcagggct

SEQ ID NO: 5860982 - DNA, 12 bp, Homo sapiens
caggggcaggcc

SEQ ID NO: 5860983 - DNA, 14 bp, Homo sapiens
caggggcaggcctg

SEQ ID NO: 5860984 - DNA, 15 bp, Homo sapiens
caggggcaggcctgg

SEQ ID NO: 5860985 - DNA, 15 bp, Homo sapiens
caggggcaggcgcag

SEQ ID NO: 5860986 - DNA, 18 bp, Homo sapiens
caggggcaggtggtggag

SEQ ID NO: 5860987 - DNA, 18 bp, Homo sapiens
caggggcagtcagtggag

SEQ ID NO: 5860988 - DNA, 22 bp, Homo sapiens
caggggcagtcagtggagggcg

SEQ ID NO: 5860989 - DNA, 13 bp, Homo sapiens
caggggcagtggc

SEQ ID NO: 5860990 - DNA, 14 bp, Homo sapiens
caggggcatctctg

SEQ ID NO: 5860991 - DNA, 16 bp, Homo sapiens
caggggcatctctggg

SEQ ID NO: 5860992 - DNA, 23 bp, Homo sapiens
caggggcatgtattggcctggag

SEQ ID NO: 5860993 - DNA, 22 bp, Homo sapiens
caggggccaaactggtgggagg

SEQ ID NO: 5860994 - DNA, 19 bp, Homo sapiens
caggggccaacctcaggct

SEQ ID NO: 5860995 - DNA, 19 bp, Homo sapiens
caggggccactccaaactc

SEQ ID NO: 5860996 - DNA, 14 bp, Homo sapiens
caggggccagaaga

SEQ ID NO: 5860997 - DNA, 14 bp, Homo sapiens
caggggccagagag

SEQ ID NO: 5860998 - DNA, 22 bp, Homo sapiens
caggggccagagagcaggggag

SEQ ID NO: 5860999 - DNA, 20 bp, Homo sapiens
caggggccaggagtggggag

SEQ ID NO: 5861000 - DNA, 18 bp, Homo sapiens
caggggccaggggtggga

SEQ ID NO: 5861001 - DNA, 22 bp, Homo sapiens
caggggcccaccctctgcccag

SEQ ID NO: 5861002 - DNA, 19 bp, Homo sapiens
caggggcccacttggggcc

SEQ ID NO: 5861003 - DNA, 13 bp, Homo sapiens
caggtactcctgc

SEQ ID NO: 5861004 - DNA, 19 bp, Homo sapiens
caggtactcctgccaggga

SEQ ID NO: 5861005 - DNA, 14 bp, Homo sapiens
caggtactgagtgg

SEQ ID NO: 5861006 - DNA, 20 bp, Homo sapiens
caggtacttcctcctgatgg

SEQ ID NO: 5861007 - DNA, 21 bp, Homo sapiens
caggtacttcctcctgatggc

SEQ ID NO: 5861008 - DNA, 20 bp, Homo sapiens
caggtacttggagggctcag

SEQ ID NO: 5861009 - DNA, 18 bp, Homo sapiens
caggtagaaaagaaatgg

SEQ ID NO: 5861010 - DNA, 18 bp, Homo sapiens
caggtagaccatattcta

SEQ ID NO: 5861011 - DNA, 21 bp, Homo sapiens
caggtagatcacttgatgcca

SEQ ID NO: 5861012 - DNA, 18 bp, Homo sapiens
caggtagatcgcttgagc

SEQ ID NO: 5861013 - DNA, 19 bp, Homo sapiens
caggtagatcgcttgagcc

SEQ ID NO: 5861014 - DNA, 15 bp, Homo sapiens
caggtagcagcaaat

SEQ ID NO: 5861015 - DNA, 21 bp, Homo sapiens
caggtagcatagctctgtaca

SEQ ID NO: 5861016 - DNA, 12 bp, Homo sapiens
caggtagccagg

SEQ ID NO: 5861017 - DNA, 13 bp, Homo sapiens
caggtagcctatt

SEQ ID NO: 5861018 - DNA, 14 bp, Homo sapiens
caggtagctgcccc

SEQ ID NO: 5861019 - DNA, 19 bp, Homo sapiens
caggtagctgcccctggct

SEQ ID NO: 5861020 - DNA, 20 bp, Homo sapiens
caggtagctgcccctggctc

SEQ ID NO: 5861021 - DNA, 21 bp, Homo sapiens
caggtagctgcccctggctct

SEQ ID NO: 5861022 - DNA, 15 bp, Homo sapiens
caggtaggaatatta

SEQ ID NO: 5861023 - DNA, 20 bp, Homo sapiens
caggtaggaatattatattt

SEQ ID NO: 5861024 - DNA, 23 bp, Homo sapiens
caggtaggaggcaaatatcttga

SEQ ID NO: 5861025 - DNA, 22 bp, Homo sapiens
caggtaggccaaggtgtcctac

SEQ ID NO: 5861026 - DNA, 19 bp, Homo sapiens
caggtaggcccttgtcctg

SEQ ID NO: 5861027 - DNA, 21 bp, Homo sapiens
caggtaggcccttgtcctgcc

SEQ ID NO: 5861028 - DNA, 16 bp, Homo sapiens
caggtagggaaataat

SEQ ID NO: 5861029 - DNA, 16 bp, Homo sapiens
caggtagggagctaag

SEQ ID NO: 5861030 - DNA, 13 bp, Homo sapiens
caggtagggggga

SEQ ID NO: 5861031 - DNA, 21 bp, Homo sapiens
caggtagggggtccctccaag

SEQ ID NO: 5861032 - DNA, 22 bp, Homo sapiens
caggtagtatatggtggagcca

SEQ ID NO: 5861033 - DNA, 22 bp, Homo sapiens
caggtagttggtgaacagagag

SEQ ID NO: 5861034 - DNA, 24 bp, Homo sapiens
caggtagttggtgaacagagagaa

SEQ ID NO: 5861035 - DNA, 22 bp, Homo sapiens
caggtataaacacaccctctgt

SEQ ID NO: 5861036 - DNA, 16 bp, Homo sapiens
caggtatacctcactt

SEQ ID NO: 5861037 - DNA, 15 bp, Homo sapiens
caggtatcaggcaca

SEQ ID NO: 5861038 - DNA, 17 bp, Homo sapiens
caggtatcaggcacagg

SEQ ID NO: 5861039 - DNA, 22 bp, Homo sapiens
caggtatcaggcacaggcagga

SEQ ID NO: 5861040 - DNA, 22 bp, Homo sapiens
caggtatctccaggattgaaga

SEQ ID NO: 5861041 - DNA, 23 bp, Homo sapiens
caggtatggaagggtttgtggct

SEQ ID NO: 5861042 - DNA, 16 bp, Homo sapiens
caggtatggctctgca

SEQ ID NO: 5861043 - DNA, 14 bp, Homo sapiens
caggtatgttgcct

SEQ ID NO: 5861044 - DNA, 15 bp, Homo sapiens
caggtatgttgcctt

SEQ ID NO: 5861045 - DNA, 20 bp, Homo sapiens
caggtatgttgcctttatgg

SEQ ID NO: 5861046 - DNA, 17 bp, Homo sapiens
caggtattaatcttgga

SEQ ID NO: 5861047 - DNA, 13 bp, Homo sapiens
caggtattgtctt

SEQ ID NO: 5861048 - DNA, 16 bp, Homo sapiens
caggtatttagaagca

SEQ ID NO: 5861049 - DNA, 18 bp, Homo sapiens
caggtatttcagaaggag

SEQ ID NO: 5861050 - DNA, 22 bp, Homo sapiens
caggtatttcagaaggagaagg

SEQ ID NO: 5861051 - DNA, 18 bp, Homo sapiens
caggtattttataattct

SEQ ID NO: 5861052 - DNA, 21 bp, Homo sapiens
caggtattttcatcaagtagc

SEQ ID NO: 5861053 - DNA, 19 bp, Homo sapiens
caggtatttttttaaatca

SEQ ID NO: 5861054 - DNA, 22 bp, Homo sapiens
caggtatttttttaaatcaagg

SEQ ID NO: 5861055 - DNA, 20 bp, Homo sapiens
caggtcaaagatgtgttcag

SEQ ID NO: 5861056 - DNA, 13 bp, Homo sapiens
caggtcaacagaa

SEQ ID NO: 5861057 - DNA, 17 bp, Homo sapiens
caggtcaacagaatgaa

SEQ ID NO: 5861058 - DNA, 19 bp, Homo sapiens
caggtcaacagaatgaaaa

SEQ ID NO: 5861059 - DNA, 20 bp, Homo sapiens
caggtcaccagcctgactgc

SEQ ID NO: 5861060 - DNA, 13 bp, Homo sapiens
caggtcaccatcc

SEQ ID NO: 5861061 - DNA, 15 bp, Homo sapiens
caggtcaccatcctc

SEQ ID NO: 5861062 - DNA, 16 bp, Homo sapiens
caggtcaccatcctca

SEQ ID NO: 5861063 - DNA, 18 bp, Homo sapiens
caggtcaccatcctcaga

SEQ ID NO: 5861064 - DNA, 19 bp, Homo sapiens
caggtcaccatcctcagag

SEQ ID NO: 5861065 - DNA, 21 bp, Homo sapiens
caggtcaccatcctcagaggc

SEQ ID NO: 5861066 - DNA, 18 bp, Homo sapiens
caggtcacccatcaggac

SEQ ID NO: 5861067 - DNA, 15 bp, Homo sapiens
caggtcaccgcgagg

SEQ ID NO: 5861068 - DNA, 17 bp, Homo sapiens
caggtcactgtcactgc

SEQ ID NO: 5861069 - DNA, 18 bp, Homo sapiens
caggtcagagcccaggaa

SEQ ID NO: 5861070 - DNA, 14 bp, Homo sapiens
caggtcagcccatg

SEQ ID NO: 5861071 - DNA, 17 bp, Homo sapiens
caggtcagcccatggag

SEQ ID NO: 5861072 - DNA, 19 bp, Homo sapiens
caggtcagcccatggaggc

SEQ ID NO: 5861073 - DNA, 14 bp, Homo sapiens
caggtcagccctgt

SEQ ID NO: 5861074 - DNA, 13 bp, Homo sapiens
caggtcagcctgg

SEQ ID NO: 5861075 - DNA, 21 bp, Homo sapiens
caggtcagcgcggtcctgact

SEQ ID NO: 5861076 - DNA, 13 bp, Homo sapiens
caggtcagctggg

SEQ ID NO: 5861077 - DNA, 15 bp, Homo sapiens
caggtcagctgggag

SEQ ID NO: 5861078 - DNA, 16 bp, Homo sapiens
caggtcagctgttact

SEQ ID NO: 5861079 - DNA, 21 bp, Homo sapiens
caggtcagggaggatctgttc

SEQ ID NO: 5861080 - DNA, 17 bp, Homo sapiens
caggtcaggggctccct

SEQ ID NO: 5861081 - DNA, 23 bp, Homo sapiens
caggtcaggggtgacacagactc

SEQ ID NO: 5861082 - DNA, 17 bp, Homo sapiens
caggtcaggtggctgtg

SEQ ID NO: 5861083 - DNA, 20 bp, Homo sapiens
caggtcagttgtaataaatc

SEQ ID NO: 5861084 - DNA, 13 bp, Homo sapiens
caggtcagtttat

SEQ ID NO: 5861085 - DNA, 20 bp, Homo sapiens
caggtcatattaatatattt

SEQ ID NO: 5861086 - DNA, 12 bp, Homo sapiens
caggtcatcaga

SEQ ID NO: 5861087 - DNA, 16 bp, Homo sapiens
caggtcatcagatgcc

SEQ ID NO: 5861088 - DNA, 19 bp, Homo sapiens
caggtcatgcagttcctgg

SEQ ID NO: 5861089 - DNA, 18 bp, Homo sapiens
caggtcatggagcagccc

SEQ ID NO: 5861090 - DNA, 20 bp, Homo sapiens
caggtcattttttttttctg

SEQ ID NO: 5861091 - DNA, 22 bp, Homo sapiens
caggtccaaacccttcaactcc

SEQ ID NO: 5861092 - DNA, 22 bp, Homo sapiens
caggtccaaggacaccctccct

SEQ ID NO: 5861093 - DNA, 19 bp, Homo sapiens
caggtccaatgagctttct

SEQ ID NO: 5861094 - DNA, 21 bp, Homo sapiens
caggtccaatgagctttctga

SEQ ID NO: 5861095 - DNA, 22 bp, Homo sapiens
caggtccaatgagctttctgaa

SEQ ID NO: 5861096 - DNA, 22 bp, Homo sapiens
caggtccacggtctgttcttga

SEQ ID NO: 5861097 - DNA, 15 bp, Homo sapiens
caggtccagctctgt

SEQ ID NO: 5861098 - DNA, 20 bp, Homo sapiens
caggtccagctctgtgggcc

SEQ ID NO: 5861099 - DNA, 15 bp, Homo sapiens
caggtccaggccagt

SEQ ID NO: 5861100 - DNA, 13 bp, Homo sapiens
caggtccattctg

SEQ ID NO: 5861101 - DNA, 18 bp, Homo sapiens
caggtccattttgcctga

SEQ ID NO: 5861102 - DNA, 18 bp, Homo sapiens
caggtcccacctccagcc

SEQ ID NO: 5861103 - DNA, 19 bp, Homo sapiens
caggtcccacgccaggcca

SEQ ID NO: 5861104 - DNA, 21 bp, Homo sapiens
caggtcccacgccaggccagc

SEQ ID NO: 5861105 - DNA, 18 bp, Homo sapiens
caggtcccacgtctggcc

SEQ ID NO: 5861106 - DNA, 15 bp, Homo sapiens
caggtcccagcccct

SEQ ID NO: 5861107 - DNA, 17 bp, Homo sapiens
caggtcccagcgagcca

SEQ ID NO: 5861108 - DNA, 19 bp, Homo sapiens
caggtcccagcgagccaca

SEQ ID NO: 5861109 - DNA, 14 bp, Homo sapiens
caggtcccaggttg

SEQ ID NO: 5861110 - DNA, 21 bp, Homo sapiens
caggtcccagttgctgtcaca

SEQ ID NO: 5861111 - DNA, 20 bp, Homo sapiens
caggtccccaattgagaatg

SEQ ID NO: 5861112 - DNA, 14 bp, Homo sapiens
caggtccccatggc

SEQ ID NO: 5861113 - DNA, 15 bp, Homo sapiens
caggtccccatggct

SEQ ID NO: 5861114 - DNA, 16 bp, Homo sapiens
caggtccccatggctt

SEQ ID NO: 5861115 - DNA, 16 bp, Homo sapiens
caggtcccccccaggt

SEQ ID NO: 5861116 - DNA, 20 bp, Homo sapiens
caggtcccccgactgcctgt

SEQ ID NO: 5861117 - DNA, 23 bp, Homo sapiens
caggtcccccgactgcctgtctc

SEQ ID NO: 5861118 - DNA, 14 bp, Homo sapiens
caggtccccctgca

SEQ ID NO: 5861119 - DNA, 21 bp, Homo sapiens
caggtcccctggcccttcctt

SEQ ID NO: 5861120 - DNA, 20 bp, Homo sapiens
caggtcccgagccccctgtc

SEQ ID NO: 5861121 - DNA, 11 bp, Homo sapiens
caggtccctaa

SEQ ID NO: 5861122 - DNA, 13 bp, Homo sapiens
caggtccctaata

SEQ ID NO: 5861123 - DNA, 15 bp, Homo sapiens
caggtccctaataaa

SEQ ID NO: 5861124 - DNA, 17 bp, Homo sapiens
caggtccctaataaagc

SEQ ID NO: 5861125 - DNA, 22 bp, Homo sapiens
caggtccctaataaagctgtgt

SEQ ID NO: 5861126 - DNA, 20 bp, Homo sapiens
caggtccctccgcggctgga

SEQ ID NO: 5861127 - DNA, 23 bp, Homo sapiens
caggtccctccgcggctggagcg

SEQ ID NO: 5861128 - DNA, 24 bp, Homo sapiens
caggtccctccgcggctggagcga

SEQ ID NO: 5861129 - DNA, 22 bp, Homo sapiens
caggtccctcctttggaccctg

SEQ ID NO: 5861130 - DNA, 16 bp, Homo sapiens
caggtccctctcattt

SEQ ID NO: 5861131 - DNA, 13 bp, Homo sapiens
caggtccggaggg

SEQ ID NO: 5861132 - DNA, 15 bp, Homo sapiens
caggtccggggagga

SEQ ID NO: 5861133 - DNA, 17 bp, Homo sapiens
caggtccggggaggagg

SEQ ID NO: 5861134 - DNA, 17 bp, Homo sapiens
caggtccgtagctcccc

SEQ ID NO: 5861135 - DNA, 21 bp, Homo sapiens
caggtccgtagctcccctggc

SEQ ID NO: 5861136 - DNA, 20 bp, Homo sapiens
caggtcctagtcgggcaggg

SEQ ID NO: 5861137 - DNA, 23 bp, Homo sapiens
caggtcctgaaagtctgtgtcca

SEQ ID NO: 5861138 - DNA, 23 bp, Homo sapiens
caggtcctgcccatgtgtcccct

SEQ ID NO: 5861139 - DNA, 23 bp, Homo sapiens
caggtcctgctccgctgcctgga

SEQ ID NO: 5861140 - DNA, 18 bp, Homo sapiens
caggtcctggggaggctg

SEQ ID NO: 5861141 - DNA, 21 bp, Homo sapiens
caggtcctggggaggctgaga

SEQ ID NO: 5861142 - DNA, 23 bp, Homo sapiens
caggtcctggggaggctgagact

SEQ ID NO: 5861143 - DNA, 20 bp, Homo sapiens
caggtcctggtggggcagct

SEQ ID NO: 5861144 - DNA, 23 bp, Homo sapiens
caggtcctggtggggcagctcct

SEQ ID NO: 5861145 - DNA, 18 bp, Homo sapiens
caggtcctggtgggtcag

SEQ ID NO: 5861146 - DNA, 14 bp, Homo sapiens
caggtcctttcctt

SEQ ID NO: 5861147 - DNA, 17 bp, Homo sapiens
caggtcgagctgtgctc

SEQ ID NO: 5861148 - DNA, 19 bp, Homo sapiens
caggtcggagtgcctggag

SEQ ID NO: 5861149 - DNA, 22 bp, Homo sapiens
caggtcggagtgcctggagtca

SEQ ID NO: 5861150 - DNA, 16 bp, Homo sapiens
caggtcgggcagtgga

SEQ ID NO: 5861151 - DNA, 16 bp, Homo sapiens
caggtcgggcgcagga

SEQ ID NO: 5861152 - DNA, 19 bp, Homo sapiens
caggtcgggctcagctctg

SEQ ID NO: 5861153 - DNA, 15 bp, Homo sapiens
caggtcgggctgcca

SEQ ID NO: 5861154 - DNA, 16 bp, Homo sapiens
caggtcgggctgccag

SEQ ID NO: 5861155 - DNA, 19 bp, Homo sapiens
caggtcgtagcatttggag

SEQ ID NO: 5861156 - DNA, 22 bp, Homo sapiens
caggtctagaaggccaggcctc

SEQ ID NO: 5861157 - DNA, 20 bp, Homo sapiens
caggtctcaaggttctcatt

SEQ ID NO: 5861158 - DNA, 14 bp, Homo sapiens
caggtctcacgggc

SEQ ID NO: 5861159 - DNA, 20 bp, Homo sapiens
caggtctcagaatctttcct

SEQ ID NO: 5861160 - DNA, 13 bp, Homo sapiens
caggtctccacca

SEQ ID NO: 5861161 - DNA, 23 bp, Homo sapiens
caggtctccaccaaggaggcagg

SEQ ID NO: 5861162 - DNA, 13 bp, Homo sapiens
caggtctcccacg

SEQ ID NO: 5861163 - DNA, 20 bp, Homo sapiens
caggtctcccacgtgggaga

SEQ ID NO: 5861164 - DNA, 13 bp, Homo sapiens
caggtctcccggg

SEQ ID NO: 5861165 - DNA, 16 bp, Homo sapiens
caggtctcctgggaaa

SEQ ID NO: 5861166 - DNA, 20 bp, Homo sapiens
caggtctcctgggcatctgg

SEQ ID NO: 5861167 - DNA, 17 bp, Homo sapiens
caggtctctccactgct

SEQ ID NO: 5861168 - DNA, 11 bp, Homo sapiens
caggtctctga

SEQ ID NO: 5861169 - DNA, 12 bp, Homo sapiens
caggtctctgtt

SEQ ID NO: 5861170 - DNA, 14 bp, Homo sapiens
caggtctcttctgg

SEQ ID NO: 5861171 - DNA, 15 bp, Homo sapiens
caggtctcttctggg

SEQ ID NO: 5861172 - DNA, 17 bp, Homo sapiens
caggtctcttctgggcg

SEQ ID NO: 5861173 - DNA, 15 bp, Homo sapiens
caggtctgactccaa

SEQ ID NO: 5861174 - DNA, 16 bp, Homo sapiens
caggtctgactccaaa

SEQ ID NO: 5861175 - DNA, 18 bp, Homo sapiens
caggtctgactccaaagc

SEQ ID NO: 5861176 - DNA, 13 bp, Homo sapiens
caggtctgagata

SEQ ID NO: 5861177 - DNA, 19 bp, Homo sapiens
caggtctgatgccaaagct

SEQ ID NO: 5861178 - DNA, 16 bp, Homo sapiens
caggtctgcaagggcc

SEQ ID NO: 5861179 - DNA, 16 bp, Homo sapiens
cagtaccttctgccag

SEQ ID NO: 5861180 - DNA, 17 bp, Homo sapiens
cagtaccttctgccaga

SEQ ID NO: 5861181 - DNA, 15 bp, Homo sapiens
cagtacctttgtcac

SEQ ID NO: 5861182 - DNA, 16 bp, Homo sapiens
cagtacctttgtcaca

SEQ ID NO: 5861183 - DNA, 18 bp, Homo sapiens
cagtactaacatttattt

SEQ ID NO: 5861184 - DNA, 14 bp, Homo sapiens
cagtactcaaattc

SEQ ID NO: 5861185 - DNA, 14 bp, Homo sapiens
cagtactcctccct

SEQ ID NO: 5861186 - DNA, 17 bp, Homo sapiens
cagtactcctccctggg

SEQ ID NO: 5861187 - DNA, 19 bp, Homo sapiens
cagtactcctccctggggg

SEQ ID NO: 5861188 - DNA, 21 bp, Homo sapiens
cagtactcctccctgggggcg

SEQ ID NO: 5861189 - DNA, 17 bp, Homo sapiens
cagtactgacagaaagc

SEQ ID NO: 5861190 - DNA, 13 bp, Homo sapiens
cagtactggagct

SEQ ID NO: 5861191 - DNA, 17 bp, Homo sapiens
cagtactggttactttc

SEQ ID NO: 5861192 - DNA, 18 bp, Homo sapiens
cagtactggttactttca

SEQ ID NO: 5861193 - DNA, 23 bp, Homo sapiens
cagtactggttactttcaaaatg

SEQ ID NO: 5861194 - DNA, 18 bp, Homo sapiens
cagtacttcagcaagaga

SEQ ID NO: 5861195 - DNA, 19 bp, Homo sapiens
cagtacttcagcaagagag

SEQ ID NO: 5861196 - DNA, 24 bp, Homo sapiens
cagtacttcagcaagagagaacct

SEQ ID NO: 5861197 - DNA, 12 bp, Homo sapiens
cagtacttctaa

SEQ ID NO: 5861198 - DNA, 14 bp, Homo sapiens
cagtacttctaaga

SEQ ID NO: 5861199 - DNA, 18 bp, Homo sapiens
cagtacttgctcaataaa

SEQ ID NO: 5861200 - DNA, 13 bp, Homo sapiens
cagtacttgtcat

SEQ ID NO: 5861201 - DNA, 21 bp, Homo sapiens
cagtacttgtgaaacacagct

SEQ ID NO: 5861202 - DNA, 21 bp, Homo sapiens
cagtactttatgaaaaaaata

SEQ ID NO: 5861203 - DNA, 16 bp, Homo sapiens
cagtactttgtgcatt

SEQ ID NO: 5861204 - DNA, 18 bp, Homo sapiens
cagtactttgtgcattct

SEQ ID NO: 5861205 - DNA, 22 bp, Homo sapiens
cagtacttttattaatatttgt

SEQ ID NO: 5861206 - DNA, 15 bp, Homo sapiens
cagtacttttctctg

SEQ ID NO: 5861207 - DNA, 15 bp, Homo sapiens
cagtacttttttaaa

SEQ ID NO: 5861208 - DNA, 23 bp, Homo sapiens
cagtacttttttaaatattttct

SEQ ID NO: 5861209 - DNA, 14 bp, Homo sapiens
cagtagaaagctaa

SEQ ID NO: 5861210 - DNA, 14 bp, Homo sapiens
cagtagaattttag

SEQ ID NO: 5861211 - DNA, 15 bp, Homo sapiens
cagtagaattttagt

SEQ ID NO: 5861212 - DNA, 12 bp, Homo sapiens
cagtagacaagc

SEQ ID NO: 5861213 - DNA, 19 bp, Homo sapiens
cagtagacaatccccacat

SEQ ID NO: 5861214 - DNA, 12 bp, Homo sapiens
cagtagacattt

SEQ ID NO: 5861215 - DNA, 16 bp, Homo sapiens
cagtagacattttaac

SEQ ID NO: 5861216 - DNA, 21 bp, Homo sapiens
cagtagacattttaacaagaa

SEQ ID NO: 5861217 - DNA, 11 bp, Homo sapiens
cagtagagaaa

SEQ ID NO: 5861218 - DNA, 15 bp, Homo sapiens
cagtagagagtgccc

SEQ ID NO: 5861219 - DNA, 16 bp, Homo sapiens
cagtagagagtgccct

SEQ ID NO: 5861220 - DNA, 13 bp, Homo sapiens
cagtagagccagc

SEQ ID NO: 5861221 - DNA, 15 bp, Homo sapiens
cagtagagccagctt

SEQ ID NO: 5861222 - DNA, 16 bp, Homo sapiens
cagtagaggcatgaac

SEQ ID NO: 5861223 - DNA, 23 bp, Homo sapiens
cagtagaggctatggacagggca

SEQ ID NO: 5861224 - DNA, 24 bp, Homo sapiens
cagtagagggtccagtcttctagt

SEQ ID NO: 5861225 - DNA, 15 bp, Homo sapiens
cagtagagtcatctc

SEQ ID NO: 5861226 - DNA, 15 bp, Homo sapiens
cagtagatcattttt

SEQ ID NO: 5861227 - DNA, 14 bp, Homo sapiens
cagtagattcaagt

SEQ ID NO: 5861228 - DNA, 23 bp, Homo sapiens
cagtagattttctttaaaagaat

SEQ ID NO: 5861229 - DNA, 18 bp, Homo sapiens
cagtagcacaagttattt

SEQ ID NO: 5861230 - DNA, 18 bp, Homo sapiens
cagtagcagtagatgcat

SEQ ID NO: 5861231 - DNA, 20 bp, Homo sapiens
cagtagcattgaagtgtttg

SEQ ID NO: 5861232 - DNA, 23 bp, Homo sapiens
cagtagccagagttgttctcagg

SEQ ID NO: 5861233 - DNA, 19 bp, Homo sapiens
cagtagccattttgtaact

SEQ ID NO: 5861234 - DNA, 20 bp, Homo sapiens
cagtagccatttttttgcag

SEQ ID NO: 5861235 - DNA, 23 bp, Homo sapiens
cagtagccccaatatggtggccc

SEQ ID NO: 5861236 - DNA, 21 bp, Homo sapiens
cagtagcctaaatctccagta

SEQ ID NO: 5861237 - DNA, 15 bp, Homo sapiens
cagtagcctcctcct

SEQ ID NO: 5861238 - DNA, 20 bp, Homo sapiens
cagtagctacggttccctgc

SEQ ID NO: 5861239 - DNA, 23 bp, Homo sapiens
cagtagctccaacactttgagca

SEQ ID NO: 5861240 - DNA, 18 bp, Homo sapiens
cagtagctccgcgtgtct

SEQ ID NO: 5861241 - DNA, 23 bp, Homo sapiens
cagtagctccgcgtgtctcattt

SEQ ID NO: 5861242 - DNA, 18 bp, Homo sapiens
cagtagctggagagagag

SEQ ID NO: 5861243 - DNA, 19 bp, Homo sapiens
cagtagctgggaccacagg

SEQ ID NO: 5861244 - DNA, 19 bp, Homo sapiens
cagtagctgtggcctcacc

SEQ ID NO: 5861245 - DNA, 23 bp, Homo sapiens
cagtagctgtggcctcaccctga

SEQ ID NO: 5861246 - DNA, 13 bp, Homo sapiens
cagtagctgtggg

SEQ ID NO: 5861247 - DNA, 23 bp, Homo sapiens
cagtagctgtggggagctggtgg

SEQ ID NO: 5861248 - DNA, 20 bp, Homo sapiens
cagtagctgtggtgaggtgg

SEQ ID NO: 5861249 - DNA, 19 bp, Homo sapiens
cagtagcttaaataaattc

SEQ ID NO: 5861250 - DNA, 17 bp, Homo sapiens
cagtagcttaagggaat

SEQ ID NO: 5861251 - DNA, 14 bp, Homo sapiens
cagtagcttcccaa

SEQ ID NO: 5861252 - DNA, 19 bp, Homo sapiens
cagtagcttcccaaaaaca

SEQ ID NO: 5861253 - DNA, 21 bp, Homo sapiens
cagtaggaacaagctggcttc

SEQ ID NO: 5861254 - DNA, 20 bp, Homo sapiens
cagtaggaacccagctctca

SEQ ID NO: 5861255 - DNA, 14 bp, Homo sapiens
cagtaggaccaggc

SEQ ID NO: 5861256 - DNA, 18 bp, Homo sapiens
cagtaggaccaggccacc

SEQ ID NO: 5861257 - DNA, 15 bp, Homo sapiens
cagtaggattgctgt

SEQ ID NO: 5861258 - DNA, 16 bp, Homo sapiens
cagtaggattgctgtg

SEQ ID NO: 5861259 - DNA, 23 bp, Homo sapiens
cagtaggatttatgtattttgaa

SEQ ID NO: 5861260 - DNA, 19 bp, Homo sapiens
cagtaggcttttaccatta

SEQ ID NO: 5861261 - DNA, 22 bp, Homo sapiens
cagtaggggcttataataaagg

SEQ ID NO: 5861262 - DNA, 19 bp, Homo sapiens
cagtaggtcccggccagct

SEQ ID NO: 5861263 - DNA, 22 bp, Homo sapiens
cagtaggtcccggccagctctg

SEQ ID NO: 5861264 - DNA, 18 bp, Homo sapiens
cagtaggttgaggacagg

SEQ ID NO: 5861265 - DNA, 15 bp, Homo sapiens
cagtaggttggcagt

SEQ ID NO: 5861266 - DNA, 17 bp, Homo sapiens
cagtagtataatgtatg

SEQ ID NO: 5861267 - DNA, 18 bp, Homo sapiens
cagtagtcacctctgggc

SEQ ID NO: 5861268 - DNA, 16 bp, Homo sapiens
cagtagtctctgtgct

SEQ ID NO: 5861269 - DNA, 13 bp, Homo sapiens
cagtagtgaccaa

SEQ ID NO: 5861270 - DNA, 15 bp, Homo sapiens
cagtagtgccaaaag

SEQ ID NO: 5861271 - DNA, 21 bp, Homo sapiens
cagtagtgccaaaaggcccct

SEQ ID NO: 5861272 - DNA, 23 bp, Homo sapiens
cagtagtgtcacttttttcctgt

SEQ ID NO: 5861273 - DNA, 22 bp, Homo sapiens
cagtagtgttctgttcactttt

SEQ ID NO: 5861274 - DNA, 19 bp, Homo sapiens
cagtagtgttgggtggagg

SEQ ID NO: 5861275 - DNA, 12 bp, Homo sapiens
cagtagtgtttg

SEQ ID NO: 5861276 - DNA, 16 bp, Homo sapiens
cagtagtgtttggaat

SEQ ID NO: 5861277 - DNA, 23 bp, Homo sapiens
cagtagtgtttggaattttctgt

SEQ ID NO: 5861278 - DNA, 18 bp, Homo sapiens
cagtagttactgctgttt

SEQ ID NO: 5861279 - DNA, 22 bp, Homo sapiens
cagtagttcacatacaaatcat

SEQ ID NO: 5861280 - DNA, 18 bp, Homo sapiens
cagtagtttaaaagttct

SEQ ID NO: 5861281 - DNA, 19 bp, Homo sapiens
cagtagtttctaagtctgt

SEQ ID NO: 5861282 - DNA, 12 bp, Homo sapiens
cagtagtttgag

SEQ ID NO: 5861283 - DNA, 15 bp, Homo sapiens
cagtagtttgcattt

SEQ ID NO: 5861284 - DNA, 20 bp, Homo sapiens
cagtagtttgcatttcagaa

SEQ ID NO: 5861285 - DNA, 16 bp, Homo sapiens
cagtagttttcaaaac

SEQ ID NO: 5861286 - DNA, 19 bp, Homo sapiens
cagtataaacaaagttact

SEQ ID NO: 5861287 - DNA, 13 bp, Homo sapiens
cagtataaagaat

SEQ ID NO: 5861288 - DNA, 13 bp, Homo sapiens
cagtataaattac

SEQ ID NO: 5861289 - DNA, 20 bp, Homo sapiens
cagtataaccagctgaagtt

SEQ ID NO: 5861290 - DNA, 19 bp, Homo sapiens
cagtataagatttttgaaa

SEQ ID NO: 5861291 - DNA, 15 bp, Homo sapiens
cagtataattaacat

SEQ ID NO: 5861292 - DNA, 17 bp, Homo sapiens
cagtataattaacatgt

SEQ ID NO: 5861293 - DNA, 14 bp, Homo sapiens
cagtataattctgt

SEQ ID NO: 5861294 - DNA, 20 bp, Homo sapiens
cagtataattctgtactgat

SEQ ID NO: 5861295 - DNA, 14 bp, Homo sapiens
cagtataatttgac

SEQ ID NO: 5861296 - DNA, 12 bp, Homo sapiens
cagtatagaata

SEQ ID NO: 5861297 - DNA, 12 bp, Homo sapiens
cagtatataagc

SEQ ID NO: 5861298 - DNA, 23 bp, Homo sapiens
cagtatataataactttattgca

SEQ ID NO: 5861299 - DNA, 21 bp, Homo sapiens
cagtatatcacagagccactc

SEQ ID NO: 5861300 - DNA, 16 bp, Homo sapiens
cagtatattagtatta

SEQ ID NO: 5861301 - DNA, 14 bp, Homo sapiens
cagtatattcttgt

SEQ ID NO: 5861302 - DNA, 18 bp, Homo sapiens
cagtatattcttgtaaat

SEQ ID NO: 5861303 - DNA, 14 bp, Homo sapiens
cagtatatttatag

SEQ ID NO: 5861304 - DNA, 13 bp, Homo sapiens
cagtatatttggt

SEQ ID NO: 5861305 - DNA, 16 bp, Homo sapiens
cagtatattttatttc

SEQ ID NO: 5861306 - DNA, 18 bp, Homo sapiens
cagtatattttatttcaa

SEQ ID NO: 5861307 - DNA, 19 bp, Homo sapiens
cagtatattttctgtattt

SEQ ID NO: 5861308 - DNA, 20 bp, Homo sapiens
cagtatcaaggctgcctgga

SEQ ID NO: 5861309 - DNA, 21 bp, Homo sapiens
cagtatcactctaatataata

SEQ ID NO: 5861310 - DNA, 22 bp, Homo sapiens
cagtatcactgtctttcctaga

SEQ ID NO: 5861311 - DNA, 20 bp, Homo sapiens
cagtatcagtattttcacac

SEQ ID NO: 5861312 - DNA, 14 bp, Homo sapiens
cagtatcatgaagc

SEQ ID NO: 5861313 - DNA, 15 bp, Homo sapiens
cagtatcatgaagcc

SEQ ID NO: 5861314 - DNA, 16 bp, Homo sapiens
cagtatcatgccctgt

SEQ ID NO: 5861315 - DNA, 17 bp, Homo sapiens
cagtatccaatgtcttt

SEQ ID NO: 5861316 - DNA, 12 bp, Homo sapiens
cagtatcccaca

SEQ ID NO: 5861317 - DNA, 16 bp, Homo sapiens
cagtatcctgctggtt

SEQ ID NO: 5861318 - DNA, 14 bp, Homo sapiens
cagtatcctggatt

SEQ ID NO: 5861319 - DNA, 15 bp, Homo sapiens
cagtatcctggattc

SEQ ID NO: 5861320 - DNA, 15 bp, Homo sapiens
cagtatcggcactgt

SEQ ID NO: 5861321 - DNA, 16 bp, Homo sapiens
cagtatctatatatgt

SEQ ID NO: 5861322 - DNA, 23 bp, Homo sapiens
cagtatctatatatgtgtatgta

SEQ ID NO: 5861323 - DNA, 16 bp, Homo sapiens
cagtatctcaaacaat

SEQ ID NO: 5861324 - DNA, 18 bp, Homo sapiens
cagtatctcaagatattc

SEQ ID NO: 5861325 - DNA, 15 bp, Homo sapiens
cagtatctcagggcc

SEQ ID NO: 5861326 - DNA, 17 bp, Homo sapiens
cagtatctccatcctta

SEQ ID NO: 5861327 - DNA, 22 bp, Homo sapiens
cagtatctccatccttaactgt

SEQ ID NO: 5861328 - DNA, 14 bp, Homo sapiens
cagtatctcttcag

SEQ ID NO: 5861329 - DNA, 22 bp, Homo sapiens
cagtatctcttcagtctctata

SEQ ID NO: 5861330 - DNA, 22 bp, Homo sapiens
cagtatctcttgctgggaacac

SEQ ID NO: 5861331 - DNA, 16 bp, Homo sapiens
cagtatctgctgttct

SEQ ID NO: 5861332 - DNA, 17 bp, Homo sapiens
cagtatctgctgttctt

SEQ ID NO: 5861333 - DNA, 21 bp, Homo sapiens
cagtatctgctgttcttcagt

SEQ ID NO: 5861334 - DNA, 14 bp, Homo sapiens
cagtatcttaaaat

SEQ ID NO: 5861335 - DNA, 18 bp, Homo sapiens
cagtatcttagagtttac

SEQ ID NO: 5861336 - DNA, 18 bp, Homo sapiens
cagtatctttgcactcca

SEQ ID NO: 5861337 - DNA, 21 bp, Homo sapiens
cagtatgaaaagctatcttaa

SEQ ID NO: 5861338 - DNA, 14 bp, Homo sapiens
cagtatgaaaataa

SEQ ID NO: 5861339 - DNA, 15 bp, Homo sapiens
cagtatgaagacact

SEQ ID NO: 5861340 - DNA, 21 bp, Homo sapiens
cagtatgatgaaaataatttt

SEQ ID NO: 5861341 - DNA, 21 bp, Homo sapiens
cagtatgctgttttaataatt

SEQ ID NO: 5861342 - DNA, 20 bp, Homo sapiens
cagtatgctttccctgagga

SEQ ID NO: 5861343 - DNA, 23 bp, Homo sapiens
cagtatgctttccctgaggaatg

SEQ ID NO: 5861344 - DNA, 15 bp, Homo sapiens
cagtatggaagggag

SEQ ID NO: 5861345 - DNA, 17 bp, Homo sapiens
cagtatggcggaggcca

SEQ ID NO: 5861346 - DNA, 18 bp, Homo sapiens
cagtatgggggttgtaaa

SEQ ID NO: 5861347 - DNA, 19 bp, Homo sapiens
cagtatgggggttgtaaat

SEQ ID NO: 5861348 - DNA, 20 bp, Homo sapiens
cagtatgggggttgtaaatt

SEQ ID NO: 5861349 - DNA, 23 bp, Homo sapiens
cagtatgggggttgtaaattggc

SEQ ID NO: 5861350 - DNA, 16 bp, Homo sapiens
cagtatgggttaggga

SEQ ID NO: 5861351 - DNA, 15 bp, Homo sapiens
cagtatggtacattt

SEQ ID NO: 5861352 - DNA, 22 bp, Homo sapiens
cagtatggtgctaatgtgtctg

SEQ ID NO: 5861353 - DNA, 16 bp, Homo sapiens
cagtatgtacaggctg

SEQ ID NO: 5861354 - DNA, 17 bp, Homo sapiens
cagtatgtattcttttg

SEQ ID NO: 5861355 - DNA, 18 bp, Homo sapiens
cagtatgtgatggactgg

SEQ ID NO: 5861356 - DNA, 12 bp, Homo sapiens
cagtcctgcctg

SEQ ID NO: 5861357 - DNA, 15 bp, Homo sapiens
cagtcctgcctggcc

SEQ ID NO: 5861358 - DNA, 21 bp, Homo sapiens
cagtcctgctgcctggagtca

SEQ ID NO: 5861359 - DNA, 15 bp, Homo sapiens
cagtcctgctggcct

SEQ ID NO: 5861360 - DNA, 19 bp, Homo sapiens
cagtcctgctggcctgctc

SEQ ID NO: 5861361 - DNA, 22 bp, Homo sapiens
cagtcctggaagccagctttcc

SEQ ID NO: 5861362 - DNA, 23 bp, Homo sapiens
cagtcctggaagccggccggctg

SEQ ID NO: 5861363 - DNA, 23 bp, Homo sapiens
cagtcctggagcaatcacagatg

SEQ ID NO: 5861364 - DNA, 15 bp, Homo sapiens
cagtcctggccccct

SEQ ID NO: 5861365 - DNA, 13 bp, Homo sapiens
cagtcctggcctg

SEQ ID NO: 5861366 - DNA, 12 bp, Homo sapiens
cagtcctgggcc

SEQ ID NO: 5861367 - DNA, 18 bp, Homo sapiens
cagtcctgggccccctgg

SEQ ID NO: 5861368 - DNA, 20 bp, Homo sapiens
cagtcctgggccccctggga

SEQ ID NO: 5861369 - DNA, 11 bp, Homo sapiens
cagtcctgggt

SEQ ID NO: 5861370 - DNA, 13 bp, Homo sapiens
cagtcctgggttg

SEQ ID NO: 5861371 - DNA, 22 bp, Homo sapiens
cagtcctggtcctggctgcact

SEQ ID NO: 5861372 - DNA, 18 bp, Homo sapiens
cagtcctggtctgctcag

SEQ ID NO: 5861373 - DNA, 13 bp, Homo sapiens
cagtcctggtggg

SEQ ID NO: 5861374 - DNA, 19 bp, Homo sapiens
cagtcctggttcagtggga

SEQ ID NO: 5861375 - DNA, 20 bp, Homo sapiens
cagtcctggttcagtgggaa

SEQ ID NO: 5861376 - DNA, 17 bp, Homo sapiens
cagtcctggttgtctga

SEQ ID NO: 5861377 - DNA, 19 bp, Homo sapiens
cagtcctggttgtctgaac

SEQ ID NO: 5861378 - DNA, 14 bp, Homo sapiens
cagtcctgtagttt

SEQ ID NO: 5861379 - DNA, 18 bp, Homo sapiens
cagtcctgtagttttatt

SEQ ID NO: 5861380 - DNA, 15 bp, Homo sapiens
cagtcctgttcagaa

SEQ ID NO: 5861381 - DNA, 18 bp, Homo sapiens
cagtccttaccagcagag

SEQ ID NO: 5861382 - DNA, 20 bp, Homo sapiens
cagtccttaccagcagagca

SEQ ID NO: 5861383 - DNA, 21 bp, Homo sapiens
cagtccttaccagcagagcac

SEQ ID NO: 5861384 - DNA, 20 bp, Homo sapiens
cagtcctttgtaaacagtgt

SEQ ID NO: 5861385 - DNA, 12 bp, Homo sapiens
cagtcctttgtc

SEQ ID NO: 5861386 - DNA, 13 bp, Homo sapiens
cagtcctttgtct

SEQ ID NO: 5861387 - DNA, 18 bp, Homo sapiens
cagtcgagccctgcagcc

SEQ ID NO: 5861388 - DNA, 14 bp, Homo sapiens
cagtcgaggctggt

SEQ ID NO: 5861389 - DNA, 15 bp, Homo sapiens
cagtcgatagagctg

SEQ ID NO: 5861390 - DNA, 17 bp, Homo sapiens
cagtcgatattcccagg

SEQ ID NO: 5861391 - DNA, 14 bp, Homo sapiens
cagtcgcaggatcc

SEQ ID NO: 5861392 - DNA, 15 bp, Homo sapiens
cagtcgccctctgtg

SEQ ID NO: 5861393 - DNA, 16 bp, Homo sapiens
cagtcgccctctgtgc

SEQ ID NO: 5861394 - DNA, 19 bp, Homo sapiens
cagtcgcctgcctgcagca

SEQ ID NO: 5861395 - DNA, 19 bp, Homo sapiens
cagtcgcctttcagcaggc

SEQ ID NO: 5861396 - DNA, 22 bp, Homo sapiens
cagtcgcctttcagcaggcagc

SEQ ID NO: 5861397 - DNA, 23 bp, Homo sapiens
cagtcgcctttcagcaggcagcc

SEQ ID NO: 5861398 - DNA, 21 bp, Homo sapiens
cagtcgcgagcacatgttcat

SEQ ID NO: 5861399 - DNA, 14 bp, Homo sapiens
cagtcgcgctgcct

SEQ ID NO: 5861400 - DNA, 17 bp, Homo sapiens
cagtcgcgctgcctgtg

SEQ ID NO: 5861401 - DNA, 20 bp, Homo sapiens
cagtcgctcacacctgtaat

SEQ ID NO: 5861402 - DNA, 16 bp, Homo sapiens
cagtcgctcagtctgt

SEQ ID NO: 5861403 - DNA, 13 bp, Homo sapiens
cagtcgctgcagg

SEQ ID NO: 5861404 - DNA, 16 bp, Homo sapiens
cagtcgctgcagggag

SEQ ID NO: 5861405 - DNA, 18 bp, Homo sapiens
cagtcgctgcagggagca

SEQ ID NO: 5861406 - DNA, 13 bp, Homo sapiens
cagtcgcttgcca

SEQ ID NO: 5861407 - DNA, 16 bp, Homo sapiens
cagtcgcttgccaaag

SEQ ID NO: 5861408 - DNA, 18 bp, Homo sapiens
cagtcgcttgccaaagca

SEQ ID NO: 5861409 - DNA, 18 bp, Homo sapiens
cagtcggcatgccaggac

SEQ ID NO: 5861410 - DNA, 19 bp, Homo sapiens
cagtcggggcaggccaggg

SEQ ID NO: 5861411 - DNA, 17 bp, Homo sapiens
cagtcgggggctggcct

SEQ ID NO: 5861412 - DNA, 15 bp, Homo sapiens
cagtcggtgacccca

SEQ ID NO: 5861413 - DNA, 19 bp, Homo sapiens
cagtcggtgaccccatcac

SEQ ID NO: 5861414 - DNA, 16 bp, Homo sapiens
cagtcgtcagcctccc

SEQ ID NO: 5861415 - DNA, 13 bp, Homo sapiens
cagtcgtcgcaca

SEQ ID NO: 5861416 - DNA, 20 bp, Homo sapiens
cagtcgtcgcacagtctctc

SEQ ID NO: 5861417 - DNA, 16 bp, Homo sapiens
cagtcgtctgtcccaa

SEQ ID NO: 5861418 - DNA, 18 bp, Homo sapiens
cagtcgtgatgtggagga

SEQ ID NO: 5861419 - DNA, 14 bp, Homo sapiens
cagtcgtgcctgtg

SEQ ID NO: 5861420 - DNA, 15 bp, Homo sapiens
cagtcgtgcctgtgt

SEQ ID NO: 5861421 - DNA, 17 bp, Homo sapiens
cagtcgttggcaccttc

SEQ ID NO: 5861422 - DNA, 20 bp, Homo sapiens
cagtcgttttagtgtctgac

SEQ ID NO: 5861423 - DNA, 18 bp, Homo sapiens
cagtctaaaaattgatag

SEQ ID NO: 5861424 - DNA, 21 bp, Homo sapiens
cagtctaaacagagtccggga

SEQ ID NO: 5861425 - DNA, 22 bp, Homo sapiens
cagtctaaagctggtttaatgt

SEQ ID NO: 5861426 - DNA, 18 bp, Homo sapiens
cagtctaacagtttgcct

SEQ ID NO: 5861427 - DNA, 19 bp, Homo sapiens
cagtctaacagtttgcctg

SEQ ID NO: 5861428 - DNA, 13 bp, Homo sapiens
cagtctaattttt

SEQ ID NO: 5861429 - DNA, 18 bp, Homo sapiens
cagtctaatttttattca

SEQ ID NO: 5861430 - DNA, 15 bp, Homo sapiens
cagtctacactcaca

SEQ ID NO: 5861431 - DNA, 13 bp, Homo sapiens
cagtctacccctc

SEQ ID NO: 5861432 - DNA, 15 bp, Homo sapiens
cagtctaccctgtcc

SEQ ID NO: 5861433 - DNA, 12 bp, Homo sapiens
cagtctacttct

SEQ ID NO: 5861434 - DNA, 22 bp, Homo sapiens
cagtctacttctgtgtctgtca

SEQ ID NO: 5861435 - DNA, 14 bp, Homo sapiens
cagtctagaagaat

SEQ ID NO: 5861436 - DNA, 21 bp, Homo sapiens
cagtctaggagctccttctgg

SEQ ID NO: 5861437 - DNA, 22 bp, Homo sapiens
cagtctaggagctccttctggc

SEQ ID NO: 5861438 - DNA, 19 bp, Homo sapiens
cagtctagttgccaaatct

SEQ ID NO: 5861439 - DNA, 18 bp, Homo sapiens
cagtctatgctgtgtgca

SEQ ID NO: 5861440 - DNA, 17 bp, Homo sapiens
cagtctattcacagaag

SEQ ID NO: 5861441 - DNA, 13 bp, Homo sapiens
cagtctatttcca

SEQ ID NO: 5861442 - DNA, 15 bp, Homo sapiens
cagtctatttccatt

SEQ ID NO: 5861443 - DNA, 23 bp, Homo sapiens
cagtctcaaaaatacaaaataaa

SEQ ID NO: 5861444 - DNA, 17 bp, Homo sapiens
cagtctcaaatttttca

SEQ ID NO: 5861445 - DNA, 18 bp, Homo sapiens
cagtctcaagcactaaaa

SEQ ID NO: 5861446 - DNA, 16 bp, Homo sapiens
cagtctcaattttgta

SEQ ID NO: 5861447 - DNA, 14 bp, Homo sapiens
cagtctcacagaga

SEQ ID NO: 5861448 - DNA, 20 bp, Homo sapiens
cagtctcacagagaagctcc

SEQ ID NO: 5861449 - DNA, 12 bp, Homo sapiens
cagtctcacatt

SEQ ID NO: 5861450 - DNA, 17 bp, Homo sapiens
cagtctcacccagactc

SEQ ID NO: 5861451 - DNA, 21 bp, Homo sapiens
cagtctcacctgccggctctg

SEQ ID NO: 5861452 - DNA, 17 bp, Homo sapiens
cagtctcactgacacag

SEQ ID NO: 5861453 - DNA, 22 bp, Homo sapiens
cagtctcactgcagtcttattt

SEQ ID NO: 5861454 - DNA, 23 bp, Homo sapiens
cagtctcactgtgggaaggccag

SEQ ID NO: 5861455 - DNA, 15 bp, Homo sapiens
cagtctcagaaagcc

SEQ ID NO: 5861456 - DNA, 19 bp, Homo sapiens
cagtctcagaatgtcattt

SEQ ID NO: 5861457 - DNA, 12 bp, Homo sapiens
cagtctcagaga

SEQ ID NO: 5861458 - DNA, 15 bp, Homo sapiens
cagtctcagagacca

SEQ ID NO: 5861459 - DNA, 19 bp, Homo sapiens
cagtctcagagaccagcac

SEQ ID NO: 5861460 - DNA, 18 bp, Homo sapiens
cagtctcagctgctgaaa

SEQ ID NO: 5861461 - DNA, 19 bp, Homo sapiens
cagtctcagctgctgaaat

SEQ ID NO: 5861462 - DNA, 18 bp, Homo sapiens
cagtctcaggagcatggg

SEQ ID NO: 5861463 - DNA, 23 bp, Homo sapiens
cagtctcagtccagatgccttcc

SEQ ID NO: 5861464 - DNA, 20 bp, Homo sapiens
cagtctcatcctcccattgc

SEQ ID NO: 5861465 - DNA, 16 bp, Homo sapiens
cagtctcatctcctga

SEQ ID NO: 5861466 - DNA, 12 bp, Homo sapiens
cagtctcattgt

SEQ ID NO: 5861467 - DNA, 13 bp, Homo sapiens
cagtctcattgtc

SEQ ID NO: 5861468 - DNA, 22 bp, Homo sapiens
cagtctccagggacccttgcct

SEQ ID NO: 5861469 - DNA, 18 bp, Homo sapiens
cagtctcccaggccccct

SEQ ID NO: 5861470 - DNA, 23 bp, Homo sapiens
cagtctcccaggccccctgcatc

SEQ ID NO: 5861471 - DNA, 13 bp, Homo sapiens
cagtctccccaga

SEQ ID NO: 5861472 - DNA, 12 bp, Homo sapiens
cagtctcccctt

SEQ ID NO: 5861473 - DNA, 16 bp, Homo sapiens
cagtctccccttcctg

SEQ ID NO: 5861474 - DNA, 17 bp, Homo sapiens
cagtctccccttcctgg

SEQ ID NO: 5861475 - DNA, 20 bp, Homo sapiens
cagtctccccttcctggcac

SEQ ID NO: 5861476 - DNA, 21 bp, Homo sapiens
cagtctccctgatggaccctc

SEQ ID NO: 5861477 - DNA, 11 bp, Homo sapiens
cagtctccctt

SEQ ID NO: 5861478 - DNA, 18 bp, Homo sapiens
cagtctcccttctcccat

SEQ ID NO: 5861479 - DNA, 17 bp, Homo sapiens
cagtctccgcctcctga

SEQ ID NO: 5861480 - DNA, 17 bp, Homo sapiens
cagtctccgctcccgca

SEQ ID NO: 5861481 - DNA, 20 bp, Homo sapiens
cagtctccggcctctccagc

SEQ ID NO: 5861482 - DNA, 12 bp, Homo sapiens
cagtctcctcac

SEQ ID NO: 5861483 - DNA, 14 bp, Homo sapiens
cagtctcctcactc

SEQ ID NO: 5861484 - DNA, 15 bp, Homo sapiens
cagtctcctctttaa

SEQ ID NO: 5861485 - DNA, 19 bp, Homo sapiens
cagtctcctctttaaaaca

SEQ ID NO: 5861486 - DNA, 14 bp, Homo sapiens
cagtctcctgacat

SEQ ID NO: 5861487 - DNA, 17 bp, Homo sapiens
cagtctcctgacattaa

SEQ ID NO: 5861488 - DNA, 17 bp, Homo sapiens
cagtctccttcagcacg

SEQ ID NO: 5861489 - DNA, 21 bp, Homo sapiens
cagtctctataccaataaagt

SEQ ID NO: 5861490 - DNA, 22 bp, Homo sapiens
cagtctctataccaataaagtg

SEQ ID NO: 5861491 - DNA, 19 bp, Homo sapiens
cagtctctcaaagacccca

SEQ ID NO: 5861492 - DNA, 14 bp, Homo sapiens
cagtctctccctgg

SEQ ID NO: 5861493 - DNA, 17 bp, Homo sapiens
cagtctctctctccctt

SEQ ID NO: 5861494 - DNA, 21 bp, Homo sapiens
cagtctctctctctctctccc

SEQ ID NO: 5861495 - DNA, 15 bp, Homo sapiens
cagtctctctcttcc

SEQ ID NO: 5861496 - DNA, 22 bp, Homo sapiens
cagtctctcttacccttctgtg

SEQ ID NO: 5861497 - DNA, 14 bp, Homo sapiens
cagtctctcttctc

SEQ ID NO: 5861498 - DNA, 16 bp, Homo sapiens
cagtctctgagggctt

SEQ ID NO: 5861499 - DNA, 16 bp, Homo sapiens
cagtctctgcagtgtc

SEQ ID NO: 5861500 - DNA, 17 bp, Homo sapiens
cagtctctgccttgcct

SEQ ID NO: 5861501 - DNA, 13 bp, Homo sapiens
cagtctctggaaa

SEQ ID NO: 5861502 - DNA, 23 bp, Homo sapiens
cagtctctgggagactttcccta

SEQ ID NO: 5861503 - DNA, 19 bp, Homo sapiens
cagtctctttaatcttcag

SEQ ID NO: 5861504 - DNA, 19 bp, Homo sapiens
cagtctctttattttacta

SEQ ID NO: 5861505 - DNA, 15 bp, Homo sapiens
cagtctctttctgta

SEQ ID NO: 5861506 - DNA, 15 bp, Homo sapiens
cagtctctttcttcc

SEQ ID NO: 5861507 - DNA, 21 bp, Homo sapiens
cagtctctttcttcctttcta

SEQ ID NO: 5861508 - DNA, 15 bp, Homo sapiens
cagtctgaagtgcct

SEQ ID NO: 5861509 - DNA, 21 bp, Homo sapiens
cagtctgaatggcatggagac

SEQ ID NO: 5861510 - DNA, 20 bp, Homo sapiens
cagtctgactgtttccatca

SEQ ID NO: 5861511 - DNA, 16 bp, Homo sapiens
cagtctgataaactga

SEQ ID NO: 5861512 - DNA, 15 bp, Homo sapiens
cagtctgatattcac

SEQ ID NO: 5861513 - DNA, 15 bp, Homo sapiens
cagtctgatctgtga

SEQ ID NO: 5861514 - DNA, 22 bp, Homo sapiens
cagtctgatgagaactctgagc

SEQ ID NO: 5861515 - DNA, 21 bp, Homo sapiens
cagtctgattcccaagctctg

SEQ ID NO: 5861516 - DNA, 23 bp, Homo sapiens
cagtctgattcccaagctctgct

SEQ ID NO: 5861517 - DNA, 17 bp, Homo sapiens
cagtctgcgtcaggcac

SEQ ID NO: 5861518 - DNA, 15 bp, Homo sapiens
cagtctgctccacca

SEQ ID NO: 5861519 - DNA, 15 bp, Homo sapiens
cagtctgctcctctt

SEQ ID NO: 5861520 - DNA, 11 bp, Homo sapiens
cagtctgctct

SEQ ID NO: 5861521 - DNA, 12 bp, Homo sapiens
cagtctgctgcc

SEQ ID NO: 5861522 - DNA, 18 bp, Homo sapiens
cagtctgctgccctccat

SEQ ID NO: 5861523 - DNA, 21 bp, Homo sapiens
cagtctgctgccctccatccc

SEQ ID NO: 5861524 - DNA, 16 bp, Homo sapiens
cagtctgcttagaaat

SEQ ID NO: 5861525 - DNA, 23 bp, Homo sapiens
cagtctgcttatccttccacgga

SEQ ID NO: 5861526 - DNA, 16 bp, Homo sapiens
cagtctgctttctcta

SEQ ID NO: 5861527 - DNA, 12 bp, Homo sapiens
cagtctggaaga

SEQ ID NO: 5861528 - DNA, 14 bp, Homo sapiens
cagtctggaagaag

SEQ ID NO: 5861529 - DNA, 18 bp, Homo sapiens
cagtctggaatgcagtgg

SEQ ID NO: 5861530 - DNA, 14 bp, Homo sapiens
cagtctggagagct

SEQ ID NO: 5861531 - DNA, 15 bp, Homo sapiens
cagtctggagcaaag

SEQ ID NO: 5861532 - DNA, 18 bp, Homo sapiens
cagtctggaggggcatgg

SEQ ID NO: 5861533 - DNA, 21 bp, Homo sapiens
cagtctggaggggcatggcca

SEQ ID NO: 5861534 - DNA, 12 bp, Homo sapiens
cagtctggaggt

SEQ ID NO: 5861535 - DNA, 21 bp, Homo sapiens
cagtgccagcaatgacatctc

SEQ ID NO: 5861536 - DNA, 14 bp, Homo sapiens
cagtgccagccaat

SEQ ID NO: 5861537 - DNA, 22 bp, Homo sapiens
cagtgccagcccctgctggctg

SEQ ID NO: 5861538 - DNA, 15 bp, Homo sapiens
cagtgccagctccag

SEQ ID NO: 5861539 - DNA, 22 bp, Homo sapiens
cagtgccagcttctttgcagct

SEQ ID NO: 5861540 - DNA, 12 bp, Homo sapiens
cagtgccaggac

SEQ ID NO: 5861541 - DNA, 17 bp, Homo sapiens
cagtgccaggacagctg

SEQ ID NO: 5861542 - DNA, 21 bp, Homo sapiens
cagtgccaggacagctggctg

SEQ ID NO: 5861543 - DNA, 22 bp, Homo sapiens
cagtgccaggacagctggctgc

SEQ ID NO: 5861544 - DNA, 11 bp, Homo sapiens
cagtgccaggg

SEQ ID NO: 5861545 - DNA, 18 bp, Homo sapiens
cagtgccagggtgggctg

SEQ ID NO: 5861546 - DNA, 23 bp, Homo sapiens
cagtgccagggtgggctggggac

SEQ ID NO: 5861547 - DNA, 20 bp, Homo sapiens
cagtgccatccccaccttca

SEQ ID NO: 5861548 - DNA, 18 bp, Homo sapiens
cagtgccattccactcca

SEQ ID NO: 5861549 - DNA, 22 bp, Homo sapiens
cagtgccattccactccactca

SEQ ID NO: 5861550 - DNA, 14 bp, Homo sapiens
cagtgccattgtct

SEQ ID NO: 5861551 - DNA, 15 bp, Homo sapiens
cagtgccattgtctt

SEQ ID NO: 5861552 - DNA, 16 bp, Homo sapiens
cagtgccattgtcttt

SEQ ID NO: 5861553 - DNA, 15 bp, Homo sapiens
cagtgcccacaggat

SEQ ID NO: 5861554 - DNA, 18 bp, Homo sapiens
cagtgcccacaggatcag

SEQ ID NO: 5861555 - DNA, 22 bp, Homo sapiens
cagtgcccacaggatcagtctg

SEQ ID NO: 5861556 - DNA, 15 bp, Homo sapiens
cagtgcccaccgccc

SEQ ID NO: 5861557 - DNA, 23 bp, Homo sapiens
cagtgcccaccgccctcctccac

SEQ ID NO: 5861558 - DNA, 13 bp, Homo sapiens
cagtgcccaggtg

SEQ ID NO: 5861559 - DNA, 14 bp, Homo sapiens
cagtgcccaggtgg

SEQ ID NO: 5861560 - DNA, 15 bp, Homo sapiens
cagtgcccaggtggc

SEQ ID NO: 5861561 - DNA, 20 bp, Homo sapiens
cagtgcccagtgatggcatt

SEQ ID NO: 5861562 - DNA, 14 bp, Homo sapiens
cagtgcccatgcaa

SEQ ID NO: 5861563 - DNA, 13 bp, Homo sapiens
cagtgccccaggg

SEQ ID NO: 5861564 - DNA, 23 bp, Homo sapiens
cagtgccccagggagtccagggt

SEQ ID NO: 5861565 - DNA, 22 bp, Homo sapiens
cagtgcccccactgaccagaac

SEQ ID NO: 5861566 - DNA, 23 bp, Homo sapiens
cagtgcccccactgaccagaact

SEQ ID NO: 5861567 - DNA, 22 bp, Homo sapiens
cagtgcccggtgcagggcctgg

SEQ ID NO: 5861568 - DNA, 19 bp, Homo sapiens
cagtgccctcattttatgt

SEQ ID NO: 5861569 - DNA, 18 bp, Homo sapiens
cagtgccctccagccccg

SEQ ID NO: 5861570 - DNA, 15 bp, Homo sapiens
cagtgccctccagga

SEQ ID NO: 5861571 - DNA, 13 bp, Homo sapiens
cagtgccctctcc

SEQ ID NO: 5861572 - DNA, 13 bp, Homo sapiens
cagtgccctgaga

SEQ ID NO: 5861573 - DNA, 14 bp, Homo sapiens
cagtgccctgagcc

SEQ ID NO: 5861574 - DNA, 24 bp, Homo sapiens
cagtgccctggggctgatctcagg

SEQ ID NO: 5861575 - DNA, 19 bp, Homo sapiens
cagtgccgccgcctcgccc

SEQ ID NO: 5861576 - DNA, 23 bp, Homo sapiens
cagtgccgccgcctcgcccaccg

SEQ ID NO: 5861577 - DNA, 19 bp, Homo sapiens
cagtgccggaggccttggg

SEQ ID NO: 5861578 - DNA, 14 bp, Homo sapiens
cagtgcctcacctt

SEQ ID NO: 5861579 - DNA, 18 bp, Homo sapiens
cagtgcctcagtgctgca

SEQ ID NO: 5861580 - DNA, 13 bp, Homo sapiens
cagtgcctccaca

SEQ ID NO: 5861581 - DNA, 11 bp, Homo sapiens
cagtgcctcct

SEQ ID NO: 5861582 - DNA, 12 bp, Homo sapiens
cagtgcctcctg

SEQ ID NO: 5861583 - DNA, 13 bp, Homo sapiens
cagtgcctcctgg

SEQ ID NO: 5861584 - DNA, 15 bp, Homo sapiens
cagtgcctcctggga

SEQ ID NO: 5861585 - DNA, 17 bp, Homo sapiens
cagtgcctcgaggcacc

SEQ ID NO: 5861586 - DNA, 14 bp, Homo sapiens
cagtgcctcttcca

SEQ ID NO: 5861587 - DNA, 20 bp, Homo sapiens
cagtgcctcttgtctgaggg

SEQ ID NO: 5861588 - DNA, 16 bp, Homo sapiens
cagtgcctgatgggag

SEQ ID NO: 5861589 - DNA, 22 bp, Homo sapiens
cagtgcctgatgggagtaggct

SEQ ID NO: 5861590 - DNA, 14 bp, Homo sapiens
cagtgcctgcacat

SEQ ID NO: 5861591 - DNA, 15 bp, Homo sapiens
cagtgcctgccactc

SEQ ID NO: 5861592 - DNA, 16 bp, Homo sapiens
cagtgcctgccactct

SEQ ID NO: 5861593 - DNA, 12 bp, Homo sapiens
cagtgcctgcct

SEQ ID NO: 5861594 - DNA, 18 bp, Homo sapiens
cagtgcctgctctgctgt

SEQ ID NO: 5861595 - DNA, 21 bp, Homo sapiens
cagtgcctgctctgctgtgag

SEQ ID NO: 5861596 - DNA, 13 bp, Homo sapiens
cagtgcctgctgt

SEQ ID NO: 5861597 - DNA, 14 bp, Homo sapiens
cagtgcctgctgtt

SEQ ID NO: 5861598 - DNA, 14 bp, Homo sapiens
cagtgcctggcaag

SEQ ID NO: 5861599 - DNA, 16 bp, Homo sapiens
cagtgcctggcaaggc

SEQ ID NO: 5861600 - DNA, 14 bp, Homo sapiens
cagtgcctgggaat

SEQ ID NO: 5861601 - DNA, 15 bp, Homo sapiens
cagtgcctgtatctt

SEQ ID NO: 5861602 - DNA, 14 bp, Homo sapiens
cagtgcctgtctgg

SEQ ID NO: 5861603 - DNA, 17 bp, Homo sapiens
cagtgcctgtctggagc

SEQ ID NO: 5861604 - DNA, 17 bp, Homo sapiens
cagtgccttacctcctg

SEQ ID NO: 5861605 - DNA, 18 bp, Homo sapiens
cagtgccttacctcctgc

SEQ ID NO: 5861606 - DNA, 22 bp, Homo sapiens
cagtgccttacctcctgcccag

SEQ ID NO: 5861607 - DNA, 17 bp, Homo sapiens
cagtgccttatggaaca

SEQ ID NO: 5861608 - DNA, 19 bp, Homo sapiens
cagtgccttatggaacact

SEQ ID NO: 5861609 - DNA, 20 bp, Homo sapiens
cagtgccttatggaacactc

SEQ ID NO: 5861610 - DNA, 19 bp, Homo sapiens
cagtgccttattacccagg

SEQ ID NO: 5861611 - DNA, 15 bp, Homo sapiens
cagtgccttcaataa

SEQ ID NO: 5861612 - DNA, 16 bp, Homo sapiens
cagtgccttcaataaa

SEQ ID NO: 5861613 - DNA, 12 bp, Homo sapiens
cagtgccttctc

SEQ ID NO: 5861614 - DNA, 15 bp, Homo sapiens
cagtgccttctctca

SEQ ID NO: 5861615 - DNA, 18 bp, Homo sapiens
cagtgccttctctcagct

SEQ ID NO: 5861616 - DNA, 21 bp, Homo sapiens
cagtgccttgctcggcgccca

SEQ ID NO: 5861617 - DNA, 12 bp, Homo sapiens
cagtgccttgga

SEQ ID NO: 5861618 - DNA, 14 bp, Homo sapiens
cagtgcctttcccc

SEQ ID NO: 5861619 - DNA, 17 bp, Homo sapiens
cagtgccttttggaact

SEQ ID NO: 5861620 - DNA, 22 bp, Homo sapiens
cagtgcggacccttcccagccc

SEQ ID NO: 5861621 - DNA, 12 bp, Homo sapiens
cagtgcggccag

SEQ ID NO: 5861622 - DNA, 21 bp, Homo sapiens
cagtgcgggaggaatttctga

SEQ ID NO: 5861623 - DNA, 17 bp, Homo sapiens
cagtgcgtgatttctca

SEQ ID NO: 5861624 - DNA, 17 bp, Homo sapiens
cagtgctaaaaatggga

SEQ ID NO: 5861625 - DNA, 17 bp, Homo sapiens
cagtgctataaatgcca

SEQ ID NO: 5861626 - DNA, 23 bp, Homo sapiens
cagtgctataaatgccagagcca

SEQ ID NO: 5861627 - DNA, 17 bp, Homo sapiens
cagtgctattctgagtg

SEQ ID NO: 5861628 - DNA, 16 bp, Homo sapiens
cagtgctcacacaatc

SEQ ID NO: 5861629 - DNA, 23 bp, Homo sapiens
cagtgctcacacaatcagaccaa

SEQ ID NO: 5861630 - DNA, 21 bp, Homo sapiens
cagtgctcaccagccctgcag

SEQ ID NO: 5861631 - DNA, 18 bp, Homo sapiens
cagtgctcagctgtggct

SEQ ID NO: 5861632 - DNA, 19 bp, Homo sapiens
cagtgctcagctgtggctg

SEQ ID NO: 5861633 - DNA, 16 bp, Homo sapiens
cagtgctcagttgtac

SEQ ID NO: 5861634 - DNA, 18 bp, Homo sapiens
cagtgctcagttgtactt

SEQ ID NO: 5861635 - DNA, 13 bp, Homo sapiens
cagtgctccagcc

SEQ ID NO: 5861636 - DNA, 17 bp, Homo sapiens
cagtgctcctggaaact

SEQ ID NO: 5861637 - DNA, 15 bp, Homo sapiens
cagtgctcgctgttg

SEQ ID NO: 5861638 - DNA, 16 bp, Homo sapiens
cagtgctctcagctgg

SEQ ID NO: 5861639 - DNA, 22 bp, Homo sapiens
cagtgctctcctaccccacctc

SEQ ID NO: 5861640 - DNA, 13 bp, Homo sapiens
cagtgctctgcct

SEQ ID NO: 5861641 - DNA, 14 bp, Homo sapiens
cagtgctctgcctc

SEQ ID NO: 5861642 - DNA, 15 bp, Homo sapiens
cagtgctctgcctca

SEQ ID NO: 5861643 - DNA, 12 bp, Homo sapiens
cagtgctctgta

SEQ ID NO: 5861644 - DNA, 14 bp, Homo sapiens
cagtgctcttttct

SEQ ID NO: 5861645 - DNA, 12 bp, Homo sapiens
cagtgctgccat

SEQ ID NO: 5861646 - DNA, 17 bp, Homo sapiens
cagtgctgccatgccac

SEQ ID NO: 5861647 - DNA, 22 bp, Homo sapiens
cagtgctgccatgccactgcca

SEQ ID NO: 5861648 - DNA, 13 bp, Homo sapiens
cagtgctgcccat

SEQ ID NO: 5861649 - DNA, 15 bp, Homo sapiens
cagtgctgcccatga

SEQ ID NO: 5861650 - DNA, 22 bp, Homo sapiens
cagtgctgccccttgcaagcca

SEQ ID NO: 5861651 - DNA, 12 bp, Homo sapiens
cagtgctgcctg

SEQ ID NO: 5861652 - DNA, 14 bp, Homo sapiens
cagtgctgcctgtc

SEQ ID NO: 5861653 - DNA, 22 bp, Homo sapiens
cagtgctgcctgtccccatgct

SEQ ID NO: 5861654 - DNA, 14 bp, Homo sapiens
cagtgctgctgtaa

SEQ ID NO: 5861655 - DNA, 16 bp, Homo sapiens
cagtgctgctgtaaat

SEQ ID NO: 5861656 - DNA, 23 bp, Homo sapiens
cagtgctgctgtaaatacaggaa

SEQ ID NO: 5861657 - DNA, 11 bp, Homo sapiens
cagtgctgctt

SEQ ID NO: 5861658 - DNA, 14 bp, Homo sapiens
cagtgctgcttctt

SEQ ID NO: 5861659 - DNA, 15 bp, Homo sapiens
cagtgctggaaggga

SEQ ID NO: 5861660 - DNA, 21 bp, Homo sapiens
cagtgctggagaaatcttgaa

SEQ ID NO: 5861661 - DNA, 20 bp, Homo sapiens
cagtgctggccacacagcag

SEQ ID NO: 5861662 - DNA, 16 bp, Homo sapiens
cagtgctggctgctgg

SEQ ID NO: 5861663 - DNA, 17 bp, Homo sapiens
cagtgctggctgctggc

SEQ ID NO: 5861664 - DNA, 15 bp, Homo sapiens
cagtgctgggaccag

SEQ ID NO: 5861665 - DNA, 15 bp, Homo sapiens
cagtgctgggcccag

SEQ ID NO: 5861666 - DNA, 23 bp, Homo sapiens
cagtgctgggcccagccggggtg

SEQ ID NO: 5861667 - DNA, 22 bp, Homo sapiens
cagtgctgtccatgcttctcat

SEQ ID NO: 5861668 - DNA, 19 bp, Homo sapiens
cagtgctgtctgatctgtg

SEQ ID NO: 5861669 - DNA, 12 bp, Homo sapiens
cagtgctgtggc

SEQ ID NO: 5861670 - DNA, 20 bp, Homo sapiens
cagtgctgtggcctgggcaa

SEQ ID NO: 5861671 - DNA, 12 bp, Homo sapiens
cagtgctgtgtg

SEQ ID NO: 5861672 - DNA, 14 bp, Homo sapiens
cagtgcttagcaaa

SEQ ID NO: 5861673 - DNA, 24 bp, Homo sapiens
cagtgcttagcaaaaaataatgac

SEQ ID NO: 5861674 - DNA, 14 bp, Homo sapiens
cagtgcttcagcct

SEQ ID NO: 5861675 - DNA, 15 bp, Homo sapiens
cagtgcttcagcctg

SEQ ID NO: 5861676 - DNA, 18 bp, Homo sapiens
cagtgcttcagcctgagg

SEQ ID NO: 5861677 - DNA, 19 bp, Homo sapiens
cagtgcttcagcctgaggc

SEQ ID NO: 5861678 - DNA, 15 bp, Homo sapiens
cagtgcttcccgagt

SEQ ID NO: 5861679 - DNA, 23 bp, Homo sapiens
cagtgcttctccaacactgaagt

SEQ ID NO: 5861680 - DNA, 19 bp, Homo sapiens
cagtgcttgattgcgtgga

SEQ ID NO: 5861681 - DNA, 17 bp, Homo sapiens
cagtgcttgccacagag

SEQ ID NO: 5861682 - DNA, 13 bp, Homo sapiens
cagtgcttggccc

SEQ ID NO: 5861683 - DNA, 14 bp, Homo sapiens
cagtgcttggccca

SEQ ID NO: 5861684 - DNA, 20 bp, Homo sapiens
cagtgcttggcccaggagtt

SEQ ID NO: 5861685 - DNA, 13 bp, Homo sapiens
cagtgcttggctg

SEQ ID NO: 5861686 - DNA, 14 bp, Homo sapiens
cagtgcttggctgc

SEQ ID NO: 5861687 - DNA, 17 bp, Homo sapiens
cagtgcttggctgcccc

SEQ ID NO: 5861688 - DNA, 18 bp, Homo sapiens
cagtgcttggctgcccca

SEQ ID NO: 5861689 - DNA, 19 bp, Homo sapiens
cagtgcttggctgccccac

SEQ ID NO: 5861690 - DNA, 15 bp, Homo sapiens
cagtgcttgggctcc

SEQ ID NO: 5861691 - DNA, 18 bp, Homo sapiens
cagtgctttatccacatt

SEQ ID NO: 5861692 - DNA, 19 bp, Homo sapiens
cagtgctttatccacattg

SEQ ID NO: 5861693 - DNA, 20 bp, Homo sapiens
cagtgctttatccacattgt

SEQ ID NO: 5861694 - DNA, 20 bp, Homo sapiens
cagtgctttatggctctaac

SEQ ID NO: 5861695 - DNA, 19 bp, Homo sapiens
cagtgctttctcaaaattt

SEQ ID NO: 5861696 - DNA, 11 bp, Homo sapiens
cagtgctttgc

SEQ ID NO: 5861697 - DNA, 15 bp, Homo sapiens
cagtgctttgccctt

SEQ ID NO: 5861698 - DNA, 16 bp, Homo sapiens
cagtgctttgcccttg

SEQ ID NO: 5861699 - DNA, 21 bp, Homo sapiens
cagtgcttttggcggggagga

SEQ ID NO: 5861700 - DNA, 19 bp, Homo sapiens
cagtggaaaaatcagaagc

SEQ ID NO: 5861701 - DNA, 20 bp, Homo sapiens
cagtggaaaaatcagaagca

SEQ ID NO: 5861702 - DNA, 21 bp, Homo sapiens
cagtggaaaaatcagaagcac

SEQ ID NO: 5861703 - DNA, 19 bp, Homo sapiens
cagtggaaaccctgagagt

SEQ ID NO: 5861704 - DNA, 18 bp, Homo sapiens
cagtggaaattcaggtga

SEQ ID NO: 5861705 - DNA, 17 bp, Homo sapiens
cagtggaactcaatata

SEQ ID NO: 5861706 - DNA, 14 bp, Homo sapiens
cagtggaagtgatt

SEQ ID NO: 5861707 - DNA, 23 bp, Homo sapiens
cagtggaatataaggaaagcaat

SEQ ID NO: 5861708 - DNA, 22 bp, Homo sapiens
cagtggaattccaacttgaagg

SEQ ID NO: 5861709 - DNA, 19 bp, Homo sapiens
cagtggacagagggagaag

SEQ ID NO: 5861710 - DNA, 22 bp, Homo sapiens
cagtggacccgcccgcggccct

SEQ ID NO: 5861711 - DNA, 15 bp, Homo sapiens
cagtggaccctggac

SEQ ID NO: 5861712 - DNA, 18 bp, Homo sapiens
cagtggaccctgtggcca

SEQ ID NO: 5861713 - DNA, 22 bp, Homo sapiens
cagtggaccctgtggccaggtg

SEQ ID NO: 5861714 - DNA, 17 bp, Homo sapiens
cagttattttgataaca

SEQ ID NO: 5861715 - DNA, 17 bp, Homo sapiens
cagttattttggatata

SEQ ID NO: 5861716 - DNA, 21 bp, Homo sapiens
cagttcaaaattctaaatgta

SEQ ID NO: 5861717 - DNA, 21 bp, Homo sapiens
cagttcaacataaagagcaat

SEQ ID NO: 5861718 - DNA, 16 bp, Homo sapiens
cagttcaacctggtgg

SEQ ID NO: 5861719 - DNA, 21 bp, Homo sapiens
cagttcaacctggtggcacca

SEQ ID NO: 5861720 - DNA, 22 bp, Homo sapiens
cagttcaacctggtggcaccag

SEQ ID NO: 5861721 - DNA, 14 bp, Homo sapiens
cagttcaactttca

SEQ ID NO: 5861722 - DNA, 14 bp, Homo sapiens
cagttcaagaaagc

SEQ ID NO: 5861723 - DNA, 22 bp, Homo sapiens
cagttcaataaacttaacttta

SEQ ID NO: 5861724 - DNA, 14 bp, Homo sapiens
cagttcaataacaa

SEQ ID NO: 5861725 - DNA, 17 bp, Homo sapiens
cagttcaatcaaacttt

SEQ ID NO: 5861726 - DNA, 18 bp, Homo sapiens
cagttcacaccctgcaag

SEQ ID NO: 5861727 - DNA, 16 bp, Homo sapiens
cagttcacctgcactt

SEQ ID NO: 5861728 - DNA, 23 bp, Homo sapiens
cagttcacttctttgcagagcct

SEQ ID NO: 5861729 - DNA, 12 bp, Homo sapiens
cagttcagaaaa

SEQ ID NO: 5861730 - DNA, 21 bp, Homo sapiens
cagttcagaaggaataagcat

SEQ ID NO: 5861731 - DNA, 23 bp, Homo sapiens
cagttcagaatggcagtcctgga

SEQ ID NO: 5861732 - DNA, 16 bp, Homo sapiens
cagttcagagctgccc

SEQ ID NO: 5861733 - DNA, 19 bp, Homo sapiens
cagttcagagctgccctct

SEQ ID NO: 5861734 - DNA, 23 bp, Homo sapiens
cagttcagagctgccctctcctg

SEQ ID NO: 5861735 - DNA, 23 bp, Homo sapiens
cagttcagagttgtacactgtgt

SEQ ID NO: 5861736 - DNA, 13 bp, Homo sapiens
cagttcagcacca

SEQ ID NO: 5861737 - DNA, 14 bp, Homo sapiens
cagttcagcttggg

SEQ ID NO: 5861738 - DNA, 17 bp, Homo sapiens
cagttcaggaatttttg

SEQ ID NO: 5861739 - DNA, 23 bp, Homo sapiens
cagttcaggagtcccaaggaaag

SEQ ID NO: 5861740 - DNA, 20 bp, Homo sapiens
cagttcagtacctggaggag

SEQ ID NO: 5861741 - DNA, 21 bp, Homo sapiens
cagttcagtacctggaggagg

SEQ ID NO: 5861742 - DNA, 22 bp, Homo sapiens
cagttcagtacctggaggagga

SEQ ID NO: 5861743 - DNA, 20 bp, Homo sapiens
cagttcagtctgtagggagt

SEQ ID NO: 5861744 - DNA, 17 bp, Homo sapiens
cagttcagtgttgcatg

SEQ ID NO: 5861745 - DNA, 23 bp, Homo sapiens
cagttcatatgtaccatgtacat

SEQ ID NO: 5861746 - DNA, 18 bp, Homo sapiens
cagttcatcctgcatggg

SEQ ID NO: 5861747 - DNA, 12 bp, Homo sapiens
cagttcatctat

SEQ ID NO: 5861748 - DNA, 22 bp, Homo sapiens
cagttcatctatggcagtccag

SEQ ID NO: 5861749 - DNA, 17 bp, Homo sapiens
cagttcatctctgctga

SEQ ID NO: 5861750 - DNA, 20 bp, Homo sapiens
cagttcatgtctgaaacaga

SEQ ID NO: 5861751 - DNA, 16 bp, Homo sapiens
cagttcatgttgctca

SEQ ID NO: 5861752 - DNA, 19 bp, Homo sapiens
cagttcatgttgctcagaa

SEQ ID NO: 5861753 - DNA, 20 bp, Homo sapiens
cagttcatgttgctcagaag

SEQ ID NO: 5861754 - DNA, 16 bp, Homo sapiens
cagttcatgtttgctt

SEQ ID NO: 5861755 - DNA, 20 bp, Homo sapiens
cagttcattagaaatatttt

SEQ ID NO: 5861756 - DNA, 15 bp, Homo sapiens
cagttcattcccaga

SEQ ID NO: 5861757 - DNA, 19 bp, Homo sapiens
cagttcattgacctcatca

SEQ ID NO: 5861758 - DNA, 15 bp, Homo sapiens
cagttcattgcactt

SEQ ID NO: 5861759 - DNA, 14 bp, Homo sapiens
cagttcatttcctg

SEQ ID NO: 5861760 - DNA, 16 bp, Homo sapiens
cagttccaagaaagat

SEQ ID NO: 5861761 - DNA, 16 bp, Homo sapiens
cagttccaatacttca

SEQ ID NO: 5861762 - DNA, 17 bp, Homo sapiens
cagttccagccttctct

SEQ ID NO: 5861763 - DNA, 23 bp, Homo sapiens
cagttccagccttctctcaagga

SEQ ID NO: 5861764 - DNA, 18 bp, Homo sapiens
cagttcccacattaaaga

SEQ ID NO: 5861765 - DNA, 19 bp, Homo sapiens
cagttcccacattaaagaa

SEQ ID NO: 5861766 - DNA, 13 bp, Homo sapiens
cagttcccagaat

SEQ ID NO: 5861767 - DNA, 23 bp, Homo sapiens
cagttcccagaatcaaagcaatg

SEQ ID NO: 5861768 - DNA, 17 bp, Homo sapiens
cagttcccagagtgggc

SEQ ID NO: 5861769 - DNA, 12 bp, Homo sapiens
cagttcccagct

SEQ ID NO: 5861770 - DNA, 22 bp, Homo sapiens
cagttcccatggtgtatgtggt

SEQ ID NO: 5861771 - DNA, 19 bp, Homo sapiens
cagttcccccaacctcaga

SEQ ID NO: 5861772 - DNA, 20 bp, Homo sapiens
cagttcccccagtacctcca

SEQ ID NO: 5861773 - DNA, 20 bp, Homo sapiens
cagttcccggagcacagccc

SEQ ID NO: 5861774 - DNA, 23 bp, Homo sapiens
cagttcccggagcacagccctgg

SEQ ID NO: 5861775 - DNA, 14 bp, Homo sapiens
cagttccctcagcc

SEQ ID NO: 5861776 - DNA, 19 bp, Homo sapiens
cagttccctcagccctcat

SEQ ID NO: 5861777 - DNA, 14 bp, Homo sapiens
cagttccctcctgc

SEQ ID NO: 5861778 - DNA, 18 bp, Homo sapiens
cagttccctcctgcccag

SEQ ID NO: 5861779 - DNA, 20 bp, Homo sapiens
cagttccctcctgcccagga

SEQ ID NO: 5861780 - DNA, 19 bp, Homo sapiens
cagttccctggacagagct

SEQ ID NO: 5861781 - DNA, 14 bp, Homo sapiens
cagttccctgttga

SEQ ID NO: 5861782 - DNA, 20 bp, Homo sapiens
cagttcccttggcctcagaa

SEQ ID NO: 5861783 - DNA, 20 bp, Homo sapiens
cagttccctttatttcacat

SEQ ID NO: 5861784 - DNA, 17 bp, Homo sapiens
cagttccgatttcccag

SEQ ID NO: 5861785 - DNA, 22 bp, Homo sapiens
cagttcctaccgtactccctgc

SEQ ID NO: 5861786 - DNA, 12 bp, Homo sapiens
cagttcctagca

SEQ ID NO: 5861787 - DNA, 15 bp, Homo sapiens
cagttcctagcactg

SEQ ID NO: 5861788 - DNA, 16 bp, Homo sapiens
cagttcctagcactgc

SEQ ID NO: 5861789 - DNA, 18 bp, Homo sapiens
cagttcctatgacacagt

SEQ ID NO: 5861790 - DNA, 21 bp, Homo sapiens
cagttcctatgacacagttat

SEQ ID NO: 5861791 - DNA, 17 bp, Homo sapiens
cagttcctcgccctggg

SEQ ID NO: 5861792 - DNA, 16 bp, Homo sapiens
cagttcctcttcatct

SEQ ID NO: 5861793 - DNA, 19 bp, Homo sapiens
cagttcctgagaccagcca

SEQ ID NO: 5861794 - DNA, 16 bp, Homo sapiens
cagttcctgcagcaga

SEQ ID NO: 5861795 - DNA, 15 bp, Homo sapiens
cagttcctgctctct

SEQ ID NO: 5861796 - DNA, 21 bp, Homo sapiens
cagttcctgctctctgctcat

SEQ ID NO: 5861797 - DNA, 15 bp, Homo sapiens
cagttcctgggaaca

SEQ ID NO: 5861798 - DNA, 11 bp, Homo sapiens
cagttcctgta

SEQ ID NO: 5861799 - DNA, 21 bp, Homo sapiens
cagttcctgtcccacatggcc

SEQ ID NO: 5861800 - DNA, 19 bp, Homo sapiens
cagttcctgtggctccctc

SEQ ID NO: 5861801 - DNA, 20 bp, Homo sapiens
cagttccttaggagatgtca

SEQ ID NO: 5861802 - DNA, 14 bp, Homo sapiens
cagttccttggcct

SEQ ID NO: 5861803 - DNA, 15 bp, Homo sapiens
cagttcctttagaaa

SEQ ID NO: 5861804 - DNA, 19 bp, Homo sapiens
cagttcctttagaaagcag

SEQ ID NO: 5861805 - DNA, 22 bp, Homo sapiens
cagttcctttagaaagcagtta

SEQ ID NO: 5861806 - DNA, 15 bp, Homo sapiens
cagttcctttcaatg

SEQ ID NO: 5861807 - DNA, 15 bp, Homo sapiens
cagttcctttgtgtg

SEQ ID NO: 5861808 - DNA, 22 bp, Homo sapiens
cagttcctttgtgtgtactcac

SEQ ID NO: 5861809 - DNA, 14 bp, Homo sapiens
cagttcgcagccac

SEQ ID NO: 5861810 - DNA, 15 bp, Homo sapiens
cagttcgcagccacc

SEQ ID NO: 5861811 - DNA, 21 bp, Homo sapiens
cagttcgcagccaccctgagg

SEQ ID NO: 5861812 - DNA, 20 bp, Homo sapiens
cagttcgcctggagccctcc

SEQ ID NO: 5861813 - DNA, 21 bp, Homo sapiens
cagttcgttggtagagccctc

SEQ ID NO: 5861814 - DNA, 12 bp, Homo sapiens
cagttctagaag

SEQ ID NO: 5861815 - DNA, 22 bp, Homo sapiens
cagttctagaagccacagtgcc

SEQ ID NO: 5861816 - DNA, 21 bp, Homo sapiens
cagttctaggcctttcctctg

SEQ ID NO: 5861817 - DNA, 23 bp, Homo sapiens
cagttctaggcctttcctctgca

SEQ ID NO: 5861818 - DNA, 19 bp, Homo sapiens
cagttctagtttgcattcc

SEQ ID NO: 5861819 - DNA, 15 bp, Homo sapiens
cagttctatttaaaa

SEQ ID NO: 5861820 - DNA, 15 bp, Homo sapiens
cagttctcacaatgt

SEQ ID NO: 5861821 - DNA, 13 bp, Homo sapiens
cagttctcatctt

SEQ ID NO: 5861822 - DNA, 14 bp, Homo sapiens
cagttctcccaggg

SEQ ID NO: 5861823 - DNA, 18 bp, Homo sapiens
cagttctcccagggagtg

SEQ ID NO: 5861824 - DNA, 20 bp, Homo sapiens
cagttctcccagggagtgag

SEQ ID NO: 5861825 - DNA, 19 bp, Homo sapiens
cagttctcccttcaactgt

SEQ ID NO: 5861826 - DNA, 17 bp, Homo sapiens
cagttctcgtgccctta

SEQ ID NO: 5861827 - DNA, 16 bp, Homo sapiens
cagttctctactccct

SEQ ID NO: 5861828 - DNA, 18 bp, Homo sapiens
cagttctctcccttcctc

SEQ ID NO: 5861829 - DNA, 14 bp, Homo sapiens
cagttctctccttc

SEQ ID NO: 5861830 - DNA, 12 bp, Homo sapiens
cagttctctgtg

SEQ ID NO: 5861831 - DNA, 14 bp, Homo sapiens
cagttctctttgta

SEQ ID NO: 5861832 - DNA, 22 bp, Homo sapiens
cagttctgaagaagatggtacc

SEQ ID NO: 5861833 - DNA, 19 bp, Homo sapiens
cagttctgaataacttgaa

SEQ ID NO: 5861834 - DNA, 20 bp, Homo sapiens
cagttctgcaaatagaaaac

SEQ ID NO: 5861835 - DNA, 20 bp, Homo sapiens
cagttctgcactcttgtaca

SEQ ID NO: 5861836 - DNA, 16 bp, Homo sapiens
cagttctgctcctctc

SEQ ID NO: 5861837 - DNA, 22 bp, Homo sapiens
cagttctgctcctctccaggca

SEQ ID NO: 5861838 - DNA, 20 bp, Homo sapiens
cagttctgctctaagaagct

SEQ ID NO: 5861839 - DNA, 18 bp, Homo sapiens
cagttctgcttgctccca

SEQ ID NO: 5861840 - DNA, 21 bp, Homo sapiens
cagttctggatggtgtgcctt

SEQ ID NO: 5861841 - DNA, 18 bp, Homo sapiens
cagttctgtcatatgtta

SEQ ID NO: 5861842 - DNA, 12 bp, Homo sapiens
cagttctgtgta

SEQ ID NO: 5861843 - DNA, 14 bp, Homo sapiens
cagttctgtgtaca

SEQ ID NO: 5861844 - DNA, 13 bp, Homo sapiens
cagttctgtgtgg

SEQ ID NO: 5861845 - DNA, 20 bp, Homo sapiens
cagttctgtgtggtgcattc

SEQ ID NO: 5861846 - DNA, 14 bp, Homo sapiens
cagttcttaataca

SEQ ID NO: 5861847 - DNA, 20 bp, Homo sapiens
cagttcttaatacaggagac

SEQ ID NO: 5861848 - DNA, 18 bp, Homo sapiens
cagttcttacacattcca

SEQ ID NO: 5861849 - DNA, 22 bp, Homo sapiens
cagttcttagattcaggggaag

SEQ ID NO: 5861850 - DNA, 12 bp, Homo sapiens
cagttcttcccc

SEQ ID NO: 5861851 - DNA, 16 bp, Homo sapiens
cagttcttcctgcaac

SEQ ID NO: 5861852 - DNA, 20 bp, Homo sapiens
cagttcttcgggaagagagg

SEQ ID NO: 5861853 - DNA, 22 bp, Homo sapiens
cagttcttcgggaagagaggag

SEQ ID NO: 5861854 - DNA, 24 bp, Homo sapiens
cagttcttcgggaagagaggagtt

SEQ ID NO: 5861855 - DNA, 16 bp, Homo sapiens
cagttcttgcaataag

SEQ ID NO: 5861856 - DNA, 19 bp, Homo sapiens
cagttcttggacccctgaa

SEQ ID NO: 5861857 - DNA, 23 bp, Homo sapiens
cagttcttggtgactgtcccacc

SEQ ID NO: 5861858 - DNA, 18 bp, Homo sapiens
cagttcttggtgctctgt

SEQ ID NO: 5861859 - DNA, 19 bp, Homo sapiens
cagttcttgtggaagacac

SEQ ID NO: 5861860 - DNA, 21 bp, Homo sapiens
cagttctttataacaaaacag

SEQ ID NO: 5861861 - DNA, 15 bp, Homo sapiens
cagttctttcctctt

SEQ ID NO: 5861862 - DNA, 22 bp, Homo sapiens
cagttctttcctctttctgctc

SEQ ID NO: 5861863 - DNA, 19 bp, Homo sapiens
cagttctttgggccagaca

SEQ ID NO: 5861864 - DNA, 16 bp, Homo sapiens
cagttctttttgtaca

SEQ ID NO: 5861865 - DNA, 20 bp, Homo sapiens
cagttctttttgtacactta

SEQ ID NO: 5861866 - DNA, 21 bp, Homo sapiens
cagttgaaaagactccaaaga

SEQ ID NO: 5861867 - DNA, 23 bp, Homo sapiens
cagttgaaaagactccaaagaaa

SEQ ID NO: 5861868 - DNA, 18 bp, Homo sapiens
cagttgaaaatgcaactc

SEQ ID NO: 5861869 - DNA, 21 bp, Homo sapiens
cagttgaaaatgcaactctaa

SEQ ID NO: 5861870 - DNA, 18 bp, Homo sapiens
cagttgaaaatggatttt

SEQ ID NO: 5861871 - DNA, 18 bp, Homo sapiens
cagttgaacctgatgagc

SEQ ID NO: 5861872 - DNA, 19 bp, Homo sapiens
cagttgaagggaggggctg

SEQ ID NO: 5861873 - DNA, 15 bp, Homo sapiens
cagttgaataatttg

SEQ ID NO: 5861874 - DNA, 16 bp, Homo sapiens
cagttgaattcagtgg

SEQ ID NO: 5861875 - DNA, 16 bp, Homo sapiens
cagttgacagcaggtg

SEQ ID NO: 5861876 - DNA, 19 bp, Homo sapiens
cagttgacatccaaatcta

SEQ ID NO: 5861877 - DNA, 15 bp, Homo sapiens
cagttgactcagagt

SEQ ID NO: 5861878 - DNA, 20 bp, Homo sapiens
cagttgactggctttcctct

SEQ ID NO: 5861879 - DNA, 21 bp, Homo sapiens
cagttgactggctttcctctc

SEQ ID NO: 5861880 - DNA, 20 bp, Homo sapiens
cagttgacttactgtttctt

SEQ ID NO: 5861881 - DNA, 20 bp, Homo sapiens
cagttgagaaaatttgaatg

SEQ ID NO: 5861882 - DNA, 20 bp, Homo sapiens
cagttgagaggacactcccg

SEQ ID NO: 5861883 - DNA, 23 bp, Homo sapiens
cagttgaggtctgcgtcgggctt

SEQ ID NO: 5861884 - DNA, 19 bp, Homo sapiens
cagttgatatttaaaagat

SEQ ID NO: 5861885 - DNA, 16 bp, Homo sapiens
cagttgatggagcccc

SEQ ID NO: 5861886 - DNA, 20 bp, Homo sapiens
cagttgatggagccccaggg

SEQ ID NO: 5861887 - DNA, 19 bp, Homo sapiens
cagttgcaataaaatagta

SEQ ID NO: 5861888 - DNA, 17 bp, Homo sapiens
cagttgcaataatactt

SEQ ID NO: 5861889 - DNA, 18 bp, Homo sapiens
cagtttggccctggagcc

SEQ ID NO: 5861890 - DNA, 21 bp, Homo sapiens
cagtttggccctggagccagg

SEQ ID NO: 5861891 - DNA, 24 bp, Homo sapiens
cagtttgggagacatggaccagca

SEQ ID NO: 5861892 - DNA, 19 bp, Homo sapiens
cagtttggggactcaggac

SEQ ID NO: 5861893 - DNA, 21 bp, Homo sapiens
cagtttggggactcaggacca

SEQ ID NO: 5861894 - DNA, 16 bp, Homo sapiens
cagtttggggcagggg

SEQ ID NO: 5861895 - DNA, 17 bp, Homo sapiens
cagtttggggtgccaag

SEQ ID NO: 5861896 - DNA, 21 bp, Homo sapiens
cagtttggggtgccaagatgg

SEQ ID NO: 5861897 - DNA, 11 bp, Homo sapiens
cagtttggttg

SEQ ID NO: 5861898 - DNA, 22 bp, Homo sapiens
cagtttgtaaatgttatttctg

SEQ ID NO: 5861899 - DNA, 14 bp, Homo sapiens
cagtttgtatatac

SEQ ID NO: 5861900 - DNA, 18 bp, Homo sapiens
cagtttgtctctttgcaa

SEQ ID NO: 5861901 - DNA, 23 bp, Homo sapiens
cagtttgtgaacttcacaagaat

SEQ ID NO: 5861902 - DNA, 13 bp, Homo sapiens
cagtttgtgaagt

SEQ ID NO: 5861903 - DNA, 22 bp, Homo sapiens
cagtttgtgaagtgattgacat

SEQ ID NO: 5861904 - DNA, 23 bp, Homo sapiens
cagtttgtgaagtgattgacatt

SEQ ID NO: 5861905 - DNA, 15 bp, Homo sapiens
cagtttgtgtgtctt

SEQ ID NO: 5861906 - DNA, 16 bp, Homo sapiens
cagtttgtgtgtctta

SEQ ID NO: 5861907 - DNA, 23 bp, Homo sapiens
cagtttgtgtgtcttaattatta

SEQ ID NO: 5861908 - DNA, 20 bp, Homo sapiens
cagtttgtgttttaaaaaaa

SEQ ID NO: 5861909 - DNA, 23 bp, Homo sapiens
cagtttgttagtatgaggcattt

SEQ ID NO: 5861910 - DNA, 12 bp, Homo sapiens
cagtttgttcag

SEQ ID NO: 5861911 - DNA, 16 bp, Homo sapiens
cagtttgttctccggg

SEQ ID NO: 5861912 - DNA, 14 bp, Homo sapiens
cagtttgttggaaa

SEQ ID NO: 5861913 - DNA, 14 bp, Homo sapiens
cagtttgtttactt

SEQ ID NO: 5861914 - DNA, 15 bp, Homo sapiens
cagtttgtttcctgt

SEQ ID NO: 5861915 - DNA, 19 bp, Homo sapiens
cagttttaaacgttaaaag

SEQ ID NO: 5861916 - DNA, 12 bp, Homo sapiens
cagttttaactg

SEQ ID NO: 5861917 - DNA, 11 bp, Homo sapiens
cagttttaata

SEQ ID NO: 5861918 - DNA, 18 bp, Homo sapiens
cagttttaataagaacag

SEQ ID NO: 5861919 - DNA, 12 bp, Homo sapiens
cagttttactgc

SEQ ID NO: 5861920 - DNA, 15 bp, Homo sapiens
cagttttactgcatt

SEQ ID NO: 5861921 - DNA, 17 bp, Homo sapiens
cagttttagcagcactt

SEQ ID NO: 5861922 - DNA, 22 bp, Homo sapiens
cagttttagttggtgctgatgg

SEQ ID NO: 5861923 - DNA, 18 bp, Homo sapiens
cagttttatagctttatt

SEQ ID NO: 5861924 - DNA, 16 bp, Homo sapiens
cagttttattttctaa

SEQ ID NO: 5861925 - DNA, 15 bp, Homo sapiens
cagttttatttttgc

SEQ ID NO: 5861926 - DNA, 13 bp, Homo sapiens
cagttttcaaatt

SEQ ID NO: 5861927 - DNA, 21 bp, Homo sapiens
cagttttcaaattataatctc

SEQ ID NO: 5861928 - DNA, 12 bp, Homo sapiens
cagttttcacag

SEQ ID NO: 5861929 - DNA, 16 bp, Homo sapiens
cagttttcacagaggc

SEQ ID NO: 5861930 - DNA, 12 bp, Homo sapiens
cagttttcataa

SEQ ID NO: 5861931 - DNA, 14 bp, Homo sapiens
cagttttccaggag

SEQ ID NO: 5861932 - DNA, 14 bp, Homo sapiens
cagttttccatgaa

SEQ ID NO: 5861933 - DNA, 18 bp, Homo sapiens
cagttttccatgaaaacg

SEQ ID NO: 5861934 - DNA, 19 bp, Homo sapiens
cagttttccatgaaaacgt

SEQ ID NO: 5861935 - DNA, 21 bp, Homo sapiens
cagttttccatggtgtattca

SEQ ID NO: 5861936 - DNA, 13 bp, Homo sapiens
cagttttccctgg

SEQ ID NO: 5861937 - DNA, 20 bp, Homo sapiens
cagttttcctagtctttggg

SEQ ID NO: 5861938 - DNA, 14 bp, Homo sapiens
cagttttctcctct

SEQ ID NO: 5861939 - DNA, 18 bp, Homo sapiens
cagttttctcctctgctt

SEQ ID NO: 5861940 - DNA, 14 bp, Homo sapiens
cagttttctgagaa

SEQ ID NO: 5861941 - DNA, 18 bp, Homo sapiens
cagttttgaaatgaaaat

SEQ ID NO: 5861942 - DNA, 19 bp, Homo sapiens
cagttttgacatcagccag

SEQ ID NO: 5861943 - DNA, 23 bp, Homo sapiens
cagttttgacatcagccagctgc

SEQ ID NO: 5861944 - DNA, 13 bp, Homo sapiens
cagttttgacatt

SEQ ID NO: 5861945 - DNA, 17 bp, Homo sapiens
cagttttgagtgtactg

SEQ ID NO: 5861946 - DNA, 19 bp, Homo sapiens
cagttttgagtgtactgtg

SEQ ID NO: 5861947 - DNA, 16 bp, Homo sapiens
cagttttgatacaaac

SEQ ID NO: 5861948 - DNA, 12 bp, Homo sapiens
cagttttgctgc

SEQ ID NO: 5861949 - DNA, 14 bp, Homo sapiens
cagttttgtaaagg

SEQ ID NO: 5861950 - DNA, 14 bp, Homo sapiens
cagttttgtaaatg

SEQ ID NO: 5861951 - DNA, 24 bp, Homo sapiens
cagttttgtaaatgtactggtaat

SEQ ID NO: 5861952 - DNA, 23 bp, Homo sapiens
cagttttgtatcaaactcgtctg

SEQ ID NO: 5861953 - DNA, 16 bp, Homo sapiens
cagttttgtcttcgta

SEQ ID NO: 5861954 - DNA, 19 bp, Homo sapiens
cagttttgtgtacagtatg

SEQ ID NO: 5861955 - DNA, 21 bp, Homo sapiens
cagttttgtgtacagtatgtg

SEQ ID NO: 5861956 - DNA, 22 bp, Homo sapiens
cagttttgtgtacagtatgtgt

SEQ ID NO: 5861957 - DNA, 22 bp, Homo sapiens
cagtttttaaaatatattgctg

SEQ ID NO: 5861958 - DNA, 19 bp, Homo sapiens
cagtttttaactctactgt

SEQ ID NO: 5861959 - DNA, 18 bp, Homo sapiens
cagtttttataatagatt

SEQ ID NO: 5861960 - DNA, 20 bp, Homo sapiens
cagtttttataatagatttt

SEQ ID NO: 5861961 - DNA, 20 bp, Homo sapiens
cagtttttattaatctactg

SEQ ID NO: 5861962 - DNA, 22 bp, Homo sapiens
cagtttttattaatctactgta

SEQ ID NO: 5861963 - DNA, 22 bp, Homo sapiens
cagtttttcagagtggaatgct

SEQ ID NO: 5861964 - DNA, 13 bp, Homo sapiens
cagtttttcattt

SEQ ID NO: 5861965 - DNA, 11 bp, Homo sapiens
cagtttttccc

SEQ ID NO: 5861966 - DNA, 13 bp, Homo sapiens
cagtttttcctcc

SEQ ID NO: 5861967 - DNA, 22 bp, Homo sapiens
cagtttttcggtgggacagccc

SEQ ID NO: 5861968 - DNA, 15 bp, Homo sapiens
cagtttttctttact

SEQ ID NO: 5861969 - DNA, 14 bp, Homo sapiens
cagtttttgacatt

SEQ ID NO: 5861970 - DNA, 17 bp, Homo sapiens
cagtttttggagtgtta

SEQ ID NO: 5861971 - DNA, 13 bp, Homo sapiens
cagtttttgtaaa

SEQ ID NO: 5861972 - DNA, 14 bp, Homo sapiens
cagtttttgtatct

SEQ ID NO: 5861973 - DNA, 15 bp, Homo sapiens
cagtttttgtatctt

SEQ ID NO: 5861974 - DNA, 19 bp, Homo sapiens
cagtttttgttcttaaaaa

SEQ ID NO: 5861975 - DNA, 16 bp, Homo sapiens
cagttttttatgctaa

SEQ ID NO: 5861976 - DNA, 17 bp, Homo sapiens
cagttttttcacctcca

SEQ ID NO: 5861977 - DNA, 19 bp, Homo sapiens
cagttttttcacctggaag

SEQ ID NO: 5861978 - DNA, 18 bp, Homo sapiens
cagttttttgccactgca

SEQ ID NO: 5861979 - DNA, 16 bp, Homo sapiens
cagttttttggaagaa

SEQ ID NO: 5861980 - DNA, 18 bp, Homo sapiens
cagttttttttttcttgt

SEQ ID NO: 5861981 - DNA, 19 bp, Homo sapiens
cagttttttttttcttgtc

SEQ ID NO: 5861982 - DNA, 23 bp, Homo sapiens
cagttttttttttcttgtctata

SEQ ID NO: 5861983 - DNA, 15 bp, Homo sapiens
cataaaaaaatgatg

SEQ ID NO: 5861984 - DNA, 16 bp, Homo sapiens
cataaaaaaatgatgc

SEQ ID NO: 5861985 - DNA, 22 bp, Homo sapiens
cataaaaaagaagcactttgat

SEQ ID NO: 5861986 - DNA, 17 bp, Homo sapiens
cataaaaacaactttat

SEQ ID NO: 5861987 - DNA, 18 bp, Homo sapiens
cataaaaactgatttgct

SEQ ID NO: 5861988 - DNA, 21 bp, Homo sapiens
cataaaaactggttctacaaa

SEQ ID NO: 5861989 - DNA, 22 bp, Homo sapiens
cataaaaactggttctacaaat

SEQ ID NO: 5861990 - DNA, 23 bp, Homo sapiens
cataaaaactggttctacaaatt

SEQ ID NO: 5861991 - DNA, 17 bp, Homo sapiens
cataaaaagaaagctaa

SEQ ID NO: 5861992 - DNA, 23 bp, Homo sapiens
cataaaaagcaaaacaaaaatta

SEQ ID NO: 5861993 - DNA, 12 bp, Homo sapiens
cataaaaagcag

SEQ ID NO: 5861994 - DNA, 17 bp, Homo sapiens
cataaaaagcagaattt

SEQ ID NO: 5861995 - DNA, 21 bp, Homo sapiens
cataaaaagcagaattttaat

SEQ ID NO: 5861996 - DNA, 13 bp, Homo sapiens
cataaaaaggaca

SEQ ID NO: 5861997 - DNA, 20 bp, Homo sapiens
cataaaaaggacatcagcaa

SEQ ID NO: 5861998 - DNA, 21 bp, Homo sapiens
cataaaaaggacatcagcaaa

SEQ ID NO: 5861999 - DNA, 22 bp, Homo sapiens
cataaaaagttaaaaaaaataa

SEQ ID NO: 5862000 - DNA, 21 bp, Homo sapiens
cataaaaataaaatctgtaaa

SEQ ID NO: 5862001 - DNA, 17 bp, Homo sapiens
cataaaaattaaatgga

SEQ ID NO: 5862002 - DNA, 13 bp, Homo sapiens
cataaaaattgaa

SEQ ID NO: 5862003 - DNA, 16 bp, Homo sapiens
cataaaaattgaattc

SEQ ID NO: 5862004 - DNA, 12 bp, Homo sapiens
cataaaacaaaa

SEQ ID NO: 5862005 - DNA, 19 bp, Homo sapiens
cataaaacacccttgaaaa

SEQ ID NO: 5862006 - DNA, 12 bp, Homo sapiens
cataaaacaggt

SEQ ID NO: 5862007 - DNA, 16 bp, Homo sapiens
cataaaacattaagaa

SEQ ID NO: 5862008 - DNA, 22 bp, Homo sapiens
cataaaacattaagaaaatcat

SEQ ID NO: 5862009 - DNA, 15 bp, Homo sapiens
cataaaactttggca

SEQ ID NO: 5862010 - DNA, 14 bp, Homo sapiens
cataaaagaatgta

SEQ ID NO: 5862011 - DNA, 17 bp, Homo sapiens
cataaaagaatgtacag

SEQ ID NO: 5862012 - DNA, 19 bp, Homo sapiens
cataaaagaatgtacagaa

SEQ ID NO: 5862013 - DNA, 23 bp, Homo sapiens
cataaaagaatgtacagaaaata

SEQ ID NO: 5862014 - DNA, 17 bp, Homo sapiens
cataaaagcattgtctc

SEQ ID NO: 5862015 - DNA, 20 bp, Homo sapiens
cataaaagggtcaaacctgt

SEQ ID NO: 5862016 - DNA, 17 bp, Homo sapiens
cataaaagtaattaatt

SEQ ID NO: 5862017 - DNA, 20 bp, Homo sapiens
cataaaataaagtatatata

SEQ ID NO: 5862018 - DNA, 17 bp, Homo sapiens
cataaaataaataatct

SEQ ID NO: 5862019 - DNA, 19 bp, Homo sapiens
cataaaataaggagcatat

SEQ ID NO: 5862020 - DNA, 15 bp, Homo sapiens
cataaaatacaaaaa

SEQ ID NO: 5862021 - DNA, 16 bp, Homo sapiens
cataaaatgctatttt

SEQ ID NO: 5862022 - DNA, 15 bp, Homo sapiens
cataaaatggaataa

SEQ ID NO: 5862023 - DNA, 19 bp, Homo sapiens
cataaaatgggtgatatgc

SEQ ID NO: 5862024 - DNA, 19 bp, Homo sapiens
cataaaattaaaatttaac

SEQ ID NO: 5862025 - DNA, 20 bp, Homo sapiens
cataaaattaaaatttaaca

SEQ ID NO: 5862026 - DNA, 13 bp, Homo sapiens
cataaaattctag

SEQ ID NO: 5862027 - DNA, 14 bp, Homo sapiens
cataaaattctaga

SEQ ID NO: 5862028 - DNA, 14 bp, Homo sapiens
cataaaattggatt

SEQ ID NO: 5862029 - DNA, 14 bp, Homo sapiens
cataaaattttcta

SEQ ID NO: 5862030 - DNA, 13 bp, Homo sapiens
cataaacaaagac

SEQ ID NO: 5862031 - DNA, 24 bp, Homo sapiens
cataaacaaagacattgacagcaa

SEQ ID NO: 5862032 - DNA, 20 bp, Homo sapiens
cataaacacatcacagatga

SEQ ID NO: 5862033 - DNA, 18 bp, Homo sapiens
cataaacacttctcctta

SEQ ID NO: 5862034 - DNA, 17 bp, Homo sapiens
cataaacacttttcaag

SEQ ID NO: 5862035 - DNA, 18 bp, Homo sapiens
cataaacagagtccctcc

SEQ ID NO: 5862036 - DNA, 19 bp, Homo sapiens
cataaacagcacacctgtg

SEQ ID NO: 5862037 - DNA, 19 bp, Homo sapiens
cataaacagcatggaaaag

SEQ ID NO: 5862038 - DNA, 13 bp, Homo sapiens
cataaacagtttt

SEQ ID NO: 5862039 - DNA, 19 bp, Homo sapiens
cataaaccaatgagctgta

SEQ ID NO: 5862040 - DNA, 17 bp, Homo sapiens
cataaaccaatgtggca

SEQ ID NO: 5862041 - DNA, 21 bp, Homo sapiens
cataaaccatttttgttactc

SEQ ID NO: 5862042 - DNA, 16 bp, Homo sapiens
cataaacccatctgta

SEQ ID NO: 5862043 - DNA, 16 bp, Homo sapiens
cataaaccctccaagg

SEQ ID NO: 5862044 - DNA, 12 bp, Homo sapiens
cataaaccttaa

SEQ ID NO: 5862045 - DNA, 16 bp, Homo sapiens
cataaactaagagaaa

SEQ ID NO: 5862046 - DNA, 18 bp, Homo sapiens
cataaactagatatagct

SEQ ID NO: 5862047 - DNA, 21 bp, Homo sapiens
cataaactagatatagctttt

SEQ ID NO: 5862048 - DNA, 17 bp, Homo sapiens
cataaactgactttatc

SEQ ID NO: 5862049 - DNA, 16 bp, Homo sapiens
cataaacttcatggtc

SEQ ID NO: 5862050 - DNA, 17 bp, Homo sapiens
cataaactttataaatt

SEQ ID NO: 5862051 - DNA, 22 bp, Homo sapiens
cataaactttctccatttaaga

SEQ ID NO: 5862052 - DNA, 12 bp, Homo sapiens
cataaagaaaag

SEQ ID NO: 5862053 - DNA, 15 bp, Homo sapiens
cataaagaaattcaa

SEQ ID NO: 5862054 - DNA, 24 bp, Homo sapiens
cataaagaagagccttcacatgaa

SEQ ID NO: 5862055 - DNA, 18 bp, Homo sapiens
cataaagacaatcactgc

SEQ ID NO: 5862056 - DNA, 20 bp, Homo sapiens
cataaagacaatcactgcca

SEQ ID NO: 5862057 - DNA, 10 bp, Homo sapiens
cataaagact

SEQ ID NO: 5862058 - DNA, 12 bp, Homo sapiens
cataaagactgt

SEQ ID NO: 5862059 - DNA, 19 bp, Homo sapiens
cataaagactgtgctgaga

SEQ ID NO: 5862060 - DNA, 14 bp, Homo sapiens
cataaagagaaaat

SEQ ID NO: 5862061 - DNA, 20 bp, Homo sapiens
cataaagcaaatagacacag

SEQ ID NO: 5862062 - DNA, 17 bp, Homo sapiens
cataaagcaccagcagt

SEQ ID NO: 5862063 - DNA, 22 bp, Homo sapiens
cataaagcactacctaagtaat

SEQ ID NO: 5862064 - DNA, 14 bp, Homo sapiens
cataaagcaggcag

SEQ ID NO: 5862065 - DNA, 12 bp, Homo sapiens
cataaagccttt

SEQ ID NO: 5862066 - DNA, 20 bp, Homo sapiens
cataaagccttttgctttat

SEQ ID NO: 5862067 - DNA, 18 bp, Homo sapiens
cataagtgctattgcaga

SEQ ID NO: 5862068 - DNA, 22 bp, Homo sapiens
cataagtgctattgcagagccg

SEQ ID NO: 5862069 - DNA, 17 bp, Homo sapiens
cataagtggggagagag

SEQ ID NO: 5862070 - DNA, 14 bp, Homo sapiens
cataagttagatgt

SEQ ID NO: 5862071 - DNA, 19 bp, Homo sapiens
cataagttatgcctctgac

SEQ ID NO: 5862072 - DNA, 14 bp, Homo sapiens
cataagttgcattt

SEQ ID NO: 5862073 - DNA, 12 bp, Homo sapiens
cataagtttctg

SEQ ID NO: 5862074 - DNA, 17 bp, Homo sapiens
cataagttttctctttt

SEQ ID NO: 5862075 - DNA, 14 bp, Homo sapiens
cataataaaaggca

SEQ ID NO: 5862076 - DNA, 15 bp, Homo sapiens
cataataaaatatca

SEQ ID NO: 5862077 - DNA, 12 bp, Homo sapiens
cataataaacta

SEQ ID NO: 5862078 - DNA, 14 bp, Homo sapiens
cataataaactaga

SEQ ID NO: 5862079 - DNA, 19 bp, Homo sapiens
cataataaacttctggtgt

SEQ ID NO: 5862080 - DNA, 13 bp, Homo sapiens
cataataaagcaa

SEQ ID NO: 5862081 - DNA, 21 bp, Homo sapiens
cataataaagcaatctgattc

SEQ ID NO: 5862082 - DNA, 15 bp, Homo sapiens
cataataaagtattt

SEQ ID NO: 5862083 - DNA, 14 bp, Homo sapiens
cataataaattttc

SEQ ID NO: 5862084 - DNA, 17 bp, Homo sapiens
cataataaccctgccag

SEQ ID NO: 5862085 - DNA, 21 bp, Homo sapiens
cataataagagaatgttccta

SEQ ID NO: 5862086 - DNA, 17 bp, Homo sapiens
cataataataatgggtt

SEQ ID NO: 5862087 - DNA, 18 bp, Homo sapiens
cataataatcctgcaaag

SEQ ID NO: 5862088 - DNA, 12 bp, Homo sapiens
cataataattct

SEQ ID NO: 5862089 - DNA, 20 bp, Homo sapiens
cataataccaccatttaaaa

SEQ ID NO: 5862090 - DNA, 16 bp, Homo sapiens
cataatactaatttat

SEQ ID NO: 5862091 - DNA, 18 bp, Homo sapiens
cataatactgaaatgctt

SEQ ID NO: 5862092 - DNA, 15 bp, Homo sapiens
cataatactgaacca

SEQ ID NO: 5862093 - DNA, 15 bp, Homo sapiens
cataatacttgcttt

SEQ ID NO: 5862094 - DNA, 17 bp, Homo sapiens
cataatagaatttccta

SEQ ID NO: 5862095 - DNA, 15 bp, Homo sapiens
cataatataagaatc

SEQ ID NO: 5862096 - DNA, 14 bp, Homo sapiens
cataatatagctta

SEQ ID NO: 5862097 - DNA, 16 bp, Homo sapiens
cataatatataaaaga

SEQ ID NO: 5862098 - DNA, 20 bp, Homo sapiens
cataatatataaaagaaata

SEQ ID NO: 5862099 - DNA, 16 bp, Homo sapiens
cataatatatgacttc

SEQ ID NO: 5862100 - DNA, 17 bp, Homo sapiens
cataatatcttgaagaa

SEQ ID NO: 5862101 - DNA, 21 bp, Homo sapiens
cataatatcttgaagaatatt

SEQ ID NO: 5862102 - DNA, 18 bp, Homo sapiens
cataatatgcatatatat

SEQ ID NO: 5862103 - DNA, 23 bp, Homo sapiens
cataatatgcatatatatgtata

SEQ ID NO: 5862104 - DNA, 20 bp, Homo sapiens
cataatatttgaacaaaaat

SEQ ID NO: 5862105 - DNA, 13 bp, Homo sapiens
cataatattttct

SEQ ID NO: 5862106 - DNA, 16 bp, Homo sapiens
cataatcactctaatt

SEQ ID NO: 5862107 - DNA, 22 bp, Homo sapiens
cataatcatccttttttaaaaa

SEQ ID NO: 5862108 - DNA, 20 bp, Homo sapiens
cataatcatggattatgttg

SEQ ID NO: 5862109 - DNA, 21 bp, Homo sapiens
cataatcatggctcttagaaa

SEQ ID NO: 5862110 - DNA, 22 bp, Homo sapiens
cataatctagtttacagaaaaa

SEQ ID NO: 5862111 - DNA, 16 bp, Homo sapiens
cataatctctggaaat

SEQ ID NO: 5862112 - DNA, 16 bp, Homo sapiens
cataatctgaaaacat

SEQ ID NO: 5862113 - DNA, 23 bp, Homo sapiens
cataatctggtctcttcttcttt

SEQ ID NO: 5862114 - DNA, 14 bp, Homo sapiens
cataatcttagaga

SEQ ID NO: 5862115 - DNA, 21 bp, Homo sapiens
cataatcttctgccttctcat

SEQ ID NO: 5862116 - DNA, 23 bp, Homo sapiens
cataatgaacagaatttatgact

SEQ ID NO: 5862117 - DNA, 18 bp, Homo sapiens
cataatgaattataacag

SEQ ID NO: 5862118 - DNA, 20 bp, Homo sapiens
cataatgagtaatgcagaca

SEQ ID NO: 5862119 - DNA, 22 bp, Homo sapiens
cataatgagtaatgcagacatt

SEQ ID NO: 5862120 - DNA, 19 bp, Homo sapiens
cataatgataaaataaata

SEQ ID NO: 5862121 - DNA, 19 bp, Homo sapiens
cataatgatactgaattgt

SEQ ID NO: 5862122 - DNA, 15 bp, Homo sapiens
cataatgatggattt

SEQ ID NO: 5862123 - DNA, 21 bp, Homo sapiens
cataatgatggatttaacagc

SEQ ID NO: 5862124 - DNA, 12 bp, Homo sapiens
cataatgcagaa

SEQ ID NO: 5862125 - DNA, 13 bp, Homo sapiens
cataatgcagaag

SEQ ID NO: 5862126 - DNA, 21 bp, Homo sapiens
cataatgcattcttctctgtt

SEQ ID NO: 5862127 - DNA, 14 bp, Homo sapiens
cataatgcgtgcat

SEQ ID NO: 5862128 - DNA, 22 bp, Homo sapiens
cataatgctcccatctcctgat

SEQ ID NO: 5862129 - DNA, 12 bp, Homo sapiens
cataatgctttg

SEQ ID NO: 5862130 - DNA, 17 bp, Homo sapiens
cataatgctttggaaaa

SEQ ID NO: 5862131 - DNA, 22 bp, Homo sapiens
cataatgggccactgaaatctg

SEQ ID NO: 5862132 - DNA, 23 bp, Homo sapiens
cataatgggccactgaaatctgt

SEQ ID NO: 5862133 - DNA, 22 bp, Homo sapiens
cataatggggtcctggccatcc

SEQ ID NO: 5862134 - DNA, 15 bp, Homo sapiens
cataatggtaaatct

SEQ ID NO: 5862135 - DNA, 17 bp, Homo sapiens
cataatggtaaatcttt

SEQ ID NO: 5862136 - DNA, 20 bp, Homo sapiens
cataatggtactcccaaact

SEQ ID NO: 5862137 - DNA, 15 bp, Homo sapiens
cataatggttgtgaa

SEQ ID NO: 5862138 - DNA, 13 bp, Homo sapiens
cataatgtaactg

SEQ ID NO: 5862139 - DNA, 20 bp, Homo sapiens
cataatgtactgatttcagt

SEQ ID NO: 5862140 - DNA, 22 bp, Homo sapiens
cataatgtagtgagtgtagact

SEQ ID NO: 5862141 - DNA, 14 bp, Homo sapiens
cataatgtattgtt

SEQ ID NO: 5862142 - DNA, 15 bp, Homo sapiens
cataatgtccctctc

SEQ ID NO: 5862143 - DNA, 19 bp, Homo sapiens
cataatgtccctctcttgg

SEQ ID NO: 5862144 - DNA, 20 bp, Homo sapiens
cataatgtccctctcttggc

SEQ ID NO: 5862145 - DNA, 22 bp, Homo sapiens
cataatgtccctctcttggcta

SEQ ID NO: 5862146 - DNA, 11 bp, Homo sapiens
cataatgtgaa

SEQ ID NO: 5862147 - DNA, 16 bp, Homo sapiens
cataatgtgaagtgtt

SEQ ID NO: 5862148 - DNA, 12 bp, Homo sapiens
cataatgtgaga

SEQ ID NO: 5862149 - DNA, 22 bp, Homo sapiens
cataatgtgagatggttcccaa

SEQ ID NO: 5862150 - DNA, 13 bp, Homo sapiens
cataatgttaagc

SEQ ID NO: 5862151 - DNA, 17 bp, Homo sapiens
cataatgttacattatt

SEQ ID NO: 5862152 - DNA, 18 bp, Homo sapiens
cataatgttacattatta

SEQ ID NO: 5862153 - DNA, 23 bp, Homo sapiens
cataatgtttctggatttcatac

SEQ ID NO: 5862154 - DNA, 20 bp, Homo sapiens
cataatgtttttcctttctt

SEQ ID NO: 5862155 - DNA, 15 bp, Homo sapiens
cataattaaagtgtc

SEQ ID NO: 5862156 - DNA, 16 bp, Homo sapiens
cataattaaagtgtcc

SEQ ID NO: 5862157 - DNA, 21 bp, Homo sapiens
cataattacattcctaactag

SEQ ID NO: 5862158 - DNA, 15 bp, Homo sapiens
cataattagaacaat

SEQ ID NO: 5862159 - DNA, 19 bp, Homo sapiens
cataattagatccattaat

SEQ ID NO: 5862160 - DNA, 21 bp, Homo sapiens
cataattatgaaaactcatga

SEQ ID NO: 5862161 - DNA, 16 bp, Homo sapiens
cataattatgggaaca

SEQ ID NO: 5862162 - DNA, 22 bp, Homo sapiens
cataattatgggaacaagtgta

SEQ ID NO: 5862163 - DNA, 23 bp, Homo sapiens
cataattcacacattaataaaca

SEQ ID NO: 5862164 - DNA, 23 bp, Homo sapiens
cataattcactctgagtgtttta

SEQ ID NO: 5862165 - DNA, 21 bp, Homo sapiens
cataattcattaaaaacattt

SEQ ID NO: 5862166 - DNA, 22 bp, Homo sapiens
cataattcattaaaaacatttt

SEQ ID NO: 5862167 - DNA, 12 bp, Homo sapiens
cataattcattt

SEQ ID NO: 5862168 - DNA, 17 bp, Homo sapiens
cataattcatttaagaa

SEQ ID NO: 5862169 - DNA, 11 bp, Homo sapiens
cataattccta

SEQ ID NO: 5862170 - DNA, 18 bp, Homo sapiens
cataattcctacagcact

SEQ ID NO: 5862171 - DNA, 21 bp, Homo sapiens
cataattctaagttatttact

SEQ ID NO: 5862172 - DNA, 22 bp, Homo sapiens
cataattctaagttatttactt

SEQ ID NO: 5862173 - DNA, 13 bp, Homo sapiens
cataattctgaaa

SEQ ID NO: 5862174 - DNA, 14 bp, Homo sapiens
cataattctgaaac

SEQ ID NO: 5862175 - DNA, 17 bp, Homo sapiens
cataattcttgtatatt

SEQ ID NO: 5862176 - DNA, 12 bp, Homo sapiens
cataattctttt

SEQ ID NO: 5862177 - DNA, 18 bp, Homo sapiens
cataattgcattgacttt

SEQ ID NO: 5862178 - DNA, 19 bp, Homo sapiens
cataattgcctacatttat

SEQ ID NO: 5862179 - DNA, 12 bp, Homo sapiens
cataattggaat

SEQ ID NO: 5862180 - DNA, 15 bp, Homo sapiens
cataattgtcaaaaa

SEQ ID NO: 5862181 - DNA, 21 bp, Homo sapiens
cataattgtgattagacagaa

SEQ ID NO: 5862182 - DNA, 21 bp, Homo sapiens
cataattgttgtggtttaaat

SEQ ID NO: 5862183 - DNA, 14 bp, Homo sapiens
cataatttaaaata

SEQ ID NO: 5862184 - DNA, 18 bp, Homo sapiens
cataatttagttgtttct

SEQ ID NO: 5862185 - DNA, 22 bp, Homo sapiens
cataatttagtttcatataaag

SEQ ID NO: 5862186 - DNA, 22 bp, Homo sapiens
cataatttccatgatacaaaga

SEQ ID NO: 5862187 - DNA, 16 bp, Homo sapiens
cataatttctgtttca

SEQ ID NO: 5862188 - DNA, 17 bp, Homo sapiens
cataatttctgtttcag

SEQ ID NO: 5862189 - DNA, 17 bp, Homo sapiens
cataatttggggccctg

SEQ ID NO: 5862190 - DNA, 21 bp, Homo sapiens
cataatttgtcttagttgata

SEQ ID NO: 5862191 - DNA, 15 bp, Homo sapiens
cataatttgtttaaa

SEQ ID NO: 5862192 - DNA, 22 bp, Homo sapiens
cataatttgtttaaaattctct

SEQ ID NO: 5862193 - DNA, 23 bp, Homo sapiens
cataatttgtttaaaattctctt

SEQ ID NO: 5862194 - DNA, 18 bp, Homo sapiens
cataatttgtttccagca

SEQ ID NO: 5862195 - DNA, 14 bp, Homo sapiens
cataattttatcta

SEQ ID NO: 5862196 - DNA, 18 bp, Homo sapiens
cataattttcaaaagaaa

SEQ ID NO: 5862197 - DNA, 14 bp, Homo sapiens
cataattttcttca

SEQ ID NO: 5862198 - DNA, 20 bp, Homo sapiens
cataattttcttcatgcaat

SEQ ID NO: 5862199 - DNA, 18 bp, Homo sapiens
cataattttgtgttgtac

SEQ ID NO: 5862200 - DNA, 13 bp, Homo sapiens
cataatttttgta

SEQ ID NO: 5862201 - DNA, 20 bp, Homo sapiens
cataatttttgtacatccca

SEQ ID NO: 5862202 - DNA, 19 bp, Homo sapiens
cataattttttttaaagaa

SEQ ID NO: 5862203 - DNA, 21 bp, Homo sapiens
cataattttttttaaagaaga

SEQ ID NO: 5862204 - DNA, 19 bp, Homo sapiens
cataattttttttttctca

SEQ ID NO: 5862205 - DNA, 22 bp, Homo sapiens
catacaaaaaaaatctttaatg

SEQ ID NO: 5862206 - DNA, 13 bp, Homo sapiens
catacaaaataaa

SEQ ID NO: 5862207 - DNA, 18 bp, Homo sapiens
catacaaaataaaactgt

SEQ ID NO: 5862208 - DNA, 17 bp, Homo sapiens
catacaaaataaatggt

SEQ ID NO: 5862209 - DNA, 18 bp, Homo sapiens
catacaaagcgtgcacaa

SEQ ID NO: 5862210 - DNA, 18 bp, Homo sapiens
catacaaatatatgtata

SEQ ID NO: 5862211 - DNA, 16 bp, Homo sapiens
catacaacagaaacca

SEQ ID NO: 5862212 - DNA, 17 bp, Homo sapiens
catacaacagaaaccag

SEQ ID NO: 5862213 - DNA, 13 bp, Homo sapiens
catacaacatata

SEQ ID NO: 5862214 - DNA, 19 bp, Homo sapiens
catacaagtttataaagag

SEQ ID NO: 5862215 - DNA, 14 bp, Homo sapiens
catacaataaaaga

SEQ ID NO: 5862216 - DNA, 17 bp, Homo sapiens
catacaataaaagagct

SEQ ID NO: 5862217 - DNA, 19 bp, Homo sapiens
catacaataaaagagcttt

SEQ ID NO: 5862218 - DNA, 16 bp, Homo sapiens
catacaatgaccacat

SEQ ID NO: 5862219 - DNA, 11 bp, Homo sapiens
catacaatgta

SEQ ID NO: 5862220 - DNA, 15 bp, Homo sapiens
catacaatgtatgta

SEQ ID NO: 5862221 - DNA, 15 bp, Homo sapiens
catacaattccaaac

SEQ ID NO: 5862222 - DNA, 16 bp, Homo sapiens
catacaatttactttt

SEQ ID NO: 5862223 - DNA, 14 bp, Homo sapiens
catacaatttgcac

SEQ ID NO: 5862224 - DNA, 21 bp, Homo sapiens
catacacaaggccagaaaaag

SEQ ID NO: 5862225 - DNA, 23 bp, Homo sapiens
catacacaaggccagaaaaagaa

SEQ ID NO: 5862226 - DNA, 14 bp, Homo sapiens
catacacacacaaa

SEQ ID NO: 5862227 - DNA, 12 bp, Homo sapiens
catacacacacg

SEQ ID NO: 5862228 - DNA, 14 bp, Homo sapiens
catacacatacata

SEQ ID NO: 5862229 - DNA, 15 bp, Homo sapiens
catacaccaaacatt

SEQ ID NO: 5862230 - DNA, 17 bp, Homo sapiens
catacaccaaacatttc

SEQ ID NO: 5862231 - DNA, 18 bp, Homo sapiens
catacaccaaacatttct

SEQ ID NO: 5862232 - DNA, 18 bp, Homo sapiens
catacaccagcattcctt

SEQ ID NO: 5862233 - DNA, 22 bp, Homo sapiens
catacactgtagtttttgaaaa

SEQ ID NO: 5862234 - DNA, 21 bp, Homo sapiens
catacagaaagaagcagttct

SEQ ID NO: 5862235 - DNA, 13 bp, Homo sapiens
catacagacacat

SEQ ID NO: 5862236 - DNA, 12 bp, Homo sapiens
catacagagaag

SEQ ID NO: 5862237 - DNA, 22 bp, Homo sapiens
catacagagaagtcacagggca

SEQ ID NO: 5862238 - DNA, 18 bp, Homo sapiens
catacagagattgtagta

SEQ ID NO: 5862239 - DNA, 18 bp, Homo sapiens
catacagaggatgccttt

SEQ ID NO: 5862240 - DNA, 22 bp, Homo sapiens
catacagaggatgccttttctg

SEQ ID NO: 5862241 - DNA, 16 bp, Homo sapiens
catacagaggtaacta

SEQ ID NO: 5862242 - DNA, 19 bp, Homo sapiens
catacagagtgtcctgatt

SEQ ID NO: 5862243 - DNA, 12 bp, Homo sapiens
catacagcacta

SEQ ID NO: 5862244 - DNA, 17 bp, Homo sapiens
cataggcccacacacag

SEQ ID NO: 5862245 - DNA, 16 bp, Homo sapiens
cataggcccagccagg

SEQ ID NO: 5862246 - DNA, 16 bp, Homo sapiens
cataggcctgctttgt

SEQ ID NO: 5862247 - DNA, 14 bp, Homo sapiens
cataggcctgggtg

SEQ ID NO: 5862248 - DNA, 15 bp, Homo sapiens
cataggcctgggtgc

SEQ ID NO: 5862249 - DNA, 18 bp, Homo sapiens
cataggcggtcatgtgtg

SEQ ID NO: 5862250 - DNA, 19 bp, Homo sapiens
cataggcggtcatgtgtgc

SEQ ID NO: 5862251 - DNA, 18 bp, Homo sapiens
cataggctccttcctgtg

SEQ ID NO: 5862252 - DNA, 13 bp, Homo sapiens
cataggctgccca

SEQ ID NO: 5862253 - DNA, 13 bp, Homo sapiens
cataggctgggga

SEQ ID NO: 5862254 - DNA, 20 bp, Homo sapiens
cataggctggtggccttggg

SEQ ID NO: 5862255 - DNA, 21 bp, Homo sapiens
cataggctggtggccttgggc

SEQ ID NO: 5862256 - DNA, 22 bp, Homo sapiens
cataggcttcaattggtggaat

SEQ ID NO: 5862257 - DNA, 20 bp, Homo sapiens
catagggacctttaaaaagc

SEQ ID NO: 5862258 - DNA, 16 bp, Homo sapiens
catagggctgataata

SEQ ID NO: 5862259 - DNA, 12 bp, Homo sapiens
catagggctggg

SEQ ID NO: 5862260 - DNA, 13 bp, Homo sapiens
cataggggcaggt

SEQ ID NO: 5862261 - DNA, 13 bp, Homo sapiens
cataggggggagg

SEQ ID NO: 5862262 - DNA, 15 bp, Homo sapiens
cataggggggagggt

SEQ ID NO: 5862263 - DNA, 18 bp, Homo sapiens
catagggtcactttgcca

SEQ ID NO: 5862264 - DNA, 21 bp, Homo sapiens
catagggtcactttgccatta

SEQ ID NO: 5862265 - DNA, 23 bp, Homo sapiens
catagggtcggaggtgctgtccc

SEQ ID NO: 5862266 - DNA, 15 bp, Homo sapiens
catagggtctcttca

SEQ ID NO: 5862267 - DNA, 20 bp, Homo sapiens
catagggtctgcagcctgct

SEQ ID NO: 5862268 - DNA, 16 bp, Homo sapiens
catagggtttggaaga

SEQ ID NO: 5862269 - DNA, 20 bp, Homo sapiens
catagggtttggaagaaagg

SEQ ID NO: 5862270 - DNA, 16 bp, Homo sapiens
cataggtatgcttact

SEQ ID NO: 5862271 - DNA, 17 bp, Homo sapiens
cataggtcactggctct

SEQ ID NO: 5862272 - DNA, 23 bp, Homo sapiens
cataggtgatccatgtaactgcc

SEQ ID NO: 5862273 - DNA, 23 bp, Homo sapiens
cataggttaaaaaaaaaagtcac

SEQ ID NO: 5862274 - DNA, 16 bp, Homo sapiens
cataggttactaccta

SEQ ID NO: 5862275 - DNA, 14 bp, Homo sapiens
cataggtttctctc

SEQ ID NO: 5862276 - DNA, 15 bp, Homo sapiens
cataggttttgattt

SEQ ID NO: 5862277 - DNA, 20 bp, Homo sapiens
catagtaaactacggtacca

SEQ ID NO: 5862278 - DNA, 15 bp, Homo sapiens
catagtaaatgtagt

SEQ ID NO: 5862279 - DNA, 19 bp, Homo sapiens
catagtaaatgtagttcat

SEQ ID NO: 5862280 - DNA, 15 bp, Homo sapiens
catagtaactgacat

SEQ ID NO: 5862281 - DNA, 20 bp, Homo sapiens
catagtaactgacatgatta

SEQ ID NO: 5862282 - DNA, 21 bp, Homo sapiens
catagtaacttcttatggaat

SEQ ID NO: 5862283 - DNA, 23 bp, Homo sapiens
catagtaacttcttatggaattg

SEQ ID NO: 5862284 - DNA, 15 bp, Homo sapiens
catagtaagtacaga

SEQ ID NO: 5862285 - DNA, 20 bp, Homo sapiens
catagtaataagatggctgt

SEQ ID NO: 5862286 - DNA, 23 bp, Homo sapiens
catagtaattagtagaaatgcca

SEQ ID NO: 5862287 - DNA, 19 bp, Homo sapiens
catagtaccatttatacaa

SEQ ID NO: 5862288 - DNA, 20 bp, Homo sapiens
catagtaccatttatacaaa

SEQ ID NO: 5862289 - DNA, 21 bp, Homo sapiens
catagtaggcactaaatacat

SEQ ID NO: 5862290 - DNA, 23 bp, Homo sapiens
catagtatattaaaaatggtaaa

SEQ ID NO: 5862291 - DNA, 15 bp, Homo sapiens
catagtatggtggct

SEQ ID NO: 5862292 - DNA, 18 bp, Homo sapiens
catagtatggtggctggg

SEQ ID NO: 5862293 - DNA, 21 bp, Homo sapiens
catagtattccattgtgtgag

SEQ ID NO: 5862294 - DNA, 22 bp, Homo sapiens
catagtcacctgactaagaaat

SEQ ID NO: 5862295 - DNA, 21 bp, Homo sapiens
catagtcagcagcagctctga

SEQ ID NO: 5862296 - DNA, 23 bp, Homo sapiens
catagtcatgtaagctgaaaata

SEQ ID NO: 5862297 - DNA, 14 bp, Homo sapiens
catagtcattctgc

SEQ ID NO: 5862298 - DNA, 20 bp, Homo sapiens
catagtcccaccttggagca

SEQ ID NO: 5862299 - DNA, 12 bp, Homo sapiens
catagtccctgc

SEQ ID NO: 5862300 - DNA, 21 bp, Homo sapiens
catagtcctgttactatggta

SEQ ID NO: 5862301 - DNA, 21 bp, Homo sapiens
catagtcgggatgtcagcaga

SEQ ID NO: 5862302 - DNA, 11 bp, Homo sapiens
catagtcttga

SEQ ID NO: 5862303 - DNA, 18 bp, Homo sapiens
catagtcttgaaatgaaa

SEQ ID NO: 5862304 - DNA, 18 bp, Homo sapiens
catagtctttgtttacat

SEQ ID NO: 5862305 - DNA, 23 bp, Homo sapiens
catagtgaaataaattctgattc

SEQ ID NO: 5862306 - DNA, 22 bp, Homo sapiens
catagtgaacacagcagaccta

SEQ ID NO: 5862307 - DNA, 20 bp, Homo sapiens
catagtgacttttcaagtat

SEQ ID NO: 5862308 - DNA, 15 bp, Homo sapiens
catagtgagaaccca

SEQ ID NO: 5862309 - DNA, 20 bp, Homo sapiens
catagtgagacactgtctct

SEQ ID NO: 5862310 - DNA, 19 bp, Homo sapiens
catagtgatggttcccctg

SEQ ID NO: 5862311 - DNA, 23 bp, Homo sapiens
catagtgctaagaaagcaagcca

SEQ ID NO: 5862312 - DNA, 22 bp, Homo sapiens
catagtgctacctgcacctctg

SEQ ID NO: 5862313 - DNA, 17 bp, Homo sapiens
catagtggatggacaga

SEQ ID NO: 5862314 - DNA, 19 bp, Homo sapiens
catagtggcttaactggac

SEQ ID NO: 5862315 - DNA, 17 bp, Homo sapiens
catagtgggccttcatt

SEQ ID NO: 5862316 - DNA, 18 bp, Homo sapiens
catagtggtattttaaca

SEQ ID NO: 5862317 - DNA, 20 bp, Homo sapiens
catagtggtattttaacata

SEQ ID NO: 5862318 - DNA, 19 bp, Homo sapiens
catagtggtgggcacctat

SEQ ID NO: 5862319 - DNA, 21 bp, Homo sapiens
catagtgtcctgcccacccta

SEQ ID NO: 5862320 - DNA, 19 bp, Homo sapiens
catagtgtgctcggacaca

SEQ ID NO: 5862321 - DNA, 23 bp, Homo sapiens
catagttattaatgtgatcctaa

SEQ ID NO: 5862322 - DNA, 19 bp, Homo sapiens
catagttatttacttgaaa

SEQ ID NO: 5862323 - DNA, 19 bp, Homo sapiens
catagttcgtttaccttca

SEQ ID NO: 5862324 - DNA, 21 bp, Homo sapiens
catagttctgagctgccagtg

SEQ ID NO: 5862325 - DNA, 13 bp, Homo sapiens
catagttctgcaa

SEQ ID NO: 5862326 - DNA, 21 bp, Homo sapiens
catagttgaaaaaagaagttt

SEQ ID NO: 5862327 - DNA, 17 bp, Homo sapiens
catagttggaaatattt

SEQ ID NO: 5862328 - DNA, 23 bp, Homo sapiens
catagtttaagttgattaaaaat

SEQ ID NO: 5862329 - DNA, 10 bp, Homo sapiens
catagtttat

SEQ ID NO: 5862330 - DNA, 13 bp, Homo sapiens
catagtttctgta

SEQ ID NO: 5862331 - DNA, 12 bp, Homo sapiens
catagtttcttt

SEQ ID NO: 5862332 - DNA, 16 bp, Homo sapiens
catagtttctttattt

SEQ ID NO: 5862333 - DNA, 17 bp, Homo sapiens
catagtttctttatttt

SEQ ID NO: 5862334 - DNA, 14 bp, Homo sapiens
catagtttggcatt

SEQ ID NO: 5862335 - DNA, 16 bp, Homo sapiens
catagttttatttata

SEQ ID NO: 5862336 - DNA, 13 bp, Homo sapiens
catagttttctaa

SEQ ID NO: 5862337 - DNA, 14 bp, Homo sapiens
catagttttctaaa

SEQ ID NO: 5862338 - DNA, 16 bp, Homo sapiens
catagtttttcagtct

SEQ ID NO: 5862339 - DNA, 22 bp, Homo sapiens
catagtttttcatcaagagttt

SEQ ID NO: 5862340 - DNA, 13 bp, Homo sapiens
catataaaaacaa

SEQ ID NO: 5862341 - DNA, 22 bp, Homo sapiens
catataaaaacaatatatttgt

SEQ ID NO: 5862342 - DNA, 20 bp, Homo sapiens
catataaaagttgcgtttaa

SEQ ID NO: 5862343 - DNA, 22 bp, Homo sapiens
catataaaagttgcgtttaagt

SEQ ID NO: 5862344 - DNA, 22 bp, Homo sapiens
catataaaataatgcaaagaat

SEQ ID NO: 5862345 - DNA, 23 bp, Homo sapiens
catataaaataatgcaaagaatc

SEQ ID NO: 5862346 - DNA, 24 bp, Homo sapiens
catataaaatgctgatatttactg

SEQ ID NO: 5862347 - DNA, 17 bp, Homo sapiens
catataaaatggcaaca

SEQ ID NO: 5862348 - DNA, 16 bp, Homo sapiens
catataaacacagtaa

SEQ ID NO: 5862349 - DNA, 20 bp, Homo sapiens
catataaacacagtaagata

SEQ ID NO: 5862350 - DNA, 15 bp, Homo sapiens
catataaacatttta

SEQ ID NO: 5862351 - DNA, 19 bp, Homo sapiens
catataaactttttaaaga

SEQ ID NO: 5862352 - DNA, 17 bp, Homo sapiens
catataaagattaacac

SEQ ID NO: 5862353 - DNA, 17 bp, Homo sapiens
catataaaggttatgaa

SEQ ID NO: 5862354 - DNA, 20 bp, Homo sapiens
catataaaggttatgaaaca

SEQ ID NO: 5862355 - DNA, 13 bp, Homo sapiens
catataaatagaa

SEQ ID NO: 5862356 - DNA, 15 bp, Homo sapiens
catataaatatattt

SEQ ID NO: 5862357 - DNA, 14 bp, Homo sapiens
catataaatggaat

SEQ ID NO: 5862358 - DNA, 12 bp, Homo sapiens
catataaatgtt

SEQ ID NO: 5862359 - DNA, 15 bp, Homo sapiens
catataaatgtttat

SEQ ID NO: 5862360 - DNA, 16 bp, Homo sapiens
catataaatgtttata

SEQ ID NO: 5862361 - DNA, 22 bp, Homo sapiens
catataaatgtttatattgttt

SEQ ID NO: 5862362 - DNA, 18 bp, Homo sapiens
catataaattaatacata

SEQ ID NO: 5862363 - DNA, 14 bp, Homo sapiens
catataaccaaaat

SEQ ID NO: 5862364 - DNA, 17 bp, Homo sapiens
catataaccaaaatcca

SEQ ID NO: 5862365 - DNA, 21 bp, Homo sapiens
catataagttgagaaggtgcc

SEQ ID NO: 5862366 - DNA, 21 bp, Homo sapiens
catataagtttgaaggaaaca

SEQ ID NO: 5862367 - DNA, 24 bp, Homo sapiens
catataagtttgaaggaaacagtt

SEQ ID NO: 5862368 - DNA, 22 bp, Homo sapiens
catataataaattaatttttca

SEQ ID NO: 5862369 - DNA, 23 bp, Homo sapiens
catataataaattaatttttcaa

SEQ ID NO: 5862370 - DNA, 16 bp, Homo sapiens
catataatatatgttt

SEQ ID NO: 5862371 - DNA, 14 bp, Homo sapiens
catataatgcaaca

SEQ ID NO: 5862372 - DNA, 15 bp, Homo sapiens
catataatgttgtta

SEQ ID NO: 5862373 - DNA, 15 bp, Homo sapiens
catataattatatgt

SEQ ID NO: 5862374 - DNA, 14 bp, Homo sapiens
catataatttaaag

SEQ ID NO: 5862375 - DNA, 21 bp, Homo sapiens
catataatttaaagaaacact

SEQ ID NO: 5862376 - DNA, 15 bp, Homo sapiens
catatacaaataaac

SEQ ID NO: 5862377 - DNA, 23 bp, Homo sapiens
catatacaacaccaaaaaatatc

SEQ ID NO: 5862378 - DNA, 14 bp, Homo sapiens
catatacaataatg

SEQ ID NO: 5862379 - DNA, 17 bp, Homo sapiens
catatacacctggaaca

SEQ ID NO: 5862380 - DNA, 12 bp, Homo sapiens
catatacacttg

SEQ ID NO: 5862381 - DNA, 15 bp, Homo sapiens
catatacatatatat

SEQ ID NO: 5862382 - DNA, 18 bp, Homo sapiens
catatacatatatatata

SEQ ID NO: 5862383 - DNA, 15 bp, Homo sapiens
catatacattagttt

SEQ ID NO: 5862384 - DNA, 19 bp, Homo sapiens
catatacattatttctgta

SEQ ID NO: 5862385 - DNA, 20 bp, Homo sapiens
catatacattttgttgcagg

SEQ ID NO: 5862386 - DNA, 15 bp, Homo sapiens
catatacctataatg

SEQ ID NO: 5862387 - DNA, 21 bp, Homo sapiens
catatacctataatgtgtgta

SEQ ID NO: 5862388 - DNA, 20 bp, Homo sapiens
catatactgattctgtgtat

SEQ ID NO: 5862389 - DNA, 23 bp, Homo sapiens
catatactgattctgtgtatctt

SEQ ID NO: 5862390 - DNA, 13 bp, Homo sapiens
catatagaaaaca

SEQ ID NO: 5862391 - DNA, 19 bp, Homo sapiens
catatagaaaacaaaggag

SEQ ID NO: 5862392 - DNA, 15 bp, Homo sapiens
catatagaaagcttt

SEQ ID NO: 5862393 - DNA, 14 bp, Homo sapiens
catatagaaaggct

SEQ ID NO: 5862394 - DNA, 16 bp, Homo sapiens
catatagaatatatta

SEQ ID NO: 5862395 - DNA, 13 bp, Homo sapiens
catatagacacac

SEQ ID NO: 5862396 - DNA, 15 bp, Homo sapiens
catatagacacacat

SEQ ID NO: 5862397 - DNA, 20 bp, Homo sapiens
catatagaccaattgaagca

SEQ ID NO: 5862398 - DNA, 21 bp, Homo sapiens
catatagatagataatgttct

SEQ ID NO: 5862399 - DNA, 20 bp, Homo sapiens
catatagatttagttttgta

SEQ ID NO: 5862400 - DNA, 20 bp, Homo sapiens
catatagcattgataatctt

SEQ ID NO: 5862401 - DNA, 19 bp, Homo sapiens
catatagccattgatcata

SEQ ID NO: 5862402 - DNA, 21 bp, Homo sapiens
catatagccctttccccactc

SEQ ID NO: 5862403 - DNA, 15 bp, Homo sapiens
catatagctttgcaa

SEQ ID NO: 5862404 - DNA, 21 bp, Homo sapiens
catataggaaaacaataattt

SEQ ID NO: 5862405 - DNA, 15 bp, Homo sapiens
catatagtcaatgta

SEQ ID NO: 5862406 - DNA, 18 bp, Homo sapiens
catatagtcaatgtaaaa

SEQ ID NO: 5862407 - DNA, 14 bp, Homo sapiens
catatagtctattc

SEQ ID NO: 5862408 - DNA, 19 bp, Homo sapiens
catatagttaaactgagag

SEQ ID NO: 5862409 - DNA, 12 bp, Homo sapiens
catatagtttgt

SEQ ID NO: 5862410 - DNA, 16 bp, Homo sapiens
catatagtttgttttc

SEQ ID NO: 5862411 - DNA, 23 bp, Homo sapiens
catatagtttgttttctttttct

SEQ ID NO: 5862412 - DNA, 17 bp, Homo sapiens
catatataaaacaaaac

SEQ ID NO: 5862413 - DNA, 19 bp, Homo sapiens
catatataaattattactt

SEQ ID NO: 5862414 - DNA, 19 bp, Homo sapiens
catatataacagatacatt

SEQ ID NO: 5862415 - DNA, 22 bp, Homo sapiens
catatataactattttaaatat

SEQ ID NO: 5862416 - DNA, 22 bp, Homo sapiens
catatatacacacacaaagaga

SEQ ID NO: 5862417 - DNA, 12 bp, Homo sapiens
catatatacata

SEQ ID NO: 5862418 - DNA, 21 bp, Homo sapiens
catatatagacagctttgact

SEQ ID NO: 5862419 - DNA, 14 bp, Homo sapiens
catatatatataca

SEQ ID NO: 5862420 - DNA, 19 bp, Homo sapiens
catattttcctttatgtga

SEQ ID NO: 5862421 - DNA, 23 bp, Homo sapiens
catattttcctttatgtgatgta

SEQ ID NO: 5862422 - DNA, 15 bp, Homo sapiens
catattttctccgaa

SEQ ID NO: 5862423 - DNA, 12 bp, Homo sapiens
catattttctgt

SEQ ID NO: 5862424 - DNA, 20 bp, Homo sapiens
catattttcttacttttatt

SEQ ID NO: 5862425 - DNA, 20 bp, Homo sapiens
catattttgccactgccttt

SEQ ID NO: 5862426 - DNA, 13 bp, Homo sapiens
catattttgctgg

SEQ ID NO: 5862427 - DNA, 14 bp, Homo sapiens
catattttgtaact

SEQ ID NO: 5862428 - DNA, 20 bp, Homo sapiens
catattttgttatagttcat

SEQ ID NO: 5862429 - DNA, 11 bp, Homo sapiens
catatttttaa

SEQ ID NO: 5862430 - DNA, 17 bp, Homo sapiens
catatttttatacttta

SEQ ID NO: 5862431 - DNA, 16 bp, Homo sapiens
catatttttccttata

SEQ ID NO: 5862432 - DNA, 18 bp, Homo sapiens
catatttttctaaagaaa

SEQ ID NO: 5862433 - DNA, 19 bp, Homo sapiens
catattttttatatctgga

SEQ ID NO: 5862434 - DNA, 21 bp, Homo sapiens
catattttttatgatggagca

SEQ ID NO: 5862435 - DNA, 22 bp, Homo sapiens
catattttttgtatatttgttt

SEQ ID NO: 5862436 - DNA, 18 bp, Homo sapiens
catatttttttccttaca

SEQ ID NO: 5862437 - DNA, 22 bp, Homo sapiens
catatttttttccttacataaa

SEQ ID NO: 5862438 - DNA, 17 bp, Homo sapiens
catatttttttctgtaa

SEQ ID NO: 5862439 - DNA, 21 bp, Homo sapiens
catcaaaaacatcactccctc

SEQ ID NO: 5862440 - DNA, 22 bp, Homo sapiens
catcaaaaagagtcttaatttt

SEQ ID NO: 5862441 - DNA, 18 bp, Homo sapiens
catcaaaatacaacttca

SEQ ID NO: 5862442 - DNA, 13 bp, Homo sapiens
catcaaaatgctt

SEQ ID NO: 5862443 - DNA, 19 bp, Homo sapiens
catcaaacaaatcattttg

SEQ ID NO: 5862444 - DNA, 21 bp, Homo sapiens
catcaaacaaatcattttgat

SEQ ID NO: 5862445 - DNA, 17 bp, Homo sapiens
catcaaacatgaaaaca

SEQ ID NO: 5862446 - DNA, 22 bp, Homo sapiens
catcaaacatgaaaacattgat

SEQ ID NO: 5862447 - DNA, 12 bp, Homo sapiens
catcaaacattt

SEQ ID NO: 5862448 - DNA, 19 bp, Homo sapiens
catcaaacctactataaaa

SEQ ID NO: 5862449 - DNA, 17 bp, Homo sapiens
catcaaactcttagtta

SEQ ID NO: 5862450 - DNA, 15 bp, Homo sapiens
catcaaagcctggcc

SEQ ID NO: 5862451 - DNA, 17 bp, Homo sapiens
catcaaaggaatataag

SEQ ID NO: 5862452 - DNA, 21 bp, Homo sapiens
catcaaaggaatataagaaaa

SEQ ID NO: 5862453 - DNA, 20 bp, Homo sapiens
catcaaagtggtaaatactg

SEQ ID NO: 5862454 - DNA, 23 bp, Homo sapiens
catcaaagtggtaaatactgtga

SEQ ID NO: 5862455 - DNA, 14 bp, Homo sapiens
catcaaagtgttta

SEQ ID NO: 5862456 - DNA, 17 bp, Homo sapiens
catcaaataaaccttgt

SEQ ID NO: 5862457 - DNA, 21 bp, Homo sapiens
catcaaataaaccttgtttct

SEQ ID NO: 5862458 - DNA, 18 bp, Homo sapiens
catcaaataaatttctgg

SEQ ID NO: 5862459 - DNA, 14 bp, Homo sapiens
catcaaatgcatgc

SEQ ID NO: 5862460 - DNA, 18 bp, Homo sapiens
catcaaatttgccaccac

SEQ ID NO: 5862461 - DNA, 13 bp, Homo sapiens
catcaacaaaaat

SEQ ID NO: 5862462 - DNA, 14 bp, Homo sapiens
catcaacattcttg

SEQ ID NO: 5862463 - DNA, 22 bp, Homo sapiens
catcaaccccccgactgtgctg

SEQ ID NO: 5862464 - DNA, 17 bp, Homo sapiens
catcaacctaggagcag

SEQ ID NO: 5862465 - DNA, 23 bp, Homo sapiens
catcaacctattaaaatacattt

SEQ ID NO: 5862466 - DNA, 19 bp, Homo sapiens
catcaactaaagttgtact

SEQ ID NO: 5862467 - DNA, 22 bp, Homo sapiens
catcaactcccaacttcttcct

SEQ ID NO: 5862468 - DNA, 16 bp, Homo sapiens
catcaagaaaacagca

SEQ ID NO: 5862469 - DNA, 13 bp, Homo sapiens
catcaagaagggc

SEQ ID NO: 5862470 - DNA, 21 bp, Homo sapiens
catcaagaagggctgcatgat

SEQ ID NO: 5862471 - DNA, 19 bp, Homo sapiens
catcaagaaggtagcttga

SEQ ID NO: 5862472 - DNA, 14 bp, Homo sapiens
catcaagaatgagg

SEQ ID NO: 5862473 - DNA, 22 bp, Homo sapiens
catcaagaatggggatcacaga

SEQ ID NO: 5862474 - DNA, 17 bp, Homo sapiens
catcaagactatctaca

SEQ ID NO: 5862475 - DNA, 21 bp, Homo sapiens
catcaagaggtgggagggccc

SEQ ID NO: 5862476 - DNA, 20 bp, Homo sapiens
catcaagagtttattattgt

SEQ ID NO: 5862477 - DNA, 20 bp, Homo sapiens
catcaagattaattaaaatt

SEQ ID NO: 5862478 - DNA, 16 bp, Homo sapiens
catcaagcatcattgt

SEQ ID NO: 5862479 - DNA, 15 bp, Homo sapiens
catcaagcatgcaat

SEQ ID NO: 5862480 - DNA, 23 bp, Homo sapiens
catcaagcatgcaataatgtgca

SEQ ID NO: 5862481 - DNA, 12 bp, Homo sapiens
catcaagccact

SEQ ID NO: 5862482 - DNA, 14 bp, Homo sapiens
catcaagcttttct

SEQ ID NO: 5862483 - DNA, 18 bp, Homo sapiens
catcaaggcactgcctga

SEQ ID NO: 5862484 - DNA, 16 bp, Homo sapiens
catcaaggggtcactt

SEQ ID NO: 5862485 - DNA, 18 bp, Homo sapiens
catcaagggtcatggcag

SEQ ID NO: 5862486 - DNA, 20 bp, Homo sapiens
catcaagggtcatggcagtg

SEQ ID NO: 5862487 - DNA, 14 bp, Homo sapiens
catcaagtgccaga

SEQ ID NO: 5862488 - DNA, 12 bp, Homo sapiens
catcaagtgtaa

SEQ ID NO: 5862489 - DNA, 21 bp, Homo sapiens
catcaagtgtaattagctttt

SEQ ID NO: 5862490 - DNA, 22 bp, Homo sapiens
catcaagttattgacaaactct

SEQ ID NO: 5862491 - DNA, 13 bp, Homo sapiens
catcaagttctcc

SEQ ID NO: 5862492 - DNA, 14 bp, Homo sapiens
catcaataaatgct

SEQ ID NO: 5862493 - DNA, 18 bp, Homo sapiens
catcaatacctgctgaga

SEQ ID NO: 5862494 - DNA, 19 bp, Homo sapiens
catcaatatccctcttgta

SEQ ID NO: 5862495 - DNA, 16 bp, Homo sapiens
catcaatatgtatata

SEQ ID NO: 5862496 - DNA, 16 bp, Homo sapiens
catcaatcaaatattt

SEQ ID NO: 5862497 - DNA, 14 bp, Homo sapiens
catcaatcctgatt

SEQ ID NO: 5862498 - DNA, 14 bp, Homo sapiens
catcaatcttgtta

SEQ ID NO: 5862499 - DNA, 18 bp, Homo sapiens
catcaatgaatgaatgaa

SEQ ID NO: 5862500 - DNA, 17 bp, Homo sapiens
catcaatgataatgcta

SEQ ID NO: 5862501 - DNA, 22 bp, Homo sapiens
catcaatggggccagtcaggcc

SEQ ID NO: 5862502 - DNA, 15 bp, Homo sapiens
catcaatgtgacatt

SEQ ID NO: 5862503 - DNA, 14 bp, Homo sapiens
catcaatgttcatt

SEQ ID NO: 5862504 - DNA, 15 bp, Homo sapiens
catcaatgttcattg

SEQ ID NO: 5862505 - DNA, 16 bp, Homo sapiens
catcaatgttcattgt

SEQ ID NO: 5862506 - DNA, 16 bp, Homo sapiens
catcaattatagaaag

SEQ ID NO: 5862507 - DNA, 17 bp, Homo sapiens
catcaattttgtctatt

SEQ ID NO: 5862508 - DNA, 16 bp, Homo sapiens
catcacaatattcagt

SEQ ID NO: 5862509 - DNA, 21 bp, Homo sapiens
catcacaattagggaatggtt

SEQ ID NO: 5862510 - DNA, 15 bp, Homo sapiens
catcacacacatgga

SEQ ID NO: 5862511 - DNA, 14 bp, Homo sapiens
catcacacagtggc

SEQ ID NO: 5862512 - DNA, 17 bp, Homo sapiens
catcacacccatttaaa

SEQ ID NO: 5862513 - DNA, 19 bp, Homo sapiens
catcacacccttttaacat

SEQ ID NO: 5862514 - DNA, 17 bp, Homo sapiens
catcacacctgccctaa

SEQ ID NO: 5862515 - DNA, 19 bp, Homo sapiens
catcacacttatattttat

SEQ ID NO: 5862516 - DNA, 17 bp, Homo sapiens
catcacacttcattgta

SEQ ID NO: 5862517 - DNA, 19 bp, Homo sapiens
catcacagaccccagctgg

SEQ ID NO: 5862518 - DNA, 20 bp, Homo sapiens
catcacagaccccagctggg

SEQ ID NO: 5862519 - DNA, 21 bp, Homo sapiens
catcacagatcgcatttccta

SEQ ID NO: 5862520 - DNA, 14 bp, Homo sapiens
catcacagcagaat

SEQ ID NO: 5862521 - DNA, 12 bp, Homo sapiens
catcacagcagc

SEQ ID NO: 5862522 - DNA, 19 bp, Homo sapiens
catcacagcagcctccaac

SEQ ID NO: 5862523 - DNA, 17 bp, Homo sapiens
catcacagcatgtgcaa

SEQ ID NO: 5862524 - DNA, 19 bp, Homo sapiens
catcacagcatgtgcaata

SEQ ID NO: 5862525 - DNA, 15 bp, Homo sapiens
catcacagccagccc

SEQ ID NO: 5862526 - DNA, 17 bp, Homo sapiens
catcacagccagcccag

SEQ ID NO: 5862527 - DNA, 19 bp, Homo sapiens
catcacagccagcccagct

SEQ ID NO: 5862528 - DNA, 13 bp, Homo sapiens
catcacagcccag

SEQ ID NO: 5862529 - DNA, 14 bp, Homo sapiens
catcacagcccagc

SEQ ID NO: 5862530 - DNA, 17 bp, Homo sapiens
catcacagctaacaatt

SEQ ID NO: 5862531 - DNA, 15 bp, Homo sapiens
catcacagcttgttt

SEQ ID NO: 5862532 - DNA, 19 bp, Homo sapiens
catcacaggatgccagccc

SEQ ID NO: 5862533 - DNA, 21 bp, Homo sapiens
catcacaggatgccagcccct

SEQ ID NO: 5862534 - DNA, 20 bp, Homo sapiens
catcacagggcagagccggg

SEQ ID NO: 5862535 - DNA, 18 bp, Homo sapiens
catcacagggtgggcctc

SEQ ID NO: 5862536 - DNA, 19 bp, Homo sapiens
catcacagggtgggcctcg

SEQ ID NO: 5862537 - DNA, 22 bp, Homo sapiens
catcacagggtgggcctcggcc

SEQ ID NO: 5862538 - DNA, 19 bp, Homo sapiens
catcacagggttgggccca

SEQ ID NO: 5862539 - DNA, 18 bp, Homo sapiens
catcacagtgggaagaat

SEQ ID NO: 5862540 - DNA, 13 bp, Homo sapiens
catcacagttttg

SEQ ID NO: 5862541 - DNA, 21 bp, Homo sapiens
catcacagttttggttgcttt

SEQ ID NO: 5862542 - DNA, 22 bp, Homo sapiens
catcacagttttggttgcttta

SEQ ID NO: 5862543 - DNA, 16 bp, Homo sapiens
catcacatcttattta

SEQ ID NO: 5862544 - DNA, 19 bp, Homo sapiens
catcacatcttatttattt

SEQ ID NO: 5862545 - DNA, 22 bp, Homo sapiens
catcacatcttatttattttag

SEQ ID NO: 5862546 - DNA, 15 bp, Homo sapiens
catcacatgatgaaa

SEQ ID NO: 5862547 - DNA, 16 bp, Homo sapiens
catcacatgatgaaaa

SEQ ID NO: 5862548 - DNA, 17 bp, Homo sapiens
catcacattcccatggt

SEQ ID NO: 5862549 - DNA, 21 bp, Homo sapiens
catcacattcccatggtggcc

SEQ ID NO: 5862550 - DNA, 16 bp, Homo sapiens
catcaccaccgcctct

SEQ ID NO: 5862551 - DNA, 19 bp, Homo sapiens
catcaccaccgcctctggc

SEQ ID NO: 5862552 - DNA, 15 bp, Homo sapiens
catcaccacgcagag

SEQ ID NO: 5862553 - DNA, 16 bp, Homo sapiens
catcaccactcatttt

SEQ ID NO: 5862554 - DNA, 14 bp, Homo sapiens
catcaccagagtct

SEQ ID NO: 5862555 - DNA, 17 bp, Homo sapiens
catcaccaggtgcatct

SEQ ID NO: 5862556 - DNA, 19 bp, Homo sapiens
catcaccaggtgcatctgc

SEQ ID NO: 5862557 - DNA, 14 bp, Homo sapiens
catcaccatttcct

SEQ ID NO: 5862558 - DNA, 13 bp, Homo sapiens
catcacccagtcc

SEQ ID NO: 5862559 - DNA, 14 bp, Homo sapiens
catcacccagtcct

SEQ ID NO: 5862560 - DNA, 12 bp, Homo sapiens
catcaccccaga

SEQ ID NO: 5862561 - DNA, 20 bp, Homo sapiens
catcaccccctaccccagaa

SEQ ID NO: 5862562 - DNA, 20 bp, Homo sapiens
catcacccctggtggctgca

SEQ ID NO: 5862563 - DNA, 23 bp, Homo sapiens
catcacccctggtggctgcaggc

SEQ ID NO: 5862564 - DNA, 19 bp, Homo sapiens
catcacccgcccctggact

SEQ ID NO: 5862565 - DNA, 14 bp, Homo sapiens
catcaccctcaccc

SEQ ID NO: 5862566 - DNA, 16 bp, Homo sapiens
catcaccctcacccac

SEQ ID NO: 5862567 - DNA, 21 bp, Homo sapiens
catcaccctctgggcagctgt

SEQ ID NO: 5862568 - DNA, 15 bp, Homo sapiens
catcaccctttgcct

SEQ ID NO: 5862569 - DNA, 22 bp, Homo sapiens
catcaccgacgcgtctcctgtt

SEQ ID NO: 5862570 - DNA, 15 bp, Homo sapiens
catcaccgattcttc

SEQ ID NO: 5862571 - DNA, 21 bp, Homo sapiens
catcaccgattcttccttgcc

SEQ ID NO: 5862572 - DNA, 17 bp, Homo sapiens
catcaccgtcattgatg

SEQ ID NO: 5862573 - DNA, 22 bp, Homo sapiens
catcaccgtcccgcacagtgga

SEQ ID NO: 5862574 - DNA, 14 bp, Homo sapiens
catcacctactcac

SEQ ID NO: 5862575 - DNA, 22 bp, Homo sapiens
catcacctcagatggcagcttt

SEQ ID NO: 5862576 - DNA, 12 bp, Homo sapiens
catcacctcagg

SEQ ID NO: 5862577 - DNA, 21 bp, Homo sapiens
catcacctctaatagaggcag

SEQ ID NO: 5862578 - DNA, 20 bp, Homo sapiens
catcacctctttgcccccga

SEQ ID NO: 5862579 - DNA, 19 bp, Homo sapiens
catcacctgaaacactgga

SEQ ID NO: 5862580 - DNA, 11 bp, Homo sapiens
catcacctgct

SEQ ID NO: 5862581 - DNA, 11 bp, Homo sapiens
catcacctggg

SEQ ID NO: 5862582 - DNA, 18 bp, Homo sapiens
catcaccttagaccacca

SEQ ID NO: 5862583 - DNA, 19 bp, Homo sapiens
catcaccttaggcagggaa

SEQ ID NO: 5862584 - DNA, 15 bp, Homo sapiens
catcaccttcctcct

SEQ ID NO: 5862585 - DNA, 15 bp, Homo sapiens
catcacgacacattt

SEQ ID NO: 5862586 - DNA, 16 bp, Homo sapiens
catcacgacacatttg

SEQ ID NO: 5862587 - DNA, 22 bp, Homo sapiens
catcacgtcagtgctcagaaat

SEQ ID NO: 5862588 - DNA, 17 bp, Homo sapiens
catcacgtgtactggct

SEQ ID NO: 5862589 - DNA, 19 bp, Homo sapiens
catcacgttagctgtccca

SEQ ID NO: 5862590 - DNA, 16 bp, Homo sapiens
catcactaaaccgata

SEQ ID NO: 5862591 - DNA, 14 bp, Homo sapiens
catcactagtgaca

SEQ ID NO: 5862592 - DNA, 15 bp, Homo sapiens
catcactagtgacaa

SEQ ID NO: 5862593 - DNA, 15 bp, Homo sapiens
catcactatcaattt

SEQ ID NO: 5862594 - DNA, 16 bp, Homo sapiens
catcactatccatgca

SEQ ID NO: 5862595 - DNA, 23 bp, Homo sapiens
catcactattcagaagacacaga

SEQ ID NO: 5862596 - DNA, 16 bp, Homo sapiens
catcactcactcactc

SEQ ID NO: 5862597 - DNA, 23 bp, Homo sapiens
catcactcactcactccccactc

SEQ ID NO: 5862598 - DNA, 15 bp, Homo sapiens
catccagctccccag

SEQ ID NO: 5862599 - DNA, 22 bp, Homo sapiens
catccagctccccagcccacct

SEQ ID NO: 5862600 - DNA, 15 bp, Homo sapiens
catccagctgcccct

SEQ ID NO: 5862601 - DNA, 16 bp, Homo sapiens
catccagctgcccctc

SEQ ID NO: 5862602 - DNA, 20 bp, Homo sapiens
catccagctgcccctccctc

SEQ ID NO: 5862603 - DNA, 16 bp, Homo sapiens
catccaggactgagat

SEQ ID NO: 5862604 - DNA, 17 bp, Homo sapiens
catccaggccagggctc

SEQ ID NO: 5862605 - DNA, 18 bp, Homo sapiens
catccaggccagggctcc

SEQ ID NO: 5862606 - DNA, 22 bp, Homo sapiens
catccaggccagggctcctgtg

SEQ ID NO: 5862607 - DNA, 16 bp, Homo sapiens
catccaggcctgaggc

SEQ ID NO: 5862608 - DNA, 13 bp, Homo sapiens
catccagggggca

SEQ ID NO: 5862609 - DNA, 12 bp, Homo sapiens
catccagggtct

SEQ ID NO: 5862610 - DNA, 13 bp, Homo sapiens
catccagggtctg

SEQ ID NO: 5862611 - DNA, 17 bp, Homo sapiens
catccagggtctggcag

SEQ ID NO: 5862612 - DNA, 18 bp, Homo sapiens
catccagggtctggcaga

SEQ ID NO: 5862613 - DNA, 16 bp, Homo sapiens
catccaggtcctttcc

SEQ ID NO: 5862614 - DNA, 14 bp, Homo sapiens
catccagtgaaact

SEQ ID NO: 5862615 - DNA, 17 bp, Homo sapiens
catccagttaaccaagt

SEQ ID NO: 5862616 - DNA, 13 bp, Homo sapiens
catccagttcatg

SEQ ID NO: 5862617 - DNA, 21 bp, Homo sapiens
catccagttgcaataaaatag

SEQ ID NO: 5862618 - DNA, 15 bp, Homo sapiens
catccagttgtctaa

SEQ ID NO: 5862619 - DNA, 15 bp, Homo sapiens
catccagtttgttct

SEQ ID NO: 5862620 - DNA, 16 bp, Homo sapiens
catccagtttgttctc

SEQ ID NO: 5862621 - DNA, 16 bp, Homo sapiens
catccataaagcaagc

SEQ ID NO: 5862622 - DNA, 17 bp, Homo sapiens
catccataaatccagtt

SEQ ID NO: 5862623 - DNA, 16 bp, Homo sapiens
catccatagacacagt

SEQ ID NO: 5862624 - DNA, 18 bp, Homo sapiens
catccatagtaactgaca

SEQ ID NO: 5862625 - DNA, 19 bp, Homo sapiens
catccatagtaactgacat

SEQ ID NO: 5862626 - DNA, 18 bp, Homo sapiens
catccatagtagtatgat

SEQ ID NO: 5862627 - DNA, 15 bp, Homo sapiens
catccatcagctccc

SEQ ID NO: 5862628 - DNA, 17 bp, Homo sapiens
catccatcatctgctgc

SEQ ID NO: 5862629 - DNA, 12 bp, Homo sapiens
catccatccagg

SEQ ID NO: 5862630 - DNA, 15 bp, Homo sapiens
catccatcctgagcc

SEQ ID NO: 5862631 - DNA, 16 bp, Homo sapiens
catccatcctgagcca

SEQ ID NO: 5862632 - DNA, 14 bp, Homo sapiens
catccatctccagg

SEQ ID NO: 5862633 - DNA, 16 bp, Homo sapiens
catccatctccaggga

SEQ ID NO: 5862634 - DNA, 15 bp, Homo sapiens
catccatctgtggaa

SEQ ID NO: 5862635 - DNA, 13 bp, Homo sapiens
catccatgccctc

SEQ ID NO: 5862636 - DNA, 19 bp, Homo sapiens
catccatgccctcccagga

SEQ ID NO: 5862637 - DNA, 20 bp, Homo sapiens
catccatgccctcccaggac

SEQ ID NO: 5862638 - DNA, 21 bp, Homo sapiens
catccatgcggccggcctggg

SEQ ID NO: 5862639 - DNA, 19 bp, Homo sapiens
catccatggggctgattgt

SEQ ID NO: 5862640 - DNA, 21 bp, Homo sapiens
catccatggggtctctcacag

SEQ ID NO: 5862641 - DNA, 22 bp, Homo sapiens
catccatgtacttccctcttga

SEQ ID NO: 5862642 - DNA, 20 bp, Homo sapiens
catccattaatgtagataaa

SEQ ID NO: 5862643 - DNA, 18 bp, Homo sapiens
catccattacctccatcc

SEQ ID NO: 5862644 - DNA, 19 bp, Homo sapiens
catccattacctccatcca

SEQ ID NO: 5862645 - DNA, 15 bp, Homo sapiens
catccattccagagc

SEQ ID NO: 5862646 - DNA, 16 bp, Homo sapiens
catccattccagagct

SEQ ID NO: 5862647 - DNA, 12 bp, Homo sapiens
catccattccca

SEQ ID NO: 5862648 - DNA, 18 bp, Homo sapiens
catccattcccaagaaat

SEQ ID NO: 5862649 - DNA, 17 bp, Homo sapiens
catccattcctcaggga

SEQ ID NO: 5862650 - DNA, 19 bp, Homo sapiens
catccattcctcagggaca

SEQ ID NO: 5862651 - DNA, 12 bp, Homo sapiens
catccattctcc

SEQ ID NO: 5862652 - DNA, 14 bp, Homo sapiens
catccattgtctct

SEQ ID NO: 5862653 - DNA, 21 bp, Homo sapiens
catccattgtgttctctttaa

SEQ ID NO: 5862654 - DNA, 12 bp, Homo sapiens
catccatttctt

SEQ ID NO: 5862655 - DNA, 20 bp, Homo sapiens
catcccaaacccttcagtgc

SEQ ID NO: 5862656 - DNA, 13 bp, Homo sapiens
catcccaaacttt

SEQ ID NO: 5862657 - DNA, 15 bp, Homo sapiens
catcccaaactttaa

SEQ ID NO: 5862658 - DNA, 19 bp, Homo sapiens
catcccaaactttaaaatg

SEQ ID NO: 5862659 - DNA, 23 bp, Homo sapiens
catcccaaaggatgagaatgtga

SEQ ID NO: 5862660 - DNA, 17 bp, Homo sapiens
catcccaacagccaaga

SEQ ID NO: 5862661 - DNA, 16 bp, Homo sapiens
catcccaagcccagtg

SEQ ID NO: 5862662 - DNA, 14 bp, Homo sapiens
catcccacaccctg

SEQ ID NO: 5862663 - DNA, 12 bp, Homo sapiens
catcccacatga

SEQ ID NO: 5862664 - DNA, 22 bp, Homo sapiens
catcccacattcggaccctgcc

SEQ ID NO: 5862665 - DNA, 16 bp, Homo sapiens
catcccaccagccccg

SEQ ID NO: 5862666 - DNA, 12 bp, Homo sapiens
catcccacccca

SEQ ID NO: 5862667 - DNA, 19 bp, Homo sapiens
catcccaccccatcctcca

SEQ ID NO: 5862668 - DNA, 18 bp, Homo sapiens
catcccacccccgaccct

SEQ ID NO: 5862669 - DNA, 23 bp, Homo sapiens
catcccacccccgaccctgccct

SEQ ID NO: 5862670 - DNA, 19 bp, Homo sapiens
catcccacgcactccatga

SEQ ID NO: 5862671 - DNA, 18 bp, Homo sapiens
catcccactccctttccc

SEQ ID NO: 5862672 - DNA, 19 bp, Homo sapiens
catcccactggatctggct

SEQ ID NO: 5862673 - DNA, 11 bp, Homo sapiens
catcccactta

SEQ ID NO: 5862674 - DNA, 19 bp, Homo sapiens
catcccacttagccgcacc

SEQ ID NO: 5862675 - DNA, 23 bp, Homo sapiens
catcccacttagccgcaccctgc

SEQ ID NO: 5862676 - DNA, 15 bp, Homo sapiens
catcccacttccttt

SEQ ID NO: 5862677 - DNA, 18 bp, Homo sapiens
catcccacttcctttcct

SEQ ID NO: 5862678 - DNA, 17 bp, Homo sapiens
catcccagacaggtccc

SEQ ID NO: 5862679 - DNA, 14 bp, Homo sapiens
catcccagcacctg

SEQ ID NO: 5862680 - DNA, 16 bp, Homo sapiens
catcccagcacctgcc

SEQ ID NO: 5862681 - DNA, 17 bp, Homo sapiens
catcccagcacctgcca

SEQ ID NO: 5862682 - DNA, 16 bp, Homo sapiens
catcccagccccaatg

SEQ ID NO: 5862683 - DNA, 16 bp, Homo sapiens
catcccagccccaatt

SEQ ID NO: 5862684 - DNA, 12 bp, Homo sapiens
catcccagcctc

SEQ ID NO: 5862685 - DNA, 14 bp, Homo sapiens
catcccagcctcag

SEQ ID NO: 5862686 - DNA, 18 bp, Homo sapiens
catcccagctgctgaggc

SEQ ID NO: 5862687 - DNA, 14 bp, Homo sapiens
catcccagcttgcc

SEQ ID NO: 5862688 - DNA, 16 bp, Homo sapiens
catcccagcttgcccc

SEQ ID NO: 5862689 - DNA, 17 bp, Homo sapiens
catcccagcttgccccc

SEQ ID NO: 5862690 - DNA, 19 bp, Homo sapiens
catcccaggacaccacacc

SEQ ID NO: 5862691 - DNA, 23 bp, Homo sapiens
catcccaggacaccacacccagc

SEQ ID NO: 5862692 - DNA, 20 bp, Homo sapiens
catcccagggtcccaccccc

SEQ ID NO: 5862693 - DNA, 22 bp, Homo sapiens
catcccagtagtgtttggaatt

SEQ ID NO: 5862694 - DNA, 21 bp, Homo sapiens
catcccagtcctgatggccgc

SEQ ID NO: 5862695 - DNA, 12 bp, Homo sapiens
catcccatcatc

SEQ ID NO: 5862696 - DNA, 12 bp, Homo sapiens
catcccatccca

SEQ ID NO: 5862697 - DNA, 15 bp, Homo sapiens
catcccatcccatcc

SEQ ID NO: 5862698 - DNA, 19 bp, Homo sapiens
catcccatctaagctgcag

SEQ ID NO: 5862699 - DNA, 12 bp, Homo sapiens
catcccatgctg

SEQ ID NO: 5862700 - DNA, 23 bp, Homo sapiens
catcccatgtagaaaaataaaga

SEQ ID NO: 5862701 - DNA, 13 bp, Homo sapiens
catcccattccag

SEQ ID NO: 5862702 - DNA, 17 bp, Homo sapiens
catcccattgccctggt

SEQ ID NO: 5862703 - DNA, 18 bp, Homo sapiens
catcccattttcatcctg

SEQ ID NO: 5862704 - DNA, 19 bp, Homo sapiens
catcccattttcatcctga

SEQ ID NO: 5862705 - DNA, 21 bp, Homo sapiens
catcccattttcatcctgagc

SEQ ID NO: 5862706 - DNA, 22 bp, Homo sapiens
catcccattttcatcctgagcc

SEQ ID NO: 5862707 - DNA, 22 bp, Homo sapiens
catccccaaaacaaagtctttg

SEQ ID NO: 5862708 - DNA, 20 bp, Homo sapiens
catccccaactccatggggt

SEQ ID NO: 5862709 - DNA, 16 bp, Homo sapiens
catccccaagcccacc

SEQ ID NO: 5862710 - DNA, 16 bp, Homo sapiens
catccccacaatctgg

SEQ ID NO: 5862711 - DNA, 13 bp, Homo sapiens
catccccaccagc

SEQ ID NO: 5862712 - DNA, 15 bp, Homo sapiens
catccccaccagctc

SEQ ID NO: 5862713 - DNA, 14 bp, Homo sapiens
catccccaccccac

SEQ ID NO: 5862714 - DNA, 12 bp, Homo sapiens
catccccagagc

SEQ ID NO: 5862715 - DNA, 20 bp, Homo sapiens
catccccaggtccccaaact

SEQ ID NO: 5862716 - DNA, 14 bp, Homo sapiens
catccccagttggg

SEQ ID NO: 5862717 - DNA, 20 bp, Homo sapiens
catccccatcggccctgtcc

SEQ ID NO: 5862718 - DNA, 17 bp, Homo sapiens
catccccattcggggct

SEQ ID NO: 5862719 - DNA, 19 bp, Homo sapiens
catcccccactgccacacc

SEQ ID NO: 5862720 - DNA, 20 bp, Homo sapiens
catcccccactgccacaccc

SEQ ID NO: 5862721 - DNA, 17 bp, Homo sapiens
catccccccacccgact

SEQ ID NO: 5862722 - DNA, 14 bp, Homo sapiens
catcccccctcacc

SEQ ID NO: 5862723 - DNA, 13 bp, Homo sapiens
catcccccctgct

SEQ ID NO: 5862724 - DNA, 14 bp, Homo sapiens
catcccccctgctg

SEQ ID NO: 5862725 - DNA, 15 bp, Homo sapiens
catcccccctgctgc

SEQ ID NO: 5862726 - DNA, 19 bp, Homo sapiens
catccccctccaaagtctt

SEQ ID NO: 5862727 - DNA, 22 bp, Homo sapiens
catccccctcctctccctgtta

SEQ ID NO: 5862728 - DNA, 14 bp, Homo sapiens
catccccctctgtc

SEQ ID NO: 5862729 - DNA, 15 bp, Homo sapiens
catccccctctgtct

SEQ ID NO: 5862730 - DNA, 22 bp, Homo sapiens
catccccctctgtctgccctca

SEQ ID NO: 5862731 - DNA, 15 bp, Homo sapiens
catccccctgcctcc

SEQ ID NO: 5862732 - DNA, 13 bp, Homo sapiens
catcccccttctt

SEQ ID NO: 5862733 - DNA, 13 bp, Homo sapiens
catccccgagggc

SEQ ID NO: 5862734 - DNA, 16 bp, Homo sapiens
catccccgagggcggg

SEQ ID NO: 5862735 - DNA, 23 bp, Homo sapiens
catcccctcaacaccctgcttct

SEQ ID NO: 5862736 - DNA, 14 bp, Homo sapiens
catcccctcccatc

SEQ ID NO: 5862737 - DNA, 16 bp, Homo sapiens
catcccctccctgcct

SEQ ID NO: 5862738 - DNA, 21 bp, Homo sapiens
catcccctccctgcctgctcc

SEQ ID NO: 5862739 - DNA, 17 bp, Homo sapiens
catcccctcgtcctgtc

SEQ ID NO: 5862740 - DNA, 15 bp, Homo sapiens
catcccctctcagga

SEQ ID NO: 5862741 - DNA, 16 bp, Homo sapiens
catcccctctcaggag

SEQ ID NO: 5862742 - DNA, 12 bp, Homo sapiens
catcccctgcct

SEQ ID NO: 5862743 - DNA, 14 bp, Homo sapiens
catcccctgcctcc

SEQ ID NO: 5862744 - DNA, 22 bp, Homo sapiens
catcccctgcctccatcctagt

SEQ ID NO: 5862745 - DNA, 14 bp, Homo sapiens
catcccctggactg

SEQ ID NO: 5862746 - DNA, 19 bp, Homo sapiens
catcccctggactgggagg

SEQ ID NO: 5862747 - DNA, 14 bp, Homo sapiens
catcccctgtagag

SEQ ID NO: 5862748 - DNA, 16 bp, Homo sapiens
catccccttccagctc

SEQ ID NO: 5862749 - DNA, 14 bp, Homo sapiens
catccccttccccc

SEQ ID NO: 5862750 - DNA, 19 bp, Homo sapiens
catccccttcccccatccc

SEQ ID NO: 5862751 - DNA, 19 bp, Homo sapiens
catccccttgaactcttca

SEQ ID NO: 5862752 - DNA, 15 bp, Homo sapiens
catcccctttattaa

SEQ ID NO: 5862753 - DNA, 14 bp, Homo sapiens
catcccctttcctc

SEQ ID NO: 5862754 - DNA, 23 bp, Homo sapiens
catcccgacatggacccggagct

SEQ ID NO: 5862755 - DNA, 18 bp, Homo sapiens
catcccgatacctcagcc

SEQ ID NO: 5862756 - DNA, 15 bp, Homo sapiens
catcccgccttctcc

SEQ ID NO: 5862757 - DNA, 14 bp, Homo sapiens
catcccgctcctgc

SEQ ID NO: 5862758 - DNA, 16 bp, Homo sapiens
catcccgctcctgctg

SEQ ID NO: 5862759 - DNA, 17 bp, Homo sapiens
catcccgctcctgctga

SEQ ID NO: 5862760 - DNA, 17 bp, Homo sapiens
catcccgctcttttcct

SEQ ID NO: 5862761 - DNA, 18 bp, Homo sapiens
catcccgcttctgaagct

SEQ ID NO: 5862762 - DNA, 18 bp, Homo sapiens
catcccggagcgcacctg

SEQ ID NO: 5862763 - DNA, 20 bp, Homo sapiens
catcccggagcgcacctgct

SEQ ID NO: 5862764 - DNA, 15 bp, Homo sapiens
catcccggaggaaat

SEQ ID NO: 5862765 - DNA, 13 bp, Homo sapiens
catcccggcctct

SEQ ID NO: 5862766 - DNA, 16 bp, Homo sapiens
catcccggcctcttcc

SEQ ID NO: 5862767 - DNA, 21 bp, Homo sapiens
catcccggcctcttccaccca

SEQ ID NO: 5862768 - DNA, 15 bp, Homo sapiens
catcccggctgaccc

SEQ ID NO: 5862769 - DNA, 16 bp, Homo sapiens
catcccggctgaccct

SEQ ID NO: 5862770 - DNA, 17 bp, Homo sapiens
catcccgggcctcagtg

SEQ ID NO: 5862771 - DNA, 16 bp, Homo sapiens
catcccggggccatgg

SEQ ID NO: 5862772 - DNA, 17 bp, Homo sapiens
catcccggggccatgga

SEQ ID NO: 5862773 - DNA, 23 bp, Homo sapiens
catcccgtaagaccaccttccct

SEQ ID NO: 5862774 - DNA, 16 bp, Homo sapiens
catcccgtatcacagt

SEQ ID NO: 5862775 - DNA, 17 bp, Homo sapiens
catcccgtgttctcctt

SEQ ID NO: 5862776 - DNA, 21 bp, Homo sapiens
catcccgtgttctccttttcc

SEQ ID NO: 5862777 - DNA, 16 bp, Homo sapiens
catcccgtttccctcc

SEQ ID NO: 5862778 - DNA, 20 bp, Homo sapiens
catcctcctccgatttctaa

SEQ ID NO: 5862779 - DNA, 15 bp, Homo sapiens
catcctcctcctcat

SEQ ID NO: 5862780 - DNA, 23 bp, Homo sapiens
catcctcctcctggactcccctc

SEQ ID NO: 5862781 - DNA, 14 bp, Homo sapiens
catcctcctctcca

SEQ ID NO: 5862782 - DNA, 17 bp, Homo sapiens
catcctcctctccatgc

SEQ ID NO: 5862783 - DNA, 22 bp, Homo sapiens
catcctcctgcccagctcctca

SEQ ID NO: 5862784 - DNA, 23 bp, Homo sapiens
catcctcctgcccagctcctcac

SEQ ID NO: 5862785 - DNA, 21 bp, Homo sapiens
catcctcctgcccccacccca

SEQ ID NO: 5862786 - DNA, 14 bp, Homo sapiens
catcctcctggaac

SEQ ID NO: 5862787 - DNA, 23 bp, Homo sapiens
catcctcctggaaccttgctgtc

SEQ ID NO: 5862788 - DNA, 13 bp, Homo sapiens
catcctcctggac

SEQ ID NO: 5862789 - DNA, 22 bp, Homo sapiens
catcctcctggacccagcaggg

SEQ ID NO: 5862790 - DNA, 16 bp, Homo sapiens
catcctcctggtgccc

SEQ ID NO: 5862791 - DNA, 20 bp, Homo sapiens
catcctccttataagcccag

SEQ ID NO: 5862792 - DNA, 14 bp, Homo sapiens
catcctcctttcag

SEQ ID NO: 5862793 - DNA, 19 bp, Homo sapiens
catcctctaaagcagaggc

SEQ ID NO: 5862794 - DNA, 14 bp, Homo sapiens
catcctctccagga

SEQ ID NO: 5862795 - DNA, 14 bp, Homo sapiens
catcctctcccttc

SEQ ID NO: 5862796 - DNA, 15 bp, Homo sapiens
catcctctcccttct

SEQ ID NO: 5862797 - DNA, 16 bp, Homo sapiens
catcctctcccttctt

SEQ ID NO: 5862798 - DNA, 17 bp, Homo sapiens
catcctctcccttctta

SEQ ID NO: 5862799 - DNA, 21 bp, Homo sapiens
catcctctctatgggccatat

SEQ ID NO: 5862800 - DNA, 13 bp, Homo sapiens
catcctctgactc

SEQ ID NO: 5862801 - DNA, 17 bp, Homo sapiens
catcctctgactccact

SEQ ID NO: 5862802 - DNA, 23 bp, Homo sapiens
catcctctgactccactcaaaga

SEQ ID NO: 5862803 - DNA, 21 bp, Homo sapiens
catcctctgatagctgtttca

SEQ ID NO: 5862804 - DNA, 14 bp, Homo sapiens
catcctctgcctca

SEQ ID NO: 5862805 - DNA, 14 bp, Homo sapiens
catcctctgctggt

SEQ ID NO: 5862806 - DNA, 23 bp, Homo sapiens
catcctctggcttggccacagcc

SEQ ID NO: 5862807 - DNA, 15 bp, Homo sapiens
catcctctgtacaga

SEQ ID NO: 5862808 - DNA, 11 bp, Homo sapiens
catcctctgtt

SEQ ID NO: 5862809 - DNA, 11 bp, Homo sapiens
catcctcttat

SEQ ID NO: 5862810 - DNA, 12 bp, Homo sapiens
catcctgaacag

SEQ ID NO: 5862811 - DNA, 14 bp, Homo sapiens
catcctgaacagca

SEQ ID NO: 5862812 - DNA, 15 bp, Homo sapiens
catcctgaacagcat

SEQ ID NO: 5862813 - DNA, 12 bp, Homo sapiens
catcctgaccaa

SEQ ID NO: 5862814 - DNA, 16 bp, Homo sapiens
catcctgacctcctgg

SEQ ID NO: 5862815 - DNA, 20 bp, Homo sapiens
catcctgactctgccccctg

SEQ ID NO: 5862816 - DNA, 23 bp, Homo sapiens
catcctgagccagggaacagccc

SEQ ID NO: 5862817 - DNA, 14 bp, Homo sapiens
catcctgagcccaa

SEQ ID NO: 5862818 - DNA, 15 bp, Homo sapiens
catcctgaggccagt

SEQ ID NO: 5862819 - DNA, 16 bp, Homo sapiens
catcctgaggccagtg

SEQ ID NO: 5862820 - DNA, 15 bp, Homo sapiens
catcctgaggtgcct

SEQ ID NO: 5862821 - DNA, 20 bp, Homo sapiens
catcctgaggtgcctcccag

SEQ ID NO: 5862822 - DNA, 17 bp, Homo sapiens
catcctgcaaaggccct

SEQ ID NO: 5862823 - DNA, 23 bp, Homo sapiens
catcctgcagatactttgaagtg

SEQ ID NO: 5862824 - DNA, 12 bp, Homo sapiens
catcctgcaggc

SEQ ID NO: 5862825 - DNA, 13 bp, Homo sapiens
catcctgccagcc

SEQ ID NO: 5862826 - DNA, 15 bp, Homo sapiens
catcctgccagcccc

SEQ ID NO: 5862827 - DNA, 19 bp, Homo sapiens
catcctgccagccccacac

SEQ ID NO: 5862828 - DNA, 14 bp, Homo sapiens
catcctgccaggag

SEQ ID NO: 5862829 - DNA, 22 bp, Homo sapiens
catcctgccttcatggaactca

SEQ ID NO: 5862830 - DNA, 20 bp, Homo sapiens
catcctgctacactcatccg

SEQ ID NO: 5862831 - DNA, 23 bp, Homo sapiens
catcctgctagcacctccccaga

SEQ ID NO: 5862832 - DNA, 14 bp, Homo sapiens
catcctgctcttcc

SEQ ID NO: 5862833 - DNA, 20 bp, Homo sapiens
catcctgctcttttgtgatg

SEQ ID NO: 5862834 - DNA, 10 bp, Homo sapiens
catcctgctg

SEQ ID NO: 5862835 - DNA, 16 bp, Homo sapiens
catcctgcttcctgaa

SEQ ID NO: 5862836 - DNA, 15 bp, Homo sapiens
catcctggaaatttg

SEQ ID NO: 5862837 - DNA, 21 bp, Homo sapiens
catcctggaaatttgtgtgct

SEQ ID NO: 5862838 - DNA, 10 bp, Homo sapiens
catcctggat

SEQ ID NO: 5862839 - DNA, 22 bp, Homo sapiens
catcctggcacccggcccctgc

SEQ ID NO: 5862840 - DNA, 15 bp, Homo sapiens
catcctggcacgccc

SEQ ID NO: 5862841 - DNA, 13 bp, Homo sapiens
catcctggccaac

SEQ ID NO: 5862842 - DNA, 15 bp, Homo sapiens
catcctggcccaggg

SEQ ID NO: 5862843 - DNA, 16 bp, Homo sapiens
catcctggcccagggc

SEQ ID NO: 5862844 - DNA, 19 bp, Homo sapiens
catcctggcccctccagac

SEQ ID NO: 5862845 - DNA, 17 bp, Homo sapiens
catcctggcctcctttt

SEQ ID NO: 5862846 - DNA, 14 bp, Homo sapiens
catcctggcctggc

SEQ ID NO: 5862847 - DNA, 23 bp, Homo sapiens
catcctggcctggcacatcagaa

SEQ ID NO: 5862848 - DNA, 19 bp, Homo sapiens
catcctggctcagctctca

SEQ ID NO: 5862849 - DNA, 12 bp, Homo sapiens
catcctggctgc

SEQ ID NO: 5862850 - DNA, 15 bp, Homo sapiens
catcctggctgcggc

SEQ ID NO: 5862851 - DNA, 14 bp, Homo sapiens
catcctggctggag

SEQ ID NO: 5862852 - DNA, 13 bp, Homo sapiens
catcctggctggc

SEQ ID NO: 5862853 - DNA, 16 bp, Homo sapiens
catcctgggatgtaaa

SEQ ID NO: 5862854 - DNA, 13 bp, Homo sapiens
catcctgggcctt

SEQ ID NO: 5862855 - DNA, 17 bp, Homo sapiens
catcctggggcagcact

SEQ ID NO: 5862856 - DNA, 12 bp, Homo sapiens
catcctgggtaa

SEQ ID NO: 5862857 - DNA, 21 bp, Homo sapiens
catcctgtaaaggtcaacaat

SEQ ID NO: 5862858 - DNA, 17 bp, Homo sapiens
catcctgtacaagtgct

SEQ ID NO: 5862859 - DNA, 16 bp, Homo sapiens
catcctgtcagtgtca

SEQ ID NO: 5862860 - DNA, 20 bp, Homo sapiens
catcctgtgggacctgggcc

SEQ ID NO: 5862861 - DNA, 21 bp, Homo sapiens
catcctgtgggacctgggcca

SEQ ID NO: 5862862 - DNA, 10 bp, Homo sapiens
catcctgtgt

SEQ ID NO: 5862863 - DNA, 18 bp, Homo sapiens
catcctgtttttcctttt

SEQ ID NO: 5862864 - DNA, 11 bp, Homo sapiens
catccttaaag

SEQ ID NO: 5862865 - DNA, 15 bp, Homo sapiens
catccttaactgtcc

SEQ ID NO: 5862866 - DNA, 23 bp, Homo sapiens
catccttagatgggacgcataat

SEQ ID NO: 5862867 - DNA, 18 bp, Homo sapiens
catccttagtacatgctc

SEQ ID NO: 5862868 - DNA, 15 bp, Homo sapiens
catccttatccttca

SEQ ID NO: 5862869 - DNA, 19 bp, Homo sapiens
catccttatccttcatctt

SEQ ID NO: 5862870 - DNA, 14 bp, Homo sapiens
catccttatgagac

SEQ ID NO: 5862871 - DNA, 22 bp, Homo sapiens
catccttcaagaactctgggct

SEQ ID NO: 5862872 - DNA, 20 bp, Homo sapiens
catccttcaaggtggcagct

SEQ ID NO: 5862873 - DNA, 20 bp, Homo sapiens
catccttcaccagagcccat

SEQ ID NO: 5862874 - DNA, 22 bp, Homo sapiens
catccttcaccagagcccatgc

SEQ ID NO: 5862875 - DNA, 16 bp, Homo sapiens
catccttcagtgaact

SEQ ID NO: 5862876 - DNA, 14 bp, Homo sapiens
catccttccagcaa

SEQ ID NO: 5862877 - DNA, 15 bp, Homo sapiens
catccttccatcctg

SEQ ID NO: 5862878 - DNA, 16 bp, Homo sapiens
catccttccatcctga

SEQ ID NO: 5862879 - DNA, 19 bp, Homo sapiens
catccttcccaagaagaga

SEQ ID NO: 5862880 - DNA, 22 bp, Homo sapiens
catccttcccaagaagagagaa

SEQ ID NO: 5862881 - DNA, 15 bp, Homo sapiens
catccttcccactct

SEQ ID NO: 5862882 - DNA, 17 bp, Homo sapiens
catccttcccactctgt

SEQ ID NO: 5862883 - DNA, 16 bp, Homo sapiens
catccttcccagcaga

SEQ ID NO: 5862884 - DNA, 12 bp, Homo sapiens
catccttcccca

SEQ ID NO: 5862885 - DNA, 15 bp, Homo sapiens
catccttccccaact

SEQ ID NO: 5862886 - DNA, 15 bp, Homo sapiens
catccttcccgcagc

SEQ ID NO: 5862887 - DNA, 18 bp, Homo sapiens
catccttcccgcagcacc

SEQ ID NO: 5862888 - DNA, 19 bp, Homo sapiens
catccttcccgcagcacca

SEQ ID NO: 5862889 - DNA, 23 bp, Homo sapiens
catccttccctcatgcccgccag

SEQ ID NO: 5862890 - DNA, 15 bp, Homo sapiens
catccttccctgtct

SEQ ID NO: 5862891 - DNA, 18 bp, Homo sapiens
catccttccgccaatctg

SEQ ID NO: 5862892 - DNA, 22 bp, Homo sapiens
catccttccgccaatctggccc

SEQ ID NO: 5862893 - DNA, 12 bp, Homo sapiens
catccttcctat

SEQ ID NO: 5862894 - DNA, 16 bp, Homo sapiens
catccttcctggggac

SEQ ID NO: 5862895 - DNA, 16 bp, Homo sapiens
catccttccttcccac

SEQ ID NO: 5862896 - DNA, 16 bp, Homo sapiens
catccttctcactgcc

SEQ ID NO: 5862897 - DNA, 13 bp, Homo sapiens
catccttctcccc

SEQ ID NO: 5862898 - DNA, 16 bp, Homo sapiens
catccttctccccaag

SEQ ID NO: 5862899 - DNA, 15 bp, Homo sapiens
catccttctgccttt

SEQ ID NO: 5862900 - DNA, 17 bp, Homo sapiens
catccttcttccactgt

SEQ ID NO: 5862901 - DNA, 20 bp, Homo sapiens
catccttcttccactgtctc

SEQ ID NO: 5862902 - DNA, 20 bp, Homo sapiens
catccttcttggcttcctgg

SEQ ID NO: 5862903 - DNA, 17 bp, Homo sapiens
catccttctttccttgt

SEQ ID NO: 5862904 - DNA, 16 bp, Homo sapiens
catccttgactgaagc

SEQ ID NO: 5862905 - DNA, 21 bp, Homo sapiens
catccttgaggacctccacct

SEQ ID NO: 5862906 - DNA, 19 bp, Homo sapiens
catccttgattacttccac

SEQ ID NO: 5862907 - DNA, 15 bp, Homo sapiens
catccttgcctgtct

SEQ ID NO: 5862908 - DNA, 16 bp, Homo sapiens
catccttgcctgtcta

SEQ ID NO: 5862909 - DNA, 20 bp, Homo sapiens
catccttgcctgtctaaagc

SEQ ID NO: 5862910 - DNA, 13 bp, Homo sapiens
catccttgtctta

SEQ ID NO: 5862911 - DNA, 20 bp, Homo sapiens
catccttgtggcacattttt

SEQ ID NO: 5862912 - DNA, 15 bp, Homo sapiens
catcctttacgtgtt

SEQ ID NO: 5862913 - DNA, 19 bp, Homo sapiens
catcctttacgtgtttaaa

SEQ ID NO: 5862914 - DNA, 19 bp, Homo sapiens
catcctttctgcctctcaa

SEQ ID NO: 5862915 - DNA, 19 bp, Homo sapiens
catcctttgcagggcagcc

SEQ ID NO: 5862916 - DNA, 14 bp, Homo sapiens
catcctttgcattt

SEQ ID NO: 5862917 - DNA, 18 bp, Homo sapiens
catcctttgttctgagca

SEQ ID NO: 5862918 - DNA, 17 bp, Homo sapiens
catccttttctcctatc

SEQ ID NO: 5862919 - DNA, 11 bp, Homo sapiens
catcctttttt

SEQ ID NO: 5862920 - DNA, 21 bp, Homo sapiens
catcgaaatgtattcaccttt

SEQ ID NO: 5862921 - DNA, 19 bp, Homo sapiens
catcgaacaaactgatgcg

SEQ ID NO: 5862922 - DNA, 15 bp, Homo sapiens
catcgaagtcttccc

SEQ ID NO: 5862923 - DNA, 19 bp, Homo sapiens
catcgaggagctagaacat

SEQ ID NO: 5862924 - DNA, 18 bp, Homo sapiens
catcgaggtatgtttata

SEQ ID NO: 5862925 - DNA, 14 bp, Homo sapiens
catcgatatgtata

SEQ ID NO: 5862926 - DNA, 12 bp, Homo sapiens
catcgatgcgag

SEQ ID NO: 5862927 - DNA, 16 bp, Homo sapiens
catcgcaagtcacaga

SEQ ID NO: 5862928 - DNA, 12 bp, Homo sapiens
catcgcaatgta

SEQ ID NO: 5862929 - DNA, 13 bp, Homo sapiens
catcgcactgtgg

SEQ ID NO: 5862930 - DNA, 15 bp, Homo sapiens
catcgcagcccctgt

SEQ ID NO: 5862931 - DNA, 14 bp, Homo sapiens
catcgcagcttcct

SEQ ID NO: 5862932 - DNA, 17 bp, Homo sapiens
catcgcaggagtctctg

SEQ ID NO: 5862933 - DNA, 22 bp, Homo sapiens
catcgcaggagtctctgccacc

SEQ ID NO: 5862934 - DNA, 15 bp, Homo sapiens
catcgccacaaactc

SEQ ID NO: 5862935 - DNA, 20 bp, Homo sapiens
catcgccagctgatgactca

SEQ ID NO: 5862936 - DNA, 16 bp, Homo sapiens
catcgccatcttcttc

SEQ ID NO: 5862937 - DNA, 16 bp, Homo sapiens
catcgccgggactcca

SEQ ID NO: 5862938 - DNA, 22 bp, Homo sapiens
catcgccttctggccgctgcag

SEQ ID NO: 5862939 - DNA, 15 bp, Homo sapiens
catcgccttctgggg

SEQ ID NO: 5862940 - DNA, 22 bp, Homo sapiens
catcgccttctggggaggggct

SEQ ID NO: 5862941 - DNA, 22 bp, Homo sapiens
catcgctgtccaagtgtttctt

SEQ ID NO: 5862942 - DNA, 16 bp, Homo sapiens
catcgctgttctgggc

SEQ ID NO: 5862943 - DNA, 14 bp, Homo sapiens
catcggaaaaataa

SEQ ID NO: 5862944 - DNA, 15 bp, Homo sapiens
catcggaagagaggg

SEQ ID NO: 5862945 - DNA, 18 bp, Homo sapiens
catcggagactgccccac

SEQ ID NO: 5862946 - DNA, 15 bp, Homo sapiens
catcggaggagaaac

SEQ ID NO: 5862947 - DNA, 18 bp, Homo sapiens
catcggaggcccatgccc

SEQ ID NO: 5862948 - DNA, 17 bp, Homo sapiens
catcggaggctgggccc

SEQ ID NO: 5862949 - DNA, 22 bp, Homo sapiens
catcggagggagtcccagagcc

SEQ ID NO: 5862950 - DNA, 16 bp, Homo sapiens
catcgggaaagaagaa

SEQ ID NO: 5862951 - DNA, 15 bp, Homo sapiens
catcgggctcacctt

SEQ ID NO: 5862952 - DNA, 12 bp, Homo sapiens
catcgggctttg

SEQ ID NO: 5862953 - DNA, 13 bp, Homo sapiens
catcgggggcctg

SEQ ID NO: 5862954 - DNA, 18 bp, Homo sapiens
catcggggtggtgcaggc

SEQ ID NO: 5862955 - DNA, 23 bp, Homo sapiens
catcgggtgtaggtgaaaggcat

SEQ ID NO: 5862956 - DNA, 17 bp, Homo sapiens
catcggtaggcaaagga

SEQ ID NO: 5862957 - DNA, 22 bp, Homo sapiens
catcggtcctgtctcccctctg

SEQ ID NO: 5862958 - DNA, 16 bp, Homo sapiens
catctgccccacagtc

SEQ ID NO: 5862959 - DNA, 16 bp, Homo sapiens
catctgcccctccccc

SEQ ID NO: 5862960 - DNA, 13 bp, Homo sapiens
catctgcccgcct

SEQ ID NO: 5862961 - DNA, 19 bp, Homo sapiens
catctgcccgcctgcccac

SEQ ID NO: 5862962 - DNA, 21 bp, Homo sapiens
catctgcccgcctgcccacct

SEQ ID NO: 5862963 - DNA, 15 bp, Homo sapiens
catctgccctccctg

SEQ ID NO: 5862964 - DNA, 16 bp, Homo sapiens
catctgccctccctgt

SEQ ID NO: 5862965 - DNA, 15 bp, Homo sapiens
catctgcctcctctc

SEQ ID NO: 5862966 - DNA, 16 bp, Homo sapiens
catctgcctgcagtgt

SEQ ID NO: 5862967 - DNA, 12 bp, Homo sapiens
catctgcctgga

SEQ ID NO: 5862968 - DNA, 13 bp, Homo sapiens
catctgcctggag

SEQ ID NO: 5862969 - DNA, 18 bp, Homo sapiens
catctgccttaaaaccaa

SEQ ID NO: 5862970 - DNA, 14 bp, Homo sapiens
catctgccttgctg

SEQ ID NO: 5862971 - DNA, 22 bp, Homo sapiens
catctgcgacaccaccaacagg

SEQ ID NO: 5862972 - DNA, 23 bp, Homo sapiens
catctgcgacaccaccaacaggc

SEQ ID NO: 5862973 - DNA, 19 bp, Homo sapiens
catctgcggggcttctggg

SEQ ID NO: 5862974 - DNA, 20 bp, Homo sapiens
catctgcgggggcagtgctc

SEQ ID NO: 5862975 - DNA, 16 bp, Homo sapiens
catctgctaagtaatt

SEQ ID NO: 5862976 - DNA, 18 bp, Homo sapiens
catctgctcatctgatat

SEQ ID NO: 5862977 - DNA, 19 bp, Homo sapiens
catctgctcctagcccagc

SEQ ID NO: 5862978 - DNA, 15 bp, Homo sapiens
catctgctcctccca

SEQ ID NO: 5862979 - DNA, 14 bp, Homo sapiens
catctgctcctgga

SEQ ID NO: 5862980 - DNA, 22 bp, Homo sapiens
catctgctcctggatctccctg

SEQ ID NO: 5862981 - DNA, 15 bp, Homo sapiens
catctgctccttcct

SEQ ID NO: 5862982 - DNA, 23 bp, Homo sapiens
catctgctctagattcataaata

SEQ ID NO: 5862983 - DNA, 13 bp, Homo sapiens
catctgctctcct

SEQ ID NO: 5862984 - DNA, 16 bp, Homo sapiens
catctgctctccttcc

SEQ ID NO: 5862985 - DNA, 13 bp, Homo sapiens
catctgctctgag

SEQ ID NO: 5862986 - DNA, 13 bp, Homo sapiens
catctgctcttct

SEQ ID NO: 5862987 - DNA, 14 bp, Homo sapiens
catctgctcttctc

SEQ ID NO: 5862988 - DNA, 14 bp, Homo sapiens
catctgctgagctc

SEQ ID NO: 5862989 - DNA, 18 bp, Homo sapiens
catctgctgagctctgac

SEQ ID NO: 5862990 - DNA, 11 bp, Homo sapiens
catctgctgca

SEQ ID NO: 5862991 - DNA, 14 bp, Homo sapiens
catctgctgcacat

SEQ ID NO: 5862992 - DNA, 19 bp, Homo sapiens
catctgctgcacatagcag

SEQ ID NO: 5862993 - DNA, 12 bp, Homo sapiens
catctgctgtct

SEQ ID NO: 5862994 - DNA, 16 bp, Homo sapiens
catctgctgtgactgt

SEQ ID NO: 5862995 - DNA, 14 bp, Homo sapiens
catctgctgtgtgg

SEQ ID NO: 5862996 - DNA, 15 bp, Homo sapiens
catctgctgtgtgga

SEQ ID NO: 5862997 - DNA, 16 bp, Homo sapiens
catctgctgtgtggaa

SEQ ID NO: 5862998 - DNA, 14 bp, Homo sapiens
catctgctgttatc

SEQ ID NO: 5862999 - DNA, 20 bp, Homo sapiens
catctgcttacaattccctg

SEQ ID NO: 5863000 - DNA, 12 bp, Homo sapiens
catctgctttat

SEQ ID NO: 5863001 - DNA, 23 bp, Homo sapiens
catctgctttattgcctctgtct

SEQ ID NO: 5863002 - DNA, 11 bp, Homo sapiens
catctgctttt

SEQ ID NO: 5863003 - DNA, 14 bp, Homo sapiens
catctggaaagggg

SEQ ID NO: 5863004 - DNA, 11 bp, Homo sapiens
catctggaaat

SEQ ID NO: 5863005 - DNA, 12 bp, Homo sapiens
catctggaaatc

SEQ ID NO: 5863006 - DNA, 17 bp, Homo sapiens
catctggaaccatcaga

SEQ ID NO: 5863007 - DNA, 19 bp, Homo sapiens
catctggaaccatcagaaa

SEQ ID NO: 5863008 - DNA, 16 bp, Homo sapiens
catctggaatctggag

SEQ ID NO: 5863009 - DNA, 21 bp, Homo sapiens
catctggaatctggagaccag

SEQ ID NO: 5863010 - DNA, 11 bp, Homo sapiens
catctggaggc

SEQ ID NO: 5863011 - DNA, 12 bp, Homo sapiens
catctggaggct

SEQ ID NO: 5863012 - DNA, 23 bp, Homo sapiens
catctggagttggagccgcacat

SEQ ID NO: 5863013 - DNA, 21 bp, Homo sapiens
catctggataggagcctgctg

SEQ ID NO: 5863014 - DNA, 22 bp, Homo sapiens
catctggataggagcctgctgg

SEQ ID NO: 5863015 - DNA, 23 bp, Homo sapiens
catctggataggagcctgctggt

SEQ ID NO: 5863016 - DNA, 17 bp, Homo sapiens
catctggatatcaaggt

SEQ ID NO: 5863017 - DNA, 18 bp, Homo sapiens
catctggatgccttcccc

SEQ ID NO: 5863018 - DNA, 11 bp, Homo sapiens
catctggatgt

SEQ ID NO: 5863019 - DNA, 15 bp, Homo sapiens
catctggatgtaaat

SEQ ID NO: 5863020 - DNA, 17 bp, Homo sapiens
catctggattctgccta

SEQ ID NO: 5863021 - DNA, 24 bp, Homo sapiens
catctggcacgtggccaggagcca

SEQ ID NO: 5863022 - DNA, 14 bp, Homo sapiens
catctggcccaggc

SEQ ID NO: 5863023 - DNA, 12 bp, Homo sapiens
catctggccctg

SEQ ID NO: 5863024 - DNA, 14 bp, Homo sapiens
catctggccctgct

SEQ ID NO: 5863025 - DNA, 17 bp, Homo sapiens
catctggccctgctgcc

SEQ ID NO: 5863026 - DNA, 18 bp, Homo sapiens
catctggccctgctgccc

SEQ ID NO: 5863027 - DNA, 11 bp, Homo sapiens
catctggccta

SEQ ID NO: 5863028 - DNA, 13 bp, Homo sapiens
catctggcctatg

SEQ ID NO: 5863029 - DNA, 22 bp, Homo sapiens
catctggcctatgaccctgtgc

SEQ ID NO: 5863030 - DNA, 18 bp, Homo sapiens
catctggcctggccagtg

SEQ ID NO: 5863031 - DNA, 15 bp, Homo sapiens
catctggcctggcct

SEQ ID NO: 5863032 - DNA, 18 bp, Homo sapiens
catctggcctggcctggc

SEQ ID NO: 5863033 - DNA, 23 bp, Homo sapiens
catctggcctggcctggccctgc

SEQ ID NO: 5863034 - DNA, 14 bp, Homo sapiens
catctggcctgggg

SEQ ID NO: 5863035 - DNA, 14 bp, Homo sapiens
catctggctctaat

SEQ ID NO: 5863036 - DNA, 20 bp, Homo sapiens
catctggctgcacaggctga

SEQ ID NO: 5863037 - DNA, 23 bp, Homo sapiens
catctggctggaaagcagagcct

SEQ ID NO: 5863038 - DNA, 18 bp, Homo sapiens
catctggctgtctagaat

SEQ ID NO: 5863039 - DNA, 21 bp, Homo sapiens
catctggctgtctagaatgtg

SEQ ID NO: 5863040 - DNA, 22 bp, Homo sapiens
catctggctgtctagaatgtgg

SEQ ID NO: 5863041 - DNA, 17 bp, Homo sapiens
catctggctgtttagca

SEQ ID NO: 5863042 - DNA, 20 bp, Homo sapiens
catctggctgtttagcagaa

SEQ ID NO: 5863043 - DNA, 21 bp, Homo sapiens
catctggctgtttagcagaac

SEQ ID NO: 5863044 - DNA, 22 bp, Homo sapiens
catctggctgtttagcagaact

SEQ ID NO: 5863045 - DNA, 23 bp, Homo sapiens
catctggctgtttagcagaactc

SEQ ID NO: 5863046 - DNA, 20 bp, Homo sapiens
catctggctttttctgccac

SEQ ID NO: 5863047 - DNA, 21 bp, Homo sapiens
catctgggaagatttctacct

SEQ ID NO: 5863048 - DNA, 17 bp, Homo sapiens
catctgggacaaaactg

SEQ ID NO: 5863049 - DNA, 15 bp, Homo sapiens
catctgggaggctgg

SEQ ID NO: 5863050 - DNA, 18 bp, Homo sapiens
catctgggaggctggtct

SEQ ID NO: 5863051 - DNA, 20 bp, Homo sapiens
catctgggaggctggtctcc

SEQ ID NO: 5863052 - DNA, 18 bp, Homo sapiens
catctgggagtccccttt

SEQ ID NO: 5863053 - DNA, 15 bp, Homo sapiens
catctgggccttggc

SEQ ID NO: 5863054 - DNA, 18 bp, Homo sapiens
catctgggccttggcctg

SEQ ID NO: 5863055 - DNA, 20 bp, Homo sapiens
catctgggccttggcctgga

SEQ ID NO: 5863056 - DNA, 20 bp, Homo sapiens
catctgggctcctccagggt

SEQ ID NO: 5863057 - DNA, 15 bp, Homo sapiens
catctgggctggcag

SEQ ID NO: 5863058 - DNA, 22 bp, Homo sapiens
catctgggctggcagaggggac

SEQ ID NO: 5863059 - DNA, 16 bp, Homo sapiens
catctgggggagtgga

SEQ ID NO: 5863060 - DNA, 19 bp, Homo sapiens
catctggggttggcaacag

SEQ ID NO: 5863061 - DNA, 21 bp, Homo sapiens
catctggggttggcaacagga

SEQ ID NO: 5863062 - DNA, 15 bp, Homo sapiens
catctgggtccttgc

SEQ ID NO: 5863063 - DNA, 14 bp, Homo sapiens
catctgggtgccct

SEQ ID NO: 5863064 - DNA, 16 bp, Homo sapiens
catctggtgcctttcc

SEQ ID NO: 5863065 - DNA, 18 bp, Homo sapiens
catctggtgtaggaagtt

SEQ ID NO: 5863066 - DNA, 17 bp, Homo sapiens
catctggttaggatggc

SEQ ID NO: 5863067 - DNA, 15 bp, Homo sapiens
catctggttttctct

SEQ ID NO: 5863068 - DNA, 19 bp, Homo sapiens
catctggttttctctccag

SEQ ID NO: 5863069 - DNA, 20 bp, Homo sapiens
catctgtaaaaccaggctga

SEQ ID NO: 5863070 - DNA, 13 bp, Homo sapiens
catctgtaaaata

SEQ ID NO: 5863071 - DNA, 11 bp, Homo sapiens
catctgtaaat

SEQ ID NO: 5863072 - DNA, 19 bp, Homo sapiens
catctgtaaatatcccaga

SEQ ID NO: 5863073 - DNA, 20 bp, Homo sapiens
catctgtaaatatcccagag

SEQ ID NO: 5863074 - DNA, 21 bp, Homo sapiens
catctgtaaatatcccagaga

SEQ ID NO: 5863075 - DNA, 16 bp, Homo sapiens
catctgtaactctaaa

SEQ ID NO: 5863076 - DNA, 14 bp, Homo sapiens
catctgtaagagct

SEQ ID NO: 5863077 - DNA, 17 bp, Homo sapiens
catctgtaagagcttgc

SEQ ID NO: 5863078 - DNA, 22 bp, Homo sapiens
catctgtaagagcttgctccag

SEQ ID NO: 5863079 - DNA, 12 bp, Homo sapiens
catctgtacaaa

SEQ ID NO: 5863080 - DNA, 22 bp, Homo sapiens
catctgtaccctgcttcccaaa

SEQ ID NO: 5863081 - DNA, 21 bp, Homo sapiens
catctgtacttggtccaactg

SEQ ID NO: 5863082 - DNA, 17 bp, Homo sapiens
catctgtaggtcactct

SEQ ID NO: 5863083 - DNA, 18 bp, Homo sapiens
catctgtaggtcactctc

SEQ ID NO: 5863084 - DNA, 23 bp, Homo sapiens
catctgtaggtcactctccagca

SEQ ID NO: 5863085 - DNA, 14 bp, Homo sapiens
catctgtagtcagc

SEQ ID NO: 5863086 - DNA, 20 bp, Homo sapiens
catctgtataagtaagaaaa

SEQ ID NO: 5863087 - DNA, 21 bp, Homo sapiens
catctgtataagtaagaaaat

SEQ ID NO: 5863088 - DNA, 18 bp, Homo sapiens
catctgtataccctctgt

SEQ ID NO: 5863089 - DNA, 21 bp, Homo sapiens
catctgtataccctctgtttc

SEQ ID NO: 5863090 - DNA, 19 bp, Homo sapiens
catctgtatgctggtagct

SEQ ID NO: 5863091 - DNA, 14 bp, Homo sapiens
catctgtcattata

SEQ ID NO: 5863092 - DNA, 23 bp, Homo sapiens
catctgtcattatattctaatta

SEQ ID NO: 5863093 - DNA, 23 bp, Homo sapiens
catctgtccacatccccagagcc

SEQ ID NO: 5863094 - DNA, 14 bp, Homo sapiens
catctgtccagctg

SEQ ID NO: 5863095 - DNA, 14 bp, Homo sapiens
catctgtccatcct

SEQ ID NO: 5863096 - DNA, 21 bp, Homo sapiens
catctgtccatcctcctctcc

SEQ ID NO: 5863097 - DNA, 22 bp, Homo sapiens
catctgtccatcctcctctcca

SEQ ID NO: 5863098 - DNA, 19 bp, Homo sapiens
catctgtcccactgggaca

SEQ ID NO: 5863099 - DNA, 17 bp, Homo sapiens
catctgtccctccggga

SEQ ID NO: 5863100 - DNA, 19 bp, Homo sapiens
catctgtccgtccagagcc

SEQ ID NO: 5863101 - DNA, 15 bp, Homo sapiens
catctgtctgctctg

SEQ ID NO: 5863102 - DNA, 15 bp, Homo sapiens
catctgtctggaggg

SEQ ID NO: 5863103 - DNA, 16 bp, Homo sapiens
catctgtctgtcctac

SEQ ID NO: 5863104 - DNA, 18 bp, Homo sapiens
catctgtctgtcctaccc

SEQ ID NO: 5863105 - DNA, 23 bp, Homo sapiens
catctgtctgtccttccttccat

SEQ ID NO: 5863106 - DNA, 14 bp, Homo sapiens
catctgtctgtctg

SEQ ID NO: 5863107 - DNA, 18 bp, Homo sapiens
catctgtctgtctgtggg

SEQ ID NO: 5863108 - DNA, 11 bp, Homo sapiens
catctgtcttc

SEQ ID NO: 5863109 - DNA, 18 bp, Homo sapiens
catctgtcttgccagcca

SEQ ID NO: 5863110 - DNA, 20 bp, Homo sapiens
catctgtcttgccagccaga

SEQ ID NO: 5863111 - DNA, 14 bp, Homo sapiens
catctgtgaataag

SEQ ID NO: 5863112 - DNA, 14 bp, Homo sapiens
catctgtgatggga

SEQ ID NO: 5863113 - DNA, 14 bp, Homo sapiens
catctgtgcaccac

SEQ ID NO: 5863114 - DNA, 18 bp, Homo sapiens
catctgtgcagggctggt

SEQ ID NO: 5863115 - DNA, 13 bp, Homo sapiens
catctgtgcctgt

SEQ ID NO: 5863116 - DNA, 15 bp, Homo sapiens
catctgtgcctgtct

SEQ ID NO: 5863117 - DNA, 17 bp, Homo sapiens
catctgtgcctgtctgt

SEQ ID NO: 5863118 - DNA, 13 bp, Homo sapiens
catctgtggagct

SEQ ID NO: 5863119 - DNA, 20 bp, Homo sapiens
catctgtggagctgccacag

SEQ ID NO: 5863120 - DNA, 22 bp, Homo sapiens
catctgtggagctgccacagag

SEQ ID NO: 5863121 - DNA, 15 bp, Homo sapiens
catctgtggcctggg

SEQ ID NO: 5863122 - DNA, 16 bp, Homo sapiens
catctgtgggatgctg

SEQ ID NO: 5863123 - DNA, 14 bp, Homo sapiens
catctgtggttttc

SEQ ID NO: 5863124 - DNA, 20 bp, Homo sapiens
catctgtgtaacctccacag

SEQ ID NO: 5863125 - DNA, 12 bp, Homo sapiens
catctgtgtatt

SEQ ID NO: 5863126 - DNA, 14 bp, Homo sapiens
catctgtgtcctgg

SEQ ID NO: 5863127 - DNA, 12 bp, Homo sapiens
catctgtgtctg

SEQ ID NO: 5863128 - DNA, 13 bp, Homo sapiens
catctgtgtctgt

SEQ ID NO: 5863129 - DNA, 13 bp, Homo sapiens
catctgtgttcta

SEQ ID NO: 5863130 - DNA, 17 bp, Homo sapiens
catctgtgtttcaagtg

SEQ ID NO: 5863131 - DNA, 17 bp, Homo sapiens
catctgttcatttctaa

SEQ ID NO: 5863132 - DNA, 16 bp, Homo sapiens
catctgttctatgctt

SEQ ID NO: 5863133 - DNA, 22 bp, Homo sapiens
catctgtttacactctttgcca

SEQ ID NO: 5863134 - DNA, 20 bp, Homo sapiens
catcttaaaagctatcttca

SEQ ID NO: 5863135 - DNA, 13 bp, Homo sapiens
catcttaaactaa

SEQ ID NO: 5863136 - DNA, 20 bp, Homo sapiens
catcttaaactaatacgtgc

SEQ ID NO: 5863137 - DNA, 15 bp, Homo sapiens
catgaccaaaaacca

SEQ ID NO: 5863138 - DNA, 14 bp, Homo sapiens
catgaccacataga

SEQ ID NO: 5863139 - DNA, 15 bp, Homo sapiens
catgaccacatagaa

SEQ ID NO: 5863140 - DNA, 17 bp, Homo sapiens
catgaccacatagcatg

SEQ ID NO: 5863141 - DNA, 14 bp, Homo sapiens
catgaccactcttg

SEQ ID NO: 5863142 - DNA, 18 bp, Homo sapiens
catgaccactcttggcta

SEQ ID NO: 5863143 - DNA, 13 bp, Homo sapiens
catgaccactggg

SEQ ID NO: 5863144 - DNA, 12 bp, Homo sapiens
catgaccagcaa

SEQ ID NO: 5863145 - DNA, 19 bp, Homo sapiens
catgaccagttctggccag

SEQ ID NO: 5863146 - DNA, 16 bp, Homo sapiens
catgacccagcctgaa

SEQ ID NO: 5863147 - DNA, 20 bp, Homo sapiens
catgaccccttctctctcca

SEQ ID NO: 5863148 - DNA, 22 bp, Homo sapiens
catgaccccttctctctccaga

SEQ ID NO: 5863149 - DNA, 15 bp, Homo sapiens
catgacccgtacaca

SEQ ID NO: 5863150 - DNA, 18 bp, Homo sapiens
catgacccgtacacacca

SEQ ID NO: 5863151 - DNA, 13 bp, Homo sapiens
catgaccctcctg

SEQ ID NO: 5863152 - DNA, 18 bp, Homo sapiens
catgaccctcctgtccag

SEQ ID NO: 5863153 - DNA, 18 bp, Homo sapiens
catgaccctctgtcccca

SEQ ID NO: 5863154 - DNA, 15 bp, Homo sapiens
catgaccctgcctct

SEQ ID NO: 5863155 - DNA, 13 bp, Homo sapiens
catgaccctgggc

SEQ ID NO: 5863156 - DNA, 15 bp, Homo sapiens
catgacctaaaacac

SEQ ID NO: 5863157 - DNA, 19 bp, Homo sapiens
catgacctaccaggacaga

SEQ ID NO: 5863158 - DNA, 15 bp, Homo sapiens
catgacctcattccg

SEQ ID NO: 5863159 - DNA, 14 bp, Homo sapiens
catgacctccagct

SEQ ID NO: 5863160 - DNA, 20 bp, Homo sapiens
catgacctccagctttcctg

SEQ ID NO: 5863161 - DNA, 13 bp, Homo sapiens
catgacctccatt

SEQ ID NO: 5863162 - DNA, 14 bp, Homo sapiens
catgaccttttggc

SEQ ID NO: 5863163 - DNA, 22 bp, Homo sapiens
catgaccttttggcctttgtaa

SEQ ID NO: 5863164 - DNA, 19 bp, Homo sapiens
catgacgacaaagctgcta

SEQ ID NO: 5863165 - DNA, 17 bp, Homo sapiens
catgacggagccgagcc

SEQ ID NO: 5863166 - DNA, 17 bp, Homo sapiens
catgacggcctgcctgc

SEQ ID NO: 5863167 - DNA, 21 bp, Homo sapiens
catgacggcttttgtcagtat

SEQ ID NO: 5863168 - DNA, 15 bp, Homo sapiens
catgacgtaaaattt

SEQ ID NO: 5863169 - DNA, 17 bp, Homo sapiens
catgacgtggtaaaatg

SEQ ID NO: 5863170 - DNA, 20 bp, Homo sapiens
catgactaatgctttttaga

SEQ ID NO: 5863171 - DNA, 15 bp, Homo sapiens
catgactagggtcct

SEQ ID NO: 5863172 - DNA, 19 bp, Homo sapiens
catgactagtgcctagaaa

SEQ ID NO: 5863173 - DNA, 20 bp, Homo sapiens
catgactagtgcctagaaag

SEQ ID NO: 5863174 - DNA, 22 bp, Homo sapiens
catgactatgtatttttctatg

SEQ ID NO: 5863175 - DNA, 20 bp, Homo sapiens
catgactcgtatatgtctca

SEQ ID NO: 5863176 - DNA, 13 bp, Homo sapiens
catgactcttgga

SEQ ID NO: 5863177 - DNA, 14 bp, Homo sapiens
catgactcttggag

SEQ ID NO: 5863178 - DNA, 22 bp, Homo sapiens
catgactgagtctggcaaacat

SEQ ID NO: 5863179 - DNA, 18 bp, Homo sapiens
catgactgcacccagctc

SEQ ID NO: 5863180 - DNA, 20 bp, Homo sapiens
catgactgcacccagctcca

SEQ ID NO: 5863181 - DNA, 21 bp, Homo sapiens
catgactgcacccagctccag

SEQ ID NO: 5863182 - DNA, 16 bp, Homo sapiens
catgactgcattttac

SEQ ID NO: 5863183 - DNA, 23 bp, Homo sapiens
catgactgcattttactgtacag

SEQ ID NO: 5863184 - DNA, 16 bp, Homo sapiens
catgactgctcaggcc

SEQ ID NO: 5863185 - DNA, 20 bp, Homo sapiens
catgactgctcaggcctcac

SEQ ID NO: 5863186 - DNA, 12 bp, Homo sapiens
catgactgcttg

SEQ ID NO: 5863187 - DNA, 17 bp, Homo sapiens
catgactggctaatttt

SEQ ID NO: 5863188 - DNA, 20 bp, Homo sapiens
catgactgggcctcccttgg

SEQ ID NO: 5863189 - DNA, 21 bp, Homo sapiens
catgactgggcctcccttggg

SEQ ID NO: 5863190 - DNA, 22 bp, Homo sapiens
catgactgggcctcccttgggc

SEQ ID NO: 5863191 - DNA, 23 bp, Homo sapiens
catgactggtgcgttcctaaact

SEQ ID NO: 5863192 - DNA, 13 bp, Homo sapiens
catgactgtgacc

SEQ ID NO: 5863193 - DNA, 22 bp, Homo sapiens
catgactgtgaccaccttctgt

SEQ ID NO: 5863194 - DNA, 22 bp, Homo sapiens
catgactgtgtgttgtgaaata

SEQ ID NO: 5863195 - DNA, 20 bp, Homo sapiens
catgacttccttatttctga

SEQ ID NO: 5863196 - DNA, 19 bp, Homo sapiens
catgacttgggctttctga

SEQ ID NO: 5863197 - DNA, 18 bp, Homo sapiens
catgactttatagttatg

SEQ ID NO: 5863198 - DNA, 15 bp, Homo sapiens
catgactttcagatt

SEQ ID NO: 5863199 - DNA, 19 bp, Homo sapiens
catgactttcagattgtat

SEQ ID NO: 5863200 - DNA, 23 bp, Homo sapiens
catgagaaaaactgttcttttgc

SEQ ID NO: 5863201 - DNA, 13 bp, Homo sapiens
catgagaaaggga

SEQ ID NO: 5863202 - DNA, 22 bp, Homo sapiens
catgagaaatacaaaaatactc

SEQ ID NO: 5863203 - DNA, 12 bp, Homo sapiens
catgagaaatgt

SEQ ID NO: 5863204 - DNA, 18 bp, Homo sapiens
catgagaactaaatagat

SEQ ID NO: 5863205 - DNA, 14 bp, Homo sapiens
catgagaagagggc

SEQ ID NO: 5863206 - DNA, 16 bp, Homo sapiens
catgagaagagggcct

SEQ ID NO: 5863207 - DNA, 22 bp, Homo sapiens
catgagaagccaagcgctcatg

SEQ ID NO: 5863208 - DNA, 20 bp, Homo sapiens
catgagaataagagaaagaa

SEQ ID NO: 5863209 - DNA, 12 bp, Homo sapiens
catgagaatcta

SEQ ID NO: 5863210 - DNA, 20 bp, Homo sapiens
catgagaatgtcatttgcta

SEQ ID NO: 5863211 - DNA, 22 bp, Homo sapiens
catgagaatgttttagcacagc

SEQ ID NO: 5863212 - DNA, 14 bp, Homo sapiens
catgagacacatct

SEQ ID NO: 5863213 - DNA, 19 bp, Homo sapiens
catgagacacatctcctcc

SEQ ID NO: 5863214 - DNA, 18 bp, Homo sapiens
catgagactatgtaaaaa

SEQ ID NO: 5863215 - DNA, 15 bp, Homo sapiens
catgagactcagtgc

SEQ ID NO: 5863216 - DNA, 19 bp, Homo sapiens
catgagactcagtgcagat

SEQ ID NO: 5863217 - DNA, 19 bp, Homo sapiens
catgagactgatccctggc

SEQ ID NO: 5863218 - DNA, 22 bp, Homo sapiens
catgagactttccgactgcttt

SEQ ID NO: 5863219 - DNA, 15 bp, Homo sapiens
catgagactttctgc

SEQ ID NO: 5863220 - DNA, 18 bp, Homo sapiens
catgagagcgcagcccgc

SEQ ID NO: 5863221 - DNA, 14 bp, Homo sapiens
catgagaggaggca

SEQ ID NO: 5863222 - DNA, 19 bp, Homo sapiens
catgagatgagatgaccac

SEQ ID NO: 5863223 - DNA, 17 bp, Homo sapiens
catgagatggagaggct

SEQ ID NO: 5863224 - DNA, 15 bp, Homo sapiens
catgagatgtgtgga

SEQ ID NO: 5863225 - DNA, 23 bp, Homo sapiens
catgagatgtgtggactgtggca

SEQ ID NO: 5863226 - DNA, 20 bp, Homo sapiens
catgagattggtcattaaat

SEQ ID NO: 5863227 - DNA, 14 bp, Homo sapiens
catgagattgtaca

SEQ ID NO: 5863228 - DNA, 16 bp, Homo sapiens
catgagcaattctcct

SEQ ID NO: 5863229 - DNA, 21 bp, Homo sapiens
catgagcaccccaaggctgcg

SEQ ID NO: 5863230 - DNA, 19 bp, Homo sapiens
catgagcacctccagctgt

SEQ ID NO: 5863231 - DNA, 20 bp, Homo sapiens
catgagcattggatacagca

SEQ ID NO: 5863232 - DNA, 22 bp, Homo sapiens
catgagccactgtgcttggcca

SEQ ID NO: 5863233 - DNA, 14 bp, Homo sapiens
catgagccagctct

SEQ ID NO: 5863234 - DNA, 12 bp, Homo sapiens
catgagcctcag

SEQ ID NO: 5863235 - DNA, 17 bp, Homo sapiens
catgagcctcagcatcc

SEQ ID NO: 5863236 - DNA, 21 bp, Homo sapiens
catgagcctcagcatcctggc

SEQ ID NO: 5863237 - DNA, 23 bp, Homo sapiens
catgagcctcagcatcctggcac

SEQ ID NO: 5863238 - DNA, 14 bp, Homo sapiens
catgagcctgctgg

SEQ ID NO: 5863239 - DNA, 18 bp, Homo sapiens
catgagcctgctggaagc

SEQ ID NO: 5863240 - DNA, 19 bp, Homo sapiens
catgagcctgctggaagcc

SEQ ID NO: 5863241 - DNA, 16 bp, Homo sapiens
catgagcgtccaggtg

SEQ ID NO: 5863242 - DNA, 17 bp, Homo sapiens
catgagcgtccaggtga

SEQ ID NO: 5863243 - DNA, 20 bp, Homo sapiens
catgagctacgcctgcctcc

SEQ ID NO: 5863244 - DNA, 13 bp, Homo sapiens
catgagctccaga

SEQ ID NO: 5863245 - DNA, 14 bp, Homo sapiens
catgagctccagac

SEQ ID NO: 5863246 - DNA, 17 bp, Homo sapiens
catgagctccagacccc

SEQ ID NO: 5863247 - DNA, 21 bp, Homo sapiens
catgagctccagacccccagc

SEQ ID NO: 5863248 - DNA, 16 bp, Homo sapiens
catgagctccctcgct

SEQ ID NO: 5863249 - DNA, 18 bp, Homo sapiens
catgagctccctcgctgt

SEQ ID NO: 5863250 - DNA, 22 bp, Homo sapiens
catgagctcctgatcagaggca

SEQ ID NO: 5863251 - DNA, 21 bp, Homo sapiens
catgagctcggggtccaccag

SEQ ID NO: 5863252 - DNA, 12 bp, Homo sapiens
catgagctgagt

SEQ ID NO: 5863253 - DNA, 19 bp, Homo sapiens
catgagctgctcattacag

SEQ ID NO: 5863254 - DNA, 17 bp, Homo sapiens
catgagctgctgtgccc

SEQ ID NO: 5863255 - DNA, 17 bp, Homo sapiens
catgagctgggtactga

SEQ ID NO: 5863256 - DNA, 21 bp, Homo sapiens
catgagctgtgttcacagacc

SEQ ID NO: 5863257 - DNA, 16 bp, Homo sapiens
catgaggaaagacaca

SEQ ID NO: 5863258 - DNA, 18 bp, Homo sapiens
catgaggaaagacacaga

SEQ ID NO: 5863259 - DNA, 22 bp, Homo sapiens
catgaggaaagcagttgaaatg

SEQ ID NO: 5863260 - DNA, 17 bp, Homo sapiens
catgaggaacaaggcaa

SEQ ID NO: 5863261 - DNA, 21 bp, Homo sapiens
catgaggaacaaggcaaggct

SEQ ID NO: 5863262 - DNA, 18 bp, Homo sapiens
catgaggacagaaggact

SEQ ID NO: 5863263 - DNA, 14 bp, Homo sapiens
catgaggaccaggg

SEQ ID NO: 5863264 - DNA, 21 bp, Homo sapiens
catgaggagattctgcctttg

SEQ ID NO: 5863265 - DNA, 23 bp, Homo sapiens
catgaggagattctgcctttgcc

SEQ ID NO: 5863266 - DNA, 19 bp, Homo sapiens
catgaggagcgtggactct

SEQ ID NO: 5863267 - DNA, 14 bp, Homo sapiens
catgaggaggcaga

SEQ ID NO: 5863268 - DNA, 18 bp, Homo sapiens
catgaggaggcagagagg

SEQ ID NO: 5863269 - DNA, 15 bp, Homo sapiens
catgaggagttgctg

SEQ ID NO: 5863270 - DNA, 16 bp, Homo sapiens
catgaggagttgctgt

SEQ ID NO: 5863271 - DNA, 13 bp, Homo sapiens
catgaggcagctt

SEQ ID NO: 5863272 - DNA, 22 bp, Homo sapiens
catgaggccactgctgcttctc

SEQ ID NO: 5863273 - DNA, 18 bp, Homo sapiens
catgaggccactggagac

SEQ ID NO: 5863274 - DNA, 19 bp, Homo sapiens
catgaggccatctcaggag

SEQ ID NO: 5863275 - DNA, 21 bp, Homo sapiens
catgaggccatctcaggagat

SEQ ID NO: 5863276 - DNA, 14 bp, Homo sapiens
catgaggcctcctg

SEQ ID NO: 5863277 - DNA, 15 bp, Homo sapiens
catgaggctcactca

SEQ ID NO: 5863278 - DNA, 16 bp, Homo sapiens
catgaggctcactcat

SEQ ID NO: 5863279 - DNA, 19 bp, Homo sapiens
catgagggaagaataaaga

SEQ ID NO: 5863280 - DNA, 18 bp, Homo sapiens
catgagggatcacagggc

SEQ ID NO: 5863281 - DNA, 14 bp, Homo sapiens
catgagggctgaga

SEQ ID NO: 5863282 - DNA, 16 bp, Homo sapiens
catgagggctgagatg

SEQ ID NO: 5863283 - DNA, 17 bp, Homo sapiens
catgagggctgagatgc

SEQ ID NO: 5863284 - DNA, 14 bp, Homo sapiens
catgaggggagagg

SEQ ID NO: 5863285 - DNA, 20 bp, Homo sapiens
catgaggggcccgagcagaa

SEQ ID NO: 5863286 - DNA, 18 bp, Homo sapiens
catgaggggttcctcccc

SEQ ID NO: 5863287 - DNA, 21 bp, Homo sapiens
catgaggggttcctcccctcc

SEQ ID NO: 5863288 - DNA, 22 bp, Homo sapiens
catgaggggttcctcccctcca

SEQ ID NO: 5863289 - DNA, 21 bp, Homo sapiens
catgaggtgttgtgcatttgt

SEQ ID NO: 5863290 - DNA, 23 bp, Homo sapiens
catgagtagtgggctatgcagga

SEQ ID NO: 5863291 - DNA, 17 bp, Homo sapiens
catgagtatctgtggga

SEQ ID NO: 5863292 - DNA, 20 bp, Homo sapiens
catgagtattcctagcaaat

SEQ ID NO: 5863293 - DNA, 14 bp, Homo sapiens
catgagtcaaaaca

SEQ ID NO: 5863294 - DNA, 16 bp, Homo sapiens
catgagtcaaaacaaa

SEQ ID NO: 5863295 - DNA, 17 bp, Homo sapiens
catgagtcaaaacaaag

SEQ ID NO: 5863296 - DNA, 12 bp, Homo sapiens
catgagtcccag

SEQ ID NO: 5863297 - DNA, 16 bp, Homo sapiens
catgagtcccagtggg

SEQ ID NO: 5863298 - DNA, 19 bp, Homo sapiens
catgagtcccagtgggagg

SEQ ID NO: 5863299 - DNA, 23 bp, Homo sapiens
catgagtcccctgtttgtttctg

SEQ ID NO: 5863300 - DNA, 15 bp, Homo sapiens
catgagtctgtagga

SEQ ID NO: 5863301 - DNA, 21 bp, Homo sapiens
catgagtctgtaggagcaagg

SEQ ID NO: 5863302 - DNA, 15 bp, Homo sapiens
catgagtctgtttcc

SEQ ID NO: 5863303 - DNA, 21 bp, Homo sapiens
catgagtctgtttcccaagct

SEQ ID NO: 5863304 - DNA, 15 bp, Homo sapiens
catgagtcttgtaat

SEQ ID NO: 5863305 - DNA, 14 bp, Homo sapiens
catgagtgcgtgct

SEQ ID NO: 5863306 - DNA, 19 bp, Homo sapiens
catgagtgctaagagcctc

SEQ ID NO: 5863307 - DNA, 17 bp, Homo sapiens
catgagtggagtttcca

SEQ ID NO: 5863308 - DNA, 15 bp, Homo sapiens
catgagtggatggat

SEQ ID NO: 5863309 - DNA, 16 bp, Homo sapiens
catgagtggatggatg

SEQ ID NO: 5863310 - DNA, 19 bp, Homo sapiens
catgagtggatggatggac

SEQ ID NO: 5863311 - DNA, 21 bp, Homo sapiens
catgagtggatggatggacag

SEQ ID NO: 5863312 - DNA, 18 bp, Homo sapiens
catgagttactgtgcatt

SEQ ID NO: 5863313 - DNA, 18 bp, Homo sapiens
catgagttatcatgaatt

SEQ ID NO: 5863314 - DNA, 16 bp, Homo sapiens
catgccccctcccttc

SEQ ID NO: 5863315 - DNA, 22 bp, Homo sapiens
catgccccctcccttcacaggg

SEQ ID NO: 5863316 - DNA, 11 bp, Homo sapiens
catgccccctg

SEQ ID NO: 5863317 - DNA, 14 bp, Homo sapiens
catgccccgatgtc

SEQ ID NO: 5863318 - DNA, 19 bp, Homo sapiens
catgccccggccacctctg

SEQ ID NO: 5863319 - DNA, 20 bp, Homo sapiens
catgccccggccacctctgc

SEQ ID NO: 5863320 - DNA, 12 bp, Homo sapiens
catgcccctccc

SEQ ID NO: 5863321 - DNA, 19 bp, Homo sapiens
catgcccctcccctccccg

SEQ ID NO: 5863322 - DNA, 14 bp, Homo sapiens
catgcccctgacag

SEQ ID NO: 5863323 - DNA, 15 bp, Homo sapiens
catgcccctggctgg

SEQ ID NO: 5863324 - DNA, 15 bp, Homo sapiens
catgccccttggtcc

SEQ ID NO: 5863325 - DNA, 20 bp, Homo sapiens
catgccccttggtcctggca

SEQ ID NO: 5863326 - DNA, 22 bp, Homo sapiens
catgcccgagtccgcccatccc

SEQ ID NO: 5863327 - DNA, 23 bp, Homo sapiens
catgcccgagtccgcccatccct

SEQ ID NO: 5863328 - DNA, 14 bp, Homo sapiens
catgcccgccagtg

SEQ ID NO: 5863329 - DNA, 17 bp, Homo sapiens
catgcccgctgtcccag

SEQ ID NO: 5863330 - DNA, 21 bp, Homo sapiens
catgcccggctaatttttgta

SEQ ID NO: 5863331 - DNA, 18 bp, Homo sapiens
catgcccggtcccacccc

SEQ ID NO: 5863332 - DNA, 21 bp, Homo sapiens
catgccctagaccctccccaa

SEQ ID NO: 5863333 - DNA, 17 bp, Homo sapiens
catgccctcaggcttgg

SEQ ID NO: 5863334 - DNA, 16 bp, Homo sapiens
catgccctcatcccga

SEQ ID NO: 5863335 - DNA, 21 bp, Homo sapiens
catgccctccactccactgcc

SEQ ID NO: 5863336 - DNA, 11 bp, Homo sapiens
catgccctccc

SEQ ID NO: 5863337 - DNA, 12 bp, Homo sapiens
catgccctccca

SEQ ID NO: 5863338 - DNA, 17 bp, Homo sapiens
catgccctccccacttc

SEQ ID NO: 5863339 - DNA, 13 bp, Homo sapiens
catgccctccctt

SEQ ID NO: 5863340 - DNA, 15 bp, Homo sapiens
catgccctcccttct

SEQ ID NO: 5863341 - DNA, 20 bp, Homo sapiens
catgccctcccttctccctg

SEQ ID NO: 5863342 - DNA, 15 bp, Homo sapiens
catgccctcctctcc

SEQ ID NO: 5863343 - DNA, 17 bp, Homo sapiens
catgccctcctctccca

SEQ ID NO: 5863344 - DNA, 15 bp, Homo sapiens
catgccctcctggac

SEQ ID NO: 5863345 - DNA, 22 bp, Homo sapiens
catgccctcggtcactgagtct

SEQ ID NO: 5863346 - DNA, 15 bp, Homo sapiens
catgccctctcaggc

SEQ ID NO: 5863347 - DNA, 13 bp, Homo sapiens
catgccctctctc

SEQ ID NO: 5863348 - DNA, 18 bp, Homo sapiens
catgccctctctcgggag

SEQ ID NO: 5863349 - DNA, 22 bp, Homo sapiens
catgccctctctcgggagccct

SEQ ID NO: 5863350 - DNA, 21 bp, Homo sapiens
catgccctctctgagtctgga

SEQ ID NO: 5863351 - DNA, 21 bp, Homo sapiens
catgccctgccaagcctggag

SEQ ID NO: 5863352 - DNA, 22 bp, Homo sapiens
catgccctgccaagcctggagc

SEQ ID NO: 5863353 - DNA, 13 bp, Homo sapiens
catgccctggacc

SEQ ID NO: 5863354 - DNA, 14 bp, Homo sapiens
catgccctggacca

SEQ ID NO: 5863355 - DNA, 20 bp, Homo sapiens
catgccctggaccagccgcc

SEQ ID NO: 5863356 - DNA, 23 bp, Homo sapiens
catgccctgtgcaacctcttggc

SEQ ID NO: 5863357 - DNA, 13 bp, Homo sapiens
catgccctgtgtg

SEQ ID NO: 5863358 - DNA, 17 bp, Homo sapiens
catgccctgtgtggctg

SEQ ID NO: 5863359 - DNA, 16 bp, Homo sapiens
catgcccttcctttct

SEQ ID NO: 5863360 - DNA, 12 bp, Homo sapiens
catgcccttctg

SEQ ID NO: 5863361 - DNA, 13 bp, Homo sapiens
catgcccttctga

SEQ ID NO: 5863362 - DNA, 20 bp, Homo sapiens
catgccgcgtccctgccccg

SEQ ID NO: 5863363 - DNA, 15 bp, Homo sapiens
catgccgggtgcagc

SEQ ID NO: 5863364 - DNA, 21 bp, Homo sapiens
catgccggtacacagccagta

SEQ ID NO: 5863365 - DNA, 15 bp, Homo sapiens
catgcctaaagccca

SEQ ID NO: 5863366 - DNA, 16 bp, Homo sapiens
catgcctacagataat

SEQ ID NO: 5863367 - DNA, 19 bp, Homo sapiens
catgcctacattagtgaga

SEQ ID NO: 5863368 - DNA, 17 bp, Homo sapiens
catgcctaccaatattt

SEQ ID NO: 5863369 - DNA, 20 bp, Homo sapiens
catgcctactaaatgtacag

SEQ ID NO: 5863370 - DNA, 22 bp, Homo sapiens
catgcctactaaatgtacagat

SEQ ID NO: 5863371 - DNA, 14 bp, Homo sapiens
catgcctagcagag

SEQ ID NO: 5863372 - DNA, 23 bp, Homo sapiens
catgcctagcagagtgctggcac

SEQ ID NO: 5863373 - DNA, 20 bp, Homo sapiens
catgcctatttactggaaac

SEQ ID NO: 5863374 - DNA, 16 bp, Homo sapiens
catgcctcaagaacac

SEQ ID NO: 5863375 - DNA, 18 bp, Homo sapiens
catgcctcactttcttct

SEQ ID NO: 5863376 - DNA, 11 bp, Homo sapiens
catgcctcagc

SEQ ID NO: 5863377 - DNA, 16 bp, Homo sapiens
catgcctcagccagcc

SEQ ID NO: 5863378 - DNA, 17 bp, Homo sapiens
catgcctcagccagccc

SEQ ID NO: 5863379 - DNA, 19 bp, Homo sapiens
catgcctcagccagccctg

SEQ ID NO: 5863380 - DNA, 14 bp, Homo sapiens
catgcctcagccct

SEQ ID NO: 5863381 - DNA, 20 bp, Homo sapiens
catgcctcagccctgaccct

SEQ ID NO: 5863382 - DNA, 17 bp, Homo sapiens
catgcctcagtttcccc

SEQ ID NO: 5863383 - DNA, 13 bp, Homo sapiens
catgcctcatgcc

SEQ ID NO: 5863384 - DNA, 15 bp, Homo sapiens
catgcctcatgccac

SEQ ID NO: 5863385 - DNA, 17 bp, Homo sapiens
catgcctcatgccacac

SEQ ID NO: 5863386 - DNA, 16 bp, Homo sapiens
catgcctcccaggcca

SEQ ID NO: 5863387 - DNA, 21 bp, Homo sapiens
catgcctccccctagccattt

SEQ ID NO: 5863388 - DNA, 22 bp, Homo sapiens
catgcctccctgggccacctcc

SEQ ID NO: 5863389 - DNA, 15 bp, Homo sapiens
catgcctcctcagga

SEQ ID NO: 5863390 - DNA, 12 bp, Homo sapiens
catgcctcctcc

SEQ ID NO: 5863391 - DNA, 18 bp, Homo sapiens
catgcctcctcctgccct

SEQ ID NO: 5863392 - DNA, 15 bp, Homo sapiens
catgcctctctcagg

SEQ ID NO: 5863393 - DNA, 13 bp, Homo sapiens
catgcctctgagg

SEQ ID NO: 5863394 - DNA, 17 bp, Homo sapiens
catgcctctgaggccag

SEQ ID NO: 5863395 - DNA, 22 bp, Homo sapiens
catgcctctgatatgggactga

SEQ ID NO: 5863396 - DNA, 19 bp, Homo sapiens
catgcctctggaggcctct

SEQ ID NO: 5863397 - DNA, 22 bp, Homo sapiens
catgcctctggaggcctctggc

SEQ ID NO: 5863398 - DNA, 23 bp, Homo sapiens
catgcctgagaatgcctaggcca

SEQ ID NO: 5863399 - DNA, 14 bp, Homo sapiens
catgcctgagagac

SEQ ID NO: 5863400 - DNA, 13 bp, Homo sapiens
catgcctgagggt

SEQ ID NO: 5863401 - DNA, 15 bp, Homo sapiens
catgcctgagggtgg

SEQ ID NO: 5863402 - DNA, 14 bp, Homo sapiens
catgcctgatgaaa

SEQ ID NO: 5863403 - DNA, 13 bp, Homo sapiens
catgcctgcacct

SEQ ID NO: 5863404 - DNA, 20 bp, Homo sapiens
catgcctgcgcctgctgcct

SEQ ID NO: 5863405 - DNA, 23 bp, Homo sapiens
catgcctgcgcctgctgcctgct

SEQ ID NO: 5863406 - DNA, 20 bp, Homo sapiens
catgcctgctccctgtctgt

SEQ ID NO: 5863407 - DNA, 21 bp, Homo sapiens
catgcctgctccctgtctgtg

SEQ ID NO: 5863408 - DNA, 15 bp, Homo sapiens
catgcctgctgagag

SEQ ID NO: 5863409 - DNA, 12 bp, Homo sapiens
catgcctggccc

SEQ ID NO: 5863410 - DNA, 21 bp, Homo sapiens
catgcctggcccccctccagg

SEQ ID NO: 5863411 - DNA, 15 bp, Homo sapiens
catgcctggcccctc

SEQ ID NO: 5863412 - DNA, 16 bp, Homo sapiens
catgcctggcccctcc

SEQ ID NO: 5863413 - DNA, 17 bp, Homo sapiens
catgcctggcccctcct

SEQ ID NO: 5863414 - DNA, 14 bp, Homo sapiens
catgcctggccctt

SEQ ID NO: 5863415 - DNA, 13 bp, Homo sapiens
catgcctggcctg

SEQ ID NO: 5863416 - DNA, 17 bp, Homo sapiens
catgcctgggcccaggc

SEQ ID NO: 5863417 - DNA, 12 bp, Homo sapiens
catgcctggggt

SEQ ID NO: 5863418 - DNA, 17 bp, Homo sapiens
catgcctggtattttca

SEQ ID NO: 5863419 - DNA, 18 bp, Homo sapiens
catgcctggtattttcaa

SEQ ID NO: 5863420 - DNA, 14 bp, Homo sapiens
catgcctgtaatcc

SEQ ID NO: 5863421 - DNA, 23 bp, Homo sapiens
catgcctgtaatcccagaacttt

SEQ ID NO: 5863422 - DNA, 22 bp, Homo sapiens
catgcctgtagctttcctggtc

SEQ ID NO: 5863423 - DNA, 18 bp, Homo sapiens
catgcctgtagtctcagc

SEQ ID NO: 5863424 - DNA, 21 bp, Homo sapiens
catgcctgtcctttcagtctg

SEQ ID NO: 5863425 - DNA, 17 bp, Homo sapiens
catgcctgtggctgcgc

SEQ ID NO: 5863426 - DNA, 14 bp, Homo sapiens
catgccttaaattt

SEQ ID NO: 5863427 - DNA, 15 bp, Homo sapiens
catgccttaaatttg

SEQ ID NO: 5863428 - DNA, 13 bp, Homo sapiens
catgccttccagc

SEQ ID NO: 5863429 - DNA, 15 bp, Homo sapiens
catgccttccagcac

SEQ ID NO: 5863430 - DNA, 13 bp, Homo sapiens
catgccttgataa

SEQ ID NO: 5863431 - DNA, 21 bp, Homo sapiens
catgccttgataaatatatat

SEQ ID NO: 5863432 - DNA, 17 bp, Homo sapiens
catgccttggtgccggt

SEQ ID NO: 5863433 - DNA, 12 bp, Homo sapiens
catgccttgtgc

SEQ ID NO: 5863434 - DNA, 15 bp, Homo sapiens
catgcctttatactt

SEQ ID NO: 5863435 - DNA, 20 bp, Homo sapiens
catgcctttatttctgtatc

SEQ ID NO: 5863436 - DNA, 19 bp, Homo sapiens
catgcctttcatagtttat

SEQ ID NO: 5863437 - DNA, 20 bp, Homo sapiens
catgcctttcatagtttatt

SEQ ID NO: 5863438 - DNA, 16 bp, Homo sapiens
catgcctttgtaagtt

SEQ ID NO: 5863439 - DNA, 22 bp, Homo sapiens
catgccttttgggtttgcctta

SEQ ID NO: 5863440 - DNA, 14 bp, Homo sapiens
catgcgaaatgttc

SEQ ID NO: 5863441 - DNA, 22 bp, Homo sapiens
catgcgacactgggaggccagt

SEQ ID NO: 5863442 - DNA, 19 bp, Homo sapiens
catgcgaggggccagcaga

SEQ ID NO: 5863443 - DNA, 21 bp, Homo sapiens
catgcgaggggccagcagagg

SEQ ID NO: 5863444 - DNA, 22 bp, Homo sapiens
catgcgaggggccagcagaggg

SEQ ID NO: 5863445 - DNA, 17 bp, Homo sapiens
catgcgatgacacttgt

SEQ ID NO: 5863446 - DNA, 18 bp, Homo sapiens
catgcgatgacacttgta

SEQ ID NO: 5863447 - DNA, 18 bp, Homo sapiens
catgcgcagaggccagtt

SEQ ID NO: 5863448 - DNA, 15 bp, Homo sapiens
catgcgcagatgagg

SEQ ID NO: 5863449 - DNA, 19 bp, Homo sapiens
catgcgcagatgaggggcc

SEQ ID NO: 5863450 - DNA, 20 bp, Homo sapiens
catgcgcagatgaggggcca

SEQ ID NO: 5863451 - DNA, 22 bp, Homo sapiens
catgcgctcagggccatgctga

SEQ ID NO: 5863452 - DNA, 23 bp, Homo sapiens
catgcgctcagggccatgctgag

SEQ ID NO: 5863453 - DNA, 16 bp, Homo sapiens
catgcgctcctggctt

SEQ ID NO: 5863454 - DNA, 19 bp, Homo sapiens
catgcgctgctcaacctct

SEQ ID NO: 5863455 - DNA, 16 bp, Homo sapiens
catgcggagaacaaat

SEQ ID NO: 5863456 - DNA, 23 bp, Homo sapiens
catgcggagaacaaatgtgaagg

SEQ ID NO: 5863457 - DNA, 15 bp, Homo sapiens
catgcggagccagca

SEQ ID NO: 5863458 - DNA, 14 bp, Homo sapiens
catgcggcccagcc

SEQ ID NO: 5863459 - DNA, 19 bp, Homo sapiens
catgcggcccagcccggct

SEQ ID NO: 5863460 - DNA, 13 bp, Homo sapiens
catgcggctgccc

SEQ ID NO: 5863461 - DNA, 20 bp, Homo sapiens
catgcgggctgggcagctgt

SEQ ID NO: 5863462 - DNA, 21 bp, Homo sapiens
catgcgggctgggcagctgtt

SEQ ID NO: 5863463 - DNA, 16 bp, Homo sapiens
catgcggtagccagca

SEQ ID NO: 5863464 - DNA, 17 bp, Homo sapiens
catgcggtagccagcac

SEQ ID NO: 5863465 - DNA, 23 bp, Homo sapiens
catgcggtgccatgaagggaccc

SEQ ID NO: 5863466 - DNA, 21 bp, Homo sapiens
catgcgtccactttcccttcc

SEQ ID NO: 5863467 - DNA, 19 bp, Homo sapiens
catgcgtgccgcctgctcc

SEQ ID NO: 5863468 - DNA, 22 bp, Homo sapiens
catgcgtgggtggggagggagg

SEQ ID NO: 5863469 - DNA, 18 bp, Homo sapiens
catgcgtgtgtcagggat

SEQ ID NO: 5863470 - DNA, 16 bp, Homo sapiens
catgcgtgtttctgac

SEQ ID NO: 5863471 - DNA, 14 bp, Homo sapiens
catgctaaaattct

SEQ ID NO: 5863472 - DNA, 17 bp, Homo sapiens
catgctaacaaagacaa

SEQ ID NO: 5863473 - DNA, 16 bp, Homo sapiens
catgctaagaaagcaa

SEQ ID NO: 5863474 - DNA, 16 bp, Homo sapiens
catgctaagagaagta

SEQ ID NO: 5863475 - DNA, 21 bp, Homo sapiens
catgctaagagaagtagaaat

SEQ ID NO: 5863476 - DNA, 15 bp, Homo sapiens
catgctaagcaagct

SEQ ID NO: 5863477 - DNA, 22 bp, Homo sapiens
catgctaatataagtttctttg

SEQ ID NO: 5863478 - DNA, 23 bp, Homo sapiens
catgctacacactgcatgtttgt

SEQ ID NO: 5863479 - DNA, 20 bp, Homo sapiens
catgctacctgatcccactc

SEQ ID NO: 5863480 - DNA, 15 bp, Homo sapiens
catgctactaaattt

SEQ ID NO: 5863481 - DNA, 14 bp, Homo sapiens
catgctaggatgcg

SEQ ID NO: 5863482 - DNA, 14 bp, Homo sapiens
catgctagtgttgt

SEQ ID NO: 5863483 - DNA, 20 bp, Homo sapiens
catgctagtgttgtatttct

SEQ ID NO: 5863484 - DNA, 20 bp, Homo sapiens
catgctatccaatctcatct

SEQ ID NO: 5863485 - DNA, 16 bp, Homo sapiens
catgctatctctgtgt

SEQ ID NO: 5863486 - DNA, 17 bp, Homo sapiens
catgctatgtgcacagc

SEQ ID NO: 5863487 - DNA, 14 bp, Homo sapiens
catgctatgttctg

SEQ ID NO: 5863488 - DNA, 19 bp, Homo sapiens
catgctatgttctgtcttc

SEQ ID NO: 5863489 - DNA, 21 bp, Homo sapiens
catgctatgttctgtcttccc

SEQ ID NO: 5863490 - DNA, 22 bp, Homo sapiens
catgctatttgttcttcaagaa

SEQ ID NO: 5863491 - DNA, 13 bp, Homo sapiens
catgctcaaatga

SEQ ID NO: 5863492 - DNA, 17 bp, Homo sapiens
catgctcaaccactgtg

SEQ ID NO: 5863493 - DNA, 18 bp, Homo sapiens
catgctcaaccactgtgg

SEQ ID NO: 5863494 - DNA, 19 bp, Homo sapiens
catgctcaaccactgtggc

SEQ ID NO: 5863495 - DNA, 13 bp, Homo sapiens
catgctcaacccc

SEQ ID NO: 5863496 - DNA, 14 bp, Homo sapiens
catgctcaaccccc

SEQ ID NO: 5863497 - DNA, 20 bp, Homo sapiens
catgctcaacccccctccca

SEQ ID NO: 5863498 - DNA, 21 bp, Homo sapiens
catgctcaacccccctcccag

SEQ ID NO: 5863499 - DNA, 22 bp, Homo sapiens
catgctcaacccccctcccaga

SEQ ID NO: 5863500 - DNA, 18 bp, Homo sapiens
catgctcaactaatttta

SEQ ID NO: 5863501 - DNA, 12 bp, Homo sapiens
catgctcacaca

SEQ ID NO: 5863502 - DNA, 14 bp, Homo sapiens
catgctcacacatt

SEQ ID NO: 5863503 - DNA, 22 bp, Homo sapiens
catgctcacacattacaacagt

SEQ ID NO: 5863504 - DNA, 14 bp, Homo sapiens
catgctcacctcta

SEQ ID NO: 5863505 - DNA, 19 bp, Homo sapiens
catgctcacttttgtgaaa

SEQ ID NO: 5863506 - DNA, 9 bp, Homo sapiens
catgctcag

SEQ ID NO: 5863507 - DNA, 16 bp, Homo sapiens
catgctcagcccttcc

SEQ ID NO: 5863508 - DNA, 16 bp, Homo sapiens
catgctcagccttgct

SEQ ID NO: 5863509 - DNA, 18 bp, Homo sapiens
catgctcagccttgctgc

SEQ ID NO: 5863510 - DNA, 20 bp, Homo sapiens
catgctcagccttgctgctc

SEQ ID NO: 5863511 - DNA, 15 bp, Homo sapiens
catgctccaaatata

SEQ ID NO: 5863512 - DNA, 16 bp, Homo sapiens
catgctccactatttt

SEQ ID NO: 5863513 - DNA, 19 bp, Homo sapiens
catgctccactattttatt

SEQ ID NO: 5863514 - DNA, 22 bp, Homo sapiens
catgctccagattagagcctgt

SEQ ID NO: 5863515 - DNA, 17 bp, Homo sapiens
catgctcccaaatgcag

SEQ ID NO: 5863516 - DNA, 19 bp, Homo sapiens
catgctcccaaatgcagct

SEQ ID NO: 5863517 - DNA, 12 bp, Homo sapiens
catgctcccagc

SEQ ID NO: 5863518 - DNA, 15 bp, Homo sapiens
catgctcccagcatt

SEQ ID NO: 5863519 - DNA, 18 bp, Homo sapiens
catgctcctctgcctgtg

SEQ ID NO: 5863520 - DNA, 22 bp, Homo sapiens
catgctcctctgcctgtgcccg

SEQ ID NO: 5863521 - DNA, 14 bp, Homo sapiens
catgctcctcttcc

SEQ ID NO: 5863522 - DNA, 18 bp, Homo sapiens
catgctcctcttccccag

SEQ ID NO: 5863523 - DNA, 14 bp, Homo sapiens
catgctcctggccc

SEQ ID NO: 5863524 - DNA, 22 bp, Homo sapiens
catgctccttaatggcgccatg

SEQ ID NO: 5863525 - DNA, 17 bp, Homo sapiens
catgctccttgagagga

SEQ ID NO: 5863526 - DNA, 13 bp, Homo sapiens
catgctctcaata

SEQ ID NO: 5863527 - DNA, 14 bp, Homo sapiens
catgctctctcacc

SEQ ID NO: 5863528 - DNA, 16 bp, Homo sapiens
catgctctctcacctg

SEQ ID NO: 5863529 - DNA, 17 bp, Homo sapiens
catgctctctcacctgc

SEQ ID NO: 5863530 - DNA, 21 bp, Homo sapiens
catgctctctcacctgctccc

SEQ ID NO: 5863531 - DNA, 14 bp, Homo sapiens
catgctctgcccca

SEQ ID NO: 5863532 - DNA, 22 bp, Homo sapiens
catgctctgccccaagccccca

SEQ ID NO: 5863533 - DNA, 14 bp, Homo sapiens
catgctctggaagc

SEQ ID NO: 5863534 - DNA, 21 bp, Homo sapiens
catgctctggaagcctggact

SEQ ID NO: 5863535 - DNA, 19 bp, Homo sapiens
catgctcttacccacacta

SEQ ID NO: 5863536 - DNA, 21 bp, Homo sapiens
catgctcttgaccttgtagag

SEQ ID NO: 5863537 - DNA, 21 bp, Homo sapiens
catgctctttcaccctgccac

SEQ ID NO: 5863538 - DNA, 22 bp, Homo sapiens
catgctgaacaaggggcctcca

SEQ ID NO: 5863539 - DNA, 19 bp, Homo sapiens
catgctgaagggaccttga

SEQ ID NO: 5863540 - DNA, 18 bp, Homo sapiens
catgctgaatccacctcg

SEQ ID NO: 5863541 - DNA, 21 bp, Homo sapiens
catgctgaatccacctcggag

SEQ ID NO: 5863542 - DNA, 16 bp, Homo sapiens
catgctgagacatccc

SEQ ID NO: 5863543 - DNA, 17 bp, Homo sapiens
catgctgagagctgggc

SEQ ID NO: 5863544 - DNA, 17 bp, Homo sapiens
catgctgaggcctgggc

SEQ ID NO: 5863545 - DNA, 18 bp, Homo sapiens
catgctgaggcctgggcc

SEQ ID NO: 5863546 - DNA, 18 bp, Homo sapiens
catgctgagtcatgtctt

SEQ ID NO: 5863547 - DNA, 15 bp, Homo sapiens
catgctgagtctccc

SEQ ID NO: 5863548 - DNA, 17 bp, Homo sapiens
catgctgagtctcccaa

SEQ ID NO: 5863549 - DNA, 18 bp, Homo sapiens
catgctgataatcatttt

SEQ ID NO: 5863550 - DNA, 19 bp, Homo sapiens
catgctgataatcattttg

SEQ ID NO: 5863551 - DNA, 15 bp, Homo sapiens
catgctgatttacca

SEQ ID NO: 5863552 - DNA, 17 bp, Homo sapiens
catgctgccaatatcct

SEQ ID NO: 5863553 - DNA, 19 bp, Homo sapiens
catgctgccaatatcctaa

SEQ ID NO: 5863554 - DNA, 11 bp, Homo sapiens
catgctgccca

SEQ ID NO: 5863555 - DNA, 18 bp, Homo sapiens
catgctgcccaccccctg

SEQ ID NO: 5863556 - DNA, 15 bp, Homo sapiens
catgctgccctgtga

SEQ ID NO: 5863557 - DNA, 18 bp, Homo sapiens
catgctgccctgtgagta

SEQ ID NO: 5863558 - DNA, 22 bp, Homo sapiens
catgctgcctgcctccggccct

SEQ ID NO: 5863559 - DNA, 15 bp, Homo sapiens
catgctgcctggcac

SEQ ID NO: 5863560 - DNA, 20 bp, Homo sapiens
catgctgcctggcacagacc

SEQ ID NO: 5863561 - DNA, 14 bp, Homo sapiens
catgctgccttctt

SEQ ID NO: 5863562 - DNA, 15 bp, Homo sapiens
catgctgctagatct

SEQ ID NO: 5863563 - DNA, 17 bp, Homo sapiens
catgctgctatacacaa

SEQ ID NO: 5863564 - DNA, 22 bp, Homo sapiens
catgctgctatgaagactactt

SEQ ID NO: 5863565 - DNA, 17 bp, Homo sapiens
catgctgctggggaaga

SEQ ID NO: 5863566 - DNA, 18 bp, Homo sapiens
catgctgctttaattgtg

SEQ ID NO: 5863567 - DNA, 14 bp, Homo sapiens
catgctgctttgca

SEQ ID NO: 5863568 - DNA, 15 bp, Homo sapiens
catgctgctttgcac

SEQ ID NO: 5863569 - DNA, 18 bp, Homo sapiens
catgctggacaggtctgg

SEQ ID NO: 5863570 - DNA, 12 bp, Homo sapiens
catgctggagcc

SEQ ID NO: 5863571 - DNA, 13 bp, Homo sapiens
catgctggagcct

SEQ ID NO: 5863572 - DNA, 17 bp, Homo sapiens
catgctggagcctgtgt

SEQ ID NO: 5863573 - DNA, 19 bp, Homo sapiens
catgctggagcctgtgtaa

SEQ ID NO: 5863574 - DNA, 22 bp, Homo sapiens
catgctggaggtgacatctctt

SEQ ID NO: 5863575 - DNA, 22 bp, Homo sapiens
catgctggagtacccagcctat

SEQ ID NO: 5863576 - DNA, 19 bp, Homo sapiens
catgctggatactggacac

SEQ ID NO: 5863577 - DNA, 12 bp, Homo sapiens
catgctggatga

SEQ ID NO: 5863578 - DNA, 13 bp, Homo sapiens
catgctggccagc

SEQ ID NO: 5863579 - DNA, 15 bp, Homo sapiens
catgctggccagcct

SEQ ID NO: 5863580 - DNA, 20 bp, Homo sapiens
catgctggcctcccaataaa

SEQ ID NO: 5863581 - DNA, 23 bp, Homo sapiens
catgctggcctcccaataaagct

SEQ ID NO: 5863582 - DNA, 14 bp, Homo sapiens
catgctggcctgtg

SEQ ID NO: 5863583 - DNA, 17 bp, Homo sapiens
catgctggcctgtggca

SEQ ID NO: 5863584 - DNA, 18 bp, Homo sapiens
catgctggcggcgcagag

SEQ ID NO: 5863585 - DNA, 20 bp, Homo sapiens
catgctggctcccagggcca

SEQ ID NO: 5863586 - DNA, 12 bp, Homo sapiens
catgctggctgg

SEQ ID NO: 5863587 - DNA, 15 bp, Homo sapiens
catgctggctggggc

SEQ ID NO: 5863588 - DNA, 14 bp, Homo sapiens
catgctgggatttc

SEQ ID NO: 5863589 - DNA, 18 bp, Homo sapiens
catgctgggttctgcaca

SEQ ID NO: 5863590 - DNA, 16 bp, Homo sapiens
catgctggtgtggcca

SEQ ID NO: 5863591 - DNA, 21 bp, Homo sapiens
catgctgtacatactttttgg

SEQ ID NO: 5863592 - DNA, 23 bp, Homo sapiens
catgctgtccctgcactgtgccc

SEQ ID NO: 5863593 - DNA, 18 bp, Homo sapiens
catgctgtccctgtgggc

SEQ ID NO: 5863594 - DNA, 19 bp, Homo sapiens
catgctgtccctgtgggct

SEQ ID NO: 5863595 - DNA, 22 bp, Homo sapiens
catgctgtcccttacgtgagtc

SEQ ID NO: 5863596 - DNA, 17 bp, Homo sapiens
catgctgtccgtgcttg

SEQ ID NO: 5863597 - DNA, 20 bp, Homo sapiens
catgctgtccgtgcttgctg

SEQ ID NO: 5863598 - DNA, 23 bp, Homo sapiens
catgctgtctacactaagagaga

SEQ ID NO: 5863599 - DNA, 12 bp, Homo sapiens
catgctgtctgg

SEQ ID NO: 5863600 - DNA, 18 bp, Homo sapiens
catgctgtctggcacagc

SEQ ID NO: 5863601 - DNA, 21 bp, Homo sapiens
catgctgtctggcacagcctg

SEQ ID NO: 5863602 - DNA, 19 bp, Homo sapiens
catgctgtctggccctggg

SEQ ID NO: 5863603 - DNA, 22 bp, Homo sapiens
catgctgtctgtgtgaggctcc

SEQ ID NO: 5863604 - DNA, 14 bp, Homo sapiens
catgctgtgcattt

SEQ ID NO: 5863605 - DNA, 15 bp, Homo sapiens
catgctgtgcatttt

SEQ ID NO: 5863606 - DNA, 13 bp, Homo sapiens
catgctgtgctct

SEQ ID NO: 5863607 - DNA, 15 bp, Homo sapiens
catgctgtgctcttt

SEQ ID NO: 5863608 - DNA, 19 bp, Homo sapiens
catgctgtgctctttgaag

SEQ ID NO: 5863609 - DNA, 18 bp, Homo sapiens
catgctgtgtaagctgtg

SEQ ID NO: 5863610 - DNA, 19 bp, Homo sapiens
catgctgtgtaagctgtgt

SEQ ID NO: 5863611 - DNA, 21 bp, Homo sapiens
catgctgtgtgactcaaacca

SEQ ID NO: 5863612 - DNA, 15 bp, Homo sapiens
catgctgttcatgaa

SEQ ID NO: 5863613 - DNA, 16 bp, Homo sapiens
catgctgttcatgaaa

SEQ ID NO: 5863614 - DNA, 20 bp, Homo sapiens
catgctgttcatgaaagatt

SEQ ID NO: 5863615 - DNA, 20 bp, Homo sapiens
catgctgttctctttgctga

SEQ ID NO: 5863616 - DNA, 16 bp, Homo sapiens
catgctgttgattgct

SEQ ID NO: 5863617 - DNA, 17 bp, Homo sapiens
catgctgttgattgcta

SEQ ID NO: 5863618 - DNA, 18 bp, Homo sapiens
catgctgttgattgctaa

SEQ ID NO: 5863619 - DNA, 21 bp, Homo sapiens
catgctgttgattgctaaatg

SEQ ID NO: 5863620 - DNA, 22 bp, Homo sapiens
catgctgttgattgctaaatgt

SEQ ID NO: 5863621 - DNA, 19 bp, Homo sapiens
catgctgttggcctcaagc

SEQ ID NO: 5863622 - DNA, 21 bp, Homo sapiens
catgcttaagggggtgtaatg

SEQ ID NO: 5863623 - DNA, 13 bp, Homo sapiens
catgcttaataaa

SEQ ID NO: 5863624 - DNA, 14 bp, Homo sapiens
catgcttaataaac

SEQ ID NO: 5863625 - DNA, 15 bp, Homo sapiens
catgcttacttttta

SEQ ID NO: 5863626 - DNA, 15 bp, Homo sapiens
catgcttagagcatg

SEQ ID NO: 5863627 - DNA, 13 bp, Homo sapiens
catgcttagctta

SEQ ID NO: 5863628 - DNA, 21 bp, Homo sapiens
catgcttagcttatctttctt

SEQ ID NO: 5863629 - DNA, 22 bp, Homo sapiens
catgcttagcttatctttcttt

SEQ ID NO: 5863630 - DNA, 15 bp, Homo sapiens
catgcttagtcactg

SEQ ID NO: 5863631 - DNA, 17 bp, Homo sapiens
catgcttagtcactgcc

SEQ ID NO: 5863632 - DNA, 21 bp, Homo sapiens
catgcttattagcagctgggt

SEQ ID NO: 5863633 - DNA, 16 bp, Homo sapiens
catgcttattccatga

SEQ ID NO: 5863634 - DNA, 21 bp, Homo sapiens
catgcttattccatgactgct

SEQ ID NO: 5863635 - DNA, 16 bp, Homo sapiens
catgcttcacaatgtt

SEQ ID NO: 5863636 - DNA, 13 bp, Homo sapiens
catgcttcccaga

SEQ ID NO: 5863637 - DNA, 14 bp, Homo sapiens
catgcttcccagag

SEQ ID NO: 5863638 - DNA, 14 bp, Homo sapiens
catgcttccctgca

SEQ ID NO: 5863639 - DNA, 18 bp, Homo sapiens
catgcttccctgcagctg

SEQ ID NO: 5863640 - DNA, 19 bp, Homo sapiens
catgcttccctgcagctga

SEQ ID NO: 5863641 - DNA, 15 bp, Homo sapiens
catgcttcctttctc

SEQ ID NO: 5863642 - DNA, 18 bp, Homo sapiens
catgcttcctttctctcc

SEQ ID NO: 5863643 - DNA, 23 bp, Homo sapiens
catgcttcctttctctcctggct

SEQ ID NO: 5863644 - DNA, 21 bp, Homo sapiens
catgcttctactgtgacactt

SEQ ID NO: 5863645 - DNA, 14 bp, Homo sapiens
catgcttctcaccg

SEQ ID NO: 5863646 - DNA, 17 bp, Homo sapiens
catgcttctcaccgtgc

SEQ ID NO: 5863647 - DNA, 16 bp, Homo sapiens
catgcttcttccttac

SEQ ID NO: 5863648 - DNA, 12 bp, Homo sapiens
catgcttcttgc

SEQ ID NO: 5863649 - DNA, 18 bp, Homo sapiens
catgcttgaatggagctg

SEQ ID NO: 5863650 - DNA, 13 bp, Homo sapiens
catgcttgacata

SEQ ID NO: 5863651 - DNA, 14 bp, Homo sapiens
catgcttgacatac

SEQ ID NO: 5863652 - DNA, 21 bp, Homo sapiens
catgcttgggctgacccagca

SEQ ID NO: 5863653 - DNA, 22 bp, Homo sapiens
catgcttgggctgacccagcat

SEQ ID NO: 5863654 - DNA, 15 bp, Homo sapiens
catgctttaaagtgt

SEQ ID NO: 5863655 - DNA, 23 bp, Homo sapiens
catgctttaaagtgtaataatat

SEQ ID NO: 5863656 - DNA, 22 bp, Homo sapiens
catgctttcacctacacaagca

SEQ ID NO: 5863657 - DNA, 17 bp, Homo sapiens
catgctttccatatttt

SEQ ID NO: 5863658 - DNA, 23 bp, Homo sapiens
catgctttccttttcttccttct

SEQ ID NO: 5863659 - DNA, 17 bp, Homo sapiens
catgctttctccttttt

SEQ ID NO: 5863660 - DNA, 22 bp, Homo sapiens
catgctttgaaaaatcacttga

SEQ ID NO: 5863661 - DNA, 22 bp, Homo sapiens
catgctttggaaatttggaaga

SEQ ID NO: 5863662 - DNA, 17 bp, Homo sapiens
catgctttgtgaacaag

SEQ ID NO: 5863663 - DNA, 15 bp, Homo sapiens
catgcttttacttta

SEQ ID NO: 5863664 - DNA, 17 bp, Homo sapiens
catgcttttctgccact

SEQ ID NO: 5863665 - DNA, 20 bp, Homo sapiens
catgcttttctgccactcca

SEQ ID NO: 5863666 - DNA, 15 bp, Homo sapiens
catgctttttggtga

SEQ ID NO: 5863667 - DNA, 15 bp, Homo sapiens
catggaaaaatgcca

SEQ ID NO: 5863668 - DNA, 21 bp, Homo sapiens
catggaaaaatgccatcaaat

SEQ ID NO: 5863669 - DNA, 21 bp, Homo sapiens
catgggaggcctttccctaag

SEQ ID NO: 5863670 - DNA, 20 bp, Homo sapiens
catgggagggagctgagaag

SEQ ID NO: 5863671 - DNA, 13 bp, Homo sapiens
catgggagggagg

SEQ ID NO: 5863672 - DNA, 12 bp, Homo sapiens
catgggagggat

SEQ ID NO: 5863673 - DNA, 15 bp, Homo sapiens
catgggagggatcag

SEQ ID NO: 5863674 - DNA, 19 bp, Homo sapiens
catgggagggatcagcccc

SEQ ID NO: 5863675 - DNA, 12 bp, Homo sapiens
catgggaggggg

SEQ ID NO: 5863676 - DNA, 17 bp, Homo sapiens
catgggagtcagggagc

SEQ ID NO: 5863677 - DNA, 20 bp, Homo sapiens
catgggagtcagggagccct

SEQ ID NO: 5863678 - DNA, 17 bp, Homo sapiens
catgggatatgtggtgt

SEQ ID NO: 5863679 - DNA, 20 bp, Homo sapiens
catgggcaactcgtgacagc

SEQ ID NO: 5863680 - DNA, 16 bp, Homo sapiens
catgggcaccaggcaa

SEQ ID NO: 5863681 - DNA, 17 bp, Homo sapiens
catgggcacctcatgga

SEQ ID NO: 5863682 - DNA, 18 bp, Homo sapiens
catgggcacctctgctgt

SEQ ID NO: 5863683 - DNA, 13 bp, Homo sapiens
catgggcactgct

SEQ ID NO: 5863684 - DNA, 19 bp, Homo sapiens
catgggcactgctgggtgg

SEQ ID NO: 5863685 - DNA, 17 bp, Homo sapiens
catgggcagagcccaag

SEQ ID NO: 5863686 - DNA, 13 bp, Homo sapiens
catgggcagccca

SEQ ID NO: 5863687 - DNA, 20 bp, Homo sapiens
catgggcataggtaagctgt

SEQ ID NO: 5863688 - DNA, 16 bp, Homo sapiens
catgggcattgcagcc

SEQ ID NO: 5863689 - DNA, 21 bp, Homo sapiens
catgggcattgcagccttgcg

SEQ ID NO: 5863690 - DNA, 19 bp, Homo sapiens
catgggcattgctggactg

SEQ ID NO: 5863691 - DNA, 17 bp, Homo sapiens
catgggcattgggttct

SEQ ID NO: 5863692 - DNA, 14 bp, Homo sapiens
catgggccaccacg

SEQ ID NO: 5863693 - DNA, 15 bp, Homo sapiens
catgggccaccgccc

SEQ ID NO: 5863694 - DNA, 13 bp, Homo sapiens
catgggccagagc

SEQ ID NO: 5863695 - DNA, 15 bp, Homo sapiens
catgggccagagcct

SEQ ID NO: 5863696 - DNA, 16 bp, Homo sapiens
catgggccagagcctc

SEQ ID NO: 5863697 - DNA, 22 bp, Homo sapiens
catgggccagagcctcggccct

SEQ ID NO: 5863698 - DNA, 14 bp, Homo sapiens
catgggccagcccc

SEQ ID NO: 5863699 - DNA, 17 bp, Homo sapiens
catgggccagcccctcc

SEQ ID NO: 5863700 - DNA, 16 bp, Homo sapiens
catgggccagcccttg

SEQ ID NO: 5863701 - DNA, 19 bp, Homo sapiens
catgggccagcccttgctc

SEQ ID NO: 5863702 - DNA, 15 bp, Homo sapiens
catgggccagcctag

SEQ ID NO: 5863703 - DNA, 20 bp, Homo sapiens
catgggcccaggcctcacca

SEQ ID NO: 5863704 - DNA, 17 bp, Homo sapiens
catgggccccccatgca

SEQ ID NO: 5863705 - DNA, 14 bp, Homo sapiens
catgggcccctctg

SEQ ID NO: 5863706 - DNA, 21 bp, Homo sapiens
catgggcccgctgcctcttgg

SEQ ID NO: 5863707 - DNA, 14 bp, Homo sapiens
catgggcctcccac

SEQ ID NO: 5863708 - DNA, 18 bp, Homo sapiens
catgggcctcctgtgtgt

SEQ ID NO: 5863709 - DNA, 18 bp, Homo sapiens
catgggcctctctggggg

SEQ ID NO: 5863710 - DNA, 19 bp, Homo sapiens
catgggcctctctggggga

SEQ ID NO: 5863711 - DNA, 21 bp, Homo sapiens
catgggcctctctgggggagg

SEQ ID NO: 5863712 - DNA, 14 bp, Homo sapiens
catgggcctgctgc

SEQ ID NO: 5863713 - DNA, 24 bp, Homo sapiens
catgggcctggccacctctctcct

SEQ ID NO: 5863714 - DNA, 17 bp, Homo sapiens
catgggcctgggcctgc

SEQ ID NO: 5863715 - DNA, 20 bp, Homo sapiens
catgggcctttaagaacctt

SEQ ID NO: 5863716 - DNA, 15 bp, Homo sapiens
catgggcgcaggccc

SEQ ID NO: 5863717 - DNA, 18 bp, Homo sapiens
catgggcgcaggcccagt

SEQ ID NO: 5863718 - DNA, 22 bp, Homo sapiens
catgggctagtgtgagtggcag

SEQ ID NO: 5863719 - DNA, 23 bp, Homo sapiens
catgggctagtgtgagtggcagc

SEQ ID NO: 5863720 - DNA, 15 bp, Homo sapiens
catgggctcagggcc

SEQ ID NO: 5863721 - DNA, 19 bp, Homo sapiens
catgggctcagggccaggt

SEQ ID NO: 5863722 - DNA, 17 bp, Homo sapiens
catgggctcctgcccct

SEQ ID NO: 5863723 - DNA, 14 bp, Homo sapiens
catgggctctggcc

SEQ ID NO: 5863724 - DNA, 15 bp, Homo sapiens
catgggctctggccc

SEQ ID NO: 5863725 - DNA, 14 bp, Homo sapiens
catgggcttcactg

SEQ ID NO: 5863726 - DNA, 17 bp, Homo sapiens
catgggcttcactgtat

SEQ ID NO: 5863727 - DNA, 13 bp, Homo sapiens
catgggcttggac

SEQ ID NO: 5863728 - DNA, 20 bp, Homo sapiens
catgggcttggacttcctgg

SEQ ID NO: 5863729 - DNA, 21 bp, Homo sapiens
catgggcttgtgacattcgtg

SEQ ID NO: 5863730 - DNA, 17 bp, Homo sapiens
catggggaaaccctgga

SEQ ID NO: 5863731 - DNA, 20 bp, Homo sapiens
catggggaaaccctggagcc

SEQ ID NO: 5863732 - DNA, 13 bp, Homo sapiens
catggggaaggca

SEQ ID NO: 5863733 - DNA, 22 bp, Homo sapiens
catggggaaggcagaggctggc

SEQ ID NO: 5863734 - DNA, 24 bp, Homo sapiens
catggggaaggcagaggctggcac

SEQ ID NO: 5863735 - DNA, 24 bp, Homo sapiens
catggggaagtgctccccacacgt

SEQ ID NO: 5863736 - DNA, 11 bp, Homo sapiens
catggggagga

SEQ ID NO: 5863737 - DNA, 12 bp, Homo sapiens
catggggaggag

SEQ ID NO: 5863738 - DNA, 18 bp, Homo sapiens
catggggaggaggagggt

SEQ ID NO: 5863739 - DNA, 15 bp, Homo sapiens
catggggaggcagca

SEQ ID NO: 5863740 - DNA, 17 bp, Homo sapiens
catggggaggcagcaga

SEQ ID NO: 5863741 - DNA, 18 bp, Homo sapiens
catggggaggcagcagag

SEQ ID NO: 5863742 - DNA, 19 bp, Homo sapiens
catggggaggcagcagagc

SEQ ID NO: 5863743 - DNA, 20 bp, Homo sapiens
catggggaggcagcagagcg

SEQ ID NO: 5863744 - DNA, 23 bp, Homo sapiens
catggggagggattctggttcca

SEQ ID NO: 5863745 - DNA, 19 bp, Homo sapiens
catggggatcaattttcat

SEQ ID NO: 5863746 - DNA, 21 bp, Homo sapiens
catggggatcagagtctggcc

SEQ ID NO: 5863747 - DNA, 17 bp, Homo sapiens
catggggatctgggggg

SEQ ID NO: 5863748 - DNA, 22 bp, Homo sapiens
catggggattgcagagtgacca

SEQ ID NO: 5863749 - DNA, 13 bp, Homo sapiens
catggggcaagcc

SEQ ID NO: 5863750 - DNA, 16 bp, Homo sapiens
catggggcaagccagg

SEQ ID NO: 5863751 - DNA, 15 bp, Homo sapiens
catggggcagaggct

SEQ ID NO: 5863752 - DNA, 13 bp, Homo sapiens
catggggcagcct

SEQ ID NO: 5863753 - DNA, 14 bp, Homo sapiens
catggggcagcctc

SEQ ID NO: 5863754 - DNA, 13 bp, Homo sapiens
catggggcataga

SEQ ID NO: 5863755 - DNA, 15 bp, Homo sapiens
catggggcatgtcct

SEQ ID NO: 5863756 - DNA, 11 bp, Homo sapiens
catggggccag

SEQ ID NO: 5863757 - DNA, 13 bp, Homo sapiens
catggggccagga

SEQ ID NO: 5863758 - DNA, 15 bp, Homo sapiens
catggggcccctggc

SEQ ID NO: 5863759 - DNA, 18 bp, Homo sapiens
catggggcccctggccca

SEQ ID NO: 5863760 - DNA, 15 bp, Homo sapiens
catggggcgctccca

SEQ ID NO: 5863761 - DNA, 19 bp, Homo sapiens
catggggcgctcccactca

SEQ ID NO: 5863762 - DNA, 17 bp, Homo sapiens
catggggctgggcagct

SEQ ID NO: 5863763 - DNA, 20 bp, Homo sapiens
catggggctggggtcctcct

SEQ ID NO: 5863764 - DNA, 23 bp, Homo sapiens
catggggctggggtcctcctgtg

SEQ ID NO: 5863765 - DNA, 18 bp, Homo sapiens
catgggggaccccttccc

SEQ ID NO: 5863766 - DNA, 13 bp, Homo sapiens
catgggggaggct

SEQ ID NO: 5863767 - DNA, 19 bp, Homo sapiens
catgggggagggggcagaa

SEQ ID NO: 5863768 - DNA, 13 bp, Homo sapiens
catgggggcaggg

SEQ ID NO: 5863769 - DNA, 19 bp, Homo sapiens
catgggggcagggcatgac

SEQ ID NO: 5863770 - DNA, 13 bp, Homo sapiens
catgggggcccaa

SEQ ID NO: 5863771 - DNA, 16 bp, Homo sapiens
catgggggctcagcca

SEQ ID NO: 5863772 - DNA, 14 bp, Homo sapiens
catgggggctgcca

SEQ ID NO: 5863773 - DNA, 17 bp, Homo sapiens
catgggggtaagaaaag

SEQ ID NO: 5863774 - DNA, 20 bp, Homo sapiens
catgggggtattatccattc

SEQ ID NO: 5863775 - DNA, 16 bp, Homo sapiens
catgggggtgacccca

SEQ ID NO: 5863776 - DNA, 20 bp, Homo sapiens
catggggtcagccccaaggg

SEQ ID NO: 5863777 - DNA, 23 bp, Homo sapiens
catggggtcagccccaagggctg

SEQ ID NO: 5863778 - DNA, 15 bp, Homo sapiens
catggggtccttgga

SEQ ID NO: 5863779 - DNA, 20 bp, Homo sapiens
catggggtcggctcctgatg

SEQ ID NO: 5863780 - DNA, 15 bp, Homo sapiens
catggggtggaagga

SEQ ID NO: 5863781 - DNA, 15 bp, Homo sapiens
catggggtgggcctc

SEQ ID NO: 5863782 - DNA, 14 bp, Homo sapiens
catggggtgggggt

SEQ ID NO: 5863783 - DNA, 14 bp, Homo sapiens
catggggttcctgg

SEQ ID NO: 5863784 - DNA, 16 bp, Homo sapiens
catggggttcctggtt

SEQ ID NO: 5863785 - DNA, 23 bp, Homo sapiens
catgggtaatccgttcatagaaa

SEQ ID NO: 5863786 - DNA, 22 bp, Homo sapiens
catgggtactgtctcggcagag

SEQ ID NO: 5863787 - DNA, 22 bp, Homo sapiens
catgggtcagggtgtgaggcca

SEQ ID NO: 5863788 - DNA, 17 bp, Homo sapiens
catgggtccaagagaca

SEQ ID NO: 5863789 - DNA, 19 bp, Homo sapiens
catgggtccaagagacatg

SEQ ID NO: 5863790 - DNA, 23 bp, Homo sapiens
catgggtccaagagacatggaag

SEQ ID NO: 5863791 - DNA, 19 bp, Homo sapiens
catgggtccagaagacgtg

SEQ ID NO: 5863792 - DNA, 15 bp, Homo sapiens
catgggtccagggcc

SEQ ID NO: 5863793 - DNA, 22 bp, Homo sapiens
catgggtcctagcccttccctg

SEQ ID NO: 5863794 - DNA, 15 bp, Homo sapiens
catgggtcgcccatg

SEQ ID NO: 5863795 - DNA, 19 bp, Homo sapiens
catgggtcgggagagggga

SEQ ID NO: 5863796 - DNA, 14 bp, Homo sapiens
catgggtctggcct

SEQ ID NO: 5863797 - DNA, 15 bp, Homo sapiens
catgggtctggcctg

SEQ ID NO: 5863798 - DNA, 23 bp, Homo sapiens
catgggtctggctagagggccca

SEQ ID NO: 5863799 - DNA, 19 bp, Homo sapiens
catgggtgaagggagagcc

SEQ ID NO: 5863800 - DNA, 16 bp, Homo sapiens
catgggtgagacctga

SEQ ID NO: 5863801 - DNA, 18 bp, Homo sapiens
catgggtgagacctgacc

SEQ ID NO: 5863802 - DNA, 18 bp, Homo sapiens
catgggtgctattggggt

SEQ ID NO: 5863803 - DNA, 21 bp, Homo sapiens
catgggtgctattggggttgg

SEQ ID NO: 5863804 - DNA, 23 bp, Homo sapiens
catgggtgctattggggttgggg

SEQ ID NO: 5863805 - DNA, 13 bp, Homo sapiens
catgggtggaggg

SEQ ID NO: 5863806 - DNA, 23 bp, Homo sapiens
catgggtggctgtgacaaccctg

SEQ ID NO: 5863807 - DNA, 11 bp, Homo sapiens
catgggtgggg

SEQ ID NO: 5863808 - DNA, 17 bp, Homo sapiens
catgggtgtggatggca

SEQ ID NO: 5863809 - DNA, 15 bp, Homo sapiens
catgggttatgtgta

SEQ ID NO: 5863810 - DNA, 16 bp, Homo sapiens
catgggttttgtaggt

SEQ ID NO: 5863811 - DNA, 23 bp, Homo sapiens
catgggttttgtaggtacttttg

SEQ ID NO: 5863812 - DNA, 18 bp, Homo sapiens
catggtaaccagccacag

SEQ ID NO: 5863813 - DNA, 13 bp, Homo sapiens
catggtaatgtaa

SEQ ID NO: 5863814 - DNA, 13 bp, Homo sapiens
catggtaatttat

SEQ ID NO: 5863815 - DNA, 19 bp, Homo sapiens
catggtacccccttctggg

SEQ ID NO: 5863816 - DNA, 16 bp, Homo sapiens
catggtacttcctctg

SEQ ID NO: 5863817 - DNA, 16 bp, Homo sapiens
catggtagaaaatgca

SEQ ID NO: 5863818 - DNA, 22 bp, Homo sapiens
catggtagcagggtctttgtgt

SEQ ID NO: 5863819 - DNA, 16 bp, Homo sapiens
catggtagtttaaaac

SEQ ID NO: 5863820 - DNA, 20 bp, Homo sapiens
catggtataaggaaatatca

SEQ ID NO: 5863821 - DNA, 14 bp, Homo sapiens
catggtatctcttt

SEQ ID NO: 5863822 - DNA, 23 bp, Homo sapiens
catggtatttgaccattttagtt

SEQ ID NO: 5863823 - DNA, 16 bp, Homo sapiens
catggtcaaccctcag

SEQ ID NO: 5863824 - DNA, 19 bp, Homo sapiens
catggtcaagcctcttatg

SEQ ID NO: 5863825 - DNA, 13 bp, Homo sapiens
catggtcacagac

SEQ ID NO: 5863826 - DNA, 15 bp, Homo sapiens
catggtcacagaccc

SEQ ID NO: 5863827 - DNA, 17 bp, Homo sapiens
catggtcacagacccct

SEQ ID NO: 5863828 - DNA, 18 bp, Homo sapiens
catggtcacagacccctg

SEQ ID NO: 5863829 - DNA, 23 bp, Homo sapiens
catggtcacagacccctggggga

SEQ ID NO: 5863830 - DNA, 14 bp, Homo sapiens
catggtcacagaga

SEQ ID NO: 5863831 - DNA, 15 bp, Homo sapiens
catggtcacagtcct

SEQ ID NO: 5863832 - DNA, 14 bp, Homo sapiens
catggtcaccctca

SEQ ID NO: 5863833 - DNA, 15 bp, Homo sapiens
catggtcaccctcag

SEQ ID NO: 5863834 - DNA, 16 bp, Homo sapiens
catggtcaccctcagg

SEQ ID NO: 5863835 - DNA, 17 bp, Homo sapiens
catggtcagctcacacc

SEQ ID NO: 5863836 - DNA, 14 bp, Homo sapiens
catggtcagtctac

SEQ ID NO: 5863837 - DNA, 20 bp, Homo sapiens
catggtccatttcatgtgat

SEQ ID NO: 5863838 - DNA, 22 bp, Homo sapiens
catggtccatttcatgtgatct

SEQ ID NO: 5863839 - DNA, 18 bp, Homo sapiens
catggtcccacatccctg

SEQ ID NO: 5863840 - DNA, 23 bp, Homo sapiens
catggtcccacatccctgggcct

SEQ ID NO: 5863841 - DNA, 15 bp, Homo sapiens
catggtcccacttcc

SEQ ID NO: 5863842 - DNA, 14 bp, Homo sapiens
catggtccctgcct

SEQ ID NO: 5863843 - DNA, 17 bp, Homo sapiens
catggtccggtgtcctt

SEQ ID NO: 5863844 - DNA, 20 bp, Homo sapiens
catggtccggtgtccttttc

SEQ ID NO: 5863845 - DNA, 14 bp, Homo sapiens
catggtcctggctg

SEQ ID NO: 5863846 - DNA, 15 bp, Homo sapiens
catggtcctgtctgt

SEQ ID NO: 5863847 - DNA, 23 bp, Homo sapiens
catggtcctgtctgtccttctga

SEQ ID NO: 5863848 - DNA, 16 bp, Homo sapiens
catggtcctgtgcccc

SEQ ID NO: 5863849 - DNA, 17 bp, Homo sapiens
catggtctctgcaccca

SEQ ID NO: 5863850 - DNA, 14 bp, Homo sapiens
catggtctcttcca

SEQ ID NO: 5863851 - DNA, 16 bp, Homo sapiens
catggtctgccctctg

SEQ ID NO: 5863852 - DNA, 14 bp, Homo sapiens
catggtctgtcctg

SEQ ID NO: 5863853 - DNA, 22 bp, Homo sapiens
catggtctgtcctgacagcact

SEQ ID NO: 5863854 - DNA, 20 bp, Homo sapiens
catggtctttccactttcat

SEQ ID NO: 5863855 - DNA, 13 bp, Homo sapiens
catggtctttgct

SEQ ID NO: 5863856 - DNA, 20 bp, Homo sapiens
catggtgaaaccccatctct

SEQ ID NO: 5863857 - DNA, 17 bp, Homo sapiens
catggtgaaaccccatt

SEQ ID NO: 5863858 - DNA, 18 bp, Homo sapiens
catggtgaaacccccatc

SEQ ID NO: 5863859 - DNA, 19 bp, Homo sapiens
catggtgaactgaagcaga

SEQ ID NO: 5863860 - DNA, 20 bp, Homo sapiens
catggtgaactgaagcagag

SEQ ID NO: 5863861 - DNA, 22 bp, Homo sapiens
catggtgaaggtttttgtttct

SEQ ID NO: 5863862 - DNA, 16 bp, Homo sapiens
catggtgaattaatca

SEQ ID NO: 5863863 - DNA, 23 bp, Homo sapiens
catggtgaccaccccctgttccc

SEQ ID NO: 5863864 - DNA, 16 bp, Homo sapiens
catggtgactgccaca

SEQ ID NO: 5863865 - DNA, 16 bp, Homo sapiens
catggtgatcagtgca

SEQ ID NO: 5863866 - DNA, 18 bp, Homo sapiens
catggtgattccagcaag

SEQ ID NO: 5863867 - DNA, 16 bp, Homo sapiens
catggtgcaatttgtc

SEQ ID NO: 5863868 - DNA, 21 bp, Homo sapiens
catggtgcagttgacagcagg

SEQ ID NO: 5863869 - DNA, 16 bp, Homo sapiens
catggtgccccaggac

SEQ ID NO: 5863870 - DNA, 17 bp, Homo sapiens
catggtgccccaggacc

SEQ ID NO: 5863871 - DNA, 19 bp, Homo sapiens
catggtgccccaggaccag

SEQ ID NO: 5863872 - DNA, 22 bp, Homo sapiens
catggtgccccaggaccagctc

SEQ ID NO: 5863873 - DNA, 14 bp, Homo sapiens
catggtgcctatat

SEQ ID NO: 5863874 - DNA, 14 bp, Homo sapiens
catggtgcctctgg

SEQ ID NO: 5863875 - DNA, 16 bp, Homo sapiens
catggtgcctctggag

SEQ ID NO: 5863876 - DNA, 13 bp, Homo sapiens
catggtgcctgag

SEQ ID NO: 5863877 - DNA, 19 bp, Homo sapiens
catggtgcctgagaggcag

SEQ ID NO: 5863878 - DNA, 22 bp, Homo sapiens
catggtgcctgagaggcaggca

SEQ ID NO: 5863879 - DNA, 22 bp, Homo sapiens
catggtgctaggaagaggagtg

SEQ ID NO: 5863880 - DNA, 22 bp, Homo sapiens
catggtgctgggagaggcagcc

SEQ ID NO: 5863881 - DNA, 14 bp, Homo sapiens
catggtgctgtgtg

SEQ ID NO: 5863882 - DNA, 16 bp, Homo sapiens
catggtggacccagcg

SEQ ID NO: 5863883 - DNA, 22 bp, Homo sapiens
catggtggacccagcgggcagg

SEQ ID NO: 5863884 - DNA, 16 bp, Homo sapiens
catggtggagggcact

SEQ ID NO: 5863885 - DNA, 20 bp, Homo sapiens
catggtggagggcacttcag

SEQ ID NO: 5863886 - DNA, 21 bp, Homo sapiens
catggtggatatggtgcagag

SEQ ID NO: 5863887 - DNA, 20 bp, Homo sapiens
catggtggcacacgcctgta

SEQ ID NO: 5863888 - DNA, 23 bp, Homo sapiens
catggtggcaccagcgaagggag

SEQ ID NO: 5863889 - DNA, 19 bp, Homo sapiens
catggtggcacgtgcctgt

SEQ ID NO: 5863890 - DNA, 14 bp, Homo sapiens
catggtggcaggcg

SEQ ID NO: 5863891 - DNA, 20 bp, Homo sapiens
catggtggcatgcacctgca

SEQ ID NO: 5863892 - DNA, 12 bp, Homo sapiens
catggtggcgca

SEQ ID NO: 5863893 - DNA, 21 bp, Homo sapiens
catggtgggtccatgggcaga

SEQ ID NO: 5863894 - DNA, 17 bp, Homo sapiens
catggtgtgccacaggc

SEQ ID NO: 5863895 - DNA, 13 bp, Homo sapiens
catggtgtggcca

SEQ ID NO: 5863896 - DNA, 13 bp, Homo sapiens
catggtgtggggg

SEQ ID NO: 5863897 - DNA, 17 bp, Homo sapiens
catggtgtgtggtgcta

SEQ ID NO: 5863898 - DNA, 17 bp, Homo sapiens
catggtgtgtgtctctg

SEQ ID NO: 5863899 - DNA, 17 bp, Homo sapiens
catggtgttcatgacaa

SEQ ID NO: 5863900 - DNA, 19 bp, Homo sapiens
catggtgttctcctgctgc

SEQ ID NO: 5863901 - DNA, 17 bp, Homo sapiens
catggtgttggaggggc

SEQ ID NO: 5863902 - DNA, 21 bp, Homo sapiens
catggtgttggaggggcaggc

SEQ ID NO: 5863903 - DNA, 22 bp, Homo sapiens
catggtgtttaaaatttaaatc

SEQ ID NO: 5863904 - DNA, 21 bp, Homo sapiens
catggtgttttcattccccct

SEQ ID NO: 5863905 - DNA, 19 bp, Homo sapiens
catggttaagagtccaaga

SEQ ID NO: 5863906 - DNA, 19 bp, Homo sapiens
catggttaaggtaaagtaa

SEQ ID NO: 5863907 - DNA, 19 bp, Homo sapiens
catggttaccatgtctttc

SEQ ID NO: 5863908 - DNA, 13 bp, Homo sapiens
catggttcaagta

SEQ ID NO: 5863909 - DNA, 16 bp, Homo sapiens
catggttcaagtatta

SEQ ID NO: 5863910 - DNA, 17 bp, Homo sapiens
catggttcaagtattaa

SEQ ID NO: 5863911 - DNA, 23 bp, Homo sapiens
catggttcaagtattaagcagtt

SEQ ID NO: 5863912 - DNA, 23 bp, Homo sapiens
catggttcattttctgatgccca

SEQ ID NO: 5863913 - DNA, 14 bp, Homo sapiens
catggttccttccc

SEQ ID NO: 5863914 - DNA, 16 bp, Homo sapiens
catggttctgcctcct

SEQ ID NO: 5863915 - DNA, 13 bp, Homo sapiens
catggttgttgca

SEQ ID NO: 5863916 - DNA, 21 bp, Homo sapiens
catggtttagataaaggaaac

SEQ ID NO: 5863917 - DNA, 14 bp, Homo sapiens
catggtttggagct

SEQ ID NO: 5863918 - DNA, 15 bp, Homo sapiens
catggtttggagctg

SEQ ID NO: 5863919 - DNA, 19 bp, Homo sapiens
catggttttggctctccca

SEQ ID NO: 5863920 - DNA, 20 bp, Homo sapiens
catggttttggctctcccac

SEQ ID NO: 5863921 - DNA, 23 bp, Homo sapiens
catggttttggctctcccacccc

SEQ ID NO: 5863922 - DNA, 16 bp, Homo sapiens
catggtttttataata

SEQ ID NO: 5863923 - DNA, 21 bp, Homo sapiens
catggtttttgctctacttta

SEQ ID NO: 5863924 - DNA, 22 bp, Homo sapiens
catggtttttgctctactttat

SEQ ID NO: 5863925 - DNA, 15 bp, Homo sapiens
catgtaaaaagacaa

SEQ ID NO: 5863926 - DNA, 16 bp, Homo sapiens
catgtaaaaagacaaa

SEQ ID NO: 5863927 - DNA, 13 bp, Homo sapiens
catgtaaaacaaa

SEQ ID NO: 5863928 - DNA, 14 bp, Homo sapiens
catgtaaaacaaaa

SEQ ID NO: 5863929 - DNA, 22 bp, Homo sapiens
catgtaaaacaaaaaacaatat

SEQ ID NO: 5863930 - DNA, 14 bp, Homo sapiens
catgtaaaagccta

SEQ ID NO: 5863931 - DNA, 12 bp, Homo sapiens
catgtaaaatat

SEQ ID NO: 5863932 - DNA, 15 bp, Homo sapiens
catgtaaaatatgta

SEQ ID NO: 5863933 - DNA, 14 bp, Homo sapiens
catgtaaaatcttc

SEQ ID NO: 5863934 - DNA, 21 bp, Homo sapiens
catgtaaaatcttcagctggt

SEQ ID NO: 5863935 - DNA, 13 bp, Homo sapiens
catgtaaaatgca

SEQ ID NO: 5863936 - DNA, 15 bp, Homo sapiens
catgtaaaatgcagt

SEQ ID NO: 5863937 - DNA, 12 bp, Homo sapiens
catgtaaaatgt

SEQ ID NO: 5863938 - DNA, 13 bp, Homo sapiens
catgtaaaatgtt

SEQ ID NO: 5863939 - DNA, 14 bp, Homo sapiens
catgtaaaatgttt

SEQ ID NO: 5863940 - DNA, 15 bp, Homo sapiens
catgtaaacaaatat

SEQ ID NO: 5863941 - DNA, 16 bp, Homo sapiens
catgtaaagaaatgtc

SEQ ID NO: 5863942 - DNA, 19 bp, Homo sapiens
catgtaaagctgttaaaat

SEQ ID NO: 5863943 - DNA, 15 bp, Homo sapiens
catgtaaaggccttt

SEQ ID NO: 5863944 - DNA, 15 bp, Homo sapiens
catgtaaataagatg

SEQ ID NO: 5863945 - DNA, 14 bp, Homo sapiens
catgtaaataatac

SEQ ID NO: 5863946 - DNA, 15 bp, Homo sapiens
catgtaaataatctg

SEQ ID NO: 5863947 - DNA, 17 bp, Homo sapiens
catgtaaataatctgtg

SEQ ID NO: 5863948 - DNA, 22 bp, Homo sapiens
catgtaaataatctgtgagtga

SEQ ID NO: 5863949 - DNA, 23 bp, Homo sapiens
catgtaaataccagactgcaggt

SEQ ID NO: 5863950 - DNA, 14 bp, Homo sapiens
catgtaaatgctca

SEQ ID NO: 5863951 - DNA, 22 bp, Homo sapiens
catgtaaatgtattggcacagt

SEQ ID NO: 5863952 - DNA, 18 bp, Homo sapiens
catgtaaattaagtgtgt

SEQ ID NO: 5863953 - DNA, 21 bp, Homo sapiens
catgtaaattaagtgtgtgta

SEQ ID NO: 5863954 - DNA, 16 bp, Homo sapiens
catgtaaattttgtat

SEQ ID NO: 5863955 - DNA, 14 bp, Homo sapiens
catgtaacaatgtt

SEQ ID NO: 5863956 - DNA, 19 bp, Homo sapiens
catgtaacacataaacaat

SEQ ID NO: 5863957 - DNA, 13 bp, Homo sapiens
catgtaacagaaa

SEQ ID NO: 5863958 - DNA, 14 bp, Homo sapiens
catgtaacagttgt

SEQ ID NO: 5863959 - DNA, 15 bp, Homo sapiens
catgtaacagttgtg

SEQ ID NO: 5863960 - DNA, 17 bp, Homo sapiens
catgtaacattggtgaa

SEQ ID NO: 5863961 - DNA, 22 bp, Homo sapiens
catgtaacattggtgaaggatc

SEQ ID NO: 5863962 - DNA, 17 bp, Homo sapiens
catgtaaccactgcact

SEQ ID NO: 5863963 - DNA, 16 bp, Homo sapiens
catgtaactatagact

SEQ ID NO: 5863964 - DNA, 18 bp, Homo sapiens
catgtaactatttcttca

SEQ ID NO: 5863965 - DNA, 14 bp, Homo sapiens
catgtaactctcca

SEQ ID NO: 5863966 - DNA, 16 bp, Homo sapiens
catgtaactgcctaga

SEQ ID NO: 5863967 - DNA, 15 bp, Homo sapiens
catgtaactttcgta

SEQ ID NO: 5863968 - DNA, 17 bp, Homo sapiens
catgtaagaaaatgtta

SEQ ID NO: 5863969 - DNA, 18 bp, Homo sapiens
catgtaagaatccaaagt

SEQ ID NO: 5863970 - DNA, 19 bp, Homo sapiens
catgtaaggttgtgcaggg

SEQ ID NO: 5863971 - DNA, 15 bp, Homo sapiens
catgtaataaacagg

SEQ ID NO: 5863972 - DNA, 14 bp, Homo sapiens
catgtaataaatct

SEQ ID NO: 5863973 - DNA, 16 bp, Homo sapiens
catgtaataaattcaa

SEQ ID NO: 5863974 - DNA, 19 bp, Homo sapiens
catgtaataaattcaaaac

SEQ ID NO: 5863975 - DNA, 22 bp, Homo sapiens
catgtaataagcacttgcctgg

SEQ ID NO: 5863976 - DNA, 23 bp, Homo sapiens
catgtaatataaagatgttaaaa

SEQ ID NO: 5863977 - DNA, 23 bp, Homo sapiens
catgtaatatatttcagacattt

SEQ ID NO: 5863978 - DNA, 14 bp, Homo sapiens
catgtaatcagttt

SEQ ID NO: 5863979 - DNA, 16 bp, Homo sapiens
catgtaatccttttgt

SEQ ID NO: 5863980 - DNA, 13 bp, Homo sapiens
catgtaatgacac

SEQ ID NO: 5863981 - DNA, 15 bp, Homo sapiens
catgtaatgtggtca

SEQ ID NO: 5863982 - DNA, 23 bp, Homo sapiens
catgtaatgttaatgttatatca

SEQ ID NO: 5863983 - DNA, 18 bp, Homo sapiens
catgtaattaagtactat

SEQ ID NO: 5863984 - DNA, 13 bp, Homo sapiens
catgtacagagaa

SEQ ID NO: 5863985 - DNA, 14 bp, Homo sapiens
catgtacagcatgc

SEQ ID NO: 5863986 - DNA, 16 bp, Homo sapiens
catgtacagcatgcat

SEQ ID NO: 5863987 - DNA, 20 bp, Homo sapiens
catgtacagtgttctgttta

SEQ ID NO: 5863988 - DNA, 17 bp, Homo sapiens
catgtacatagtaaagt

SEQ ID NO: 5863989 - DNA, 23 bp, Homo sapiens
catgtacatagtaaagtattttt

SEQ ID NO: 5863990 - DNA, 15 bp, Homo sapiens
catgtacatgaagaa

SEQ ID NO: 5863991 - DNA, 13 bp, Homo sapiens
catgtacatgcat

SEQ ID NO: 5863992 - DNA, 20 bp, Homo sapiens
catgtacattggtctttcta

SEQ ID NO: 5863993 - DNA, 17 bp, Homo sapiens
catgtaccagtgtactg

SEQ ID NO: 5863994 - DNA, 17 bp, Homo sapiens
catgtaccatcaataaa

SEQ ID NO: 5863995 - DNA, 21 bp, Homo sapiens
catgtaccatcaataaagtac

SEQ ID NO: 5863996 - DNA, 16 bp, Homo sapiens
catgtactacacttct

SEQ ID NO: 5863997 - DNA, 14 bp, Homo sapiens
catgtactataatg

SEQ ID NO: 5863998 - DNA, 15 bp, Homo sapiens
catgtactatcttat

SEQ ID NO: 5863999 - DNA, 13 bp, Homo sapiens
catgtactccaga

SEQ ID NO: 5864000 - DNA, 23 bp, Homo sapiens
catgtactgagacaaaaaggaaa

SEQ ID NO: 5864001 - DNA, 19 bp, Homo sapiens
catgtactgggaaggcaat

SEQ ID NO: 5864002 - DNA, 14 bp, Homo sapiens
catgtactgtagtt

SEQ ID NO: 5864003 - DNA, 20 bp, Homo sapiens
catgtacttccctcttgaaa

SEQ ID NO: 5864004 - DNA, 17 bp, Homo sapiens
catgtacttctttattt

SEQ ID NO: 5864005 - DNA, 21 bp, Homo sapiens
catgtacttgtttgcaagcag

SEQ ID NO: 5864006 - DNA, 15 bp, Homo sapiens
catgtactttggcat

SEQ ID NO: 5864007 - DNA, 18 bp, Homo sapiens
catgtacttttaaattat

SEQ ID NO: 5864008 - DNA, 22 bp, Homo sapiens
catgtagaacaagaaatctttc

SEQ ID NO: 5864009 - DNA, 17 bp, Homo sapiens
catgtagaagagggaga

SEQ ID NO: 5864010 - DNA, 18 bp, Homo sapiens
catgtagaagagggagaa

SEQ ID NO: 5864011 - DNA, 13 bp, Homo sapiens
catgtagaagctg

SEQ ID NO: 5864012 - DNA, 17 bp, Homo sapiens
catgtagaataaatgaa

SEQ ID NO: 5864013 - DNA, 18 bp, Homo sapiens
catgtagaataaatgaag

SEQ ID NO: 5864014 - DNA, 19 bp, Homo sapiens
catgtagaataaatgaaga

SEQ ID NO: 5864015 - DNA, 17 bp, Homo sapiens
catgtagattttagttc

SEQ ID NO: 5864016 - DNA, 13 bp, Homo sapiens
catgtagcagaca

SEQ ID NO: 5864017 - DNA, 14 bp, Homo sapiens
catgtagcaggact

SEQ ID NO: 5864018 - DNA, 15 bp, Homo sapiens
catgtagcagtgagt

SEQ ID NO: 5864019 - DNA, 12 bp, Homo sapiens
catgtagcatat

SEQ ID NO: 5864020 - DNA, 23 bp, Homo sapiens
catgtagcatataaatgtttata

SEQ ID NO: 5864021 - DNA, 16 bp, Homo sapiens
catgtagccacccaac

SEQ ID NO: 5864022 - DNA, 21 bp, Homo sapiens
catgtagccacccaactttgt

SEQ ID NO: 5864023 - DNA, 15 bp, Homo sapiens
catgtagccagcaga

SEQ ID NO: 5864024 - DNA, 19 bp, Homo sapiens
catgtagccagcagaactg

SEQ ID NO: 5864025 - DNA, 21 bp, Homo sapiens
catgttaattaaactgaagaa

SEQ ID NO: 5864026 - DNA, 20 bp, Homo sapiens
catgttaccaaagcaatatt

SEQ ID NO: 5864027 - DNA, 22 bp, Homo sapiens
catgttaccaaagcaatatttc

SEQ ID NO: 5864028 - DNA, 23 bp, Homo sapiens
catgttaccaaagcaatatttcc

SEQ ID NO: 5864029 - DNA, 23 bp, Homo sapiens
catgttactaaattacgtatgca

SEQ ID NO: 5864030 - DNA, 17 bp, Homo sapiens
catgttacttgagaagt

SEQ ID NO: 5864031 - DNA, 15 bp, Homo sapiens
catgttagagttact

SEQ ID NO: 5864032 - DNA, 14 bp, Homo sapiens
catgttagccttag

SEQ ID NO: 5864033 - DNA, 14 bp, Homo sapiens
catgttaggaaaat

SEQ ID NO: 5864034 - DNA, 18 bp, Homo sapiens
catgttaggaaaatttca

SEQ ID NO: 5864035 - DNA, 16 bp, Homo sapiens
catgttagtaatacct

SEQ ID NO: 5864036 - DNA, 19 bp, Homo sapiens
catgttagtaatacctcta

SEQ ID NO: 5864037 - DNA, 21 bp, Homo sapiens
catgttagttaccttatagtt

SEQ ID NO: 5864038 - DNA, 22 bp, Homo sapiens
catgttagttaccttatagtta

SEQ ID NO: 5864039 - DNA, 21 bp, Homo sapiens
catgttagttttgctccttct

SEQ ID NO: 5864040 - DNA, 22 bp, Homo sapiens
catgttatgataaaaaattttg

SEQ ID NO: 5864041 - DNA, 13 bp, Homo sapiens
catgttatgttta

SEQ ID NO: 5864042 - DNA, 18 bp, Homo sapiens
catgttatttaacctgag

SEQ ID NO: 5864043 - DNA, 19 bp, Homo sapiens
catgttatttaacctgagt

SEQ ID NO: 5864044 - DNA, 14 bp, Homo sapiens
catgttattttatt

SEQ ID NO: 5864045 - DNA, 15 bp, Homo sapiens
catgttcaaaagaag

SEQ ID NO: 5864046 - DNA, 20 bp, Homo sapiens
catgttcaaattttatcatg

SEQ ID NO: 5864047 - DNA, 15 bp, Homo sapiens
catgttcagaaaaga

SEQ ID NO: 5864048 - DNA, 17 bp, Homo sapiens
catgttcagggatgctc

SEQ ID NO: 5864049 - DNA, 23 bp, Homo sapiens
catgttcatatagtcaatgtaaa

SEQ ID NO: 5864050 - DNA, 16 bp, Homo sapiens
catgttcatgtgatta

SEQ ID NO: 5864051 - DNA, 16 bp, Homo sapiens
catgttccaataaaca

SEQ ID NO: 5864052 - DNA, 17 bp, Homo sapiens
catgttcccaaaacaat

SEQ ID NO: 5864053 - DNA, 16 bp, Homo sapiens
catgttcccaaggccc

SEQ ID NO: 5864054 - DNA, 15 bp, Homo sapiens
catgttcccagctca

SEQ ID NO: 5864055 - DNA, 23 bp, Homo sapiens
catgttcccagctcagtgccaaa

SEQ ID NO: 5864056 - DNA, 19 bp, Homo sapiens
catgttccccagttcagtg

SEQ ID NO: 5864057 - DNA, 16 bp, Homo sapiens
catgttcccttctcct

SEQ ID NO: 5864058 - DNA, 21 bp, Homo sapiens
catgttcctcaaaagcaccct

SEQ ID NO: 5864059 - DNA, 13 bp, Homo sapiens
catgttcctcctt

SEQ ID NO: 5864060 - DNA, 21 bp, Homo sapiens
catgttcctggacaccaccca

SEQ ID NO: 5864061 - DNA, 12 bp, Homo sapiens
catgttccttca

SEQ ID NO: 5864062 - DNA, 20 bp, Homo sapiens
catgttccttcaagatcatg

SEQ ID NO: 5864063 - DNA, 23 bp, Homo sapiens
catgttccttcaagatcatgtac

SEQ ID NO: 5864064 - DNA, 19 bp, Homo sapiens
catgttcctttgtaattga

SEQ ID NO: 5864065 - DNA, 18 bp, Homo sapiens
catgttccttttgaaatt

SEQ ID NO: 5864066 - DNA, 16 bp, Homo sapiens
catgttctatattctt

SEQ ID NO: 5864067 - DNA, 20 bp, Homo sapiens
catgttctatattctttatt

SEQ ID NO: 5864068 - DNA, 21 bp, Homo sapiens
catgttctatattctttattc

SEQ ID NO: 5864069 - DNA, 16 bp, Homo sapiens
catgttctcatgtttg

SEQ ID NO: 5864070 - DNA, 19 bp, Homo sapiens
catgttctcttcccaggcc

SEQ ID NO: 5864071 - DNA, 13 bp, Homo sapiens
catgttctgcccc

SEQ ID NO: 5864072 - DNA, 14 bp, Homo sapiens
catgttctgctttc

SEQ ID NO: 5864073 - DNA, 18 bp, Homo sapiens
catgttctggtggtttga

SEQ ID NO: 5864074 - DNA, 11 bp, Homo sapiens
catgttctgtg

SEQ ID NO: 5864075 - DNA, 13 bp, Homo sapiens
catgttctgtgtc

SEQ ID NO: 5864076 - DNA, 18 bp, Homo sapiens
catgttctgtgtcacgtg

SEQ ID NO: 5864077 - DNA, 20 bp, Homo sapiens
catgttctgtgtcacgtgac

SEQ ID NO: 5864078 - DNA, 21 bp, Homo sapiens
catgttctgtgtcacgtgacc

SEQ ID NO: 5864079 - DNA, 16 bp, Homo sapiens
catgttcttaattctt

SEQ ID NO: 5864080 - DNA, 14 bp, Homo sapiens
catgttcttgtcat

SEQ ID NO: 5864081 - DNA, 18 bp, Homo sapiens
catgttcttttctggaaa

SEQ ID NO: 5864082 - DNA, 22 bp, Homo sapiens
catgttgaagccactgccttca

SEQ ID NO: 5864083 - DNA, 20 bp, Homo sapiens
catgttgaccatgtctatga

SEQ ID NO: 5864084 - DNA, 13 bp, Homo sapiens
catgttgacgaga

SEQ ID NO: 5864085 - DNA, 20 bp, Homo sapiens
catgttgacgagactggtct

SEQ ID NO: 5864086 - DNA, 13 bp, Homo sapiens
catgttgatttct

SEQ ID NO: 5864087 - DNA, 17 bp, Homo sapiens
catgttgccaaaatggt

SEQ ID NO: 5864088 - DNA, 22 bp, Homo sapiens
catgttgcccctttctcttttc

SEQ ID NO: 5864089 - DNA, 14 bp, Homo sapiens
catgttgctcagaa

SEQ ID NO: 5864090 - DNA, 13 bp, Homo sapiens
catgttgctgact

SEQ ID NO: 5864091 - DNA, 14 bp, Homo sapiens
catgttgctgagga

SEQ ID NO: 5864092 - DNA, 17 bp, Homo sapiens
catgttggaaatgtgtt

SEQ ID NO: 5864093 - DNA, 16 bp, Homo sapiens
catgttggccaggctg

SEQ ID NO: 5864094 - DNA, 20 bp, Homo sapiens
catgttggccaggctgctct

SEQ ID NO: 5864095 - DNA, 21 bp, Homo sapiens
catgttggccaggctggtctt

SEQ ID NO: 5864096 - DNA, 18 bp, Homo sapiens
catgttgggaaaaactgg

SEQ ID NO: 5864097 - DNA, 15 bp, Homo sapiens
catgttgggaaactt

SEQ ID NO: 5864098 - DNA, 19 bp, Homo sapiens
catgttgggaaacttggct

SEQ ID NO: 5864099 - DNA, 17 bp, Homo sapiens
catgttgggataaatag

SEQ ID NO: 5864100 - DNA, 18 bp, Homo sapiens
catgttggggttgtgtgt

SEQ ID NO: 5864101 - DNA, 16 bp, Homo sapiens
catgttggtcaggctg

SEQ ID NO: 5864102 - DNA, 22 bp, Homo sapiens
catgttggtcaggctggtctca

SEQ ID NO: 5864103 - DNA, 22 bp, Homo sapiens
catgttggttgcactttgtagt

SEQ ID NO: 5864104 - DNA, 19 bp, Homo sapiens
catgttggtttattttcac

SEQ ID NO: 5864105 - DNA, 19 bp, Homo sapiens
catgttgtaatgctgcact

SEQ ID NO: 5864106 - DNA, 23 bp, Homo sapiens
catgttgtagatacaatcagctg

SEQ ID NO: 5864107 - DNA, 22 bp, Homo sapiens
catgttgtcctttttatctgat

SEQ ID NO: 5864108 - DNA, 22 bp, Homo sapiens
catgtttaaatagcctaaatga

SEQ ID NO: 5864109 - DNA, 11 bp, Homo sapiens
catgtttaaga

SEQ ID NO: 5864110 - DNA, 16 bp, Homo sapiens
catgtttaagatttaa

SEQ ID NO: 5864111 - DNA, 17 bp, Homo sapiens
catgtttaataatatgt

SEQ ID NO: 5864112 - DNA, 20 bp, Homo sapiens
catgtttaattgtgatattt

SEQ ID NO: 5864113 - DNA, 22 bp, Homo sapiens
catgtttaattgtgatatttga

SEQ ID NO: 5864114 - DNA, 23 bp, Homo sapiens
catgtttaattgtgatatttgac

SEQ ID NO: 5864115 - DNA, 9 bp, Homo sapiens
catgtttac

SEQ ID NO: 5864116 - DNA, 21 bp, Homo sapiens
catgtttacttttcagggcat

SEQ ID NO: 5864117 - DNA, 13 bp, Homo sapiens
catgtttataaat

SEQ ID NO: 5864118 - DNA, 21 bp, Homo sapiens
catgtttataactattcagtt

SEQ ID NO: 5864119 - DNA, 15 bp, Homo sapiens
catgtttatgaaaat

SEQ ID NO: 5864120 - DNA, 23 bp, Homo sapiens
catgtttatgaaaataaatagct

SEQ ID NO: 5864121 - DNA, 18 bp, Homo sapiens
catgtttattacagtata

SEQ ID NO: 5864122 - DNA, 13 bp, Homo sapiens
catgtttattcta

SEQ ID NO: 5864123 - DNA, 22 bp, Homo sapiens
catgtttattgttttttaaaga

SEQ ID NO: 5864124 - DNA, 21 bp, Homo sapiens
catgtttatttatttccagtg

SEQ ID NO: 5864125 - DNA, 19 bp, Homo sapiens
catgtttatttttcttgtc

SEQ ID NO: 5864126 - DNA, 18 bp, Homo sapiens
catgtttcactcctgctt

SEQ ID NO: 5864127 - DNA, 21 bp, Homo sapiens
catgtttcactcctgcttctc

SEQ ID NO: 5864128 - DNA, 13 bp, Homo sapiens
catgtttcactta

SEQ ID NO: 5864129 - DNA, 21 bp, Homo sapiens
catgtttcagtgaagatgctg

SEQ ID NO: 5864130 - DNA, 16 bp, Homo sapiens
catgtttcatgttttg

SEQ ID NO: 5864131 - DNA, 17 bp, Homo sapiens
catgtttcatgttttgt

SEQ ID NO: 5864132 - DNA, 13 bp, Homo sapiens
catgtttccagca

SEQ ID NO: 5864133 - DNA, 15 bp, Homo sapiens
catgtttccagcatt

SEQ ID NO: 5864134 - DNA, 20 bp, Homo sapiens
catgtttccagcattcccag

SEQ ID NO: 5864135 - DNA, 10 bp, Homo sapiens
catgtttctt

SEQ ID NO: 5864136 - DNA, 11 bp, Homo sapiens
catgtttcttt

SEQ ID NO: 5864137 - DNA, 21 bp, Homo sapiens
catgtttgagaaccccctaac

SEQ ID NO: 5864138 - DNA, 20 bp, Homo sapiens
catgtttgagctcagacccc

SEQ ID NO: 5864139 - DNA, 20 bp, Homo sapiens
catgtttgcacctttctagt

SEQ ID NO: 5864140 - DNA, 21 bp, Homo sapiens
catgtttgcacctttctagtt

SEQ ID NO: 5864141 - DNA, 14 bp, Homo sapiens
catgtttgcagtgt

SEQ ID NO: 5864142 - DNA, 21 bp, Homo sapiens
catgtttgcagtgttaagata

SEQ ID NO: 5864143 - DNA, 14 bp, Homo sapiens
catgtttgcctaga

SEQ ID NO: 5864144 - DNA, 14 bp, Homo sapiens
catgtttgctgttc

SEQ ID NO: 5864145 - DNA, 14 bp, Homo sapiens
catgtttggaaaat

SEQ ID NO: 5864146 - DNA, 22 bp, Homo sapiens
catgtttggaaggggtctgtag

SEQ ID NO: 5864147 - DNA, 20 bp, Homo sapiens
catgtttggtgcatagaact

SEQ ID NO: 5864148 - DNA, 21 bp, Homo sapiens
catgtttggtgcatagaactg

SEQ ID NO: 5864149 - DNA, 22 bp, Homo sapiens
catgtttggtgcatagaactgg

SEQ ID NO: 5864150 - DNA, 13 bp, Homo sapiens
catgtttgtaaaa

SEQ ID NO: 5864151 - DNA, 18 bp, Homo sapiens
catgtttgtctgtgtgct

SEQ ID NO: 5864152 - DNA, 14 bp, Homo sapiens
catgttttaaaatt

SEQ ID NO: 5864153 - DNA, 19 bp, Homo sapiens
catgttttaaaattatata

SEQ ID NO: 5864154 - DNA, 22 bp, Homo sapiens
catgttttaaaattatatagca

SEQ ID NO: 5864155 - DNA, 23 bp, Homo sapiens
catgttttaaatgtacagtttgg

SEQ ID NO: 5864156 - DNA, 14 bp, Homo sapiens
catgttttaacaaa

SEQ ID NO: 5864157 - DNA, 15 bp, Homo sapiens
catgttttaacaaaa

SEQ ID NO: 5864158 - DNA, 16 bp, Homo sapiens
catgttttaacaaaaa

SEQ ID NO: 5864159 - DNA, 23 bp, Homo sapiens
catgttttagacaaatactcatg

SEQ ID NO: 5864160 - DNA, 21 bp, Homo sapiens
catgttttatgtacacaaatc

SEQ ID NO: 5864161 - DNA, 16 bp, Homo sapiens
catgttttcaaatgga

SEQ ID NO: 5864162 - DNA, 13 bp, Homo sapiens
catgttttccagg

SEQ ID NO: 5864163 - DNA, 22 bp, Homo sapiens
catgttttctatatgaacttag

SEQ ID NO: 5864164 - DNA, 21 bp, Homo sapiens
catgttttctttgtttcctgg

SEQ ID NO: 5864165 - DNA, 13 bp, Homo sapiens
catgttttgataa

SEQ ID NO: 5864166 - DNA, 14 bp, Homo sapiens
catgttttgataaa

SEQ ID NO: 5864167 - DNA, 16 bp, Homo sapiens
catgttttgcatgtaa

SEQ ID NO: 5864168 - DNA, 14 bp, Homo sapiens
catgttttgctaat

SEQ ID NO: 5864169 - DNA, 11 bp, Homo sapiens
catgttttggt

SEQ ID NO: 5864170 - DNA, 12 bp, Homo sapiens
catgttttgtat

SEQ ID NO: 5864171 - DNA, 15 bp, Homo sapiens
catgttttgtgacta

SEQ ID NO: 5864172 - DNA, 17 bp, Homo sapiens
catgttttgtgactata

SEQ ID NO: 5864173 - DNA, 15 bp, Homo sapiens
catgttttgtttacg

SEQ ID NO: 5864174 - DNA, 14 bp, Homo sapiens
catgttttgttttc

SEQ ID NO: 5864175 - DNA, 17 bp, Homo sapiens
catgtttttaactttta

SEQ ID NO: 5864176 - DNA, 13 bp, Homo sapiens
catgttttttcat

SEQ ID NO: 5864177 - DNA, 19 bp, Homo sapiens
catgttttttcatttgtaa

SEQ ID NO: 5864178 - DNA, 16 bp, Homo sapiens
catgttttttcttcaa

SEQ ID NO: 5864179 - DNA, 19 bp, Homo sapiens
cattaaaaacatagaaaaa

SEQ ID NO: 5864180 - DNA, 15 bp, Homo sapiens
cattaaaaacatttt

SEQ ID NO: 5864181 - DNA, 15 bp, Homo sapiens
cattaaaaagcctta

SEQ ID NO: 5864182 - DNA, 19 bp, Homo sapiens
cattaaaaagttgttcttt

SEQ ID NO: 5864183 - DNA, 22 bp, Homo sapiens
cattaaaaagttgttctttgtt

SEQ ID NO: 5864184 - DNA, 12 bp, Homo sapiens
cattaaaaataa

SEQ ID NO: 5864185 - DNA, 20 bp, Homo sapiens
cattaaaaataaaagttgta

SEQ ID NO: 5864186 - DNA, 22 bp, Homo sapiens
cattaaaaatgcatatacttta

SEQ ID NO: 5864187 - DNA, 13 bp, Homo sapiens
cattaaaaatgga

SEQ ID NO: 5864188 - DNA, 13 bp, Homo sapiens
cattaaaactcat

SEQ ID NO: 5864189 - DNA, 22 bp, Homo sapiens
cattaaaactgaagtctgaaat

SEQ ID NO: 5864190 - DNA, 14 bp, Homo sapiens
cattaaaactgctt

SEQ ID NO: 5864191 - DNA, 15 bp, Homo sapiens
cattaaaactgcttt

SEQ ID NO: 5864192 - DNA, 20 bp, Homo sapiens
cattaaaagaaaataaaaaa

SEQ ID NO: 5864193 - DNA, 20 bp, Homo sapiens
cattaaaagaagactggaag

SEQ ID NO: 5864194 - DNA, 13 bp, Homo sapiens
cattaaaagaata

SEQ ID NO: 5864195 - DNA, 22 bp, Homo sapiens
cattaaaagctttagattgaaa

SEQ ID NO: 5864196 - DNA, 17 bp, Homo sapiens
cattaaaaggaaaaaag

SEQ ID NO: 5864197 - DNA, 18 bp, Homo sapiens
cattaaaaggaaaaaaga

SEQ ID NO: 5864198 - DNA, 18 bp, Homo sapiens
cattaaaagttttatgta

SEQ ID NO: 5864199 - DNA, 22 bp, Homo sapiens
cattaaaagttttatgtacttt

SEQ ID NO: 5864200 - DNA, 23 bp, Homo sapiens
cattaaaagttttatgtactttg

SEQ ID NO: 5864201 - DNA, 17 bp, Homo sapiens
cattaaaataaaacaag

SEQ ID NO: 5864202 - DNA, 13 bp, Homo sapiens
cattaaaataact

SEQ ID NO: 5864203 - DNA, 14 bp, Homo sapiens
cattaaaatataat

SEQ ID NO: 5864204 - DNA, 20 bp, Homo sapiens
cattaaaatatagagacagg

SEQ ID NO: 5864205 - DNA, 15 bp, Homo sapiens
cattaaaatatatgt

SEQ ID NO: 5864206 - DNA, 19 bp, Homo sapiens
cattaaaatatatgttctg

SEQ ID NO: 5864207 - DNA, 14 bp, Homo sapiens
cattaaaatgacaa

SEQ ID NO: 5864208 - DNA, 15 bp, Homo sapiens
cattaaaatgacaaa

SEQ ID NO: 5864209 - DNA, 16 bp, Homo sapiens
cattaaaatggaagtg

SEQ ID NO: 5864210 - DNA, 18 bp, Homo sapiens
cattaaaattaaatactt

SEQ ID NO: 5864211 - DNA, 19 bp, Homo sapiens
cattaaacagaaggtaata

SEQ ID NO: 5864212 - DNA, 15 bp, Homo sapiens
cattaaacatgaatt

SEQ ID NO: 5864213 - DNA, 16 bp, Homo sapiens
cattaaacatgaattt

SEQ ID NO: 5864214 - DNA, 18 bp, Homo sapiens
cattaaacatgaatttaa

SEQ ID NO: 5864215 - DNA, 13 bp, Homo sapiens
cattaaacctgtc

SEQ ID NO: 5864216 - DNA, 14 bp, Homo sapiens
cattaaacctgtct

SEQ ID NO: 5864217 - DNA, 22 bp, Homo sapiens
cattaaacgatttttaaaatgt

SEQ ID NO: 5864218 - DNA, 18 bp, Homo sapiens
cattaaactctaaagatt

SEQ ID NO: 5864219 - DNA, 17 bp, Homo sapiens
cattaaacttctactga

SEQ ID NO: 5864220 - DNA, 13 bp, Homo sapiens
cattaaacttgaa

SEQ ID NO: 5864221 - DNA, 17 bp, Homo sapiens
cattaaacttgaagcag

SEQ ID NO: 5864222 - DNA, 11 bp, Homo sapiens
cattaaacttt

SEQ ID NO: 5864223 - DNA, 13 bp, Homo sapiens
cattaaacttttt

SEQ ID NO: 5864224 - DNA, 14 bp, Homo sapiens
cattaaactttttt

SEQ ID NO: 5864225 - DNA, 11 bp, Homo sapiens
cattaaagaag

SEQ ID NO: 5864226 - DNA, 12 bp, Homo sapiens
cattaaagagcc

SEQ ID NO: 5864227 - DNA, 17 bp, Homo sapiens
cattaaagatttctgct

SEQ ID NO: 5864228 - DNA, 13 bp, Homo sapiens
cattaaagcaatc

SEQ ID NO: 5864229 - DNA, 13 bp, Homo sapiens
cattaaagcagtc

SEQ ID NO: 5864230 - DNA, 18 bp, Homo sapiens
cattaaagccctgtgtta

SEQ ID NO: 5864231 - DNA, 20 bp, Homo sapiens
cattaaaggcataaatgact

SEQ ID NO: 5864232 - DNA, 17 bp, Homo sapiens
cattaaaggcttctctc

SEQ ID NO: 5864233 - DNA, 24 bp, Homo sapiens
cattaaaggcttctctctcaccag

SEQ ID NO: 5864234 - DNA, 11 bp, Homo sapiens
cattaaataaa

SEQ ID NO: 5864235 - DNA, 16 bp, Homo sapiens
cattaaatctgacagt

SEQ ID NO: 5864236 - DNA, 18 bp, Homo sapiens
cattaaatgaatattttg

SEQ ID NO: 5864237 - DNA, 13 bp, Homo sapiens
cattaaatgactc

SEQ ID NO: 5864238 - DNA, 18 bp, Homo sapiens
cattaaatgactcttccc

SEQ ID NO: 5864239 - DNA, 19 bp, Homo sapiens
cattaaatgcaataatttt

SEQ ID NO: 5864240 - DNA, 20 bp, Homo sapiens
cattaaatgcaataatttta

SEQ ID NO: 5864241 - DNA, 14 bp, Homo sapiens
cattaaatgctttg

SEQ ID NO: 5864242 - DNA, 23 bp, Homo sapiens
cattaaatggtgatttcttgcta

SEQ ID NO: 5864243 - DNA, 20 bp, Homo sapiens
cattaaattacagaaattta

SEQ ID NO: 5864244 - DNA, 13 bp, Homo sapiens
cattaaattcaca

SEQ ID NO: 5864245 - DNA, 21 bp, Homo sapiens
cattaaattcacaaactttta

SEQ ID NO: 5864246 - DNA, 15 bp, Homo sapiens
cattaacaaataaaa

SEQ ID NO: 5864247 - DNA, 13 bp, Homo sapiens
cattaacaagaaa

SEQ ID NO: 5864248 - DNA, 18 bp, Homo sapiens
cattaacaggtctttgaa

SEQ ID NO: 5864249 - DNA, 16 bp, Homo sapiens
cattaacagttttcca

SEQ ID NO: 5864250 - DNA, 22 bp, Homo sapiens
cattaacagttttccatgaaaa

SEQ ID NO: 5864251 - DNA, 13 bp, Homo sapiens
cattaacatgttt

SEQ ID NO: 5864252 - DNA, 18 bp, Homo sapiens
cattaaccaaagaaagtg

SEQ ID NO: 5864253 - DNA, 21 bp, Homo sapiens
cattaacccccaaattcaaaa

SEQ ID NO: 5864254 - DNA, 16 bp, Homo sapiens
cattaactaatctatt

SEQ ID NO: 5864255 - DNA, 16 bp, Homo sapiens
cattaacttctctgga

SEQ ID NO: 5864256 - DNA, 15 bp, Homo sapiens
cattaagaaaatatt

SEQ ID NO: 5864257 - DNA, 13 bp, Homo sapiens
cattaagaataat

SEQ ID NO: 5864258 - DNA, 13 bp, Homo sapiens
cattaagcacaca

SEQ ID NO: 5864259 - DNA, 20 bp, Homo sapiens
cattaagcacacacatctgg

SEQ ID NO: 5864260 - DNA, 15 bp, Homo sapiens
cattaagcatcacaa

SEQ ID NO: 5864261 - DNA, 19 bp, Homo sapiens
cattaagcatcacaaatga

SEQ ID NO: 5864262 - DNA, 20 bp, Homo sapiens
cattaagccctcttccatca

SEQ ID NO: 5864263 - DNA, 22 bp, Homo sapiens
cattaagctttttttttttgaa

SEQ ID NO: 5864264 - DNA, 17 bp, Homo sapiens
cattaaggccacatcca

SEQ ID NO: 5864265 - DNA, 15 bp, Homo sapiens
cattaagggcctgct

SEQ ID NO: 5864266 - DNA, 19 bp, Homo sapiens
cattaaggggaagaatgaa

SEQ ID NO: 5864267 - DNA, 23 bp, Homo sapiens
cattaaggggaagaatgaaagct

SEQ ID NO: 5864268 - DNA, 13 bp, Homo sapiens
cattaaggtattt

SEQ ID NO: 5864269 - DNA, 15 bp, Homo sapiens
cattaagtaaatgct

SEQ ID NO: 5864270 - DNA, 20 bp, Homo sapiens
cattaagtaatctttttaca

SEQ ID NO: 5864271 - DNA, 22 bp, Homo sapiens
cattaagtattccttggcccag

SEQ ID NO: 5864272 - DNA, 17 bp, Homo sapiens
cattaagtcagtggctt

SEQ ID NO: 5864273 - DNA, 23 bp, Homo sapiens
cattaagtcatgtgtgaacacat

SEQ ID NO: 5864274 - DNA, 14 bp, Homo sapiens
cattaagtgacttt

SEQ ID NO: 5864275 - DNA, 16 bp, Homo sapiens
cattaataaaaatcaa

SEQ ID NO: 5864276 - DNA, 13 bp, Homo sapiens
cattaataaagac

SEQ ID NO: 5864277 - DNA, 15 bp, Homo sapiens
cattaataactgaat

SEQ ID NO: 5864278 - DNA, 19 bp, Homo sapiens
cattaataactgaataaaa

SEQ ID NO: 5864279 - DNA, 20 bp, Homo sapiens
cattaataactgaataaaaa

SEQ ID NO: 5864280 - DNA, 21 bp, Homo sapiens
cattaataactgaataaaaaa

SEQ ID NO: 5864281 - DNA, 17 bp, Homo sapiens
cattaataagtgaagaa

SEQ ID NO: 5864282 - DNA, 18 bp, Homo sapiens
cattaataatagctaata

SEQ ID NO: 5864283 - DNA, 15 bp, Homo sapiens
cattaatactcttta

SEQ ID NO: 5864284 - DNA, 17 bp, Homo sapiens
cattaatattcttttgt

SEQ ID NO: 5864285 - DNA, 16 bp, Homo sapiens
cattaatcaccaaagt

SEQ ID NO: 5864286 - DNA, 21 bp, Homo sapiens
cattaatccacatgtttcaga

SEQ ID NO: 5864287 - DNA, 17 bp, Homo sapiens
cattaatctcaaagaga

SEQ ID NO: 5864288 - DNA, 20 bp, Homo sapiens
cattaatcttgatcattccg

SEQ ID NO: 5864289 - DNA, 23 bp, Homo sapiens
cattaatgaatgaccagcagcag

SEQ ID NO: 5864290 - DNA, 23 bp, Homo sapiens
cattaatgagaagagttttctca

SEQ ID NO: 5864291 - DNA, 24 bp, Homo sapiens
cattaatgagaagagttttctcag

SEQ ID NO: 5864292 - DNA, 20 bp, Homo sapiens
cattaatgcccagccagcca

SEQ ID NO: 5864293 - DNA, 24 bp, Homo sapiens
cattaatgcccagccagccacccc

SEQ ID NO: 5864294 - DNA, 21 bp, Homo sapiens
cattaatgcctgctttttgga

SEQ ID NO: 5864295 - DNA, 22 bp, Homo sapiens
cattaatgcctgctttttggaa

SEQ ID NO: 5864296 - DNA, 16 bp, Homo sapiens
cattaatggcatatgg

SEQ ID NO: 5864297 - DNA, 13 bp, Homo sapiens
cattaatgtgttg

SEQ ID NO: 5864298 - DNA, 15 bp, Homo sapiens
cattaatgttcttta

SEQ ID NO: 5864299 - DNA, 20 bp, Homo sapiens
cattaatgttgatttctagt

SEQ ID NO: 5864300 - DNA, 16 bp, Homo sapiens
cattaattaattaaag

SEQ ID NO: 5864301 - DNA, 18 bp, Homo sapiens
cattaattaattaaagcc

SEQ ID NO: 5864302 - DNA, 12 bp, Homo sapiens
cattaattacat

SEQ ID NO: 5864303 - DNA, 13 bp, Homo sapiens
cattaattacata

SEQ ID NO: 5864304 - DNA, 15 bp, Homo sapiens
cattaattacataca

SEQ ID NO: 5864305 - DNA, 22 bp, Homo sapiens
cattaattaccctactttcatt

SEQ ID NO: 5864306 - DNA, 21 bp, Homo sapiens
cattaattagttccagtttct

SEQ ID NO: 5864307 - DNA, 17 bp, Homo sapiens
cattaattatatgtata

SEQ ID NO: 5864308 - DNA, 15 bp, Homo sapiens
cattaattattaata

SEQ ID NO: 5864309 - DNA, 20 bp, Homo sapiens
cattaattattattgctgtt

SEQ ID NO: 5864310 - DNA, 17 bp, Homo sapiens
cattaattcaatgaaat

SEQ ID NO: 5864311 - DNA, 19 bp, Homo sapiens
cattaattcaatgaaatgg

SEQ ID NO: 5864312 - DNA, 18 bp, Homo sapiens
cattaattcaattaaaac

SEQ ID NO: 5864313 - DNA, 22 bp, Homo sapiens
cattaattctactaaatatttt

SEQ ID NO: 5864314 - DNA, 19 bp, Homo sapiens
cattaattgttccttgctt

SEQ ID NO: 5864315 - DNA, 21 bp, Homo sapiens
cattaattttgtgcattcttt

SEQ ID NO: 5864316 - DNA, 13 bp, Homo sapiens
cattacaaatctt

SEQ ID NO: 5864317 - DNA, 14 bp, Homo sapiens
cattacaaatttct

SEQ ID NO: 5864318 - DNA, 21 bp, Homo sapiens
cattacaagcctggaaaaaaa

SEQ ID NO: 5864319 - DNA, 19 bp, Homo sapiens
cattacaatacagtatttc

SEQ ID NO: 5864320 - DNA, 17 bp, Homo sapiens
cattacaattttctgta

SEQ ID NO: 5864321 - DNA, 16 bp, Homo sapiens
cattacactaaattat

SEQ ID NO: 5864322 - DNA, 17 bp, Homo sapiens
cattacactaaattatt

SEQ ID NO: 5864323 - DNA, 15 bp, Homo sapiens
cattacactccagcc

SEQ ID NO: 5864324 - DNA, 17 bp, Homo sapiens
cattacagaccatggat

SEQ ID NO: 5864325 - DNA, 21 bp, Homo sapiens
cattacagagaggagaaacac

SEQ ID NO: 5864326 - DNA, 16 bp, Homo sapiens
cattacagattaaaga

SEQ ID NO: 5864327 - DNA, 23 bp, Homo sapiens
cattacagattaaagaagaaaag

SEQ ID NO: 5864328 - DNA, 14 bp, Homo sapiens
cattacagcttaat

SEQ ID NO: 5864329 - DNA, 22 bp, Homo sapiens
cattacaggggcagtgcctttg

SEQ ID NO: 5864330 - DNA, 22 bp, Homo sapiens
cattacagtatccaatgtcttt

SEQ ID NO: 5864331 - DNA, 21 bp, Homo sapiens
cattacagtgggtgcccccct

SEQ ID NO: 5864332 - DNA, 17 bp, Homo sapiens
cattacatcctctgctt

SEQ ID NO: 5864333 - DNA, 22 bp, Homo sapiens
cattacatcctctgcttgtcat

SEQ ID NO: 5864334 - DNA, 16 bp, Homo sapiens
cattacatgactattg

SEQ ID NO: 5864335 - DNA, 14 bp, Homo sapiens
cattacatggctgt

SEQ ID NO: 5864336 - DNA, 17 bp, Homo sapiens
cattacatggctgtggt

SEQ ID NO: 5864337 - DNA, 14 bp, Homo sapiens
cattacatgtgttt

SEQ ID NO: 5864338 - DNA, 19 bp, Homo sapiens
cattacatgtgtttattca

SEQ ID NO: 5864339 - DNA, 23 bp, Homo sapiens
cattacatgtttaaattgtaaat

SEQ ID NO: 5864340 - DNA, 20 bp, Homo sapiens
cattacattccttgataatg

SEQ ID NO: 5864341 - DNA, 16 bp, Homo sapiens
cattacattgccattt

SEQ ID NO: 5864342 - DNA, 20 bp, Homo sapiens
cattaccaaaataataaaaa

SEQ ID NO: 5864343 - DNA, 12 bp, Homo sapiens
cattaccactca

SEQ ID NO: 5864344 - DNA, 20 bp, Homo sapiens
cattaccagacggttcacca

SEQ ID NO: 5864345 - DNA, 15 bp, Homo sapiens
cattacccaaaagca

SEQ ID NO: 5864346 - DNA, 23 bp, Homo sapiens
cattaccccataccccttattgc

SEQ ID NO: 5864347 - DNA, 18 bp, Homo sapiens
cattaccctctgcagaac

SEQ ID NO: 5864348 - DNA, 17 bp, Homo sapiens
cattaccgcgttgtaaa

SEQ ID NO: 5864349 - DNA, 21 bp, Homo sapiens
cattacctccatccatccttc

SEQ ID NO: 5864350 - DNA, 23 bp, Homo sapiens
cattacctccatccatccttcca

SEQ ID NO: 5864351 - DNA, 17 bp, Homo sapiens
cattacctctttggaaa

SEQ ID NO: 5864352 - DNA, 19 bp, Homo sapiens
cattacctgggaatttata

SEQ ID NO: 5864353 - DNA, 15 bp, Homo sapiens
cattacctgtagctt

SEQ ID NO: 5864354 - DNA, 20 bp, Homo sapiens
cattaccttactgtggagga

SEQ ID NO: 5864355 - DNA, 18 bp, Homo sapiens
cattaccttttaccagct

SEQ ID NO: 5864356 - DNA, 14 bp, Homo sapiens
cattacgtgcattt

SEQ ID NO: 5864357 - DNA, 16 bp, Homo sapiens
cattacgtgcatttaa

SEQ ID NO: 5864358 - DNA, 19 bp, Homo sapiens
cattactacactggtgtgt

SEQ ID NO: 5864359 - DNA, 17 bp, Homo sapiens
cattactactgtacacg

SEQ ID NO: 5864360 - DNA, 19 bp, Homo sapiens
cattactagatattaaaag

SEQ ID NO: 5864361 - DNA, 18 bp, Homo sapiens
cattactattaactctgc

SEQ ID NO: 5864362 - DNA, 17 bp, Homo sapiens
cattactcttgtaagat

SEQ ID NO: 5864363 - DNA, 18 bp, Homo sapiens
cattactcttgtaagatt

SEQ ID NO: 5864364 - DNA, 15 bp, Homo sapiens
cattactctttttca

SEQ ID NO: 5864365 - DNA, 13 bp, Homo sapiens
cattactgcatgc

SEQ ID NO: 5864366 - DNA, 20 bp, Homo sapiens
cattactgcccagatgtttt

SEQ ID NO: 5864367 - DNA, 22 bp, Homo sapiens
cattactgcttcatttttgtaa

SEQ ID NO: 5864368 - DNA, 19 bp, Homo sapiens
cattactggccttttcact

SEQ ID NO: 5864369 - DNA, 13 bp, Homo sapiens
cattactgggcct

SEQ ID NO: 5864370 - DNA, 12 bp, Homo sapiens
cattactgtatg

SEQ ID NO: 5864371 - DNA, 15 bp, Homo sapiens
cattacttgaatgta

SEQ ID NO: 5864372 - DNA, 18 bp, Homo sapiens
cattacttgcacaagctt

SEQ ID NO: 5864373 - DNA, 20 bp, Homo sapiens
cattacttgctttcaattga

SEQ ID NO: 5864374 - DNA, 18 bp, Homo sapiens
cattacttgggaaatttt

SEQ ID NO: 5864375 - DNA, 23 bp, Homo sapiens
cattactttaatactcacctcct

SEQ ID NO: 5864376 - DNA, 21 bp, Homo sapiens
cattactttaccacccccaca

SEQ ID NO: 5864377 - DNA, 19 bp, Homo sapiens
cattagaaaaatagcaact

SEQ ID NO: 5864378 - DNA, 17 bp, Homo sapiens
cattagaaaattttgta

SEQ ID NO: 5864379 - DNA, 13 bp, Homo sapiens
cattccatgtcca

SEQ ID NO: 5864380 - DNA, 17 bp, Homo sapiens
cattccatgtgcccagt

SEQ ID NO: 5864381 - DNA, 13 bp, Homo sapiens
cattccattgcct

SEQ ID NO: 5864382 - DNA, 23 bp, Homo sapiens
cattccatttatcctagaaaatt

SEQ ID NO: 5864383 - DNA, 16 bp, Homo sapiens
cattcccaagatgcct

SEQ ID NO: 5864384 - DNA, 20 bp, Homo sapiens
cattcccactaagctttctc

SEQ ID NO: 5864385 - DNA, 23 bp, Homo sapiens
cattcccactaagctttctcctt

SEQ ID NO: 5864386 - DNA, 12 bp, Homo sapiens
cattcccactgc

SEQ ID NO: 5864387 - DNA, 17 bp, Homo sapiens
cattcccagacagcagt

SEQ ID NO: 5864388 - DNA, 23 bp, Homo sapiens
cattcccagagtcagaggagaag

SEQ ID NO: 5864389 - DNA, 14 bp, Homo sapiens
cattcccatgtgga

SEQ ID NO: 5864390 - DNA, 20 bp, Homo sapiens
cattcccattggttctccta

SEQ ID NO: 5864391 - DNA, 15 bp, Homo sapiens
cattccccaggaggc

SEQ ID NO: 5864392 - DNA, 20 bp, Homo sapiens
cattccccaggaggccagcc

SEQ ID NO: 5864393 - DNA, 13 bp, Homo sapiens
cattccccatggg

SEQ ID NO: 5864394 - DNA, 20 bp, Homo sapiens
cattcccccaccagctgcag

SEQ ID NO: 5864395 - DNA, 14 bp, Homo sapiens
cattcccccagtgc

SEQ ID NO: 5864396 - DNA, 17 bp, Homo sapiens
cattcccccttcctagt

SEQ ID NO: 5864397 - DNA, 18 bp, Homo sapiens
cattcccccttcctagtg

SEQ ID NO: 5864398 - DNA, 19 bp, Homo sapiens
cattcccccttcctagtga

SEQ ID NO: 5864399 - DNA, 16 bp, Homo sapiens
cattccccgacactgc

SEQ ID NO: 5864400 - DNA, 17 bp, Homo sapiens
cattccccgtctctggt

SEQ ID NO: 5864401 - DNA, 20 bp, Homo sapiens
cattcccctcgtgtgactct

SEQ ID NO: 5864402 - DNA, 20 bp, Homo sapiens
cattcccctgctgccagccc

SEQ ID NO: 5864403 - DNA, 23 bp, Homo sapiens
cattcccctttgcactgtaatga

SEQ ID NO: 5864404 - DNA, 16 bp, Homo sapiens
cattcccgaggtcagc

SEQ ID NO: 5864405 - DNA, 16 bp, Homo sapiens
cattcccgcagtggga

SEQ ID NO: 5864406 - DNA, 20 bp, Homo sapiens
cattcccgcagtgggagcaa

SEQ ID NO: 5864407 - DNA, 12 bp, Homo sapiens
cattccctagca

SEQ ID NO: 5864408 - DNA, 15 bp, Homo sapiens
cattccctccaccca

SEQ ID NO: 5864409 - DNA, 13 bp, Homo sapiens
cattccctcccat

SEQ ID NO: 5864410 - DNA, 19 bp, Homo sapiens
cattccctcgggaccctcc

SEQ ID NO: 5864411 - DNA, 19 bp, Homo sapiens
cattccctcgtctttccca

SEQ ID NO: 5864412 - DNA, 21 bp, Homo sapiens
cattccctctcatctcaggta

SEQ ID NO: 5864413 - DNA, 17 bp, Homo sapiens
cattccctgagtcacca

SEQ ID NO: 5864414 - DNA, 21 bp, Homo sapiens
cattccctgagtcaccaggaa

SEQ ID NO: 5864415 - DNA, 15 bp, Homo sapiens
cattccctggcctgg

SEQ ID NO: 5864416 - DNA, 15 bp, Homo sapiens
cattccctgggatct

SEQ ID NO: 5864417 - DNA, 10 bp, Homo sapiens
cattccctgt

SEQ ID NO: 5864418 - DNA, 13 bp, Homo sapiens
cattccctgtagg

SEQ ID NO: 5864419 - DNA, 14 bp, Homo sapiens
cattcccttcggcc

SEQ ID NO: 5864420 - DNA, 23 bp, Homo sapiens
cattcccttggatgtagtctgag

SEQ ID NO: 5864421 - DNA, 21 bp, Homo sapiens
cattccgaggggctcagttct

SEQ ID NO: 5864422 - DNA, 18 bp, Homo sapiens
cattccgagggtgaaaca

SEQ ID NO: 5864423 - DNA, 20 bp, Homo sapiens
cattccgcagcccccacccc

SEQ ID NO: 5864424 - DNA, 16 bp, Homo sapiens
cattccgttgtctgtg

SEQ ID NO: 5864425 - DNA, 22 bp, Homo sapiens
cattcctaaagaaaaatatctt

SEQ ID NO: 5864426 - DNA, 15 bp, Homo sapiens
cattcctaactagaa

SEQ ID NO: 5864427 - DNA, 16 bp, Homo sapiens
cattcctaactagaat

SEQ ID NO: 5864428 - DNA, 18 bp, Homo sapiens
cattcctaactagaatta

SEQ ID NO: 5864429 - DNA, 23 bp, Homo sapiens
cattcctcaccttttcccgggga

SEQ ID NO: 5864430 - DNA, 15 bp, Homo sapiens
cattcctcagctgcc

SEQ ID NO: 5864431 - DNA, 17 bp, Homo sapiens
cattcctcagctgccaa

SEQ ID NO: 5864432 - DNA, 13 bp, Homo sapiens
cattcctcaggga

SEQ ID NO: 5864433 - DNA, 23 bp, Homo sapiens
cattcctcagggacagagacacc

SEQ ID NO: 5864434 - DNA, 17 bp, Homo sapiens
cattcctcatgaatgta

SEQ ID NO: 5864435 - DNA, 21 bp, Homo sapiens
cattcctcatgaatgtaaatt

SEQ ID NO: 5864436 - DNA, 17 bp, Homo sapiens
cattcctccagcctccc

SEQ ID NO: 5864437 - DNA, 18 bp, Homo sapiens
cattcctccagcctcccc

SEQ ID NO: 5864438 - DNA, 19 bp, Homo sapiens
cattcctccagcctcccct

SEQ ID NO: 5864439 - DNA, 12 bp, Homo sapiens
cattcctccagg

SEQ ID NO: 5864440 - DNA, 19 bp, Homo sapiens
cattcctcccattcaagat

SEQ ID NO: 5864441 - DNA, 14 bp, Homo sapiens
cattcctgaacagg

SEQ ID NO: 5864442 - DNA, 17 bp, Homo sapiens
cattcctgaagaaccag

SEQ ID NO: 5864443 - DNA, 20 bp, Homo sapiens
cattcctgaagaaccagtcc

SEQ ID NO: 5864444 - DNA, 21 bp, Homo sapiens
cattcctgaagaaccagtccc

SEQ ID NO: 5864445 - DNA, 18 bp, Homo sapiens
cattcctgaccctcactt

SEQ ID NO: 5864446 - DNA, 13 bp, Homo sapiens
cattcctgacggc

SEQ ID NO: 5864447 - DNA, 17 bp, Homo sapiens
cattcctgagattctgg

SEQ ID NO: 5864448 - DNA, 22 bp, Homo sapiens
cattcctgagattctgggaaag

SEQ ID NO: 5864449 - DNA, 21 bp, Homo sapiens
cattcctgatatgatttaaaa

SEQ ID NO: 5864450 - DNA, 22 bp, Homo sapiens
cattcctgatgcttcttcagag

SEQ ID NO: 5864451 - DNA, 24 bp, Homo sapiens
cattcctgatggaattgttatact

SEQ ID NO: 5864452 - DNA, 13 bp, Homo sapiens
cattcctgcctgg

SEQ ID NO: 5864453 - DNA, 15 bp, Homo sapiens
cattcctgcctggtc

SEQ ID NO: 5864454 - DNA, 13 bp, Homo sapiens
cattcctgcctgt

SEQ ID NO: 5864455 - DNA, 15 bp, Homo sapiens
cattcctgcctgtct

SEQ ID NO: 5864456 - DNA, 15 bp, Homo sapiens
cattcctgcctttaa

SEQ ID NO: 5864457 - DNA, 17 bp, Homo sapiens
cattcctggaaaccaca

SEQ ID NO: 5864458 - DNA, 16 bp, Homo sapiens
cattcctggagcccga

SEQ ID NO: 5864459 - DNA, 17 bp, Homo sapiens
cattcctggagcccgag

SEQ ID NO: 5864460 - DNA, 13 bp, Homo sapiens
cattcctggcccc

SEQ ID NO: 5864461 - DNA, 16 bp, Homo sapiens
cattcctgggcacagt

SEQ ID NO: 5864462 - DNA, 21 bp, Homo sapiens
cattcctggtacccagccatc

SEQ ID NO: 5864463 - DNA, 18 bp, Homo sapiens
cattcctgtattcacccg

SEQ ID NO: 5864464 - DNA, 12 bp, Homo sapiens
cattcctgtcaa

SEQ ID NO: 5864465 - DNA, 13 bp, Homo sapiens
cattcctgtccct

SEQ ID NO: 5864466 - DNA, 14 bp, Homo sapiens
cattcctgttctct

SEQ ID NO: 5864467 - DNA, 14 bp, Homo sapiens
cattcctgttcttt

SEQ ID NO: 5864468 - DNA, 16 bp, Homo sapiens
cattccttaattgtat

SEQ ID NO: 5864469 - DNA, 16 bp, Homo sapiens
cattccttacttgcac

SEQ ID NO: 5864470 - DNA, 21 bp, Homo sapiens
cattccttagcagctcaggcg

SEQ ID NO: 5864471 - DNA, 16 bp, Homo sapiens
cattccttcaaataaa

SEQ ID NO: 5864472 - DNA, 22 bp, Homo sapiens
cattccttcaaataaagaaatt

SEQ ID NO: 5864473 - DNA, 12 bp, Homo sapiens
cattccttccca

SEQ ID NO: 5864474 - DNA, 19 bp, Homo sapiens
cattccttctggaggacac

SEQ ID NO: 5864475 - DNA, 19 bp, Homo sapiens
cattccttctttgataatg

SEQ ID NO: 5864476 - DNA, 16 bp, Homo sapiens
cattccttgaggacag

SEQ ID NO: 5864477 - DNA, 15 bp, Homo sapiens
cattccttgcgcctc

SEQ ID NO: 5864478 - DNA, 20 bp, Homo sapiens
cattccttgcgcctcagccc

SEQ ID NO: 5864479 - DNA, 18 bp, Homo sapiens
cattcgaatctctgcccc

SEQ ID NO: 5864480 - DNA, 22 bp, Homo sapiens
cattcgacctataagaagcctt

SEQ ID NO: 5864481 - DNA, 23 bp, Homo sapiens
cattcgacctataagaagcctta

SEQ ID NO: 5864482 - DNA, 16 bp, Homo sapiens
cattcgatctcattca

SEQ ID NO: 5864483 - DNA, 19 bp, Homo sapiens
cattcgcctgtgggaagag

SEQ ID NO: 5864484 - DNA, 17 bp, Homo sapiens
cattcgcgctctgctca

SEQ ID NO: 5864485 - DNA, 15 bp, Homo sapiens
cattcggaccctgcc

SEQ ID NO: 5864486 - DNA, 15 bp, Homo sapiens
cattcggctccctgg

SEQ ID NO: 5864487 - DNA, 19 bp, Homo sapiens
cattcggctccctggagcc

SEQ ID NO: 5864488 - DNA, 17 bp, Homo sapiens
cattcgggccacagggc

SEQ ID NO: 5864489 - DNA, 23 bp, Homo sapiens
cattcgggccccacctgcagctc

SEQ ID NO: 5864490 - DNA, 21 bp, Homo sapiens
cattcggggaagctgcacatg

SEQ ID NO: 5864491 - DNA, 13 bp, Homo sapiens
cattcggtgtgaa

SEQ ID NO: 5864492 - DNA, 19 bp, Homo sapiens
cattcgtacataatactga

SEQ ID NO: 5864493 - DNA, 18 bp, Homo sapiens
cattcgtgagctggggac

SEQ ID NO: 5864494 - DNA, 19 bp, Homo sapiens
cattcgtgagctggggact

SEQ ID NO: 5864495 - DNA, 14 bp, Homo sapiens
cattcgttgctcca

SEQ ID NO: 5864496 - DNA, 13 bp, Homo sapiens
cattctaaaacac

SEQ ID NO: 5864497 - DNA, 13 bp, Homo sapiens
cattctaaaatca

SEQ ID NO: 5864498 - DNA, 19 bp, Homo sapiens
cattctaaaccaaaacaga

SEQ ID NO: 5864499 - DNA, 22 bp, Homo sapiens
cattctaactcatatgttccca

SEQ ID NO: 5864500 - DNA, 15 bp, Homo sapiens
cattctaagtgtgtt

SEQ ID NO: 5864501 - DNA, 19 bp, Homo sapiens
cattctaatgatggcccat

SEQ ID NO: 5864502 - DNA, 12 bp, Homo sapiens
cattctaatgca

SEQ ID NO: 5864503 - DNA, 21 bp, Homo sapiens
cattctaatgcatatttataa

SEQ ID NO: 5864504 - DNA, 14 bp, Homo sapiens
cattctaattacaa

SEQ ID NO: 5864505 - DNA, 13 bp, Homo sapiens
cattctaatttgc

SEQ ID NO: 5864506 - DNA, 14 bp, Homo sapiens
cattctaatttgca

SEQ ID NO: 5864507 - DNA, 17 bp, Homo sapiens
cattctacacagagcag

SEQ ID NO: 5864508 - DNA, 19 bp, Homo sapiens
cattctacacagagcagga

SEQ ID NO: 5864509 - DNA, 15 bp, Homo sapiens
cattctacacctgga

SEQ ID NO: 5864510 - DNA, 16 bp, Homo sapiens
cattctacacctggac

SEQ ID NO: 5864511 - DNA, 18 bp, Homo sapiens
cattctacacctggacca

SEQ ID NO: 5864512 - DNA, 16 bp, Homo sapiens
cattctacagaataat

SEQ ID NO: 5864513 - DNA, 21 bp, Homo sapiens
cattctacagaataatccagt

SEQ ID NO: 5864514 - DNA, 17 bp, Homo sapiens
cattctacagttgtgat

SEQ ID NO: 5864515 - DNA, 16 bp, Homo sapiens
cattctaccaagctgt

SEQ ID NO: 5864516 - DNA, 17 bp, Homo sapiens
cattctaccaagctgtc

SEQ ID NO: 5864517 - DNA, 21 bp, Homo sapiens
cattctaccaagctgtcacag

SEQ ID NO: 5864518 - DNA, 15 bp, Homo sapiens
cattctactgaaaag

SEQ ID NO: 5864519 - DNA, 14 bp, Homo sapiens
cattctacttgctc

SEQ ID NO: 5864520 - DNA, 21 bp, Homo sapiens
cattctacttgctctggacct

SEQ ID NO: 5864521 - DNA, 23 bp, Homo sapiens
cattctacttgctctggacctgc

SEQ ID NO: 5864522 - DNA, 23 bp, Homo sapiens
cattctacttgcttattacattt

SEQ ID NO: 5864523 - DNA, 20 bp, Homo sapiens
cattctagagggatccaccg

SEQ ID NO: 5864524 - DNA, 10 bp, Homo sapiens
cattctagat

SEQ ID NO: 5864525 - DNA, 20 bp, Homo sapiens
cattctagataaccttgttt

SEQ ID NO: 5864526 - DNA, 23 bp, Homo sapiens
cattctagatcctgcaccccagc

SEQ ID NO: 5864527 - DNA, 13 bp, Homo sapiens
cattctagatgct

SEQ ID NO: 5864528 - DNA, 19 bp, Homo sapiens
cattctagcaccttgttct

SEQ ID NO: 5864529 - DNA, 14 bp, Homo sapiens
cattctaggatgtg

SEQ ID NO: 5864530 - DNA, 20 bp, Homo sapiens
cattctaggatgtggagcta

SEQ ID NO: 5864531 - DNA, 23 bp, Homo sapiens
cattctaggcctcctggcccagg

SEQ ID NO: 5864532 - DNA, 18 bp, Homo sapiens
cattctaggtttgcaaga

SEQ ID NO: 5864533 - DNA, 18 bp, Homo sapiens
cattctagtattctttat

SEQ ID NO: 5864534 - DNA, 15 bp, Homo sapiens
cattctatagccata

SEQ ID NO: 5864535 - DNA, 22 bp, Homo sapiens
cattctatagccataaacctga

SEQ ID NO: 5864536 - DNA, 23 bp, Homo sapiens
cattctatcaagcccaggtgcca

SEQ ID NO: 5864537 - DNA, 17 bp, Homo sapiens
cattctatcgttattat

SEQ ID NO: 5864538 - DNA, 19 bp, Homo sapiens
cattctatcgttattataa

SEQ ID NO: 5864539 - DNA, 14 bp, Homo sapiens
cattctatctactg

SEQ ID NO: 5864540 - DNA, 20 bp, Homo sapiens
cattctatgacaataaattt

SEQ ID NO: 5864541 - DNA, 17 bp, Homo sapiens
cattctatgacattttt

SEQ ID NO: 5864542 - DNA, 23 bp, Homo sapiens
cattctatgactcttgtctcctc

SEQ ID NO: 5864543 - DNA, 17 bp, Homo sapiens
cattctattctccagac

SEQ ID NO: 5864544 - DNA, 23 bp, Homo sapiens
cattctattgccttctttgaaga

SEQ ID NO: 5864545 - DNA, 16 bp, Homo sapiens
cattctcaagccctgc

SEQ ID NO: 5864546 - DNA, 18 bp, Homo sapiens
cattctcaccctgtgaaa

SEQ ID NO: 5864547 - DNA, 14 bp, Homo sapiens
cattctcactccta

SEQ ID NO: 5864548 - DNA, 17 bp, Homo sapiens
cattctcactcctacct

SEQ ID NO: 5864549 - DNA, 13 bp, Homo sapiens
cattctcactgct

SEQ ID NO: 5864550 - DNA, 14 bp, Homo sapiens
cattctcagccaca

SEQ ID NO: 5864551 - DNA, 20 bp, Homo sapiens
cattctcagcccctagcaga

SEQ ID NO: 5864552 - DNA, 15 bp, Homo sapiens
cattctcaggcacca

SEQ ID NO: 5864553 - DNA, 18 bp, Homo sapiens
cattctcagtttttctta

SEQ ID NO: 5864554 - DNA, 23 bp, Homo sapiens
cattctcataattcctacagcac

SEQ ID NO: 5864555 - DNA, 20 bp, Homo sapiens
cattctcatctgcacccttc

SEQ ID NO: 5864556 - DNA, 21 bp, Homo sapiens
cattctcatctgcacccttct

SEQ ID NO: 5864557 - DNA, 13 bp, Homo sapiens
cattctcattgaa

SEQ ID NO: 5864558 - DNA, 17 bp, Homo sapiens
cattctccacctgccag

SEQ ID NO: 5864559 - DNA, 19 bp, Homo sapiens
cattctccacctgccaggg

SEQ ID NO: 5864560 - DNA, 22 bp, Homo sapiens
cattctccaggggtttacagtg

SEQ ID NO: 5864561 - DNA, 15 bp, Homo sapiens
cattctcccaggtac

SEQ ID NO: 5864562 - DNA, 23 bp, Homo sapiens
cattctcccaggtaccagctgcg

SEQ ID NO: 5864563 - DNA, 19 bp, Homo sapiens
cattctcccagtctctgtc

SEQ ID NO: 5864564 - DNA, 23 bp, Homo sapiens
cattctccccctctttgggcagt

SEQ ID NO: 5864565 - DNA, 13 bp, Homo sapiens
cattctcccgctt

SEQ ID NO: 5864566 - DNA, 21 bp, Homo sapiens
cattctcccgcttcctggcct

SEQ ID NO: 5864567 - DNA, 22 bp, Homo sapiens
cattctcccgcttcctggcctc

SEQ ID NO: 5864568 - DNA, 20 bp, Homo sapiens
cattctccctccatggcagg

SEQ ID NO: 5864569 - DNA, 13 bp, Homo sapiens
cattctcctcctc

SEQ ID NO: 5864570 - DNA, 14 bp, Homo sapiens
cattctcctcctcc

SEQ ID NO: 5864571 - DNA, 16 bp, Homo sapiens
cattctcctcctcctc

SEQ ID NO: 5864572 - DNA, 20 bp, Homo sapiens
cattctcctcctcctccctc

SEQ ID NO: 5864573 - DNA, 21 bp, Homo sapiens
cattctcctcctcctccctcc

SEQ ID NO: 5864574 - DNA, 22 bp, Homo sapiens
cattctcctcctcctccctcct

SEQ ID NO: 5864575 - DNA, 17 bp, Homo sapiens
cattctcctgcctcagc

SEQ ID NO: 5864576 - DNA, 21 bp, Homo sapiens
cattctcctgtgcccctcaga

SEQ ID NO: 5864577 - DNA, 20 bp, Homo sapiens
cattctccttgtgttactaa

SEQ ID NO: 5864578 - DNA, 17 bp, Homo sapiens
cattctcgttgcctctg

SEQ ID NO: 5864579 - DNA, 22 bp, Homo sapiens
cattctcgttgcctctgatttt

SEQ ID NO: 5864580 - DNA, 20 bp, Homo sapiens
cattctctaagcctggctta

SEQ ID NO: 5864581 - DNA, 12 bp, Homo sapiens
cattctctctcc

SEQ ID NO: 5864582 - DNA, 15 bp, Homo sapiens
cattctctctcctgt

SEQ ID NO: 5864583 - DNA, 16 bp, Homo sapiens
cattctctctcctgta

SEQ ID NO: 5864584 - DNA, 20 bp, Homo sapiens
cattctctctcctgtccaac

SEQ ID NO: 5864585 - DNA, 15 bp, Homo sapiens
cattctctctgccca

SEQ ID NO: 5864586 - DNA, 14 bp, Homo sapiens
cattctctctgctc

SEQ ID NO: 5864587 - DNA, 17 bp, Homo sapiens
cattctctctgctcagt

SEQ ID NO: 5864588 - DNA, 18 bp, Homo sapiens
cattctctctgctcagtg

SEQ ID NO: 5864589 - DNA, 23 bp, Homo sapiens
cattctctgtctcatccatcatc

SEQ ID NO: 5864590 - DNA, 18 bp, Homo sapiens
cattctcttcttgctata

SEQ ID NO: 5864591 - DNA, 15 bp, Homo sapiens
cattctctttgataa

SEQ ID NO: 5864592 - DNA, 19 bp, Homo sapiens
cattctctttgataacaaa

SEQ ID NO: 5864593 - DNA, 21 bp, Homo sapiens
cattctgaaaatagcaggaca

SEQ ID NO: 5864594 - DNA, 16 bp, Homo sapiens
cattctgaaggagccc

SEQ ID NO: 5864595 - DNA, 20 bp, Homo sapiens
cattctgaaggccttgttaa

SEQ ID NO: 5864596 - DNA, 14 bp, Homo sapiens
cattctgaatctga

SEQ ID NO: 5864597 - DNA, 18 bp, Homo sapiens
cattctgaatgcttctaa

SEQ ID NO: 5864598 - DNA, 23 bp, Homo sapiens
cattctgaattaattaatttgga

SEQ ID NO: 5864599 - DNA, 17 bp, Homo sapiens
cattctgacatccacat

SEQ ID NO: 5864600 - DNA, 23 bp, Homo sapiens
cattctgacatccacatgctctg

SEQ ID NO: 5864601 - DNA, 17 bp, Homo sapiens
cattctgaccatttcag

SEQ ID NO: 5864602 - DNA, 23 bp, Homo sapiens
cattctgactcggtttctccaaa

SEQ ID NO: 5864603 - DNA, 15 bp, Homo sapiens
cattctgagctcccc

SEQ ID NO: 5864604 - DNA, 17 bp, Homo sapiens
cattctgagctccccat

SEQ ID NO: 5864605 - DNA, 13 bp, Homo sapiens
cattctgagctgg

SEQ ID NO: 5864606 - DNA, 15 bp, Homo sapiens
cattctgatgagcaa

SEQ ID NO: 5864607 - DNA, 23 bp, Homo sapiens
cattctgattcgaatgacactgt

SEQ ID NO: 5864608 - DNA, 19 bp, Homo sapiens
cattctgattggacctggc

SEQ ID NO: 5864609 - DNA, 20 bp, Homo sapiens
cattctgattggacctggcc

SEQ ID NO: 5864610 - DNA, 23 bp, Homo sapiens
cattctgattggacctggcccag

SEQ ID NO: 5864611 - DNA, 17 bp, Homo sapiens
cattctgcaagtatact

SEQ ID NO: 5864612 - DNA, 16 bp, Homo sapiens
cattctgcacgctgcc

SEQ ID NO: 5864613 - DNA, 12 bp, Homo sapiens
cattctgcatta

SEQ ID NO: 5864614 - DNA, 13 bp, Homo sapiens
cattctgcattaa

SEQ ID NO: 5864615 - DNA, 22 bp, Homo sapiens
cattctgcattgagaaggaact

SEQ ID NO: 5864616 - DNA, 19 bp, Homo sapiens
cattctgcattgctagata

SEQ ID NO: 5864617 - DNA, 21 bp, Homo sapiens
cattctgcattgctagataaa

SEQ ID NO: 5864618 - DNA, 13 bp, Homo sapiens
cattctgcattta

SEQ ID NO: 5864619 - DNA, 22 bp, Homo sapiens
cattctgccaggcccccaagcc

SEQ ID NO: 5864620 - DNA, 16 bp, Homo sapiens
cattctgccccagagt

SEQ ID NO: 5864621 - DNA, 16 bp, Homo sapiens
cattctgccctgtggg

SEQ ID NO: 5864622 - DNA, 18 bp, Homo sapiens
cattctgccgccccctcc

SEQ ID NO: 5864623 - DNA, 17 bp, Homo sapiens
cattctgcctagagtgt

SEQ ID NO: 5864624 - DNA, 19 bp, Homo sapiens
cattctgcctagagtgtag

SEQ ID NO: 5864625 - DNA, 20 bp, Homo sapiens
cattctgcctcagcctccca

SEQ ID NO: 5864626 - DNA, 18 bp, Homo sapiens
cattctgcctctctagga

SEQ ID NO: 5864627 - DNA, 13 bp, Homo sapiens
cattctgcctgcc

SEQ ID NO: 5864628 - DNA, 16 bp, Homo sapiens
cattctgcctgcccag

SEQ ID NO: 5864629 - DNA, 17 bp, Homo sapiens
cattctgcctgcccagg

SEQ ID NO: 5864630 - DNA, 18 bp, Homo sapiens
cattctgcctgcccaggc

SEQ ID NO: 5864631 - DNA, 19 bp, Homo sapiens
cattctgcctgcccaggcc

SEQ ID NO: 5864632 - DNA, 20 bp, Homo sapiens
cattctgcctgcccaggccc

SEQ ID NO: 5864633 - DNA, 17 bp, Homo sapiens
cattctgcctgccctga

SEQ ID NO: 5864634 - DNA, 23 bp, Homo sapiens
cattctgcctgccctgaaagtcc

SEQ ID NO: 5864635 - DNA, 16 bp, Homo sapiens
cattctgcctgcctgg

SEQ ID NO: 5864636 - DNA, 18 bp, Homo sapiens
cattctgcctgcctggga

SEQ ID NO: 5864637 - DNA, 15 bp, Homo sapiens
cattctgcctgctcc

SEQ ID NO: 5864638 - DNA, 17 bp, Homo sapiens
cattctgcctgctccat

SEQ ID NO: 5864639 - DNA, 19 bp, Homo sapiens
cattctgcctgctccatcg

SEQ ID NO: 5864640 - DNA, 22 bp, Homo sapiens
cattctgctacttcactgtcat

SEQ ID NO: 5864641 - DNA, 14 bp, Homo sapiens
cattctgctccttc

SEQ ID NO: 5864642 - DNA, 18 bp, Homo sapiens
cattctgctctgcccatg

SEQ ID NO: 5864643 - DNA, 19 bp, Homo sapiens
cattctgctctgcccatgc

SEQ ID NO: 5864644 - DNA, 20 bp, Homo sapiens
cattctgctgcccccagacc

SEQ ID NO: 5864645 - DNA, 19 bp, Homo sapiens
cattctgctttcttgccac

SEQ ID NO: 5864646 - DNA, 13 bp, Homo sapiens
cattctggaataa

SEQ ID NO: 5864647 - DNA, 16 bp, Homo sapiens
cattctggacctctgg

SEQ ID NO: 5864648 - DNA, 18 bp, Homo sapiens
cattctggatagagtcct

SEQ ID NO: 5864649 - DNA, 18 bp, Homo sapiens
cattctggatctgaccct

SEQ ID NO: 5864650 - DNA, 22 bp, Homo sapiens
cattctggatctgaccctccca

SEQ ID NO: 5864651 - DNA, 16 bp, Homo sapiens
cattctggcactttaa

SEQ ID NO: 5864652 - DNA, 17 bp, Homo sapiens
cattctggcactttaat

SEQ ID NO: 5864653 - DNA, 19 bp, Homo sapiens
cattctggcagttttgaca

SEQ ID NO: 5864654 - DNA, 20 bp, Homo sapiens
cattctggcagttttgacat

SEQ ID NO: 5864655 - DNA, 14 bp, Homo sapiens
cattctggctccac

SEQ ID NO: 5864656 - DNA, 15 bp, Homo sapiens
cattctggctccacc

SEQ ID NO: 5864657 - DNA, 16 bp, Homo sapiens
cattctgggctgggaa

SEQ ID NO: 5864658 - DNA, 19 bp, Homo sapiens
cattctggtccttagtaaa

SEQ ID NO: 5864659 - DNA, 20 bp, Homo sapiens
cattctggtccttagtaaat

SEQ ID NO: 5864660 - DNA, 22 bp, Homo sapiens
cattctggtccttagtaaattc

SEQ ID NO: 5864661 - DNA, 12 bp, Homo sapiens
cattctggtctc

SEQ ID NO: 5864662 - DNA, 18 bp, Homo sapiens
cattctggtgaccagact

SEQ ID NO: 5864663 - DNA, 20 bp, Homo sapiens
cattctggttccctgctgcg

SEQ ID NO: 5864664 - DNA, 14 bp, Homo sapiens
cattctgtcatcac

SEQ ID NO: 5864665 - DNA, 12 bp, Homo sapiens
cattctgtctct

SEQ ID NO: 5864666 - DNA, 14 bp, Homo sapiens
cattctgtctctgc

SEQ ID NO: 5864667 - DNA, 21 bp, Homo sapiens
cattctgtctctgcttggctt

SEQ ID NO: 5864668 - DNA, 14 bp, Homo sapiens
cattctgtctgttt

SEQ ID NO: 5864669 - DNA, 16 bp, Homo sapiens
cattctgtgatcattt

SEQ ID NO: 5864670 - DNA, 14 bp, Homo sapiens
cattctgtgcaggc

SEQ ID NO: 5864671 - DNA, 18 bp, Homo sapiens
cattctgtgcaggctgca

SEQ ID NO: 5864672 - DNA, 14 bp, Homo sapiens
cattctgtgtccca

SEQ ID NO: 5864673 - DNA, 16 bp, Homo sapiens
cattctgttgcccagg

SEQ ID NO: 5864674 - DNA, 20 bp, Homo sapiens
cattctgttgcccaggctgg

SEQ ID NO: 5864675 - DNA, 21 bp, Homo sapiens
cattctgttttcccccagcaa

SEQ ID NO: 5864676 - DNA, 21 bp, Homo sapiens
cattcttaaaattcaagaaaa

SEQ ID NO: 5864677 - DNA, 18 bp, Homo sapiens
cattcttaacaaactctt

SEQ ID NO: 5864678 - DNA, 20 bp, Homo sapiens
cattcttaccgagaaaagga

SEQ ID NO: 5864679 - DNA, 18 bp, Homo sapiens
cattcttactaaaaagta

SEQ ID NO: 5864680 - DNA, 14 bp, Homo sapiens
cattcttataaata

SEQ ID NO: 5864681 - DNA, 17 bp, Homo sapiens
cattcttatgttccaga

SEQ ID NO: 5864682 - DNA, 17 bp, Homo sapiens
cattcttattgacaatt

SEQ ID NO: 5864683 - DNA, 15 bp, Homo sapiens
cattcttcactgtct

SEQ ID NO: 5864684 - DNA, 19 bp, Homo sapiens
cattcttcagtgtctctgt

SEQ ID NO: 5864685 - DNA, 13 bp, Homo sapiens
cattcttcagttc

SEQ ID NO: 5864686 - DNA, 20 bp, Homo sapiens
cattcttcagtttttcactt

SEQ ID NO: 5864687 - DNA, 21 bp, Homo sapiens
cattcttccatcatcactgta

SEQ ID NO: 5864688 - DNA, 22 bp, Homo sapiens
cattcttccatcatcactgtaa

SEQ ID NO: 5864689 - DNA, 23 bp, Homo sapiens
cattcttccatcatcactgtaaa

SEQ ID NO: 5864690 - DNA, 18 bp, Homo sapiens
cattcttcctagttttct

SEQ ID NO: 5864691 - DNA, 21 bp, Homo sapiens
cattcttcctagttttctcct

SEQ ID NO: 5864692 - DNA, 19 bp, Homo sapiens
cattcttcgacatccgtca

SEQ ID NO: 5864693 - DNA, 18 bp, Homo sapiens
cattcttctctagctggt

SEQ ID NO: 5864694 - DNA, 17 bp, Homo sapiens
cattcttctctcccaca

SEQ ID NO: 5864695 - DNA, 18 bp, Homo sapiens
cattcttctctgttgtcg

SEQ ID NO: 5864696 - DNA, 19 bp, Homo sapiens
cattcttctgagcactgtt

SEQ ID NO: 5864697 - DNA, 13 bp, Homo sapiens
cattcttctgatc

SEQ ID NO: 5864698 - DNA, 22 bp, Homo sapiens
cattcttctgatcactgaaata

SEQ ID NO: 5864699 - DNA, 17 bp, Homo sapiens
cattcttggcatctact

SEQ ID NO: 5864700 - DNA, 13 bp, Homo sapiens
cattcttggccca

SEQ ID NO: 5864701 - DNA, 16 bp, Homo sapiens
cattcttggcccagga

SEQ ID NO: 5864702 - DNA, 17 bp, Homo sapiens
cattcttgggaggacac

SEQ ID NO: 5864703 - DNA, 21 bp, Homo sapiens
cattcttggtcaagtttttct

SEQ ID NO: 5864704 - DNA, 16 bp, Homo sapiens
cattcttggttggctg

SEQ ID NO: 5864705 - DNA, 16 bp, Homo sapiens
cattcttggttgttaa

SEQ ID NO: 5864706 - DNA, 18 bp, Homo sapiens
cattcttggttgttaatt

SEQ ID NO: 5864707 - DNA, 22 bp, Homo sapiens
cattcttgtaaggctttgatta

SEQ ID NO: 5864708 - DNA, 14 bp, Homo sapiens
cattcttgtcctgg

SEQ ID NO: 5864709 - DNA, 14 bp, Homo sapiens
cattcttgtgggag

SEQ ID NO: 5864710 - DNA, 21 bp, Homo sapiens
cattcttgtgggagacagcag

SEQ ID NO: 5864711 - DNA, 14 bp, Homo sapiens
cattcttgttcaaa

SEQ ID NO: 5864712 - DNA, 23 bp, Homo sapiens
cattctttacagcaaatgttata

SEQ ID NO: 5864713 - DNA, 17 bp, Homo sapiens
cattctttagagatgct

SEQ ID NO: 5864714 - DNA, 19 bp, Homo sapiens
cattctttataaaccataa

SEQ ID NO: 5864715 - DNA, 14 bp, Homo sapiens
cattctttatagtg

SEQ ID NO: 5864716 - DNA, 22 bp, Homo sapiens
cattctttatagtgaagtgtta

SEQ ID NO: 5864717 - DNA, 15 bp, Homo sapiens
cattctttcagctgt

SEQ ID NO: 5864718 - DNA, 12 bp, Homo sapiens
cattctttccca

SEQ ID NO: 5864719 - DNA, 14 bp, Homo sapiens
cattctttcccaac

SEQ ID NO: 5864720 - DNA, 17 bp, Homo sapiens
cattctttctgataact

SEQ ID NO: 5864721 - DNA, 12 bp, Homo sapiens
cattctttcttc

SEQ ID NO: 5864722 - DNA, 17 bp, Homo sapiens
cattctttcttggtgca

SEQ ID NO: 5864723 - DNA, 20 bp, Homo sapiens
cattctttcttggtgcattc

SEQ ID NO: 5864724 - DNA, 15 bp, Homo sapiens
cattctttgaacatg

SEQ ID NO: 5864725 - DNA, 13 bp, Homo sapiens
cattctttgcagg

SEQ ID NO: 5864726 - DNA, 17 bp, Homo sapiens
cattctttgtatcttaa

SEQ ID NO: 5864727 - DNA, 20 bp, Homo sapiens
cattctttgtatcttaaatc

SEQ ID NO: 5864728 - DNA, 21 bp, Homo sapiens
cattctttgtatcttaaatct

SEQ ID NO: 5864729 - DNA, 16 bp, Homo sapiens
cattcttttaaaagac

SEQ ID NO: 5864730 - DNA, 18 bp, Homo sapiens
cattcttttaaaagacaa

SEQ ID NO: 5864731 - DNA, 19 bp, Homo sapiens
cattcttttaaaagacaag

SEQ ID NO: 5864732 - DNA, 15 bp, Homo sapiens
cattgtattagatct

SEQ ID NO: 5864733 - DNA, 23 bp, Homo sapiens
cattgtattcagagttgatggtt

SEQ ID NO: 5864734 - DNA, 11 bp, Homo sapiens
cattgtattgt

SEQ ID NO: 5864735 - DNA, 19 bp, Homo sapiens
cattgtatttaaaacattt

SEQ ID NO: 5864736 - DNA, 19 bp, Homo sapiens
cattgtcaccgcaggtgct

SEQ ID NO: 5864737 - DNA, 19 bp, Homo sapiens
cattgtcagaatgttgtgt

SEQ ID NO: 5864738 - DNA, 13 bp, Homo sapiens
cattgtcagagat

SEQ ID NO: 5864739 - DNA, 23 bp, Homo sapiens
cattgtcatcagaggggagcagc

SEQ ID NO: 5864740 - DNA, 13 bp, Homo sapiens
cattgtccaaagt

SEQ ID NO: 5864741 - DNA, 19 bp, Homo sapiens
cattgtccaatcctatgtt

SEQ ID NO: 5864742 - DNA, 16 bp, Homo sapiens
cattgtccagagctgc

SEQ ID NO: 5864743 - DNA, 15 bp, Homo sapiens
cattgtccatgccta

SEQ ID NO: 5864744 - DNA, 14 bp, Homo sapiens
cattgtccctctgc

SEQ ID NO: 5864745 - DNA, 15 bp, Homo sapiens
cattgtccctctgcc

SEQ ID NO: 5864746 - DNA, 19 bp, Homo sapiens
cattgtccctctgccccat

SEQ ID NO: 5864747 - DNA, 21 bp, Homo sapiens
cattgtcctccttttcacttt

SEQ ID NO: 5864748 - DNA, 11 bp, Homo sapiens
cattgtcctgt

SEQ ID NO: 5864749 - DNA, 22 bp, Homo sapiens
cattgtctaatctgtagaagct

SEQ ID NO: 5864750 - DNA, 13 bp, Homo sapiens
cattgtctaatga

SEQ ID NO: 5864751 - DNA, 16 bp, Homo sapiens
cattgtctaatgacag

SEQ ID NO: 5864752 - DNA, 22 bp, Homo sapiens
cattgtctactcctagaagaac

SEQ ID NO: 5864753 - DNA, 18 bp, Homo sapiens
cattgtctcagtgctggt

SEQ ID NO: 5864754 - DNA, 19 bp, Homo sapiens
cattgtctcctatatattt

SEQ ID NO: 5864755 - DNA, 21 bp, Homo sapiens
cattgtctcctatatatttct

SEQ ID NO: 5864756 - DNA, 20 bp, Homo sapiens
cattgtctcgtgtacagctc

SEQ ID NO: 5864757 - DNA, 17 bp, Homo sapiens
cattgtctcgtttgtga

SEQ ID NO: 5864758 - DNA, 13 bp, Homo sapiens
cattgtcttcgga

SEQ ID NO: 5864759 - DNA, 13 bp, Homo sapiens
cattgtcttgatg

SEQ ID NO: 5864760 - DNA, 23 bp, Homo sapiens
cattgtcttgttatgtacaaact

SEQ ID NO: 5864761 - DNA, 21 bp, Homo sapiens
cattgtctttatatgaacata

SEQ ID NO: 5864762 - DNA, 14 bp, Homo sapiens
cattgtctttcctc

SEQ ID NO: 5864763 - DNA, 15 bp, Homo sapiens
cattgtctttcctcc

SEQ ID NO: 5864764 - DNA, 15 bp, Homo sapiens
cattgtctttgctgt

SEQ ID NO: 5864765 - DNA, 16 bp, Homo sapiens
cattgtctttgctgta

SEQ ID NO: 5864766 - DNA, 21 bp, Homo sapiens
cattgtctttgctgtactctt

SEQ ID NO: 5864767 - DNA, 20 bp, Homo sapiens
cattgtctttttagatgccc

SEQ ID NO: 5864768 - DNA, 17 bp, Homo sapiens
cattgtgaaccaatgca

SEQ ID NO: 5864769 - DNA, 15 bp, Homo sapiens
cattgtgaagcacct

SEQ ID NO: 5864770 - DNA, 16 bp, Homo sapiens
cattgtgaatattaga

SEQ ID NO: 5864771 - DNA, 21 bp, Homo sapiens
cattgtgaatgttgtcctgtg

SEQ ID NO: 5864772 - DNA, 16 bp, Homo sapiens
cattgtgaattgcctg

SEQ ID NO: 5864773 - DNA, 19 bp, Homo sapiens
cattgtgaattgcctgcca

SEQ ID NO: 5864774 - DNA, 18 bp, Homo sapiens
cattgtgactgtgtttgc

SEQ ID NO: 5864775 - DNA, 17 bp, Homo sapiens
cattgtgagctctggtt

SEQ ID NO: 5864776 - DNA, 15 bp, Homo sapiens
cattgtgatgattat

SEQ ID NO: 5864777 - DNA, 14 bp, Homo sapiens
cattgtgattattg

SEQ ID NO: 5864778 - DNA, 12 bp, Homo sapiens
cattgtgattta

SEQ ID NO: 5864779 - DNA, 19 bp, Homo sapiens
cattgtgccaagccttctg

SEQ ID NO: 5864780 - DNA, 22 bp, Homo sapiens
cattgtgccatgtcaaacaaat

SEQ ID NO: 5864781 - DNA, 15 bp, Homo sapiens
cattgtgccttacta

SEQ ID NO: 5864782 - DNA, 17 bp, Homo sapiens
cattgtgcttaataata

SEQ ID NO: 5864783 - DNA, 13 bp, Homo sapiens
cattgtggctcct

SEQ ID NO: 5864784 - DNA, 16 bp, Homo sapiens
cattgtggctcctatc

SEQ ID NO: 5864785 - DNA, 22 bp, Homo sapiens
cattgtggttatttttatacag

SEQ ID NO: 5864786 - DNA, 18 bp, Homo sapiens
cattgtgtgagcttctac

SEQ ID NO: 5864787 - DNA, 18 bp, Homo sapiens
cattgtgtgatccagccc

SEQ ID NO: 5864788 - DNA, 19 bp, Homo sapiens
cattgtgtggcctggtggg

SEQ ID NO: 5864789 - DNA, 19 bp, Homo sapiens
cattgtgttgacattaaga

SEQ ID NO: 5864790 - DNA, 15 bp, Homo sapiens
cattgtgtttgtgtg

SEQ ID NO: 5864791 - DNA, 14 bp, Homo sapiens
cattgtgttttctt

SEQ ID NO: 5864792 - DNA, 13 bp, Homo sapiens
cattgttaaaaaa

SEQ ID NO: 5864793 - DNA, 16 bp, Homo sapiens
cattgttaaaaaacaa

SEQ ID NO: 5864794 - DNA, 22 bp, Homo sapiens
cattgttaaatacacattatca

SEQ ID NO: 5864795 - DNA, 11 bp, Homo sapiens
cattgttacaa

SEQ ID NO: 5864796 - DNA, 18 bp, Homo sapiens
cattgttacctctatata

SEQ ID NO: 5864797 - DNA, 22 bp, Homo sapiens
cattgttagcactaggcaccca

SEQ ID NO: 5864798 - DNA, 16 bp, Homo sapiens
cattgttataaagaca

SEQ ID NO: 5864799 - DNA, 19 bp, Homo sapiens
cattgttataattactaat

SEQ ID NO: 5864800 - DNA, 17 bp, Homo sapiens
cattgttatataatcat

SEQ ID NO: 5864801 - DNA, 18 bp, Homo sapiens
cattgttatttaatagct

SEQ ID NO: 5864802 - DNA, 13 bp, Homo sapiens
cattgttattttc

SEQ ID NO: 5864803 - DNA, 19 bp, Homo sapiens
cattgttattttcagtgat

SEQ ID NO: 5864804 - DNA, 15 bp, Homo sapiens
cattgttcaaaagga

SEQ ID NO: 5864805 - DNA, 16 bp, Homo sapiens
cattgttcaaaaggaa

SEQ ID NO: 5864806 - DNA, 18 bp, Homo sapiens
cattgttcaattagaata

SEQ ID NO: 5864807 - DNA, 14 bp, Homo sapiens
cattgttcacttct

SEQ ID NO: 5864808 - DNA, 14 bp, Homo sapiens
cattgttcagaaga

SEQ ID NO: 5864809 - DNA, 18 bp, Homo sapiens
cattgttcagaagacctc

SEQ ID NO: 5864810 - DNA, 17 bp, Homo sapiens
cattgttcaggtgaata

SEQ ID NO: 5864811 - DNA, 15 bp, Homo sapiens
cattgttcccttcct

SEQ ID NO: 5864812 - DNA, 13 bp, Homo sapiens
cattgttgagcta

SEQ ID NO: 5864813 - DNA, 17 bp, Homo sapiens
cattgttgagctgtcat

SEQ ID NO: 5864814 - DNA, 16 bp, Homo sapiens
cattgttgctccctgt

SEQ ID NO: 5864815 - DNA, 17 bp, Homo sapiens
cattgttggacatttgg

SEQ ID NO: 5864816 - DNA, 15 bp, Homo sapiens
cattgttgtaaagta

SEQ ID NO: 5864817 - DNA, 16 bp, Homo sapiens
cattgttgtaaagtat

SEQ ID NO: 5864818 - DNA, 13 bp, Homo sapiens
cattgttgtcaaa

SEQ ID NO: 5864819 - DNA, 18 bp, Homo sapiens
cattgttgtgtataattt

SEQ ID NO: 5864820 - DNA, 12 bp, Homo sapiens
cattgtttaaaa

SEQ ID NO: 5864821 - DNA, 20 bp, Homo sapiens
cattgtttgaaacaaagaag

SEQ ID NO: 5864822 - DNA, 22 bp, Homo sapiens
cattgtttgaaacaaagaaggt

SEQ ID NO: 5864823 - DNA, 14 bp, Homo sapiens
cattgtttgcttat

SEQ ID NO: 5864824 - DNA, 17 bp, Homo sapiens
cattgtttgcttattgt

SEQ ID NO: 5864825 - DNA, 18 bp, Homo sapiens
cattgtttgcttattgtt

SEQ ID NO: 5864826 - DNA, 21 bp, Homo sapiens
cattgtttgcttattgttcca

SEQ ID NO: 5864827 - DNA, 15 bp, Homo sapiens
cattgtttggcattg

SEQ ID NO: 5864828 - DNA, 14 bp, Homo sapiens
cattgtttgtcctt

SEQ ID NO: 5864829 - DNA, 16 bp, Homo sapiens
cattgttttaaaaaga

SEQ ID NO: 5864830 - DNA, 12 bp, Homo sapiens
cattgttttagt

SEQ ID NO: 5864831 - DNA, 21 bp, Homo sapiens
cattgttttcttttacagact

SEQ ID NO: 5864832 - DNA, 19 bp, Homo sapiens
cattgttttgaatattact

SEQ ID NO: 5864833 - DNA, 12 bp, Homo sapiens
cattgtttttgt

SEQ ID NO: 5864834 - DNA, 12 bp, Homo sapiens
catttaaaaaaa

SEQ ID NO: 5864835 - DNA, 20 bp, Homo sapiens
catttaaaaagctcactgct

SEQ ID NO: 5864836 - DNA, 20 bp, Homo sapiens
catttaaaaatatatagctt

SEQ ID NO: 5864837 - DNA, 23 bp, Homo sapiens
catttaaaacaagctgatagtgt

SEQ ID NO: 5864838 - DNA, 12 bp, Homo sapiens
catttaaaacag

SEQ ID NO: 5864839 - DNA, 17 bp, Homo sapiens
catttaaaacagacact

SEQ ID NO: 5864840 - DNA, 23 bp, Homo sapiens
catttaaaacagacactggcatg

SEQ ID NO: 5864841 - DNA, 12 bp, Homo sapiens
catttaaaacat

SEQ ID NO: 5864842 - DNA, 19 bp, Homo sapiens
catttaaaacattaaaata

SEQ ID NO: 5864843 - DNA, 14 bp, Homo sapiens
catttaaaagagta

SEQ ID NO: 5864844 - DNA, 22 bp, Homo sapiens
catttaaaagcataaggccgga

SEQ ID NO: 5864845 - DNA, 20 bp, Homo sapiens
catttaaaatagttttctaa

SEQ ID NO: 5864846 - DNA, 21 bp, Homo sapiens
catttaaaatagttttctaaa

SEQ ID NO: 5864847 - DNA, 15 bp, Homo sapiens
catttaaaatgatta

SEQ ID NO: 5864848 - DNA, 21 bp, Homo sapiens
catttaaaattaaataaattt

SEQ ID NO: 5864849 - DNA, 22 bp, Homo sapiens
catttaaaattaaataaatttt

SEQ ID NO: 5864850 - DNA, 16 bp, Homo sapiens
catttaaaattgctat

SEQ ID NO: 5864851 - DNA, 14 bp, Homo sapiens
catttaaacagatg

SEQ ID NO: 5864852 - DNA, 16 bp, Homo sapiens
catttaaacagatgtc

SEQ ID NO: 5864853 - DNA, 17 bp, Homo sapiens
catttaaactaaattac

SEQ ID NO: 5864854 - DNA, 16 bp, Homo sapiens
catttaaactaacctt

SEQ ID NO: 5864855 - DNA, 17 bp, Homo sapiens
catttaaactaaccttt

SEQ ID NO: 5864856 - DNA, 12 bp, Homo sapiens
catttaaacttt

SEQ ID NO: 5864857 - DNA, 13 bp, Homo sapiens
catttaaagattt

SEQ ID NO: 5864858 - DNA, 14 bp, Homo sapiens
catttaaagcattg

SEQ ID NO: 5864859 - DNA, 17 bp, Homo sapiens
catttaaagcattgctg

SEQ ID NO: 5864860 - DNA, 17 bp, Homo sapiens
catttaaagctaaattt

SEQ ID NO: 5864861 - DNA, 15 bp, Homo sapiens
catttaaagtatttt

SEQ ID NO: 5864862 - DNA, 15 bp, Homo sapiens
catttaaagttgtat

SEQ ID NO: 5864863 - DNA, 19 bp, Homo sapiens
catttaaagttgtataaaa

SEQ ID NO: 5864864 - DNA, 18 bp, Homo sapiens
catttaaatacagtcttc

SEQ ID NO: 5864865 - DNA, 16 bp, Homo sapiens
catttaaatatctgaa

SEQ ID NO: 5864866 - DNA, 16 bp, Homo sapiens
catttaaatgtgtaca

SEQ ID NO: 5864867 - DNA, 21 bp, Homo sapiens
catttaaatgtgtacaatgta

SEQ ID NO: 5864868 - DNA, 17 bp, Homo sapiens
catttaaattccacaga

SEQ ID NO: 5864869 - DNA, 17 bp, Homo sapiens
catttaaatttgatttc

SEQ ID NO: 5864870 - DNA, 18 bp, Homo sapiens
catttaaattttttggca

SEQ ID NO: 5864871 - DNA, 13 bp, Homo sapiens
catttaacactga

SEQ ID NO: 5864872 - DNA, 21 bp, Homo sapiens
catttaacactgagtgaaata

SEQ ID NO: 5864873 - DNA, 13 bp, Homo sapiens
catttaacataat

SEQ ID NO: 5864874 - DNA, 15 bp, Homo sapiens
catttaacattgttt

SEQ ID NO: 5864875 - DNA, 23 bp, Homo sapiens
catttaacccccctgtacacaac

SEQ ID NO: 5864876 - DNA, 14 bp, Homo sapiens
catttaactggagc

SEQ ID NO: 5864877 - DNA, 15 bp, Homo sapiens
catttaactggagct

SEQ ID NO: 5864878 - DNA, 21 bp, Homo sapiens
catttaacttacatttgtact

SEQ ID NO: 5864879 - DNA, 13 bp, Homo sapiens
catttaagaacaa

SEQ ID NO: 5864880 - DNA, 14 bp, Homo sapiens
catttaagaacaga

SEQ ID NO: 5864881 - DNA, 23 bp, Homo sapiens
catttaagaaggagttctgacat

SEQ ID NO: 5864882 - DNA, 18 bp, Homo sapiens
catttaagaattgccagt

SEQ ID NO: 5864883 - DNA, 23 bp, Homo sapiens
catttaagaatttaccagaaata

SEQ ID NO: 5864884 - DNA, 20 bp, Homo sapiens
catttaagcaggaatgcaat

SEQ ID NO: 5864885 - DNA, 14 bp, Homo sapiens
catttaagggaaaa

SEQ ID NO: 5864886 - DNA, 20 bp, Homo sapiens
catttaagtatcttgtgctt

SEQ ID NO: 5864887 - DNA, 23 bp, Homo sapiens
catttaagtatcttgtgcttctt

SEQ ID NO: 5864888 - DNA, 16 bp, Homo sapiens
catttaagttgtaaac

SEQ ID NO: 5864889 - DNA, 12 bp, Homo sapiens
catttaagtttc

SEQ ID NO: 5864890 - DNA, 21 bp, Homo sapiens
catttaataaaactgcgagga

SEQ ID NO: 5864891 - DNA, 17 bp, Homo sapiens
catttaataaagaaata

SEQ ID NO: 5864892 - DNA, 14 bp, Homo sapiens
catttaataaagat

SEQ ID NO: 5864893 - DNA, 18 bp, Homo sapiens
catttaataaagatgagt

SEQ ID NO: 5864894 - DNA, 17 bp, Homo sapiens
catttaataactttgct

SEQ ID NO: 5864895 - DNA, 14 bp, Homo sapiens
catttaataatata

SEQ ID NO: 5864896 - DNA, 19 bp, Homo sapiens
catttaataatatcaaaga

SEQ ID NO: 5864897 - DNA, 18 bp, Homo sapiens
catttaataatgtatgta

SEQ ID NO: 5864898 - DNA, 15 bp, Homo sapiens
catttaatacagata

SEQ ID NO: 5864899 - DNA, 16 bp, Homo sapiens
catttaatacagataa

SEQ ID NO: 5864900 - DNA, 13 bp, Homo sapiens
catttaatagact

SEQ ID NO: 5864901 - DNA, 18 bp, Homo sapiens
catttaatatttttcaaa

SEQ ID NO: 5864902 - DNA, 14 bp, Homo sapiens
catttaatcaatat

SEQ ID NO: 5864903 - DNA, 18 bp, Homo sapiens
catttaatcaatatttaa

SEQ ID NO: 5864904 - DNA, 12 bp, Homo sapiens
catttaatcatt

SEQ ID NO: 5864905 - DNA, 13 bp, Homo sapiens
catttaatcattt

SEQ ID NO: 5864906 - DNA, 14 bp, Homo sapiens
catttaatcccagg

SEQ ID NO: 5864907 - DNA, 16 bp, Homo sapiens
catttaatcccaggaa

SEQ ID NO: 5864908 - DNA, 16 bp, Homo sapiens
catttaatgaacacaa

SEQ ID NO: 5864909 - DNA, 22 bp, Homo sapiens
catttaatggcagctagtgcct

SEQ ID NO: 5864910 - DNA, 21 bp, Homo sapiens
catttaatgtagccatgggac

SEQ ID NO: 5864911 - DNA, 19 bp, Homo sapiens
catttaatgtcgaggctct

SEQ ID NO: 5864912 - DNA, 15 bp, Homo sapiens
catttcttcagaggg

SEQ ID NO: 5864913 - DNA, 17 bp, Homo sapiens
catttcttcagagggaa

SEQ ID NO: 5864914 - DNA, 22 bp, Homo sapiens
catttcttcagtcagaaaactt

SEQ ID NO: 5864915 - DNA, 23 bp, Homo sapiens
catttcttccacaagagcccagg

SEQ ID NO: 5864916 - DNA, 17 bp, Homo sapiens
catttcttcctcagctg

SEQ ID NO: 5864917 - DNA, 21 bp, Homo sapiens
catttcttctcccaaatgtct

SEQ ID NO: 5864918 - DNA, 22 bp, Homo sapiens
catttcttctctctgtgctggt

SEQ ID NO: 5864919 - DNA, 18 bp, Homo sapiens
catttcttctctctgttc

SEQ ID NO: 5864920 - DNA, 19 bp, Homo sapiens
catttcttctctctgttcc

SEQ ID NO: 5864921 - DNA, 20 bp, Homo sapiens
catttcttctctctgttccc

SEQ ID NO: 5864922 - DNA, 17 bp, Homo sapiens
catttcttgaaaagcct

SEQ ID NO: 5864923 - DNA, 23 bp, Homo sapiens
catttcttgaaaagccttggaga

SEQ ID NO: 5864924 - DNA, 12 bp, Homo sapiens
catttcttgggc

SEQ ID NO: 5864925 - DNA, 18 bp, Homo sapiens
catttctttatttctgtc

SEQ ID NO: 5864926 - DNA, 22 bp, Homo sapiens
catttctttatttctgtctcat

SEQ ID NO: 5864927 - DNA, 13 bp, Homo sapiens
catttctttgcat

SEQ ID NO: 5864928 - DNA, 15 bp, Homo sapiens
catttctttgcttat

SEQ ID NO: 5864929 - DNA, 18 bp, Homo sapiens
catttctttgtctttttc

SEQ ID NO: 5864930 - DNA, 19 bp, Homo sapiens
catttctttgtctttttcc

SEQ ID NO: 5864931 - DNA, 22 bp, Homo sapiens
catttctttgtctttttcctac

SEQ ID NO: 5864932 - DNA, 23 bp, Homo sapiens
catttctttgtctttttcctact

SEQ ID NO: 5864933 - DNA, 14 bp, Homo sapiens
catttcttttactc

SEQ ID NO: 5864934 - DNA, 13 bp, Homo sapiens
catttcttttctg

SEQ ID NO: 5864935 - DNA, 21 bp, Homo sapiens
catttcttttctttttacata

SEQ ID NO: 5864936 - DNA, 12 bp, Homo sapiens
catttgaaaata

SEQ ID NO: 5864937 - DNA, 17 bp, Homo sapiens
catttgaaaattttgat

SEQ ID NO: 5864938 - DNA, 11 bp, Homo sapiens
catttgaaaga

SEQ ID NO: 5864939 - DNA, 14 bp, Homo sapiens
catttgaaagaaag

SEQ ID NO: 5864940 - DNA, 15 bp, Homo sapiens
catttgaaagaaagg

SEQ ID NO: 5864941 - DNA, 15 bp, Homo sapiens
catttgaaagaggag

SEQ ID NO: 5864942 - DNA, 16 bp, Homo sapiens
catttgaaagaggagt

SEQ ID NO: 5864943 - DNA, 21 bp, Homo sapiens
catttgaaagtgggtttcaat

SEQ ID NO: 5864944 - DNA, 18 bp, Homo sapiens
catttgaagtgtacctgt

SEQ ID NO: 5864945 - DNA, 15 bp, Homo sapiens
catttgaatgcattt

SEQ ID NO: 5864946 - DNA, 18 bp, Homo sapiens
catttgaatgcattttgt

SEQ ID NO: 5864947 - DNA, 21 bp, Homo sapiens
catttgacaaaactaaccttg

SEQ ID NO: 5864948 - DNA, 17 bp, Homo sapiens
catttgacacaaagctt

SEQ ID NO: 5864949 - DNA, 19 bp, Homo sapiens
catttgacacaaagcttct

SEQ ID NO: 5864950 - DNA, 21 bp, Homo sapiens
catttgacacaaagcttctaa

SEQ ID NO: 5864951 - DNA, 13 bp, Homo sapiens
catttgacacata

SEQ ID NO: 5864952 - DNA, 14 bp, Homo sapiens
catttgacatgagt

SEQ ID NO: 5864953 - DNA, 23 bp, Homo sapiens
catttgactgaagatgcagctca

SEQ ID NO: 5864954 - DNA, 19 bp, Homo sapiens
catttgactgtctcacttt

SEQ ID NO: 5864955 - DNA, 12 bp, Homo sapiens
catttgagaaat

SEQ ID NO: 5864956 - DNA, 22 bp, Homo sapiens
catttgagaaatgcatattgta

SEQ ID NO: 5864957 - DNA, 23 bp, Homo sapiens
catttgagaaatgcatattgtat

SEQ ID NO: 5864958 - DNA, 16 bp, Homo sapiens
catttgagaactgtca

SEQ ID NO: 5864959 - DNA, 16 bp, Homo sapiens
catttgagatttttgg

SEQ ID NO: 5864960 - DNA, 17 bp, Homo sapiens
catttgagcagggctca

SEQ ID NO: 5864961 - DNA, 18 bp, Homo sapiens
catttgaggaagctctcc

SEQ ID NO: 5864962 - DNA, 20 bp, Homo sapiens
catttgaggaagctctccct

SEQ ID NO: 5864963 - DNA, 18 bp, Homo sapiens
catttgaggtctgttctt

SEQ ID NO: 5864964 - DNA, 15 bp, Homo sapiens
catttgataaactaa

SEQ ID NO: 5864965 - DNA, 16 bp, Homo sapiens
catttgataatgataa

SEQ ID NO: 5864966 - DNA, 19 bp, Homo sapiens
catttgatacccctgggga

SEQ ID NO: 5864967 - DNA, 14 bp, Homo sapiens
catttgatagaaag

SEQ ID NO: 5864968 - DNA, 13 bp, Homo sapiens
catttgatatttt

SEQ ID NO: 5864969 - DNA, 17 bp, Homo sapiens
catttgatgatagcaga

SEQ ID NO: 5864970 - DNA, 22 bp, Homo sapiens
catttgatgcatgtcttttaaa

SEQ ID NO: 5864971 - DNA, 21 bp, Homo sapiens
catttgatgtctagataacat

SEQ ID NO: 5864972 - DNA, 22 bp, Homo sapiens
catttgatgtctagataacatt

SEQ ID NO: 5864973 - DNA, 11 bp, Homo sapiens
catttgattaa

SEQ ID NO: 5864974 - DNA, 20 bp, Homo sapiens
catttgattaaattatgaat

SEQ ID NO: 5864975 - DNA, 15 bp, Homo sapiens
catttgattaataaa

SEQ ID NO: 5864976 - DNA, 19 bp, Homo sapiens
catttgattaataaaatat

SEQ ID NO: 5864977 - DNA, 14 bp, Homo sapiens
catttgatttaaac

SEQ ID NO: 5864978 - DNA, 15 bp, Homo sapiens
catttgatttaaaca

SEQ ID NO: 5864979 - DNA, 21 bp, Homo sapiens
catttgatttccatgggcccc

SEQ ID NO: 5864980 - DNA, 20 bp, Homo sapiens
catttgatttcgatgtacag

SEQ ID NO: 5864981 - DNA, 16 bp, Homo sapiens
catttgatttgttcat

SEQ ID NO: 5864982 - DNA, 18 bp, Homo sapiens
catttgcaataacagctg

SEQ ID NO: 5864983 - DNA, 21 bp, Homo sapiens
catttgcaataacagctgcaa

SEQ ID NO: 5864984 - DNA, 21 bp, Homo sapiens
catttgcaatatggatttctt

SEQ ID NO: 5864985 - DNA, 12 bp, Homo sapiens
catttgcaatta

SEQ ID NO: 5864986 - DNA, 14 bp, Homo sapiens
catttgcacctctg

SEQ ID NO: 5864987 - DNA, 15 bp, Homo sapiens
catttgcacctctgt

SEQ ID NO: 5864988 - DNA, 18 bp, Homo sapiens
catttgcagctgctggtt

SEQ ID NO: 5864989 - DNA, 22 bp, Homo sapiens
catttgcagggtcctcttctgg

SEQ ID NO: 5864990 - DNA, 21 bp, Homo sapiens
catttgcaggtgaccagaatg

SEQ ID NO: 5864991 - DNA, 15 bp, Homo sapiens
catttgcattgggca

SEQ ID NO: 5864992 - DNA, 17 bp, Homo sapiens
catttgccaactaattt

SEQ ID NO: 5864993 - DNA, 14 bp, Homo sapiens
catttgccaagtga

SEQ ID NO: 5864994 - DNA, 17 bp, Homo sapiens
catttgccaattttcct

SEQ ID NO: 5864995 - DNA, 14 bp, Homo sapiens
catttgccatgctg

SEQ ID NO: 5864996 - DNA, 15 bp, Homo sapiens
catttgccatgctgc

SEQ ID NO: 5864997 - DNA, 16 bp, Homo sapiens
catttgccattcctgg

SEQ ID NO: 5864998 - DNA, 23 bp, Homo sapiens
catttgccctgtggattccagca

SEQ ID NO: 5864999 - DNA, 19 bp, Homo sapiens
catttgcctattcccacac

SEQ ID NO: 5865000 - DNA, 13 bp, Homo sapiens
catttgcctgctt

SEQ ID NO: 5865001 - DNA, 22 bp, Homo sapiens
catttgcctgcttctttccaga

SEQ ID NO: 5865002 - DNA, 12 bp, Homo sapiens
catttgccttgc

SEQ ID NO: 5865003 - DNA, 21 bp, Homo sapiens
catttgcctttctgggagcag

SEQ ID NO: 5865004 - DNA, 23 bp, Homo sapiens
catttgcgcacaacttaaaaagt

SEQ ID NO: 5865005 - DNA, 22 bp, Homo sapiens
catttgcgttccatgatgctgg

SEQ ID NO: 5865006 - DNA, 19 bp, Homo sapiens
catttgctaaggcagctga

SEQ ID NO: 5865007 - DNA, 13 bp, Homo sapiens
catttgctaatga

SEQ ID NO: 5865008 - DNA, 15 bp, Homo sapiens
catttgctactgttg

SEQ ID NO: 5865009 - DNA, 15 bp, Homo sapiens
catttgctcatggaa

SEQ ID NO: 5865010 - DNA, 20 bp, Homo sapiens
catttgctcttcagatgcca

SEQ ID NO: 5865011 - DNA, 17 bp, Homo sapiens
catttgctgaactcagc

SEQ ID NO: 5865012 - DNA, 19 bp, Homo sapiens
catttgctgaatatgcaat

SEQ ID NO: 5865013 - DNA, 21 bp, Homo sapiens
catttgctgagtttcccttcc

SEQ ID NO: 5865014 - DNA, 16 bp, Homo sapiens
catttgctgatttcta

SEQ ID NO: 5865015 - DNA, 21 bp, Homo sapiens
catttgctgcatttcaagtta

SEQ ID NO: 5865016 - DNA, 12 bp, Homo sapiens
catttgctgccc

SEQ ID NO: 5865017 - DNA, 14 bp, Homo sapiens
catttgctgccctg

SEQ ID NO: 5865018 - DNA, 19 bp, Homo sapiens
catttgctgccctggggca

SEQ ID NO: 5865019 - DNA, 20 bp, Homo sapiens
catttgctgccctggggcat

SEQ ID NO: 5865020 - DNA, 16 bp, Homo sapiens
catttgctggcctggc

SEQ ID NO: 5865021 - DNA, 18 bp, Homo sapiens
catttgctggcctggcag

SEQ ID NO: 5865022 - DNA, 19 bp, Homo sapiens
catttgctggttataacag

SEQ ID NO: 5865023 - DNA, 17 bp, Homo sapiens
catttgctgtctttttg

SEQ ID NO: 5865024 - DNA, 12 bp, Homo sapiens
catttgctgttg

SEQ ID NO: 5865025 - DNA, 16 bp, Homo sapiens
catttgctgttttaaa

SEQ ID NO: 5865026 - DNA, 20 bp, Homo sapiens
catttgcttcaggagtttca

SEQ ID NO: 5865027 - DNA, 18 bp, Homo sapiens
catttgcttgtactggga

SEQ ID NO: 5865028 - DNA, 20 bp, Homo sapiens
catttgcttgtactgggaca

SEQ ID NO: 5865029 - DNA, 13 bp, Homo sapiens
catttgctttttg

SEQ ID NO: 5865030 - DNA, 14 bp, Homo sapiens
catttggaaatcag

SEQ ID NO: 5865031 - DNA, 15 bp, Homo sapiens
catttggaaatgatt

SEQ ID NO: 5865032 - DNA, 21 bp, Homo sapiens
catttggaaatgatttactgg

SEQ ID NO: 5865033 - DNA, 16 bp, Homo sapiens
catttggaacaacaaa

SEQ ID NO: 5865034 - DNA, 17 bp, Homo sapiens
catttggaacagtgaca

SEQ ID NO: 5865035 - DNA, 14 bp, Homo sapiens
catttggaaccaaa

SEQ ID NO: 5865036 - DNA, 23 bp, Homo sapiens
catttggaatttttgcttgactt

SEQ ID NO: 5865037 - DNA, 16 bp, Homo sapiens
catttggacaaaatgg

SEQ ID NO: 5865038 - DNA, 21 bp, Homo sapiens
catttggaggaatcaccccat

SEQ ID NO: 5865039 - DNA, 15 bp, Homo sapiens
catttggaggcaatc

SEQ ID NO: 5865040 - DNA, 17 bp, Homo sapiens
catttggatataaatct

SEQ ID NO: 5865041 - DNA, 18 bp, Homo sapiens
catttggatataaatctt

SEQ ID NO: 5865042 - DNA, 19 bp, Homo sapiens
catttggatataaatctta

SEQ ID NO: 5865043 - DNA, 23 bp, Homo sapiens
catttggattggggtccctctaa

SEQ ID NO: 5865044 - DNA, 20 bp, Homo sapiens
catttggcaatgccatcatc

SEQ ID NO: 5865045 - DNA, 12 bp, Homo sapiens
catttggcagaa

SEQ ID NO: 5865046 - DNA, 22 bp, Homo sapiens
catttggcagaactgctggggc

SEQ ID NO: 5865047 - DNA, 23 bp, Homo sapiens
catttggcaggaagatgtatgct

SEQ ID NO: 5865048 - DNA, 20 bp, Homo sapiens
catttggcatccctgggcct

SEQ ID NO: 5865049 - DNA, 18 bp, Homo sapiens
catttggccccaggggac

SEQ ID NO: 5865050 - DNA, 17 bp, Homo sapiens
catttggccggctctgg

SEQ ID NO: 5865051 - DNA, 20 bp, Homo sapiens
catttggcctcttgtagtct

SEQ ID NO: 5865052 - DNA, 13 bp, Homo sapiens
catttggcttcct

SEQ ID NO: 5865053 - DNA, 16 bp, Homo sapiens
catttggcttcctctg

SEQ ID NO: 5865054 - DNA, 17 bp, Homo sapiens
catttggcttcctctgc

SEQ ID NO: 5865055 - DNA, 20 bp, Homo sapiens
catttggcttgctgtttact

SEQ ID NO: 5865056 - DNA, 22 bp, Homo sapiens
catttgggactgtcttgagaaa

SEQ ID NO: 5865057 - DNA, 18 bp, Homo sapiens
catttgggagacatgtga

SEQ ID NO: 5865058 - DNA, 20 bp, Homo sapiens
catttgggagacatgtgaca

SEQ ID NO: 5865059 - DNA, 23 bp, Homo sapiens
catttgggagtttttatgagaaa

SEQ ID NO: 5865060 - DNA, 17 bp, Homo sapiens
catttgggataccagat

SEQ ID NO: 5865061 - DNA, 23 bp, Homo sapiens
catttgggatgttccttttttca

SEQ ID NO: 5865062 - DNA, 20 bp, Homo sapiens
catttggggaccacagaggc

SEQ ID NO: 5865063 - DNA, 18 bp, Homo sapiens
catttggggcatttgtaa

SEQ ID NO: 5865064 - DNA, 22 bp, Homo sapiens
catttggggtagctagaggaac

SEQ ID NO: 5865065 - DNA, 20 bp, Homo sapiens
catttggggtttgtgtttga

SEQ ID NO: 5865066 - DNA, 16 bp, Homo sapiens
catttgggtaaatcat

SEQ ID NO: 5865067 - DNA, 19 bp, Homo sapiens
catttggtacacacttgac

SEQ ID NO: 5865068 - DNA, 18 bp, Homo sapiens
catttggtagatgttctt

SEQ ID NO: 5865069 - DNA, 23 bp, Homo sapiens
catttggtagatgttcttttcta

SEQ ID NO: 5865070 - DNA, 16 bp, Homo sapiens
catttggtattacaca

SEQ ID NO: 5865071 - DNA, 18 bp, Homo sapiens
catttggtattacacagt

SEQ ID NO: 5865072 - DNA, 20 bp, Homo sapiens
catttggtcaagattttgaa

SEQ ID NO: 5865073 - DNA, 23 bp, Homo sapiens
catttggtctcactacttgacca

SEQ ID NO: 5865074 - DNA, 15 bp, Homo sapiens
catttggtctcaggc

SEQ ID NO: 5865075 - DNA, 21 bp, Homo sapiens
catttggtctcaggcagcacc

SEQ ID NO: 5865076 - DNA, 17 bp, Homo sapiens
catttggtctgccagaa

SEQ ID NO: 5865077 - DNA, 18 bp, Homo sapiens
catttggtctgccagaat

SEQ ID NO: 5865078 - DNA, 22 bp, Homo sapiens
catttggtctgccagaatactg

SEQ ID NO: 5865079 - DNA, 12 bp, Homo sapiens
catttggtgaag

SEQ ID NO: 5865080 - DNA, 21 bp, Homo sapiens
catttggtgagagtcaaagct

SEQ ID NO: 5865081 - DNA, 15 bp, Homo sapiens
catttggtggctcta

SEQ ID NO: 5865082 - DNA, 21 bp, Homo sapiens
catttggtggtactttattct

SEQ ID NO: 5865083 - DNA, 22 bp, Homo sapiens
catttggtggtttcagaaatgt

SEQ ID NO: 5865084 - DNA, 23 bp, Homo sapiens
catttggtgtggattttctactg

SEQ ID NO: 5865085 - DNA, 20 bp, Homo sapiens
catttggtgttcctggaagc

SEQ ID NO: 5865086 - DNA, 16 bp, Homo sapiens
catttggttcattaat

SEQ ID NO: 5865087 - DNA, 16 bp, Homo sapiens
catttggttcttctga

SEQ ID NO: 5865088 - DNA, 16 bp, Homo sapiens
catttggttggcacta

SEQ ID NO: 5865089 - DNA, 14 bp, Homo sapiens
catttgtaaaaagt

SEQ ID NO: 5865090 - DNA, 19 bp, Homo sapiens
catttgtaaaaagtagatt

SEQ ID NO: 5865091 - DNA, 22 bp, Homo sapiens
catttgtaaaaagtagattaaa

SEQ ID NO: 5865092 - DNA, 15 bp, Homo sapiens
catttgtaaaaatac

SEQ ID NO: 5865093 - DNA, 18 bp, Homo sapiens
catttgtaaaaatactgt

SEQ ID NO: 5865094 - DNA, 19 bp, Homo sapiens
catttgtaaaaatactgtt

SEQ ID NO: 5865095 - DNA, 23 bp, Homo sapiens
catttgtaaaaatactgtttcac

SEQ ID NO: 5865096 - DNA, 15 bp, Homo sapiens
catttgtaaaaatga

SEQ ID NO: 5865097 - DNA, 20 bp, Homo sapiens
catttgtaaaaatgagactt

SEQ ID NO: 5865098 - DNA, 16 bp, Homo sapiens
catttgtaaatattaa

SEQ ID NO: 5865099 - DNA, 19 bp, Homo sapiens
catttgtaagtgtaaaaaa

SEQ ID NO: 5865100 - DNA, 22 bp, Homo sapiens
catttgtaagtgtaaaaaatgt

SEQ ID NO: 5865101 - DNA, 13 bp, Homo sapiens
catttgtaataaa

SEQ ID NO: 5865102 - DNA, 14 bp, Homo sapiens
catttgtaataaag

SEQ ID NO: 5865103 - DNA, 17 bp, Homo sapiens
catttgtaataaagtat

SEQ ID NO: 5865104 - DNA, 17 bp, Homo sapiens
catttgtaatgtatctt

SEQ ID NO: 5865105 - DNA, 22 bp, Homo sapiens
catttgtaatgtatcttattta

SEQ ID NO: 5865106 - DNA, 23 bp, Homo sapiens
catttgtaatgtatcttatttat

SEQ ID NO: 5865107 - DNA, 21 bp, Homo sapiens
catttgtacaaggtaattgtt

SEQ ID NO: 5865108 - DNA, 20 bp, Homo sapiens
catttgtacagaattttgga

SEQ ID NO: 5865109 - DNA, 18 bp, Homo sapiens
catttgtacattcctgat

SEQ ID NO: 5865110 - DNA, 16 bp, Homo sapiens
catttgtagatatata

SEQ ID NO: 5865111 - DNA, 19 bp, Homo sapiens
catttgtagatatatattt

SEQ ID NO: 5865112 - DNA, 23 bp, Homo sapiens
catttgtagatatatatttccaa

SEQ ID NO: 5865113 - DNA, 13 bp, Homo sapiens
catttgtagtgag

SEQ ID NO: 5865114 - DNA, 16 bp, Homo sapiens
catttgtataaaataa

SEQ ID NO: 5865115 - DNA, 23 bp, Homo sapiens
catttgtataatgggaagcctgt

SEQ ID NO: 5865116 - DNA, 11 bp, Homo sapiens
catttgtatat

SEQ ID NO: 5865117 - DNA, 12 bp, Homo sapiens
catttgtatatt

SEQ ID NO: 5865118 - DNA, 20 bp, Homo sapiens
catttgtatgtcaaagcttt

SEQ ID NO: 5865119 - DNA, 22 bp, Homo sapiens
catttgtatgtgtgtagactgt

SEQ ID NO: 5865120 - DNA, 22 bp, Homo sapiens
catttgtattactgcttcccat

SEQ ID NO: 5865121 - DNA, 21 bp, Homo sapiens
catttgtattattttttaata

SEQ ID NO: 5865122 - DNA, 21 bp, Homo sapiens
catttgtattgtacataaaat

SEQ ID NO: 5865123 - DNA, 11 bp, Homo sapiens
catttgtattt

SEQ ID NO: 5865124 - DNA, 15 bp, Homo sapiens
catttgtattttgtg

SEQ ID NO: 5865125 - DNA, 21 bp, Homo sapiens
catttgtattttgtgatgaat

SEQ ID NO: 5865126 - DNA, 19 bp, Homo sapiens
catttgtcagagaagaaaa

SEQ ID NO: 5865127 - DNA, 22 bp, Homo sapiens
catttgtcatcgttccccaccc

SEQ ID NO: 5865128 - DNA, 12 bp, Homo sapiens
catttgtcattt

SEQ ID NO: 5865129 - DNA, 15 bp, Homo sapiens
catttgtcattttca

SEQ ID NO: 5865130 - DNA, 12 bp, Homo sapiens
catttgtcccag

SEQ ID NO: 5865131 - DNA, 23 bp, Homo sapiens
catttgtcctaatctgctgccag

SEQ ID NO: 5865132 - DNA, 20 bp, Homo sapiens
catttgtcctgactgtctgc

SEQ ID NO: 5865133 - DNA, 19 bp, Homo sapiens
catttgtcctgcagagctg

SEQ ID NO: 5865134 - DNA, 18 bp, Homo sapiens
catttgtctctacttttc

SEQ ID NO: 5865135 - DNA, 18 bp, Homo sapiens
catttgtcttagagagag

SEQ ID NO: 5865136 - DNA, 14 bp, Homo sapiens
catttgtgaaatga

SEQ ID NO: 5865137 - DNA, 14 bp, Homo sapiens
catttgtgaagaat

SEQ ID NO: 5865138 - DNA, 12 bp, Homo sapiens
catttgtgaggc

SEQ ID NO: 5865139 - DNA, 15 bp, Homo sapiens
catttgtgaggccca

SEQ ID NO: 5865140 - DNA, 19 bp, Homo sapiens
catttgtgatatatgtatt

SEQ ID NO: 5865141 - DNA, 13 bp, Homo sapiens
catttgtgcataa

SEQ ID NO: 5865142 - DNA, 17 bp, Homo sapiens
catttgtgcataaattt

SEQ ID NO: 5865143 - DNA, 13 bp, Homo sapiens
catttgtgccaca

SEQ ID NO: 5865144 - DNA, 14 bp, Homo sapiens
catttgtgccacac

SEQ ID NO: 5865145 - DNA, 21 bp, Homo sapiens
catttgtgctagaaattttca

SEQ ID NO: 5865146 - DNA, 20 bp, Homo sapiens
catttgtgctccattttttc

SEQ ID NO: 5865147 - DNA, 16 bp, Homo sapiens
catttgtggcaattaa

SEQ ID NO: 5865148 - DNA, 22 bp, Homo sapiens
catttgtgggtttttatttcct

SEQ ID NO: 5865149 - DNA, 15 bp, Homo sapiens
catttgtgtaaagac

SEQ ID NO: 5865150 - DNA, 14 bp, Homo sapiens
catttgtgtcaatg

SEQ ID NO: 5865151 - DNA, 17 bp, Homo sapiens
catttgtgtcactgtac

SEQ ID NO: 5865152 - DNA, 19 bp, Homo sapiens
catttgtgtcactgtacag

SEQ ID NO: 5865153 - DNA, 23 bp, Homo sapiens
catttgtgtcactgtacagtttt

SEQ ID NO: 5865154 - DNA, 14 bp, Homo sapiens
catttgtgtctctt

SEQ ID NO: 5865155 - DNA, 15 bp, Homo sapiens
catttgtgtggaaat

SEQ ID NO: 5865156 - DNA, 19 bp, Homo sapiens
catttgtgtgtgtgcaagt

SEQ ID NO: 5865157 - DNA, 13 bp, Homo sapiens
catttgttaaaat

SEQ ID NO: 5865158 - DNA, 16 bp, Homo sapiens
catttgttaatatcac

SEQ ID NO: 5865159 - DNA, 21 bp, Homo sapiens
catttgttacagtttcttcat

SEQ ID NO: 5865160 - DNA, 20 bp, Homo sapiens
catttgttagccacggaaac

SEQ ID NO: 5865161 - DNA, 24 bp, Homo sapiens
catttgttatcctcttgtatactt

SEQ ID NO: 5865162 - DNA, 19 bp, Homo sapiens
catttgttattcttaagac

SEQ ID NO: 5865163 - DNA, 13 bp, Homo sapiens
catttgttcatat

SEQ ID NO: 5865164 - DNA, 18 bp, Homo sapiens
catttgttcatattaaga

SEQ ID NO: 5865165 - DNA, 19 bp, Homo sapiens
catttgttcatattaagaa

SEQ ID NO: 5865166 - DNA, 13 bp, Homo sapiens
catttgttcctgg

SEQ ID NO: 5865167 - DNA, 14 bp, Homo sapiens
catttgttcctgga

SEQ ID NO: 5865168 - DNA, 20 bp, Homo sapiens
catttgttcctggagttttg

SEQ ID NO: 5865169 - DNA, 14 bp, Homo sapiens
catttgttctgggt

SEQ ID NO: 5865170 - DNA, 23 bp, Homo sapiens
catttgttgaataggggaaagaa

SEQ ID NO: 5865171 - DNA, 14 bp, Homo sapiens
catttgttgctgct

SEQ ID NO: 5865172 - DNA, 18 bp, Homo sapiens
catttgttggtaactaat

SEQ ID NO: 5865173 - DNA, 20 bp, Homo sapiens
catttgttgtgactggcacc

SEQ ID NO: 5865174 - DNA, 18 bp, Homo sapiens
catttgttgtgatgtctt

SEQ ID NO: 5865175 - DNA, 18 bp, Homo sapiens
catttgtttaaacaatct

SEQ ID NO: 5865176 - DNA, 22 bp, Homo sapiens
catttgtttattttttggaaga

SEQ ID NO: 5865177 - DNA, 22 bp, Homo sapiens
catttgtttctttctctgagga

SEQ ID NO: 5865178 - DNA, 20 bp, Homo sapiens
catttgtttgaactgataaa

SEQ ID NO: 5865179 - DNA, 22 bp, Homo sapiens
catttgtttgaccccagtttct

SEQ ID NO: 5865180 - DNA, 18 bp, Homo sapiens
catttgtttggttatagt

SEQ ID NO: 5865181 - DNA, 17 bp, Homo sapiens
catttgtttgtattcat

SEQ ID NO: 5865182 - DNA, 14 bp, Homo sapiens
catttgtttgtgct

SEQ ID NO: 5865183 - DNA, 20 bp, Homo sapiens
catttgttttagcattacct

SEQ ID NO: 5865184 - DNA, 21 bp, Homo sapiens
catttgttttagcattaccta

SEQ ID NO: 5865185 - DNA, 22 bp, Homo sapiens
catttgttttagcattacctaa

SEQ ID NO: 5865186 - DNA, 18 bp, Homo sapiens
catttgttttcggcagcc

SEQ ID NO: 5865187 - DNA, 20 bp, Homo sapiens
catttgttttcggcagcctt

SEQ ID NO: 5865188 - DNA, 14 bp, Homo sapiens
catttgttttgctt

SEQ ID NO: 5865189 - DNA, 20 bp, Homo sapiens
cattttaaaaaaaaaggcat

SEQ ID NO: 5865190 - DNA, 21 bp, Homo sapiens
cattttaaaaacatagaaaaa

SEQ ID NO: 5865191 - DNA, 20 bp, Homo sapiens
cattttaaaaaccaatcatt

SEQ ID NO: 5865192 - DNA, 18 bp, Homo sapiens
cattttaaaaatgaaatt

SEQ ID NO: 5865193 - DNA, 16 bp, Homo sapiens
cattttaaaagcaatt

SEQ ID NO: 5865194 - DNA, 20 bp, Homo sapiens
cattttaaaagcaattatat

SEQ ID NO: 5865195 - DNA, 16 bp, Homo sapiens
cattttaaaatcaact

SEQ ID NO: 5865196 - DNA, 15 bp, Homo sapiens
cattttaaaatctga

SEQ ID NO: 5865197 - DNA, 21 bp, Homo sapiens
cattttaaaatgtcttggtct

SEQ ID NO: 5865198 - DNA, 16 bp, Homo sapiens
cattttaaacaaaata

SEQ ID NO: 5865199 - DNA, 17 bp, Homo sapiens
cattttaaagttagtat

SEQ ID NO: 5865200 - DNA, 14 bp, Homo sapiens
cattttaaatgaaa

SEQ ID NO: 5865201 - DNA, 15 bp, Homo sapiens
cattttaaatgaaag

SEQ ID NO: 5865202 - DNA, 14 bp, Homo sapiens
cattttaaatttta

SEQ ID NO: 5865203 - DNA, 15 bp, Homo sapiens
cattttaaattttat

SEQ ID NO: 5865204 - DNA, 17 bp, Homo sapiens
cattttaacaagaagat

SEQ ID NO: 5865205 - DNA, 20 bp, Homo sapiens
cattttaacaagaagatgaa

SEQ ID NO: 5865206 - DNA, 21 bp, Homo sapiens
cattttaacagtacctgtgcc

SEQ ID NO: 5865207 - DNA, 19 bp, Homo sapiens
cattttaacttgccacatc

SEQ ID NO: 5865208 - DNA, 19 bp, Homo sapiens
cattttaagaagacatgac

SEQ ID NO: 5865209 - DNA, 20 bp, Homo sapiens
cattttaagaagacatgaca

SEQ ID NO: 5865210 - DNA, 14 bp, Homo sapiens
cattttaagcataa

SEQ ID NO: 5865211 - DNA, 22 bp, Homo sapiens
cattttaagtaacgtgctcact

SEQ ID NO: 5865212 - DNA, 21 bp, Homo sapiens
cattttaagtgcttcacattt

SEQ ID NO: 5865213 - DNA, 22 bp, Homo sapiens
cattttaagtggagacatattt

SEQ ID NO: 5865214 - DNA, 18 bp, Homo sapiens
cattttaagtttgtagta

SEQ ID NO: 5865215 - DNA, 17 bp, Homo sapiens
cattttaagttttactg

SEQ ID NO: 5865216 - DNA, 12 bp, Homo sapiens
cattttaataac

SEQ ID NO: 5865217 - DNA, 21 bp, Homo sapiens
cattttaatagagatgaatca

SEQ ID NO: 5865218 - DNA, 23 bp, Homo sapiens
cattttaatagttggttaggcta

SEQ ID NO: 5865219 - DNA, 22 bp, Homo sapiens
cattttaatgatattggaggaa

SEQ ID NO: 5865220 - DNA, 13 bp, Homo sapiens
cattttaatgtaa

SEQ ID NO: 5865221 - DNA, 14 bp, Homo sapiens
cattttaattcatc

SEQ ID NO: 5865222 - DNA, 22 bp, Homo sapiens
cattttaatttattaattgctt

SEQ ID NO: 5865223 - DNA, 15 bp, Homo sapiens
cattttaattttaaa

SEQ ID NO: 5865224 - DNA, 19 bp, Homo sapiens
cattttaattttaaccaaa

SEQ ID NO: 5865225 - DNA, 21 bp, Homo sapiens
cattttacacttgctttattt

SEQ ID NO: 5865226 - DNA, 14 bp, Homo sapiens
cattttacagtaaa

SEQ ID NO: 5865227 - DNA, 13 bp, Homo sapiens
cattttacagtat

SEQ ID NO: 5865228 - DNA, 16 bp, Homo sapiens
cattttacagtatctt

SEQ ID NO: 5865229 - DNA, 12 bp, Homo sapiens
cattttacagtg

SEQ ID NO: 5865230 - DNA, 15 bp, Homo sapiens
cattttaccttcaaa

SEQ ID NO: 5865231 - DNA, 14 bp, Homo sapiens
cattttacgtcttt

SEQ ID NO: 5865232 - DNA, 17 bp, Homo sapiens
cattttacgttttagaa

SEQ ID NO: 5865233 - DNA, 13 bp, Homo sapiens
cattttactaaaa

SEQ ID NO: 5865234 - DNA, 15 bp, Homo sapiens
cattttactacttgt

SEQ ID NO: 5865235 - DNA, 21 bp, Homo sapiens
cattttactatgcctgttgat

SEQ ID NO: 5865236 - DNA, 19 bp, Homo sapiens
cattttactgattaacaaa

SEQ ID NO: 5865237 - DNA, 22 bp, Homo sapiens
cattttactgtacagattgctg

SEQ ID NO: 5865238 - DNA, 18 bp, Homo sapiens
cattttactgtatatttt

SEQ ID NO: 5865239 - DNA, 15 bp, Homo sapiens
cattttactgttgta

SEQ ID NO: 5865240 - DNA, 17 bp, Homo sapiens
cattttactgttgtaca

SEQ ID NO: 5865241 - DNA, 19 bp, Homo sapiens
cattttactgttgtacaat

SEQ ID NO: 5865242 - DNA, 17 bp, Homo sapiens
cattttactttttcctg

SEQ ID NO: 5865243 - DNA, 13 bp, Homo sapiens
cattttagaaaat

SEQ ID NO: 5865244 - DNA, 17 bp, Homo sapiens
cattttagaaaatcaga

SEQ ID NO: 5865245 - DNA, 11 bp, Homo sapiens
cattttagaat

SEQ ID NO: 5865246 - DNA, 18 bp, Homo sapiens
cattttagaatgtcaata

SEQ ID NO: 5865247 - DNA, 19 bp, Homo sapiens
cattttagacactgggaga

SEQ ID NO: 5865248 - DNA, 19 bp, Homo sapiens
cattttagacagtaagtat

SEQ ID NO: 5865249 - DNA, 23 bp, Homo sapiens
cattttaggaaaaaaaaaagcat

SEQ ID NO: 5865250 - DNA, 20 bp, Homo sapiens
cattttaggaataataaatt

SEQ ID NO: 5865251 - DNA, 15 bp, Homo sapiens
cattttataaaacat

SEQ ID NO: 5865252 - DNA, 15 bp, Homo sapiens
cattttataaagtgc

SEQ ID NO: 5865253 - DNA, 13 bp, Homo sapiens
cattttataaatc

SEQ ID NO: 5865254 - DNA, 19 bp, Homo sapiens
cattttataaatgatatca

SEQ ID NO: 5865255 - DNA, 16 bp, Homo sapiens
cattttatacaagaag

SEQ ID NO: 5865256 - DNA, 22 bp, Homo sapiens
cattttatactgtacatgctat

SEQ ID NO: 5865257 - DNA, 22 bp, Homo sapiens
cattttatagaatgtgtcacac

SEQ ID NO: 5865258 - DNA, 17 bp, Homo sapiens
cattttatagacaccct

SEQ ID NO: 5865259 - DNA, 14 bp, Homo sapiens
cattttatatgtca

SEQ ID NO: 5865260 - DNA, 15 bp, Homo sapiens
cattttatattagaa

SEQ ID NO: 5865261 - DNA, 13 bp, Homo sapiens
cattttatattga

SEQ ID NO: 5865262 - DNA, 15 bp, Homo sapiens
cattttatattgaaa

SEQ ID NO: 5865263 - DNA, 16 bp, Homo sapiens
cattttatatttttgt

SEQ ID NO: 5865264 - DNA, 21 bp, Homo sapiens
cattttatatttttgtacata

SEQ ID NO: 5865265 - DNA, 15 bp, Homo sapiens
ccaaaagcgccctca

SEQ ID NO: 5865266 - DNA, 22 bp, Homo sapiens
ccaaaagctgctttccatggca

SEQ ID NO: 5865267 - DNA, 13 bp, Homo sapiens
ccaaaaggaaaaa

SEQ ID NO: 5865268 - DNA, 15 bp, Homo sapiens
ccaaaaggaaaaagc

SEQ ID NO: 5865269 - DNA, 18 bp, Homo sapiens
ccaaaaggccccttccca

SEQ ID NO: 5865270 - DNA, 14 bp, Homo sapiens
ccaaaagggaaaaa

SEQ ID NO: 5865271 - DNA, 21 bp, Homo sapiens
ccaaaagggaaaaaataaaaa

SEQ ID NO: 5865272 - DNA, 16 bp, Homo sapiens
ccaaaagggaggctct

SEQ ID NO: 5865273 - DNA, 17 bp, Homo sapiens
ccaaaagggcagccagg

SEQ ID NO: 5865274 - DNA, 16 bp, Homo sapiens
ccaaaagtacttaccc

SEQ ID NO: 5865275 - DNA, 17 bp, Homo sapiens
ccaaaagtccctccctg

SEQ ID NO: 5865276 - DNA, 15 bp, Homo sapiens
ccaaaagtgcattca

SEQ ID NO: 5865277 - DNA, 16 bp, Homo sapiens
ccaaaagtgcattcaa

SEQ ID NO: 5865278 - DNA, 20 bp, Homo sapiens
ccaaaagtgcattcaacctt

SEQ ID NO: 5865279 - DNA, 17 bp, Homo sapiens
ccaaaagtggctagtcc

SEQ ID NO: 5865280 - DNA, 11 bp, Homo sapiens
ccaaaagtgtc

SEQ ID NO: 5865281 - DNA, 18 bp, Homo sapiens
ccaaaagttttcctgaga

SEQ ID NO: 5865282 - DNA, 20 bp, Homo sapiens
ccaaaataaaaaccttccaa

SEQ ID NO: 5865283 - DNA, 21 bp, Homo sapiens
ccaaaataaaactttttaaaa

SEQ ID NO: 5865284 - DNA, 16 bp, Homo sapiens
ccaaaataagaaaaga

SEQ ID NO: 5865285 - DNA, 19 bp, Homo sapiens
ccaaaataccaaatgcctg

SEQ ID NO: 5865286 - DNA, 24 bp, Homo sapiens
ccaaaataccaaatgcctgttgta

SEQ ID NO: 5865287 - DNA, 16 bp, Homo sapiens
ccaaaatactccaaag

SEQ ID NO: 5865288 - DNA, 12 bp, Homo sapiens
ccaaaatcaaga

SEQ ID NO: 5865289 - DNA, 16 bp, Homo sapiens
ccaaaatccaaaaagc

SEQ ID NO: 5865290 - DNA, 16 bp, Homo sapiens
ccaaaatccccttctc

SEQ ID NO: 5865291 - DNA, 21 bp, Homo sapiens
ccaaaatcctgaactttctcc

SEQ ID NO: 5865292 - DNA, 16 bp, Homo sapiens
ccaaaatgacatcttt

SEQ ID NO: 5865293 - DNA, 17 bp, Homo sapiens
ccaaaatgactttgaac

SEQ ID NO: 5865294 - DNA, 18 bp, Homo sapiens
ccaaaatgactttgaact

SEQ ID NO: 5865295 - DNA, 12 bp, Homo sapiens
ccaaaatgcaac

SEQ ID NO: 5865296 - DNA, 22 bp, Homo sapiens
ccaaaatggtacagcttctgga

SEQ ID NO: 5865297 - DNA, 12 bp, Homo sapiens
ccaaaatgtgaa

SEQ ID NO: 5865298 - DNA, 20 bp, Homo sapiens
ccaaaatgttggtcatttta

SEQ ID NO: 5865299 - DNA, 14 bp, Homo sapiens
ccaaaattaaggtg

SEQ ID NO: 5865300 - DNA, 23 bp, Homo sapiens
ccaaaattagccagtaatcctgt

SEQ ID NO: 5865301 - DNA, 13 bp, Homo sapiens
ccaaaatttgatg

SEQ ID NO: 5865302 - DNA, 16 bp, Homo sapiens
ccaaacaaatatgcaa

SEQ ID NO: 5865303 - DNA, 15 bp, Homo sapiens
ccaaacaagcgccac

SEQ ID NO: 5865304 - DNA, 13 bp, Homo sapiens
ccaaacaaggaag

SEQ ID NO: 5865305 - DNA, 15 bp, Homo sapiens
ccaaacacacagaag

SEQ ID NO: 5865306 - DNA, 17 bp, Homo sapiens
ccaaacacacagaaggg

SEQ ID NO: 5865307 - DNA, 21 bp, Homo sapiens
ccaaacacagagcgggagtga

SEQ ID NO: 5865308 - DNA, 14 bp, Homo sapiens
ccaaacacaggcaa

SEQ ID NO: 5865309 - DNA, 14 bp, Homo sapiens
ccaaacacccagag

SEQ ID NO: 5865310 - DNA, 15 bp, Homo sapiens
ccaaacacccagagg

SEQ ID NO: 5865311 - DNA, 14 bp, Homo sapiens
ccaaacaccggcag

SEQ ID NO: 5865312 - DNA, 20 bp, Homo sapiens
ccaaacaccttccagctcct

SEQ ID NO: 5865313 - DNA, 13 bp, Homo sapiens
ccaaacactcagt

SEQ ID NO: 5865314 - DNA, 13 bp, Homo sapiens
ccaaacactccac

SEQ ID NO: 5865315 - DNA, 20 bp, Homo sapiens
ccaaacactgaggcagcctt

SEQ ID NO: 5865316 - DNA, 13 bp, Homo sapiens
ccaaacacttctg

SEQ ID NO: 5865317 - DNA, 19 bp, Homo sapiens
ccaaacacttctgctttca

SEQ ID NO: 5865318 - DNA, 17 bp, Homo sapiens
ccaaacagaaaggagtt

SEQ ID NO: 5865319 - DNA, 13 bp, Homo sapiens
ccaaacagagcct

SEQ ID NO: 5865320 - DNA, 12 bp, Homo sapiens
ccaaacagcaaa

SEQ ID NO: 5865321 - DNA, 13 bp, Homo sapiens
ccaaacagcaaac

SEQ ID NO: 5865322 - DNA, 19 bp, Homo sapiens
ccaaacagcaaaccaagag

SEQ ID NO: 5865323 - DNA, 23 bp, Homo sapiens
ccaaacagcaaaccaagagattg

SEQ ID NO: 5865324 - DNA, 16 bp, Homo sapiens
ccaaacagccacactg

SEQ ID NO: 5865325 - DNA, 16 bp, Homo sapiens
ccaaacagcttaaatt

SEQ ID NO: 5865326 - DNA, 14 bp, Homo sapiens
ccaaacaggaacta

SEQ ID NO: 5865327 - DNA, 20 bp, Homo sapiens
ccaaacaggtgctggcccag

SEQ ID NO: 5865328 - DNA, 17 bp, Homo sapiens
ccaaacatatgcacatt

SEQ ID NO: 5865329 - DNA, 20 bp, Homo sapiens
ccaaacatcagacctgtctt

SEQ ID NO: 5865330 - DNA, 20 bp, Homo sapiens
ccaaacatcctacaagacac

SEQ ID NO: 5865331 - DNA, 20 bp, Homo sapiens
ccaaacatcctcttccatat

SEQ ID NO: 5865332 - DNA, 11 bp, Homo sapiens
ccaaacatggt

SEQ ID NO: 5865333 - DNA, 12 bp, Homo sapiens
ccaaacatgtat

SEQ ID NO: 5865334 - DNA, 14 bp, Homo sapiens
ccaaacatgtattt

SEQ ID NO: 5865335 - DNA, 12 bp, Homo sapiens
ccaaacattaat

SEQ ID NO: 5865336 - DNA, 21 bp, Homo sapiens
ccaaacattaatgttgatttc

SEQ ID NO: 5865337 - DNA, 11 bp, Homo sapiens
ccaaacatttc

SEQ ID NO: 5865338 - DNA, 17 bp, Homo sapiens
ccaaacatttcatccgt

SEQ ID NO: 5865339 - DNA, 13 bp, Homo sapiens
ccaaacatttctg

SEQ ID NO: 5865340 - DNA, 15 bp, Homo sapiens
ccaaaccaagtgcct

SEQ ID NO: 5865341 - DNA, 16 bp, Homo sapiens
ccaaaccacatatgaa

SEQ ID NO: 5865342 - DNA, 17 bp, Homo sapiens
ccaaaccaccagaagcc

SEQ ID NO: 5865343 - DNA, 13 bp, Homo sapiens
ccaaaccagcagg

SEQ ID NO: 5865344 - DNA, 18 bp, Homo sapiens
ccaaaccagtttattctg

SEQ ID NO: 5865345 - DNA, 22 bp, Homo sapiens
ccaaaccagtttattctgtggt

SEQ ID NO: 5865346 - DNA, 19 bp, Homo sapiens
ccaaaccattactgagggg

SEQ ID NO: 5865347 - DNA, 12 bp, Homo sapiens
ccaaacccactc

SEQ ID NO: 5865348 - DNA, 21 bp, Homo sapiens
ccaaacccacttctggcctcc

SEQ ID NO: 5865349 - DNA, 18 bp, Homo sapiens
ccaaacccagccactgcc

SEQ ID NO: 5865350 - DNA, 15 bp, Homo sapiens
ccaaacccagcccct

SEQ ID NO: 5865351 - DNA, 16 bp, Homo sapiens
ccaaacccatgaggca

SEQ ID NO: 5865352 - DNA, 14 bp, Homo sapiens
ccaaacccatggct

SEQ ID NO: 5865353 - DNA, 16 bp, Homo sapiens
ccaaaccccagcccca

SEQ ID NO: 5865354 - DNA, 16 bp, Homo sapiens
ccaaacccccattctg

SEQ ID NO: 5865355 - DNA, 21 bp, Homo sapiens
ccaaacccctagagacagtga

SEQ ID NO: 5865356 - DNA, 14 bp, Homo sapiens
ccaaaccctcacaa

SEQ ID NO: 5865357 - DNA, 20 bp, Homo sapiens
ccaaaccctgtcctcccacc

SEQ ID NO: 5865358 - DNA, 15 bp, Homo sapiens
ccaaacccttaactg

SEQ ID NO: 5865359 - DNA, 19 bp, Homo sapiens
ccaaacccttaactgacat

SEQ ID NO: 5865360 - DNA, 20 bp, Homo sapiens
ccaaacccttagcagcccag

SEQ ID NO: 5865361 - DNA, 13 bp, Homo sapiens
ccaaacccttcaa

SEQ ID NO: 5865362 - DNA, 16 bp, Homo sapiens
ccaaacccttcagtgc

SEQ ID NO: 5865363 - DNA, 13 bp, Homo sapiens
ccaaaccggcagg

SEQ ID NO: 5865364 - DNA, 16 bp, Homo sapiens
ccaaaccggcaggtgc

SEQ ID NO: 5865365 - DNA, 18 bp, Homo sapiens
ccaaaccggcaggtgcga

SEQ ID NO: 5865366 - DNA, 22 bp, Homo sapiens
ccaaacctaccttatagagcac

SEQ ID NO: 5865367 - DNA, 15 bp, Homo sapiens
ccaaacctcaccaac

SEQ ID NO: 5865368 - DNA, 18 bp, Homo sapiens
ccaaacctccagcctccc

SEQ ID NO: 5865369 - DNA, 21 bp, Homo sapiens
ccaaacctccagcctccctgt

SEQ ID NO: 5865370 - DNA, 17 bp, Homo sapiens
ccaaacctctgttcagt

SEQ ID NO: 5865371 - DNA, 21 bp, Homo sapiens
ccaaacctctgttcagtgtaa

SEQ ID NO: 5865372 - DNA, 20 bp, Homo sapiens
ccaaacctgggaaggccagc

SEQ ID NO: 5865373 - DNA, 13 bp, Homo sapiens
ccaaacctgtctt

SEQ ID NO: 5865374 - DNA, 18 bp, Homo sapiens
ccaaaccttcacacacag

SEQ ID NO: 5865375 - DNA, 13 bp, Homo sapiens
ccaaaccttctac

SEQ ID NO: 5865376 - DNA, 15 bp, Homo sapiens
ccaaacgctgagcca

SEQ ID NO: 5865377 - DNA, 19 bp, Homo sapiens
ccaaacggtgcaacagaag

SEQ ID NO: 5865378 - DNA, 19 bp, Homo sapiens
ccaaactaaaccctcacaa

SEQ ID NO: 5865379 - DNA, 14 bp, Homo sapiens
ccaaactaattttt

SEQ ID NO: 5865380 - DNA, 13 bp, Homo sapiens
ccaaactacagaa

SEQ ID NO: 5865381 - DNA, 16 bp, Homo sapiens
ccaaactactgaatga

SEQ ID NO: 5865382 - DNA, 17 bp, Homo sapiens
ccaaactcccaggacct

SEQ ID NO: 5865383 - DNA, 17 bp, Homo sapiens
ccaaactcctgcctgag

SEQ ID NO: 5865384 - DNA, 15 bp, Homo sapiens
ccaaactcctttctt

SEQ ID NO: 5865385 - DNA, 15 bp, Homo sapiens
ccaaactctgtgtca

SEQ ID NO: 5865386 - DNA, 22 bp, Homo sapiens
ccaaactgactcttaagaagac

SEQ ID NO: 5865387 - DNA, 17 bp, Homo sapiens
ccaaactgccaaaaaca

SEQ ID NO: 5865388 - DNA, 19 bp, Homo sapiens
ccaaactgccaaaaacaag

SEQ ID NO: 5865389 - DNA, 12 bp, Homo sapiens
ccaaactgccta

SEQ ID NO: 5865390 - DNA, 19 bp, Homo sapiens
ccaaactgcctaagccctc

SEQ ID NO: 5865391 - DNA, 17 bp, Homo sapiens
ccaaactgctgtctctt

SEQ ID NO: 5865392 - DNA, 17 bp, Homo sapiens
ccaaactggtgcatgac

SEQ ID NO: 5865393 - DNA, 20 bp, Homo sapiens
ccaaactgtagcaagatgca

SEQ ID NO: 5865394 - DNA, 23 bp, Homo sapiens
ccaaactgtagcaagatgcaaat

SEQ ID NO: 5865395 - DNA, 18 bp, Homo sapiens
ccaaactgtctctgcctc

SEQ ID NO: 5865396 - DNA, 18 bp, Homo sapiens
ccaaactgtgccctgcct

SEQ ID NO: 5865397 - DNA, 20 bp, Homo sapiens
ccaaactgtgccctgccttc

SEQ ID NO: 5865398 - DNA, 17 bp, Homo sapiens
ccaaactgtgtcacgca

SEQ ID NO: 5865399 - DNA, 21 bp, Homo sapiens
ccaaactgttctgagaaggtg

SEQ ID NO: 5865400 - DNA, 15 bp, Homo sapiens
ccaaactgttggaag

SEQ ID NO: 5865401 - DNA, 22 bp, Homo sapiens
ccaaacttatggacactgcctt

SEQ ID NO: 5865402 - DNA, 15 bp, Homo sapiens
ccaaacttcactctg

SEQ ID NO: 5865403 - DNA, 18 bp, Homo sapiens
ccaaacttggatttttga

SEQ ID NO: 5865404 - DNA, 17 bp, Homo sapiens
ccaaacttgttcattta

SEQ ID NO: 5865405 - DNA, 18 bp, Homo sapiens
ccaaactttaaaatgcga

SEQ ID NO: 5865406 - DNA, 22 bp, Homo sapiens
ccaaacttttgcagaaaaaaca

SEQ ID NO: 5865407 - DNA, 22 bp, Homo sapiens
ccaaagaaaaagggctgccggg

SEQ ID NO: 5865408 - DNA, 18 bp, Homo sapiens
ccaaagaaacaagctgtg

SEQ ID NO: 5865409 - DNA, 14 bp, Homo sapiens
ccaaagaaacacca

SEQ ID NO: 5865410 - DNA, 18 bp, Homo sapiens
ccaaagaaactcagaaga

SEQ ID NO: 5865411 - DNA, 14 bp, Homo sapiens
ccaaagaaatgaac

SEQ ID NO: 5865412 - DNA, 17 bp, Homo sapiens
ccaaagaaatgaacatt

SEQ ID NO: 5865413 - DNA, 22 bp, Homo sapiens
ccaaagaaatgggcctgcctgc

SEQ ID NO: 5865414 - DNA, 15 bp, Homo sapiens
ccaaagaaccaaaga

SEQ ID NO: 5865415 - DNA, 21 bp, Homo sapiens
ccaaagaacttgatttgcatg

SEQ ID NO: 5865416 - DNA, 23 bp, Homo sapiens
ccaaagaattcctgaagccagat

SEQ ID NO: 5865417 - DNA, 14 bp, Homo sapiens
ccaaagaattctta

SEQ ID NO: 5865418 - DNA, 15 bp, Homo sapiens
ccaaagacaaatagt

SEQ ID NO: 5865419 - DNA, 16 bp, Homo sapiens
ccaaagacaaatagta

SEQ ID NO: 5865420 - DNA, 21 bp, Homo sapiens
ccaaagactatttcaaaatgt

SEQ ID NO: 5865421 - DNA, 16 bp, Homo sapiens
ccaaagactgcagaac

SEQ ID NO: 5865422 - DNA, 17 bp, Homo sapiens
ccaaagactgcagaacc

SEQ ID NO: 5865423 - DNA, 18 bp, Homo sapiens
ccaaagactgcagaaccc

SEQ ID NO: 5865424 - DNA, 17 bp, Homo sapiens
ccaaagagacagggccc

SEQ ID NO: 5865425 - DNA, 21 bp, Homo sapiens
ccaaagagacagggcccgggc

SEQ ID NO: 5865426 - DNA, 20 bp, Homo sapiens
ccaaagagcacaaacatttt

SEQ ID NO: 5865427 - DNA, 21 bp, Homo sapiens
ccaaagagcacaaacattttt

SEQ ID NO: 5865428 - DNA, 22 bp, Homo sapiens
ccaaagagcacaaacatttttc

SEQ ID NO: 5865429 - DNA, 15 bp, Homo sapiens
ccaaagagcctggag

SEQ ID NO: 5865430 - DNA, 15 bp, Homo sapiens
ccaaagagccttcag

SEQ ID NO: 5865431 - DNA, 14 bp, Homo sapiens
ccaaagagctgcct

SEQ ID NO: 5865432 - DNA, 15 bp, Homo sapiens
ccaaagagctgccta

SEQ ID NO: 5865433 - DNA, 12 bp, Homo sapiens
ccaaagagctgt

SEQ ID NO: 5865434 - DNA, 20 bp, Homo sapiens
ccaaagaggctgcccctctc

SEQ ID NO: 5865435 - DNA, 23 bp, Homo sapiens
ccaaagaggctgcccctctcacc

SEQ ID NO: 5865436 - DNA, 16 bp, Homo sapiens
ccaaagagggcttcct

SEQ ID NO: 5865437 - DNA, 17 bp, Homo sapiens
ccaaagagggcttcctc

SEQ ID NO: 5865438 - DNA, 19 bp, Homo sapiens
ccaaagagggcttcctcta

SEQ ID NO: 5865439 - DNA, 19 bp, Homo sapiens
ccaaagagtctctggctca

SEQ ID NO: 5865440 - DNA, 14 bp, Homo sapiens
ccaaagagtgctaa

SEQ ID NO: 5865441 - DNA, 22 bp, Homo sapiens
ccaaagataatgcatatttttg

SEQ ID NO: 5865442 - DNA, 23 bp, Homo sapiens
ccaaagataatgcatatttttgc

SEQ ID NO: 5865443 - DNA, 21 bp, Homo sapiens
ccaaagatatatacacaggat

SEQ ID NO: 5865444 - DNA, 21 bp, Homo sapiens
ccaacattatcctgtgtgatt

SEQ ID NO: 5865445 - DNA, 19 bp, Homo sapiens
ccaacattcaaaagcacaa

SEQ ID NO: 5865446 - DNA, 13 bp, Homo sapiens
ccaacattgcctt

SEQ ID NO: 5865447 - DNA, 15 bp, Homo sapiens
ccaacatttctcact

SEQ ID NO: 5865448 - DNA, 13 bp, Homo sapiens
ccaacatttcttg

SEQ ID NO: 5865449 - DNA, 20 bp, Homo sapiens
ccaacattttaaaaataaat

SEQ ID NO: 5865450 - DNA, 14 bp, Homo sapiens
ccaaccaaccagca

SEQ ID NO: 5865451 - DNA, 15 bp, Homo sapiens
ccaaccaaggaagga

SEQ ID NO: 5865452 - DNA, 16 bp, Homo sapiens
ccaaccaaggaaggag

SEQ ID NO: 5865453 - DNA, 14 bp, Homo sapiens
ccaaccacagagaa

SEQ ID NO: 5865454 - DNA, 16 bp, Homo sapiens
ccaaccacagagaaca

SEQ ID NO: 5865455 - DNA, 17 bp, Homo sapiens
ccaaccagacagcacag

SEQ ID NO: 5865456 - DNA, 20 bp, Homo sapiens
ccaaccagacagcacagggc

SEQ ID NO: 5865457 - DNA, 15 bp, Homo sapiens
ccaaccagactttga

SEQ ID NO: 5865458 - DNA, 12 bp, Homo sapiens
ccaaccagcctt

SEQ ID NO: 5865459 - DNA, 12 bp, Homo sapiens
ccaaccaggacc

SEQ ID NO: 5865460 - DNA, 23 bp, Homo sapiens
ccaaccaggagctgatggcagct

SEQ ID NO: 5865461 - DNA, 23 bp, Homo sapiens
ccaaccaggaggggtctgcctcc

SEQ ID NO: 5865462 - DNA, 14 bp, Homo sapiens
ccaacccaataaaa

SEQ ID NO: 5865463 - DNA, 16 bp, Homo sapiens
ccaacccacctctggc

SEQ ID NO: 5865464 - DNA, 19 bp, Homo sapiens
ccaacccacctctggccct

SEQ ID NO: 5865465 - DNA, 20 bp, Homo sapiens
ccaacccacctctggccctg

SEQ ID NO: 5865466 - DNA, 21 bp, Homo sapiens
ccaacccacctctggccctgt

SEQ ID NO: 5865467 - DNA, 23 bp, Homo sapiens
ccaacccacctctggccctgtgt

SEQ ID NO: 5865468 - DNA, 13 bp, Homo sapiens
ccaacccagcagt

SEQ ID NO: 5865469 - DNA, 13 bp, Homo sapiens
ccaacccagccac

SEQ ID NO: 5865470 - DNA, 13 bp, Homo sapiens
ccaacccagccgc

SEQ ID NO: 5865471 - DNA, 16 bp, Homo sapiens
ccaacccagccgctgc

SEQ ID NO: 5865472 - DNA, 13 bp, Homo sapiens
ccaacccagcctg

SEQ ID NO: 5865473 - DNA, 12 bp, Homo sapiens
ccaacccatcag

SEQ ID NO: 5865474 - DNA, 14 bp, Homo sapiens
ccaacccatgcatg

SEQ ID NO: 5865475 - DNA, 16 bp, Homo sapiens
ccaaccccacccagct

SEQ ID NO: 5865476 - DNA, 17 bp, Homo sapiens
ccaaccccacccagctc

SEQ ID NO: 5865477 - DNA, 14 bp, Homo sapiens
ccaaccccagaccc

SEQ ID NO: 5865478 - DNA, 21 bp, Homo sapiens
ccaaccccagcagtcctgggc

SEQ ID NO: 5865479 - DNA, 22 bp, Homo sapiens
ccaaccccagcagtcctgggcc

SEQ ID NO: 5865480 - DNA, 17 bp, Homo sapiens
ccaaccccagctggcct

SEQ ID NO: 5865481 - DNA, 12 bp, Homo sapiens
ccaaccccaggg

SEQ ID NO: 5865482 - DNA, 14 bp, Homo sapiens
ccaaccccagggcc

SEQ ID NO: 5865483 - DNA, 16 bp, Homo sapiens
ccaacccccaccccac

SEQ ID NO: 5865484 - DNA, 20 bp, Homo sapiens
ccaacccccaccccacactt

SEQ ID NO: 5865485 - DNA, 23 bp, Homo sapiens
ccaacccccaccgaagagccctg

SEQ ID NO: 5865486 - DNA, 15 bp, Homo sapiens
ccaacccccacctcc

SEQ ID NO: 5865487 - DNA, 16 bp, Homo sapiens
ccaacccccacctccc

SEQ ID NO: 5865488 - DNA, 18 bp, Homo sapiens
ccaacccccacctcccgg

SEQ ID NO: 5865489 - DNA, 18 bp, Homo sapiens
ccaacccccagcccccac

SEQ ID NO: 5865490 - DNA, 13 bp, Homo sapiens
ccaacccccatct

SEQ ID NO: 5865491 - DNA, 18 bp, Homo sapiens
ccaaccccccacctgcca

SEQ ID NO: 5865492 - DNA, 19 bp, Homo sapiens
ccaacccccctcctgctcc

SEQ ID NO: 5865493 - DNA, 20 bp, Homo sapiens
ccaacccccctcctgctcct

SEQ ID NO: 5865494 - DNA, 14 bp, Homo sapiens
ccaaccccctgcaa

SEQ ID NO: 5865495 - DNA, 17 bp, Homo sapiens
ccaaccccgcggcccag

SEQ ID NO: 5865496 - DNA, 21 bp, Homo sapiens
ccaaccccgcggtgctctggc

SEQ ID NO: 5865497 - DNA, 22 bp, Homo sapiens
ccaaccccgcggtgctctggcg

SEQ ID NO: 5865498 - DNA, 14 bp, Homo sapiens
ccaaccccggggca

SEQ ID NO: 5865499 - DNA, 16 bp, Homo sapiens
ccaacccctcctccct

SEQ ID NO: 5865500 - DNA, 17 bp, Homo sapiens
ccaacccctcctccctc

SEQ ID NO: 5865501 - DNA, 21 bp, Homo sapiens
ccaacccctccttccccagac

SEQ ID NO: 5865502 - DNA, 14 bp, Homo sapiens
ccaacccctctcca

SEQ ID NO: 5865503 - DNA, 15 bp, Homo sapiens
ccaacccctctccag

SEQ ID NO: 5865504 - DNA, 22 bp, Homo sapiens
ccaacccctctccaggcctgtc

SEQ ID NO: 5865505 - DNA, 15 bp, Homo sapiens
ccaacccgaggcccg

SEQ ID NO: 5865506 - DNA, 20 bp, Homo sapiens
ccaacccgtgcccctgggat

SEQ ID NO: 5865507 - DNA, 15 bp, Homo sapiens
ccaacccgtggaggc

SEQ ID NO: 5865508 - DNA, 12 bp, Homo sapiens
ccaaccctagca

SEQ ID NO: 5865509 - DNA, 15 bp, Homo sapiens
ccaaccctcatcacc

SEQ ID NO: 5865510 - DNA, 19 bp, Homo sapiens
ccaaccctgcccagcctga

SEQ ID NO: 5865511 - DNA, 14 bp, Homo sapiens
ccaaccctgggacc

SEQ ID NO: 5865512 - DNA, 13 bp, Homo sapiens
ccaaccctgggct

SEQ ID NO: 5865513 - DNA, 20 bp, Homo sapiens
ccaaccctgggctggggagg

SEQ ID NO: 5865514 - DNA, 21 bp, Homo sapiens
ccaaccctgggctggggagga

SEQ ID NO: 5865515 - DNA, 22 bp, Homo sapiens
ccaaccctgggctggggaggag

SEQ ID NO: 5865516 - DNA, 16 bp, Homo sapiens
ccaaccctggggaagg

SEQ ID NO: 5865517 - DNA, 23 bp, Homo sapiens
ccaaccctgtcagaatcatgctg

SEQ ID NO: 5865518 - DNA, 12 bp, Homo sapiens
ccaaccctgtgg

SEQ ID NO: 5865519 - DNA, 14 bp, Homo sapiens
ccaacccttcccca

SEQ ID NO: 5865520 - DNA, 11 bp, Homo sapiens
ccaacccttct

SEQ ID NO: 5865521 - DNA, 21 bp, Homo sapiens
ccaacccttctcctcttgtaa

SEQ ID NO: 5865522 - DNA, 16 bp, Homo sapiens
ccaacccttcttcatg

SEQ ID NO: 5865523 - DNA, 20 bp, Homo sapiens
ccaaccgaacatgaccaaaa

SEQ ID NO: 5865524 - DNA, 13 bp, Homo sapiens
ccaaccgacaggc

SEQ ID NO: 5865525 - DNA, 18 bp, Homo sapiens
ccaacctaacccctttcc

SEQ ID NO: 5865526 - DNA, 13 bp, Homo sapiens
ccaacctaacctg

SEQ ID NO: 5865527 - DNA, 14 bp, Homo sapiens
ccaacctaacctgt

SEQ ID NO: 5865528 - DNA, 16 bp, Homo sapiens
ccaacctaacctgtgt

SEQ ID NO: 5865529 - DNA, 14 bp, Homo sapiens
ccaacctacattcc

SEQ ID NO: 5865530 - DNA, 15 bp, Homo sapiens
ccaacctcaatgccc

SEQ ID NO: 5865531 - DNA, 15 bp, Homo sapiens
ccaacctcaccctcc

SEQ ID NO: 5865532 - DNA, 17 bp, Homo sapiens
ccaacctcactgccctc

SEQ ID NO: 5865533 - DNA, 17 bp, Homo sapiens
ccaacctcagaggcagc

SEQ ID NO: 5865534 - DNA, 15 bp, Homo sapiens
ccaacctcaggctcc

SEQ ID NO: 5865535 - DNA, 11 bp, Homo sapiens
ccaacctccag

SEQ ID NO: 5865536 - DNA, 15 bp, Homo sapiens
ccaacctccagactc

SEQ ID NO: 5865537 - DNA, 20 bp, Homo sapiens
ccaacctccagactcagcag

SEQ ID NO: 5865538 - DNA, 18 bp, Homo sapiens
ccaacctccagtgtcagg

SEQ ID NO: 5865539 - DNA, 21 bp, Homo sapiens
ccaacctcccctggtcctgca

SEQ ID NO: 5865540 - DNA, 15 bp, Homo sapiens
ccaacctcctgctct

SEQ ID NO: 5865541 - DNA, 19 bp, Homo sapiens
ccaacctcctgctctggga

SEQ ID NO: 5865542 - DNA, 20 bp, Homo sapiens
ccaacctcctgctctgggac

SEQ ID NO: 5865543 - DNA, 21 bp, Homo sapiens
ccaacctcctgctctgggacg

SEQ ID NO: 5865544 - DNA, 16 bp, Homo sapiens
ccaacctcgccctctc

SEQ ID NO: 5865545 - DNA, 19 bp, Homo sapiens
ccaacctcgccctctctca

SEQ ID NO: 5865546 - DNA, 14 bp, Homo sapiens
ccaacctcgctcca

SEQ ID NO: 5865547 - DNA, 21 bp, Homo sapiens
ccaacctcggcttgtgggctg

SEQ ID NO: 5865548 - DNA, 22 bp, Homo sapiens
ccaacctcggcttgtgggctgg

SEQ ID NO: 5865549 - DNA, 14 bp, Homo sapiens
ccaacctctggagc

SEQ ID NO: 5865550 - DNA, 14 bp, Homo sapiens
ccaacctcttcctc

SEQ ID NO: 5865551 - DNA, 15 bp, Homo sapiens
ccaacctcttcctcc

SEQ ID NO: 5865552 - DNA, 17 bp, Homo sapiens
ccaacctcttcctcctg

SEQ ID NO: 5865553 - DNA, 15 bp, Homo sapiens
ccaacctgaaggagg

SEQ ID NO: 5865554 - DNA, 13 bp, Homo sapiens
ccaacctgaccta

SEQ ID NO: 5865555 - DNA, 18 bp, Homo sapiens
ccaacctgatgccccttc

SEQ ID NO: 5865556 - DNA, 20 bp, Homo sapiens
ccaacctgatgccccttccc

SEQ ID NO: 5865557 - DNA, 17 bp, Homo sapiens
ccaacctgcaaagatct

SEQ ID NO: 5865558 - DNA, 18 bp, Homo sapiens
ccaacctgcctgtgcatg

SEQ ID NO: 5865559 - DNA, 18 bp, Homo sapiens
ccaacctgctctcctctt

SEQ ID NO: 5865560 - DNA, 14 bp, Homo sapiens
ccaacctgctctgt

SEQ ID NO: 5865561 - DNA, 18 bp, Homo sapiens
ccaacctgctctgtcccc

SEQ ID NO: 5865562 - DNA, 12 bp, Homo sapiens
ccaacctgctga

SEQ ID NO: 5865563 - DNA, 14 bp, Homo sapiens
ccaacctggacaac

SEQ ID NO: 5865564 - DNA, 16 bp, Homo sapiens
ccaacctggacttcct

SEQ ID NO: 5865565 - DNA, 17 bp, Homo sapiens
ccaacctggacttcctg

SEQ ID NO: 5865566 - DNA, 15 bp, Homo sapiens
ccaacctggaggctg

SEQ ID NO: 5865567 - DNA, 16 bp, Homo sapiens
ccaacctggaggctgg

SEQ ID NO: 5865568 - DNA, 17 bp, Homo sapiens
ccaacctggggagccag

SEQ ID NO: 5865569 - DNA, 14 bp, Homo sapiens
ccaacctggggggc

SEQ ID NO: 5865570 - DNA, 17 bp, Homo sapiens
ccaacctgtaataaata

SEQ ID NO: 5865571 - DNA, 19 bp, Homo sapiens
ccaacctgtaataaatatg

SEQ ID NO: 5865572 - DNA, 13 bp, Homo sapiens
ccaacctgtcctt

SEQ ID NO: 5865573 - DNA, 18 bp, Homo sapiens
ccaacctgttcaagtcta

SEQ ID NO: 5865574 - DNA, 18 bp, Homo sapiens
ccaacctgttcttagagt

SEQ ID NO: 5865575 - DNA, 19 bp, Homo sapiens
ccaaccttacttacagcat

SEQ ID NO: 5865576 - DNA, 14 bp, Homo sapiens
ccaaccttcaaaga

SEQ ID NO: 5865577 - DNA, 17 bp, Homo sapiens
ccaaccttctgccctcc

SEQ ID NO: 5865578 - DNA, 23 bp, Homo sapiens
ccaaccttctgccctcctgccaa

SEQ ID NO: 5865579 - DNA, 13 bp, Homo sapiens
ccaacctttaaaa

SEQ ID NO: 5865580 - DNA, 16 bp, Homo sapiens
ccaacctttccctcac

SEQ ID NO: 5865581 - DNA, 17 bp, Homo sapiens
ccaacctttccctcacc

SEQ ID NO: 5865582 - DNA, 18 bp, Homo sapiens
ccaacctttccctcaccc

SEQ ID NO: 5865583 - DNA, 20 bp, Homo sapiens
ccaacctttccctcaccccc

SEQ ID NO: 5865584 - DNA, 19 bp, Homo sapiens
ccaacgaaaagcacatcca

SEQ ID NO: 5865585 - DNA, 14 bp, Homo sapiens
ccaacgagacacat

SEQ ID NO: 5865586 - DNA, 19 bp, Homo sapiens
ccaacgagcctcctcaggg

SEQ ID NO: 5865587 - DNA, 18 bp, Homo sapiens
ccaacgcccctgtggcca

SEQ ID NO: 5865588 - DNA, 21 bp, Homo sapiens
ccaacgcccctgtggccaact

SEQ ID NO: 5865589 - DNA, 17 bp, Homo sapiens
ccaacgccgccttggcc

SEQ ID NO: 5865590 - DNA, 22 bp, Homo sapiens
ccaacgcgaaaccaattcctca

SEQ ID NO: 5865591 - DNA, 13 bp, Homo sapiens
ccaacgctgaagc

SEQ ID NO: 5865592 - DNA, 20 bp, Homo sapiens
ccaacgctgaagcggtcaga

SEQ ID NO: 5865593 - DNA, 22 bp, Homo sapiens
ccaacgctgaagcggtcagact

SEQ ID NO: 5865594 - DNA, 22 bp, Homo sapiens
ccaacggagagcgcctgcccct

SEQ ID NO: 5865595 - DNA, 15 bp, Homo sapiens
ccaacggcaacagca

SEQ ID NO: 5865596 - DNA, 21 bp, Homo sapiens
ccaacggccctgcagccagct

SEQ ID NO: 5865597 - DNA, 15 bp, Homo sapiens
ccaacgggagcgagt

SEQ ID NO: 5865598 - DNA, 15 bp, Homo sapiens
ccaacgggtctgtgg

SEQ ID NO: 5865599 - DNA, 17 bp, Homo sapiens
ccaacgtgcaaagccaa

SEQ ID NO: 5865600 - DNA, 19 bp, Homo sapiens
ccaacgttactcagggctc

SEQ ID NO: 5865601 - DNA, 23 bp, Homo sapiens
ccaacgttcgatttctacctcag

SEQ ID NO: 5865602 - DNA, 13 bp, Homo sapiens
ccaacgtttggaa

SEQ ID NO: 5865603 - DNA, 15 bp, Homo sapiens
ccaactaaataaaaa

SEQ ID NO: 5865604 - DNA, 19 bp, Homo sapiens
ccaactaatgccttactct

SEQ ID NO: 5865605 - DNA, 20 bp, Homo sapiens
ccaactaatgccttactctt

SEQ ID NO: 5865606 - DNA, 21 bp, Homo sapiens
ccaactacccgggcctgaccc

SEQ ID NO: 5865607 - DNA, 15 bp, Homo sapiens
ccaactactactggt

SEQ ID NO: 5865608 - DNA, 22 bp, Homo sapiens
ccaactactactggtgatgcct

SEQ ID NO: 5865609 - DNA, 17 bp, Homo sapiens
ccaactactatctcaga

SEQ ID NO: 5865610 - DNA, 14 bp, Homo sapiens
ccaactactcagaa

SEQ ID NO: 5865611 - DNA, 14 bp, Homo sapiens
ccaactatattgcg

SEQ ID NO: 5865612 - DNA, 14 bp, Homo sapiens
ccaactatggcctg

SEQ ID NO: 5865613 - DNA, 15 bp, Homo sapiens
ccaactatggcctgt

SEQ ID NO: 5865614 - DNA, 16 bp, Homo sapiens
ccaactatggcctgtg

SEQ ID NO: 5865615 - DNA, 11 bp, Homo sapiens
ccaactattta

SEQ ID NO: 5865616 - DNA, 16 bp, Homo sapiens
ccaactatttattgac

SEQ ID NO: 5865617 - DNA, 15 bp, Homo sapiens
ccaactatttcaata

SEQ ID NO: 5865618 - DNA, 20 bp, Homo sapiens
ccaactcaagtgtcacctcc

SEQ ID NO: 5865619 - DNA, 16 bp, Homo sapiens
ccaactcaccccagcc

SEQ ID NO: 5865620 - DNA, 18 bp, Homo sapiens
ccaactcaccccagcccc

SEQ ID NO: 5865621 - DNA, 21 bp, Homo sapiens
ccaactcaccccagccccaaa

SEQ ID NO: 5865622 - DNA, 14 bp, Homo sapiens
ccaactcactgtgc

SEQ ID NO: 5865623 - DNA, 15 bp, Homo sapiens
ccaactcactgtgct

SEQ ID NO: 5865624 - DNA, 20 bp, Homo sapiens
ccaagagcttccagagctct

SEQ ID NO: 5865625 - DNA, 18 bp, Homo sapiens
ccaagaggaaaaacaggg

SEQ ID NO: 5865626 - DNA, 20 bp, Homo sapiens
ccaagaggaaaaacagggaa

SEQ ID NO: 5865627 - DNA, 16 bp, Homo sapiens
ccaagaggccagggtg

SEQ ID NO: 5865628 - DNA, 10 bp, Homo sapiens
ccaagaggct

SEQ ID NO: 5865629 - DNA, 17 bp, Homo sapiens
ccaagaggctagcccca

SEQ ID NO: 5865630 - DNA, 18 bp, Homo sapiens
ccaagaggctagccccag

SEQ ID NO: 5865631 - DNA, 19 bp, Homo sapiens
ccaagaggctagccccagg

SEQ ID NO: 5865632 - DNA, 21 bp, Homo sapiens
ccaagaggctagccccagggt

SEQ ID NO: 5865633 - DNA, 19 bp, Homo sapiens
ccaagaggctccctcctgt

SEQ ID NO: 5865634 - DNA, 11 bp, Homo sapiens
ccaagaggctg

SEQ ID NO: 5865635 - DNA, 12 bp, Homo sapiens
ccaagaggctgg

SEQ ID NO: 5865636 - DNA, 13 bp, Homo sapiens
ccaagaggctggt

SEQ ID NO: 5865637 - DNA, 16 bp, Homo sapiens
ccaagaggtctgagcc

SEQ ID NO: 5865638 - DNA, 17 bp, Homo sapiens
ccaagaggtctgagccc

SEQ ID NO: 5865639 - DNA, 22 bp, Homo sapiens
ccaagaggtttggctcctgccc

SEQ ID NO: 5865640 - DNA, 23 bp, Homo sapiens
ccaagagtatgagaaatacagtg

SEQ ID NO: 5865641 - DNA, 16 bp, Homo sapiens
ccaagagtccaagcca

SEQ ID NO: 5865642 - DNA, 16 bp, Homo sapiens
ccaagagtgcactact

SEQ ID NO: 5865643 - DNA, 15 bp, Homo sapiens
ccaagagtggcccca

SEQ ID NO: 5865644 - DNA, 16 bp, Homo sapiens
ccaagagtggccccac

SEQ ID NO: 5865645 - DNA, 18 bp, Homo sapiens
ccaagagtggccccacct

SEQ ID NO: 5865646 - DNA, 20 bp, Homo sapiens
ccaagagtggccccacctgg

SEQ ID NO: 5865647 - DNA, 21 bp, Homo sapiens
ccaagagtggccccacctggc

SEQ ID NO: 5865648 - DNA, 18 bp, Homo sapiens
ccaagagtgggctttgtg

SEQ ID NO: 5865649 - DNA, 19 bp, Homo sapiens
ccaagagtgggctttgtgg

SEQ ID NO: 5865650 - DNA, 19 bp, Homo sapiens
ccaagagtggtggcagctc

SEQ ID NO: 5865651 - DNA, 22 bp, Homo sapiens
ccaagagttctttaggtgcctc

SEQ ID NO: 5865652 - DNA, 15 bp, Homo sapiens
ccaagataagcctga

SEQ ID NO: 5865653 - DNA, 19 bp, Homo sapiens
ccaagataagcctgagcct

SEQ ID NO: 5865654 - DNA, 21 bp, Homo sapiens
ccaagataggaccttgggcca

SEQ ID NO: 5865655 - DNA, 21 bp, Homo sapiens
ccaagataggagttctctgat

SEQ ID NO: 5865656 - DNA, 22 bp, Homo sapiens
ccaagatatttttatcccaaga

SEQ ID NO: 5865657 - DNA, 23 bp, Homo sapiens
ccaagatcaattccctctctcag

SEQ ID NO: 5865658 - DNA, 21 bp, Homo sapiens
ccaagatctacaggacaaagg

SEQ ID NO: 5865659 - DNA, 20 bp, Homo sapiens
ccaagatctgccagacctgc

SEQ ID NO: 5865660 - DNA, 14 bp, Homo sapiens
ccaagatgcctgat

SEQ ID NO: 5865661 - DNA, 16 bp, Homo sapiens
ccaagatggagaggaa

SEQ ID NO: 5865662 - DNA, 18 bp, Homo sapiens
ccaagatggagaggaaga

SEQ ID NO: 5865663 - DNA, 18 bp, Homo sapiens
ccaagatgggcatctttt

SEQ ID NO: 5865664 - DNA, 22 bp, Homo sapiens
ccaagatgggcatcttttgtat

SEQ ID NO: 5865665 - DNA, 18 bp, Homo sapiens
ccaagatgtttggacacc

SEQ ID NO: 5865666 - DNA, 14 bp, Homo sapiens
ccaagattatgtga

SEQ ID NO: 5865667 - DNA, 19 bp, Homo sapiens
ccaagattcaaagagacta

SEQ ID NO: 5865668 - DNA, 15 bp, Homo sapiens
ccaagattctagatg

SEQ ID NO: 5865669 - DNA, 16 bp, Homo sapiens
ccaagattctagatga

SEQ ID NO: 5865670 - DNA, 12 bp, Homo sapiens
ccaagatttaaa

SEQ ID NO: 5865671 - DNA, 22 bp, Homo sapiens
ccaagattttcctcttgtgatt

SEQ ID NO: 5865672 - DNA, 16 bp, Homo sapiens
ccaagattttgaagga

SEQ ID NO: 5865673 - DNA, 18 bp, Homo sapiens
ccaagcaaaatctaaaat

SEQ ID NO: 5865674 - DNA, 20 bp, Homo sapiens
ccaagcaaaggtgaagagac

SEQ ID NO: 5865675 - DNA, 15 bp, Homo sapiens
ccaagcaaatgcctg

SEQ ID NO: 5865676 - DNA, 16 bp, Homo sapiens
ccaagcaacatttgta

SEQ ID NO: 5865677 - DNA, 23 bp, Homo sapiens
ccaagcaacctgggtccaaataa

SEQ ID NO: 5865678 - DNA, 15 bp, Homo sapiens
ccaagcaagactgag

SEQ ID NO: 5865679 - DNA, 14 bp, Homo sapiens
ccaagcaagtatta

SEQ ID NO: 5865680 - DNA, 15 bp, Homo sapiens
ccaagcacaaactgt

SEQ ID NO: 5865681 - DNA, 17 bp, Homo sapiens
ccaagcacagcagcctg

SEQ ID NO: 5865682 - DNA, 21 bp, Homo sapiens
ccaagcacagtggtggcaggg

SEQ ID NO: 5865683 - DNA, 22 bp, Homo sapiens
ccaagcacagtggtggcagggc

SEQ ID NO: 5865684 - DNA, 20 bp, Homo sapiens
ccaagcactcgagaccatcc

SEQ ID NO: 5865685 - DNA, 22 bp, Homo sapiens
ccaagcactgtgctcagggcta

SEQ ID NO: 5865686 - DNA, 14 bp, Homo sapiens
ccaagcagactcca

SEQ ID NO: 5865687 - DNA, 17 bp, Homo sapiens
ccaagcagactccagcc

SEQ ID NO: 5865688 - DNA, 23 bp, Homo sapiens
ccaagcagaggttgggaggccat

SEQ ID NO: 5865689 - DNA, 15 bp, Homo sapiens
ccaagcagccagcca

SEQ ID NO: 5865690 - DNA, 14 bp, Homo sapiens
ccaagcagctgaag

SEQ ID NO: 5865691 - DNA, 18 bp, Homo sapiens
ccaagcaggaaatgaaaa

SEQ ID NO: 5865692 - DNA, 18 bp, Homo sapiens
ccaagcaggaagctcaga

SEQ ID NO: 5865693 - DNA, 19 bp, Homo sapiens
ccaagcaggacagtgcttg

SEQ ID NO: 5865694 - DNA, 14 bp, Homo sapiens
ccaagcaggagacg

SEQ ID NO: 5865695 - DNA, 20 bp, Homo sapiens
ccaagcaggagacgacaggc

SEQ ID NO: 5865696 - DNA, 13 bp, Homo sapiens
ccaagcaggaggc

SEQ ID NO: 5865697 - DNA, 17 bp, Homo sapiens
ccaagcagtgcctgcct

SEQ ID NO: 5865698 - DNA, 18 bp, Homo sapiens
ccaagcagtgcctgccta

SEQ ID NO: 5865699 - DNA, 16 bp, Homo sapiens
ccaagcatataaaatt

SEQ ID NO: 5865700 - DNA, 19 bp, Homo sapiens
ccaagcattactttaacct

SEQ ID NO: 5865701 - DNA, 17 bp, Homo sapiens
ccaagcatttagatgta

SEQ ID NO: 5865702 - DNA, 13 bp, Homo sapiens
ccaagcatttcat

SEQ ID NO: 5865703 - DNA, 14 bp, Homo sapiens
ccaagcatttcatg

SEQ ID NO: 5865704 - DNA, 15 bp, Homo sapiens
ccaagccaaaaacct

SEQ ID NO: 5865705 - DNA, 21 bp, Homo sapiens
ccaagccaaaaaccttagctc

SEQ ID NO: 5865706 - DNA, 23 bp, Homo sapiens
ccaagccaccgcagctgctgcca

SEQ ID NO: 5865707 - DNA, 12 bp, Homo sapiens
ccaagccagctg

SEQ ID NO: 5865708 - DNA, 13 bp, Homo sapiens
ccaagccagctgc

SEQ ID NO: 5865709 - DNA, 21 bp, Homo sapiens
ccaagccagggttccagacag

SEQ ID NO: 5865710 - DNA, 20 bp, Homo sapiens
ccaagccatgggtagcctgg

SEQ ID NO: 5865711 - DNA, 14 bp, Homo sapiens
ccaagccatggtga

SEQ ID NO: 5865712 - DNA, 18 bp, Homo sapiens
ccaagccattcacttccc

SEQ ID NO: 5865713 - DNA, 22 bp, Homo sapiens
ccaagcccacaggtgtccccag

SEQ ID NO: 5865714 - DNA, 12 bp, Homo sapiens
ccaagcccacca

SEQ ID NO: 5865715 - DNA, 17 bp, Homo sapiens
ccaagcccaccaggtgt

SEQ ID NO: 5865716 - DNA, 15 bp, Homo sapiens
ccaagcccaccctgg

SEQ ID NO: 5865717 - DNA, 22 bp, Homo sapiens
ccaagcccagcctatctctctt

SEQ ID NO: 5865718 - DNA, 20 bp, Homo sapiens
ccaagccccatctcatcctg

SEQ ID NO: 5865719 - DNA, 24 bp, Homo sapiens
ccaagccccatctcatcctggcac

SEQ ID NO: 5865720 - DNA, 22 bp, Homo sapiens
ccaagccccctggcagctgccc

SEQ ID NO: 5865721 - DNA, 19 bp, Homo sapiens
ccaagcccctgccctgggg

SEQ ID NO: 5865722 - DNA, 17 bp, Homo sapiens
ccaagcccgacttgctg

SEQ ID NO: 5865723 - DNA, 18 bp, Homo sapiens
ccaagcccgacttgctgt

SEQ ID NO: 5865724 - DNA, 14 bp, Homo sapiens
ccaagccctaagcc

SEQ ID NO: 5865725 - DNA, 23 bp, Homo sapiens
ccaagccctaagcctgtccccag

SEQ ID NO: 5865726 - DNA, 15 bp, Homo sapiens
ccaagccctcctttg

SEQ ID NO: 5865727 - DNA, 17 bp, Homo sapiens
ccaagccctcctttgga

SEQ ID NO: 5865728 - DNA, 18 bp, Homo sapiens
ccaagccctgaggcctga

SEQ ID NO: 5865729 - DNA, 24 bp, Homo sapiens
ccaagccctgaggcctgaggcctg

SEQ ID NO: 5865730 - DNA, 11 bp, Homo sapiens
ccaagccctgg

SEQ ID NO: 5865731 - DNA, 12 bp, Homo sapiens
ccaagccctggc

SEQ ID NO: 5865732 - DNA, 19 bp, Homo sapiens
ccaagcccttccctctgtt

SEQ ID NO: 5865733 - DNA, 15 bp, Homo sapiens
ccaagccggcccaac

SEQ ID NO: 5865734 - DNA, 14 bp, Homo sapiens
ccaagccgtggctt

SEQ ID NO: 5865735 - DNA, 16 bp, Homo sapiens
ccaagccgtggcttcc

SEQ ID NO: 5865736 - DNA, 17 bp, Homo sapiens
ccaagccgtggcttccc

SEQ ID NO: 5865737 - DNA, 13 bp, Homo sapiens
ccaagcctccaca

SEQ ID NO: 5865738 - DNA, 16 bp, Homo sapiens
ccaagcctccacagcg

SEQ ID NO: 5865739 - DNA, 18 bp, Homo sapiens
ccaagcctccacagcgag

SEQ ID NO: 5865740 - DNA, 13 bp, Homo sapiens
ccaagcctctgcc

SEQ ID NO: 5865741 - DNA, 13 bp, Homo sapiens
ccaagcctgactt

SEQ ID NO: 5865742 - DNA, 15 bp, Homo sapiens
ccaagcctgctggct

SEQ ID NO: 5865743 - DNA, 14 bp, Homo sapiens
ccaagcctgctgtg

SEQ ID NO: 5865744 - DNA, 14 bp, Homo sapiens
ccaagcctggagcc

SEQ ID NO: 5865745 - DNA, 18 bp, Homo sapiens
ccaagcctggcaggggat

SEQ ID NO: 5865746 - DNA, 13 bp, Homo sapiens
ccaagcctggccc

SEQ ID NO: 5865747 - DNA, 14 bp, Homo sapiens
ccaagcctggccct

SEQ ID NO: 5865748 - DNA, 16 bp, Homo sapiens
ccaagcctggccctta

SEQ ID NO: 5865749 - DNA, 15 bp, Homo sapiens
ccaagcctgggccac

SEQ ID NO: 5865750 - DNA, 16 bp, Homo sapiens
ccaagcctgggccact

SEQ ID NO: 5865751 - DNA, 23 bp, Homo sapiens
ccaagcctgggccactggcatct

SEQ ID NO: 5865752 - DNA, 15 bp, Homo sapiens
ccaagcctggtctcc

SEQ ID NO: 5865753 - DNA, 16 bp, Homo sapiens
ccaagccttaaactgt

SEQ ID NO: 5865754 - DNA, 17 bp, Homo sapiens
ccaagccttaaactgta

SEQ ID NO: 5865755 - DNA, 19 bp, Homo sapiens
ccaagccttaaactgtaca

SEQ ID NO: 5865756 - DNA, 16 bp, Homo sapiens
ccaagcgaccaaggat

SEQ ID NO: 5865757 - DNA, 14 bp, Homo sapiens
ccaagcgccctggc

SEQ ID NO: 5865758 - DNA, 13 bp, Homo sapiens
ccaagcgcctggc

SEQ ID NO: 5865759 - DNA, 17 bp, Homo sapiens
ccaagcggtgtctctcc

SEQ ID NO: 5865760 - DNA, 22 bp, Homo sapiens
ccaagcgtgattcctgctgcct

SEQ ID NO: 5865761 - DNA, 18 bp, Homo sapiens
ccaagcgtggtcccgagg

SEQ ID NO: 5865762 - DNA, 15 bp, Homo sapiens
ccaagcgttcctggc

SEQ ID NO: 5865763 - DNA, 22 bp, Homo sapiens
ccaagcgttcctggccttctga

SEQ ID NO: 5865764 - DNA, 20 bp, Homo sapiens
ccaagctaagcactgccact

SEQ ID NO: 5865765 - DNA, 20 bp, Homo sapiens
ccaagctaagctgcaggcac

SEQ ID NO: 5865766 - DNA, 17 bp, Homo sapiens
ccaagctaatctgcctg

SEQ ID NO: 5865767 - DNA, 17 bp, Homo sapiens
ccaagctagaattccct

SEQ ID NO: 5865768 - DNA, 22 bp, Homo sapiens
ccaagctagaattccctctctc

SEQ ID NO: 5865769 - DNA, 18 bp, Homo sapiens
ccaagctatctaaagttt

SEQ ID NO: 5865770 - DNA, 17 bp, Homo sapiens
ccaagctattcaattct

SEQ ID NO: 5865771 - DNA, 18 bp, Homo sapiens
ccaagctcaaagcgtgga

SEQ ID NO: 5865772 - DNA, 16 bp, Homo sapiens
ccaagctcacacctgt

SEQ ID NO: 5865773 - DNA, 13 bp, Homo sapiens
ccaagctcacagt

SEQ ID NO: 5865774 - DNA, 15 bp, Homo sapiens
ccaagctcagagcag

SEQ ID NO: 5865775 - DNA, 22 bp, Homo sapiens
ccaagctccaaatccaaggaaa

SEQ ID NO: 5865776 - DNA, 15 bp, Homo sapiens
ccaagctcccaggca

SEQ ID NO: 5865777 - DNA, 16 bp, Homo sapiens
ccaagctcccaggcat

SEQ ID NO: 5865778 - DNA, 22 bp, Homo sapiens
ccaagctccctgccccaaataa

SEQ ID NO: 5865779 - DNA, 14 bp, Homo sapiens
ccaagctccctgga

SEQ ID NO: 5865780 - DNA, 15 bp, Homo sapiens
ccaagctccttggga

SEQ ID NO: 5865781 - DNA, 17 bp, Homo sapiens
ccaagctccttgggagg

SEQ ID NO: 5865782 - DNA, 19 bp, Homo sapiens
ccaagctccttgggaggcc

SEQ ID NO: 5865783 - DNA, 21 bp, Homo sapiens
ccaagctcggatcacatgaag

SEQ ID NO: 5865784 - DNA, 14 bp, Homo sapiens
ccaagctctctgca

SEQ ID NO: 5865785 - DNA, 14 bp, Homo sapiens
ccaagctctgcagt

SEQ ID NO: 5865786 - DNA, 14 bp, Homo sapiens
ccaagctctgctcc

SEQ ID NO: 5865787 - DNA, 15 bp, Homo sapiens
ccaagctctgctcct

SEQ ID NO: 5865788 - DNA, 16 bp, Homo sapiens
ccaagctgaagctaca

SEQ ID NO: 5865789 - DNA, 23 bp, Homo sapiens
ccaagctgaagtgaaggagaaag

SEQ ID NO: 5865790 - DNA, 15 bp, Homo sapiens
ccaagctgaggtgcc

SEQ ID NO: 5865791 - DNA, 17 bp, Homo sapiens
ccaagctgaggtgccca

SEQ ID NO: 5865792 - DNA, 20 bp, Homo sapiens
ccaagctgaggtgcccagga

SEQ ID NO: 5865793 - DNA, 22 bp, Homo sapiens
ccaagctgaggtgcccaggaga

SEQ ID NO: 5865794 - DNA, 17 bp, Homo sapiens
ccaagctgagtttccta

SEQ ID NO: 5865795 - DNA, 16 bp, Homo sapiens
ccaagctgattttatt

SEQ ID NO: 5865796 - DNA, 20 bp, Homo sapiens
ccaagctgcctctgggccat

SEQ ID NO: 5865797 - DNA, 21 bp, Homo sapiens
ccaagctgctgccgcctcacc

SEQ ID NO: 5865798 - DNA, 16 bp, Homo sapiens
ccaagctggagtgaag

SEQ ID NO: 5865799 - DNA, 22 bp, Homo sapiens
ccaagctggcacaaaagacagc

SEQ ID NO: 5865800 - DNA, 13 bp, Homo sapiens
ccaagctggctgg

SEQ ID NO: 5865801 - DNA, 11 bp, Homo sapiens
ccaagctgggc

SEQ ID NO: 5865802 - DNA, 24 bp, Homo sapiens
ccaataactaatgctaagaaatgc

SEQ ID NO: 5865803 - DNA, 18 bp, Homo sapiens
ccaataacttcagagaag

SEQ ID NO: 5865804 - DNA, 21 bp, Homo sapiens
ccaataacttcagagaagtca

SEQ ID NO: 5865805 - DNA, 16 bp, Homo sapiens
ccaataataaagacat

SEQ ID NO: 5865806 - DNA, 22 bp, Homo sapiens
ccaataatcgtcataggcttct

SEQ ID NO: 5865807 - DNA, 21 bp, Homo sapiens
ccaataatggggcagacacaa

SEQ ID NO: 5865808 - DNA, 18 bp, Homo sapiens
ccaataattttcctgtga

SEQ ID NO: 5865809 - DNA, 17 bp, Homo sapiens
ccaatacatttgtattt

SEQ ID NO: 5865810 - DNA, 14 bp, Homo sapiens
ccaataccccatgg

SEQ ID NO: 5865811 - DNA, 22 bp, Homo sapiens
ccaataccctactgtggggaga

SEQ ID NO: 5865812 - DNA, 15 bp, Homo sapiens
ccaatacctcttgga

SEQ ID NO: 5865813 - DNA, 18 bp, Homo sapiens
ccaatacgtagatttttg

SEQ ID NO: 5865814 - DNA, 20 bp, Homo sapiens
ccaatactagccccccagtg

SEQ ID NO: 5865815 - DNA, 16 bp, Homo sapiens
ccaatagaaagaaact

SEQ ID NO: 5865816 - DNA, 12 bp, Homo sapiens
ccaatagaaagc

SEQ ID NO: 5865817 - DNA, 14 bp, Homo sapiens
ccaatagctgccca

SEQ ID NO: 5865818 - DNA, 16 bp, Homo sapiens
ccaataggcaaattaa

SEQ ID NO: 5865819 - DNA, 22 bp, Homo sapiens
ccaatagggctgagctctctgt

SEQ ID NO: 5865820 - DNA, 15 bp, Homo sapiens
ccaataggtgcaaaa

SEQ ID NO: 5865821 - DNA, 12 bp, Homo sapiens
ccaatagtcata

SEQ ID NO: 5865822 - DNA, 23 bp, Homo sapiens
ccaatagtctgccacaagggcag

SEQ ID NO: 5865823 - DNA, 17 bp, Homo sapiens
ccaatagttgctgtccc

SEQ ID NO: 5865824 - DNA, 19 bp, Homo sapiens
ccaatagttgctgtcccct

SEQ ID NO: 5865825 - DNA, 23 bp, Homo sapiens
ccaatagttttagattattttat

SEQ ID NO: 5865826 - DNA, 12 bp, Homo sapiens
ccaatataccta

SEQ ID NO: 5865827 - DNA, 23 bp, Homo sapiens
ccaatatagttttctaactcctg

SEQ ID NO: 5865828 - DNA, 14 bp, Homo sapiens
ccaatatatgtatt

SEQ ID NO: 5865829 - DNA, 17 bp, Homo sapiens
ccaatatatgtattttt

SEQ ID NO: 5865830 - DNA, 18 bp, Homo sapiens
ccaatatcatgtgtagat

SEQ ID NO: 5865831 - DNA, 18 bp, Homo sapiens
ccaatatcccttacttta

SEQ ID NO: 5865832 - DNA, 12 bp, Homo sapiens
ccaatatcctaa

SEQ ID NO: 5865833 - DNA, 16 bp, Homo sapiens
ccaatatcctaataaa

SEQ ID NO: 5865834 - DNA, 19 bp, Homo sapiens
ccaatatcctcgctcccgg

SEQ ID NO: 5865835 - DNA, 17 bp, Homo sapiens
ccaatatttaccagacc

SEQ ID NO: 5865836 - DNA, 22 bp, Homo sapiens
ccaatatttataattaaagaaa

SEQ ID NO: 5865837 - DNA, 18 bp, Homo sapiens
ccaatatttctcagacat

SEQ ID NO: 5865838 - DNA, 19 bp, Homo sapiens
ccaatatttctgctttctt

SEQ ID NO: 5865839 - DNA, 22 bp, Homo sapiens
ccaatattttctttaatgcttt

SEQ ID NO: 5865840 - DNA, 18 bp, Homo sapiens
ccaatcaaagaattacag

SEQ ID NO: 5865841 - DNA, 17 bp, Homo sapiens
ccaatcaagataaagga

SEQ ID NO: 5865842 - DNA, 22 bp, Homo sapiens
ccaatcaatcttgcatgtaacg

SEQ ID NO: 5865843 - DNA, 20 bp, Homo sapiens
ccaatcaatttaaatgttta

SEQ ID NO: 5865844 - DNA, 22 bp, Homo sapiens
ccaatcaatttaaatgtttact

SEQ ID NO: 5865845 - DNA, 20 bp, Homo sapiens
ccaatcacgagatcttcctt

SEQ ID NO: 5865846 - DNA, 22 bp, Homo sapiens
ccaatcagagaccaggccctgg

SEQ ID NO: 5865847 - DNA, 15 bp, Homo sapiens
ccaatcagagagcct

SEQ ID NO: 5865848 - DNA, 18 bp, Homo sapiens
ccaatcagcactctgtaa

SEQ ID NO: 5865849 - DNA, 14 bp, Homo sapiens
ccaatcagcactga

SEQ ID NO: 5865850 - DNA, 17 bp, Homo sapiens
ccaatcagcactgaaaa

SEQ ID NO: 5865851 - DNA, 18 bp, Homo sapiens
ccaatcagcgctctgtag

SEQ ID NO: 5865852 - DNA, 19 bp, Homo sapiens
ccaatcagcttttgttcta

SEQ ID NO: 5865853 - DNA, 15 bp, Homo sapiens
ccaatcatattaata

SEQ ID NO: 5865854 - DNA, 14 bp, Homo sapiens
ccaatcattttaat

SEQ ID NO: 5865855 - DNA, 22 bp, Homo sapiens
ccaatcattttaattattattc

SEQ ID NO: 5865856 - DNA, 21 bp, Homo sapiens
ccaatccaggccaaagcccca

SEQ ID NO: 5865857 - DNA, 23 bp, Homo sapiens
ccaatccaggcccggtgaggcca

SEQ ID NO: 5865858 - DNA, 21 bp, Homo sapiens
ccaatccaggtacgcacagac

SEQ ID NO: 5865859 - DNA, 22 bp, Homo sapiens
ccaatccaggtacgcacagaca

SEQ ID NO: 5865860 - DNA, 16 bp, Homo sapiens
ccaatccatgcttcac

SEQ ID NO: 5865861 - DNA, 18 bp, Homo sapiens
ccaatcccagctacctca

SEQ ID NO: 5865862 - DNA, 15 bp, Homo sapiens
ccaatcccagggctg

SEQ ID NO: 5865863 - DNA, 16 bp, Homo sapiens
ccaatccccactcctc

SEQ ID NO: 5865864 - DNA, 14 bp, Homo sapiens
ccaatccccagcct

SEQ ID NO: 5865865 - DNA, 16 bp, Homo sapiens
ccaatccccagcctag

SEQ ID NO: 5865866 - DNA, 16 bp, Homo sapiens
ccaatcccctccttgg

SEQ ID NO: 5865867 - DNA, 18 bp, Homo sapiens
ccaatcccgtgaaagaat

SEQ ID NO: 5865868 - DNA, 13 bp, Homo sapiens
ccaatccctgcca

SEQ ID NO: 5865869 - DNA, 14 bp, Homo sapiens
ccaatccctgccac

SEQ ID NO: 5865870 - DNA, 14 bp, Homo sapiens
ccaatcctatgttt

SEQ ID NO: 5865871 - DNA, 14 bp, Homo sapiens
ccaatcctcaggat

SEQ ID NO: 5865872 - DNA, 14 bp, Homo sapiens
ccaatcctctctcc

SEQ ID NO: 5865873 - DNA, 13 bp, Homo sapiens
ccaatcctgcccc

SEQ ID NO: 5865874 - DNA, 17 bp, Homo sapiens
ccaatcctgtttttcct

SEQ ID NO: 5865875 - DNA, 14 bp, Homo sapiens
ccaatcggactgcc

SEQ ID NO: 5865876 - DNA, 15 bp, Homo sapiens
ccaatcggactgcca

SEQ ID NO: 5865877 - DNA, 18 bp, Homo sapiens
ccaatcggctacccctcg

SEQ ID NO: 5865878 - DNA, 16 bp, Homo sapiens
ccaatcgggagtagca

SEQ ID NO: 5865879 - DNA, 21 bp, Homo sapiens
ccaatctatgtcgtgttttca

SEQ ID NO: 5865880 - DNA, 19 bp, Homo sapiens
ccaatctattgcttcacca

SEQ ID NO: 5865881 - DNA, 19 bp, Homo sapiens
ccaatctccaggctccctc

SEQ ID NO: 5865882 - DNA, 11 bp, Homo sapiens
ccaatctctgg

SEQ ID NO: 5865883 - DNA, 19 bp, Homo sapiens
ccaatctctggtgcctaaa

SEQ ID NO: 5865884 - DNA, 16 bp, Homo sapiens
ccaatctctgtgactc

SEQ ID NO: 5865885 - DNA, 19 bp, Homo sapiens
ccaatctcttggtggggag

SEQ ID NO: 5865886 - DNA, 12 bp, Homo sapiens
ccaatctgccct

SEQ ID NO: 5865887 - DNA, 21 bp, Homo sapiens
ccaatctgctcagcaggccct

SEQ ID NO: 5865888 - DNA, 20 bp, Homo sapiens
ccaatctggacacttcttta

SEQ ID NO: 5865889 - DNA, 22 bp, Homo sapiens
ccaatctggacacttctttata

SEQ ID NO: 5865890 - DNA, 22 bp, Homo sapiens
ccaatctggcccttacacactc

SEQ ID NO: 5865891 - DNA, 14 bp, Homo sapiens
ccaatctgtacaaa

SEQ ID NO: 5865892 - DNA, 20 bp, Homo sapiens
ccaatcttgttttaagcaaa

SEQ ID NO: 5865893 - DNA, 17 bp, Homo sapiens
ccaatctttcctacttt

SEQ ID NO: 5865894 - DNA, 22 bp, Homo sapiens
ccaatctttctatataaaatgt

SEQ ID NO: 5865895 - DNA, 21 bp, Homo sapiens
ccaatgaagaagacaaagtct

SEQ ID NO: 5865896 - DNA, 13 bp, Homo sapiens
ccaatgaaggaaa

SEQ ID NO: 5865897 - DNA, 17 bp, Homo sapiens
ccaatgacacccatgcc

SEQ ID NO: 5865898 - DNA, 17 bp, Homo sapiens
ccaatgagacttgcctt

SEQ ID NO: 5865899 - DNA, 15 bp, Homo sapiens
ccaatgagctttctg

SEQ ID NO: 5865900 - DNA, 21 bp, Homo sapiens
ccaatgagctttctgaacagc

SEQ ID NO: 5865901 - DNA, 23 bp, Homo sapiens
ccaatgagctttctgaacagctg

SEQ ID NO: 5865902 - DNA, 23 bp, Homo sapiens
ccaatgatataggaaaatacatt

SEQ ID NO: 5865903 - DNA, 13 bp, Homo sapiens
ccaatgcactgag

SEQ ID NO: 5865904 - DNA, 14 bp, Homo sapiens
ccaatgcactttgt

SEQ ID NO: 5865905 - DNA, 23 bp, Homo sapiens
ccaatgcactttgttctggctct

SEQ ID NO: 5865906 - DNA, 19 bp, Homo sapiens
ccaatgcaggctgtttcct

SEQ ID NO: 5865907 - DNA, 20 bp, Homo sapiens
ccaatgcatagagccctggc

SEQ ID NO: 5865908 - DNA, 22 bp, Homo sapiens
ccaatgcatagagccctggcca

SEQ ID NO: 5865909 - DNA, 23 bp, Homo sapiens
ccaatgcatgcagccactgtgct

SEQ ID NO: 5865910 - DNA, 14 bp, Homo sapiens
ccaatgcattggcc

SEQ ID NO: 5865911 - DNA, 14 bp, Homo sapiens
ccaatgccacagcc

SEQ ID NO: 5865912 - DNA, 17 bp, Homo sapiens
ccaatgccacagccaag

SEQ ID NO: 5865913 - DNA, 18 bp, Homo sapiens
ccaatgccacagccaagc

SEQ ID NO: 5865914 - DNA, 19 bp, Homo sapiens
ccaatgccacagccaagcc

SEQ ID NO: 5865915 - DNA, 18 bp, Homo sapiens
ccaatgcctataaaatgc

SEQ ID NO: 5865916 - DNA, 22 bp, Homo sapiens
ccaatgcggcccactttcctga

SEQ ID NO: 5865917 - DNA, 14 bp, Homo sapiens
ccaatgctcctgga

SEQ ID NO: 5865918 - DNA, 14 bp, Homo sapiens
ccaatgctctggag

SEQ ID NO: 5865919 - DNA, 13 bp, Homo sapiens
ccaatgctgcttt

SEQ ID NO: 5865920 - DNA, 19 bp, Homo sapiens
ccaatgcttgcatggagaa

SEQ ID NO: 5865921 - DNA, 17 bp, Homo sapiens
ccaatgctttgggaggc

SEQ ID NO: 5865922 - DNA, 18 bp, Homo sapiens
ccaatgcttttatcaaac

SEQ ID NO: 5865923 - DNA, 17 bp, Homo sapiens
ccaatggaacctccttt

SEQ ID NO: 5865924 - DNA, 19 bp, Homo sapiens
ccaatggaacctcctttct

SEQ ID NO: 5865925 - DNA, 22 bp, Homo sapiens
ccaatggaatgtgatgttcatg

SEQ ID NO: 5865926 - DNA, 22 bp, Homo sapiens
ccaatggacaagcagtgtctgt

SEQ ID NO: 5865927 - DNA, 23 bp, Homo sapiens
ccaatggactaacttgtctttgg

SEQ ID NO: 5865928 - DNA, 14 bp, Homo sapiens
ccaatggagaaaat

SEQ ID NO: 5865929 - DNA, 17 bp, Homo sapiens
ccaatggagaaatgaag

SEQ ID NO: 5865930 - DNA, 17 bp, Homo sapiens
ccaatggggcggggctt

SEQ ID NO: 5865931 - DNA, 19 bp, Homo sapiens
ccaatggggcggggcttct

SEQ ID NO: 5865932 - DNA, 22 bp, Homo sapiens
ccaatggggcggggcttctctc

SEQ ID NO: 5865933 - DNA, 17 bp, Homo sapiens
ccaatgggtttgccaag

SEQ ID NO: 5865934 - DNA, 19 bp, Homo sapiens
ccaatggtaggaatttcaa

SEQ ID NO: 5865935 - DNA, 16 bp, Homo sapiens
ccaatggtgagggctg

SEQ ID NO: 5865936 - DNA, 17 bp, Homo sapiens
ccaatggtgagggctga

SEQ ID NO: 5865937 - DNA, 18 bp, Homo sapiens
ccaatggtgagggctgag

SEQ ID NO: 5865938 - DNA, 20 bp, Homo sapiens
ccaatggtgatcctctattt

SEQ ID NO: 5865939 - DNA, 23 bp, Homo sapiens
ccaatggtgatcctctattttgt

SEQ ID NO: 5865940 - DNA, 14 bp, Homo sapiens
ccaatggtgcttgg

SEQ ID NO: 5865941 - DNA, 18 bp, Homo sapiens
ccaatggtgcttggaggg

SEQ ID NO: 5865942 - DNA, 20 bp, Homo sapiens
ccaatgtaggagctgccttg

SEQ ID NO: 5865943 - DNA, 17 bp, Homo sapiens
ccaatgtatgtgtggct

SEQ ID NO: 5865944 - DNA, 19 bp, Homo sapiens
ccaatgtccaggtcacagg

SEQ ID NO: 5865945 - DNA, 16 bp, Homo sapiens
ccaatgtcctgaaaca

SEQ ID NO: 5865946 - DNA, 15 bp, Homo sapiens
ccaatgtctcccaca

SEQ ID NO: 5865947 - DNA, 18 bp, Homo sapiens
ccaatgtctgccacacaa

SEQ ID NO: 5865948 - DNA, 16 bp, Homo sapiens
ccaatgtctggagacc

SEQ ID NO: 5865949 - DNA, 14 bp, Homo sapiens
ccaatgtgaagaca

SEQ ID NO: 5865950 - DNA, 16 bp, Homo sapiens
ccaatgtgacctgggg

SEQ ID NO: 5865951 - DNA, 22 bp, Homo sapiens
ccaatgtgactaccgtgccagc

SEQ ID NO: 5865952 - DNA, 23 bp, Homo sapiens
ccaatgtgactaccgtgccagca

SEQ ID NO: 5865953 - DNA, 18 bp, Homo sapiens
ccaatgtgcccagtcatg

SEQ ID NO: 5865954 - DNA, 15 bp, Homo sapiens
ccaatgtgttttctg

SEQ ID NO: 5865955 - DNA, 16 bp, Homo sapiens
ccaatgttatgccagc

SEQ ID NO: 5865956 - DNA, 20 bp, Homo sapiens
ccaatgttctctcttctcca

SEQ ID NO: 5865957 - DNA, 16 bp, Homo sapiens
ccaatgtttaaaaaag

SEQ ID NO: 5865958 - DNA, 23 bp, Homo sapiens
ccaatgtttcaagaggagccccc

SEQ ID NO: 5865959 - DNA, 23 bp, Homo sapiens
ccaatgtttgggatattaaaaca

SEQ ID NO: 5865960 - DNA, 14 bp, Homo sapiens
ccaatgttttattg

SEQ ID NO: 5865961 - DNA, 20 bp, Homo sapiens
ccaatgttttattggggaat

SEQ ID NO: 5865962 - DNA, 12 bp, Homo sapiens
ccaatgttttcc

SEQ ID NO: 5865963 - DNA, 11 bp, Homo sapiens
ccaattaaaag

SEQ ID NO: 5865964 - DNA, 19 bp, Homo sapiens
ccaattaaaagtatgcaga

SEQ ID NO: 5865965 - DNA, 13 bp, Homo sapiens
ccaattaaaatac

SEQ ID NO: 5865966 - DNA, 17 bp, Homo sapiens
ccaattaactgaagcaa

SEQ ID NO: 5865967 - DNA, 15 bp, Homo sapiens
ccaattaagcagctt

SEQ ID NO: 5865968 - DNA, 18 bp, Homo sapiens
ccaattaatgaagttgat

SEQ ID NO: 5865969 - DNA, 24 bp, Homo sapiens
ccaattaatgattcaattaacata

SEQ ID NO: 5865970 - DNA, 19 bp, Homo sapiens
ccaattacagggtgactca

SEQ ID NO: 5865971 - DNA, 18 bp, Homo sapiens
ccaattacccataaacag

SEQ ID NO: 5865972 - DNA, 22 bp, Homo sapiens
ccaattacggtgtacagtttaa

SEQ ID NO: 5865973 - DNA, 15 bp, Homo sapiens
ccaattagtttcctt

SEQ ID NO: 5865974 - DNA, 21 bp, Homo sapiens
ccaattataacttattagcag

SEQ ID NO: 5865975 - DNA, 20 bp, Homo sapiens
ccaattatatctcccccact

SEQ ID NO: 5865976 - DNA, 18 bp, Homo sapiens
ccaattatcaaaaaacag

SEQ ID NO: 5865977 - DNA, 22 bp, Homo sapiens
ccaattatcaaaaaacagaaaa

SEQ ID NO: 5865978 - DNA, 22 bp, Homo sapiens
ccacgtggatgggcaaagcttg

SEQ ID NO: 5865979 - DNA, 19 bp, Homo sapiens
ccacgtggccgctgctgtg

SEQ ID NO: 5865980 - DNA, 17 bp, Homo sapiens
ccacgtggcctctctct

SEQ ID NO: 5865981 - DNA, 22 bp, Homo sapiens
ccacgtggcgggaatgagctgt

SEQ ID NO: 5865982 - DNA, 18 bp, Homo sapiens
ccacgtggctgcgtgccc

SEQ ID NO: 5865983 - DNA, 23 bp, Homo sapiens
ccacgtggctgcgtgcccctgct

SEQ ID NO: 5865984 - DNA, 16 bp, Homo sapiens
ccacgtggggctcact

SEQ ID NO: 5865985 - DNA, 21 bp, Homo sapiens
ccacgtggtcactgtgcactg

SEQ ID NO: 5865986 - DNA, 21 bp, Homo sapiens
ccacgtggtggcccagctcct

SEQ ID NO: 5865987 - DNA, 14 bp, Homo sapiens
ccacgtgtatagta

SEQ ID NO: 5865988 - DNA, 20 bp, Homo sapiens
ccacgtgtatagtatctgta

SEQ ID NO: 5865989 - DNA, 22 bp, Homo sapiens
ccacgtgtatagtatctgtata

SEQ ID NO: 5865990 - DNA, 22 bp, Homo sapiens
ccacgtgtccgtccacccttcc

SEQ ID NO: 5865991 - DNA, 22 bp, Homo sapiens
ccacgtgtctggaatcccagct

SEQ ID NO: 5865992 - DNA, 12 bp, Homo sapiens
ccacgtgtcttc

SEQ ID NO: 5865993 - DNA, 16 bp, Homo sapiens
ccacgtgtcttccact

SEQ ID NO: 5865994 - DNA, 14 bp, Homo sapiens
ccacgtgtgcagac

SEQ ID NO: 5865995 - DNA, 17 bp, Homo sapiens
ccacgtgtgctgtggcc

SEQ ID NO: 5865996 - DNA, 19 bp, Homo sapiens
ccacgtgtgctgtggccag

SEQ ID NO: 5865997 - DNA, 21 bp, Homo sapiens
ccacgtgtgctgtggccaggc

SEQ ID NO: 5865998 - DNA, 21 bp, Homo sapiens
ccacgtgtggcctccgtcctg

SEQ ID NO: 5865999 - DNA, 12 bp, Homo sapiens
ccacgtgtgtgt

SEQ ID NO: 5866000 - DNA, 16 bp, Homo sapiens
ccacgtgtgtgtgtga

SEQ ID NO: 5866001 - DNA, 14 bp, Homo sapiens
ccacgttcacccct

SEQ ID NO: 5866002 - DNA, 17 bp, Homo sapiens
ccacgttcacccctcca

SEQ ID NO: 5866003 - DNA, 20 bp, Homo sapiens
ccacgttccttactgcagaa

SEQ ID NO: 5866004 - DNA, 14 bp, Homo sapiens
ccacgttctatata

SEQ ID NO: 5866005 - DNA, 19 bp, Homo sapiens
ccacgttctcacacccacc

SEQ ID NO: 5866006 - DNA, 14 bp, Homo sapiens
ccacgttctctctg

SEQ ID NO: 5866007 - DNA, 22 bp, Homo sapiens
ccacgttgcagaaaaagagctt

SEQ ID NO: 5866008 - DNA, 15 bp, Homo sapiens
ccacgttgtccctga

SEQ ID NO: 5866009 - DNA, 14 bp, Homo sapiens
ccactaaaaatatt

SEQ ID NO: 5866010 - DNA, 22 bp, Homo sapiens
ccactaaagcttcagactcaag

SEQ ID NO: 5866011 - DNA, 23 bp, Homo sapiens
ccactaaagtagggaagttttat

SEQ ID NO: 5866012 - DNA, 21 bp, Homo sapiens
ccactaaatctccaagacctg

SEQ ID NO: 5866013 - DNA, 16 bp, Homo sapiens
ccactaaccatcccca

SEQ ID NO: 5866014 - DNA, 17 bp, Homo sapiens
ccactaaccatccccaa

SEQ ID NO: 5866015 - DNA, 21 bp, Homo sapiens
ccactaaccttgcctggtaca

SEQ ID NO: 5866016 - DNA, 11 bp, Homo sapiens
ccactaactag

SEQ ID NO: 5866017 - DNA, 22 bp, Homo sapiens
ccactaactagagcagccctgg

SEQ ID NO: 5866018 - DNA, 18 bp, Homo sapiens
ccactaactcctgagaaa

SEQ ID NO: 5866019 - DNA, 14 bp, Homo sapiens
ccactaacttctaa

SEQ ID NO: 5866020 - DNA, 18 bp, Homo sapiens
ccactaagaacacctgca

SEQ ID NO: 5866021 - DNA, 20 bp, Homo sapiens
ccactaagaacccctctgct

SEQ ID NO: 5866022 - DNA, 21 bp, Homo sapiens
ccactaagaacccctctgctt

SEQ ID NO: 5866023 - DNA, 16 bp, Homo sapiens
ccactaagaagttcca

SEQ ID NO: 5866024 - DNA, 14 bp, Homo sapiens
ccactaagcagagg

SEQ ID NO: 5866025 - DNA, 18 bp, Homo sapiens
ccactaagcagaggaggg

SEQ ID NO: 5866026 - DNA, 17 bp, Homo sapiens
ccactaagctttctcct

SEQ ID NO: 5866027 - DNA, 19 bp, Homo sapiens
ccactaagctttctccttt

SEQ ID NO: 5866028 - DNA, 14 bp, Homo sapiens
ccactacacctggc

SEQ ID NO: 5866029 - DNA, 15 bp, Homo sapiens
ccactacacctggct

SEQ ID NO: 5866030 - DNA, 16 bp, Homo sapiens
ccactacacctggctg

SEQ ID NO: 5866031 - DNA, 17 bp, Homo sapiens
ccactacacctggctga

SEQ ID NO: 5866032 - DNA, 18 bp, Homo sapiens
ccactacactccagcctg

SEQ ID NO: 5866033 - DNA, 20 bp, Homo sapiens
ccactacactccagcctgag

SEQ ID NO: 5866034 - DNA, 22 bp, Homo sapiens
ccactacactccagcctgagca

SEQ ID NO: 5866035 - DNA, 22 bp, Homo sapiens
ccactacatgcagcccatgccc

SEQ ID NO: 5866036 - DNA, 13 bp, Homo sapiens
ccactaccagcca

SEQ ID NO: 5866037 - DNA, 17 bp, Homo sapiens
ccactaccagccagcct

SEQ ID NO: 5866038 - DNA, 18 bp, Homo sapiens
ccactaccagccagcctc

SEQ ID NO: 5866039 - DNA, 19 bp, Homo sapiens
ccactaccagccagcctca

SEQ ID NO: 5866040 - DNA, 18 bp, Homo sapiens
ccactaccccacaccagc

SEQ ID NO: 5866041 - DNA, 17 bp, Homo sapiens
ccactacccggcagggt

SEQ ID NO: 5866042 - DNA, 22 bp, Homo sapiens
ccactacccttctcctttcctt

SEQ ID NO: 5866043 - DNA, 23 bp, Homo sapiens
ccactacccttctcctttccttc

SEQ ID NO: 5866044 - DNA, 22 bp, Homo sapiens
ccactaccttctgacctcccca

SEQ ID NO: 5866045 - DNA, 22 bp, Homo sapiens
ccactacctttgtccaggcctg

SEQ ID NO: 5866046 - DNA, 14 bp, Homo sapiens
ccactacgctcctg

SEQ ID NO: 5866047 - DNA, 18 bp, Homo sapiens
ccactactctcttcctcc

SEQ ID NO: 5866048 - DNA, 21 bp, Homo sapiens
ccactactctcttcctccact

SEQ ID NO: 5866049 - DNA, 17 bp, Homo sapiens
ccactagacccactgga

SEQ ID NO: 5866050 - DNA, 21 bp, Homo sapiens
ccactagactcaaggaagaat

SEQ ID NO: 5866051 - DNA, 15 bp, Homo sapiens
ccactagagggccca

SEQ ID NO: 5866052 - DNA, 20 bp, Homo sapiens
ccactagaggggcacccacc

SEQ ID NO: 5866053 - DNA, 20 bp, Homo sapiens
ccactagccctctttctctc

SEQ ID NO: 5866054 - DNA, 21 bp, Homo sapiens
ccactagccctctttctctct

SEQ ID NO: 5866055 - DNA, 14 bp, Homo sapiens
ccactagcctcagg

SEQ ID NO: 5866056 - DNA, 15 bp, Homo sapiens
ccactagcctcaggg

SEQ ID NO: 5866057 - DNA, 19 bp, Homo sapiens
ccactagctaagcaagcca

SEQ ID NO: 5866058 - DNA, 14 bp, Homo sapiens
ccactagcttactg

SEQ ID NO: 5866059 - DNA, 16 bp, Homo sapiens
ccactaggactctgag

SEQ ID NO: 5866060 - DNA, 18 bp, Homo sapiens
ccactaggactctgaggc

SEQ ID NO: 5866061 - DNA, 23 bp, Homo sapiens
ccactaggataggaactgggcct

SEQ ID NO: 5866062 - DNA, 20 bp, Homo sapiens
ccactaggatcccactggcg

SEQ ID NO: 5866063 - DNA, 23 bp, Homo sapiens
ccactaggctgggtgcccacagc

SEQ ID NO: 5866064 - DNA, 18 bp, Homo sapiens
ccactaggttctaggtcc

SEQ ID NO: 5866065 - DNA, 14 bp, Homo sapiens
ccactagtgcaaat

SEQ ID NO: 5866066 - DNA, 22 bp, Homo sapiens
ccactatatcatgggctctgca

SEQ ID NO: 5866067 - DNA, 16 bp, Homo sapiens
ccactatccttcgtga

SEQ ID NO: 5866068 - DNA, 14 bp, Homo sapiens
ccactatgcaaaga

SEQ ID NO: 5866069 - DNA, 12 bp, Homo sapiens
ccactatttcca

SEQ ID NO: 5866070 - DNA, 13 bp, Homo sapiens
ccactattttcaa

SEQ ID NO: 5866071 - DNA, 21 bp, Homo sapiens
ccactatttttattttcttat

SEQ ID NO: 5866072 - DNA, 13 bp, Homo sapiens
ccactcaacagag

SEQ ID NO: 5866073 - DNA, 15 bp, Homo sapiens
ccactcaagaccaaa

SEQ ID NO: 5866074 - DNA, 16 bp, Homo sapiens
ccactcaagccaagca

SEQ ID NO: 5866075 - DNA, 18 bp, Homo sapiens
ccactcaatatgtgattt

SEQ ID NO: 5866076 - DNA, 21 bp, Homo sapiens
ccactcaatccatccatgtac

SEQ ID NO: 5866077 - DNA, 14 bp, Homo sapiens
ccactcacacagcc

SEQ ID NO: 5866078 - DNA, 16 bp, Homo sapiens
ccactcacacagccag

SEQ ID NO: 5866079 - DNA, 18 bp, Homo sapiens
ccactcacacagccaggt

SEQ ID NO: 5866080 - DNA, 21 bp, Homo sapiens
ccactcacacagccaggtgcc

SEQ ID NO: 5866081 - DNA, 23 bp, Homo sapiens
ccactcacacagccaggtgcctt

SEQ ID NO: 5866082 - DNA, 20 bp, Homo sapiens
ccactcaccacaagctgagc

SEQ ID NO: 5866083 - DNA, 21 bp, Homo sapiens
ccactcaccacaagctgagca

SEQ ID NO: 5866084 - DNA, 13 bp, Homo sapiens
ccactcaccagcc

SEQ ID NO: 5866085 - DNA, 14 bp, Homo sapiens
ccactcaccagccc

SEQ ID NO: 5866086 - DNA, 19 bp, Homo sapiens
ccactcaccagccctagct

SEQ ID NO: 5866087 - DNA, 15 bp, Homo sapiens
ccactcaccagggtc

SEQ ID NO: 5866088 - DNA, 15 bp, Homo sapiens
ccactcacccccttt

SEQ ID NO: 5866089 - DNA, 18 bp, Homo sapiens
ccactcaccccctttgct

SEQ ID NO: 5866090 - DNA, 22 bp, Homo sapiens
ccactcacccttcctggcccag

SEQ ID NO: 5866091 - DNA, 21 bp, Homo sapiens
ccactcacctttctccactgg

SEQ ID NO: 5866092 - DNA, 22 bp, Homo sapiens
ccactcacgaatattatgccca

SEQ ID NO: 5866093 - DNA, 22 bp, Homo sapiens
ccactcactaggcccccacttg

SEQ ID NO: 5866094 - DNA, 14 bp, Homo sapiens
ccactcactccagc

SEQ ID NO: 5866095 - DNA, 23 bp, Homo sapiens
ccactcactgaagcccagacctc

SEQ ID NO: 5866096 - DNA, 17 bp, Homo sapiens
ccactcagagacatgca

SEQ ID NO: 5866097 - DNA, 13 bp, Homo sapiens
ccactcagaggcc

SEQ ID NO: 5866098 - DNA, 11 bp, Homo sapiens
ccactcagcat

SEQ ID NO: 5866099 - DNA, 11 bp, Homo sapiens
ccactcagcca

SEQ ID NO: 5866100 - DNA, 20 bp, Homo sapiens
ccactcagccatttccccct

SEQ ID NO: 5866101 - DNA, 23 bp, Homo sapiens
ccactcagccatttccccctcct

SEQ ID NO: 5866102 - DNA, 12 bp, Homo sapiens
ccactcagcccc

SEQ ID NO: 5866103 - DNA, 13 bp, Homo sapiens
ccactcagcccct

SEQ ID NO: 5866104 - DNA, 14 bp, Homo sapiens
ccactcagccccta

SEQ ID NO: 5866105 - DNA, 16 bp, Homo sapiens
ccactcagcccctagg

SEQ ID NO: 5866106 - DNA, 13 bp, Homo sapiens
ccactcagcttcc

SEQ ID NO: 5866107 - DNA, 13 bp, Homo sapiens
ccactcaggaggc

SEQ ID NO: 5866108 - DNA, 20 bp, Homo sapiens
ccactcaggaggctgaggca

SEQ ID NO: 5866109 - DNA, 20 bp, Homo sapiens
ccactcaggcagcctgtggg

SEQ ID NO: 5866110 - DNA, 11 bp, Homo sapiens
ccactcaggcc

SEQ ID NO: 5866111 - DNA, 12 bp, Homo sapiens
ccactcaggcca

SEQ ID NO: 5866112 - DNA, 15 bp, Homo sapiens
ccactcagggctggc

SEQ ID NO: 5866113 - DNA, 17 bp, Homo sapiens
ccactcagggctggccc

SEQ ID NO: 5866114 - DNA, 22 bp, Homo sapiens
ccactcagggctggcccgggga

SEQ ID NO: 5866115 - DNA, 17 bp, Homo sapiens
ccactcagggcttctcc

SEQ ID NO: 5866116 - DNA, 11 bp, Homo sapiens
ccactcaggtc

SEQ ID NO: 5866117 - DNA, 21 bp, Homo sapiens
ccactcagtaggtctgaaggc

SEQ ID NO: 5866118 - DNA, 15 bp, Homo sapiens
ccactcatactcaga

SEQ ID NO: 5866119 - DNA, 18 bp, Homo sapiens
ccactcatgactgcatga

SEQ ID NO: 5866120 - DNA, 16 bp, Homo sapiens
ccactccaagccagca

SEQ ID NO: 5866121 - DNA, 16 bp, Homo sapiens
ccactccaagccccct

SEQ ID NO: 5866122 - DNA, 20 bp, Homo sapiens
ccactccaagccccctggca

SEQ ID NO: 5866123 - DNA, 22 bp, Homo sapiens
ccactccaagtgccccaccact

SEQ ID NO: 5866124 - DNA, 17 bp, Homo sapiens
ccactccagacccctgg

SEQ ID NO: 5866125 - DNA, 21 bp, Homo sapiens
ccactccagacccctggcttt

SEQ ID NO: 5866126 - DNA, 22 bp, Homo sapiens
ccactccagacccctggctttt

SEQ ID NO: 5866127 - DNA, 14 bp, Homo sapiens
ccactccagcccgc

SEQ ID NO: 5866128 - DNA, 13 bp, Homo sapiens
ccactccagccct

SEQ ID NO: 5866129 - DNA, 15 bp, Homo sapiens
ccactccagccctgt

SEQ ID NO: 5866130 - DNA, 16 bp, Homo sapiens
ccactccagccctgtc

SEQ ID NO: 5866131 - DNA, 18 bp, Homo sapiens
ccactccagcctggggac

SEQ ID NO: 5866132 - DNA, 17 bp, Homo sapiens
ccactccagtcctgcca

SEQ ID NO: 5866133 - DNA, 18 bp, Homo sapiens
ccactccagtcctgccac

SEQ ID NO: 5866134 - DNA, 21 bp, Homo sapiens
ccactccagtcctgccaccac

SEQ ID NO: 5866135 - DNA, 17 bp, Homo sapiens
ccactccatctggtaga

SEQ ID NO: 5866136 - DNA, 14 bp, Homo sapiens
ccactccattccca

SEQ ID NO: 5866137 - DNA, 13 bp, Homo sapiens
ccactcccaagcc

SEQ ID NO: 5866138 - DNA, 23 bp, Homo sapiens
ccactcccacttccctgacactg

SEQ ID NO: 5866139 - DNA, 22 bp, Homo sapiens
ccactcccagcatcgcactctg

SEQ ID NO: 5866140 - DNA, 14 bp, Homo sapiens
ccactcccaggcag

SEQ ID NO: 5866141 - DNA, 22 bp, Homo sapiens
ccactcccaggggcctttgcag

SEQ ID NO: 5866142 - DNA, 14 bp, Homo sapiens
ccactcccagtgct

SEQ ID NO: 5866143 - DNA, 15 bp, Homo sapiens
ccactcccatctcct

SEQ ID NO: 5866144 - DNA, 19 bp, Homo sapiens
ccactcccatctgatttac

SEQ ID NO: 5866145 - DNA, 19 bp, Homo sapiens
ccactcccatggctctggg

SEQ ID NO: 5866146 - DNA, 20 bp, Homo sapiens
ccactcccatggctctgggc

SEQ ID NO: 5866147 - DNA, 14 bp, Homo sapiens
ccactccccaaccc

SEQ ID NO: 5866148 - DNA, 16 bp, Homo sapiens
ccactccccaacccct

SEQ ID NO: 5866149 - DNA, 16 bp, Homo sapiens
ccactccccaccttca

SEQ ID NO: 5866150 - DNA, 17 bp, Homo sapiens
ccactcccccacctgac

SEQ ID NO: 5866151 - DNA, 15 bp, Homo sapiens
ccactcccccaggag

SEQ ID NO: 5866152 - DNA, 17 bp, Homo sapiens
ccactcccccaggagca

SEQ ID NO: 5866153 - DNA, 19 bp, Homo sapiens
ccactcccccaggagcagc

SEQ ID NO: 5866154 - DNA, 20 bp, Homo sapiens
ccactcccccaggagcagct

SEQ ID NO: 5866155 - DNA, 15 bp, Homo sapiens
ccactgtgcctttgc

SEQ ID NO: 5866156 - DNA, 22 bp, Homo sapiens
ccactgtgcctttgcaaatcag

SEQ ID NO: 5866157 - DNA, 20 bp, Homo sapiens
ccactgtgctccagcctggg

SEQ ID NO: 5866158 - DNA, 17 bp, Homo sapiens
ccactgtgctgaattct

SEQ ID NO: 5866159 - DNA, 13 bp, Homo sapiens
ccactgtgcttgg

SEQ ID NO: 5866160 - DNA, 15 bp, Homo sapiens
ccactgtgctttcag

SEQ ID NO: 5866161 - DNA, 18 bp, Homo sapiens
ccactgtggaagtccctc

SEQ ID NO: 5866162 - DNA, 18 bp, Homo sapiens
ccactgtggcaaatggag

SEQ ID NO: 5866163 - DNA, 12 bp, Homo sapiens
ccactgtggcca

SEQ ID NO: 5866164 - DNA, 16 bp, Homo sapiens
ccactgtggccccaag

SEQ ID NO: 5866165 - DNA, 21 bp, Homo sapiens
ccactgtggcgttctgctgcc

SEQ ID NO: 5866166 - DNA, 13 bp, Homo sapiens
ccactgtggggca

SEQ ID NO: 5866167 - DNA, 17 bp, Homo sapiens
ccactgtggggcaagcc

SEQ ID NO: 5866168 - DNA, 12 bp, Homo sapiens
ccactgtgggtg

SEQ ID NO: 5866169 - DNA, 22 bp, Homo sapiens
ccactgtgtactggagcctgca

SEQ ID NO: 5866170 - DNA, 17 bp, Homo sapiens
ccactgtgtcccagtgt

SEQ ID NO: 5866171 - DNA, 19 bp, Homo sapiens
ccactgtgtcccagtgtct

SEQ ID NO: 5866172 - DNA, 11 bp, Homo sapiens
ccactgtgtct

SEQ ID NO: 5866173 - DNA, 16 bp, Homo sapiens
ccactgtgtgccttct

SEQ ID NO: 5866174 - DNA, 17 bp, Homo sapiens
ccactgtgtgccttctg

SEQ ID NO: 5866175 - DNA, 17 bp, Homo sapiens
ccactgtgtgttgacac

SEQ ID NO: 5866176 - DNA, 16 bp, Homo sapiens
ccactgtgttccttcc

SEQ ID NO: 5866177 - DNA, 19 bp, Homo sapiens
ccactgttaaaataaagct

SEQ ID NO: 5866178 - DNA, 17 bp, Homo sapiens
ccactgttgagccccag

SEQ ID NO: 5866179 - DNA, 14 bp, Homo sapiens
ccactgtttattca

SEQ ID NO: 5866180 - DNA, 18 bp, Homo sapiens
ccactgtttcatgagccc

SEQ ID NO: 5866181 - DNA, 20 bp, Homo sapiens
ccactgtttcatgagcccaa

SEQ ID NO: 5866182 - DNA, 17 bp, Homo sapiens
ccactgtttctcttgag

SEQ ID NO: 5866183 - DNA, 18 bp, Homo sapiens
ccactgtttcttgcttgt

SEQ ID NO: 5866184 - DNA, 17 bp, Homo sapiens
ccactgttttaaaagat

SEQ ID NO: 5866185 - DNA, 21 bp, Homo sapiens
ccactgttttgttggcccaca

SEQ ID NO: 5866186 - DNA, 11 bp, Homo sapiens
ccacttaatct

SEQ ID NO: 5866187 - DNA, 12 bp, Homo sapiens
ccacttaatctt

SEQ ID NO: 5866188 - DNA, 14 bp, Homo sapiens
ccacttaatcttct

SEQ ID NO: 5866189 - DNA, 15 bp, Homo sapiens
ccacttaatgtatgt

SEQ ID NO: 5866190 - DNA, 21 bp, Homo sapiens
ccacttagaaattgcatttcc

SEQ ID NO: 5866191 - DNA, 16 bp, Homo sapiens
ccacttagaagatgtt

SEQ ID NO: 5866192 - DNA, 21 bp, Homo sapiens
ccacttagcagggacaggaga

SEQ ID NO: 5866193 - DNA, 15 bp, Homo sapiens
ccacttagccgtcca

SEQ ID NO: 5866194 - DNA, 20 bp, Homo sapiens
ccacttagccgtccatggca

SEQ ID NO: 5866195 - DNA, 21 bp, Homo sapiens
ccacttagccgtccatggcac

SEQ ID NO: 5866196 - DNA, 20 bp, Homo sapiens
ccacttagcctttcttttct

SEQ ID NO: 5866197 - DNA, 14 bp, Homo sapiens
ccacttagttaaaa

SEQ ID NO: 5866198 - DNA, 21 bp, Homo sapiens
ccacttagttaaaattgattt

SEQ ID NO: 5866199 - DNA, 22 bp, Homo sapiens
ccacttagttttgggaggggat

SEQ ID NO: 5866200 - DNA, 16 bp, Homo sapiens
ccacttatagcctctg

SEQ ID NO: 5866201 - DNA, 16 bp, Homo sapiens
ccacttatgctgctgt

SEQ ID NO: 5866202 - DNA, 18 bp, Homo sapiens
ccacttatgctgctgtga

SEQ ID NO: 5866203 - DNA, 14 bp, Homo sapiens
ccacttatttctaa

SEQ ID NO: 5866204 - DNA, 15 bp, Homo sapiens
ccacttatttctaaa

SEQ ID NO: 5866205 - DNA, 15 bp, Homo sapiens
ccacttcaaaacaaa

SEQ ID NO: 5866206 - DNA, 13 bp, Homo sapiens
ccacttcaataga

SEQ ID NO: 5866207 - DNA, 20 bp, Homo sapiens
ccacttcaatgcacatggtg

SEQ ID NO: 5866208 - DNA, 24 bp, Homo sapiens
ccacttcacccccaacttcaccac

SEQ ID NO: 5866209 - DNA, 12 bp, Homo sapiens
ccacttcactgt

SEQ ID NO: 5866210 - DNA, 16 bp, Homo sapiens
ccacttcactttcttc

SEQ ID NO: 5866211 - DNA, 14 bp, Homo sapiens
ccacttcagcccag

SEQ ID NO: 5866212 - DNA, 14 bp, Homo sapiens
ccacttcagcctcc

SEQ ID NO: 5866213 - DNA, 15 bp, Homo sapiens
ccacttcaggagccc

SEQ ID NO: 5866214 - DNA, 15 bp, Homo sapiens
ccacttcattccagc

SEQ ID NO: 5866215 - DNA, 16 bp, Homo sapiens
ccacttcattccagca

SEQ ID NO: 5866216 - DNA, 19 bp, Homo sapiens
ccacttcattccagcagct

SEQ ID NO: 5866217 - DNA, 23 bp, Homo sapiens
ccacttcattccagcagctgcac

SEQ ID NO: 5866218 - DNA, 18 bp, Homo sapiens
ccacttcatttttccctt

SEQ ID NO: 5866219 - DNA, 20 bp, Homo sapiens
ccacttccaggagcccagag

SEQ ID NO: 5866220 - DNA, 21 bp, Homo sapiens
ccacttccaggggaacctgcc

SEQ ID NO: 5866221 - DNA, 15 bp, Homo sapiens
ccacttcccaccctg

SEQ ID NO: 5866222 - DNA, 23 bp, Homo sapiens
ccacttcccaggtaagcaggagg

SEQ ID NO: 5866223 - DNA, 14 bp, Homo sapiens
ccacttcccatctc

SEQ ID NO: 5866224 - DNA, 20 bp, Homo sapiens
ccacttcccatctccaggga

SEQ ID NO: 5866225 - DNA, 18 bp, Homo sapiens
ccacttcccgtctcagaa

SEQ ID NO: 5866226 - DNA, 15 bp, Homo sapiens
ccacttccctgacac

SEQ ID NO: 5866227 - DNA, 16 bp, Homo sapiens
ccacttccctgcaagg

SEQ ID NO: 5866228 - DNA, 13 bp, Homo sapiens
ccacttccctggg

SEQ ID NO: 5866229 - DNA, 12 bp, Homo sapiens
ccacttcctcct

SEQ ID NO: 5866230 - DNA, 14 bp, Homo sapiens
ccacttcctcctac

SEQ ID NO: 5866231 - DNA, 19 bp, Homo sapiens
ccacttcctcctacctggg

SEQ ID NO: 5866232 - DNA, 17 bp, Homo sapiens
ccacttcctgaggcctc

SEQ ID NO: 5866233 - DNA, 16 bp, Homo sapiens
ccacttcctgctacag

SEQ ID NO: 5866234 - DNA, 17 bp, Homo sapiens
ccacttcctgctacagg

SEQ ID NO: 5866235 - DNA, 19 bp, Homo sapiens
ccacttcctgctacaggag

SEQ ID NO: 5866236 - DNA, 20 bp, Homo sapiens
ccacttcctgctacaggagg

SEQ ID NO: 5866237 - DNA, 15 bp, Homo sapiens
ccacttcctttccta

SEQ ID NO: 5866238 - DNA, 15 bp, Homo sapiens
ccacttcctttgtgt

SEQ ID NO: 5866239 - DNA, 16 bp, Homo sapiens
ccacttcgcacacacc

SEQ ID NO: 5866240 - DNA, 16 bp, Homo sapiens
ccacttctaactccac

SEQ ID NO: 5866241 - DNA, 18 bp, Homo sapiens
ccacttctcatcacacac

SEQ ID NO: 5866242 - DNA, 13 bp, Homo sapiens
ccacttctgcact

SEQ ID NO: 5866243 - DNA, 14 bp, Homo sapiens
ccacttctgccaga

SEQ ID NO: 5866244 - DNA, 15 bp, Homo sapiens
ccacttctgcgggct

SEQ ID NO: 5866245 - DNA, 21 bp, Homo sapiens
ccacttctgcgggctccctcc

SEQ ID NO: 5866246 - DNA, 19 bp, Homo sapiens
ccacttctggcatgggaca

SEQ ID NO: 5866247 - DNA, 14 bp, Homo sapiens
ccacttctggccac

SEQ ID NO: 5866248 - DNA, 13 bp, Homo sapiens
ccacttctggcct

SEQ ID NO: 5866249 - DNA, 15 bp, Homo sapiens
ccacttctggcctcc

SEQ ID NO: 5866250 - DNA, 16 bp, Homo sapiens
ccacttctggcctcca

SEQ ID NO: 5866251 - DNA, 19 bp, Homo sapiens
ccacttctggcctccagcc

SEQ ID NO: 5866252 - DNA, 21 bp, Homo sapiens
ccacttctggcctccagcctt

SEQ ID NO: 5866253 - DNA, 12 bp, Homo sapiens
ccacttctggct

SEQ ID NO: 5866254 - DNA, 19 bp, Homo sapiens
ccacttctggcttcagccc

SEQ ID NO: 5866255 - DNA, 22 bp, Homo sapiens
ccacttctggcttcagccccca

SEQ ID NO: 5866256 - DNA, 12 bp, Homo sapiens
ccacttctgggt

SEQ ID NO: 5866257 - DNA, 19 bp, Homo sapiens
ccacttctggtcccctgtg

SEQ ID NO: 5866258 - DNA, 23 bp, Homo sapiens
ccacttctggtcccctgtggtga

SEQ ID NO: 5866259 - DNA, 17 bp, Homo sapiens
ccacttctgtccatatt

SEQ ID NO: 5866260 - DNA, 14 bp, Homo sapiens
ccacttctgtgggc

SEQ ID NO: 5866261 - DNA, 13 bp, Homo sapiens
ccacttctgtgta

SEQ ID NO: 5866262 - DNA, 18 bp, Homo sapiens
ccacttctgtgtagacat

SEQ ID NO: 5866263 - DNA, 18 bp, Homo sapiens
ccacttcttaaaggcctg

SEQ ID NO: 5866264 - DNA, 20 bp, Homo sapiens
ccacttcttaaaggcctgga

SEQ ID NO: 5866265 - DNA, 23 bp, Homo sapiens
ccacttcttaaaggcctggaacc

SEQ ID NO: 5866266 - DNA, 21 bp, Homo sapiens
ccacttcttaatgctttcctc

SEQ ID NO: 5866267 - DNA, 15 bp, Homo sapiens
ccacttcttcctttc

SEQ ID NO: 5866268 - DNA, 23 bp, Homo sapiens
ccacttcttcctttctctttctc

SEQ ID NO: 5866269 - DNA, 18 bp, Homo sapiens
ccacttcttggttcctgg

SEQ ID NO: 5866270 - DNA, 20 bp, Homo sapiens
ccacttcttgttccccactg

SEQ ID NO: 5866271 - DNA, 23 bp, Homo sapiens
ccacttgacactattcactaaaa

SEQ ID NO: 5866272 - DNA, 14 bp, Homo sapiens
ccacttgacattcc

SEQ ID NO: 5866273 - DNA, 19 bp, Homo sapiens
ccacttgactggcacacac

SEQ ID NO: 5866274 - DNA, 19 bp, Homo sapiens
ccacttgaggcctgatctg

SEQ ID NO: 5866275 - DNA, 18 bp, Homo sapiens
ccacttgcaacttctttc

SEQ ID NO: 5866276 - DNA, 14 bp, Homo sapiens
ccacttgccagggc

SEQ ID NO: 5866277 - DNA, 20 bp, Homo sapiens
ccacttgccagggctctggg

SEQ ID NO: 5866278 - DNA, 22 bp, Homo sapiens
ccacttgccagggctctggggg

SEQ ID NO: 5866279 - DNA, 13 bp, Homo sapiens
ccacttgccctgt

SEQ ID NO: 5866280 - DNA, 22 bp, Homo sapiens
ccacttgcctcttccttgaaga

SEQ ID NO: 5866281 - DNA, 13 bp, Homo sapiens
ccacttgcctggg

SEQ ID NO: 5866282 - DNA, 19 bp, Homo sapiens
ccacttgcctgtcacccca

SEQ ID NO: 5866283 - DNA, 16 bp, Homo sapiens
ccacttgcctttttct

SEQ ID NO: 5866284 - DNA, 18 bp, Homo sapiens
ccacttggcatcagctgg

SEQ ID NO: 5866285 - DNA, 17 bp, Homo sapiens
ccacttggccaagcagg

SEQ ID NO: 5866286 - DNA, 13 bp, Homo sapiens
ccacttggcccag

SEQ ID NO: 5866287 - DNA, 15 bp, Homo sapiens
ccacttggcccagaa

SEQ ID NO: 5866288 - DNA, 15 bp, Homo sapiens
ccacttggctgctca

SEQ ID NO: 5866289 - DNA, 12 bp, Homo sapiens
ccacttggtctg

SEQ ID NO: 5866290 - DNA, 15 bp, Homo sapiens
ccacttggtctgtga

SEQ ID NO: 5866291 - DNA, 22 bp, Homo sapiens
ccacttggtctgtgagatgcta

SEQ ID NO: 5866292 - DNA, 12 bp, Homo sapiens
ccacttgtagat

SEQ ID NO: 5866293 - DNA, 18 bp, Homo sapiens
ccacttgtagatttgatt

SEQ ID NO: 5866294 - DNA, 20 bp, Homo sapiens
ccacttgtagatttgatttt

SEQ ID NO: 5866295 - DNA, 20 bp, Homo sapiens
ccacttgtcaaagaaggtgc

SEQ ID NO: 5866296 - DNA, 14 bp, Homo sapiens
ccacttgtcatcca

SEQ ID NO: 5866297 - DNA, 15 bp, Homo sapiens
ccacttgtcatccat

SEQ ID NO: 5866298 - DNA, 18 bp, Homo sapiens
ccacttgtccattgcgtt

SEQ ID NO: 5866299 - DNA, 20 bp, Homo sapiens
ccacttgtcccactatctgg

SEQ ID NO: 5866300 - DNA, 21 bp, Homo sapiens
ccacttgtccttagcctggac

SEQ ID NO: 5866301 - DNA, 22 bp, Homo sapiens
ccacttgtccttagcctggacc

SEQ ID NO: 5866302 - DNA, 12 bp, Homo sapiens
ccacttgtgggc

SEQ ID NO: 5866303 - DNA, 21 bp, Homo sapiens
ccacttgtgggcttcaggtgt

SEQ ID NO: 5866304 - DNA, 13 bp, Homo sapiens
ccacttgtgggtc

SEQ ID NO: 5866305 - DNA, 16 bp, Homo sapiens
ccacttgttcattctg

SEQ ID NO: 5866306 - DNA, 14 bp, Homo sapiens
ccacttgtttgcac

SEQ ID NO: 5866307 - DNA, 16 bp, Homo sapiens
ccacttgtttgcactg

SEQ ID NO: 5866308 - DNA, 17 bp, Homo sapiens
ccactttaagagagaaa

SEQ ID NO: 5866309 - DNA, 18 bp, Homo sapiens
ccactttattgcaatgca

SEQ ID NO: 5866310 - DNA, 20 bp, Homo sapiens
ccactttcaagctgcactga

SEQ ID NO: 5866311 - DNA, 24 bp, Homo sapiens
ccactttcaatcttcaatccttga

SEQ ID NO: 5866312 - DNA, 13 bp, Homo sapiens
ccactttcagctg

SEQ ID NO: 5866313 - DNA, 16 bp, Homo sapiens
ccactttcagctgtct

SEQ ID NO: 5866314 - DNA, 14 bp, Homo sapiens
ccactttcccacac

SEQ ID NO: 5866315 - DNA, 13 bp, Homo sapiens
ccactttcctctc

SEQ ID NO: 5866316 - DNA, 15 bp, Homo sapiens
ccactttcctctctc

SEQ ID NO: 5866317 - DNA, 16 bp, Homo sapiens
ccactttcctctctct

SEQ ID NO: 5866318 - DNA, 23 bp, Homo sapiens
ccactttcctgagctgtcgctgc

SEQ ID NO: 5866319 - DNA, 16 bp, Homo sapiens
ccactttcgcctcctc

SEQ ID NO: 5866320 - DNA, 17 bp, Homo sapiens
ccactttcgcctcctcc

SEQ ID NO: 5866321 - DNA, 19 bp, Homo sapiens
ccactttcgcctcctccag

SEQ ID NO: 5866322 - DNA, 21 bp, Homo sapiens
ccactttcgcctcctccagct

SEQ ID NO: 5866323 - DNA, 20 bp, Homo sapiens
ccactttctagccagaggag

SEQ ID NO: 5866324 - DNA, 20 bp, Homo sapiens
ccactttcttctaccagacc

SEQ ID NO: 5866325 - DNA, 15 bp, Homo sapiens
ccactttgcacattt

SEQ ID NO: 5866326 - DNA, 15 bp, Homo sapiens
ccactttgcagacct

SEQ ID NO: 5866327 - DNA, 21 bp, Homo sapiens
ccactttgcatatgagccgtg

SEQ ID NO: 5866328 - DNA, 16 bp, Homo sapiens
ccactttgccttccag

SEQ ID NO: 5866329 - DNA, 15 bp, Homo sapiens
ccactttgctggttc

SEQ ID NO: 5866330 - DNA, 16 bp, Homo sapiens
ccactttgctgttcct

SEQ ID NO: 5866331 - DNA, 14 bp, Homo sapiens
ccactttggagact

SEQ ID NO: 5866332 - DNA, 17 bp, Homo sapiens
ccactttggctgaacta

SEQ ID NO: 5866333 - DNA, 22 bp, Homo sapiens
ccactttggcttctcctgtgac

SEQ ID NO: 5866334 - DNA, 20 bp, Homo sapiens
ccagactggctgcacagccc

SEQ ID NO: 5866335 - DNA, 18 bp, Homo sapiens
ccagactgggcccaggca

SEQ ID NO: 5866336 - DNA, 22 bp, Homo sapiens
ccagactgtagagatttttatg

SEQ ID NO: 5866337 - DNA, 21 bp, Homo sapiens
ccagactgtccagggaaacag

SEQ ID NO: 5866338 - DNA, 12 bp, Homo sapiens
ccagactgtgga

SEQ ID NO: 5866339 - DNA, 13 bp, Homo sapiens
ccagactgtgtat

SEQ ID NO: 5866340 - DNA, 14 bp, Homo sapiens
ccagacttcaagat

SEQ ID NO: 5866341 - DNA, 17 bp, Homo sapiens
ccagacttcaagatcct

SEQ ID NO: 5866342 - DNA, 23 bp, Homo sapiens
ccagacttcccacggctcctcga

SEQ ID NO: 5866343 - DNA, 17 bp, Homo sapiens
ccagacttctaaaataa

SEQ ID NO: 5866344 - DNA, 14 bp, Homo sapiens
ccagacttgcactg

SEQ ID NO: 5866345 - DNA, 16 bp, Homo sapiens
ccagacttgcactggg

SEQ ID NO: 5866346 - DNA, 16 bp, Homo sapiens
ccagacttggcctcca

SEQ ID NO: 5866347 - DNA, 22 bp, Homo sapiens
ccagacttgttggcgtaggcta

SEQ ID NO: 5866348 - DNA, 16 bp, Homo sapiens
ccagacttgtttcctg

SEQ ID NO: 5866349 - DNA, 20 bp, Homo sapiens
ccagactttacatgacacag

SEQ ID NO: 5866350 - DNA, 19 bp, Homo sapiens
ccagactttagtgccctgc

SEQ ID NO: 5866351 - DNA, 22 bp, Homo sapiens
ccagactttagtgccctgcccc

SEQ ID NO: 5866352 - DNA, 15 bp, Homo sapiens
ccagactttctatta

SEQ ID NO: 5866353 - DNA, 14 bp, Homo sapiens
ccagacttttctct

SEQ ID NO: 5866354 - DNA, 13 bp, Homo sapiens
ccagacttttgct

SEQ ID NO: 5866355 - DNA, 21 bp, Homo sapiens
ccagacttttgcttacctttt

SEQ ID NO: 5866356 - DNA, 21 bp, Homo sapiens
ccagagaaactaacttggtgg

SEQ ID NO: 5866357 - DNA, 20 bp, Homo sapiens
ccagagaaaggggagcccac

SEQ ID NO: 5866358 - DNA, 21 bp, Homo sapiens
ccagagaaagttggtgctgct

SEQ ID NO: 5866359 - DNA, 23 bp, Homo sapiens
ccagagaaatgaaagtcagttta

SEQ ID NO: 5866360 - DNA, 16 bp, Homo sapiens
ccagagaacaatcact

SEQ ID NO: 5866361 - DNA, 12 bp, Homo sapiens
ccagagaacaca

SEQ ID NO: 5866362 - DNA, 12 bp, Homo sapiens
ccagagaacagc

SEQ ID NO: 5866363 - DNA, 18 bp, Homo sapiens
ccagagaacagctcccct

SEQ ID NO: 5866364 - DNA, 18 bp, Homo sapiens
ccagagaacattggaaga

SEQ ID NO: 5866365 - DNA, 19 bp, Homo sapiens
ccagagaacctgtgggctg

SEQ ID NO: 5866366 - DNA, 15 bp, Homo sapiens
ccagagaactgcaga

SEQ ID NO: 5866367 - DNA, 18 bp, Homo sapiens
ccagagaactgcagacct

SEQ ID NO: 5866368 - DNA, 23 bp, Homo sapiens
ccagagaagcatcggagggaatt

SEQ ID NO: 5866369 - DNA, 18 bp, Homo sapiens
ccagagaagccccttccc

SEQ ID NO: 5866370 - DNA, 20 bp, Homo sapiens
ccagagaagccccttcccca

SEQ ID NO: 5866371 - DNA, 20 bp, Homo sapiens
ccagagaaggacggtgccaa

SEQ ID NO: 5866372 - DNA, 22 bp, Homo sapiens
ccagagaaggacggtgccaagg

SEQ ID NO: 5866373 - DNA, 23 bp, Homo sapiens
ccagagaagtctggtcagagcca

SEQ ID NO: 5866374 - DNA, 17 bp, Homo sapiens
ccagagaagtgacaggg

SEQ ID NO: 5866375 - DNA, 18 bp, Homo sapiens
ccagagaagtgacaggga

SEQ ID NO: 5866376 - DNA, 20 bp, Homo sapiens
ccagagaagtgacagggaag

SEQ ID NO: 5866377 - DNA, 15 bp, Homo sapiens
ccagagacaagcaga

SEQ ID NO: 5866378 - DNA, 13 bp, Homo sapiens
ccagagacaggaa

SEQ ID NO: 5866379 - DNA, 15 bp, Homo sapiens
ccagagacaggaaaa

SEQ ID NO: 5866380 - DNA, 16 bp, Homo sapiens
ccagagacaggaaaga

SEQ ID NO: 5866381 - DNA, 18 bp, Homo sapiens
ccagagacatacttgaag

SEQ ID NO: 5866382 - DNA, 22 bp, Homo sapiens
ccagagacatacttgaagggcc

SEQ ID NO: 5866383 - DNA, 13 bp, Homo sapiens
ccagagaccaaat

SEQ ID NO: 5866384 - DNA, 12 bp, Homo sapiens
ccagagacccag

SEQ ID NO: 5866385 - DNA, 13 bp, Homo sapiens
ccagagacccagc

SEQ ID NO: 5866386 - DNA, 13 bp, Homo sapiens
ccagagacccctc

SEQ ID NO: 5866387 - DNA, 16 bp, Homo sapiens
ccagagaccccttcct

SEQ ID NO: 5866388 - DNA, 18 bp, Homo sapiens
ccagagaccccttccttt

SEQ ID NO: 5866389 - DNA, 22 bp, Homo sapiens
ccagagaccccttcctttcctc

SEQ ID NO: 5866390 - DNA, 18 bp, Homo sapiens
ccagagacctgaggcaga

SEQ ID NO: 5866391 - DNA, 12 bp, Homo sapiens
ccagagacctgc

SEQ ID NO: 5866392 - DNA, 18 bp, Homo sapiens
ccagagacctgctccaga

SEQ ID NO: 5866393 - DNA, 22 bp, Homo sapiens
ccagagacctgctccagatcct

SEQ ID NO: 5866394 - DNA, 19 bp, Homo sapiens
ccagagacggaagcctttt

SEQ ID NO: 5866395 - DNA, 18 bp, Homo sapiens
ccagagactcgagtcccc

SEQ ID NO: 5866396 - DNA, 21 bp, Homo sapiens
ccagagactcgagtccccatg

SEQ ID NO: 5866397 - DNA, 21 bp, Homo sapiens
ccagagactgcccaccctggg

SEQ ID NO: 5866398 - DNA, 22 bp, Homo sapiens
ccagagactgcccaccctgggc

SEQ ID NO: 5866399 - DNA, 14 bp, Homo sapiens
ccagagactttagg

SEQ ID NO: 5866400 - DNA, 11 bp, Homo sapiens
ccagagagaaa

SEQ ID NO: 5866401 - DNA, 16 bp, Homo sapiens
ccagagagaaaaagag

SEQ ID NO: 5866402 - DNA, 19 bp, Homo sapiens
ccagagagaaaaagagaga

SEQ ID NO: 5866403 - DNA, 18 bp, Homo sapiens
ccagagagaagagcccca

SEQ ID NO: 5866404 - DNA, 23 bp, Homo sapiens
ccagagagaagagccccactctc

SEQ ID NO: 5866405 - DNA, 16 bp, Homo sapiens
ccagagagaccctgcc

SEQ ID NO: 5866406 - DNA, 18 bp, Homo sapiens
ccagagagagaagtgccc

SEQ ID NO: 5866407 - DNA, 22 bp, Homo sapiens
ccagagagagaagtgcccctgc

SEQ ID NO: 5866408 - DNA, 18 bp, Homo sapiens
ccagagagaggcgtcctg

SEQ ID NO: 5866409 - DNA, 21 bp, Homo sapiens
ccagagagaggcgtcctggtg

SEQ ID NO: 5866410 - DNA, 18 bp, Homo sapiens
ccagagagaggggcctgc

SEQ ID NO: 5866411 - DNA, 22 bp, Homo sapiens
ccagagagaggggcctgcaggt

SEQ ID NO: 5866412 - DNA, 16 bp, Homo sapiens
ccagagagcagctccc

SEQ ID NO: 5866413 - DNA, 12 bp, Homo sapiens
ccagagagcagg

SEQ ID NO: 5866414 - DNA, 15 bp, Homo sapiens
ccagagagcaggcag

SEQ ID NO: 5866415 - DNA, 13 bp, Homo sapiens
ccagagagcaggg

SEQ ID NO: 5866416 - DNA, 22 bp, Homo sapiens
ccagagagcaggggagcttggg

SEQ ID NO: 5866417 - DNA, 19 bp, Homo sapiens
ccagagagcccgaggaggt

SEQ ID NO: 5866418 - DNA, 12 bp, Homo sapiens
ccagagagctga

SEQ ID NO: 5866419 - DNA, 15 bp, Homo sapiens
ccagagaggagcacc

SEQ ID NO: 5866420 - DNA, 19 bp, Homo sapiens
ccagagaggagcacctgaa

SEQ ID NO: 5866421 - DNA, 20 bp, Homo sapiens
ccagagaggctcaacaagga

SEQ ID NO: 5866422 - DNA, 16 bp, Homo sapiens
ccagagagggaaaagg

SEQ ID NO: 5866423 - DNA, 21 bp, Homo sapiens
ccagagagggaaaaggcaggt

SEQ ID NO: 5866424 - DNA, 13 bp, Homo sapiens
ccagagagggaag

SEQ ID NO: 5866425 - DNA, 19 bp, Homo sapiens
ccagagagggactgacacc

SEQ ID NO: 5866426 - DNA, 14 bp, Homo sapiens
ccagagagggccca

SEQ ID NO: 5866427 - DNA, 21 bp, Homo sapiens
ccagagagggcccagctgtag

SEQ ID NO: 5866428 - DNA, 17 bp, Homo sapiens
ccagagaggggctgctc

SEQ ID NO: 5866429 - DNA, 13 bp, Homo sapiens
ccagagagggtgg

SEQ ID NO: 5866430 - DNA, 23 bp, Homo sapiens
ccagagagggtggtgacctctgc

SEQ ID NO: 5866431 - DNA, 17 bp, Homo sapiens
ccagagagtcctctgga

SEQ ID NO: 5866432 - DNA, 20 bp, Homo sapiens
ccagagagtggagagagcag

SEQ ID NO: 5866433 - DNA, 14 bp, Homo sapiens
ccagagagtggctc

SEQ ID NO: 5866434 - DNA, 16 bp, Homo sapiens
ccagagagtggctcct

SEQ ID NO: 5866435 - DNA, 22 bp, Homo sapiens
ccagagagtggctcctcccggt

SEQ ID NO: 5866436 - DNA, 13 bp, Homo sapiens
ccagagatgccag

SEQ ID NO: 5866437 - DNA, 14 bp, Homo sapiens
ccagagatgccagc

SEQ ID NO: 5866438 - DNA, 17 bp, Homo sapiens
ccagagatgccagccct

SEQ ID NO: 5866439 - DNA, 18 bp, Homo sapiens
ccagagatgccagccctt

SEQ ID NO: 5866440 - DNA, 12 bp, Homo sapiens
ccagagatgcct

SEQ ID NO: 5866441 - DNA, 22 bp, Homo sapiens
ccagagatggaggttctctcgg

SEQ ID NO: 5866442 - DNA, 16 bp, Homo sapiens
ccagagatggctcctt

SEQ ID NO: 5866443 - DNA, 21 bp, Homo sapiens
ccagagatgggactgggaggg

SEQ ID NO: 5866444 - DNA, 23 bp, Homo sapiens
ccagagatgggactgggagggcc

SEQ ID NO: 5866445 - DNA, 17 bp, Homo sapiens
ccagagattcattttct

SEQ ID NO: 5866446 - DNA, 13 bp, Homo sapiens
ccagagcaaaata

SEQ ID NO: 5866447 - DNA, 19 bp, Homo sapiens
ccagagcaacctctcactc

SEQ ID NO: 5866448 - DNA, 21 bp, Homo sapiens
ccagagcacaagaaggccagc

SEQ ID NO: 5866449 - DNA, 23 bp, Homo sapiens
ccagagcacaagaaggccagccc

SEQ ID NO: 5866450 - DNA, 23 bp, Homo sapiens
ccagagcacaagttccagctggt

SEQ ID NO: 5866451 - DNA, 13 bp, Homo sapiens
ccagagcacagga

SEQ ID NO: 5866452 - DNA, 22 bp, Homo sapiens
ccagagcacccccaagcctggg

SEQ ID NO: 5866453 - DNA, 14 bp, Homo sapiens
ccagagcaccctct

SEQ ID NO: 5866454 - DNA, 13 bp, Homo sapiens
ccagagcacctca

SEQ ID NO: 5866455 - DNA, 18 bp, Homo sapiens
ccagagcacctgctgtct

SEQ ID NO: 5866456 - DNA, 16 bp, Homo sapiens
ccagagcactgctcca

SEQ ID NO: 5866457 - DNA, 22 bp, Homo sapiens
ccagagcactgggttgcagggg

SEQ ID NO: 5866458 - DNA, 13 bp, Homo sapiens
ccagagcactgta

SEQ ID NO: 5866459 - DNA, 14 bp, Homo sapiens
ccagagcagagcct

SEQ ID NO: 5866460 - DNA, 14 bp, Homo sapiens
ccagagcagatgca

SEQ ID NO: 5866461 - DNA, 20 bp, Homo sapiens
ccagagcagatgcagagagc

SEQ ID NO: 5866462 - DNA, 22 bp, Homo sapiens
ccagagcagctccaccactgtg

SEQ ID NO: 5866463 - DNA, 15 bp, Homo sapiens
ccagagcaggaagca

SEQ ID NO: 5866464 - DNA, 15 bp, Homo sapiens
ccagagcaggagact

SEQ ID NO: 5866465 - DNA, 14 bp, Homo sapiens
ccagagcaggagcc

SEQ ID NO: 5866466 - DNA, 15 bp, Homo sapiens
ccagagcaggaggcc

SEQ ID NO: 5866467 - DNA, 19 bp, Homo sapiens
ccagagcaggaggcccctg

SEQ ID NO: 5866468 - DNA, 15 bp, Homo sapiens
ccagagcaggggctg

SEQ ID NO: 5866469 - DNA, 16 bp, Homo sapiens
ccagagcagggtctct

SEQ ID NO: 5866470 - DNA, 20 bp, Homo sapiens
ccagagcagtttcatctggt

SEQ ID NO: 5866471 - DNA, 15 bp, Homo sapiens
ccagagcatctgccc

SEQ ID NO: 5866472 - DNA, 16 bp, Homo sapiens
ccagagcatctgcccc

SEQ ID NO: 5866473 - DNA, 18 bp, Homo sapiens
ccagagcatctgccccag

SEQ ID NO: 5866474 - DNA, 20 bp, Homo sapiens
ccagagcatctgccccaggt

SEQ ID NO: 5866475 - DNA, 20 bp, Homo sapiens
ccagagcattacgtgagcca

SEQ ID NO: 5866476 - DNA, 19 bp, Homo sapiens
ccagagcattccagtcagg

SEQ ID NO: 5866477 - DNA, 23 bp, Homo sapiens
ccagagcatttccaacaccacag

SEQ ID NO: 5866478 - DNA, 17 bp, Homo sapiens
ccagagccaacctggac

SEQ ID NO: 5866479 - DNA, 19 bp, Homo sapiens
ccagagccaacctggactt

SEQ ID NO: 5866480 - DNA, 22 bp, Homo sapiens
ccagagccaacctggacttcct

SEQ ID NO: 5866481 - DNA, 15 bp, Homo sapiens
ccagagccacctgga

SEQ ID NO: 5866482 - DNA, 13 bp, Homo sapiens
ccagagccactac

SEQ ID NO: 5866483 - DNA, 20 bp, Homo sapiens
ccagagccactacctttgtc

SEQ ID NO: 5866484 - DNA, 19 bp, Homo sapiens
ccagagccagatgcaggac

SEQ ID NO: 5866485 - DNA, 13 bp, Homo sapiens
ccagagccagcct

SEQ ID NO: 5866486 - DNA, 15 bp, Homo sapiens
ccagagccagcctgg

SEQ ID NO: 5866487 - DNA, 17 bp, Homo sapiens
ccagagccagcctggga

SEQ ID NO: 5866488 - DNA, 19 bp, Homo sapiens
ccagagccagcctgggact

SEQ ID NO: 5866489 - DNA, 19 bp, Homo sapiens
ccagagccagggctgtcct

SEQ ID NO: 5866490 - DNA, 20 bp, Homo sapiens
ccagagccagggctgtcctt

SEQ ID NO: 5866491 - DNA, 15 bp, Homo sapiens
ccagagccatggact

SEQ ID NO: 5866492 - DNA, 11 bp, Homo sapiens
ccagagcccac

SEQ ID NO: 5866493 - DNA, 19 bp, Homo sapiens
ccagagcccagctcttgct

SEQ ID NO: 5866494 - DNA, 14 bp, Homo sapiens
ccagagccccaagc

SEQ ID NO: 5866495 - DNA, 14 bp, Homo sapiens
ccagagccccacac

SEQ ID NO: 5866496 - DNA, 16 bp, Homo sapiens
ccagagccccacagcc

SEQ ID NO: 5866497 - DNA, 23 bp, Homo sapiens
ccagagccccacagccccatctg

SEQ ID NO: 5866498 - DNA, 16 bp, Homo sapiens
ccagagccccccacaa

SEQ ID NO: 5866499 - DNA, 17 bp, Homo sapiens
ccagagcccttcactgc

SEQ ID NO: 5866500 - DNA, 22 bp, Homo sapiens
ccagagcccttcactgccatga

SEQ ID NO: 5866501 - DNA, 19 bp, Homo sapiens
ccagagccgcaccctggct

SEQ ID NO: 5866502 - DNA, 20 bp, Homo sapiens
ccagagccgcaccctggctg

SEQ ID NO: 5866503 - DNA, 18 bp, Homo sapiens
ccagagccggccgccttc

SEQ ID NO: 5866504 - DNA, 14 bp, Homo sapiens
ccagagccgggagg

SEQ ID NO: 5866505 - DNA, 13 bp, Homo sapiens
ccagagcctccct

SEQ ID NO: 5866506 - DNA, 16 bp, Homo sapiens
ccagagcctccctcag

SEQ ID NO: 5866507 - DNA, 19 bp, Homo sapiens
ccagagcctccctcagcca

SEQ ID NO: 5866508 - DNA, 23 bp, Homo sapiens
ccagagcctccctcagccacgcc

SEQ ID NO: 5866509 - DNA, 21 bp, Homo sapiens
ccagagcctctgctggaaggg

SEQ ID NO: 5866510 - DNA, 18 bp, Homo sapiens
ccagagcctctggcccct

SEQ ID NO: 5866511 - DNA, 19 bp, Homo sapiens
ccagagcctctggcccctc

SEQ ID NO: 5866512 - DNA, 21 bp, Homo sapiens
ccagagcctggctgcccatca

SEQ ID NO: 5866513 - DNA, 12 bp, Homo sapiens
ccagagcctggg

SEQ ID NO: 5866514 - DNA, 16 bp, Homo sapiens
ccagagcctgggcgca

SEQ ID NO: 5866515 - DNA, 15 bp, Homo sapiens
ccagagcctggggct

SEQ ID NO: 5866516 - DNA, 20 bp, Homo sapiens
ccagagcctggtagagacta

SEQ ID NO: 5866517 - DNA, 12 bp, Homo sapiens
ccagagccttca

SEQ ID NO: 5866518 - DNA, 19 bp, Homo sapiens
ccagagccttcaagtgcca

SEQ ID NO: 5866519 - DNA, 22 bp, Homo sapiens
ccagagccttcaagtgccaaac

SEQ ID NO: 5866520 - DNA, 16 bp, Homo sapiens
ccagagcgaggaaagg

SEQ ID NO: 5866521 - DNA, 21 bp, Homo sapiens
ccagagcgcccctccctagtg

SEQ ID NO: 5866522 - DNA, 22 bp, Homo sapiens
ccagagcggaggctgtgtgcct

SEQ ID NO: 5866523 - DNA, 22 bp, Homo sapiens
ccagagcggtatctctggcacc

SEQ ID NO: 5866524 - DNA, 15 bp, Homo sapiens
ccagagcgtccttgg

SEQ ID NO: 5866525 - DNA, 20 bp, Homo sapiens
ccagagctacccgcagagtt

SEQ ID NO: 5866526 - DNA, 15 bp, Homo sapiens
ccagagctagggctg

SEQ ID NO: 5866527 - DNA, 17 bp, Homo sapiens
ccagagctagggctgct

SEQ ID NO: 5866528 - DNA, 14 bp, Homo sapiens
ccagagctcatccc

SEQ ID NO: 5866529 - DNA, 17 bp, Homo sapiens
ccagagctcatcccccc

SEQ ID NO: 5866530 - DNA, 18 bp, Homo sapiens
ccagagctcatcccccct

SEQ ID NO: 5866531 - DNA, 22 bp, Homo sapiens
ccagagctcatcccccctgctg

SEQ ID NO: 5866532 - DNA, 23 bp, Homo sapiens
ccagagctcatcccccctgctgc

SEQ ID NO: 5866533 - DNA, 13 bp, Homo sapiens
ccagagctcccag

SEQ ID NO: 5866534 - DNA, 18 bp, Homo sapiens
ccagagctcccaggacgc

SEQ ID NO: 5866535 - DNA, 12 bp, Homo sapiens
ccagagctcccc

SEQ ID NO: 5866536 - DNA, 17 bp, Homo sapiens
ccagagctccgatgccc

SEQ ID NO: 5866537 - DNA, 17 bp, Homo sapiens
ccagagctctgacccac

SEQ ID NO: 5866538 - DNA, 12 bp, Homo sapiens
ccagagctctgg

SEQ ID NO: 5866539 - DNA, 22 bp, Homo sapiens
ccagagctctggagccacctgt

SEQ ID NO: 5866540 - DNA, 11 bp, Homo sapiens
ccagagctgcc

SEQ ID NO: 5866541 - DNA, 14 bp, Homo sapiens
ccagagctgccacc

SEQ ID NO: 5866542 - DNA, 12 bp, Homo sapiens
ccagagctgcct

SEQ ID NO: 5866543 - DNA, 18 bp, Homo sapiens
ccagagctgcctccccaa

SEQ ID NO: 5866544 - DNA, 23 bp, Homo sapiens
ccagagctgcctccccaatccat

SEQ ID NO: 5866545 - DNA, 13 bp, Homo sapiens
ccagagctgctgg

SEQ ID NO: 5866546 - DNA, 19 bp, Homo sapiens
ccagagctgcttctgtctg

SEQ ID NO: 5866547 - DNA, 17 bp, Homo sapiens
ccagagctggaacacaa

SEQ ID NO: 5866548 - DNA, 14 bp, Homo sapiens
ccagagctggaagg

SEQ ID NO: 5866549 - DNA, 15 bp, Homo sapiens
ccagagctggaaggc

SEQ ID NO: 5866550 - DNA, 21 bp, Homo sapiens
ccagagctggaaggcagggca

SEQ ID NO: 5866551 - DNA, 14 bp, Homo sapiens
ccagagctggcctc

SEQ ID NO: 5866552 - DNA, 21 bp, Homo sapiens
ccagagctgtcctcctggcac

SEQ ID NO: 5866553 - DNA, 19 bp, Homo sapiens
ccagagctgtgccagcagg

SEQ ID NO: 5866554 - DNA, 18 bp, Homo sapiens
ccagagctgtgcctgctc

SEQ ID NO: 5866555 - DNA, 22 bp, Homo sapiens
ccagagctgtgcctgctcagca

SEQ ID NO: 5866556 - DNA, 19 bp, Homo sapiens
ccagagctgtttatggcct

SEQ ID NO: 5866557 - DNA, 22 bp, Homo sapiens
ccagagctgtttatggcctcag

SEQ ID NO: 5866558 - DNA, 23 bp, Homo sapiens
ccagagctgtttatggcctcagc

SEQ ID NO: 5866559 - DNA, 15 bp, Homo sapiens
ccagagctgtttgga

SEQ ID NO: 5866560 - DNA, 20 bp, Homo sapiens
ccagagcttattggccactg

SEQ ID NO: 5866561 - DNA, 19 bp, Homo sapiens
ccagagcttgttgtctcca

SEQ ID NO: 5866562 - DNA, 19 bp, Homo sapiens
ccagagctttgttttatat

SEQ ID NO: 5866563 - DNA, 14 bp, Homo sapiens
ccagagcttttcag

SEQ ID NO: 5866564 - DNA, 20 bp, Homo sapiens
ccagaggaaccagcactcca

SEQ ID NO: 5866565 - DNA, 21 bp, Homo sapiens
ccagaggaactgtccagagag

SEQ ID NO: 5866566 - DNA, 20 bp, Homo sapiens
ccagaggaagggaggcctga

SEQ ID NO: 5866567 - DNA, 21 bp, Homo sapiens
ccagaggaagggaggcctgag

SEQ ID NO: 5866568 - DNA, 22 bp, Homo sapiens
ccagaggaagggaggcctgagg

SEQ ID NO: 5866569 - DNA, 17 bp, Homo sapiens
ccagaggaatcctggca

SEQ ID NO: 5866570 - DNA, 19 bp, Homo sapiens
ccagaggaatcctggcagc

SEQ ID NO: 5866571 - DNA, 17 bp, Homo sapiens
ccagaggaatgatgggc

SEQ ID NO: 5866572 - DNA, 22 bp, Homo sapiens
ccagaggaatgatgggcttttg

SEQ ID NO: 5866573 - DNA, 21 bp, Homo sapiens
ccagaggaattgattgtcagc

SEQ ID NO: 5866574 - DNA, 15 bp, Homo sapiens
ccagaggacaaggaa

SEQ ID NO: 5866575 - DNA, 18 bp, Homo sapiens
ccagaggacagctctggg

SEQ ID NO: 5866576 - DNA, 12 bp, Homo sapiens
ccagaggaccaa

SEQ ID NO: 5866577 - DNA, 15 bp, Homo sapiens
ccagaggaccaatgc

SEQ ID NO: 5866578 - DNA, 20 bp, Homo sapiens
ccagaggaccaatgcttgca

SEQ ID NO: 5866579 - DNA, 23 bp, Homo sapiens
ccagaggaccaatgcttgcatgg

SEQ ID NO: 5866580 - DNA, 20 bp, Homo sapiens
ccagaggactgtgatgccct

SEQ ID NO: 5866581 - DNA, 19 bp, Homo sapiens
ccagaggagaggagacaga

SEQ ID NO: 5866582 - DNA, 21 bp, Homo sapiens
ccagaggagaggagacagaca

SEQ ID NO: 5866583 - DNA, 13 bp, Homo sapiens
ccagaggagcaga

SEQ ID NO: 5866584 - DNA, 19 bp, Homo sapiens
ccagaggagccaccagttc

SEQ ID NO: 5866585 - DNA, 19 bp, Homo sapiens
ccagaggagggcagaggga

SEQ ID NO: 5866586 - DNA, 23 bp, Homo sapiens
ccagaggaggggtggtgtccttc

SEQ ID NO: 5866587 - DNA, 17 bp, Homo sapiens
ccagaggaggtgcccgg

SEQ ID NO: 5866588 - DNA, 13 bp, Homo sapiens
ccagaggcacagc

SEQ ID NO: 5866589 - DNA, 14 bp, Homo sapiens
ccagaggcacagcc

SEQ ID NO: 5866590 - DNA, 12 bp, Homo sapiens
ccagaggcagag

SEQ ID NO: 5866591 - DNA, 12 bp, Homo sapiens
ccagaggcagcc

SEQ ID NO: 5866592 - DNA, 15 bp, Homo sapiens
ccagaggccaaggag

SEQ ID NO: 5866593 - DNA, 19 bp, Homo sapiens
ccagaggccaaggaggcct

SEQ ID NO: 5866594 - DNA, 16 bp, Homo sapiens
ccagaggccaggatgc

SEQ ID NO: 5866595 - DNA, 18 bp, Homo sapiens
ccagaggcccccagccca

SEQ ID NO: 5866596 - DNA, 19 bp, Homo sapiens
ccagaggccctgaagcctc

SEQ ID NO: 5866597 - DNA, 16 bp, Homo sapiens
ccagaggccctggagg

SEQ ID NO: 5866598 - DNA, 22 bp, Homo sapiens
ccagaggccctggagggaagga

SEQ ID NO: 5866599 - DNA, 23 bp, Homo sapiens
ccagaggccctggaggtctccag

SEQ ID NO: 5866600 - DNA, 20 bp, Homo sapiens
ccagaggccgaaggtgcctc

SEQ ID NO: 5866601 - DNA, 22 bp, Homo sapiens
ccagaggccgaaggtgcctcag

SEQ ID NO: 5866602 - DNA, 17 bp, Homo sapiens
ccagaggccgctgcccc

SEQ ID NO: 5866603 - DNA, 18 bp, Homo sapiens
ccagaggccgctgcccct

SEQ ID NO: 5866604 - DNA, 19 bp, Homo sapiens
ccagaggccgctgcccctg

SEQ ID NO: 5866605 - DNA, 21 bp, Homo sapiens
ccagaggccgctgcccctgag

SEQ ID NO: 5866606 - DNA, 12 bp, Homo sapiens
ccagaggcctgg

SEQ ID NO: 5866607 - DNA, 21 bp, Homo sapiens
ccagaggcctggtgccctggc

SEQ ID NO: 5866608 - DNA, 13 bp, Homo sapiens
ccagaggccttgt

SEQ ID NO: 5866609 - DNA, 21 bp, Homo sapiens
ccagaggccttgtcatcctcc

SEQ ID NO: 5866610 - DNA, 17 bp, Homo sapiens
ccagaggcgtcccgcac

SEQ ID NO: 5866611 - DNA, 10 bp, Homo sapiens
ccagaggctc

SEQ ID NO: 5866612 - DNA, 11 bp, Homo sapiens
ccagaggctcg

SEQ ID NO: 5866613 - DNA, 13 bp, Homo sapiens
ccagaggctgagt

SEQ ID NO: 5866614 - DNA, 13 bp, Homo sapiens
ccagaggctggga

SEQ ID NO: 5866615 - DNA, 15 bp, Homo sapiens
ccagagggaccagct

SEQ ID NO: 5866616 - DNA, 15 bp, Homo sapiens
ccagagggactggac

SEQ ID NO: 5866617 - DNA, 18 bp, Homo sapiens
ccagagggactggacagc

SEQ ID NO: 5866618 - DNA, 19 bp, Homo sapiens
ccagagggactggacagcc

SEQ ID NO: 5866619 - DNA, 17 bp, Homo sapiens
ccagagggagtgacaga

SEQ ID NO: 5866620 - DNA, 20 bp, Homo sapiens
ccagagggagtgacagaggc

SEQ ID NO: 5866621 - DNA, 17 bp, Homo sapiens
ccagagggcactcagaa

SEQ ID NO: 5866622 - DNA, 12 bp, Homo sapiens
ccagagggcagt

SEQ ID NO: 5866623 - DNA, 22 bp, Homo sapiens
ccagagggcagtctagtcctgg

SEQ ID NO: 5866624 - DNA, 15 bp, Homo sapiens
ccagagggccaagag

SEQ ID NO: 5866625 - DNA, 20 bp, Homo sapiens
ccagagggccaagagagaca

SEQ ID NO: 5866626 - DNA, 21 bp, Homo sapiens
ccagagggccaagagagacat

SEQ ID NO: 5866627 - DNA, 13 bp, Homo sapiens
ccagagggccagc

SEQ ID NO: 5866628 - DNA, 15 bp, Homo sapiens
ccagagggccagcag

SEQ ID NO: 5866629 - DNA, 13 bp, Homo sapiens
ccagagggcctgc

SEQ ID NO: 5866630 - DNA, 16 bp, Homo sapiens
ccagagggcctgcaag

SEQ ID NO: 5866631 - DNA, 19 bp, Homo sapiens
ccagagggcctgcaaggga

SEQ ID NO: 5866632 - DNA, 13 bp, Homo sapiens
ccagaggggaagg

SEQ ID NO: 5866633 - DNA, 22 bp, Homo sapiens
ccagaggggcctgccacctgga

SEQ ID NO: 5866634 - DNA, 18 bp, Homo sapiens
ccagaggggcggggccag

SEQ ID NO: 5866635 - DNA, 19 bp, Homo sapiens
ccagaggggcggggccagg

SEQ ID NO: 5866636 - DNA, 20 bp, Homo sapiens
ccagagggggccagagggac

SEQ ID NO: 5866637 - DNA, 23 bp, Homo sapiens
ccagaggggtgggttcctcttcc

SEQ ID NO: 5866638 - DNA, 17 bp, Homo sapiens
ccagagggtagggcaca

SEQ ID NO: 5866639 - DNA, 14 bp, Homo sapiens
ccagagggtctggg

SEQ ID NO: 5866640 - DNA, 18 bp, Homo sapiens
ccagagggtgtggctttc

SEQ ID NO: 5866641 - DNA, 21 bp, Homo sapiens
ccagagggtgtggctttccag

SEQ ID NO: 5866642 - DNA, 22 bp, Homo sapiens
ccagagggttgctggtcctgca

SEQ ID NO: 5866643 - DNA, 19 bp, Homo sapiens
ccagaggtaacagaacagc

SEQ ID NO: 5866644 - DNA, 23 bp, Homo sapiens
ccagaggtaacagaacagcttca

SEQ ID NO: 5866645 - DNA, 20 bp, Homo sapiens
ccagaggtccaggtcccagc

SEQ ID NO: 5866646 - DNA, 21 bp, Homo sapiens
ccagaggtccaggtcccagcc

SEQ ID NO: 5866647 - DNA, 23 bp, Homo sapiens
ccagaggtcctccgtagggtctt

SEQ ID NO: 5866648 - DNA, 15 bp, Homo sapiens
ccagaggtcgcagct

SEQ ID NO: 5866649 - DNA, 21 bp, Homo sapiens
ccagaggtgagggaggcctga

SEQ ID NO: 5866650 - DNA, 12 bp, Homo sapiens
ccagaggtgctt

SEQ ID NO: 5866651 - DNA, 16 bp, Homo sapiens
ccagaggtggccctcc

SEQ ID NO: 5866652 - DNA, 16 bp, Homo sapiens
ccagaggtgggaggcc

SEQ ID NO: 5866653 - DNA, 19 bp, Homo sapiens
ccagaggtgggatcctccc

SEQ ID NO: 5866654 - DNA, 22 bp, Homo sapiens
ccagaggtgggatcctccctca

SEQ ID NO: 5866655 - DNA, 16 bp, Homo sapiens
ccagaggtgggcaggt

SEQ ID NO: 5866656 - DNA, 19 bp, Homo sapiens
ccagaggtgggcaggtggt

SEQ ID NO: 5866657 - DNA, 22 bp, Homo sapiens
ccagaggtgggcaggtggtggc

SEQ ID NO: 5866658 - DNA, 23 bp, Homo sapiens
ccagaggtggggaagagagcctg

SEQ ID NO: 5866659 - DNA, 24 bp, Homo sapiens
ccagaggtggggaagagagcctgc

SEQ ID NO: 5866660 - DNA, 17 bp, Homo sapiens
ccagaggttgtgcactg

SEQ ID NO: 5866661 - DNA, 17 bp, Homo sapiens
ccagagtagccatgagg

SEQ ID NO: 5866662 - DNA, 19 bp, Homo sapiens
ccagagtcaacaaattaaa

SEQ ID NO: 5866663 - DNA, 21 bp, Homo sapiens
ccagagtcacaagtagcctct

SEQ ID NO: 5866664 - DNA, 17 bp, Homo sapiens
ccagagtcacccagttg

SEQ ID NO: 5866665 - DNA, 17 bp, Homo sapiens
ccagagtcccaggcccc

SEQ ID NO: 5866666 - DNA, 19 bp, Homo sapiens
ccagagtccccccactccc

SEQ ID NO: 5866667 - DNA, 17 bp, Homo sapiens
ccagagtccctgcctgg

SEQ ID NO: 5866668 - DNA, 19 bp, Homo sapiens
ccagagtccctgcctggac

SEQ ID NO: 5866669 - DNA, 22 bp, Homo sapiens
ccagagtccctgcctggaccag

SEQ ID NO: 5866670 - DNA, 15 bp, Homo sapiens
ccagagtctcccagt

SEQ ID NO: 5866671 - DNA, 11 bp, Homo sapiens
ccagagtctct

SEQ ID NO: 5866672 - DNA, 12 bp, Homo sapiens
ccagagtctctt

SEQ ID NO: 5866673 - DNA, 13 bp, Homo sapiens
ccagagtctgagc

SEQ ID NO: 5866674 - DNA, 14 bp, Homo sapiens
ccagagtctgagcc

SEQ ID NO: 5866675 - DNA, 23 bp, Homo sapiens
ccagagtctgagcccccggctag

SEQ ID NO: 5866676 - DNA, 13 bp, Homo sapiens
ccagagtctggag

SEQ ID NO: 5866677 - DNA, 15 bp, Homo sapiens
ccagagtctggagct

SEQ ID NO: 5866678 - DNA, 18 bp, Homo sapiens
ccagagtcttaagggtca

SEQ ID NO: 5866679 - DNA, 19 bp, Homo sapiens
ccagagtgaaagggctatg

SEQ ID NO: 5866680 - DNA, 21 bp, Homo sapiens
ccagagtgaaagggctatggc

SEQ ID NO: 5866681 - DNA, 19 bp, Homo sapiens
ccagagtgctgaggccagg

SEQ ID NO: 5866682 - DNA, 20 bp, Homo sapiens
ccagagtgctgtcgggacca

SEQ ID NO: 5866683 - DNA, 20 bp, Homo sapiens
ccagagtgctttaaaaaatt

SEQ ID NO: 5866684 - DNA, 20 bp, Homo sapiens
ccagagtggagtctgagtct

SEQ ID NO: 5866685 - DNA, 21 bp, Homo sapiens
ccagagtggagtctgagtctg

SEQ ID NO: 5866686 - DNA, 12 bp, Homo sapiens
ccagagtggcca

SEQ ID NO: 5866687 - DNA, 13 bp, Homo sapiens
ccagcaggctctc

SEQ ID NO: 5866688 - DNA, 15 bp, Homo sapiens
ccagcaggctctcag

SEQ ID NO: 5866689 - DNA, 21 bp, Homo sapiens
ccagcaggctctcaggccagc

SEQ ID NO: 5866690 - DNA, 20 bp, Homo sapiens
ccagcagggcgggccaggag

SEQ ID NO: 5866691 - DNA, 21 bp, Homo sapiens
ccagcagggggagaaaccctt

SEQ ID NO: 5866692 - DNA, 23 bp, Homo sapiens
ccagcagggggagaaacccttca

SEQ ID NO: 5866693 - DNA, 16 bp, Homo sapiens
ccagcaggggggctgt

SEQ ID NO: 5866694 - DNA, 20 bp, Homo sapiens
ccagcagggtcttttcatct

SEQ ID NO: 5866695 - DNA, 17 bp, Homo sapiens
ccagcaggtcacactgg

SEQ ID NO: 5866696 - DNA, 15 bp, Homo sapiens
ccagcaggtgctgac

SEQ ID NO: 5866697 - DNA, 15 bp, Homo sapiens
ccagcaggtggggag

SEQ ID NO: 5866698 - DNA, 15 bp, Homo sapiens
ccagcagtacaataa

SEQ ID NO: 5866699 - DNA, 13 bp, Homo sapiens
ccagcagtcacag

SEQ ID NO: 5866700 - DNA, 13 bp, Homo sapiens
ccagcagtcctgg

SEQ ID NO: 5866701 - DNA, 16 bp, Homo sapiens
ccagcagtcctgggcc

SEQ ID NO: 5866702 - DNA, 17 bp, Homo sapiens
ccagcagtctctgcctt

SEQ ID NO: 5866703 - DNA, 22 bp, Homo sapiens
ccagcagtctctgccttgcctt

SEQ ID NO: 5866704 - DNA, 20 bp, Homo sapiens
ccagcagtgaaacttgtgct

SEQ ID NO: 5866705 - DNA, 20 bp, Homo sapiens
ccagcagtgaatgctagaca

SEQ ID NO: 5866706 - DNA, 14 bp, Homo sapiens
ccagcagtgctggg

SEQ ID NO: 5866707 - DNA, 20 bp, Homo sapiens
ccagcagtgctgggcccagc

SEQ ID NO: 5866708 - DNA, 14 bp, Homo sapiens
ccagcagtggcttg

SEQ ID NO: 5866709 - DNA, 10 bp, Homo sapiens
ccagcagtgt

SEQ ID NO: 5866710 - DNA, 11 bp, Homo sapiens
ccagcagtgtt

SEQ ID NO: 5866711 - DNA, 18 bp, Homo sapiens
ccagcagtgttgctcagc

SEQ ID NO: 5866712 - DNA, 19 bp, Homo sapiens
ccagcagttcagagctgcc

SEQ ID NO: 5866713 - DNA, 15 bp, Homo sapiens
ccagcagttctgtta

SEQ ID NO: 5866714 - DNA, 16 bp, Homo sapiens
ccagcagttgtaaaat

SEQ ID NO: 5866715 - DNA, 12 bp, Homo sapiens
ccagcagtttct

SEQ ID NO: 5866716 - DNA, 14 bp, Homo sapiens
ccagcatacagttt

SEQ ID NO: 5866717 - DNA, 17 bp, Homo sapiens
ccagcatacattttctg

SEQ ID NO: 5866718 - DNA, 17 bp, Homo sapiens
ccagcatagttctgcaa

SEQ ID NO: 5866719 - DNA, 21 bp, Homo sapiens
ccagcatatatacttgcaaga

SEQ ID NO: 5866720 - DNA, 14 bp, Homo sapiens
ccagcatcaccagc

SEQ ID NO: 5866721 - DNA, 16 bp, Homo sapiens
ccagcatcacctgcct

SEQ ID NO: 5866722 - DNA, 18 bp, Homo sapiens
ccagcatcacctgcctgt

SEQ ID NO: 5866723 - DNA, 23 bp, Homo sapiens
ccagcatccaccttggctctgcc

SEQ ID NO: 5866724 - DNA, 16 bp, Homo sapiens
ccagcatccagcctgt

SEQ ID NO: 5866725 - DNA, 17 bp, Homo sapiens
ccagcatccagcctgtg

SEQ ID NO: 5866726 - DNA, 20 bp, Homo sapiens
ccagcatccatgcggccggc

SEQ ID NO: 5866727 - DNA, 14 bp, Homo sapiens
ccagcatcccagcc

SEQ ID NO: 5866728 - DNA, 16 bp, Homo sapiens
ccagcatcccagcctc

SEQ ID NO: 5866729 - DNA, 19 bp, Homo sapiens
ccagcatcccagcctcaga

SEQ ID NO: 5866730 - DNA, 23 bp, Homo sapiens
ccagcatcccagcctcagaagcc

SEQ ID NO: 5866731 - DNA, 24 bp, Homo sapiens
ccagcatcccagcctcagaagcct

SEQ ID NO: 5866732 - DNA, 23 bp, Homo sapiens
ccagcatccctggagcaggagcc

SEQ ID NO: 5866733 - DNA, 13 bp, Homo sapiens
ccagcatcctgct

SEQ ID NO: 5866734 - DNA, 14 bp, Homo sapiens
ccagcatcctgctt

SEQ ID NO: 5866735 - DNA, 19 bp, Homo sapiens
ccagcatccttttctgcag

SEQ ID NO: 5866736 - DNA, 14 bp, Homo sapiens
ccagcatcttttcc

SEQ ID NO: 5866737 - DNA, 20 bp, Homo sapiens
ccagcatcttttccatcctg

SEQ ID NO: 5866738 - DNA, 14 bp, Homo sapiens
ccagcatggatgaa

SEQ ID NO: 5866739 - DNA, 15 bp, Homo sapiens
ccagcatgggttagt

SEQ ID NO: 5866740 - DNA, 13 bp, Homo sapiens
ccagcatgtacaa

SEQ ID NO: 5866741 - DNA, 20 bp, Homo sapiens
ccagcatgtgtgtgtctcta

SEQ ID NO: 5866742 - DNA, 21 bp, Homo sapiens
ccagcatgtgtgtgtctctat

SEQ ID NO: 5866743 - DNA, 15 bp, Homo sapiens
ccagcattcagcaca

SEQ ID NO: 5866744 - DNA, 15 bp, Homo sapiens
ccagcattcatgccg

SEQ ID NO: 5866745 - DNA, 12 bp, Homo sapiens
ccagcattccag

SEQ ID NO: 5866746 - DNA, 15 bp, Homo sapiens
ccagcattccagccc

SEQ ID NO: 5866747 - DNA, 16 bp, Homo sapiens
ccagcattccagcccc

SEQ ID NO: 5866748 - DNA, 19 bp, Homo sapiens
ccagcattccagcccctct

SEQ ID NO: 5866749 - DNA, 21 bp, Homo sapiens
ccagcattccagctctgcccc

SEQ ID NO: 5866750 - DNA, 22 bp, Homo sapiens
ccagcattccagctctgccccc

SEQ ID NO: 5866751 - DNA, 23 bp, Homo sapiens
ccagcattccagctctgcccccg

SEQ ID NO: 5866752 - DNA, 14 bp, Homo sapiens
ccagcattcccagg

SEQ ID NO: 5866753 - DNA, 15 bp, Homo sapiens
ccagcattctcagcc

SEQ ID NO: 5866754 - DNA, 22 bp, Homo sapiens
ccagcattgctactgctcagct

SEQ ID NO: 5866755 - DNA, 21 bp, Homo sapiens
ccagcatttcccttccttcct

SEQ ID NO: 5866756 - DNA, 14 bp, Homo sapiens
ccagcatttgccat

SEQ ID NO: 5866757 - DNA, 22 bp, Homo sapiens
ccagcatttgccattcctggaa

SEQ ID NO: 5866758 - DNA, 12 bp, Homo sapiens
ccagcatttgtc

SEQ ID NO: 5866759 - DNA, 22 bp, Homo sapiens
ccagcatttgtccttttgtgaa

SEQ ID NO: 5866760 - DNA, 17 bp, Homo sapiens
ccagccaaaccctgtct

SEQ ID NO: 5866761 - DNA, 17 bp, Homo sapiens
ccagccaaacgggagct

SEQ ID NO: 5866762 - DNA, 23 bp, Homo sapiens
ccagccaaagaaatgggcctgcc

SEQ ID NO: 5866763 - DNA, 16 bp, Homo sapiens
ccagccaaagcatgcc

SEQ ID NO: 5866764 - DNA, 18 bp, Homo sapiens
ccagccaaagcctcctcc

SEQ ID NO: 5866765 - DNA, 19 bp, Homo sapiens
ccagccaacccctgtggag

SEQ ID NO: 5866766 - DNA, 17 bp, Homo sapiens
ccagccaactctgggaa

SEQ ID NO: 5866767 - DNA, 14 bp, Homo sapiens
ccagccaagctctg

SEQ ID NO: 5866768 - DNA, 24 bp, Homo sapiens
ccagccaataaatcaactccagct

SEQ ID NO: 5866769 - DNA, 17 bp, Homo sapiens
ccagccaatttcccgga

SEQ ID NO: 5866770 - DNA, 9 bp, Homo sapiens
ccagccaca

SEQ ID NO: 5866771 - DNA, 20 bp, Homo sapiens
ccagccacacagagcctgcc

SEQ ID NO: 5866772 - DNA, 12 bp, Homo sapiens
ccagccacagac

SEQ ID NO: 5866773 - DNA, 16 bp, Homo sapiens
ccagccacagacccct

SEQ ID NO: 5866774 - DNA, 23 bp, Homo sapiens
ccagccacagacccctgggagct

SEQ ID NO: 5866775 - DNA, 13 bp, Homo sapiens
ccagccacaggac

SEQ ID NO: 5866776 - DNA, 16 bp, Homo sapiens
ccagccacaggaccac

SEQ ID NO: 5866777 - DNA, 12 bp, Homo sapiens
ccagccacaggc

SEQ ID NO: 5866778 - DNA, 15 bp, Homo sapiens
ccagccacaggccaa

SEQ ID NO: 5866779 - DNA, 17 bp, Homo sapiens
ccagccaccaaggctgc

SEQ ID NO: 5866780 - DNA, 21 bp, Homo sapiens
ccagccaccaaggctgcctgc

SEQ ID NO: 5866781 - DNA, 16 bp, Homo sapiens
ccagccaccaccactg

SEQ ID NO: 5866782 - DNA, 17 bp, Homo sapiens
ccagccacccagccagg

SEQ ID NO: 5866783 - DNA, 16 bp, Homo sapiens
ccagccacccccaggc

SEQ ID NO: 5866784 - DNA, 20 bp, Homo sapiens
ccagccaccccgcagtcact

SEQ ID NO: 5866785 - DNA, 21 bp, Homo sapiens
ccagccaccccgggctctctg

SEQ ID NO: 5866786 - DNA, 13 bp, Homo sapiens
ccagccacccctc

SEQ ID NO: 5866787 - DNA, 15 bp, Homo sapiens
ccagccacccctgcc

SEQ ID NO: 5866788 - DNA, 21 bp, Homo sapiens
ccagccaccctaactgagctg

SEQ ID NO: 5866789 - DNA, 22 bp, Homo sapiens
ccagccaccctaactgagctgc

SEQ ID NO: 5866790 - DNA, 12 bp, Homo sapiens
ccagccacctcc

SEQ ID NO: 5866791 - DNA, 16 bp, Homo sapiens
ccagccacctcccaag

SEQ ID NO: 5866792 - DNA, 23 bp, Homo sapiens
ccagccacctcttgggcatgctc

SEQ ID NO: 5866793 - DNA, 13 bp, Homo sapiens
ccagccaccttcc

SEQ ID NO: 5866794 - DNA, 16 bp, Homo sapiens
ccagccaccttcctga

SEQ ID NO: 5866795 - DNA, 23 bp, Homo sapiens
ccagccaccttcctgactgggaa

SEQ ID NO: 5866796 - DNA, 14 bp, Homo sapiens
ccagccacgcaggg

SEQ ID NO: 5866797 - DNA, 16 bp, Homo sapiens
ccagccacgcagggcc

SEQ ID NO: 5866798 - DNA, 17 bp, Homo sapiens
ccagccacgcagggcca

SEQ ID NO: 5866799 - DNA, 13 bp, Homo sapiens
ccagccacggagg

SEQ ID NO: 5866800 - DNA, 17 bp, Homo sapiens
ccagccacggagggagg

SEQ ID NO: 5866801 - DNA, 20 bp, Homo sapiens
ccagccacggagggaggcac

SEQ ID NO: 5866802 - DNA, 21 bp, Homo sapiens
ccagccacggagggaggcacc

SEQ ID NO: 5866803 - DNA, 23 bp, Homo sapiens
ccagccacggagggaggcaccat

SEQ ID NO: 5866804 - DNA, 17 bp, Homo sapiens
ccagccacgttggtggt

SEQ ID NO: 5866805 - DNA, 13 bp, Homo sapiens
ccagccactccaa

SEQ ID NO: 5866806 - DNA, 15 bp, Homo sapiens
ccagccactccaagc

SEQ ID NO: 5866807 - DNA, 19 bp, Homo sapiens
ccagccactccaagccccc

SEQ ID NO: 5866808 - DNA, 20 bp, Homo sapiens
ccagccactcgggaggctga

SEQ ID NO: 5866809 - DNA, 11 bp, Homo sapiens
ccagccactct

SEQ ID NO: 5866810 - DNA, 21 bp, Homo sapiens
ccagccactgccaagcttcct

SEQ ID NO: 5866811 - DNA, 12 bp, Homo sapiens
ccagccactgga

SEQ ID NO: 5866812 - DNA, 17 bp, Homo sapiens
ccagccacttgactggc

SEQ ID NO: 5866813 - DNA, 15 bp, Homo sapiens
ccagccagaagcctc

SEQ ID NO: 5866814 - DNA, 20 bp, Homo sapiens
ccagccagagtttgcctccc

SEQ ID NO: 5866815 - DNA, 18 bp, Homo sapiens
ccagccagatcctcttgg

SEQ ID NO: 5866816 - DNA, 19 bp, Homo sapiens
ccagccagatcctcttggt

SEQ ID NO: 5866817 - DNA, 22 bp, Homo sapiens
ccagccagcagcagcccaagct

SEQ ID NO: 5866818 - DNA, 19 bp, Homo sapiens
ccagccagcagccagctct

SEQ ID NO: 5866819 - DNA, 12 bp, Homo sapiens
ccagccagcagg

SEQ ID NO: 5866820 - DNA, 14 bp, Homo sapiens
ccagccagccaccc

SEQ ID NO: 5866821 - DNA, 12 bp, Homo sapiens
ccagccagccct

SEQ ID NO: 5866822 - DNA, 15 bp, Homo sapiens
ccagccagccctggc

SEQ ID NO: 5866823 - DNA, 16 bp, Homo sapiens
ccagccagccctggcc

SEQ ID NO: 5866824 - DNA, 14 bp, Homo sapiens
ccagccagcctcag

SEQ ID NO: 5866825 - DNA, 14 bp, Homo sapiens
ccagccagcgcctc

SEQ ID NO: 5866826 - DNA, 22 bp, Homo sapiens
ccagccagcgtcggtctgtgcc

SEQ ID NO: 5866827 - DNA, 16 bp, Homo sapiens
ccagccagctcctgca

SEQ ID NO: 5866828 - DNA, 14 bp, Homo sapiens
ccagccaggagggg

SEQ ID NO: 5866829 - DNA, 18 bp, Homo sapiens
ccagccaggatcccaagc

SEQ ID NO: 5866830 - DNA, 21 bp, Homo sapiens
ccagccaggcaggtccacaga

SEQ ID NO: 5866831 - DNA, 14 bp, Homo sapiens
ccagccaggcccag

SEQ ID NO: 5866832 - DNA, 20 bp, Homo sapiens
ccagccaggcccaggccagc

SEQ ID NO: 5866833 - DNA, 15 bp, Homo sapiens
ccagccaggccctgc

SEQ ID NO: 5866834 - DNA, 22 bp, Homo sapiens
ccagccaggctatggttgccac

SEQ ID NO: 5866835 - DNA, 12 bp, Homo sapiens
ccagccaggctc

SEQ ID NO: 5866836 - DNA, 17 bp, Homo sapiens
ccagccaggctctgtgc

SEQ ID NO: 5866837 - DNA, 18 bp, Homo sapiens
ccagccaggctctgtgct

SEQ ID NO: 5866838 - DNA, 20 bp, Homo sapiens
ccagccaggctctgtgctga

SEQ ID NO: 5866839 - DNA, 19 bp, Homo sapiens
ccagccagggctcaatctc

SEQ ID NO: 5866840 - DNA, 13 bp, Homo sapiens
ccagccaggtgca

SEQ ID NO: 5866841 - DNA, 14 bp, Homo sapiens
ccagccagtcttgc

SEQ ID NO: 5866842 - DNA, 16 bp, Homo sapiens
ccagccagtcttgcct

SEQ ID NO: 5866843 - DNA, 19 bp, Homo sapiens
ccagccagtgacctgagga

SEQ ID NO: 5866844 - DNA, 22 bp, Homo sapiens
ccagccagtgaggatgacagtg

SEQ ID NO: 5866845 - DNA, 14 bp, Homo sapiens
ccagccagtggccg

SEQ ID NO: 5866846 - DNA, 22 bp, Homo sapiens
ccagccatacttatctctctgt

SEQ ID NO: 5866847 - DNA, 16 bp, Homo sapiens
ccagccatcaaaatgc

SEQ ID NO: 5866848 - DNA, 23 bp, Homo sapiens
ccagccatcaccttagaccacca

SEQ ID NO: 5866849 - DNA, 17 bp, Homo sapiens
ccagccatgccagctgg

SEQ ID NO: 5866850 - DNA, 15 bp, Homo sapiens
ccagccatgcctgag

SEQ ID NO: 5866851 - DNA, 18 bp, Homo sapiens
ccagccatggctggatgt

SEQ ID NO: 5866852 - DNA, 20 bp, Homo sapiens
ccagccatggctggatgtgc

SEQ ID NO: 5866853 - DNA, 14 bp, Homo sapiens
ccagccatgtctgc

SEQ ID NO: 5866854 - DNA, 16 bp, Homo sapiens
ccagccatgtctgcat

SEQ ID NO: 5866855 - DNA, 18 bp, Homo sapiens
ccagccatgtctgcattt

SEQ ID NO: 5866856 - DNA, 19 bp, Homo sapiens
ccagccattaccatggaga

SEQ ID NO: 5866857 - DNA, 21 bp, Homo sapiens
ccagccattaccatggagaca

SEQ ID NO: 5866858 - DNA, 13 bp, Homo sapiens
ccagccattcctg

SEQ ID NO: 5866859 - DNA, 13 bp, Homo sapiens
ccagccattgtaa

SEQ ID NO: 5866860 - DNA, 20 bp, Homo sapiens
ccagcccaaacctgggaagg

SEQ ID NO: 5866861 - DNA, 17 bp, Homo sapiens
ccagcccaaaccttggg

SEQ ID NO: 5866862 - DNA, 19 bp, Homo sapiens
ccagcccaaaccttgggcc

SEQ ID NO: 5866863 - DNA, 12 bp, Homo sapiens
ccagcccaaagc

SEQ ID NO: 5866864 - DNA, 20 bp, Homo sapiens
ccagcccaagtagaggggcc

SEQ ID NO: 5866865 - DNA, 12 bp, Homo sapiens
ccagcccaagtc

SEQ ID NO: 5866866 - DNA, 18 bp, Homo sapiens
ccagccctgccaggaggc

SEQ ID NO: 5866867 - DNA, 14 bp, Homo sapiens
ccagccctgcccag

SEQ ID NO: 5866868 - DNA, 21 bp, Homo sapiens
ccagccctgcctggaggacct

SEQ ID NO: 5866869 - DNA, 22 bp, Homo sapiens
ccagccctgcctggaggacctg

SEQ ID NO: 5866870 - DNA, 16 bp, Homo sapiens
ccagccctgctgggga

SEQ ID NO: 5866871 - DNA, 17 bp, Homo sapiens
ccagccctggcccaggt

SEQ ID NO: 5866872 - DNA, 14 bp, Homo sapiens
ccagccctgggaac

SEQ ID NO: 5866873 - DNA, 16 bp, Homo sapiens
ccagccctgggcctgg

SEQ ID NO: 5866874 - DNA, 13 bp, Homo sapiens
ccagccctgggct

SEQ ID NO: 5866875 - DNA, 19 bp, Homo sapiens
ccagccctggggctgggcc

SEQ ID NO: 5866876 - DNA, 13 bp, Homo sapiens
ccagccctggggg

SEQ ID NO: 5866877 - DNA, 20 bp, Homo sapiens
ccagccctggtggccaagcc

SEQ ID NO: 5866878 - DNA, 13 bp, Homo sapiens
ccagccctgtcct

SEQ ID NO: 5866879 - DNA, 14 bp, Homo sapiens
ccagccctgtggaa

SEQ ID NO: 5866880 - DNA, 18 bp, Homo sapiens
ccagccctgtggaaggga

SEQ ID NO: 5866881 - DNA, 17 bp, Homo sapiens
ccagcccttagcacaga

SEQ ID NO: 5866882 - DNA, 11 bp, Homo sapiens
ccagcccttca

SEQ ID NO: 5866883 - DNA, 19 bp, Homo sapiens
ccagcccttcccaggccag

SEQ ID NO: 5866884 - DNA, 13 bp, Homo sapiens
ccagcccttccct

SEQ ID NO: 5866885 - DNA, 23 bp, Homo sapiens
ccagcccttccctggccccgccg

SEQ ID NO: 5866886 - DNA, 12 bp, Homo sapiens
ccagcccttcct

SEQ ID NO: 5866887 - DNA, 17 bp, Homo sapiens
ccagcccttcctctcac

SEQ ID NO: 5866888 - DNA, 22 bp, Homo sapiens
ccagcccttcctctcactcctg

SEQ ID NO: 5866889 - DNA, 17 bp, Homo sapiens
ccagcccttcctctgct

SEQ ID NO: 5866890 - DNA, 16 bp, Homo sapiens
ccagcccttccttggg

SEQ ID NO: 5866891 - DNA, 18 bp, Homo sapiens
ccagcccttccttgggcg

SEQ ID NO: 5866892 - DNA, 16 bp, Homo sapiens
ccagcccttgaagtca

SEQ ID NO: 5866893 - DNA, 13 bp, Homo sapiens
ccagcccttgaat

SEQ ID NO: 5866894 - DNA, 18 bp, Homo sapiens
ccagccctttgcaggccc

SEQ ID NO: 5866895 - DNA, 22 bp, Homo sapiens
ccagccctttgcaggcccagca

SEQ ID NO: 5866896 - DNA, 15 bp, Homo sapiens
ccagccgaccccctc

SEQ ID NO: 5866897 - DNA, 23 bp, Homo sapiens
ccagccgaccccctctccctgca

SEQ ID NO: 5866898 - DNA, 23 bp, Homo sapiens
ccagccgagatagccaaggccaa

SEQ ID NO: 5866899 - DNA, 18 bp, Homo sapiens
ccagccgagcaggaggcc

SEQ ID NO: 5866900 - DNA, 18 bp, Homo sapiens
ccagccgcaggaaggcag

SEQ ID NO: 5866901 - DNA, 20 bp, Homo sapiens
ccagccgccattgccaccag

SEQ ID NO: 5866902 - DNA, 14 bp, Homo sapiens
ccagccgcccaccc

SEQ ID NO: 5866903 - DNA, 14 bp, Homo sapiens
ccagccgcccagat

SEQ ID NO: 5866904 - DNA, 21 bp, Homo sapiens
ccagccgcccagatcatgccg

SEQ ID NO: 5866905 - DNA, 14 bp, Homo sapiens
ccagccgccctggg

SEQ ID NO: 5866906 - DNA, 16 bp, Homo sapiens
ccagccgccctgggct

SEQ ID NO: 5866907 - DNA, 22 bp, Homo sapiens
ccagccgctgcagggctcccat

SEQ ID NO: 5866908 - DNA, 23 bp, Homo sapiens
ccagccgctgcccggcgccctct

SEQ ID NO: 5866909 - DNA, 14 bp, Homo sapiens
ccagccgctggtgc

SEQ ID NO: 5866910 - DNA, 18 bp, Homo sapiens
ccagccgctggtgcccac

SEQ ID NO: 5866911 - DNA, 22 bp, Homo sapiens
ccagccgcttggcgatgccagc

SEQ ID NO: 5866912 - DNA, 23 bp, Homo sapiens
ccagccgcttggcgatgccagcc

SEQ ID NO: 5866913 - DNA, 20 bp, Homo sapiens
ccagccggacacaagcggcc

SEQ ID NO: 5866914 - DNA, 16 bp, Homo sapiens
ccagccggccaatgga

SEQ ID NO: 5866915 - DNA, 20 bp, Homo sapiens
ccagccggcctctctggcct

SEQ ID NO: 5866916 - DNA, 15 bp, Homo sapiens
ccagccgggcacagt

SEQ ID NO: 5866917 - DNA, 20 bp, Homo sapiens
ccagccggggcgagtggcac

SEQ ID NO: 5866918 - DNA, 17 bp, Homo sapiens
ccagccggggtggggtg

SEQ ID NO: 5866919 - DNA, 17 bp, Homo sapiens
ccagccgtaatggggac

SEQ ID NO: 5866920 - DNA, 18 bp, Homo sapiens
ccagccgtaatggggact

SEQ ID NO: 5866921 - DNA, 21 bp, Homo sapiens
ccagccgtaatggggactctc

SEQ ID NO: 5866922 - DNA, 20 bp, Homo sapiens
ccagccgtgagtgcagaccc

SEQ ID NO: 5866923 - DNA, 23 bp, Homo sapiens
ccagccgtgatgctcaggcttga

SEQ ID NO: 5866924 - DNA, 14 bp, Homo sapiens
ccagccgtgtgtgc

SEQ ID NO: 5866925 - DNA, 17 bp, Homo sapiens
ccagccgtgtgtgcatg

SEQ ID NO: 5866926 - DNA, 18 bp, Homo sapiens
ccagccgtgtgtgcatgt

SEQ ID NO: 5866927 - DNA, 19 bp, Homo sapiens
ccagccgtgtgtgcatgtg

SEQ ID NO: 5866928 - DNA, 19 bp, Homo sapiens
ccagcctacactgccagcc

SEQ ID NO: 5866929 - DNA, 18 bp, Homo sapiens
ccagcctacccttcctgc

SEQ ID NO: 5866930 - DNA, 19 bp, Homo sapiens
ccagcctacccttcctgca

SEQ ID NO: 5866931 - DNA, 21 bp, Homo sapiens
ccagcctaggcttggctcctt

SEQ ID NO: 5866932 - DNA, 19 bp, Homo sapiens
ccagcctaggtggaggcaa

SEQ ID NO: 5866933 - DNA, 21 bp, Homo sapiens
ccagcctatgagcatcctgag

SEQ ID NO: 5866934 - DNA, 18 bp, Homo sapiens
ccagcctcaaatccagga

SEQ ID NO: 5866935 - DNA, 23 bp, Homo sapiens
ccagcctcaaatccaggaccctg

SEQ ID NO: 5866936 - DNA, 18 bp, Homo sapiens
ccagcctcaatgtcactt

SEQ ID NO: 5866937 - DNA, 16 bp, Homo sapiens
ccagcctcacagatgc

SEQ ID NO: 5866938 - DNA, 20 bp, Homo sapiens
ccagcctcacagatgctggc

SEQ ID NO: 5866939 - DNA, 14 bp, Homo sapiens
ccagcctcaccctt

SEQ ID NO: 5866940 - DNA, 19 bp, Homo sapiens
ccagcctcacctcattcca

SEQ ID NO: 5866941 - DNA, 21 bp, Homo sapiens
ccagcctcactccatttccca

SEQ ID NO: 5866942 - DNA, 18 bp, Homo sapiens
ccagcctcacttcctttg

SEQ ID NO: 5866943 - DNA, 10 bp, Homo sapiens
ccagcctcag

SEQ ID NO: 5866944 - DNA, 16 bp, Homo sapiens
ccagcctcagaagcct

SEQ ID NO: 5866945 - DNA, 19 bp, Homo sapiens
ccagcctcagaagccttct

SEQ ID NO: 5866946 - DNA, 22 bp, Homo sapiens
ccagcctcagaagccttcttgc

SEQ ID NO: 5866947 - DNA, 20 bp, Homo sapiens
ccagcctcagaaggccccag

SEQ ID NO: 5866948 - DNA, 16 bp, Homo sapiens
ccagcctcagactgga

SEQ ID NO: 5866949 - DNA, 13 bp, Homo sapiens
ccagcctcagccc

SEQ ID NO: 5866950 - DNA, 15 bp, Homo sapiens
ccagcctcagcccaa

SEQ ID NO: 5866951 - DNA, 21 bp, Homo sapiens
ccagcctcagcgcggccctcc

SEQ ID NO: 5866952 - DNA, 12 bp, Homo sapiens
ccagcctcagct

SEQ ID NO: 5866953 - DNA, 15 bp, Homo sapiens
ccagcctcagctcag

SEQ ID NO: 5866954 - DNA, 20 bp, Homo sapiens
ccagcctcagtcctcccctc

SEQ ID NO: 5866955 - DNA, 21 bp, Homo sapiens
ccagcctcattgtgccaagcc

SEQ ID NO: 5866956 - DNA, 23 bp, Homo sapiens
ccagcctcattgtgccaagcctt

SEQ ID NO: 5866957 - DNA, 16 bp, Homo sapiens
ccagcctccagagaag

SEQ ID NO: 5866958 - DNA, 18 bp, Homo sapiens
ccagcctccagagaagcc

SEQ ID NO: 5866959 - DNA, 19 bp, Homo sapiens
ccagcctccagagaagccc

SEQ ID NO: 5866960 - DNA, 16 bp, Homo sapiens
ccagcctccaggcccc

SEQ ID NO: 5866961 - DNA, 13 bp, Homo sapiens
ccagcctccaggg

SEQ ID NO: 5866962 - DNA, 14 bp, Homo sapiens
ccagcctccagggc

SEQ ID NO: 5866963 - DNA, 12 bp, Homo sapiens
ccagcctcccca

SEQ ID NO: 5866964 - DNA, 13 bp, Homo sapiens
ccagcctccccca

SEQ ID NO: 5866965 - DNA, 22 bp, Homo sapiens
ccagcctcccccaggctgcgcc

SEQ ID NO: 5866966 - DNA, 18 bp, Homo sapiens
ccagcctcccctcccctg

SEQ ID NO: 5866967 - DNA, 13 bp, Homo sapiens
ccagcctccctgt

SEQ ID NO: 5866968 - DNA, 15 bp, Homo sapiens
ccagcctccctgtct

SEQ ID NO: 5866969 - DNA, 17 bp, Homo sapiens
ccagcctccctgtctcc

SEQ ID NO: 5866970 - DNA, 22 bp, Homo sapiens
ccagcctccctgtctccagctg

SEQ ID NO: 5866971 - DNA, 19 bp, Homo sapiens
ccagcctccgagagggaga

SEQ ID NO: 5866972 - DNA, 12 bp, Homo sapiens
ccagcctcctct

SEQ ID NO: 5866973 - DNA, 13 bp, Homo sapiens
ccagcctcctctg

SEQ ID NO: 5866974 - DNA, 15 bp, Homo sapiens
ccagcctcctctgga

SEQ ID NO: 5866975 - DNA, 20 bp, Homo sapiens
ccagcctcctgtttgcaggc

SEQ ID NO: 5866976 - DNA, 13 bp, Homo sapiens
ccagcctccttgc

SEQ ID NO: 5866977 - DNA, 15 bp, Homo sapiens
ccagcctccttgctg

SEQ ID NO: 5866978 - DNA, 16 bp, Homo sapiens
ccagcctcgcatgcca

SEQ ID NO: 5866979 - DNA, 23 bp, Homo sapiens
ccagcctcgcccatccccttgag

SEQ ID NO: 5866980 - DNA, 15 bp, Homo sapiens
ccagcctcggcctcc

SEQ ID NO: 5866981 - DNA, 16 bp, Homo sapiens
ccagcctcgtcttcat

SEQ ID NO: 5866982 - DNA, 19 bp, Homo sapiens
ccagcctcgttggaagagg

SEQ ID NO: 5866983 - DNA, 22 bp, Homo sapiens
ccagcctcgttggaagaggaac

SEQ ID NO: 5866984 - DNA, 13 bp, Homo sapiens
ccagcctctcccc

SEQ ID NO: 5866985 - DNA, 17 bp, Homo sapiens
ccagcctctctggctca

SEQ ID NO: 5866986 - DNA, 21 bp, Homo sapiens
ccagcctctcttcctatccca

SEQ ID NO: 5866987 - DNA, 21 bp, Homo sapiens
ccagcctctgagcccctggga

SEQ ID NO: 5866988 - DNA, 24 bp, Homo sapiens
ccagcctctgagcccctgggactg

SEQ ID NO: 5866989 - DNA, 16 bp, Homo sapiens
ccagcctctgccccac

SEQ ID NO: 5866990 - DNA, 13 bp, Homo sapiens
ccagcctctgctc

SEQ ID NO: 5866991 - DNA, 14 bp, Homo sapiens
ccagcctctggggc

SEQ ID NO: 5866992 - DNA, 18 bp, Homo sapiens
ccagcctctggggcagag

SEQ ID NO: 5866993 - DNA, 19 bp, Homo sapiens
ccagcctctgttcccctag

SEQ ID NO: 5866994 - DNA, 20 bp, Homo sapiens
ccagcctcttccattccctt

SEQ ID NO: 5866995 - DNA, 15 bp, Homo sapiens
ccagcctctttccct

SEQ ID NO: 5866996 - DNA, 18 bp, Homo sapiens
ccagcctgaacagaagct

SEQ ID NO: 5866997 - DNA, 18 bp, Homo sapiens
ccagcctgacaacagcct

SEQ ID NO: 5866998 - DNA, 20 bp, Homo sapiens
ccagcctgacaacagcctga

SEQ ID NO: 5866999 - DNA, 22 bp, Homo sapiens
ccagcctgacaacagcctgaga

SEQ ID NO: 5867000 - DNA, 17 bp, Homo sapiens
ccagcctgaccttcctt

SEQ ID NO: 5867001 - DNA, 12 bp, Homo sapiens
ccagcctgagcc

SEQ ID NO: 5867002 - DNA, 14 bp, Homo sapiens
ccagcctgagccac

SEQ ID NO: 5867003 - DNA, 18 bp, Homo sapiens
ccagcctgagccacagtg

SEQ ID NO: 5867004 - DNA, 19 bp, Homo sapiens
ccagcctgagcgacagtga

SEQ ID NO: 5867005 - DNA, 20 bp, Homo sapiens
ccagcctgaggtgcccactc

SEQ ID NO: 5867006 - DNA, 23 bp, Homo sapiens
ccagcctgaggtgcccactccgc

SEQ ID NO: 5867007 - DNA, 15 bp, Homo sapiens
ccagcctgagtgaca

SEQ ID NO: 5867008 - DNA, 21 bp, Homo sapiens
ccagcctgcatctagctggag

SEQ ID NO: 5867009 - DNA, 23 bp, Homo sapiens
ccagcctgccccagcctcccagc

SEQ ID NO: 5867010 - DNA, 19 bp, Homo sapiens
ccagcctgccctccagctg

SEQ ID NO: 5867011 - DNA, 19 bp, Homo sapiens
ccagcctgcctggcaggct

SEQ ID NO: 5867012 - DNA, 14 bp, Homo sapiens
ccagcctgcgcctg

SEQ ID NO: 5867013 - DNA, 17 bp, Homo sapiens
ccagcctgcgcctgctg

SEQ ID NO: 5867014 - DNA, 19 bp, Homo sapiens
ccagcctgcgggaagctga

SEQ ID NO: 5867015 - DNA, 15 bp, Homo sapiens
ccagcctgctgacag

SEQ ID NO: 5867016 - DNA, 20 bp, Homo sapiens
ccagcctgctgacagacact

SEQ ID NO: 5867017 - DNA, 18 bp, Homo sapiens
ccagcctgctgagagccc

SEQ ID NO: 5867018 - DNA, 21 bp, Homo sapiens
ccagcctgctgtataagtaac

SEQ ID NO: 5867019 - DNA, 20 bp, Homo sapiens
ccagcctggaaacctgtctg

SEQ ID NO: 5867020 - DNA, 18 bp, Homo sapiens
ccagcctggacccccagc

SEQ ID NO: 5867021 - DNA, 19 bp, Homo sapiens
ccagcctggacccccagct

SEQ ID NO: 5867022 - DNA, 16 bp, Homo sapiens
ccagcctggagccgtg

SEQ ID NO: 5867023 - DNA, 13 bp, Homo sapiens
ccagcctggatgc

SEQ ID NO: 5867024 - DNA, 12 bp, Homo sapiens
ccagcctggcca

SEQ ID NO: 5867025 - DNA, 17 bp, Homo sapiens
ccagcctggccaacatg

SEQ ID NO: 5867026 - DNA, 19 bp, Homo sapiens
ccagcctggccaccagctt

SEQ ID NO: 5867027 - DNA, 23 bp, Homo sapiens
ccagcctggccacgcagccagga

SEQ ID NO: 5867028 - DNA, 15 bp, Homo sapiens
ccagcctggccagac

SEQ ID NO: 5867029 - DNA, 16 bp, Homo sapiens
ccagcctggccagaca

SEQ ID NO: 5867030 - DNA, 13 bp, Homo sapiens
ccagcctggccca

SEQ ID NO: 5867031 - DNA, 14 bp, Homo sapiens
ccagcctggcccag

SEQ ID NO: 5867032 - DNA, 16 bp, Homo sapiens
ccagcctggcccagct

SEQ ID NO: 5867033 - DNA, 19 bp, Homo sapiens
ccagcctggcccagctccc

SEQ ID NO: 5867034 - DNA, 12 bp, Homo sapiens
ccagcctggcct

SEQ ID NO: 5867035 - DNA, 13 bp, Homo sapiens
ccagcctggcctc

SEQ ID NO: 5867036 - DNA, 18 bp, Homo sapiens
ccagcctggcctcctgcc

SEQ ID NO: 5867037 - DNA, 20 bp, Homo sapiens
ccagcctggcctcctgcctc

SEQ ID NO: 5867038 - DNA, 21 bp, Homo sapiens
ccagcctggcctcctgcctct

SEQ ID NO: 5867039 - DNA, 15 bp, Homo sapiens
ccagcctggctctgc

SEQ ID NO: 5867040 - DNA, 18 bp, Homo sapiens
ccagcctggctctgcccc

SEQ ID NO: 5867041 - DNA, 23 bp, Homo sapiens
ccagcctggctctgccccctccc

SEQ ID NO: 5867042 - DNA, 13 bp, Homo sapiens
ccagcctgggaca

SEQ ID NO: 5867043 - DNA, 22 bp, Homo sapiens
ccagctaccctttttctccagc

SEQ ID NO: 5867044 - DNA, 21 bp, Homo sapiens
ccagctactcagaagcctgag

SEQ ID NO: 5867045 - DNA, 20 bp, Homo sapiens
ccagctactcagatggctga

SEQ ID NO: 5867046 - DNA, 15 bp, Homo sapiens
ccagctactcaggag

SEQ ID NO: 5867047 - DNA, 17 bp, Homo sapiens
ccagctactcaggaggc

SEQ ID NO: 5867048 - DNA, 20 bp, Homo sapiens
ccagctactcaggaggctga

SEQ ID NO: 5867049 - DNA, 21 bp, Homo sapiens
ccagctactcaggaggctgag

SEQ ID NO: 5867050 - DNA, 22 bp, Homo sapiens
ccagctactcaggaggctgaga

SEQ ID NO: 5867051 - DNA, 21 bp, Homo sapiens
ccagctactccggaggctgag

SEQ ID NO: 5867052 - DNA, 15 bp, Homo sapiens
ccagctactcgggag

SEQ ID NO: 5867053 - DNA, 23 bp, Homo sapiens
ccagctactcgggaggctgaggc

SEQ ID NO: 5867054 - DNA, 15 bp, Homo sapiens
ccagctactctgtcc

SEQ ID NO: 5867055 - DNA, 16 bp, Homo sapiens
ccagctactctgtcca

SEQ ID NO: 5867056 - DNA, 17 bp, Homo sapiens
ccagctactctgtccag

SEQ ID NO: 5867057 - DNA, 18 bp, Homo sapiens
ccagctactctgtccagg

SEQ ID NO: 5867058 - DNA, 19 bp, Homo sapiens
ccagctactctgtccaggc

SEQ ID NO: 5867059 - DNA, 20 bp, Homo sapiens
ccagctactctgtccaggcc

SEQ ID NO: 5867060 - DNA, 19 bp, Homo sapiens
ccagctactgaaccagcca

SEQ ID NO: 5867061 - DNA, 21 bp, Homo sapiens
ccagctactgaaccagccacg

SEQ ID NO: 5867062 - DNA, 17 bp, Homo sapiens
ccagctacttagctggc

SEQ ID NO: 5867063 - DNA, 20 bp, Homo sapiens
ccagctacttagctggccaa

SEQ ID NO: 5867064 - DNA, 21 bp, Homo sapiens
ccagctacttagctggccaag

SEQ ID NO: 5867065 - DNA, 15 bp, Homo sapiens
ccagctacttcctcc

SEQ ID NO: 5867066 - DNA, 19 bp, Homo sapiens
ccagctacttgggagcctg

SEQ ID NO: 5867067 - DNA, 20 bp, Homo sapiens
ccagctacttgggaggctga

SEQ ID NO: 5867068 - DNA, 14 bp, Homo sapiens
ccagctaggaagca

SEQ ID NO: 5867069 - DNA, 15 bp, Homo sapiens
ccagctagggctgga

SEQ ID NO: 5867070 - DNA, 20 bp, Homo sapiens
ccagctagggctggactctg

SEQ ID NO: 5867071 - DNA, 14 bp, Homo sapiens
ccagctagtgaccc

SEQ ID NO: 5867072 - DNA, 14 bp, Homo sapiens
ccagctatacctgt

SEQ ID NO: 5867073 - DNA, 16 bp, Homo sapiens
ccagctatacctgtgc

SEQ ID NO: 5867074 - DNA, 19 bp, Homo sapiens
ccagctatacctgtgcctc

SEQ ID NO: 5867075 - DNA, 15 bp, Homo sapiens
ccagctatactgtat

SEQ ID NO: 5867076 - DNA, 12 bp, Homo sapiens
ccagctatctgc

SEQ ID NO: 5867077 - DNA, 14 bp, Homo sapiens
ccagctatctgcct

SEQ ID NO: 5867078 - DNA, 16 bp, Homo sapiens
ccagctatctgcctga

SEQ ID NO: 5867079 - DNA, 17 bp, Homo sapiens
ccagctatctgcctgac

SEQ ID NO: 5867080 - DNA, 21 bp, Homo sapiens
ccagctattcaggaggctgag

SEQ ID NO: 5867081 - DNA, 17 bp, Homo sapiens
ccagctattttctgacc

SEQ ID NO: 5867082 - DNA, 19 bp, Homo sapiens
ccagctattttctgaccaa

SEQ ID NO: 5867083 - DNA, 15 bp, Homo sapiens
ccagctcaccagccc

SEQ ID NO: 5867084 - DNA, 19 bp, Homo sapiens
ccagctcaccccccacact

SEQ ID NO: 5867085 - DNA, 21 bp, Homo sapiens
ccagctcacgtaatgcattgc

SEQ ID NO: 5867086 - DNA, 14 bp, Homo sapiens
ccagctcacgtcac

SEQ ID NO: 5867087 - DNA, 15 bp, Homo sapiens
ccagctcacgtcaca

SEQ ID NO: 5867088 - DNA, 14 bp, Homo sapiens
ccagctcactccct

SEQ ID NO: 5867089 - DNA, 19 bp, Homo sapiens
ccagctcagaacccagggc

SEQ ID NO: 5867090 - DNA, 20 bp, Homo sapiens
ccagctcagaacccagggct

SEQ ID NO: 5867091 - DNA, 21 bp, Homo sapiens
ccagctcagaacccagggctc

SEQ ID NO: 5867092 - DNA, 14 bp, Homo sapiens
ccagctcagagccc

SEQ ID NO: 5867093 - DNA, 16 bp, Homo sapiens
ccagctcagagccccg

SEQ ID NO: 5867094 - DNA, 12 bp, Homo sapiens
ccagctcagcac

SEQ ID NO: 5867095 - DNA, 17 bp, Homo sapiens
ccagctcagcagttcac

SEQ ID NO: 5867096 - DNA, 14 bp, Homo sapiens
ccagctcagccccg

SEQ ID NO: 5867097 - DNA, 19 bp, Homo sapiens
ccagctcagccccggccac

SEQ ID NO: 5867098 - DNA, 22 bp, Homo sapiens
ccagctcagccccggccactcc

SEQ ID NO: 5867099 - DNA, 15 bp, Homo sapiens
ccagctcagccctgg

SEQ ID NO: 5867100 - DNA, 23 bp, Homo sapiens
ccagctcagccctggcctggctg

SEQ ID NO: 5867101 - DNA, 21 bp, Homo sapiens
ccagctcaggaattccctgga

SEQ ID NO: 5867102 - DNA, 22 bp, Homo sapiens
ccagctcaggaattccctggaa

SEQ ID NO: 5867103 - DNA, 13 bp, Homo sapiens
ccagctcaggaca

SEQ ID NO: 5867104 - DNA, 17 bp, Homo sapiens
ccagctcaggggacact

SEQ ID NO: 5867105 - DNA, 21 bp, Homo sapiens
ccagctcaggggacactggcc

SEQ ID NO: 5867106 - DNA, 15 bp, Homo sapiens
ccagctcaggggcag

SEQ ID NO: 5867107 - DNA, 19 bp, Homo sapiens
ccagctcaggggcagctca

SEQ ID NO: 5867108 - DNA, 11 bp, Homo sapiens
ccagctcagtg

SEQ ID NO: 5867109 - DNA, 16 bp, Homo sapiens
ccagctcagtgccaaa

SEQ ID NO: 5867110 - DNA, 22 bp, Homo sapiens
ccagctcatatgctgacagctc

SEQ ID NO: 5867111 - DNA, 16 bp, Homo sapiens
ccagctcatgacactg

SEQ ID NO: 5867112 - DNA, 12 bp, Homo sapiens
ccagctcattca

SEQ ID NO: 5867113 - DNA, 22 bp, Homo sapiens
ccagctccaaggggaatcagaa

SEQ ID NO: 5867114 - DNA, 22 bp, Homo sapiens
ccagctccacacattccagcca

SEQ ID NO: 5867115 - DNA, 23 bp, Homo sapiens
ccagctccacacattccagccag

SEQ ID NO: 5867116 - DNA, 13 bp, Homo sapiens
ccagctccacccc

SEQ ID NO: 5867117 - DNA, 15 bp, Homo sapiens
ccagctccaccccgc

SEQ ID NO: 5867118 - DNA, 15 bp, Homo sapiens
ccagctccactcagg

SEQ ID NO: 5867119 - DNA, 23 bp, Homo sapiens
ccagctccactcagggctggccc

SEQ ID NO: 5867120 - DNA, 16 bp, Homo sapiens
ccagctccactggcct

SEQ ID NO: 5867121 - DNA, 22 bp, Homo sapiens
ccagctccactggcctgcccgt

SEQ ID NO: 5867122 - DNA, 12 bp, Homo sapiens
ccagctccaggc

SEQ ID NO: 5867123 - DNA, 13 bp, Homo sapiens
ccagctccaggcc

SEQ ID NO: 5867124 - DNA, 18 bp, Homo sapiens
ccagctccaggcccaccg

SEQ ID NO: 5867125 - DNA, 14 bp, Homo sapiens
ccagctccagggcc

SEQ ID NO: 5867126 - DNA, 16 bp, Homo sapiens
ccagctccagggccag

SEQ ID NO: 5867127 - DNA, 18 bp, Homo sapiens
ccagctccagggccagat

SEQ ID NO: 5867128 - DNA, 20 bp, Homo sapiens
ccagctccaggggcccttgg

SEQ ID NO: 5867129 - DNA, 17 bp, Homo sapiens
ccagctccagtgccgct

SEQ ID NO: 5867130 - DNA, 24 bp, Homo sapiens
ccagctccagtgccgctcctgctt

SEQ ID NO: 5867131 - DNA, 19 bp, Homo sapiens
ccagctccatgttctccca

SEQ ID NO: 5867132 - DNA, 11 bp, Homo sapiens
ccagctcccaa

SEQ ID NO: 5867133 - DNA, 12 bp, Homo sapiens
ccagctcccaca

SEQ ID NO: 5867134 - DNA, 13 bp, Homo sapiens
ccagctcccacac

SEQ ID NO: 5867135 - DNA, 16 bp, Homo sapiens
ccagctcccacaccgc

SEQ ID NO: 5867136 - DNA, 22 bp, Homo sapiens
ccagctcccacctccccttggg

SEQ ID NO: 5867137 - DNA, 21 bp, Homo sapiens
ccagctcccactccctttcca

SEQ ID NO: 5867138 - DNA, 14 bp, Homo sapiens
ccagctcccagccc

SEQ ID NO: 5867139 - DNA, 23 bp, Homo sapiens
ccagctcccaggaccacaggctc

SEQ ID NO: 5867140 - DNA, 17 bp, Homo sapiens
ccagctcccagggtgga

SEQ ID NO: 5867141 - DNA, 14 bp, Homo sapiens
ccagctccccaaga

SEQ ID NO: 5867142 - DNA, 12 bp, Homo sapiens
ccagctccccag

SEQ ID NO: 5867143 - DNA, 16 bp, Homo sapiens
ccagctccccaggact

SEQ ID NO: 5867144 - DNA, 12 bp, Homo sapiens
ccagctcccccc

SEQ ID NO: 5867145 - DNA, 16 bp, Homo sapiens
ccagctccccccaaga

SEQ ID NO: 5867146 - DNA, 15 bp, Homo sapiens
ccagctccccctccc

SEQ ID NO: 5867147 - DNA, 23 bp, Homo sapiens
ccagctcccccttgcccgccagc

SEQ ID NO: 5867148 - DNA, 11 bp, Homo sapiens
ccagctccccg

SEQ ID NO: 5867149 - DNA, 21 bp, Homo sapiens
ccagctcccgctgtggccgca

SEQ ID NO: 5867150 - DNA, 13 bp, Homo sapiens
ccagctccctaga

SEQ ID NO: 5867151 - DNA, 15 bp, Homo sapiens
ccagctccctagact

SEQ ID NO: 5867152 - DNA, 17 bp, Homo sapiens
ccagctccctagactgc

SEQ ID NO: 5867153 - DNA, 12 bp, Homo sapiens
ccagctccctcc

SEQ ID NO: 5867154 - DNA, 17 bp, Homo sapiens
ccagctccctcccctgc

SEQ ID NO: 5867155 - DNA, 21 bp, Homo sapiens
ccagctccctcccctgctcag

SEQ ID NO: 5867156 - DNA, 17 bp, Homo sapiens
ccagctcccttcttccc

SEQ ID NO: 5867157 - DNA, 16 bp, Homo sapiens
ccagctcccttgggaa

SEQ ID NO: 5867158 - DNA, 23 bp, Homo sapiens
ccagctcccttgggaaggacaca

SEQ ID NO: 5867159 - DNA, 19 bp, Homo sapiens
ccagctccgacctctctca

SEQ ID NO: 5867160 - DNA, 16 bp, Homo sapiens
ccagctccgcctgctg

SEQ ID NO: 5867161 - DNA, 22 bp, Homo sapiens
ccagctccggagggggtcctcc

SEQ ID NO: 5867162 - DNA, 16 bp, Homo sapiens
ccagctccgtgtttct

SEQ ID NO: 5867163 - DNA, 19 bp, Homo sapiens
ccagctccgtgtttctcta

SEQ ID NO: 5867164 - DNA, 19 bp, Homo sapiens
ccagctccgtttctaccac

SEQ ID NO: 5867165 - DNA, 21 bp, Homo sapiens
ccagctccgtttctaccaccg

SEQ ID NO: 5867166 - DNA, 22 bp, Homo sapiens
ccagctcctcacccagggcccc

SEQ ID NO: 5867167 - DNA, 15 bp, Homo sapiens
ccagctcctccagcc

SEQ ID NO: 5867168 - DNA, 16 bp, Homo sapiens
ccagctcctccagccc

SEQ ID NO: 5867169 - DNA, 18 bp, Homo sapiens
ccagctcctccagccctg

SEQ ID NO: 5867170 - DNA, 15 bp, Homo sapiens
ccagctcctctctga

SEQ ID NO: 5867171 - DNA, 17 bp, Homo sapiens
ccagctcctctctgaag

SEQ ID NO: 5867172 - DNA, 17 bp, Homo sapiens
ccagctcctctgagcca

SEQ ID NO: 5867173 - DNA, 17 bp, Homo sapiens
ccagctcctcttcctgc

SEQ ID NO: 5867174 - DNA, 15 bp, Homo sapiens
ccagctcctgaataa

SEQ ID NO: 5867175 - DNA, 15 bp, Homo sapiens
ccagctcctgggcag

SEQ ID NO: 5867176 - DNA, 14 bp, Homo sapiens
ccagctccttcgct

SEQ ID NO: 5867177 - DNA, 16 bp, Homo sapiens
ccagctccttggctgc

SEQ ID NO: 5867178 - DNA, 17 bp, Homo sapiens
ccagctccttggctgca

SEQ ID NO: 5867179 - DNA, 21 bp, Homo sapiens
ccagctccttggggcagggcc

SEQ ID NO: 5867180 - DNA, 12 bp, Homo sapiens
ccagctcctttc

SEQ ID NO: 5867181 - DNA, 18 bp, Homo sapiens
ccagctcctttccctgga

SEQ ID NO: 5867182 - DNA, 20 bp, Homo sapiens
ccagctcctttcccttttcc

SEQ ID NO: 5867183 - DNA, 15 bp, Homo sapiens
ccagctccttttctg

SEQ ID NO: 5867184 - DNA, 20 bp, Homo sapiens
ccagctccttttgtccccag

SEQ ID NO: 5867185 - DNA, 20 bp, Homo sapiens
ccagctcgctggctttctct

SEQ ID NO: 5867186 - DNA, 21 bp, Homo sapiens
ccagctcgctggctttctctc

SEQ ID NO: 5867187 - DNA, 17 bp, Homo sapiens
ccagctcgtgggctggg

SEQ ID NO: 5867188 - DNA, 20 bp, Homo sapiens
ccagctcgtttttcagcacc

SEQ ID NO: 5867189 - DNA, 19 bp, Homo sapiens
ccagctctaagcagccagg

SEQ ID NO: 5867190 - DNA, 20 bp, Homo sapiens
ccagctctaagcagccagga

SEQ ID NO: 5867191 - DNA, 13 bp, Homo sapiens
ccagctctaagtc

SEQ ID NO: 5867192 - DNA, 15 bp, Homo sapiens
ccagctctacgagag

SEQ ID NO: 5867193 - DNA, 14 bp, Homo sapiens
ccagctctactcca

SEQ ID NO: 5867194 - DNA, 18 bp, Homo sapiens
ccagctctagacaaccct

SEQ ID NO: 5867195 - DNA, 19 bp, Homo sapiens
ccagctctagacaaccctg

SEQ ID NO: 5867196 - DNA, 22 bp, Homo sapiens
ccagctctagacaaccctgcaa

SEQ ID NO: 5867197 - DNA, 18 bp, Homo sapiens
ccagctctagcctctgga

SEQ ID NO: 5867198 - DNA, 19 bp, Homo sapiens
ccagctctagcctctggac

SEQ ID NO: 5867199 - DNA, 14 bp, Homo sapiens
ccagctctatccca

SEQ ID NO: 5867200 - DNA, 14 bp, Homo sapiens
ccagctctcagcca

SEQ ID NO: 5867201 - DNA, 15 bp, Homo sapiens
ccagctctcagccaa

SEQ ID NO: 5867202 - DNA, 12 bp, Homo sapiens
ccagctctcagg

SEQ ID NO: 5867203 - DNA, 18 bp, Homo sapiens
ccagctctcagggctgtc

SEQ ID NO: 5867204 - DNA, 12 bp, Homo sapiens
ccagctctccca

SEQ ID NO: 5867205 - DNA, 19 bp, Homo sapiens
ccagctctcccatggagcc

SEQ ID NO: 5867206 - DNA, 14 bp, Homo sapiens
ccagctctcccctg

SEQ ID NO: 5867207 - DNA, 17 bp, Homo sapiens
ccagctctcccctgcgc

SEQ ID NO: 5867208 - DNA, 16 bp, Homo sapiens
ccagctctccctctgg

SEQ ID NO: 5867209 - DNA, 22 bp, Homo sapiens
ccagctctccctctggccctgc

SEQ ID NO: 5867210 - DNA, 16 bp, Homo sapiens
ccagctctctctaccc

SEQ ID NO: 5867211 - DNA, 12 bp, Homo sapiens
ccagctctctga

SEQ ID NO: 5867212 - DNA, 16 bp, Homo sapiens
ccagctctctgacgct

SEQ ID NO: 5867213 - DNA, 23 bp, Homo sapiens
ccagctctctgacgcttgtgaca

SEQ ID NO: 5867214 - DNA, 21 bp, Homo sapiens
ccagctctgacatcccttcct

SEQ ID NO: 5867215 - DNA, 15 bp, Homo sapiens
ccagctctgagggga

SEQ ID NO: 5867216 - DNA, 12 bp, Homo sapiens
ccagctctgccc

SEQ ID NO: 5867217 - DNA, 15 bp, Homo sapiens
ccagctctgcccccg

SEQ ID NO: 5867218 - DNA, 11 bp, Homo sapiens
ccagctctgga

SEQ ID NO: 5867219 - DNA, 14 bp, Homo sapiens
ccagctctggcaca

SEQ ID NO: 5867220 - DNA, 21 bp, Homo sapiens
ccagctctggtccatagagag

SEQ ID NO: 5867221 - DNA, 21 bp, Homo sapiens
ccaggacccctgtccaggatg

SEQ ID NO: 5867222 - DNA, 15 bp, Homo sapiens
ccaggacccgccagc

SEQ ID NO: 5867223 - DNA, 16 bp, Homo sapiens
ccaggacccgccagcc

SEQ ID NO: 5867224 - DNA, 17 bp, Homo sapiens
ccaggacccgccagccc

SEQ ID NO: 5867225 - DNA, 21 bp, Homo sapiens
ccaggacccgccagccccgct

SEQ ID NO: 5867226 - DNA, 20 bp, Homo sapiens
ccaggaccctccactcactg

SEQ ID NO: 5867227 - DNA, 23 bp, Homo sapiens
ccaggaccctgaaggggccatga

SEQ ID NO: 5867228 - DNA, 14 bp, Homo sapiens
ccaggaccctgcca

SEQ ID NO: 5867229 - DNA, 15 bp, Homo sapiens
ccaggaccctgccag

SEQ ID NO: 5867230 - DNA, 17 bp, Homo sapiens
ccaggaccctgccaggc

SEQ ID NO: 5867231 - DNA, 18 bp, Homo sapiens
ccaggaccctgccaggca

SEQ ID NO: 5867232 - DNA, 22 bp, Homo sapiens
ccaggaccctgggtcaccttcc

SEQ ID NO: 5867233 - DNA, 19 bp, Homo sapiens
ccaggaccctttctccaca

SEQ ID NO: 5867234 - DNA, 16 bp, Homo sapiens
ccaggacctccggagc

SEQ ID NO: 5867235 - DNA, 13 bp, Homo sapiens
ccaggacctctgg

SEQ ID NO: 5867236 - DNA, 15 bp, Homo sapiens
ccaggacctggctgc

SEQ ID NO: 5867237 - DNA, 16 bp, Homo sapiens
ccaggacgcatgcagg

SEQ ID NO: 5867238 - DNA, 20 bp, Homo sapiens
ccaggacgccactcatttca

SEQ ID NO: 5867239 - DNA, 15 bp, Homo sapiens
ccaggacgcttctga

SEQ ID NO: 5867240 - DNA, 18 bp, Homo sapiens
ccaggacgcttctgaatg

SEQ ID NO: 5867241 - DNA, 23 bp, Homo sapiens
ccaggacggggccggccaggtgg

SEQ ID NO: 5867242 - DNA, 17 bp, Homo sapiens
ccaggacgtcctatctc

SEQ ID NO: 5867243 - DNA, 18 bp, Homo sapiens
ccaggacgtcctatctcc

SEQ ID NO: 5867244 - DNA, 20 bp, Homo sapiens
ccaggactatagcccaggtc

SEQ ID NO: 5867245 - DNA, 21 bp, Homo sapiens
ccaggactatatttgggcctg

SEQ ID NO: 5867246 - DNA, 15 bp, Homo sapiens
ccaggactcagggac

SEQ ID NO: 5867247 - DNA, 19 bp, Homo sapiens
ccaggactccactggacag

SEQ ID NO: 5867248 - DNA, 22 bp, Homo sapiens
ccaggactccactggacagacc

SEQ ID NO: 5867249 - DNA, 13 bp, Homo sapiens
ccaggactcccag

SEQ ID NO: 5867250 - DNA, 16 bp, Homo sapiens
ccaggactcccagaac

SEQ ID NO: 5867251 - DNA, 17 bp, Homo sapiens
ccaggactcccagaacc

SEQ ID NO: 5867252 - DNA, 18 bp, Homo sapiens
ccaggactcccagaacct

SEQ ID NO: 5867253 - DNA, 15 bp, Homo sapiens
ccaggactccccagg

SEQ ID NO: 5867254 - DNA, 17 bp, Homo sapiens
ccaggactccccaggcc

SEQ ID NO: 5867255 - DNA, 21 bp, Homo sapiens
ccaggactccccaggccaggc

SEQ ID NO: 5867256 - DNA, 22 bp, Homo sapiens
ccaggactccccaggccaggcc

SEQ ID NO: 5867257 - DNA, 17 bp, Homo sapiens
ccaggactccctcctca

SEQ ID NO: 5867258 - DNA, 11 bp, Homo sapiens
ccaggactctg

SEQ ID NO: 5867259 - DNA, 13 bp, Homo sapiens
ccaggactctgac

SEQ ID NO: 5867260 - DNA, 14 bp, Homo sapiens
ccaggactctgacc

SEQ ID NO: 5867261 - DNA, 12 bp, Homo sapiens
ccaggactctgc

SEQ ID NO: 5867262 - DNA, 15 bp, Homo sapiens
ccaggactctgcagc

SEQ ID NO: 5867263 - DNA, 22 bp, Homo sapiens
ccaggactctgcagcctcagag

SEQ ID NO: 5867264 - DNA, 13 bp, Homo sapiens
ccaggactctgcc

SEQ ID NO: 5867265 - DNA, 14 bp, Homo sapiens
ccaggactctgccc

SEQ ID NO: 5867266 - DNA, 18 bp, Homo sapiens
ccaggactctgccttcca

SEQ ID NO: 5867267 - DNA, 20 bp, Homo sapiens
ccaggactctgccttccagg

SEQ ID NO: 5867268 - DNA, 14 bp, Homo sapiens
ccaggactgaaaga

SEQ ID NO: 5867269 - DNA, 13 bp, Homo sapiens
ccaggactgagcc

SEQ ID NO: 5867270 - DNA, 14 bp, Homo sapiens
ccaggactgagccc

SEQ ID NO: 5867271 - DNA, 19 bp, Homo sapiens
ccaggactgagccccgcag

SEQ ID NO: 5867272 - DNA, 22 bp, Homo sapiens
ccaggactggggcttgccaggc

SEQ ID NO: 5867273 - DNA, 15 bp, Homo sapiens
ccaggactgggtctg

SEQ ID NO: 5867274 - DNA, 19 bp, Homo sapiens
ccaggactgggtctgacct

SEQ ID NO: 5867275 - DNA, 23 bp, Homo sapiens
ccaggactgtgataatcagaagc

SEQ ID NO: 5867276 - DNA, 16 bp, Homo sapiens
ccaggactgtttcaaa

SEQ ID NO: 5867277 - DNA, 19 bp, Homo sapiens
ccaggacttggggtcagga

SEQ ID NO: 5867278 - DNA, 20 bp, Homo sapiens
ccaggacttggggtcaggaa

SEQ ID NO: 5867279 - DNA, 17 bp, Homo sapiens
ccaggagaaagccgggg

SEQ ID NO: 5867280 - DNA, 19 bp, Homo sapiens
ccaggagaaccactacatg

SEQ ID NO: 5867281 - DNA, 13 bp, Homo sapiens
ccaggagaagacc

SEQ ID NO: 5867282 - DNA, 21 bp, Homo sapiens
ccaggagaagacccctgccca

SEQ ID NO: 5867283 - DNA, 14 bp, Homo sapiens
ccaggagaagctca

SEQ ID NO: 5867284 - DNA, 17 bp, Homo sapiens
ccaggagaagctcagct

SEQ ID NO: 5867285 - DNA, 19 bp, Homo sapiens
ccaggagaagggctggggc

SEQ ID NO: 5867286 - DNA, 15 bp, Homo sapiens
ccaggagaaggtcag

SEQ ID NO: 5867287 - DNA, 18 bp, Homo sapiens
ccaggagaagtgctccct

SEQ ID NO: 5867288 - DNA, 21 bp, Homo sapiens
ccaggagaagtgctccctgga

SEQ ID NO: 5867289 - DNA, 23 bp, Homo sapiens
ccaggagaagtgctccctggagg

SEQ ID NO: 5867290 - DNA, 16 bp, Homo sapiens
ccaggagaagttgagg

SEQ ID NO: 5867291 - DNA, 23 bp, Homo sapiens
ccaggagaattaggaaggccatg

SEQ ID NO: 5867292 - DNA, 22 bp, Homo sapiens
ccaggagacagaccacttgcca

SEQ ID NO: 5867293 - DNA, 23 bp, Homo sapiens
ccaggagacagaccacttgccac

SEQ ID NO: 5867294 - DNA, 13 bp, Homo sapiens
ccaggagaccctg

SEQ ID NO: 5867295 - DNA, 17 bp, Homo sapiens
ccaggagaccctgtctt

SEQ ID NO: 5867296 - DNA, 18 bp, Homo sapiens
ccaggagacctgctctcc

SEQ ID NO: 5867297 - DNA, 15 bp, Homo sapiens
ccaggagaccttcca

SEQ ID NO: 5867298 - DNA, 19 bp, Homo sapiens
ccaggagagaccttctctt

SEQ ID NO: 5867299 - DNA, 20 bp, Homo sapiens
ccaggagagaccttctctta

SEQ ID NO: 5867300 - DNA, 15 bp, Homo sapiens
ccaggagagagaaag

SEQ ID NO: 5867301 - DNA, 15 bp, Homo sapiens
ccaggagagagccag

SEQ ID NO: 5867302 - DNA, 13 bp, Homo sapiens
ccaggagagccag

SEQ ID NO: 5867303 - DNA, 16 bp, Homo sapiens
ccaggagagccagccc

SEQ ID NO: 5867304 - DNA, 17 bp, Homo sapiens
ccaggagagccagccct

SEQ ID NO: 5867305 - DNA, 16 bp, Homo sapiens
ccaggagagcttaggg

SEQ ID NO: 5867306 - DNA, 23 bp, Homo sapiens
ccaggagagcttagggtctcagg

SEQ ID NO: 5867307 - DNA, 16 bp, Homo sapiens
ccaggagatggcccca

SEQ ID NO: 5867308 - DNA, 18 bp, Homo sapiens
ccaggagatggccccaac

SEQ ID NO: 5867309 - DNA, 12 bp, Homo sapiens
ccaggagatggg

SEQ ID NO: 5867310 - DNA, 21 bp, Homo sapiens
ccaggagatgggtccaggggt

SEQ ID NO: 5867311 - DNA, 17 bp, Homo sapiens
ccaggagattcagagct

SEQ ID NO: 5867312 - DNA, 17 bp, Homo sapiens
ccaggagcaaatgctgg

SEQ ID NO: 5867313 - DNA, 15 bp, Homo sapiens
ccaggagcaaatgtt

SEQ ID NO: 5867314 - DNA, 19 bp, Homo sapiens
ccaggagcaaatgtttctg

SEQ ID NO: 5867315 - DNA, 21 bp, Homo sapiens
ccaggagcaacgccagtggca

SEQ ID NO: 5867316 - DNA, 21 bp, Homo sapiens
ccaggagcaatgggactggag

SEQ ID NO: 5867317 - DNA, 15 bp, Homo sapiens
ccaggagcacacggc

SEQ ID NO: 5867318 - DNA, 21 bp, Homo sapiens
ccaggagcacacggccctgcc

SEQ ID NO: 5867319 - DNA, 19 bp, Homo sapiens
ccaggagcacggctctgtc

SEQ ID NO: 5867320 - DNA, 22 bp, Homo sapiens
ccaggagcacggctctgtcccc

SEQ ID NO: 5867321 - DNA, 13 bp, Homo sapiens
ccaggagcagaag

SEQ ID NO: 5867322 - DNA, 18 bp, Homo sapiens
ccaggagcagatggacag

SEQ ID NO: 5867323 - DNA, 19 bp, Homo sapiens
ccaggagcagatggacagc

SEQ ID NO: 5867324 - DNA, 19 bp, Homo sapiens
ccaggagcagcagccagca

SEQ ID NO: 5867325 - DNA, 20 bp, Homo sapiens
ccaggagcagcagccagcac

SEQ ID NO: 5867326 - DNA, 15 bp, Homo sapiens
ccaggagcagccctg

SEQ ID NO: 5867327 - DNA, 19 bp, Homo sapiens
ccaggagcagccctggccc

SEQ ID NO: 5867328 - DNA, 16 bp, Homo sapiens
ccaggagcagcgtgca

SEQ ID NO: 5867329 - DNA, 13 bp, Homo sapiens
ccaggagcagctt

SEQ ID NO: 5867330 - DNA, 22 bp, Homo sapiens
ccaggagcaggacctactagga

SEQ ID NO: 5867331 - DNA, 22 bp, Homo sapiens
ccaggagcatagaagccacatc

SEQ ID NO: 5867332 - DNA, 14 bp, Homo sapiens
ccaggagccaggtg

SEQ ID NO: 5867333 - DNA, 19 bp, Homo sapiens
ccaggagccaggtgtcctg

SEQ ID NO: 5867334 - DNA, 18 bp, Homo sapiens
ccaggagccatgacaggg

SEQ ID NO: 5867335 - DNA, 22 bp, Homo sapiens
ccaggagccccagccagccctt

SEQ ID NO: 5867336 - DNA, 15 bp, Homo sapiens
ccaggagccccgagg

SEQ ID NO: 5867337 - DNA, 20 bp, Homo sapiens
ccaggagccccgaggccttc

SEQ ID NO: 5867338 - DNA, 21 bp, Homo sapiens
ccaggagcccgtcaggccaca

SEQ ID NO: 5867339 - DNA, 12 bp, Homo sapiens
ccaggagccctg

SEQ ID NO: 5867340 - DNA, 21 bp, Homo sapiens
ccaggagccggacacttctca

SEQ ID NO: 5867341 - DNA, 23 bp, Homo sapiens
ccaggagccggacacttctcagg

SEQ ID NO: 5867342 - DNA, 19 bp, Homo sapiens
ccaggagccgggcctccca

SEQ ID NO: 5867343 - DNA, 13 bp, Homo sapiens
ccaggagcctcac

SEQ ID NO: 5867344 - DNA, 18 bp, Homo sapiens
ccaggagcctcatccagc

SEQ ID NO: 5867345 - DNA, 21 bp, Homo sapiens
ccaggagcctcatccagcctc

SEQ ID NO: 5867346 - DNA, 14 bp, Homo sapiens
ccaggagcctcctg

SEQ ID NO: 5867347 - DNA, 16 bp, Homo sapiens
ccaggagcctggaggg

SEQ ID NO: 5867348 - DNA, 17 bp, Homo sapiens
ccaggagcctgtgcctc

SEQ ID NO: 5867349 - DNA, 13 bp, Homo sapiens
ccaggagctaatc

SEQ ID NO: 5867350 - DNA, 19 bp, Homo sapiens
ccaggagctagcccagtcc

SEQ ID NO: 5867351 - DNA, 20 bp, Homo sapiens
ccaggagctagcccagtccc

SEQ ID NO: 5867352 - DNA, 14 bp, Homo sapiens
ccaggagctccagt

SEQ ID NO: 5867353 - DNA, 19 bp, Homo sapiens
ccaggagctcccctcccca

SEQ ID NO: 5867354 - DNA, 20 bp, Homo sapiens
ccaggagctcccctccccaa

SEQ ID NO: 5867355 - DNA, 16 bp, Homo sapiens
ccaggagctctctgct

SEQ ID NO: 5867356 - DNA, 18 bp, Homo sapiens
ccaggagctctctgctga

SEQ ID NO: 5867357 - DNA, 21 bp, Homo sapiens
ccaggagctctctgctgagca

SEQ ID NO: 5867358 - DNA, 16 bp, Homo sapiens
ccaggagctctgcgcc

SEQ ID NO: 5867359 - DNA, 22 bp, Homo sapiens
ccaggagctctgcgccaggcag

SEQ ID NO: 5867360 - DNA, 23 bp, Homo sapiens
ccaggagctcttcaggcctccct

SEQ ID NO: 5867361 - DNA, 22 bp, Homo sapiens
ccaggagctgagtcacctcctc

SEQ ID NO: 5867362 - DNA, 12 bp, Homo sapiens
ccaggagctgga

SEQ ID NO: 5867363 - DNA, 22 bp, Homo sapiens
ccaggagcttcttgtttccttg

SEQ ID NO: 5867364 - DNA, 15 bp, Homo sapiens
ccaggaggaacaaag

SEQ ID NO: 5867365 - DNA, 23 bp, Homo sapiens
ccaggaggaacaaagagattgtg

SEQ ID NO: 5867366 - DNA, 21 bp, Homo sapiens
ccaggaggacccagggctctg

SEQ ID NO: 5867367 - DNA, 19 bp, Homo sapiens
ccaggaggaccgcctgccc

SEQ ID NO: 5867368 - DNA, 14 bp, Homo sapiens
ccaggaggacctgg

SEQ ID NO: 5867369 - DNA, 14 bp, Homo sapiens
ccaggaggactgcc

SEQ ID NO: 5867370 - DNA, 17 bp, Homo sapiens
ccaggaggagaccctcc

SEQ ID NO: 5867371 - DNA, 21 bp, Homo sapiens
ccaggaggagaccctcccctg

SEQ ID NO: 5867372 - DNA, 23 bp, Homo sapiens
ccaggaggagaccctcccctgcc

SEQ ID NO: 5867373 - DNA, 20 bp, Homo sapiens
ccaggaggagagagatgctg

SEQ ID NO: 5867374 - DNA, 20 bp, Homo sapiens
ccaggaggaggattgtgctg

SEQ ID NO: 5867375 - DNA, 23 bp, Homo sapiens
ccaggaggaggattgtgctgatg

SEQ ID NO: 5867376 - DNA, 23 bp, Homo sapiens
ccaggaggccgagtggctgccgg

SEQ ID NO: 5867377 - DNA, 22 bp, Homo sapiens
ccaggaggccggggggagcagg

SEQ ID NO: 5867378 - DNA, 13 bp, Homo sapiens
ccaggaggcggca

SEQ ID NO: 5867379 - DNA, 15 bp, Homo sapiens
ccaggaggcggcagc

SEQ ID NO: 5867380 - DNA, 22 bp, Homo sapiens
ccaggaggcggcagctcttctg

SEQ ID NO: 5867381 - DNA, 19 bp, Homo sapiens
ccaggaggctgaggcagga

SEQ ID NO: 5867382 - DNA, 16 bp, Homo sapiens
ccaggaggctgaggtg

SEQ ID NO: 5867383 - DNA, 16 bp, Homo sapiens
ccaggaggctgcggcc

SEQ ID NO: 5867384 - DNA, 22 bp, Homo sapiens
ccaggaggctttaagctccagc

SEQ ID NO: 5867385 - DNA, 16 bp, Homo sapiens
ccaggagggacaaagg

SEQ ID NO: 5867386 - DNA, 17 bp, Homo sapiens
ccaggagggacaaagga

SEQ ID NO: 5867387 - DNA, 22 bp, Homo sapiens
ccaggagggagagcctctgttt

SEQ ID NO: 5867388 - DNA, 17 bp, Homo sapiens
ccaggagggcactggag

SEQ ID NO: 5867389 - DNA, 17 bp, Homo sapiens
ccaggagggcatccata

SEQ ID NO: 5867390 - DNA, 20 bp, Homo sapiens
ccaggagggcatccatacca

SEQ ID NO: 5867391 - DNA, 21 bp, Homo sapiens
ccaggaggggaacactgccct

SEQ ID NO: 5867392 - DNA, 22 bp, Homo sapiens
ccaggaggggaacactgccctc

SEQ ID NO: 5867393 - DNA, 12 bp, Homo sapiens
ccaggaggggcc

SEQ ID NO: 5867394 - DNA, 15 bp, Homo sapiens
ccaggaggggcctct

SEQ ID NO: 5867395 - DNA, 17 bp, Homo sapiens
ccaggaggggcctctga

SEQ ID NO: 5867396 - DNA, 19 bp, Homo sapiens
ccaggaggggtctgcctcc

SEQ ID NO: 5867397 - DNA, 17 bp, Homo sapiens
ccaggcaggtctgaagc

SEQ ID NO: 5867398 - DNA, 15 bp, Homo sapiens
ccaggcaggtctgca

SEQ ID NO: 5867399 - DNA, 22 bp, Homo sapiens
ccaggcaggtctgcaagggccc

SEQ ID NO: 5867400 - DNA, 23 bp, Homo sapiens
ccaggcaggtcttgaactcctgg

SEQ ID NO: 5867401 - DNA, 19 bp, Homo sapiens
ccaggcaggtgcctggaca

SEQ ID NO: 5867402 - DNA, 20 bp, Homo sapiens
ccaggcatcactgattccct

SEQ ID NO: 5867403 - DNA, 22 bp, Homo sapiens
ccaggcatcactgattccctct

SEQ ID NO: 5867404 - DNA, 16 bp, Homo sapiens
ccaggcatcccatccc

SEQ ID NO: 5867405 - DNA, 15 bp, Homo sapiens
ccaggcatctccttg

SEQ ID NO: 5867406 - DNA, 22 bp, Homo sapiens
ccaggcatctgttagcagagtc

SEQ ID NO: 5867407 - DNA, 24 bp, Homo sapiens
ccaggcatctgttagcagagtctg

SEQ ID NO: 5867408 - DNA, 22 bp, Homo sapiens
ccaggcatgaccctggagcccg

SEQ ID NO: 5867409 - DNA, 19 bp, Homo sapiens
ccaggcatgcagctgcctg

SEQ ID NO: 5867410 - DNA, 22 bp, Homo sapiens
ccaggcatgcagctgcctgggg

SEQ ID NO: 5867411 - DNA, 16 bp, Homo sapiens
ccaggcatgctggcct

SEQ ID NO: 5867412 - DNA, 13 bp, Homo sapiens
ccaggcatggtgg

SEQ ID NO: 5867413 - DNA, 21 bp, Homo sapiens
ccaggcatgtcctaggctctg

SEQ ID NO: 5867414 - DNA, 20 bp, Homo sapiens
ccaggcatgtgtctggccct

SEQ ID NO: 5867415 - DNA, 18 bp, Homo sapiens
ccaggcattccccaggag

SEQ ID NO: 5867416 - DNA, 19 bp, Homo sapiens
ccaggcattccccaggagg

SEQ ID NO: 5867417 - DNA, 20 bp, Homo sapiens
ccaggcatttagccctcaca

SEQ ID NO: 5867418 - DNA, 17 bp, Homo sapiens
ccaggccaacagcacct

SEQ ID NO: 5867419 - DNA, 18 bp, Homo sapiens
ccaggccaacagcacctc

SEQ ID NO: 5867420 - DNA, 16 bp, Homo sapiens
ccaggccaactgcccc

SEQ ID NO: 5867421 - DNA, 12 bp, Homo sapiens
ccaggccacaga

SEQ ID NO: 5867422 - DNA, 13 bp, Homo sapiens
ccaggccacagcc

SEQ ID NO: 5867423 - DNA, 16 bp, Homo sapiens
ccaggccacagccagg

SEQ ID NO: 5867424 - DNA, 14 bp, Homo sapiens
ccaggccacagccg

SEQ ID NO: 5867425 - DNA, 16 bp, Homo sapiens
ccaggccacagccgcc

SEQ ID NO: 5867426 - DNA, 17 bp, Homo sapiens
ccaggccacagccgcct

SEQ ID NO: 5867427 - DNA, 12 bp, Homo sapiens
ccaggccaccag

SEQ ID NO: 5867428 - DNA, 13 bp, Homo sapiens
ccaggccacctcc

SEQ ID NO: 5867429 - DNA, 16 bp, Homo sapiens
ccaggccacctcccca

SEQ ID NO: 5867430 - DNA, 17 bp, Homo sapiens
ccaggccactctcagag

SEQ ID NO: 5867431 - DNA, 16 bp, Homo sapiens
ccaggccactgggccc

SEQ ID NO: 5867432 - DNA, 14 bp, Homo sapiens
ccaggccactgtgg

SEQ ID NO: 5867433 - DNA, 16 bp, Homo sapiens
ccaggccactgtggcc

SEQ ID NO: 5867434 - DNA, 19 bp, Homo sapiens
ccaggccagcccccccacc

SEQ ID NO: 5867435 - DNA, 23 bp, Homo sapiens
ccaggccagcccccccacccacc

SEQ ID NO: 5867436 - DNA, 13 bp, Homo sapiens
ccaggccagctca

SEQ ID NO: 5867437 - DNA, 14 bp, Homo sapiens
ccaggccagctcag

SEQ ID NO: 5867438 - DNA, 15 bp, Homo sapiens
ccaggccagctgcct

SEQ ID NO: 5867439 - DNA, 13 bp, Homo sapiens
ccaggccaggacc

SEQ ID NO: 5867440 - DNA, 14 bp, Homo sapiens
ccaggccaggacca

SEQ ID NO: 5867441 - DNA, 15 bp, Homo sapiens
ccaggccaggaccac

SEQ ID NO: 5867442 - DNA, 17 bp, Homo sapiens
ccaggccaggaccacac

SEQ ID NO: 5867443 - DNA, 19 bp, Homo sapiens
ccaggccaggactctgcag

SEQ ID NO: 5867444 - DNA, 12 bp, Homo sapiens
ccaggccaggct

SEQ ID NO: 5867445 - DNA, 13 bp, Homo sapiens
ccaggccaggctc

SEQ ID NO: 5867446 - DNA, 15 bp, Homo sapiens
ccaggccagggctcc

SEQ ID NO: 5867447 - DNA, 15 bp, Homo sapiens
ccaggccagggctgg

SEQ ID NO: 5867448 - DNA, 17 bp, Homo sapiens
ccaggccagggctgggt

SEQ ID NO: 5867449 - DNA, 13 bp, Homo sapiens
ccaggccaggtag

SEQ ID NO: 5867450 - DNA, 16 bp, Homo sapiens
ccaggccaggtagcaa

SEQ ID NO: 5867451 - DNA, 17 bp, Homo sapiens
ccaggccaggtccctgg

SEQ ID NO: 5867452 - DNA, 13 bp, Homo sapiens
ccaggccaggtgc

SEQ ID NO: 5867453 - DNA, 14 bp, Homo sapiens
ccaggccaggtgcc

SEQ ID NO: 5867454 - DNA, 14 bp, Homo sapiens
ccaggccagtgctg

SEQ ID NO: 5867455 - DNA, 15 bp, Homo sapiens
ccaggccagtgggcc

SEQ ID NO: 5867456 - DNA, 13 bp, Homo sapiens
ccaggccatacca

SEQ ID NO: 5867457 - DNA, 18 bp, Homo sapiens
ccaggccataccaggtgc

SEQ ID NO: 5867458 - DNA, 22 bp, Homo sapiens
ccaggccatcaccacagctgca

SEQ ID NO: 5867459 - DNA, 14 bp, Homo sapiens
ccaggccatcagag

SEQ ID NO: 5867460 - DNA, 16 bp, Homo sapiens
ccaggccatggaggca

SEQ ID NO: 5867461 - DNA, 12 bp, Homo sapiens
ccaggccatggc

SEQ ID NO: 5867462 - DNA, 13 bp, Homo sapiens
ccaggccatggcc

SEQ ID NO: 5867463 - DNA, 17 bp, Homo sapiens
ccaggccatgtggcctg

SEQ ID NO: 5867464 - DNA, 18 bp, Homo sapiens
ccaggccatgtggcctgc

SEQ ID NO: 5867465 - DNA, 21 bp, Homo sapiens
ccaggccatgtggcctgccca

SEQ ID NO: 5867466 - DNA, 22 bp, Homo sapiens
ccaggccatgtggcctgcccag

SEQ ID NO: 5867467 - DNA, 23 bp, Homo sapiens
ccaggccatgtggcctgcccagc

SEQ ID NO: 5867468 - DNA, 15 bp, Homo sapiens
ccaggcccaaggctc

SEQ ID NO: 5867469 - DNA, 19 bp, Homo sapiens
ccaggcccaaggctcccgg

SEQ ID NO: 5867470 - DNA, 17 bp, Homo sapiens
ccaggcccaccatcacc

SEQ ID NO: 5867471 - DNA, 16 bp, Homo sapiens
ccaggcccactcaggg

SEQ ID NO: 5867472 - DNA, 17 bp, Homo sapiens
ccaggcccactgtgcct

SEQ ID NO: 5867473 - DNA, 13 bp, Homo sapiens
ccaggcccagcca

SEQ ID NO: 5867474 - DNA, 15 bp, Homo sapiens
ccaggcccagccctc

SEQ ID NO: 5867475 - DNA, 16 bp, Homo sapiens
ccaggcccagccctcc

SEQ ID NO: 5867476 - DNA, 13 bp, Homo sapiens
ccaggcccagcct

SEQ ID NO: 5867477 - DNA, 14 bp, Homo sapiens
ccaggcccagcctc

SEQ ID NO: 5867478 - DNA, 16 bp, Homo sapiens
ccaggcccagcctctt

SEQ ID NO: 5867479 - DNA, 14 bp, Homo sapiens
ccaggcccaggcag

SEQ ID NO: 5867480 - DNA, 16 bp, Homo sapiens
ccaggcccaggcagag

SEQ ID NO: 5867481 - DNA, 14 bp, Homo sapiens
ccaggcccaggcct

SEQ ID NO: 5867482 - DNA, 16 bp, Homo sapiens
ccaggcccatctcagg

SEQ ID NO: 5867483 - DNA, 19 bp, Homo sapiens
ccaggcccatctcaggtgc

SEQ ID NO: 5867484 - DNA, 18 bp, Homo sapiens
ccaggcccatgccaaggc

SEQ ID NO: 5867485 - DNA, 16 bp, Homo sapiens
ccaggccccacccctt

SEQ ID NO: 5867486 - DNA, 20 bp, Homo sapiens
ccaggccccaccccttccct

SEQ ID NO: 5867487 - DNA, 20 bp, Homo sapiens
ccaggccccaccggccaggc

SEQ ID NO: 5867488 - DNA, 16 bp, Homo sapiens
ccaggccccagacagg

SEQ ID NO: 5867489 - DNA, 15 bp, Homo sapiens
ccaggccccaggaag

SEQ ID NO: 5867490 - DNA, 16 bp, Homo sapiens
ccaggccccaggctgg

SEQ ID NO: 5867491 - DNA, 17 bp, Homo sapiens
ccaggccccaggggaga

SEQ ID NO: 5867492 - DNA, 14 bp, Homo sapiens
ccaggccccatcag

SEQ ID NO: 5867493 - DNA, 13 bp, Homo sapiens
ccaggccccatga

SEQ ID NO: 5867494 - DNA, 22 bp, Homo sapiens
ccaggccccatgacctccagct

SEQ ID NO: 5867495 - DNA, 18 bp, Homo sapiens
ccaggccccatggagggt

SEQ ID NO: 5867496 - DNA, 15 bp, Homo sapiens
ccaggcccccaaccc

SEQ ID NO: 5867497 - DNA, 22 bp, Homo sapiens
ccaggcccccaacccctcctcc

SEQ ID NO: 5867498 - DNA, 21 bp, Homo sapiens
ccaggcccccaacccctcctt

SEQ ID NO: 5867499 - DNA, 19 bp, Homo sapiens
ccaggcccccaccacacat

SEQ ID NO: 5867500 - DNA, 21 bp, Homo sapiens
ccaggcccccaccacacatcc

SEQ ID NO: 5867501 - DNA, 22 bp, Homo sapiens
ccaggcccccaccacacatccc

SEQ ID NO: 5867502 - DNA, 23 bp, Homo sapiens
ccaggcccccaccacacatccca

SEQ ID NO: 5867503 - DNA, 17 bp, Homo sapiens
ccaggcccccagcccct

SEQ ID NO: 5867504 - DNA, 20 bp, Homo sapiens
ccaggcccccagcccctcct

SEQ ID NO: 5867505 - DNA, 15 bp, Homo sapiens
ccaggcccccctgtc

SEQ ID NO: 5867506 - DNA, 11 bp, Homo sapiens
ccaggcccccg

SEQ ID NO: 5867507 - DNA, 18 bp, Homo sapiens
ccaggcccccggctttcc

SEQ ID NO: 5867508 - DNA, 21 bp, Homo sapiens
ccaggcccccgttgaagccgc

SEQ ID NO: 5867509 - DNA, 17 bp, Homo sapiens
ccaggccccctgcatct

SEQ ID NO: 5867510 - DNA, 19 bp, Homo sapiens
ccaggccccgaggacccag

SEQ ID NO: 5867511 - DNA, 20 bp, Homo sapiens
ccaggccccgctcattcttt

SEQ ID NO: 5867512 - DNA, 15 bp, Homo sapiens
ccaggcccctgagga

SEQ ID NO: 5867513 - DNA, 23 bp, Homo sapiens
ccaggcccctgaggactggagac

SEQ ID NO: 5867514 - DNA, 16 bp, Homo sapiens
ccaggcccctgccccc

SEQ ID NO: 5867515 - DNA, 23 bp, Homo sapiens
ccaggcccctggaggctgcctcc

SEQ ID NO: 5867516 - DNA, 22 bp, Homo sapiens
ccaggcccgcaccccggcctca

SEQ ID NO: 5867517 - DNA, 24 bp, Homo sapiens
ccaggcccgcaccccggcctcagg

SEQ ID NO: 5867518 - DNA, 15 bp, Homo sapiens
ccaggcccgcactgg

SEQ ID NO: 5867519 - DNA, 16 bp, Homo sapiens
ccaggcccgcgggcac

SEQ ID NO: 5867520 - DNA, 21 bp, Homo sapiens
ccaggcccggggctggcggct

SEQ ID NO: 5867521 - DNA, 17 bp, Homo sapiens
ccaggcccgtctgtcca

SEQ ID NO: 5867522 - DNA, 18 bp, Homo sapiens
ccaggcccgtctgtccat

SEQ ID NO: 5867523 - DNA, 20 bp, Homo sapiens
ccaggcccgtctgtccatct

SEQ ID NO: 5867524 - DNA, 22 bp, Homo sapiens
ccaggcccgtctgtccatctgc

SEQ ID NO: 5867525 - DNA, 12 bp, Homo sapiens
ccaggcccgtgg

SEQ ID NO: 5867526 - DNA, 18 bp, Homo sapiens
ccaggcccgtgggcgcaa

SEQ ID NO: 5867527 - DNA, 13 bp, Homo sapiens
ccaggccctacaa

SEQ ID NO: 5867528 - DNA, 12 bp, Homo sapiens
ccaggccctcag

SEQ ID NO: 5867529 - DNA, 23 bp, Homo sapiens
ccaggccctcagtcttcctgccg

SEQ ID NO: 5867530 - DNA, 16 bp, Homo sapiens
ccaggccctccagcag

SEQ ID NO: 5867531 - DNA, 19 bp, Homo sapiens
ccaggccctccatgggcta

SEQ ID NO: 5867532 - DNA, 20 bp, Homo sapiens
ccaggccctccatgggctag

SEQ ID NO: 5867533 - DNA, 12 bp, Homo sapiens
ccaggccctccc

SEQ ID NO: 5867534 - DNA, 13 bp, Homo sapiens
ccaggccctccca

SEQ ID NO: 5867535 - DNA, 21 bp, Homo sapiens
ccaggccctcccaccacccca

SEQ ID NO: 5867536 - DNA, 18 bp, Homo sapiens
ccaggccctccgcaggct

SEQ ID NO: 5867537 - DNA, 16 bp, Homo sapiens
ccaggccctcctgctg

SEQ ID NO: 5867538 - DNA, 18 bp, Homo sapiens
ccaggccctcctgctggc

SEQ ID NO: 5867539 - DNA, 18 bp, Homo sapiens
ccaggccctctctgcagt

SEQ ID NO: 5867540 - DNA, 20 bp, Homo sapiens
ccaggccctctgcccactcc

SEQ ID NO: 5867541 - DNA, 21 bp, Homo sapiens
ccaggccctctgcccactccc

SEQ ID NO: 5867542 - DNA, 15 bp, Homo sapiens
ccaggccctgagagt

SEQ ID NO: 5867543 - DNA, 19 bp, Homo sapiens
ccaggccctgccagagcag

SEQ ID NO: 5867544 - DNA, 20 bp, Homo sapiens
ccaggccctgccagagcagg

SEQ ID NO: 5867545 - DNA, 14 bp, Homo sapiens
ccaggccctggagg

SEQ ID NO: 5867546 - DNA, 15 bp, Homo sapiens
ccaggccctggaggg

SEQ ID NO: 5867547 - DNA, 22 bp, Homo sapiens
ccaggccctggagggcagagac

SEQ ID NO: 5867548 - DNA, 18 bp, Homo sapiens
ccaggcccttcaggaact

SEQ ID NO: 5867549 - DNA, 19 bp, Homo sapiens
ccaggcccttggctgcagg

SEQ ID NO: 5867550 - DNA, 15 bp, Homo sapiens
ccaggccctttggct

SEQ ID NO: 5867551 - DNA, 16 bp, Homo sapiens
ccaggccctttggctt

SEQ ID NO: 5867552 - DNA, 18 bp, Homo sapiens
ccaggccctttggcttct

SEQ ID NO: 5867553 - DNA, 21 bp, Homo sapiens
ccaggccgacaggaggccatg

SEQ ID NO: 5867554 - DNA, 16 bp, Homo sapiens
ccaggccgcagctctt

SEQ ID NO: 5867555 - DNA, 16 bp, Homo sapiens
ccaggccgccccagcc

SEQ ID NO: 5867556 - DNA, 19 bp, Homo sapiens
ccaggccgcctgccatacc

SEQ ID NO: 5867557 - DNA, 21 bp, Homo sapiens
ccaggccgcgcccagcagagg

SEQ ID NO: 5867558 - DNA, 19 bp, Homo sapiens
ccaggccgcgccctttccc

SEQ ID NO: 5867559 - DNA, 16 bp, Homo sapiens
ccaggccggagcccag

SEQ ID NO: 5867560 - DNA, 18 bp, Homo sapiens
ccaggccggagcccagat

SEQ ID NO: 5867561 - DNA, 22 bp, Homo sapiens
ccaggccggcccagatgtgtcc

SEQ ID NO: 5867562 - DNA, 18 bp, Homo sapiens
ccaggccggcgagccctg

SEQ ID NO: 5867563 - DNA, 14 bp, Homo sapiens
ccaggccgggaaga

SEQ ID NO: 5867564 - DNA, 21 bp, Homo sapiens
ccaggccgggaagagccacct

SEQ ID NO: 5867565 - DNA, 19 bp, Homo sapiens
ccaggccgggcctgtacag

SEQ ID NO: 5867566 - DNA, 19 bp, Homo sapiens
ccaggccgtcctcccgggc

SEQ ID NO: 5867567 - DNA, 18 bp, Homo sapiens
ccaggccgtggctgccca

SEQ ID NO: 5867568 - DNA, 22 bp, Homo sapiens
ccaggccgttccccttggcttc

SEQ ID NO: 5867569 - DNA, 23 bp, Homo sapiens
ccaggcctagtaaccaaggccct

SEQ ID NO: 5867570 - DNA, 17 bp, Homo sapiens
ccaggcctccagaacct

SEQ ID NO: 5867571 - DNA, 13 bp, Homo sapiens
ccaggcctccagc

SEQ ID NO: 5867572 - DNA, 17 bp, Homo sapiens
ccaggcctccagcctct

SEQ ID NO: 5867573 - DNA, 19 bp, Homo sapiens
ccaggcctccagcctctcc

SEQ ID NO: 5867574 - DNA, 15 bp, Homo sapiens
ccaggcctccagctc

SEQ ID NO: 5867575 - DNA, 21 bp, Homo sapiens
ccaggctggtctcgaactcct

SEQ ID NO: 5867576 - DNA, 23 bp, Homo sapiens
ccaggctggtctcgaactcctga

SEQ ID NO: 5867577 - DNA, 22 bp, Homo sapiens
ccaggctgtgggcctcaaggac

SEQ ID NO: 5867578 - DNA, 21 bp, Homo sapiens
ccaggctgtgggtagatgtgc

SEQ ID NO: 5867579 - DNA, 23 bp, Homo sapiens
ccaggctgtgggtagatgtgcaa

SEQ ID NO: 5867580 - DNA, 23 bp, Homo sapiens
ccaggctgtgtttggctttcagg

SEQ ID NO: 5867581 - DNA, 14 bp, Homo sapiens
ccaggctgttctca

SEQ ID NO: 5867582 - DNA, 16 bp, Homo sapiens
ccaggctgttctcagc

SEQ ID NO: 5867583 - DNA, 18 bp, Homo sapiens
ccaggctgttctcagcgt

SEQ ID NO: 5867584 - DNA, 13 bp, Homo sapiens
ccaggctgtttca

SEQ ID NO: 5867585 - DNA, 13 bp, Homo sapiens
ccaggctgtttct

SEQ ID NO: 5867586 - DNA, 18 bp, Homo sapiens
ccaggcttactgagctgt

SEQ ID NO: 5867587 - DNA, 22 bp, Homo sapiens
ccaggcttagtcactgagacag

SEQ ID NO: 5867588 - DNA, 18 bp, Homo sapiens
ccaggcttcaccctgaat

SEQ ID NO: 5867589 - DNA, 22 bp, Homo sapiens
ccaggcttccacacttctgggc

SEQ ID NO: 5867590 - DNA, 17 bp, Homo sapiens
ccaggcttccgcgccca

SEQ ID NO: 5867591 - DNA, 21 bp, Homo sapiens
ccaggcttccgcgcccagcgc

SEQ ID NO: 5867592 - DNA, 22 bp, Homo sapiens
ccaggcttccgcgcccagcgct

SEQ ID NO: 5867593 - DNA, 13 bp, Homo sapiens
ccaggcttcctgc

SEQ ID NO: 5867594 - DNA, 14 bp, Homo sapiens
ccaggcttcctgcc

SEQ ID NO: 5867595 - DNA, 17 bp, Homo sapiens
ccaggcttcctgcccta

SEQ ID NO: 5867596 - DNA, 18 bp, Homo sapiens
ccaggcttcctgggtcct

SEQ ID NO: 5867597 - DNA, 16 bp, Homo sapiens
ccaggcttctcccgga

SEQ ID NO: 5867598 - DNA, 18 bp, Homo sapiens
ccaggcttctcccggacc

SEQ ID NO: 5867599 - DNA, 16 bp, Homo sapiens
ccaggcttctgctggg

SEQ ID NO: 5867600 - DNA, 23 bp, Homo sapiens
ccaggcttctgctggggcctggg

SEQ ID NO: 5867601 - DNA, 18 bp, Homo sapiens
ccaggcttgcctgcaggc

SEQ ID NO: 5867602 - DNA, 14 bp, Homo sapiens
ccaggcttgcctgg

SEQ ID NO: 5867603 - DNA, 15 bp, Homo sapiens
ccaggcttgcctggg

SEQ ID NO: 5867604 - DNA, 12 bp, Homo sapiens
ccaggcttggaa

SEQ ID NO: 5867605 - DNA, 23 bp, Homo sapiens
ccaggcttgtcactagcagctgc

SEQ ID NO: 5867606 - DNA, 12 bp, Homo sapiens
ccaggctttcta

SEQ ID NO: 5867607 - DNA, 21 bp, Homo sapiens
ccaggctttctggagttccca

SEQ ID NO: 5867608 - DNA, 19 bp, Homo sapiens
ccaggcttttttatcatgt

SEQ ID NO: 5867609 - DNA, 17 bp, Homo sapiens
ccagggaaacagcctct

SEQ ID NO: 5867610 - DNA, 22 bp, Homo sapiens
ccagggaaacagcctctctctt

SEQ ID NO: 5867611 - DNA, 16 bp, Homo sapiens
ccagggaaatgcctcg

SEQ ID NO: 5867612 - DNA, 14 bp, Homo sapiens
ccagggaacagccc

SEQ ID NO: 5867613 - DNA, 16 bp, Homo sapiens
ccagggaacagcccca

SEQ ID NO: 5867614 - DNA, 16 bp, Homo sapiens
ccagggaaccagagcg

SEQ ID NO: 5867615 - DNA, 17 bp, Homo sapiens
ccagggaaccagagcga

SEQ ID NO: 5867616 - DNA, 13 bp, Homo sapiens
ccagggaagaaac

SEQ ID NO: 5867617 - DNA, 17 bp, Homo sapiens
ccagggaagacagagca

SEQ ID NO: 5867618 - DNA, 21 bp, Homo sapiens
ccagggaagacagagcaggct

SEQ ID NO: 5867619 - DNA, 21 bp, Homo sapiens
ccagggaagctgtcctggagg

SEQ ID NO: 5867620 - DNA, 12 bp, Homo sapiens
ccagggaagggg

SEQ ID NO: 5867621 - DNA, 22 bp, Homo sapiens
ccagggaaggtggccacagcaa

SEQ ID NO: 5867622 - DNA, 14 bp, Homo sapiens
ccagggaaggtggg

SEQ ID NO: 5867623 - DNA, 16 bp, Homo sapiens
ccagggaagtccccga

SEQ ID NO: 5867624 - DNA, 16 bp, Homo sapiens
ccagggaattcttaca

SEQ ID NO: 5867625 - DNA, 17 bp, Homo sapiens
ccagggaattcttacag

SEQ ID NO: 5867626 - DNA, 19 bp, Homo sapiens
ccagggacacacagcctag

SEQ ID NO: 5867627 - DNA, 21 bp, Homo sapiens
ccagggacacacagcctagca

SEQ ID NO: 5867628 - DNA, 18 bp, Homo sapiens
ccagggacaccagccagg

SEQ ID NO: 5867629 - DNA, 22 bp, Homo sapiens
ccagggacaccagccaggctct

SEQ ID NO: 5867630 - DNA, 17 bp, Homo sapiens
ccagggacacccacaca

SEQ ID NO: 5867631 - DNA, 18 bp, Homo sapiens
ccagggacagaagcagga

SEQ ID NO: 5867632 - DNA, 13 bp, Homo sapiens
ccagggacagagg

SEQ ID NO: 5867633 - DNA, 16 bp, Homo sapiens
ccagggacagaggcca

SEQ ID NO: 5867634 - DNA, 23 bp, Homo sapiens
ccagggacagaggccaaggactg

SEQ ID NO: 5867635 - DNA, 20 bp, Homo sapiens
ccagggacagaggccccagc

SEQ ID NO: 5867636 - DNA, 21 bp, Homo sapiens
ccagggacagaggccccagcc

SEQ ID NO: 5867637 - DNA, 23 bp, Homo sapiens
ccagggacatgtatgcttccagg

SEQ ID NO: 5867638 - DNA, 23 bp, Homo sapiens
ccagggaccacgggcgaggacgt

SEQ ID NO: 5867639 - DNA, 12 bp, Homo sapiens
ccagggaccagc

SEQ ID NO: 5867640 - DNA, 19 bp, Homo sapiens
ccagggaccagcccagcct

SEQ ID NO: 5867641 - DNA, 20 bp, Homo sapiens
ccagggaccagcccagcctg

SEQ ID NO: 5867642 - DNA, 16 bp, Homo sapiens
ccagggacccaaagca

SEQ ID NO: 5867643 - DNA, 17 bp, Homo sapiens
ccagggacccaaagcag

SEQ ID NO: 5867644 - DNA, 13 bp, Homo sapiens
ccagggacccagg

SEQ ID NO: 5867645 - DNA, 14 bp, Homo sapiens
ccagggacccaggt

SEQ ID NO: 5867646 - DNA, 16 bp, Homo sapiens
ccagggacccaggtgt

SEQ ID NO: 5867647 - DNA, 21 bp, Homo sapiens
ccagggacccaggtgtgcctg

SEQ ID NO: 5867648 - DNA, 22 bp, Homo sapiens
ccagggacccaggtgtgcctgt

SEQ ID NO: 5867649 - DNA, 17 bp, Homo sapiens
ccagggacccccagaac

SEQ ID NO: 5867650 - DNA, 14 bp, Homo sapiens
ccagggacccccga

SEQ ID NO: 5867651 - DNA, 14 bp, Homo sapiens
ccagggaccttgga

SEQ ID NO: 5867652 - DNA, 19 bp, Homo sapiens
ccagggacgaagaagagcc

SEQ ID NO: 5867653 - DNA, 22 bp, Homo sapiens
ccagggactaagcagcccagaa

SEQ ID NO: 5867654 - DNA, 22 bp, Homo sapiens
ccagggactcagcgtcccctgc

SEQ ID NO: 5867655 - DNA, 14 bp, Homo sapiens
ccagggactgcagc

SEQ ID NO: 5867656 - DNA, 17 bp, Homo sapiens
ccagggactgtacctgt

SEQ ID NO: 5867657 - DNA, 18 bp, Homo sapiens
ccagggactgtacctgta

SEQ ID NO: 5867658 - DNA, 21 bp, Homo sapiens
ccagggactgtacctgtagga

SEQ ID NO: 5867659 - DNA, 14 bp, Homo sapiens
ccagggagaagctc

SEQ ID NO: 5867660 - DNA, 22 bp, Homo sapiens
ccagggagacctggacacaggc

SEQ ID NO: 5867661 - DNA, 23 bp, Homo sapiens
ccagggagacctggacacaggcc

SEQ ID NO: 5867662 - DNA, 17 bp, Homo sapiens
ccagggagaggccatga

SEQ ID NO: 5867663 - DNA, 21 bp, Homo sapiens
ccagggagaggcctcggctgt

SEQ ID NO: 5867664 - DNA, 16 bp, Homo sapiens
ccagggagcaagacag

SEQ ID NO: 5867665 - DNA, 17 bp, Homo sapiens
ccagggagcaagacaga

SEQ ID NO: 5867666 - DNA, 23 bp, Homo sapiens
ccagggagcaatgggagggggct

SEQ ID NO: 5867667 - DNA, 22 bp, Homo sapiens
ccagggagcatgagaggaggca

SEQ ID NO: 5867668 - DNA, 18 bp, Homo sapiens
ccagggagcccggggcag

SEQ ID NO: 5867669 - DNA, 23 bp, Homo sapiens
ccagggagcccggggcagagctc

SEQ ID NO: 5867670 - DNA, 16 bp, Homo sapiens
ccagggagcctagaag

SEQ ID NO: 5867671 - DNA, 13 bp, Homo sapiens
ccagggagccttt

SEQ ID NO: 5867672 - DNA, 19 bp, Homo sapiens
ccagggagcggaaagcagc

SEQ ID NO: 5867673 - DNA, 17 bp, Homo sapiens
ccagggagctctgcata

SEQ ID NO: 5867674 - DNA, 20 bp, Homo sapiens
ccagggagcttcctggctct

SEQ ID NO: 5867675 - DNA, 21 bp, Homo sapiens
ccagggagcttcctggctctg

SEQ ID NO: 5867676 - DNA, 22 bp, Homo sapiens
ccagggagcttgaaagttttca

SEQ ID NO: 5867677 - DNA, 13 bp, Homo sapiens
ccagggagcttgc

SEQ ID NO: 5867678 - DNA, 13 bp, Homo sapiens
ccagggaggaagc

SEQ ID NO: 5867679 - DNA, 13 bp, Homo sapiens
ccagggaggagag

SEQ ID NO: 5867680 - DNA, 12 bp, Homo sapiens
ccagggaggagc

SEQ ID NO: 5867681 - DNA, 17 bp, Homo sapiens
ccagggaggagccccag

SEQ ID NO: 5867682 - DNA, 15 bp, Homo sapiens
ccagggaggagtcag

SEQ ID NO: 5867683 - DNA, 14 bp, Homo sapiens
ccagggaggcagag

SEQ ID NO: 5867684 - DNA, 22 bp, Homo sapiens
ccagggaggcagagcgggaggg

SEQ ID NO: 5867685 - DNA, 18 bp, Homo sapiens
ccagggaggcagcctagc

SEQ ID NO: 5867686 - DNA, 14 bp, Homo sapiens
ccagggaggcagcg

SEQ ID NO: 5867687 - DNA, 16 bp, Homo sapiens
ccagggaggcagcgtg

SEQ ID NO: 5867688 - DNA, 13 bp, Homo sapiens
ccagggaggcgca

SEQ ID NO: 5867689 - DNA, 15 bp, Homo sapiens
ccagggaggcgcagg

SEQ ID NO: 5867690 - DNA, 16 bp, Homo sapiens
ccagggaggcgcaggg

SEQ ID NO: 5867691 - DNA, 20 bp, Homo sapiens
ccagggaggcgcagggacat

SEQ ID NO: 5867692 - DNA, 21 bp, Homo sapiens
ccagggaggcgcagggacatg

SEQ ID NO: 5867693 - DNA, 24 bp, Homo sapiens
ccagggagggaagtgtgagcgcct

SEQ ID NO: 5867694 - DNA, 14 bp, Homo sapiens
ccagggaggggccg

SEQ ID NO: 5867695 - DNA, 18 bp, Homo sapiens
ccagggagggtgagctgg

SEQ ID NO: 5867696 - DNA, 10 bp, Homo sapiens
ccagggaggt

SEQ ID NO: 5867697 - DNA, 20 bp, Homo sapiens
ccagggaggtggcagggaag

SEQ ID NO: 5867698 - DNA, 13 bp, Homo sapiens
ccagggagtccag

SEQ ID NO: 5867699 - DNA, 13 bp, Homo sapiens
ccagggagtcccc

SEQ ID NO: 5867700 - DNA, 13 bp, Homo sapiens
ccagggagtgagc

SEQ ID NO: 5867701 - DNA, 17 bp, Homo sapiens
ccagggagtgagcagct

SEQ ID NO: 5867702 - DNA, 16 bp, Homo sapiens
ccagggagtggggagg

SEQ ID NO: 5867703 - DNA, 14 bp, Homo sapiens
ccagggagtgtgat

SEQ ID NO: 5867704 - DNA, 15 bp, Homo sapiens
ccagggatctctcta

SEQ ID NO: 5867705 - DNA, 21 bp, Homo sapiens
ccagggatgattcaagccatt

SEQ ID NO: 5867706 - DNA, 14 bp, Homo sapiens
ccagggatgctggg

SEQ ID NO: 5867707 - DNA, 19 bp, Homo sapiens
ccagggatgctgggctggg

SEQ ID NO: 5867708 - DNA, 16 bp, Homo sapiens
ccagggatggcagtgg

SEQ ID NO: 5867709 - DNA, 14 bp, Homo sapiens
ccagggatgggagg

SEQ ID NO: 5867710 - DNA, 19 bp, Homo sapiens
ccagggatgggaggtatgg

SEQ ID NO: 5867711 - DNA, 18 bp, Homo sapiens
ccagggatggggccacag

SEQ ID NO: 5867712 - DNA, 12 bp, Homo sapiens
ccagggatgtct

SEQ ID NO: 5867713 - DNA, 21 bp, Homo sapiens
ccagggatgtctgttgaaata

SEQ ID NO: 5867714 - DNA, 22 bp, Homo sapiens
ccagggatttgtccttggggac

SEQ ID NO: 5867715 - DNA, 17 bp, Homo sapiens
ccagggcaaatgtttac

SEQ ID NO: 5867716 - DNA, 22 bp, Homo sapiens
ccagggcaaatgtttacatttt

SEQ ID NO: 5867717 - DNA, 22 bp, Homo sapiens
ccagggcaagggttaaggcctg

SEQ ID NO: 5867718 - DNA, 16 bp, Homo sapiens
ccagggcacagctgga

SEQ ID NO: 5867719 - DNA, 17 bp, Homo sapiens
ccagggcacaggagcta

SEQ ID NO: 5867720 - DNA, 15 bp, Homo sapiens
ccagggcaccaagcc

SEQ ID NO: 5867721 - DNA, 19 bp, Homo sapiens
ccagggcaccaagcccaca

SEQ ID NO: 5867722 - DNA, 22 bp, Homo sapiens
ccagggcaccaagcccacaggt

SEQ ID NO: 5867723 - DNA, 17 bp, Homo sapiens
ccagggcacccaggcag

SEQ ID NO: 5867724 - DNA, 14 bp, Homo sapiens
ccagggcactgcca

SEQ ID NO: 5867725 - DNA, 16 bp, Homo sapiens
ccagggcactgccagc

SEQ ID NO: 5867726 - DNA, 19 bp, Homo sapiens
ccagggcactgccagccca

SEQ ID NO: 5867727 - DNA, 15 bp, Homo sapiens
ccagggcactgtctg

SEQ ID NO: 5867728 - DNA, 10 bp, Homo sapiens
ccagggcaga

SEQ ID NO: 5867729 - DNA, 16 bp, Homo sapiens
ccagggcagaggaatg

SEQ ID NO: 5867730 - DNA, 22 bp, Homo sapiens
ccagggcagcaagggacctgct

SEQ ID NO: 5867731 - DNA, 13 bp, Homo sapiens
ccagggcagcagc

SEQ ID NO: 5867732 - DNA, 15 bp, Homo sapiens
ccagggcagcaggcc

SEQ ID NO: 5867733 - DNA, 21 bp, Homo sapiens
ccagggcagcaggccagagaa

SEQ ID NO: 5867734 - DNA, 23 bp, Homo sapiens
ccagggcagcaggccagagaaag

SEQ ID NO: 5867735 - DNA, 19 bp, Homo sapiens
ccagggcagccagggagag

SEQ ID NO: 5867736 - DNA, 12 bp, Homo sapiens
ccagggcagcct

SEQ ID NO: 5867737 - DNA, 13 bp, Homo sapiens
ccagggcagcctc

SEQ ID NO: 5867738 - DNA, 12 bp, Homo sapiens
ccagggcagggc

SEQ ID NO: 5867739 - DNA, 14 bp, Homo sapiens
ccagggcagggcca

SEQ ID NO: 5867740 - DNA, 23 bp, Homo sapiens
ccagggcagggccaccccactct

SEQ ID NO: 5867741 - DNA, 16 bp, Homo sapiens
ccagggcagggcgagc

SEQ ID NO: 5867742 - DNA, 21 bp, Homo sapiens
ccagggcagggcgagctgcag

SEQ ID NO: 5867743 - DNA, 23 bp, Homo sapiens
ccagggcagggcgagctgcagga

SEQ ID NO: 5867744 - DNA, 13 bp, Homo sapiens
ccagggcagggtc

SEQ ID NO: 5867745 - DNA, 22 bp, Homo sapiens
ccagggcagggtctgggctggg

SEQ ID NO: 5867746 - DNA, 17 bp, Homo sapiens
ccagggcagtgctagtg

SEQ ID NO: 5867747 - DNA, 23 bp, Homo sapiens
ccagggcagtgctagtgagctgg

SEQ ID NO: 5867748 - DNA, 18 bp, Homo sapiens
ccagggcagtgtggtggg

SEQ ID NO: 5867749 - DNA, 20 bp, Homo sapiens
ccagggcatccgcagcccag

SEQ ID NO: 5867750 - DNA, 14 bp, Homo sapiens
ccagggcatctctg

SEQ ID NO: 5867751 - DNA, 15 bp, Homo sapiens
ccagggcatctctgg

SEQ ID NO: 5867752 - DNA, 19 bp, Homo sapiens
ccaggggtgggacaccctg

SEQ ID NO: 5867753 - DNA, 20 bp, Homo sapiens
ccaggggtggggcccatggg

SEQ ID NO: 5867754 - DNA, 21 bp, Homo sapiens
ccaggggtggggcccatgggg

SEQ ID NO: 5867755 - DNA, 17 bp, Homo sapiens
ccagggtagaattgttt

SEQ ID NO: 5867756 - DNA, 20 bp, Homo sapiens
ccagggtagagcaaaggaga

SEQ ID NO: 5867757 - DNA, 14 bp, Homo sapiens
ccagggtagcccgc

SEQ ID NO: 5867758 - DNA, 16 bp, Homo sapiens
ccagggtagcccgcct

SEQ ID NO: 5867759 - DNA, 21 bp, Homo sapiens
ccagggtagcccgcctgccag

SEQ ID NO: 5867760 - DNA, 23 bp, Homo sapiens
ccagggtagcccgcctgccagtc

SEQ ID NO: 5867761 - DNA, 19 bp, Homo sapiens
ccagggtcataagtgggga

SEQ ID NO: 5867762 - DNA, 17 bp, Homo sapiens
ccagggtccagccctcc

SEQ ID NO: 5867763 - DNA, 13 bp, Homo sapiens
ccagggtcccacc

SEQ ID NO: 5867764 - DNA, 17 bp, Homo sapiens
ccagggtcccaccccca

SEQ ID NO: 5867765 - DNA, 18 bp, Homo sapiens
ccagggtcccacccccaa

SEQ ID NO: 5867766 - DNA, 13 bp, Homo sapiens
ccagggtcccagg

SEQ ID NO: 5867767 - DNA, 21 bp, Homo sapiens
ccagggtcccctccccagctc

SEQ ID NO: 5867768 - DNA, 15 bp, Homo sapiens
ccagggtcccctgcc

SEQ ID NO: 5867769 - DNA, 18 bp, Homo sapiens
ccagggtccctctgtgta

SEQ ID NO: 5867770 - DNA, 13 bp, Homo sapiens
ccagggtccctgg

SEQ ID NO: 5867771 - DNA, 19 bp, Homo sapiens
ccagggtccgcaccagctg

SEQ ID NO: 5867772 - DNA, 20 bp, Homo sapiens
ccagggtccgcaccagctgc

SEQ ID NO: 5867773 - DNA, 21 bp, Homo sapiens
ccagggtccgcaccagctgct

SEQ ID NO: 5867774 - DNA, 24 bp, Homo sapiens
ccagggtccgcaccagctgctctg

SEQ ID NO: 5867775 - DNA, 14 bp, Homo sapiens
ccagggtcctggga

SEQ ID NO: 5867776 - DNA, 23 bp, Homo sapiens
ccagggtcctgggaggagagaca

SEQ ID NO: 5867777 - DNA, 20 bp, Homo sapiens
ccagggtctagccgctgccc

SEQ ID NO: 5867778 - DNA, 14 bp, Homo sapiens
ccagggtctgaaag

SEQ ID NO: 5867779 - DNA, 21 bp, Homo sapiens
ccagggtctggcagagcctct

SEQ ID NO: 5867780 - DNA, 16 bp, Homo sapiens
ccagggtctgtgtgaa

SEQ ID NO: 5867781 - DNA, 22 bp, Homo sapiens
ccagggtctgtgtgaatgtggg

SEQ ID NO: 5867782 - DNA, 17 bp, Homo sapiens
ccagggtcttgggctac

SEQ ID NO: 5867783 - DNA, 20 bp, Homo sapiens
ccagggtctttactgggaag

SEQ ID NO: 5867784 - DNA, 21 bp, Homo sapiens
ccagggtctttactgggaagc

SEQ ID NO: 5867785 - DNA, 14 bp, Homo sapiens
ccagggtgagagct

SEQ ID NO: 5867786 - DNA, 17 bp, Homo sapiens
ccagggtgagagctgct

SEQ ID NO: 5867787 - DNA, 22 bp, Homo sapiens
ccagggtgagagctgctctgga

SEQ ID NO: 5867788 - DNA, 23 bp, Homo sapiens
ccagggtgagagctgctctggaa

SEQ ID NO: 5867789 - DNA, 19 bp, Homo sapiens
ccagggtgagttaaagaga

SEQ ID NO: 5867790 - DNA, 18 bp, Homo sapiens
ccagggtgcatggcttgg

SEQ ID NO: 5867791 - DNA, 23 bp, Homo sapiens
ccagggtgcatggcttggggagc

SEQ ID NO: 5867792 - DNA, 19 bp, Homo sapiens
ccagggtggaccaggcctg

SEQ ID NO: 5867793 - DNA, 20 bp, Homo sapiens
ccagggtggaccaggcctgg

SEQ ID NO: 5867794 - DNA, 21 bp, Homo sapiens
ccagggtggacttagaaagca

SEQ ID NO: 5867795 - DNA, 12 bp, Homo sapiens
ccagggtggaga

SEQ ID NO: 5867796 - DNA, 17 bp, Homo sapiens
ccagggtggagctgaga

SEQ ID NO: 5867797 - DNA, 18 bp, Homo sapiens
ccagggtggccacacctc

SEQ ID NO: 5867798 - DNA, 24 bp, Homo sapiens
ccagggtggccacacctctatccc

SEQ ID NO: 5867799 - DNA, 16 bp, Homo sapiens
ccagggtggctgccag

SEQ ID NO: 5867800 - DNA, 18 bp, Homo sapiens
ccagggtggctgccagcc

SEQ ID NO: 5867801 - DNA, 17 bp, Homo sapiens
ccagggtgggctgggga

SEQ ID NO: 5867802 - DNA, 18 bp, Homo sapiens
ccagggtgggctggggac

SEQ ID NO: 5867803 - DNA, 13 bp, Homo sapiens
ccagggtgggtgt

SEQ ID NO: 5867804 - DNA, 15 bp, Homo sapiens
ccagggtggttagag

SEQ ID NO: 5867805 - DNA, 14 bp, Homo sapiens
ccagggtgtctcta

SEQ ID NO: 5867806 - DNA, 15 bp, Homo sapiens
ccagggttccagaca

SEQ ID NO: 5867807 - DNA, 22 bp, Homo sapiens
ccagggttccagacagggtggg

SEQ ID NO: 5867808 - DNA, 14 bp, Homo sapiens
ccagggttccccca

SEQ ID NO: 5867809 - DNA, 20 bp, Homo sapiens
ccagggttcccccagccctg

SEQ ID NO: 5867810 - DNA, 15 bp, Homo sapiens
ccagggttctgtatt

SEQ ID NO: 5867811 - DNA, 16 bp, Homo sapiens
ccagggttgaccccag

SEQ ID NO: 5867812 - DNA, 21 bp, Homo sapiens
ccagggttgaccccagaggat

SEQ ID NO: 5867813 - DNA, 19 bp, Homo sapiens
ccagggttggcaccttccc

SEQ ID NO: 5867814 - DNA, 21 bp, Homo sapiens
ccagggttggcaccttccccc

SEQ ID NO: 5867815 - DNA, 20 bp, Homo sapiens
ccagggtttacatgaagcag

SEQ ID NO: 5867816 - DNA, 21 bp, Homo sapiens
ccagggttttgccccaagtcc

SEQ ID NO: 5867817 - DNA, 19 bp, Homo sapiens
ccaggtaaagtcaaagctt

SEQ ID NO: 5867818 - DNA, 12 bp, Homo sapiens
ccaggtaacttt

SEQ ID NO: 5867819 - DNA, 18 bp, Homo sapiens
ccaggtaatatgtcttgg

SEQ ID NO: 5867820 - DNA, 13 bp, Homo sapiens
ccaggtacacctc

SEQ ID NO: 5867821 - DNA, 14 bp, Homo sapiens
ccaggtacacctcc

SEQ ID NO: 5867822 - DNA, 15 bp, Homo sapiens
ccaggtacacctccc

SEQ ID NO: 5867823 - DNA, 20 bp, Homo sapiens
ccaggtacacctccccctgc

SEQ ID NO: 5867824 - DNA, 23 bp, Homo sapiens
ccaggtacacctccccctgcgcc

SEQ ID NO: 5867825 - DNA, 15 bp, Homo sapiens
ccaggtacaggagag

SEQ ID NO: 5867826 - DNA, 19 bp, Homo sapiens
ccaggtacaggagaggcag

SEQ ID NO: 5867827 - DNA, 23 bp, Homo sapiens
ccaggtacaggagaggcagcatg

SEQ ID NO: 5867828 - DNA, 15 bp, Homo sapiens
ccaggtaccagctgc

SEQ ID NO: 5867829 - DNA, 16 bp, Homo sapiens
ccaggtacctcatggg

SEQ ID NO: 5867830 - DNA, 24 bp, Homo sapiens
ccaggtaccttctcacctgtgaga

SEQ ID NO: 5867831 - DNA, 14 bp, Homo sapiens
ccaggtacgcacag

SEQ ID NO: 5867832 - DNA, 19 bp, Homo sapiens
ccaggtacgcacagacagg

SEQ ID NO: 5867833 - DNA, 18 bp, Homo sapiens
ccaggtactgagtgggga

SEQ ID NO: 5867834 - DNA, 22 bp, Homo sapiens
ccaggtactgcattctctccca

SEQ ID NO: 5867835 - DNA, 20 bp, Homo sapiens
ccaggtagaaaagaaatggt

SEQ ID NO: 5867836 - DNA, 17 bp, Homo sapiens
ccaggtagaacgccagg

SEQ ID NO: 5867837 - DNA, 19 bp, Homo sapiens
ccaggtagcaagagagcag

SEQ ID NO: 5867838 - DNA, 21 bp, Homo sapiens
ccaggtaggatgaacacaggc

SEQ ID NO: 5867839 - DNA, 15 bp, Homo sapiens
ccaggtaggccaagg

SEQ ID NO: 5867840 - DNA, 21 bp, Homo sapiens
ccaggtaggccaaggtgtcct

SEQ ID NO: 5867841 - DNA, 22 bp, Homo sapiens
ccaggtatagagaaaggtctat

SEQ ID NO: 5867842 - DNA, 16 bp, Homo sapiens
ccaggtatcaaatcaa

SEQ ID NO: 5867843 - DNA, 22 bp, Homo sapiens
ccaggtatccaaaaatgtgtaa

SEQ ID NO: 5867844 - DNA, 15 bp, Homo sapiens
ccaggtatcctgggg

SEQ ID NO: 5867845 - DNA, 17 bp, Homo sapiens
ccaggtatcctggggga

SEQ ID NO: 5867846 - DNA, 20 bp, Homo sapiens
ccaggtatcctgggggaaga

SEQ ID NO: 5867847 - DNA, 20 bp, Homo sapiens
ccaggtattcgttatctaat

SEQ ID NO: 5867848 - DNA, 17 bp, Homo sapiens
ccaggtatttttctatt

SEQ ID NO: 5867849 - DNA, 21 bp, Homo sapiens
ccaggtcaacagaatgaaaaa

SEQ ID NO: 5867850 - DNA, 13 bp, Homo sapiens
ccaggtcaccagc

SEQ ID NO: 5867851 - DNA, 18 bp, Homo sapiens
ccaggtcaccatcctcag

SEQ ID NO: 5867852 - DNA, 20 bp, Homo sapiens
ccaggtcaccctttgctgtg

SEQ ID NO: 5867853 - DNA, 17 bp, Homo sapiens
ccaggtcagccctgtgt

SEQ ID NO: 5867854 - DNA, 22 bp, Homo sapiens
ccaggtcagctgttactttctt

SEQ ID NO: 5867855 - DNA, 19 bp, Homo sapiens
ccaggtcaggatgcacatt

SEQ ID NO: 5867856 - DNA, 22 bp, Homo sapiens
ccaggtcaggatgcacatttct

SEQ ID NO: 5867857 - DNA, 21 bp, Homo sapiens
ccaggtcatgcagttcctggc

SEQ ID NO: 5867858 - DNA, 19 bp, Homo sapiens
ccaggtccaatgagctttc

SEQ ID NO: 5867859 - DNA, 15 bp, Homo sapiens
ccaggtccagctctg

SEQ ID NO: 5867860 - DNA, 13 bp, Homo sapiens
ccaggtcccagcc

SEQ ID NO: 5867861 - DNA, 16 bp, Homo sapiens
ccaggtcccagcccct

SEQ ID NO: 5867862 - DNA, 17 bp, Homo sapiens
ccaggtccctggaccag

SEQ ID NO: 5867863 - DNA, 19 bp, Homo sapiens
ccaggtccgtagctcccct

SEQ ID NO: 5867864 - DNA, 21 bp, Homo sapiens
ccaggtccgtagctcccctgg

SEQ ID NO: 5867865 - DNA, 10 bp, Homo sapiens
ccaggtcctc

SEQ ID NO: 5867866 - DNA, 13 bp, Homo sapiens
ccaggtcctcaca

SEQ ID NO: 5867867 - DNA, 17 bp, Homo sapiens
ccaggtcctcacagcag

SEQ ID NO: 5867868 - DNA, 19 bp, Homo sapiens
ccaggtcctcacagcagtc

SEQ ID NO: 5867869 - DNA, 23 bp, Homo sapiens
ccaggtcctcccgggagcacaga

SEQ ID NO: 5867870 - DNA, 22 bp, Homo sapiens
ccaggtcctgctccgctgcctg

SEQ ID NO: 5867871 - DNA, 13 bp, Homo sapiens
ccaggtcctggtg

SEQ ID NO: 5867872 - DNA, 21 bp, Homo sapiens
ccaggtcctggtggggcagct

SEQ ID NO: 5867873 - DNA, 12 bp, Homo sapiens
ccaggtcctgtc

SEQ ID NO: 5867874 - DNA, 22 bp, Homo sapiens
ccaggtcctgtctctgcacaga

SEQ ID NO: 5867875 - DNA, 20 bp, Homo sapiens
ccaggtcctgtgagcaaagt

SEQ ID NO: 5867876 - DNA, 14 bp, Homo sapiens
ccaggtccttcctt

SEQ ID NO: 5867877 - DNA, 18 bp, Homo sapiens
ccaggtcctttctcctga

SEQ ID NO: 5867878 - DNA, 19 bp, Homo sapiens
ccaggtcctttctcctgat

SEQ ID NO: 5867879 - DNA, 17 bp, Homo sapiens
ccaggtcggagtgcctg

SEQ ID NO: 5867880 - DNA, 19 bp, Homo sapiens
ccaggtcggagtgcctgga

SEQ ID NO: 5867881 - DNA, 16 bp, Homo sapiens
ccaggtcgggcagtgg

SEQ ID NO: 5867882 - DNA, 14 bp, Homo sapiens
ccaggtcgggctca

SEQ ID NO: 5867883 - DNA, 17 bp, Homo sapiens
ccaggtcgggctcagct

SEQ ID NO: 5867884 - DNA, 18 bp, Homo sapiens
ccaggtcgggctcagctc

SEQ ID NO: 5867885 - DNA, 23 bp, Homo sapiens
ccaggtcgggctcagctctggct

SEQ ID NO: 5867886 - DNA, 18 bp, Homo sapiens
ccaggtctagaaggccag

SEQ ID NO: 5867887 - DNA, 19 bp, Homo sapiens
ccaggtctagaaggccagg

SEQ ID NO: 5867888 - DNA, 21 bp, Homo sapiens
ccaggtctagaaggccaggcc

SEQ ID NO: 5867889 - DNA, 15 bp, Homo sapiens
ccaggtctcactgct

SEQ ID NO: 5867890 - DNA, 13 bp, Homo sapiens
ccaggtctcccgg

SEQ ID NO: 5867891 - DNA, 14 bp, Homo sapiens
ccaggtctcctcca

SEQ ID NO: 5867892 - DNA, 23 bp, Homo sapiens
ccaggtctcctgggaaagggaga

SEQ ID NO: 5867893 - DNA, 17 bp, Homo sapiens
ccaggtctcctgggcat

SEQ ID NO: 5867894 - DNA, 21 bp, Homo sapiens
ccaggtctcctgggcatctgg

SEQ ID NO: 5867895 - DNA, 23 bp, Homo sapiens
ccaggtctctccactgctctcag

SEQ ID NO: 5867896 - DNA, 20 bp, Homo sapiens
ccaggtctcttcctttgctc

SEQ ID NO: 5867897 - DNA, 13 bp, Homo sapiens
ccaggtctgcctg

SEQ ID NO: 5867898 - DNA, 14 bp, Homo sapiens
ccaggtctgcctgg

SEQ ID NO: 5867899 - DNA, 18 bp, Homo sapiens
ccaggtctgcctggttcc

SEQ ID NO: 5867900 - DNA, 15 bp, Homo sapiens
ccaggtctggcgcca

SEQ ID NO: 5867901 - DNA, 17 bp, Homo sapiens
ccaggtcttcctgcttt

SEQ ID NO: 5867902 - DNA, 21 bp, Homo sapiens
ccaggtcttgacctgaactct

SEQ ID NO: 5867903 - DNA, 21 bp, Homo sapiens
ccaggtcttgactcatggcag

SEQ ID NO: 5867904 - DNA, 17 bp, Homo sapiens
ccaggtcttgaggagag

SEQ ID NO: 5867905 - DNA, 22 bp, Homo sapiens
ccaggtcttggagctgagcctc

SEQ ID NO: 5867906 - DNA, 23 bp, Homo sapiens
ccaggtcttggagctgagcctct

SEQ ID NO: 5867907 - DNA, 23 bp, Homo sapiens
ccaggtgaacaaagtttaccaga

SEQ ID NO: 5867908 - DNA, 16 bp, Homo sapiens
ccaggtgaaggaggct

SEQ ID NO: 5867909 - DNA, 20 bp, Homo sapiens
ccaggtgaaggaggctccag

SEQ ID NO: 5867910 - DNA, 22 bp, Homo sapiens
ccaggtgacacgcttctgagca

SEQ ID NO: 5867911 - DNA, 23 bp, Homo sapiens
ccaggtgacacgcttctgagcag

SEQ ID NO: 5867912 - DNA, 21 bp, Homo sapiens
ccaggtgaggcccaagagccc

SEQ ID NO: 5867913 - DNA, 18 bp, Homo sapiens
ccaggtgcacaagctcca

SEQ ID NO: 5867914 - DNA, 13 bp, Homo sapiens
ccaggtgcacaga

SEQ ID NO: 5867915 - DNA, 16 bp, Homo sapiens
ccaggtgcacagacgt

SEQ ID NO: 5867916 - DNA, 13 bp, Homo sapiens
ccaggtgcagagg

SEQ ID NO: 5867917 - DNA, 14 bp, Homo sapiens
ccaggtgcagccag

SEQ ID NO: 5867918 - DNA, 14 bp, Homo sapiens
ccaggtgcagtggc

SEQ ID NO: 5867919 - DNA, 22 bp, Homo sapiens
ccaggtgcatgcatgccctctc

SEQ ID NO: 5867920 - DNA, 21 bp, Homo sapiens
ccaggtgccaccaataaaaat

SEQ ID NO: 5867921 - DNA, 12 bp, Homo sapiens
ccaggtgccagt

SEQ ID NO: 5867922 - DNA, 14 bp, Homo sapiens
ccaggtgcccagga

SEQ ID NO: 5867923 - DNA, 22 bp, Homo sapiens
ccaggtgcccgcgccaggccct

SEQ ID NO: 5867924 - DNA, 20 bp, Homo sapiens
ccaggtgccctgtgggagag

SEQ ID NO: 5867925 - DNA, 18 bp, Homo sapiens
ccaggtgccgacactgag

SEQ ID NO: 5867926 - DNA, 17 bp, Homo sapiens
ccaggtgcctggccctt

SEQ ID NO: 5867927 - DNA, 23 bp, Homo sapiens
ccagtgtgtgctcagcagcccca

SEQ ID NO: 5867928 - DNA, 18 bp, Homo sapiens
ccagtgtgtggctttcag

SEQ ID NO: 5867929 - DNA, 21 bp, Homo sapiens
ccagtgtgtggctttcagagc

SEQ ID NO: 5867930 - DNA, 15 bp, Homo sapiens
ccagtgtgtggggga

SEQ ID NO: 5867931 - DNA, 19 bp, Homo sapiens
ccagtgtgttactcatctt

SEQ ID NO: 5867932 - DNA, 17 bp, Homo sapiens
ccagtgttaataaatgg

SEQ ID NO: 5867933 - DNA, 19 bp, Homo sapiens
ccagtgttagtgggaagag

SEQ ID NO: 5867934 - DNA, 17 bp, Homo sapiens
ccagtgttcctgaagct

SEQ ID NO: 5867935 - DNA, 19 bp, Homo sapiens
ccagtgttcctgaagctgc

SEQ ID NO: 5867936 - DNA, 19 bp, Homo sapiens
ccagtgttctgcatggatt

SEQ ID NO: 5867937 - DNA, 17 bp, Homo sapiens
ccagtgttgcctaagta

SEQ ID NO: 5867938 - DNA, 21 bp, Homo sapiens
ccagtgttgtgggcttcctgc

SEQ ID NO: 5867939 - DNA, 17 bp, Homo sapiens
ccagtgttgtttgtaaa

SEQ ID NO: 5867940 - DNA, 22 bp, Homo sapiens
ccagtgttgtttgtaaataaga

SEQ ID NO: 5867941 - DNA, 17 bp, Homo sapiens
ccagtgtttagaagagc

SEQ ID NO: 5867942 - DNA, 21 bp, Homo sapiens
ccagtgtttagaagagcctga

SEQ ID NO: 5867943 - DNA, 12 bp, Homo sapiens
ccagtgtttcca

SEQ ID NO: 5867944 - DNA, 14 bp, Homo sapiens
ccagtgtttctgaa

SEQ ID NO: 5867945 - DNA, 18 bp, Homo sapiens
ccagtgtttctgaatgtt

SEQ ID NO: 5867946 - DNA, 11 bp, Homo sapiens
ccagtgttttc

SEQ ID NO: 5867947 - DNA, 24 bp, Homo sapiens
ccagtgtttttcttcatgtgcaaa

SEQ ID NO: 5867948 - DNA, 17 bp, Homo sapiens
ccagttaaaaaaaattt

SEQ ID NO: 5867949 - DNA, 14 bp, Homo sapiens
ccagttaaagatta

SEQ ID NO: 5867950 - DNA, 23 bp, Homo sapiens
ccagttaaagtagatcacctcct

SEQ ID NO: 5867951 - DNA, 21 bp, Homo sapiens
ccagttaacgtattagttgcc

SEQ ID NO: 5867952 - DNA, 13 bp, Homo sapiens
ccagttaaggaaa

SEQ ID NO: 5867953 - DNA, 13 bp, Homo sapiens
ccagttaaggacc

SEQ ID NO: 5867954 - DNA, 22 bp, Homo sapiens
ccagttaaggaccgtggccctg

SEQ ID NO: 5867955 - DNA, 18 bp, Homo sapiens
ccagttaatttttccaac

SEQ ID NO: 5867956 - DNA, 12 bp, Homo sapiens
ccagttaccttt

SEQ ID NO: 5867957 - DNA, 17 bp, Homo sapiens
ccagttacctttgctgt

SEQ ID NO: 5867958 - DNA, 20 bp, Homo sapiens
ccagttacctttgctgtcac

SEQ ID NO: 5867959 - DNA, 12 bp, Homo sapiens
ccagttactgtt

SEQ ID NO: 5867960 - DNA, 14 bp, Homo sapiens
ccagttagcaacaa

SEQ ID NO: 5867961 - DNA, 14 bp, Homo sapiens
ccagttagggctgt

SEQ ID NO: 5867962 - DNA, 17 bp, Homo sapiens
ccagttcaaagtgtata

SEQ ID NO: 5867963 - DNA, 20 bp, Homo sapiens
ccagttcagaaatttggcat

SEQ ID NO: 5867964 - DNA, 17 bp, Homo sapiens
ccagttcagtacctgga

SEQ ID NO: 5867965 - DNA, 19 bp, Homo sapiens
ccagttcagtacctggagg

SEQ ID NO: 5867966 - DNA, 20 bp, Homo sapiens
ccagttcagtacctggagga

SEQ ID NO: 5867967 - DNA, 14 bp, Homo sapiens
ccagttcatcccaa

SEQ ID NO: 5867968 - DNA, 16 bp, Homo sapiens
ccagttcatctctgct

SEQ ID NO: 5867969 - DNA, 13 bp, Homo sapiens
ccagttccacagc

SEQ ID NO: 5867970 - DNA, 14 bp, Homo sapiens
ccagttccacagca

SEQ ID NO: 5867971 - DNA, 13 bp, Homo sapiens
ccagttcctagca

SEQ ID NO: 5867972 - DNA, 16 bp, Homo sapiens
ccagttcctgctctct

SEQ ID NO: 5867973 - DNA, 11 bp, Homo sapiens
ccagttcctgt

SEQ ID NO: 5867974 - DNA, 21 bp, Homo sapiens
ccagttcctgtaacaggtgtg

SEQ ID NO: 5867975 - DNA, 21 bp, Homo sapiens
ccagttccttaggagatgtca

SEQ ID NO: 5867976 - DNA, 19 bp, Homo sapiens
ccagttcgcctggagccct

SEQ ID NO: 5867977 - DNA, 22 bp, Homo sapiens
ccagttctaggggagaagagcc

SEQ ID NO: 5867978 - DNA, 23 bp, Homo sapiens
ccagttctaggggagaagagccc

SEQ ID NO: 5867979 - DNA, 17 bp, Homo sapiens
ccagttctcgtgccctt

SEQ ID NO: 5867980 - DNA, 13 bp, Homo sapiens
ccagttctctgtg

SEQ ID NO: 5867981 - DNA, 17 bp, Homo sapiens
ccagttctctgtggaag

SEQ ID NO: 5867982 - DNA, 14 bp, Homo sapiens
ccagttctgatgag

SEQ ID NO: 5867983 - DNA, 15 bp, Homo sapiens
ccagttctgctcctc

SEQ ID NO: 5867984 - DNA, 16 bp, Homo sapiens
ccagttctgctcctct

SEQ ID NO: 5867985 - DNA, 13 bp, Homo sapiens
ccagttctggggc

SEQ ID NO: 5867986 - DNA, 20 bp, Homo sapiens
ccagttcttcatttggagga

SEQ ID NO: 5867987 - DNA, 23 bp, Homo sapiens
ccagttcttcatttggaggaatc

SEQ ID NO: 5867988 - DNA, 19 bp, Homo sapiens
ccagttcttcgactgttgt

SEQ ID NO: 5867989 - DNA, 13 bp, Homo sapiens
ccagttcttgcaa

SEQ ID NO: 5867990 - DNA, 23 bp, Homo sapiens
ccagttgaacactagtctgtgta

SEQ ID NO: 5867991 - DNA, 19 bp, Homo sapiens
ccagttgaactgcaggaag

SEQ ID NO: 5867992 - DNA, 13 bp, Homo sapiens
ccagttgaagtga

SEQ ID NO: 5867993 - DNA, 21 bp, Homo sapiens
ccagttgacatccaggatggc

SEQ ID NO: 5867994 - DNA, 19 bp, Homo sapiens
ccagttgatctgctctgtt

SEQ ID NO: 5867995 - DNA, 21 bp, Homo sapiens
ccagttgcacttggcctctgg

SEQ ID NO: 5867996 - DNA, 12 bp, Homo sapiens
ccagttgcagtc

SEQ ID NO: 5867997 - DNA, 17 bp, Homo sapiens
ccagttgcccagagcac

SEQ ID NO: 5867998 - DNA, 16 bp, Homo sapiens
ccagttgcctccaggg

SEQ ID NO: 5867999 - DNA, 23 bp, Homo sapiens
ccagttgctgatccctgctctct

SEQ ID NO: 5868000 - DNA, 14 bp, Homo sapiens
ccagttgctgctgc

SEQ ID NO: 5868001 - DNA, 21 bp, Homo sapiens
ccagttgctgcttcaatttat

SEQ ID NO: 5868002 - DNA, 18 bp, Homo sapiens
ccagttgctgtggaccaa

SEQ ID NO: 5868003 - DNA, 14 bp, Homo sapiens
ccagttggactgtg

SEQ ID NO: 5868004 - DNA, 16 bp, Homo sapiens
ccagttggactgtggc

SEQ ID NO: 5868005 - DNA, 20 bp, Homo sapiens
ccagttggactgtggcctca

SEQ ID NO: 5868006 - DNA, 22 bp, Homo sapiens
ccagttggagctccagcctgac

SEQ ID NO: 5868007 - DNA, 15 bp, Homo sapiens
ccagttggagttttt

SEQ ID NO: 5868008 - DNA, 23 bp, Homo sapiens
ccagttggagttttttgtaccaa

SEQ ID NO: 5868009 - DNA, 19 bp, Homo sapiens
ccagttggatgaacattca

SEQ ID NO: 5868010 - DNA, 19 bp, Homo sapiens
ccagttggcccttctgccc

SEQ ID NO: 5868011 - DNA, 12 bp, Homo sapiens
ccagttgggact

SEQ ID NO: 5868012 - DNA, 18 bp, Homo sapiens
ccagttgggactcaggat

SEQ ID NO: 5868013 - DNA, 18 bp, Homo sapiens
ccagttgggagcactgga

SEQ ID NO: 5868014 - DNA, 19 bp, Homo sapiens
ccagttgggagcactggag

SEQ ID NO: 5868015 - DNA, 21 bp, Homo sapiens
ccagttgggctcgcactgccc

SEQ ID NO: 5868016 - DNA, 15 bp, Homo sapiens
ccagttggggccccg

SEQ ID NO: 5868017 - DNA, 20 bp, Homo sapiens
ccagttgggtggatgcctgg

SEQ ID NO: 5868018 - DNA, 19 bp, Homo sapiens
ccagttggtgactgggaaa

SEQ ID NO: 5868019 - DNA, 18 bp, Homo sapiens
ccagttggtggggccagg

SEQ ID NO: 5868020 - DNA, 21 bp, Homo sapiens
ccagttggtggggccaggcca

SEQ ID NO: 5868021 - DNA, 21 bp, Homo sapiens
ccagttgtagcaggtttcact

SEQ ID NO: 5868022 - DNA, 15 bp, Homo sapiens
ccagttgtatttaat

SEQ ID NO: 5868023 - DNA, 13 bp, Homo sapiens
ccagttgtcctcc

SEQ ID NO: 5868024 - DNA, 14 bp, Homo sapiens
ccagttgtcctcct

SEQ ID NO: 5868025 - DNA, 10 bp, Homo sapiens
ccagttgtgg

SEQ ID NO: 5868026 - DNA, 19 bp, Homo sapiens
ccagttgtgttgacacata

SEQ ID NO: 5868027 - DNA, 16 bp, Homo sapiens
ccagttgttactgaag

SEQ ID NO: 5868028 - DNA, 18 bp, Homo sapiens
ccagttgttactgaagtt

SEQ ID NO: 5868029 - DNA, 23 bp, Homo sapiens
ccagttgttactgaagttatctg

SEQ ID NO: 5868030 - DNA, 16 bp, Homo sapiens
ccagttgttatttaca

SEQ ID NO: 5868031 - DNA, 22 bp, Homo sapiens
ccagttgttttccatcatttgg

SEQ ID NO: 5868032 - DNA, 17 bp, Homo sapiens
ccagttgttttgtcttg

SEQ ID NO: 5868033 - DNA, 17 bp, Homo sapiens
ccagtttaacctgatgc

SEQ ID NO: 5868034 - DNA, 22 bp, Homo sapiens
ccagtttaagacaccaaatata

SEQ ID NO: 5868035 - DNA, 22 bp, Homo sapiens
ccagtttaagccgcagacctgg

SEQ ID NO: 5868036 - DNA, 20 bp, Homo sapiens
ccagtttatggatatgctgc

SEQ ID NO: 5868037 - DNA, 14 bp, Homo sapiens
ccagtttcacctct

SEQ ID NO: 5868038 - DNA, 21 bp, Homo sapiens
ccagtttcagaagcaggcagg

SEQ ID NO: 5868039 - DNA, 19 bp, Homo sapiens
ccagtttctaaactggaga

SEQ ID NO: 5868040 - DNA, 21 bp, Homo sapiens
ccagtttctaaactggagact

SEQ ID NO: 5868041 - DNA, 11 bp, Homo sapiens
ccagtttctcc

SEQ ID NO: 5868042 - DNA, 13 bp, Homo sapiens
ccagtttctcctt

SEQ ID NO: 5868043 - DNA, 16 bp, Homo sapiens
ccagtttctgcggcct

SEQ ID NO: 5868044 - DNA, 20 bp, Homo sapiens
ccagtttcttaaactgaaag

SEQ ID NO: 5868045 - DNA, 22 bp, Homo sapiens
ccagtttcttcttacacttctt

SEQ ID NO: 5868046 - DNA, 19 bp, Homo sapiens
ccagtttgaagcctgtgcc

SEQ ID NO: 5868047 - DNA, 13 bp, Homo sapiens
ccagtttgcatga

SEQ ID NO: 5868048 - DNA, 15 bp, Homo sapiens
ccagtttgcatttgg

SEQ ID NO: 5868049 - DNA, 16 bp, Homo sapiens
ccagtttgggaactca

SEQ ID NO: 5868050 - DNA, 18 bp, Homo sapiens
ccagtttgggaactcatc

SEQ ID NO: 5868051 - DNA, 14 bp, Homo sapiens
ccagtttggggtgc

SEQ ID NO: 5868052 - DNA, 17 bp, Homo sapiens
ccagtttggggtgccaa

SEQ ID NO: 5868053 - DNA, 18 bp, Homo sapiens
ccagttttactgtgattc

SEQ ID NO: 5868054 - DNA, 14 bp, Homo sapiens
ccagttttccctgg

SEQ ID NO: 5868055 - DNA, 19 bp, Homo sapiens
ccagttttcggaaacactg

SEQ ID NO: 5868056 - DNA, 14 bp, Homo sapiens
ccagttttgcctga

SEQ ID NO: 5868057 - DNA, 15 bp, Homo sapiens
ccagttttgtttagt

SEQ ID NO: 5868058 - DNA, 19 bp, Homo sapiens
ccagttttgtttggaccaa

SEQ ID NO: 5868059 - DNA, 12 bp, Homo sapiens
ccataaaacatt

SEQ ID NO: 5868060 - DNA, 20 bp, Homo sapiens
ccataaaacattaagaaaat

SEQ ID NO: 5868061 - DNA, 14 bp, Homo sapiens
ccataaaagcattg

SEQ ID NO: 5868062 - DNA, 20 bp, Homo sapiens
ccataaaagccgcccagtgg

SEQ ID NO: 5868063 - DNA, 13 bp, Homo sapiens
ccataaaataaat

SEQ ID NO: 5868064 - DNA, 19 bp, Homo sapiens
ccataaacagcacacctgt

SEQ ID NO: 5868065 - DNA, 19 bp, Homo sapiens
ccataaactaagagaaact

SEQ ID NO: 5868066 - DNA, 20 bp, Homo sapiens
ccataaagaagatgtttaac

SEQ ID NO: 5868067 - DNA, 20 bp, Homo sapiens
ccataaagacaatcactgcc

SEQ ID NO: 5868068 - DNA, 17 bp, Homo sapiens
ccataaagcaagctcaa

SEQ ID NO: 5868069 - DNA, 12 bp, Homo sapiens
ccataaatcaat

SEQ ID NO: 5868070 - DNA, 16 bp, Homo sapiens
ccataaccaagaaata

SEQ ID NO: 5868071 - DNA, 20 bp, Homo sapiens
ccataaccaagaaatactaa

SEQ ID NO: 5868072 - DNA, 15 bp, Homo sapiens
ccataaccacattta

SEQ ID NO: 5868073 - DNA, 15 bp, Homo sapiens
ccataaccactgaag

SEQ ID NO: 5868074 - DNA, 22 bp, Homo sapiens
ccataaccgctgattctcaggg

SEQ ID NO: 5868075 - DNA, 13 bp, Homo sapiens
ccataacgtgccc

SEQ ID NO: 5868076 - DNA, 18 bp, Homo sapiens
ccataacgtgcccccaga

SEQ ID NO: 5868077 - DNA, 20 bp, Homo sapiens
ccataacgttagactgcaat

SEQ ID NO: 5868078 - DNA, 18 bp, Homo sapiens
ccataacttccagtatca

SEQ ID NO: 5868079 - DNA, 18 bp, Homo sapiens
ccataacttgtttgtaaa

SEQ ID NO: 5868080 - DNA, 17 bp, Homo sapiens
ccataagacaaacactg

SEQ ID NO: 5868081 - DNA, 12 bp, Homo sapiens
ccataagagaaa

SEQ ID NO: 5868082 - DNA, 13 bp, Homo sapiens
ccataagagaaac

SEQ ID NO: 5868083 - DNA, 13 bp, Homo sapiens
ccataagaggagt

SEQ ID NO: 5868084 - DNA, 13 bp, Homo sapiens
ccataagccctga

SEQ ID NO: 5868085 - DNA, 17 bp, Homo sapiens
ccataagcctccattta

SEQ ID NO: 5868086 - DNA, 17 bp, Homo sapiens
ccataagctactgccat

SEQ ID NO: 5868087 - DNA, 21 bp, Homo sapiens
ccataagctactgccatcctg

SEQ ID NO: 5868088 - DNA, 12 bp, Homo sapiens
ccataagctatt

SEQ ID NO: 5868089 - DNA, 13 bp, Homo sapiens
ccataagctattt

SEQ ID NO: 5868090 - DNA, 16 bp, Homo sapiens
ccataaggcagtggct

SEQ ID NO: 5868091 - DNA, 20 bp, Homo sapiens
ccataagtaagaaatttcta

SEQ ID NO: 5868092 - DNA, 14 bp, Homo sapiens
ccataagtctgatt

SEQ ID NO: 5868093 - DNA, 21 bp, Homo sapiens
ccataagtttaactgtatttt

SEQ ID NO: 5868094 - DNA, 15 bp, Homo sapiens
ccataataaagcaat

SEQ ID NO: 5868095 - DNA, 24 bp, Homo sapiens
ccataataaagcaatctgattcag

SEQ ID NO: 5868096 - DNA, 22 bp, Homo sapiens
ccataataaaggttgtgaatgt

SEQ ID NO: 5868097 - DNA, 15 bp, Homo sapiens
ccataataaccctgc

SEQ ID NO: 5868098 - DNA, 22 bp, Homo sapiens
ccataataagagaatgttccta

SEQ ID NO: 5868099 - DNA, 19 bp, Homo sapiens
ccataatagttagccctca

SEQ ID NO: 5868100 - DNA, 13 bp, Homo sapiens
ccataatatgatg

SEQ ID NO: 5868101 - DNA, 17 bp, Homo sapiens
ccataatcaatctatca

SEQ ID NO: 5868102 - DNA, 16 bp, Homo sapiens
ccataatcagaacaca

SEQ ID NO: 5868103 - DNA, 22 bp, Homo sapiens
ccataatgagatgtgagccttg

SEQ ID NO: 5868104 - DNA, 22 bp, Homo sapiens
ccataatgatggatttaacagc

SEQ ID NO: 5868105 - DNA, 16 bp, Homo sapiens
ccatatttgtaaaatg

SEQ ID NO: 5868106 - DNA, 22 bp, Homo sapiens
ccatatttgtaaaatgacaatc

SEQ ID NO: 5868107 - DNA, 17 bp, Homo sapiens
ccatatttgtgttcagt

SEQ ID NO: 5868108 - DNA, 22 bp, Homo sapiens
ccatatttgtgttcagttccag

SEQ ID NO: 5868109 - DNA, 22 bp, Homo sapiens
ccatattttaaaagagaaaaac

SEQ ID NO: 5868110 - DNA, 19 bp, Homo sapiens
ccatattttattgtatttt

SEQ ID NO: 5868111 - DNA, 22 bp, Homo sapiens
ccatattttattgtattttgat

SEQ ID NO: 5868112 - DNA, 23 bp, Homo sapiens
ccatattttcacaggtgtggtgt

SEQ ID NO: 5868113 - DNA, 22 bp, Homo sapiens
ccatattttgtatccaaggatc

SEQ ID NO: 5868114 - DNA, 22 bp, Homo sapiens
ccatatttttttccttacataa

SEQ ID NO: 5868115 - DNA, 16 bp, Homo sapiens
ccatatttttttctgt

SEQ ID NO: 5868116 - DNA, 22 bp, Homo sapiens
ccatcaaacaaatcattttgat

SEQ ID NO: 5868117 - DNA, 19 bp, Homo sapiens
ccatcaactaaaacattat

SEQ ID NO: 5868118 - DNA, 22 bp, Homo sapiens
ccatcaactaaagttgtacttt

SEQ ID NO: 5868119 - DNA, 21 bp, Homo sapiens
ccatcaactcccaacttcttc

SEQ ID NO: 5868120 - DNA, 15 bp, Homo sapiens
ccatcaagcacttcc

SEQ ID NO: 5868121 - DNA, 18 bp, Homo sapiens
ccatcaagcacttcccag

SEQ ID NO: 5868122 - DNA, 21 bp, Homo sapiens
ccatcaaggcgggagggcctg

SEQ ID NO: 5868123 - DNA, 16 bp, Homo sapiens
ccatcaaggtccagtg

SEQ ID NO: 5868124 - DNA, 16 bp, Homo sapiens
ccatcaagttgtgcca

SEQ ID NO: 5868125 - DNA, 20 bp, Homo sapiens
ccatcaataaaaaattatga

SEQ ID NO: 5868126 - DNA, 17 bp, Homo sapiens
ccatcaataaagtaccc

SEQ ID NO: 5868127 - DNA, 12 bp, Homo sapiens
ccatcaataaat

SEQ ID NO: 5868128 - DNA, 20 bp, Homo sapiens
ccatcaataggcaaaagtgt

SEQ ID NO: 5868129 - DNA, 17 bp, Homo sapiens
ccatcaattttaacatt

SEQ ID NO: 5868130 - DNA, 17 bp, Homo sapiens
ccatcacaatacagata

SEQ ID NO: 5868131 - DNA, 22 bp, Homo sapiens
ccatcacagatcgcatttccta

SEQ ID NO: 5868132 - DNA, 12 bp, Homo sapiens
ccatcacagcca

SEQ ID NO: 5868133 - DNA, 13 bp, Homo sapiens
ccatcacagccag

SEQ ID NO: 5868134 - DNA, 16 bp, Homo sapiens
ccatcacagccagccc

SEQ ID NO: 5868135 - DNA, 19 bp, Homo sapiens
ccatcacagccagcccagc

SEQ ID NO: 5868136 - DNA, 19 bp, Homo sapiens
ccatcacaggatgccagcc

SEQ ID NO: 5868137 - DNA, 23 bp, Homo sapiens
ccatcacaggatgccagcccctg

SEQ ID NO: 5868138 - DNA, 13 bp, Homo sapiens
ccatcaccagaaa

SEQ ID NO: 5868139 - DNA, 17 bp, Homo sapiens
ccatcaccataacctct

SEQ ID NO: 5868140 - DNA, 16 bp, Homo sapiens
ccatcacccctggtgg

SEQ ID NO: 5868141 - DNA, 23 bp, Homo sapiens
ccatcacccctggtggctgcagg

SEQ ID NO: 5868142 - DNA, 20 bp, Homo sapiens
ccatcaccctcacccactct

SEQ ID NO: 5868143 - DNA, 15 bp, Homo sapiens
ccatcaccctctggg

SEQ ID NO: 5868144 - DNA, 19 bp, Homo sapiens
ccatcaccctctgggcagc

SEQ ID NO: 5868145 - DNA, 20 bp, Homo sapiens
ccatcaccctcttcctgtga

SEQ ID NO: 5868146 - DNA, 14 bp, Homo sapiens
ccatcaccgctggg

SEQ ID NO: 5868147 - DNA, 19 bp, Homo sapiens
ccatcacctactcacacag

SEQ ID NO: 5868148 - DNA, 17 bp, Homo sapiens
ccatcacctcagatggc

SEQ ID NO: 5868149 - DNA, 18 bp, Homo sapiens
ccatcaccttagaccacc

SEQ ID NO: 5868150 - DNA, 18 bp, Homo sapiens
ccatcactagaagaaaag

SEQ ID NO: 5868151 - DNA, 19 bp, Homo sapiens
ccatcactagagtgctctg

SEQ ID NO: 5868152 - DNA, 12 bp, Homo sapiens
ccatcactcact

SEQ ID NO: 5868153 - DNA, 16 bp, Homo sapiens
ccatcactcagcccct

SEQ ID NO: 5868154 - DNA, 21 bp, Homo sapiens
ccatcactcggctgtggagaa

SEQ ID NO: 5868155 - DNA, 16 bp, Homo sapiens
ccatcactgagtggct

SEQ ID NO: 5868156 - DNA, 17 bp, Homo sapiens
ccatcactgagtggctt

SEQ ID NO: 5868157 - DNA, 18 bp, Homo sapiens
ccatcactgagttttcca

SEQ ID NO: 5868158 - DNA, 18 bp, Homo sapiens
ccatcactgcgccactgc

SEQ ID NO: 5868159 - DNA, 21 bp, Homo sapiens
ccatcactgcgccactgctcc

SEQ ID NO: 5868160 - DNA, 12 bp, Homo sapiens
ccatcactgtgt

SEQ ID NO: 5868161 - DNA, 18 bp, Homo sapiens
ccatcagaaacaccctca

SEQ ID NO: 5868162 - DNA, 18 bp, Homo sapiens
ccatcagaacctgagcta

SEQ ID NO: 5868163 - DNA, 18 bp, Homo sapiens
ccatcagaggctggggga

SEQ ID NO: 5868164 - DNA, 16 bp, Homo sapiens
ccatcagattctgtga

SEQ ID NO: 5868165 - DNA, 14 bp, Homo sapiens
ccatcagcacccca

SEQ ID NO: 5868166 - DNA, 16 bp, Homo sapiens
ccatcagcaccccagt

SEQ ID NO: 5868167 - DNA, 13 bp, Homo sapiens
ccatcagcagtga

SEQ ID NO: 5868168 - DNA, 13 bp, Homo sapiens
ccatcagccattt

SEQ ID NO: 5868169 - DNA, 12 bp, Homo sapiens
ccatcagcccaa

SEQ ID NO: 5868170 - DNA, 13 bp, Homo sapiens
ccatcagcccctg

SEQ ID NO: 5868171 - DNA, 15 bp, Homo sapiens
ccatcagcccctggg

SEQ ID NO: 5868172 - DNA, 16 bp, Homo sapiens
ccatcagcccctggga

SEQ ID NO: 5868173 - DNA, 17 bp, Homo sapiens
ccatcagcccctgggaa

SEQ ID NO: 5868174 - DNA, 13 bp, Homo sapiens
ccatcagccctgc

SEQ ID NO: 5868175 - DNA, 16 bp, Homo sapiens
ccatcagccctgctag

SEQ ID NO: 5868176 - DNA, 23 bp, Homo sapiens
ccatcagcggcgcgccctgcaga

SEQ ID NO: 5868177 - DNA, 21 bp, Homo sapiens
ccatcagcgggtctcctccca

SEQ ID NO: 5868178 - DNA, 15 bp, Homo sapiens
ccatcagctcccaac

SEQ ID NO: 5868179 - DNA, 20 bp, Homo sapiens
ccatcagctcccaacgagcc

SEQ ID NO: 5868180 - DNA, 15 bp, Homo sapiens
ccatcagctctctgc

SEQ ID NO: 5868181 - DNA, 14 bp, Homo sapiens
ccatcagctctgcc

SEQ ID NO: 5868182 - DNA, 17 bp, Homo sapiens
ccatcagctctgccttg

SEQ ID NO: 5868183 - DNA, 14 bp, Homo sapiens
ccatcagctttata

SEQ ID NO: 5868184 - DNA, 12 bp, Homo sapiens
ccatcaggactt

SEQ ID NO: 5868185 - DNA, 17 bp, Homo sapiens
ccatcaggctgttatta

SEQ ID NO: 5868186 - DNA, 22 bp, Homo sapiens
ccatcaggctgttattatgaag

SEQ ID NO: 5868187 - DNA, 15 bp, Homo sapiens
ccatcagggccctgc

SEQ ID NO: 5868188 - DNA, 21 bp, Homo sapiens
ccatcagggccctgccccagg

SEQ ID NO: 5868189 - DNA, 20 bp, Homo sapiens
ccatcagggtaggctggagt

SEQ ID NO: 5868190 - DNA, 14 bp, Homo sapiens
ccatcagggtgggc

SEQ ID NO: 5868191 - DNA, 22 bp, Homo sapiens
ccatcagggtgggccactctcc

SEQ ID NO: 5868192 - DNA, 24 bp, Homo sapiens
ccatcagggtgggccactctcccc

SEQ ID NO: 5868193 - DNA, 20 bp, Homo sapiens
ccatcagggttctcttagca

SEQ ID NO: 5868194 - DNA, 22 bp, Homo sapiens
ccatcaggtcccccccaggtgc

SEQ ID NO: 5868195 - DNA, 17 bp, Homo sapiens
ccatcaggttccatccc

SEQ ID NO: 5868196 - DNA, 15 bp, Homo sapiens
ccatcagtgaaagaa

SEQ ID NO: 5868197 - DNA, 18 bp, Homo sapiens
ccatcagtgccagcccct

SEQ ID NO: 5868198 - DNA, 20 bp, Homo sapiens
ccatcagtgccagcccctgc

SEQ ID NO: 5868199 - DNA, 23 bp, Homo sapiens
ccatcagtggagtccagatggca

SEQ ID NO: 5868200 - DNA, 22 bp, Homo sapiens
ccatcagtgtacccccgcccag

SEQ ID NO: 5868201 - DNA, 23 bp, Homo sapiens
ccatcagtgtacccccgcccagg

SEQ ID NO: 5868202 - DNA, 13 bp, Homo sapiens
ccatcagttactg

SEQ ID NO: 5868203 - DNA, 18 bp, Homo sapiens
ccatcagttactggtttc

SEQ ID NO: 5868204 - DNA, 17 bp, Homo sapiens
ccatcagttccagcctt

SEQ ID NO: 5868205 - DNA, 14 bp, Homo sapiens
ccatcataggctga

SEQ ID NO: 5868206 - DNA, 18 bp, Homo sapiens
ccatcatatgacatgcca

SEQ ID NO: 5868207 - DNA, 19 bp, Homo sapiens
ccatcatatgacatgccac

SEQ ID NO: 5868208 - DNA, 20 bp, Homo sapiens
ccatcatatgacatgccacc

SEQ ID NO: 5868209 - DNA, 20 bp, Homo sapiens
ccatcatcaccgattcttcc

SEQ ID NO: 5868210 - DNA, 13 bp, Homo sapiens
ccatcatcctact

SEQ ID NO: 5868211 - DNA, 11 bp, Homo sapiens
ccatcatcctc

SEQ ID NO: 5868212 - DNA, 13 bp, Homo sapiens
ccatcatctcctg

SEQ ID NO: 5868213 - DNA, 13 bp, Homo sapiens
ccatcatctctga

SEQ ID NO: 5868214 - DNA, 13 bp, Homo sapiens
ccatcatctctgc

SEQ ID NO: 5868215 - DNA, 16 bp, Homo sapiens
ccatcatctctgcctt

SEQ ID NO: 5868216 - DNA, 16 bp, Homo sapiens
ccatcatgcccggtcc

SEQ ID NO: 5868217 - DNA, 15 bp, Homo sapiens
ccatcatgccttgat

SEQ ID NO: 5868218 - DNA, 10 bp, Homo sapiens
ccatcatgtc

SEQ ID NO: 5868219 - DNA, 13 bp, Homo sapiens
ccatcatgtctgt

SEQ ID NO: 5868220 - DNA, 17 bp, Homo sapiens
ccatcatgtgcctggaa

SEQ ID NO: 5868221 - DNA, 20 bp, Homo sapiens
ccatcatgtttacagaggac

SEQ ID NO: 5868222 - DNA, 19 bp, Homo sapiens
ccatcattacccttccctg

SEQ ID NO: 5868223 - DNA, 17 bp, Homo sapiens
ccatcattataaacgtg

SEQ ID NO: 5868224 - DNA, 12 bp, Homo sapiens
ccatcattgaaa

SEQ ID NO: 5868225 - DNA, 16 bp, Homo sapiens
ccatcattgaaatctt

SEQ ID NO: 5868226 - DNA, 17 bp, Homo sapiens
ccatcattgaaatcttt

SEQ ID NO: 5868227 - DNA, 19 bp, Homo sapiens
ccatcattgcacctgcagg

SEQ ID NO: 5868228 - DNA, 22 bp, Homo sapiens
ccatcattgcacctgcaggctt

SEQ ID NO: 5868229 - DNA, 14 bp, Homo sapiens
ccatcatttcattc

SEQ ID NO: 5868230 - DNA, 16 bp, Homo sapiens
ccatcatttctagtat

SEQ ID NO: 5868231 - DNA, 13 bp, Homo sapiens
ccatcatttctgg

SEQ ID NO: 5868232 - DNA, 14 bp, Homo sapiens
ccatcattttacag

SEQ ID NO: 5868233 - DNA, 21 bp, Homo sapiens
ccatcattttacagtgacctt

SEQ ID NO: 5868234 - DNA, 22 bp, Homo sapiens
ccatcattttccatatcctggt

SEQ ID NO: 5868235 - DNA, 17 bp, Homo sapiens
ccatccaaacctacctt

SEQ ID NO: 5868236 - DNA, 22 bp, Homo sapiens
ccatccacacacagcagctcca

SEQ ID NO: 5868237 - DNA, 11 bp, Homo sapiens
ccatccacacc

SEQ ID NO: 5868238 - DNA, 23 bp, Homo sapiens
ccatccacatgggtactgtctcg

SEQ ID NO: 5868239 - DNA, 13 bp, Homo sapiens
ccatccaccacct

SEQ ID NO: 5868240 - DNA, 16 bp, Homo sapiens
ccatccaccaccttgc

SEQ ID NO: 5868241 - DNA, 15 bp, Homo sapiens
ccatccactgtgacg

SEQ ID NO: 5868242 - DNA, 13 bp, Homo sapiens
ccatccagatgtg

SEQ ID NO: 5868243 - DNA, 15 bp, Homo sapiens
ccatccagccacgga

SEQ ID NO: 5868244 - DNA, 23 bp, Homo sapiens
ccatccagccacggagggaggca

SEQ ID NO: 5868245 - DNA, 12 bp, Homo sapiens
ccatccagccag

SEQ ID NO: 5868246 - DNA, 15 bp, Homo sapiens
ccatccagccagggg

SEQ ID NO: 5868247 - DNA, 16 bp, Homo sapiens
ccatccagccaggggt

SEQ ID NO: 5868248 - DNA, 12 bp, Homo sapiens
ccatccagcctc

SEQ ID NO: 5868249 - DNA, 15 bp, Homo sapiens
ccatccagcctccag

SEQ ID NO: 5868250 - DNA, 19 bp, Homo sapiens
ccatccagcctccagggca

SEQ ID NO: 5868251 - DNA, 15 bp, Homo sapiens
ccatccagcttgcca

SEQ ID NO: 5868252 - DNA, 20 bp, Homo sapiens
ccatccagggtctggcagag

SEQ ID NO: 5868253 - DNA, 13 bp, Homo sapiens
ccatccaggtctt

SEQ ID NO: 5868254 - DNA, 18 bp, Homo sapiens
ccatccaggttcagcttg

SEQ ID NO: 5868255 - DNA, 19 bp, Homo sapiens
ccatccaggttcagcttgt

SEQ ID NO: 5868256 - DNA, 18 bp, Homo sapiens
ccatccagtgacaaacca

SEQ ID NO: 5868257 - DNA, 21 bp, Homo sapiens
ccatccataaatccagttcta

SEQ ID NO: 5868258 - DNA, 16 bp, Homo sapiens
ccatccatctgtccgt

SEQ ID NO: 5868259 - DNA, 23 bp, Homo sapiens
ccatccatctgtccgtccagagc

SEQ ID NO: 5868260 - DNA, 13 bp, Homo sapiens
ccatccatggcca

SEQ ID NO: 5868261 - DNA, 18 bp, Homo sapiens
ccatccatggccagcagc

SEQ ID NO: 5868262 - DNA, 14 bp, Homo sapiens
ccatccatgtgttc

SEQ ID NO: 5868263 - DNA, 17 bp, Homo sapiens
ccatccattaggccagc

SEQ ID NO: 5868264 - DNA, 23 bp, Homo sapiens
ccatcccaaacccttcagtgcca

SEQ ID NO: 5868265 - DNA, 16 bp, Homo sapiens
ccatcccacaccctgg

SEQ ID NO: 5868266 - DNA, 12 bp, Homo sapiens
ccatcccacatt

SEQ ID NO: 5868267 - DNA, 23 bp, Homo sapiens
ccatcccacattcggaccctgcc

SEQ ID NO: 5868268 - DNA, 14 bp, Homo sapiens
ccatcccactccac

SEQ ID NO: 5868269 - DNA, 15 bp, Homo sapiens
ccatcccagccccaa

SEQ ID NO: 5868270 - DNA, 23 bp, Homo sapiens
ccatcccaggacaccacacccag

SEQ ID NO: 5868271 - DNA, 24 bp, Homo sapiens
ccatcccaggacaccacacccagc

SEQ ID NO: 5868272 - DNA, 11 bp, Homo sapiens
ccatcccaggg

SEQ ID NO: 5868273 - DNA, 15 bp, Homo sapiens
ccatcccagtccctc

SEQ ID NO: 5868274 - DNA, 16 bp, Homo sapiens
ccatcccatcccatcc

SEQ ID NO: 5868275 - DNA, 21 bp, Homo sapiens
ccatccccaaactgtgccctg

SEQ ID NO: 5868276 - DNA, 14 bp, Homo sapiens
ccatccccaccagc

SEQ ID NO: 5868277 - DNA, 15 bp, Homo sapiens
ccatccccaccagct

SEQ ID NO: 5868278 - DNA, 13 bp, Homo sapiens
ccatccccagcga

SEQ ID NO: 5868279 - DNA, 15 bp, Homo sapiens
ccatccccagctggt

SEQ ID NO: 5868280 - DNA, 17 bp, Homo sapiens
ccatccccatcctccag

SEQ ID NO: 5868281 - DNA, 22 bp, Homo sapiens
ccatcccccactgccacaccct

SEQ ID NO: 5868282 - DNA, 12 bp, Homo sapiens
ccatccccctgc

SEQ ID NO: 5868283 - DNA, 14 bp, Homo sapiens
ccatgaaggcacct

SEQ ID NO: 5868284 - DNA, 15 bp, Homo sapiens
ccatgaaggcacctg

SEQ ID NO: 5868285 - DNA, 22 bp, Homo sapiens
ccatgaaggcacctgcccccac

SEQ ID NO: 5868286 - DNA, 20 bp, Homo sapiens
ccatgaaggctggaaggcag

SEQ ID NO: 5868287 - DNA, 23 bp, Homo sapiens
ccatgaaggctggaaggcagcag

SEQ ID NO: 5868288 - DNA, 17 bp, Homo sapiens
ccatgaatcaaagacat

SEQ ID NO: 5868289 - DNA, 15 bp, Homo sapiens
ccatgaatcgcttct

SEQ ID NO: 5868290 - DNA, 18 bp, Homo sapiens
ccatgaatcgcttctctt

SEQ ID NO: 5868291 - DNA, 22 bp, Homo sapiens
ccatgaatgaacccctggctcc

SEQ ID NO: 5868292 - DNA, 13 bp, Homo sapiens
ccatgaatttcta

SEQ ID NO: 5868293 - DNA, 11 bp, Homo sapiens
ccatgacaaac

SEQ ID NO: 5868294 - DNA, 17 bp, Homo sapiens
ccatgacacccaagggt

SEQ ID NO: 5868295 - DNA, 14 bp, Homo sapiens
ccatgacagaggct

SEQ ID NO: 5868296 - DNA, 15 bp, Homo sapiens
ccatgacagaggctg

SEQ ID NO: 5868297 - DNA, 16 bp, Homo sapiens
ccatgacagaggctgc

SEQ ID NO: 5868298 - DNA, 20 bp, Homo sapiens
ccatgacaggcctgaagata

SEQ ID NO: 5868299 - DNA, 14 bp, Homo sapiens
ccatgacagtagca

SEQ ID NO: 5868300 - DNA, 18 bp, Homo sapiens
ccatgacatttcatctgg

SEQ ID NO: 5868301 - DNA, 14 bp, Homo sapiens
ccatgacatttttc

SEQ ID NO: 5868302 - DNA, 15 bp, Homo sapiens
ccatgaccaggccac

SEQ ID NO: 5868303 - DNA, 20 bp, Homo sapiens
ccatgaccaggccaccatct

SEQ ID NO: 5868304 - DNA, 12 bp, Homo sapiens
ccatgacccacc

SEQ ID NO: 5868305 - DNA, 18 bp, Homo sapiens
ccatgacccacccctgtg

SEQ ID NO: 5868306 - DNA, 20 bp, Homo sapiens
ccatgacccacccctgtgct

SEQ ID NO: 5868307 - DNA, 14 bp, Homo sapiens
ccatgacccaggct

SEQ ID NO: 5868308 - DNA, 18 bp, Homo sapiens
ccatgacccaggctgggc

SEQ ID NO: 5868309 - DNA, 20 bp, Homo sapiens
ccatgaccccttctctctcc

SEQ ID NO: 5868310 - DNA, 15 bp, Homo sapiens
ccatgaccctgcctc

SEQ ID NO: 5868311 - DNA, 17 bp, Homo sapiens
ccatgaccctgcctctc

SEQ ID NO: 5868312 - DNA, 23 bp, Homo sapiens
ccatgaccctgcctctcccaggc

SEQ ID NO: 5868313 - DNA, 13 bp, Homo sapiens
ccatgacctcacc

SEQ ID NO: 5868314 - DNA, 19 bp, Homo sapiens
ccatgacctcacccctcct

SEQ ID NO: 5868315 - DNA, 21 bp, Homo sapiens
ccatgacctccagctttcctg

SEQ ID NO: 5868316 - DNA, 17 bp, Homo sapiens
ccatgacctcccctccc

SEQ ID NO: 5868317 - DNA, 19 bp, Homo sapiens
ccatgaccttaaggcagta

SEQ ID NO: 5868318 - DNA, 22 bp, Homo sapiens
ccatgacgcaaagagagatttt

SEQ ID NO: 5868319 - DNA, 14 bp, Homo sapiens
ccatgactcttgga

SEQ ID NO: 5868320 - DNA, 21 bp, Homo sapiens
ccatgactcttggagcctctt

SEQ ID NO: 5868321 - DNA, 21 bp, Homo sapiens
ccatgactgcacccagctcca

SEQ ID NO: 5868322 - DNA, 17 bp, Homo sapiens
ccatgactgccccttgc

SEQ ID NO: 5868323 - DNA, 18 bp, Homo sapiens
ccatgactgccccttgct

SEQ ID NO: 5868324 - DNA, 13 bp, Homo sapiens
ccatgactgcttg

SEQ ID NO: 5868325 - DNA, 21 bp, Homo sapiens
ccatgactgcttgccctaagc

SEQ ID NO: 5868326 - DNA, 22 bp, Homo sapiens
ccatgactgcttgccctaagca

SEQ ID NO: 5868327 - DNA, 16 bp, Homo sapiens
ccatgactggctgtct

SEQ ID NO: 5868328 - DNA, 23 bp, Homo sapiens
ccatgactgtgtgttgtgaaata

SEQ ID NO: 5868329 - DNA, 18 bp, Homo sapiens
ccatgagaagagggcctg

SEQ ID NO: 5868330 - DNA, 19 bp, Homo sapiens
ccatgagaagagggcctgt

SEQ ID NO: 5868331 - DNA, 22 bp, Homo sapiens
ccatgagaatgttttagcacag

SEQ ID NO: 5868332 - DNA, 23 bp, Homo sapiens
ccatgagaccctggtgcctggct

SEQ ID NO: 5868333 - DNA, 20 bp, Homo sapiens
ccatgagactgccctgccca

SEQ ID NO: 5868334 - DNA, 22 bp, Homo sapiens
ccatgagactgccctgcccagg

SEQ ID NO: 5868335 - DNA, 15 bp, Homo sapiens
ccatgagagcgcagc

SEQ ID NO: 5868336 - DNA, 22 bp, Homo sapiens
ccatgagcaccccaaggctgcg

SEQ ID NO: 5868337 - DNA, 19 bp, Homo sapiens
ccatgagcctcagcatcct

SEQ ID NO: 5868338 - DNA, 12 bp, Homo sapiens
ccatgagctcct

SEQ ID NO: 5868339 - DNA, 22 bp, Homo sapiens
ccatgagctcggggtccaccag

SEQ ID NO: 5868340 - DNA, 15 bp, Homo sapiens
ccatgagctgctcat

SEQ ID NO: 5868341 - DNA, 17 bp, Homo sapiens
ccatgaggaacaaggca

SEQ ID NO: 5868342 - DNA, 20 bp, Homo sapiens
ccatgaggaacaaggcaagg

SEQ ID NO: 5868343 - DNA, 17 bp, Homo sapiens
ccatgaggaaggaacag

SEQ ID NO: 5868344 - DNA, 17 bp, Homo sapiens
ccatgaggactaggagc

SEQ ID NO: 5868345 - DNA, 23 bp, Homo sapiens
ccatgaggagaaaaaaagcatgt

SEQ ID NO: 5868346 - DNA, 17 bp, Homo sapiens
ccatgaggaggcagaga

SEQ ID NO: 5868347 - DNA, 18 bp, Homo sapiens
ccatgaggagttgctgtt

SEQ ID NO: 5868348 - DNA, 22 bp, Homo sapiens
ccatgaggcctttccccagtgt

SEQ ID NO: 5868349 - DNA, 15 bp, Homo sapiens
ccatgaggctcactc

SEQ ID NO: 5868350 - DNA, 15 bp, Homo sapiens
ccatgagggacaggg

SEQ ID NO: 5868351 - DNA, 19 bp, Homo sapiens
ccatgagggagatgccatg

SEQ ID NO: 5868352 - DNA, 20 bp, Homo sapiens
ccatgagggagatgccatga

SEQ ID NO: 5868353 - DNA, 21 bp, Homo sapiens
ccatgagggagatgccatgag

SEQ ID NO: 5868354 - DNA, 14 bp, Homo sapiens
ccatgagggctgga

SEQ ID NO: 5868355 - DNA, 20 bp, Homo sapiens
ccatgagggctggagaccag

SEQ ID NO: 5868356 - DNA, 16 bp, Homo sapiens
ccatgaggtaaaagag

SEQ ID NO: 5868357 - DNA, 18 bp, Homo sapiens
ccatgagtccatgtccta

SEQ ID NO: 5868358 - DNA, 19 bp, Homo sapiens
ccatgagtccatgtcctat

SEQ ID NO: 5868359 - DNA, 21 bp, Homo sapiens
ccatgagtccatgtcctatgc

SEQ ID NO: 5868360 - DNA, 14 bp, Homo sapiens
ccatgagtgtgggc

SEQ ID NO: 5868361 - DNA, 19 bp, Homo sapiens
ccatgagtgtgggccatcg

SEQ ID NO: 5868362 - DNA, 17 bp, Homo sapiens
ccatgagtttgccctgg

SEQ ID NO: 5868363 - DNA, 18 bp, Homo sapiens
ccatgagtttgccctggt

SEQ ID NO: 5868364 - DNA, 14 bp, Homo sapiens
ccatgataaaataa

SEQ ID NO: 5868365 - DNA, 14 bp, Homo sapiens
ccatgataagaaca

SEQ ID NO: 5868366 - DNA, 14 bp, Homo sapiens
ccatgatactttaa

SEQ ID NO: 5868367 - DNA, 13 bp, Homo sapiens
ccatgatagctgg

SEQ ID NO: 5868368 - DNA, 18 bp, Homo sapiens
ccatgatcaaaatgcata

SEQ ID NO: 5868369 - DNA, 15 bp, Homo sapiens
ccatgatcacacagc

SEQ ID NO: 5868370 - DNA, 16 bp, Homo sapiens
ccatgatccctgtgtt

SEQ ID NO: 5868371 - DNA, 21 bp, Homo sapiens
ccatgatcgagccactgcact

SEQ ID NO: 5868372 - DNA, 20 bp, Homo sapiens
ccatgatctgcaggggtctg

SEQ ID NO: 5868373 - DNA, 19 bp, Homo sapiens
ccatgatctgtatttaatg

SEQ ID NO: 5868374 - DNA, 22 bp, Homo sapiens
ccatgatgacaactacagaaaa

SEQ ID NO: 5868375 - DNA, 18 bp, Homo sapiens
ccatgatgcacagtatct

SEQ ID NO: 5868376 - DNA, 19 bp, Homo sapiens
ccatgatgcacagtatctg

SEQ ID NO: 5868377 - DNA, 15 bp, Homo sapiens
ccatgatgctgagcc

SEQ ID NO: 5868378 - DNA, 16 bp, Homo sapiens
ccatgatgctgagccc

SEQ ID NO: 5868379 - DNA, 17 bp, Homo sapiens
ccatgatgctgagcccg

SEQ ID NO: 5868380 - DNA, 14 bp, Homo sapiens
ccatgatggcaaca

SEQ ID NO: 5868381 - DNA, 18 bp, Homo sapiens
ccatgatggccaggctga

SEQ ID NO: 5868382 - DNA, 19 bp, Homo sapiens
ccatgatggtgctgacctc

SEQ ID NO: 5868383 - DNA, 22 bp, Homo sapiens
ccatgatggtgctgacctctgg

SEQ ID NO: 5868384 - DNA, 13 bp, Homo sapiens
ccatgatgtatat

SEQ ID NO: 5868385 - DNA, 13 bp, Homo sapiens
ccatgatgtcctt

SEQ ID NO: 5868386 - DNA, 23 bp, Homo sapiens
ccatgatgtcgttcattttctgt

SEQ ID NO: 5868387 - DNA, 20 bp, Homo sapiens
ccatgattccaagggcccag

SEQ ID NO: 5868388 - DNA, 14 bp, Homo sapiens
ccatgattccctcc

SEQ ID NO: 5868389 - DNA, 16 bp, Homo sapiens
ccatgattccctcctc

SEQ ID NO: 5868390 - DNA, 15 bp, Homo sapiens
ccatgatttagcaag

SEQ ID NO: 5868391 - DNA, 18 bp, Homo sapiens
ccatgatttcatgtactg

SEQ ID NO: 5868392 - DNA, 21 bp, Homo sapiens
ccatgatttcatgtactgcat

SEQ ID NO: 5868393 - DNA, 23 bp, Homo sapiens
ccatgatttcccactgcactcca

SEQ ID NO: 5868394 - DNA, 21 bp, Homo sapiens
ccatgatttgtcccagcctgg

SEQ ID NO: 5868395 - DNA, 16 bp, Homo sapiens
ccatgattttctaaaa

SEQ ID NO: 5868396 - DNA, 16 bp, Homo sapiens
ccatgattttggccac

SEQ ID NO: 5868397 - DNA, 17 bp, Homo sapiens
ccatgattttggccact

SEQ ID NO: 5868398 - DNA, 22 bp, Homo sapiens
ccatgcaaagcaacgactactt

SEQ ID NO: 5868399 - DNA, 16 bp, Homo sapiens
ccatgcaaattgtgaa

SEQ ID NO: 5868400 - DNA, 14 bp, Homo sapiens
ccatgcaacatgga

SEQ ID NO: 5868401 - DNA, 12 bp, Homo sapiens
ccatgcaactgg

SEQ ID NO: 5868402 - DNA, 19 bp, Homo sapiens
ccatgcaagcagaggacca

SEQ ID NO: 5868403 - DNA, 17 bp, Homo sapiens
ccatgcaattcatccca

SEQ ID NO: 5868404 - DNA, 12 bp, Homo sapiens
ccatgcaccaaa

SEQ ID NO: 5868405 - DNA, 14 bp, Homo sapiens
ccatgcagaaagca

SEQ ID NO: 5868406 - DNA, 15 bp, Homo sapiens
ccatgcagaaagcat

SEQ ID NO: 5868407 - DNA, 12 bp, Homo sapiens
ccatgcagacct

SEQ ID NO: 5868408 - DNA, 18 bp, Homo sapiens
ccatgcagacctcatgcc

SEQ ID NO: 5868409 - DNA, 22 bp, Homo sapiens
ccatgcagacctcatgcccagc

SEQ ID NO: 5868410 - DNA, 12 bp, Homo sapiens
ccatgcagagcg

SEQ ID NO: 5868411 - DNA, 15 bp, Homo sapiens
ccatgcagataacag

SEQ ID NO: 5868412 - DNA, 22 bp, Homo sapiens
ccatgcagatctagccaggcct

SEQ ID NO: 5868413 - DNA, 15 bp, Homo sapiens
ccatgcagccttggg

SEQ ID NO: 5868414 - DNA, 17 bp, Homo sapiens
ccatgcagctgctcccc

SEQ ID NO: 5868415 - DNA, 19 bp, Homo sapiens
ccatgcaggaagaggccca

SEQ ID NO: 5868416 - DNA, 16 bp, Homo sapiens
ccatgcaggaaggaaa

SEQ ID NO: 5868417 - DNA, 13 bp, Homo sapiens
ccatgcaggaggt

SEQ ID NO: 5868418 - DNA, 21 bp, Homo sapiens
ccatgcaggcagcctgcagac

SEQ ID NO: 5868419 - DNA, 17 bp, Homo sapiens
ccatgcaggccctttga

SEQ ID NO: 5868420 - DNA, 23 bp, Homo sapiens
ccatgcaggctaaagtgattcct

SEQ ID NO: 5868421 - DNA, 12 bp, Homo sapiens
ccatgcaggggg

SEQ ID NO: 5868422 - DNA, 19 bp, Homo sapiens
ccatgcaggggtcagtgca

SEQ ID NO: 5868423 - DNA, 19 bp, Homo sapiens
ccatgcagtgaccgcttcc

SEQ ID NO: 5868424 - DNA, 18 bp, Homo sapiens
ccatgcatgacagcctct

SEQ ID NO: 5868425 - DNA, 15 bp, Homo sapiens
ccatgcatgatgggt

SEQ ID NO: 5868426 - DNA, 12 bp, Homo sapiens
ccatgcatggcc

SEQ ID NO: 5868427 - DNA, 15 bp, Homo sapiens
ccatgcatggcctcc

SEQ ID NO: 5868428 - DNA, 17 bp, Homo sapiens
ccatgcatggcctccca

SEQ ID NO: 5868429 - DNA, 22 bp, Homo sapiens
ccatgcatggcctcccagccac

SEQ ID NO: 5868430 - DNA, 13 bp, Homo sapiens
ccatgccaaggcc

SEQ ID NO: 5868431 - DNA, 22 bp, Homo sapiens
ccatgccaaggcctccctcagg

SEQ ID NO: 5868432 - DNA, 13 bp, Homo sapiens
ccatgccaataaa

SEQ ID NO: 5868433 - DNA, 22 bp, Homo sapiens
ccatgccaatagttgctgtccc

SEQ ID NO: 5868434 - DNA, 16 bp, Homo sapiens
ccatgccaccacccac

SEQ ID NO: 5868435 - DNA, 19 bp, Homo sapiens
ccatgccaccacccacccc

SEQ ID NO: 5868436 - DNA, 19 bp, Homo sapiens
ccatgccactgccaggcac

SEQ ID NO: 5868437 - DNA, 13 bp, Homo sapiens
ccatgccagagag

SEQ ID NO: 5868438 - DNA, 23 bp, Homo sapiens
ccatgccagattctgcctctctg

SEQ ID NO: 5868439 - DNA, 14 bp, Homo sapiens
ccatgccagctggc

SEQ ID NO: 5868440 - DNA, 12 bp, Homo sapiens
ccatgcccaacc

SEQ ID NO: 5868441 - DNA, 14 bp, Homo sapiens
ccatgcccaccatc

SEQ ID NO: 5868442 - DNA, 15 bp, Homo sapiens
ccatgcccacctgcc

SEQ ID NO: 5868443 - DNA, 17 bp, Homo sapiens
ccatgcccacctgccca

SEQ ID NO: 5868444 - DNA, 18 bp, Homo sapiens
ccatgcccacctgcccat

SEQ ID NO: 5868445 - DNA, 17 bp, Homo sapiens
ccatgcccactgctggt

SEQ ID NO: 5868446 - DNA, 19 bp, Homo sapiens
ccatgccccacccccctcc

SEQ ID NO: 5868447 - DNA, 23 bp, Homo sapiens
ccatgccccacccccctcctccc

SEQ ID NO: 5868448 - DNA, 22 bp, Homo sapiens
ccatgccccactctgctgaggc

SEQ ID NO: 5868449 - DNA, 17 bp, Homo sapiens
ccatgccccagctctgg

SEQ ID NO: 5868450 - DNA, 11 bp, Homo sapiens
ccatgccccca

SEQ ID NO: 5868451 - DNA, 11 bp, Homo sapiens
ccatgccccct

SEQ ID NO: 5868452 - DNA, 18 bp, Homo sapiens
ccatgcccccttcgctcc

SEQ ID NO: 5868453 - DNA, 15 bp, Homo sapiens
ccatgcccctcccct

SEQ ID NO: 5868454 - DNA, 15 bp, Homo sapiens
ccatgcccctgacag

SEQ ID NO: 5868455 - DNA, 14 bp, Homo sapiens
ccatgccctcccag

SEQ ID NO: 5868456 - DNA, 17 bp, Homo sapiens
ccatgccctccctgctg

SEQ ID NO: 5868457 - DNA, 22 bp, Homo sapiens
ccatgccctccgtcctggcagg

SEQ ID NO: 5868458 - DNA, 11 bp, Homo sapiens
ccatgccctgc

SEQ ID NO: 5868459 - DNA, 15 bp, Homo sapiens
ccatgccctgccaag

SEQ ID NO: 5868460 - DNA, 18 bp, Homo sapiens
ccatgccctgccaagcct

SEQ ID NO: 5868461 - DNA, 22 bp, Homo sapiens
ccatgggatgttaagcaaagga

SEQ ID NO: 5868462 - DNA, 16 bp, Homo sapiens
ccatgggcagagccca

SEQ ID NO: 5868463 - DNA, 14 bp, Homo sapiens
ccatgggcagagga

SEQ ID NO: 5868464 - DNA, 14 bp, Homo sapiens
ccatgggcaggaga

SEQ ID NO: 5868465 - DNA, 15 bp, Homo sapiens
ccatgggccaccgcc

SEQ ID NO: 5868466 - DNA, 15 bp, Homo sapiens
ccatgggccagccta

SEQ ID NO: 5868467 - DNA, 16 bp, Homo sapiens
ccatgggccagcctag

SEQ ID NO: 5868468 - DNA, 19 bp, Homo sapiens
ccatgggccccaccattta

SEQ ID NO: 5868469 - DNA, 12 bp, Homo sapiens
ccatgggccctc

SEQ ID NO: 5868470 - DNA, 18 bp, Homo sapiens
ccatgggccctctgagca

SEQ ID NO: 5868471 - DNA, 23 bp, Homo sapiens
ccatgggcctgctgcgtcagacc

SEQ ID NO: 5868472 - DNA, 12 bp, Homo sapiens
ccatgggcctgg

SEQ ID NO: 5868473 - DNA, 17 bp, Homo sapiens
ccatgggcctgggcctg

SEQ ID NO: 5868474 - DNA, 14 bp, Homo sapiens
ccatgggctaggag

SEQ ID NO: 5868475 - DNA, 15 bp, Homo sapiens
ccatgggctcagggc

SEQ ID NO: 5868476 - DNA, 16 bp, Homo sapiens
ccatgggctcagggcc

SEQ ID NO: 5868477 - DNA, 18 bp, Homo sapiens
ccatgggctcagggccag

SEQ ID NO: 5868478 - DNA, 19 bp, Homo sapiens
ccatgggctcagggccagg

SEQ ID NO: 5868479 - DNA, 17 bp, Homo sapiens
ccatgggctcctgcccc

SEQ ID NO: 5868480 - DNA, 18 bp, Homo sapiens
ccatgggctcctgcccct

SEQ ID NO: 5868481 - DNA, 13 bp, Homo sapiens
ccatgggctctga

SEQ ID NO: 5868482 - DNA, 17 bp, Homo sapiens
ccatgggctctggcccc

SEQ ID NO: 5868483 - DNA, 14 bp, Homo sapiens
ccatgggctgctgg

SEQ ID NO: 5868484 - DNA, 23 bp, Homo sapiens
ccatggggaaaccctggagccat

SEQ ID NO: 5868485 - DNA, 11 bp, Homo sapiens
ccatggggaag

SEQ ID NO: 5868486 - DNA, 20 bp, Homo sapiens
ccatggggaagtgctcccca

SEQ ID NO: 5868487 - DNA, 22 bp, Homo sapiens
ccatggggaggagacctttgat

SEQ ID NO: 5868488 - DNA, 18 bp, Homo sapiens
ccatggggatcagagtct

SEQ ID NO: 5868489 - DNA, 13 bp, Homo sapiens
ccatggggcagcc

SEQ ID NO: 5868490 - DNA, 20 bp, Homo sapiens
ccatggggcagcctccagtc

SEQ ID NO: 5868491 - DNA, 22 bp, Homo sapiens
ccatggggcagcctccagtctg

SEQ ID NO: 5868492 - DNA, 23 bp, Homo sapiens
ccatggggcagcctccagtctgc

SEQ ID NO: 5868493 - DNA, 13 bp, Homo sapiens
ccatggggccctc

SEQ ID NO: 5868494 - DNA, 22 bp, Homo sapiens
ccatgggggtttggggctaaga

SEQ ID NO: 5868495 - DNA, 23 bp, Homo sapiens
ccatggggtaggaggatgggctc

SEQ ID NO: 5868496 - DNA, 17 bp, Homo sapiens
ccatggggtccatcccc

SEQ ID NO: 5868497 - DNA, 16 bp, Homo sapiens
ccatggggtccttgga

SEQ ID NO: 5868498 - DNA, 19 bp, Homo sapiens
ccatggggtcggctcctga

SEQ ID NO: 5868499 - DNA, 20 bp, Homo sapiens
ccatggggtctctgcatctt

SEQ ID NO: 5868500 - DNA, 16 bp, Homo sapiens
ccatggggttcgagac

SEQ ID NO: 5868501 - DNA, 17 bp, Homo sapiens
ccatggggttcgagact

SEQ ID NO: 5868502 - DNA, 11 bp, Homo sapiens
ccatgggtatg

SEQ ID NO: 5868503 - DNA, 16 bp, Homo sapiens
ccatgggtctggcctg

SEQ ID NO: 5868504 - DNA, 15 bp, Homo sapiens
ccatgggtctggcta

SEQ ID NO: 5868505 - DNA, 23 bp, Homo sapiens
ccatgggtctggctagagggccc

SEQ ID NO: 5868506 - DNA, 17 bp, Homo sapiens
ccatgggtgtggatggc

SEQ ID NO: 5868507 - DNA, 19 bp, Homo sapiens
ccatgggtgtggatggcag

SEQ ID NO: 5868508 - DNA, 20 bp, Homo sapiens
ccatgggtgtggatggcagt

SEQ ID NO: 5868509 - DNA, 16 bp, Homo sapiens
ccatggtaaccagcca

SEQ ID NO: 5868510 - DNA, 16 bp, Homo sapiens
ccatggtacccccttc

SEQ ID NO: 5868511 - DNA, 14 bp, Homo sapiens
ccatggtagtttaa

SEQ ID NO: 5868512 - DNA, 14 bp, Homo sapiens
ccatggtcacagac

SEQ ID NO: 5868513 - DNA, 16 bp, Homo sapiens
ccatggtcacagaccc

SEQ ID NO: 5868514 - DNA, 17 bp, Homo sapiens
ccatggtcacagacccc

SEQ ID NO: 5868515 - DNA, 18 bp, Homo sapiens
ccatggtcacagacccct

SEQ ID NO: 5868516 - DNA, 16 bp, Homo sapiens
ccatggtcaccctcag

SEQ ID NO: 5868517 - DNA, 17 bp, Homo sapiens
ccatggtccatcccctg

SEQ ID NO: 5868518 - DNA, 19 bp, Homo sapiens
ccatggtccatcccctgag

SEQ ID NO: 5868519 - DNA, 15 bp, Homo sapiens
ccatggtccctagca

SEQ ID NO: 5868520 - DNA, 16 bp, Homo sapiens
ccatggtcctgtctgt

SEQ ID NO: 5868521 - DNA, 23 bp, Homo sapiens
ccatggtcctgtctgtccttctg

SEQ ID NO: 5868522 - DNA, 20 bp, Homo sapiens
ccatggtctttccactttca

SEQ ID NO: 5868523 - DNA, 21 bp, Homo sapiens
ccatggtgaactgaagcagag

SEQ ID NO: 5868524 - DNA, 17 bp, Homo sapiens
ccatggtgacacacagc

SEQ ID NO: 5868525 - DNA, 13 bp, Homo sapiens
ccatggtgagaaa

SEQ ID NO: 5868526 - DNA, 16 bp, Homo sapiens
ccatggtgatggtgta

SEQ ID NO: 5868527 - DNA, 22 bp, Homo sapiens
ccatggtgcccgtgcctctgtg

SEQ ID NO: 5868528 - DNA, 21 bp, Homo sapiens
ccatggtggagggcacttcag

SEQ ID NO: 5868529 - DNA, 23 bp, Homo sapiens
ccatggtggagggcacttcaggt

SEQ ID NO: 5868530 - DNA, 14 bp, Homo sapiens
ccatggtggcctca

SEQ ID NO: 5868531 - DNA, 20 bp, Homo sapiens
ccatggtggtttcagaaagg

SEQ ID NO: 5868532 - DNA, 19 bp, Homo sapiens
ccatggtgtgatcgtctga

SEQ ID NO: 5868533 - DNA, 18 bp, Homo sapiens
ccatggtgtgtttgtaat

SEQ ID NO: 5868534 - DNA, 20 bp, Homo sapiens
ccatggtgtgtttgtaataa

SEQ ID NO: 5868535 - DNA, 13 bp, Homo sapiens
ccatggtgttgga

SEQ ID NO: 5868536 - DNA, 16 bp, Homo sapiens
ccatggtgttggaggg

SEQ ID NO: 5868537 - DNA, 19 bp, Homo sapiens
ccatggtgttggaggggca

SEQ ID NO: 5868538 - DNA, 20 bp, Homo sapiens
ccatggtgttggaggggcag

SEQ ID NO: 5868539 - DNA, 21 bp, Homo sapiens
ccatggttttggctctcccac

SEQ ID NO: 5868540 - DNA, 16 bp, Homo sapiens
ccatgtaaaacaaaaa

SEQ ID NO: 5868541 - DNA, 23 bp, Homo sapiens
ccatgtaaatccccactgggacc

SEQ ID NO: 5868542 - DNA, 18 bp, Homo sapiens
ccatgtaaggtatcagtt

SEQ ID NO: 5868543 - DNA, 21 bp, Homo sapiens
ccatgtaaggttgtgcagggt

SEQ ID NO: 5868544 - DNA, 23 bp, Homo sapiens
ccatgtaaggttgtgcagggtgt

SEQ ID NO: 5868545 - DNA, 16 bp, Homo sapiens
ccatgtacatgaagaa

SEQ ID NO: 5868546 - DNA, 16 bp, Homo sapiens
ccatgtaccagtgtac

SEQ ID NO: 5868547 - DNA, 22 bp, Homo sapiens
ccatgtaccagtgtactgcttt

SEQ ID NO: 5868548 - DNA, 22 bp, Homo sapiens
ccatgtacccattgcagaccct

SEQ ID NO: 5868549 - DNA, 19 bp, Homo sapiens
ccatgtacctcccctgcct

SEQ ID NO: 5868550 - DNA, 18 bp, Homo sapiens
ccatgtactcaagtacca

SEQ ID NO: 5868551 - DNA, 13 bp, Homo sapiens
ccatgtactgtag

SEQ ID NO: 5868552 - DNA, 16 bp, Homo sapiens
ccatgtagaagaggga

SEQ ID NO: 5868553 - DNA, 17 bp, Homo sapiens
ccatgtagaagagggag

SEQ ID NO: 5868554 - DNA, 20 bp, Homo sapiens
ccatgtagaagagggagaag

SEQ ID NO: 5868555 - DNA, 15 bp, Homo sapiens
ccatgtagccaccca

SEQ ID NO: 5868556 - DNA, 23 bp, Homo sapiens
ccatgtagccccctggcctctgt

SEQ ID NO: 5868557 - DNA, 20 bp, Homo sapiens
ccatgtagttttaacagaac

SEQ ID NO: 5868558 - DNA, 22 bp, Homo sapiens
ccatgtataatttttttcttgt

SEQ ID NO: 5868559 - DNA, 15 bp, Homo sapiens
ccatgtatctacctc

SEQ ID NO: 5868560 - DNA, 18 bp, Homo sapiens
ccatgtatggccaggaag

SEQ ID NO: 5868561 - DNA, 15 bp, Homo sapiens
ccatgtatgttgcat

SEQ ID NO: 5868562 - DNA, 19 bp, Homo sapiens
ccatgtatgttgcatgaat

SEQ ID NO: 5868563 - DNA, 15 bp, Homo sapiens
ccatgtattcatcca

SEQ ID NO: 5868564 - DNA, 17 bp, Homo sapiens
ccatgtattcatccaga

SEQ ID NO: 5868565 - DNA, 16 bp, Homo sapiens
ccatgtatttatctct

SEQ ID NO: 5868566 - DNA, 17 bp, Homo sapiens
ccatgtatttcagggac

SEQ ID NO: 5868567 - DNA, 21 bp, Homo sapiens
ccatgtatttcagggacctca

SEQ ID NO: 5868568 - DNA, 22 bp, Homo sapiens
ccatgtatttcagggacctcag

SEQ ID NO: 5868569 - DNA, 14 bp, Homo sapiens
ccatgtatttgtta

SEQ ID NO: 5868570 - DNA, 16 bp, Homo sapiens
ccatgtcaaacaaata

SEQ ID NO: 5868571 - DNA, 22 bp, Homo sapiens
ccatgtcaagagtcgctgtgcc

SEQ ID NO: 5868572 - DNA, 19 bp, Homo sapiens
ccatgtcaagattcagcta

SEQ ID NO: 5868573 - DNA, 23 bp, Homo sapiens
ccatgtcaccggatcctgggtgg

SEQ ID NO: 5868574 - DNA, 14 bp, Homo sapiens
ccatgtcacctcag

SEQ ID NO: 5868575 - DNA, 17 bp, Homo sapiens
ccatgtcacctcagctg

SEQ ID NO: 5868576 - DNA, 16 bp, Homo sapiens
ccatgtcacctggctg

SEQ ID NO: 5868577 - DNA, 22 bp, Homo sapiens
ccatgtcacctggctgctaggc

SEQ ID NO: 5868578 - DNA, 15 bp, Homo sapiens
ccatgtcactgcaga

SEQ ID NO: 5868579 - DNA, 13 bp, Homo sapiens
ccatgtcactgtg

SEQ ID NO: 5868580 - DNA, 15 bp, Homo sapiens
ccatgtcagacacag

SEQ ID NO: 5868581 - DNA, 21 bp, Homo sapiens
ccatgtcaggccagcctgtcc

SEQ ID NO: 5868582 - DNA, 13 bp, Homo sapiens
ccatgtcccaccc

SEQ ID NO: 5868583 - DNA, 14 bp, Homo sapiens
ccatgtcgcttttg

SEQ ID NO: 5868584 - DNA, 13 bp, Homo sapiens
ccatgtcggcctc

SEQ ID NO: 5868585 - DNA, 15 bp, Homo sapiens
ccatgtctcctgcat

SEQ ID NO: 5868586 - DNA, 20 bp, Homo sapiens
ccatgtctctgagcattaga

SEQ ID NO: 5868587 - DNA, 23 bp, Homo sapiens
ccatgtctgagcggcgcagagcc

SEQ ID NO: 5868588 - DNA, 13 bp, Homo sapiens
ccatgtcttctgc

SEQ ID NO: 5868589 - DNA, 13 bp, Homo sapiens
ccatgtctttctc

SEQ ID NO: 5868590 - DNA, 21 bp, Homo sapiens
ccatgtctttctccaaagtta

SEQ ID NO: 5868591 - DNA, 15 bp, Homo sapiens
ccatgtgaaaataaa

SEQ ID NO: 5868592 - DNA, 17 bp, Homo sapiens
ccatgtgactctggctt

SEQ ID NO: 5868593 - DNA, 13 bp, Homo sapiens
ccatgtgagccac

SEQ ID NO: 5868594 - DNA, 16 bp, Homo sapiens
ccatgtgagctgctgc

SEQ ID NO: 5868595 - DNA, 15 bp, Homo sapiens
ccatgtgagggaata

SEQ ID NO: 5868596 - DNA, 17 bp, Homo sapiens
ccatgtgagtccctgtg

SEQ ID NO: 5868597 - DNA, 18 bp, Homo sapiens
ccatgtgagtccctgtga

SEQ ID NO: 5868598 - DNA, 17 bp, Homo sapiens
ccatgtgattaatgttt

SEQ ID NO: 5868599 - DNA, 21 bp, Homo sapiens
ccatgtgattaatgttttcat

SEQ ID NO: 5868600 - DNA, 13 bp, Homo sapiens
ccatgtgcaataa

SEQ ID NO: 5868601 - DNA, 17 bp, Homo sapiens
ccatgtgcaataagatt

SEQ ID NO: 5868602 - DNA, 13 bp, Homo sapiens
ccatgtgcacccg

SEQ ID NO: 5868603 - DNA, 22 bp, Homo sapiens
ccatgtgcacccggcctggatg

SEQ ID NO: 5868604 - DNA, 21 bp, Homo sapiens
ccatgtgcacctatggcccag

SEQ ID NO: 5868605 - DNA, 22 bp, Homo sapiens
ccatgtgcatggaaatgtcctc

SEQ ID NO: 5868606 - DNA, 20 bp, Homo sapiens
ccatgtgccatctgtacata

SEQ ID NO: 5868607 - DNA, 16 bp, Homo sapiens
ccatgtgcctgatcca

SEQ ID NO: 5868608 - DNA, 20 bp, Homo sapiens
ccatgtgcctgcaccaggag

SEQ ID NO: 5868609 - DNA, 22 bp, Homo sapiens
ccatgtgcctgtcacgctctgg

SEQ ID NO: 5868610 - DNA, 13 bp, Homo sapiens
ccatgtgccttgt

SEQ ID NO: 5868611 - DNA, 22 bp, Homo sapiens
ccatgtgcctttctttgcctct

SEQ ID NO: 5868612 - DNA, 23 bp, Homo sapiens
ccatgtgcctttctttgcctctg

SEQ ID NO: 5868613 - DNA, 19 bp, Homo sapiens
ccatgtgcggaattcaagt

SEQ ID NO: 5868614 - DNA, 20 bp, Homo sapiens
ccatgtgcggagcagccttt

SEQ ID NO: 5868615 - DNA, 14 bp, Homo sapiens
ccatgtgctgccct

SEQ ID NO: 5868616 - DNA, 12 bp, Homo sapiens
ccatgtgctgct

SEQ ID NO: 5868617 - DNA, 21 bp, Homo sapiens
ccatgtgctgtgcacccgtgc

SEQ ID NO: 5868618 - DNA, 22 bp, Homo sapiens
ccatgtgcttattatatttctt

SEQ ID NO: 5868619 - DNA, 24 bp, Homo sapiens
ccatgtggaaggcaagccaggctc

SEQ ID NO: 5868620 - DNA, 17 bp, Homo sapiens
ccatgtggactgtgcca

SEQ ID NO: 5868621 - DNA, 12 bp, Homo sapiens
ccatgtggactt

SEQ ID NO: 5868622 - DNA, 21 bp, Homo sapiens
ccatgtggataactttacaga

SEQ ID NO: 5868623 - DNA, 17 bp, Homo sapiens
ccatgtggcagcccatg

SEQ ID NO: 5868624 - DNA, 11 bp, Homo sapiens
ccatgtggcca

SEQ ID NO: 5868625 - DNA, 18 bp, Homo sapiens
ccatgtggccccaggtgc

SEQ ID NO: 5868626 - DNA, 19 bp, Homo sapiens
ccatgtggccccaggtgcc

SEQ ID NO: 5868627 - DNA, 21 bp, Homo sapiens
ccatgtggccccaggtgccac

SEQ ID NO: 5868628 - DNA, 16 bp, Homo sapiens
ccatgtggcctgccca

SEQ ID NO: 5868629 - DNA, 15 bp, Homo sapiens
ccatgtggctgaaga

SEQ ID NO: 5868630 - DNA, 22 bp, Homo sapiens
ccatgtgggcgcccaccctggg

SEQ ID NO: 5868631 - DNA, 19 bp, Homo sapiens
ccatgtgggtgaccaggtc

SEQ ID NO: 5868632 - DNA, 17 bp, Homo sapiens
ccatgtggtggcacagg

SEQ ID NO: 5868633 - DNA, 16 bp, Homo sapiens
ccatgtgtagattgcg

SEQ ID NO: 5868634 - DNA, 15 bp, Homo sapiens
ccatgtgtcccccct

SEQ ID NO: 5868635 - DNA, 16 bp, Homo sapiens
ccatgtgtcccctcac

SEQ ID NO: 5868636 - DNA, 20 bp, Homo sapiens
ccatgtgtcccctcactctg

SEQ ID NO: 5868637 - DNA, 17 bp, Homo sapiens
ccatgtgtcctggtgag

SEQ ID NO: 5868638 - DNA, 13 bp, Homo sapiens
ccattctcatgtt

SEQ ID NO: 5868639 - DNA, 14 bp, Homo sapiens
ccattctccacctg

SEQ ID NO: 5868640 - DNA, 15 bp, Homo sapiens
ccattctccacctgc

SEQ ID NO: 5868641 - DNA, 16 bp, Homo sapiens
ccattctccacctgcc

SEQ ID NO: 5868642 - DNA, 19 bp, Homo sapiens
ccattctccacctgccagg

SEQ ID NO: 5868643 - DNA, 22 bp, Homo sapiens
ccattctccaggggtttacagt

SEQ ID NO: 5868644 - DNA, 13 bp, Homo sapiens
ccattctccattt

SEQ ID NO: 5868645 - DNA, 23 bp, Homo sapiens
ccattctcccttttgacacagtt

SEQ ID NO: 5868646 - DNA, 13 bp, Homo sapiens
ccattctcctcag

SEQ ID NO: 5868647 - DNA, 12 bp, Homo sapiens
ccattctcctgc

SEQ ID NO: 5868648 - DNA, 15 bp, Homo sapiens
ccattctcctgcctc

SEQ ID NO: 5868649 - DNA, 17 bp, Homo sapiens
ccattctcctgcctcag

SEQ ID NO: 5868650 - DNA, 20 bp, Homo sapiens
ccattctcctgcctcagcct

SEQ ID NO: 5868651 - DNA, 22 bp, Homo sapiens
ccattctcctgcctcagcctcc

SEQ ID NO: 5868652 - DNA, 16 bp, Homo sapiens
ccattctctctcctgt

SEQ ID NO: 5868653 - DNA, 14 bp, Homo sapiens
ccattctctctgcc

SEQ ID NO: 5868654 - DNA, 16 bp, Homo sapiens
ccattctctctgccca

SEQ ID NO: 5868655 - DNA, 13 bp, Homo sapiens
ccattctgaattt

SEQ ID NO: 5868656 - DNA, 15 bp, Homo sapiens
ccattctgccctgtg

SEQ ID NO: 5868657 - DNA, 21 bp, Homo sapiens
ccattctgcctcagcctccca

SEQ ID NO: 5868658 - DNA, 20 bp, Homo sapiens
ccattctgcctcagcctcct

SEQ ID NO: 5868659 - DNA, 15 bp, Homo sapiens
ccattctgcctctcc

SEQ ID NO: 5868660 - DNA, 17 bp, Homo sapiens
ccattctgcctctcctc

SEQ ID NO: 5868661 - DNA, 21 bp, Homo sapiens
ccattctgcctgcccaggccc

SEQ ID NO: 5868662 - DNA, 13 bp, Homo sapiens
ccattctgggtgt

SEQ ID NO: 5868663 - DNA, 16 bp, Homo sapiens
ccattctgtgcaggct

SEQ ID NO: 5868664 - DNA, 22 bp, Homo sapiens
ccattctgtgcaggctgcagtg

SEQ ID NO: 5868665 - DNA, 23 bp, Homo sapiens
ccattctgtgtcccatgtcccgt

SEQ ID NO: 5868666 - DNA, 15 bp, Homo sapiens
ccattctgtttaaat

SEQ ID NO: 5868667 - DNA, 22 bp, Homo sapiens
ccattcttacttactaaaatat

SEQ ID NO: 5868668 - DNA, 22 bp, Homo sapiens
ccattcttatgttccagatggc

SEQ ID NO: 5868669 - DNA, 19 bp, Homo sapiens
ccattcttcagtgtctctg

SEQ ID NO: 5868670 - DNA, 14 bp, Homo sapiens
ccattcttcctagt

SEQ ID NO: 5868671 - DNA, 20 bp, Homo sapiens
ccattcttcctagttttctc

SEQ ID NO: 5868672 - DNA, 14 bp, Homo sapiens
ccattcttctggtg

SEQ ID NO: 5868673 - DNA, 11 bp, Homo sapiens
ccattcttctt

SEQ ID NO: 5868674 - DNA, 14 bp, Homo sapiens
ccattcttcttgct

SEQ ID NO: 5868675 - DNA, 17 bp, Homo sapiens
ccattcttcttgctaca

SEQ ID NO: 5868676 - DNA, 20 bp, Homo sapiens
ccattcttgagtcatggatt

SEQ ID NO: 5868677 - DNA, 16 bp, Homo sapiens
ccattcttgcttgact

SEQ ID NO: 5868678 - DNA, 11 bp, Homo sapiens
ccattcttggt

SEQ ID NO: 5868679 - DNA, 21 bp, Homo sapiens
ccattctttataatcctctgt

SEQ ID NO: 5868680 - DNA, 20 bp, Homo sapiens
ccattctttattcttttact

SEQ ID NO: 5868681 - DNA, 12 bp, Homo sapiens
ccattctttccc

SEQ ID NO: 5868682 - DNA, 14 bp, Homo sapiens
ccattctttcccaa

SEQ ID NO: 5868683 - DNA, 17 bp, Homo sapiens
ccattctttctgataac

SEQ ID NO: 5868684 - DNA, 19 bp, Homo sapiens
ccattctttcttcctccag

SEQ ID NO: 5868685 - DNA, 15 bp, Homo sapiens
ccattctttgcttga

SEQ ID NO: 5868686 - DNA, 20 bp, Homo sapiens
ccattctttgcttgaacaca

SEQ ID NO: 5868687 - DNA, 15 bp, Homo sapiens
ccattcttttgtaat

SEQ ID NO: 5868688 - DNA, 19 bp, Homo sapiens
ccattgaaatcagcatgac

SEQ ID NO: 5868689 - DNA, 18 bp, Homo sapiens
ccattgaacactgcaccc

SEQ ID NO: 5868690 - DNA, 20 bp, Homo sapiens
ccattgaacactgcaccctc

SEQ ID NO: 5868691 - DNA, 16 bp, Homo sapiens
ccattgaacagctgtg

SEQ ID NO: 5868692 - DNA, 17 bp, Homo sapiens
ccattgaacagctgtga

SEQ ID NO: 5868693 - DNA, 15 bp, Homo sapiens
ccattgaactctgag

SEQ ID NO: 5868694 - DNA, 16 bp, Homo sapiens
ccattgaactggaaga

SEQ ID NO: 5868695 - DNA, 20 bp, Homo sapiens
ccattgaagaagaaccagcc

SEQ ID NO: 5868696 - DNA, 23 bp, Homo sapiens
ccattgaagccgactctggccct

SEQ ID NO: 5868697 - DNA, 11 bp, Homo sapiens
ccattgaaggc

SEQ ID NO: 5868698 - DNA, 20 bp, Homo sapiens
ccattgaaggcttaattgac

SEQ ID NO: 5868699 - DNA, 17 bp, Homo sapiens
ccattgacatgtacaga

SEQ ID NO: 5868700 - DNA, 17 bp, Homo sapiens
ccattgaccagctctct

SEQ ID NO: 5868701 - DNA, 18 bp, Homo sapiens
ccattgaccagctctctt

SEQ ID NO: 5868702 - DNA, 22 bp, Homo sapiens
ccattgaccctcacctgaataa

SEQ ID NO: 5868703 - DNA, 16 bp, Homo sapiens
ccattgacctcagctg

SEQ ID NO: 5868704 - DNA, 19 bp, Homo sapiens
ccattgaccttaatttctt

SEQ ID NO: 5868705 - DNA, 22 bp, Homo sapiens
ccattgagaccgtgaagatact

SEQ ID NO: 5868706 - DNA, 13 bp, Homo sapiens
ccattgagtgctg

SEQ ID NO: 5868707 - DNA, 16 bp, Homo sapiens
ccattgatgtttaagt

SEQ ID NO: 5868708 - DNA, 21 bp, Homo sapiens
ccattgattttttttttcttc

SEQ ID NO: 5868709 - DNA, 17 bp, Homo sapiens
ccattgcaaaatagaag

SEQ ID NO: 5868710 - DNA, 16 bp, Homo sapiens
ccattgcactccagcc

SEQ ID NO: 5868711 - DNA, 18 bp, Homo sapiens
ccattgcactccagcctg

SEQ ID NO: 5868712 - DNA, 19 bp, Homo sapiens
ccattgcactccagcctgg

SEQ ID NO: 5868713 - DNA, 20 bp, Homo sapiens
ccattgcactccagcctggg

SEQ ID NO: 5868714 - DNA, 20 bp, Homo sapiens
ccattgcactctagcctggc

SEQ ID NO: 5868715 - DNA, 16 bp, Homo sapiens
ccattgccaccaggag

SEQ ID NO: 5868716 - DNA, 12 bp, Homo sapiens
ccattgcccagt

SEQ ID NO: 5868717 - DNA, 13 bp, Homo sapiens
ccattgcccagtg

SEQ ID NO: 5868718 - DNA, 18 bp, Homo sapiens
ccattgcccagtgagccc

SEQ ID NO: 5868719 - DNA, 14 bp, Homo sapiens
ccattgccctggtt

SEQ ID NO: 5868720 - DNA, 23 bp, Homo sapiens
ccattgcctcctccttcccaaag

SEQ ID NO: 5868721 - DNA, 15 bp, Homo sapiens
ccattgcggccccag

SEQ ID NO: 5868722 - DNA, 19 bp, Homo sapiens
ccattgcggccccaggagg

SEQ ID NO: 5868723 - DNA, 13 bp, Homo sapiens
ccattgctccatt

SEQ ID NO: 5868724 - DNA, 14 bp, Homo sapiens
ccattgctccattc

SEQ ID NO: 5868725 - DNA, 15 bp, Homo sapiens
ccattgctgctcctt

SEQ ID NO: 5868726 - DNA, 23 bp, Homo sapiens
ccattgctgctccttagctgcca

SEQ ID NO: 5868727 - DNA, 18 bp, Homo sapiens
ccattgcttaaaagaaag

SEQ ID NO: 5868728 - DNA, 10 bp, Homo sapiens
ccattgcttc

SEQ ID NO: 5868729 - DNA, 12 bp, Homo sapiens
ccattgcttcac

SEQ ID NO: 5868730 - DNA, 22 bp, Homo sapiens
ccattggaaaatttaagacaag

SEQ ID NO: 5868731 - DNA, 23 bp, Homo sapiens
ccattggaactagtcattaaccc

SEQ ID NO: 5868732 - DNA, 19 bp, Homo sapiens
ccattggacagatttcagt

SEQ ID NO: 5868733 - DNA, 15 bp, Homo sapiens
ccattggagagctgt

SEQ ID NO: 5868734 - DNA, 16 bp, Homo sapiens
ccattggagcacctgg

SEQ ID NO: 5868735 - DNA, 17 bp, Homo sapiens
ccattggagcacctggg

SEQ ID NO: 5868736 - DNA, 19 bp, Homo sapiens
ccattggagcacctgggcc

SEQ ID NO: 5868737 - DNA, 20 bp, Homo sapiens
ccattggagcacctgggccc

SEQ ID NO: 5868738 - DNA, 15 bp, Homo sapiens
ccattggatctcatt

SEQ ID NO: 5868739 - DNA, 17 bp, Homo sapiens
ccattggccgagctcct

SEQ ID NO: 5868740 - DNA, 18 bp, Homo sapiens
ccattggccgagctcctg

SEQ ID NO: 5868741 - DNA, 20 bp, Homo sapiens
ccattggccgagctcctggg

SEQ ID NO: 5868742 - DNA, 21 bp, Homo sapiens
ccattggctatttaaaacttg

SEQ ID NO: 5868743 - DNA, 17 bp, Homo sapiens
ccattggctcccatctg

SEQ ID NO: 5868744 - DNA, 19 bp, Homo sapiens
ccattgggcacagtccaga

SEQ ID NO: 5868745 - DNA, 22 bp, Homo sapiens
ccattgggcacagtccagaccc

SEQ ID NO: 5868746 - DNA, 20 bp, Homo sapiens
ccattggggaggactaggac

SEQ ID NO: 5868747 - DNA, 16 bp, Homo sapiens
ccattggggctcccag

SEQ ID NO: 5868748 - DNA, 14 bp, Homo sapiens
ccattgggtttggg

SEQ ID NO: 5868749 - DNA, 13 bp, Homo sapiens
ccattggtgttga

SEQ ID NO: 5868750 - DNA, 21 bp, Homo sapiens
ccattggttcacctgtgactc

SEQ ID NO: 5868751 - DNA, 23 bp, Homo sapiens
ccattggttcacctgtgactcct

SEQ ID NO: 5868752 - DNA, 18 bp, Homo sapiens
ccattggttcttcctttc

SEQ ID NO: 5868753 - DNA, 23 bp, Homo sapiens
ccattgtaacttggatgtagcca

SEQ ID NO: 5868754 - DNA, 16 bp, Homo sapiens
ccattgtactccagcc

SEQ ID NO: 5868755 - DNA, 18 bp, Homo sapiens
ccattgtactccagcctg

SEQ ID NO: 5868756 - DNA, 19 bp, Homo sapiens
ccattgtactccagcctgg

SEQ ID NO: 5868757 - DNA, 17 bp, Homo sapiens
ccattgtccctctgccc

SEQ ID NO: 5868758 - DNA, 12 bp, Homo sapiens
ccattgtcctcc

SEQ ID NO: 5868759 - DNA, 14 bp, Homo sapiens
ccattgtcctcctt

SEQ ID NO: 5868760 - DNA, 19 bp, Homo sapiens
ccattgtcctccttttcac

SEQ ID NO: 5868761 - DNA, 15 bp, Homo sapiens
ccattgtctcagagc

SEQ ID NO: 5868762 - DNA, 19 bp, Homo sapiens
ccattgtctcattgccagt

SEQ ID NO: 5868763 - DNA, 22 bp, Homo sapiens
ccattgtctcattgccagtggt

SEQ ID NO: 5868764 - DNA, 18 bp, Homo sapiens
ccattgtctcttcatgtc

SEQ ID NO: 5868765 - DNA, 10 bp, Homo sapiens
ccattgtctt

SEQ ID NO: 5868766 - DNA, 15 bp, Homo sapiens
ccattgtcttgttct

SEQ ID NO: 5868767 - DNA, 14 bp, Homo sapiens
ccattgtctttata

SEQ ID NO: 5868768 - DNA, 18 bp, Homo sapiens
ccattgtctttatatgaa

SEQ ID NO: 5868769 - DNA, 20 bp, Homo sapiens
ccattgtctttatatgaaca

SEQ ID NO: 5868770 - DNA, 20 bp, Homo sapiens
ccattgtctttcctcccttc

SEQ ID NO: 5868771 - DNA, 19 bp, Homo sapiens
ccattgtgaagcacctact

SEQ ID NO: 5868772 - DNA, 17 bp, Homo sapiens
ccattgtgcattctaga

SEQ ID NO: 5868773 - DNA, 20 bp, Homo sapiens
ccattgtggcctaagaggct

SEQ ID NO: 5868774 - DNA, 11 bp, Homo sapiens
ccattgtttaa

SEQ ID NO: 5868775 - DNA, 15 bp, Homo sapiens
ccattgtttgaaaca

SEQ ID NO: 5868776 - DNA, 12 bp, Homo sapiens
ccattgttttag

SEQ ID NO: 5868777 - DNA, 15 bp, Homo sapiens
ccatttaaaaacagg

SEQ ID NO: 5868778 - DNA, 19 bp, Homo sapiens
ccatttaaaacaagctgat

SEQ ID NO: 5868779 - DNA, 20 bp, Homo sapiens
ccatttaaactaacctttta

SEQ ID NO: 5868780 - DNA, 15 bp, Homo sapiens
ccatttaaagaaaga

SEQ ID NO: 5868781 - DNA, 22 bp, Homo sapiens
ccatttaaagaccaataaactt

SEQ ID NO: 5868782 - DNA, 19 bp, Homo sapiens
ccatttaaatttttttcct

SEQ ID NO: 5868783 - DNA, 16 bp, Homo sapiens
ccatttaactggagct

SEQ ID NO: 5868784 - DNA, 19 bp, Homo sapiens
ccatttaagagactcttta

SEQ ID NO: 5868785 - DNA, 20 bp, Homo sapiens
ccatttaagagactctttat

SEQ ID NO: 5868786 - DNA, 19 bp, Homo sapiens
ccatttaagtatcttgtgc

SEQ ID NO: 5868787 - DNA, 14 bp, Homo sapiens
ccatttaataaaga

SEQ ID NO: 5868788 - DNA, 19 bp, Homo sapiens
ccatttaataaagaaatat

SEQ ID NO: 5868789 - DNA, 21 bp, Homo sapiens
ccatttaatcatttccagcaa

SEQ ID NO: 5868790 - DNA, 14 bp, Homo sapiens
ccatttaatgattg

SEQ ID NO: 5868791 - DNA, 14 bp, Homo sapiens
ccatttaattcata

SEQ ID NO: 5868792 - DNA, 12 bp, Homo sapiens
ccatttacactt

SEQ ID NO: 5868793 - DNA, 18 bp, Homo sapiens
ccatttacgtgtctgaat

SEQ ID NO: 5868794 - DNA, 15 bp, Homo sapiens
ccatttactgacact

SEQ ID NO: 5868795 - DNA, 16 bp, Homo sapiens
ccatttactgcattct

SEQ ID NO: 5868796 - DNA, 15 bp, Homo sapiens
ccatttagaatctag

SEQ ID NO: 5868797 - DNA, 13 bp, Homo sapiens
ccatttagaatgg

SEQ ID NO: 5868798 - DNA, 22 bp, Homo sapiens
ccatttagtcctcaccttctgt

SEQ ID NO: 5868799 - DNA, 20 bp, Homo sapiens
ccatttataaccccagcctg

SEQ ID NO: 5868800 - DNA, 14 bp, Homo sapiens
ccatttatagaata

SEQ ID NO: 5868801 - DNA, 11 bp, Homo sapiens
ccatttatata

SEQ ID NO: 5868802 - DNA, 20 bp, Homo sapiens
ccatttatatatctaagttc

SEQ ID NO: 5868803 - DNA, 16 bp, Homo sapiens
ccatttatccacctcc

SEQ ID NO: 5868804 - DNA, 14 bp, Homo sapiens
ccatttatctacta

SEQ ID NO: 5868805 - DNA, 20 bp, Homo sapiens
ccatttatgtgagtgtgtgt

SEQ ID NO: 5868806 - DNA, 19 bp, Homo sapiens
ccatttatttcctcagctg

SEQ ID NO: 5868807 - DNA, 13 bp, Homo sapiens
ccatttcaaatgg

SEQ ID NO: 5868808 - DNA, 14 bp, Homo sapiens
ccatttcaactcca

SEQ ID NO: 5868809 - DNA, 16 bp, Homo sapiens
ccatttcaactccaga

SEQ ID NO: 5868810 - DNA, 19 bp, Homo sapiens
ccatttcaatagccccatc

SEQ ID NO: 5868811 - DNA, 19 bp, Homo sapiens
ccatttcaggaatttaaaa

SEQ ID NO: 5868812 - DNA, 20 bp, Homo sapiens
ccatttcaggaatttaaaat

SEQ ID NO: 5868813 - DNA, 14 bp, Homo sapiens
ccatttcaggactc

SEQ ID NO: 5868814 - DNA, 22 bp, Homo sapiens
ccatttcaggactctctccagg

SEQ ID NO: 5868815 - DNA, 14 bp, Homo sapiens
ccatttcaggaggt

SEQ ID NO: 5868816 - DNA, 19 bp, Homo sapiens
ccatttcatccatatttct

SEQ ID NO: 5868817 - DNA, 16 bp, Homo sapiens
cccaagcagctgaagg

SEQ ID NO: 5868818 - DNA, 14 bp, Homo sapiens
cccaagcaggaggc

SEQ ID NO: 5868819 - DNA, 15 bp, Homo sapiens
cccaagcatgcccca

SEQ ID NO: 5868820 - DNA, 17 bp, Homo sapiens
cccaagcatgccccacc

SEQ ID NO: 5868821 - DNA, 20 bp, Homo sapiens
cccaagcatgggggacccct

SEQ ID NO: 5868822 - DNA, 16 bp, Homo sapiens
cccaagccaaaaacct

SEQ ID NO: 5868823 - DNA, 17 bp, Homo sapiens
cccaagcccagtgacct

SEQ ID NO: 5868824 - DNA, 15 bp, Homo sapiens
cccaagccctccttt

SEQ ID NO: 5868825 - DNA, 16 bp, Homo sapiens
cccaagccctcctttg

SEQ ID NO: 5868826 - DNA, 17 bp, Homo sapiens
cccaagccctgaggcct

SEQ ID NO: 5868827 - DNA, 15 bp, Homo sapiens
cccaagccctgcccc

SEQ ID NO: 5868828 - DNA, 20 bp, Homo sapiens
cccaagccctggtgaccaga

SEQ ID NO: 5868829 - DNA, 23 bp, Homo sapiens
cccaagccctggtgaccagacca

SEQ ID NO: 5868830 - DNA, 14 bp, Homo sapiens
cccaagcctctgcc

SEQ ID NO: 5868831 - DNA, 22 bp, Homo sapiens
cccaagcctctgccccaagggg

SEQ ID NO: 5868832 - DNA, 23 bp, Homo sapiens
cccaagcctctgccccaaggggc

SEQ ID NO: 5868833 - DNA, 22 bp, Homo sapiens
cccaagcctgctggctgcggcc

SEQ ID NO: 5868834 - DNA, 15 bp, Homo sapiens
cccaagcctggcagg

SEQ ID NO: 5868835 - DNA, 13 bp, Homo sapiens
cccaagcggcctt

SEQ ID NO: 5868836 - DNA, 16 bp, Homo sapiens
cccaagcggtgtctct

SEQ ID NO: 5868837 - DNA, 16 bp, Homo sapiens
cccaagcgttcctggc

SEQ ID NO: 5868838 - DNA, 21 bp, Homo sapiens
cccaagcgttcctggccttct

SEQ ID NO: 5868839 - DNA, 19 bp, Homo sapiens
cccaagctaagctgcaggc

SEQ ID NO: 5868840 - DNA, 20 bp, Homo sapiens
cccaagctaagctgcaggca

SEQ ID NO: 5868841 - DNA, 19 bp, Homo sapiens
cccaagctagactgtgtct

SEQ ID NO: 5868842 - DNA, 12 bp, Homo sapiens
cccaagctcctc

SEQ ID NO: 5868843 - DNA, 13 bp, Homo sapiens
cccaagctctggg

SEQ ID NO: 5868844 - DNA, 17 bp, Homo sapiens
cccaagctcttgtggta

SEQ ID NO: 5868845 - DNA, 9 bp, Homo sapiens
cccaagctg

SEQ ID NO: 5868846 - DNA, 21 bp, Homo sapiens
cccaagctgggccccagccca

SEQ ID NO: 5868847 - DNA, 14 bp, Homo sapiens
cccaagctggtctt

SEQ ID NO: 5868848 - DNA, 15 bp, Homo sapiens
cccaagctgtgctgg

SEQ ID NO: 5868849 - DNA, 14 bp, Homo sapiens
cccaagctgtggca

SEQ ID NO: 5868850 - DNA, 16 bp, Homo sapiens
cccaagctgtggcagc

SEQ ID NO: 5868851 - DNA, 18 bp, Homo sapiens
cccaagctgtggcagccg

SEQ ID NO: 5868852 - DNA, 14 bp, Homo sapiens
cccaagcttagaac

SEQ ID NO: 5868853 - DNA, 23 bp, Homo sapiens
cccaagctttgaatacccccaga

SEQ ID NO: 5868854 - DNA, 17 bp, Homo sapiens
cccaaggaaaactgcat

SEQ ID NO: 5868855 - DNA, 17 bp, Homo sapiens
cccaaggaatcagcagg

SEQ ID NO: 5868856 - DNA, 18 bp, Homo sapiens
cccaaggaatcagcagga

SEQ ID NO: 5868857 - DNA, 13 bp, Homo sapiens
cccaaggacccag

SEQ ID NO: 5868858 - DNA, 18 bp, Homo sapiens
cccaaggacccagccctc

SEQ ID NO: 5868859 - DNA, 16 bp, Homo sapiens
cccaaggactgaggga

SEQ ID NO: 5868860 - DNA, 18 bp, Homo sapiens
cccaaggactgagggcag

SEQ ID NO: 5868861 - DNA, 14 bp, Homo sapiens
cccaaggagcacag

SEQ ID NO: 5868862 - DNA, 20 bp, Homo sapiens
cccaaggagccattctgtgt

SEQ ID NO: 5868863 - DNA, 15 bp, Homo sapiens
cccaaggagggcacc

SEQ ID NO: 5868864 - DNA, 13 bp, Homo sapiens
cccaaggaggggg

SEQ ID NO: 5868865 - DNA, 21 bp, Homo sapiens
cccaaggagggggcctcattg

SEQ ID NO: 5868866 - DNA, 22 bp, Homo sapiens
cccaaggcaaggggtgcctggg

SEQ ID NO: 5868867 - DNA, 16 bp, Homo sapiens
cccaaggcactgagcg

SEQ ID NO: 5868868 - DNA, 22 bp, Homo sapiens
cccaaggcactgagcgcctgca

SEQ ID NO: 5868869 - DNA, 15 bp, Homo sapiens
cccaaggcccccacc

SEQ ID NO: 5868870 - DNA, 21 bp, Homo sapiens
cccaaggcccccacctctgtg

SEQ ID NO: 5868871 - DNA, 18 bp, Homo sapiens
cccaaggcctaccccagt

SEQ ID NO: 5868872 - DNA, 17 bp, Homo sapiens
cccaaggcctctctctg

SEQ ID NO: 5868873 - DNA, 18 bp, Homo sapiens
cccaaggcctctctctgc

SEQ ID NO: 5868874 - DNA, 20 bp, Homo sapiens
cccaaggcctctctctgcct

SEQ ID NO: 5868875 - DNA, 21 bp, Homo sapiens
cccaaggcctctctctgcctg

SEQ ID NO: 5868876 - DNA, 14 bp, Homo sapiens
cccaaggcgtgcag

SEQ ID NO: 5868877 - DNA, 17 bp, Homo sapiens
cccaaggctctgagcaa

SEQ ID NO: 5868878 - DNA, 14 bp, Homo sapiens
cccaaggctgccag

SEQ ID NO: 5868879 - DNA, 17 bp, Homo sapiens
cccaaggctgccagaca

SEQ ID NO: 5868880 - DNA, 15 bp, Homo sapiens
cccaaggctgcgtct

SEQ ID NO: 5868881 - DNA, 12 bp, Homo sapiens
cccaaggctgct

SEQ ID NO: 5868882 - DNA, 14 bp, Homo sapiens
cccaaggctgctca

SEQ ID NO: 5868883 - DNA, 15 bp, Homo sapiens
cccaaggctgctcag

SEQ ID NO: 5868884 - DNA, 18 bp, Homo sapiens
cccaagggagactgacca

SEQ ID NO: 5868885 - DNA, 18 bp, Homo sapiens
cccaagggaggctgctgc

SEQ ID NO: 5868886 - DNA, 20 bp, Homo sapiens
cccaagggcatcatcctcag

SEQ ID NO: 5868887 - DNA, 16 bp, Homo sapiens
cccaagggcccagacc

SEQ ID NO: 5868888 - DNA, 12 bp, Homo sapiens
cccaagggccct

SEQ ID NO: 5868889 - DNA, 13 bp, Homo sapiens
cccaagggccctg

SEQ ID NO: 5868890 - DNA, 15 bp, Homo sapiens
cccaagggccctggc

SEQ ID NO: 5868891 - DNA, 23 bp, Homo sapiens
cccaagggcctggcctgagctgg

SEQ ID NO: 5868892 - DNA, 21 bp, Homo sapiens
cccaaggggcagtctggaggg

SEQ ID NO: 5868893 - DNA, 18 bp, Homo sapiens
cccaaggggcccacaaag

SEQ ID NO: 5868894 - DNA, 15 bp, Homo sapiens
cccaagggggctgct

SEQ ID NO: 5868895 - DNA, 17 bp, Homo sapiens
cccaaggggtttctgtt

SEQ ID NO: 5868896 - DNA, 22 bp, Homo sapiens
cccaagggtcgcctatttttaa

SEQ ID NO: 5868897 - DNA, 19 bp, Homo sapiens
cccaagggtgccctttggg

SEQ ID NO: 5868898 - DNA, 16 bp, Homo sapiens
cccaaggtcacatagc

SEQ ID NO: 5868899 - DNA, 16 bp, Homo sapiens
cccaaggtcagggagg

SEQ ID NO: 5868900 - DNA, 15 bp, Homo sapiens
cccaaggtccccgtg

SEQ ID NO: 5868901 - DNA, 15 bp, Homo sapiens
cccaaggtcccctcc

SEQ ID NO: 5868902 - DNA, 21 bp, Homo sapiens
cccaaggtgctgatgtcaaag

SEQ ID NO: 5868903 - DNA, 21 bp, Homo sapiens
cccaaggtggtcttggagagg

SEQ ID NO: 5868904 - DNA, 18 bp, Homo sapiens
cccaaggttactcagcag

SEQ ID NO: 5868905 - DNA, 23 bp, Homo sapiens
cccaaggtttaaacttctctgaa

SEQ ID NO: 5868906 - DNA, 17 bp, Homo sapiens
cccaagtagctgggatt

SEQ ID NO: 5868907 - DNA, 22 bp, Homo sapiens
cccaagtagtagtgtcttccta

SEQ ID NO: 5868908 - DNA, 17 bp, Homo sapiens
cccaagtatgccttaag

SEQ ID NO: 5868909 - DNA, 12 bp, Homo sapiens
cccaagtcacac

SEQ ID NO: 5868910 - DNA, 15 bp, Homo sapiens
cccaagtcacaccca

SEQ ID NO: 5868911 - DNA, 20 bp, Homo sapiens
cccaagtcacacccactccc

SEQ ID NO: 5868912 - DNA, 12 bp, Homo sapiens
cccaagtccaaa

SEQ ID NO: 5868913 - DNA, 21 bp, Homo sapiens
cccaagtccaggtcgggctca

SEQ ID NO: 5868914 - DNA, 18 bp, Homo sapiens
cccaagtccctgttttct

SEQ ID NO: 5868915 - DNA, 16 bp, Homo sapiens
cccaagtcctgaagag

SEQ ID NO: 5868916 - DNA, 15 bp, Homo sapiens
cccaagtctgacagc

SEQ ID NO: 5868917 - DNA, 22 bp, Homo sapiens
cccaagtctgacagccagagcg

SEQ ID NO: 5868918 - DNA, 23 bp, Homo sapiens
cccaagtcttgagcaatgttttt

SEQ ID NO: 5868919 - DNA, 23 bp, Homo sapiens
cccaagtgaaggttcccaaggac

SEQ ID NO: 5868920 - DNA, 20 bp, Homo sapiens
cccaagtgagtctctctggg

SEQ ID NO: 5868921 - DNA, 11 bp, Homo sapiens
cccaagtgcca

SEQ ID NO: 5868922 - DNA, 13 bp, Homo sapiens
cccaagtgccaaa

SEQ ID NO: 5868923 - DNA, 19 bp, Homo sapiens
cccaagtgccaagacacag

SEQ ID NO: 5868924 - DNA, 18 bp, Homo sapiens
cccaagtgccagtcttgt

SEQ ID NO: 5868925 - DNA, 12 bp, Homo sapiens
cccaagtgcctg

SEQ ID NO: 5868926 - DNA, 16 bp, Homo sapiens
cccaagtgcctgcttt

SEQ ID NO: 5868927 - DNA, 23 bp, Homo sapiens
cccaagtggacgttaggccaggc

SEQ ID NO: 5868928 - DNA, 12 bp, Homo sapiens
cccaagtgggca

SEQ ID NO: 5868929 - DNA, 13 bp, Homo sapiens
cccaagtgggcag

SEQ ID NO: 5868930 - DNA, 18 bp, Homo sapiens
cccaagtgggcagtcacc

SEQ ID NO: 5868931 - DNA, 23 bp, Homo sapiens
cccaagtgggcagtcaccaccca

SEQ ID NO: 5868932 - DNA, 23 bp, Homo sapiens
cccaagtgggggcagagggcaga

SEQ ID NO: 5868933 - DNA, 18 bp, Homo sapiens
cccaagtggtgagcaagc

SEQ ID NO: 5868934 - DNA, 21 bp, Homo sapiens
cccaagtggtttccacatgct

SEQ ID NO: 5868935 - DNA, 19 bp, Homo sapiens
cccaagttatgcatcccca

SEQ ID NO: 5868936 - DNA, 19 bp, Homo sapiens
cccaagttgcagtgagcag

SEQ ID NO: 5868937 - DNA, 21 bp, Homo sapiens
cccaagttgcagtgagcaggg

SEQ ID NO: 5868938 - DNA, 22 bp, Homo sapiens
cccaagttgcagtgagcagggt

SEQ ID NO: 5868939 - DNA, 14 bp, Homo sapiens
cccaagttgctctg

SEQ ID NO: 5868940 - DNA, 17 bp, Homo sapiens
cccaagttggaagggac

SEQ ID NO: 5868941 - DNA, 21 bp, Homo sapiens
cccaagtttccatagcaacag

SEQ ID NO: 5868942 - DNA, 14 bp, Homo sapiens
cccaataaaccagt

SEQ ID NO: 5868943 - DNA, 11 bp, Homo sapiens
cccaataaagc

SEQ ID NO: 5868944 - DNA, 14 bp, Homo sapiens
cccaataaagcctt

SEQ ID NO: 5868945 - DNA, 15 bp, Homo sapiens
cccaataaagccttt

SEQ ID NO: 5868946 - DNA, 16 bp, Homo sapiens
cccaataaagctggac

SEQ ID NO: 5868947 - DNA, 18 bp, Homo sapiens
cccaataaaggcagctgc

SEQ ID NO: 5868948 - DNA, 22 bp, Homo sapiens
cccaataaaggcagctgcctct

SEQ ID NO: 5868949 - DNA, 14 bp, Homo sapiens
cccaataaagtcct

SEQ ID NO: 5868950 - DNA, 19 bp, Homo sapiens
cccaataaagtcctcttcc

SEQ ID NO: 5868951 - DNA, 20 bp, Homo sapiens
cccaataaagtcctcttccc

SEQ ID NO: 5868952 - DNA, 16 bp, Homo sapiens
cccaatacaaagatga

SEQ ID NO: 5868953 - DNA, 11 bp, Homo sapiens
cccaatagaat

SEQ ID NO: 5868954 - DNA, 12 bp, Homo sapiens
cccaatatattc

SEQ ID NO: 5868955 - DNA, 15 bp, Homo sapiens
cccaatattataatt

SEQ ID NO: 5868956 - DNA, 18 bp, Homo sapiens
cccaatcaaagaattaca

SEQ ID NO: 5868957 - DNA, 20 bp, Homo sapiens
cccaatcaaagaattacagt

SEQ ID NO: 5868958 - DNA, 21 bp, Homo sapiens
cccaatcacgagatcttcctt

SEQ ID NO: 5868959 - DNA, 17 bp, Homo sapiens
cccaatcagcactgaaa

SEQ ID NO: 5868960 - DNA, 14 bp, Homo sapiens
cccaatcagctcct

SEQ ID NO: 5868961 - DNA, 15 bp, Homo sapiens
cccaatcagcttttg

SEQ ID NO: 5868962 - DNA, 23 bp, Homo sapiens
cccaatcagcttttgttctagac

SEQ ID NO: 5868963 - DNA, 15 bp, Homo sapiens
cccaatccagagaag

SEQ ID NO: 5868964 - DNA, 23 bp, Homo sapiens
cccaatccaggtacgcacagaca

SEQ ID NO: 5868965 - DNA, 14 bp, Homo sapiens
cccaatccagtgga

SEQ ID NO: 5868966 - DNA, 16 bp, Homo sapiens
cccaatccatgcttca

SEQ ID NO: 5868967 - DNA, 23 bp, Homo sapiens
cccaatcccagttcttcctgcaa

SEQ ID NO: 5868968 - DNA, 13 bp, Homo sapiens
cccaatccctctc

SEQ ID NO: 5868969 - DNA, 14 bp, Homo sapiens
cccaatccctctcc

SEQ ID NO: 5868970 - DNA, 17 bp, Homo sapiens
cccaatccctctccact

SEQ ID NO: 5868971 - DNA, 20 bp, Homo sapiens
cccaatccctgccactgggc

SEQ ID NO: 5868972 - DNA, 15 bp, Homo sapiens
cccaatcggactgcc

SEQ ID NO: 5868973 - DNA, 17 bp, Homo sapiens
cccaatcggactgccaa

SEQ ID NO: 5868974 - DNA, 14 bp, Homo sapiens
cccaatctccatct

SEQ ID NO: 5868975 - DNA, 19 bp, Homo sapiens
cccaatctgcacactccag

SEQ ID NO: 5868976 - DNA, 21 bp, Homo sapiens
cccaatctgcacactccaggc

SEQ ID NO: 5868977 - DNA, 13 bp, Homo sapiens
cccaatgaaatac

SEQ ID NO: 5868978 - DNA, 18 bp, Homo sapiens
cccaatgagacttgcctt

SEQ ID NO: 5868979 - DNA, 16 bp, Homo sapiens
cccaatgaggtggctc

SEQ ID NO: 5868980 - DNA, 23 bp, Homo sapiens
cccaatgaggtggctcatgcctg

SEQ ID NO: 5868981 - DNA, 21 bp, Homo sapiens
cccaatgcatagagccctggc

SEQ ID NO: 5868982 - DNA, 12 bp, Homo sapiens
cccaatgcctgt

SEQ ID NO: 5868983 - DNA, 20 bp, Homo sapiens
cccaatgcgacaagtagttc

SEQ ID NO: 5868984 - DNA, 12 bp, Homo sapiens
cccaatgctcct

SEQ ID NO: 5868985 - DNA, 15 bp, Homo sapiens
cccaatgctgatgtc

SEQ ID NO: 5868986 - DNA, 20 bp, Homo sapiens
cccaatgctgtacctggctg

SEQ ID NO: 5868987 - DNA, 20 bp, Homo sapiens
cccaatggtgcttggagggg

SEQ ID NO: 5868988 - DNA, 16 bp, Homo sapiens
cccaatgtaggagctg

SEQ ID NO: 5868989 - DNA, 16 bp, Homo sapiens
cccaatgtctcccaca

SEQ ID NO: 5868990 - DNA, 14 bp, Homo sapiens
cccaatgtttaaaa

SEQ ID NO: 5868991 - DNA, 14 bp, Homo sapiens
cccaattaactgaa

SEQ ID NO: 5868992 - DNA, 14 bp, Homo sapiens
cccaattaggaagt

SEQ ID NO: 5868993 - DNA, 14 bp, Homo sapiens
cccaattctgcccg

SEQ ID NO: 5868994 - DNA, 15 bp, Homo sapiens
cccaattgagaaaaa

SEQ ID NO: 5868995 - DNA, 18 bp, Homo sapiens
cccaattgggaatgcaat

SEQ ID NO: 5868996 - DNA, 14 bp, Homo sapiens
cccaccctgcccct

SEQ ID NO: 5868997 - DNA, 15 bp, Homo sapiens
cccaccctgcgggcc

SEQ ID NO: 5868998 - DNA, 21 bp, Homo sapiens
cccaccctgcgggccagggtc

SEQ ID NO: 5868999 - DNA, 11 bp, Homo sapiens
cccaccctgct

SEQ ID NO: 5869000 - DNA, 12 bp, Homo sapiens
cccaccctgctg

SEQ ID NO: 5869001 - DNA, 14 bp, Homo sapiens
cccaccctgctgct

SEQ ID NO: 5869002 - DNA, 15 bp, Homo sapiens
cccaccctgcttctg

SEQ ID NO: 5869003 - DNA, 21 bp, Homo sapiens
cccaccctgcttggcccaggg

SEQ ID NO: 5869004 - DNA, 14 bp, Homo sapiens
cccaccctgggcct

SEQ ID NO: 5869005 - DNA, 13 bp, Homo sapiens
cccaccctgggct

SEQ ID NO: 5869006 - DNA, 15 bp, Homo sapiens
cccaccctgggctcc

SEQ ID NO: 5869007 - DNA, 22 bp, Homo sapiens
cccaccctgggtttggcccctg

SEQ ID NO: 5869008 - DNA, 14 bp, Homo sapiens
cccaccctgtgccc

SEQ ID NO: 5869009 - DNA, 17 bp, Homo sapiens
cccacccttacttcctg

SEQ ID NO: 5869010 - DNA, 13 bp, Homo sapiens
cccacccttctcc

SEQ ID NO: 5869011 - DNA, 20 bp, Homo sapiens
cccacccttctcccctgccc

SEQ ID NO: 5869012 - DNA, 16 bp, Homo sapiens
cccacccttgggcaga

SEQ ID NO: 5869013 - DNA, 18 bp, Homo sapiens
cccaccctttctgccagg

SEQ ID NO: 5869014 - DNA, 19 bp, Homo sapiens
cccaccgaagagccctgag

SEQ ID NO: 5869015 - DNA, 14 bp, Homo sapiens
cccaccgaccccct

SEQ ID NO: 5869016 - DNA, 19 bp, Homo sapiens
cccaccgaccccctttcta

SEQ ID NO: 5869017 - DNA, 16 bp, Homo sapiens
cccaccgagctggagc

SEQ ID NO: 5869018 - DNA, 18 bp, Homo sapiens
cccaccgaggagccccag

SEQ ID NO: 5869019 - DNA, 17 bp, Homo sapiens
cccaccgaggttcccag

SEQ ID NO: 5869020 - DNA, 19 bp, Homo sapiens
cccaccgaggttcccaggg

SEQ ID NO: 5869021 - DNA, 20 bp, Homo sapiens
cccaccgcatgccccctcgt

SEQ ID NO: 5869022 - DNA, 22 bp, Homo sapiens
cccaccgcatgccccctcgtgc

SEQ ID NO: 5869023 - DNA, 13 bp, Homo sapiens
cccaccgccccca

SEQ ID NO: 5869024 - DNA, 16 bp, Homo sapiens
cccaccgccctcctcc

SEQ ID NO: 5869025 - DNA, 16 bp, Homo sapiens
cccaccgccggggtcc

SEQ ID NO: 5869026 - DNA, 21 bp, Homo sapiens
cccaccgccggggtcctggga

SEQ ID NO: 5869027 - DNA, 23 bp, Homo sapiens
cccaccgccggggtcctgggagg

SEQ ID NO: 5869028 - DNA, 24 bp, Homo sapiens
cccaccgccggggtcctgggaggc

SEQ ID NO: 5869029 - DNA, 22 bp, Homo sapiens
cccaccggaactgggctggcgc

SEQ ID NO: 5869030 - DNA, 22 bp, Homo sapiens
cccaccggatgctgtgcctggc

SEQ ID NO: 5869031 - DNA, 15 bp, Homo sapiens
cccaccggccaggcc

SEQ ID NO: 5869032 - DNA, 17 bp, Homo sapiens
cccaccgggccactcct

SEQ ID NO: 5869033 - DNA, 18 bp, Homo sapiens
cccaccgggccactcctt

SEQ ID NO: 5869034 - DNA, 23 bp, Homo sapiens
cccaccgggctgggagctctgca

SEQ ID NO: 5869035 - DNA, 23 bp, Homo sapiens
cccaccggggactggacacaaac

SEQ ID NO: 5869036 - DNA, 16 bp, Homo sapiens
cccaccggtccagctg

SEQ ID NO: 5869037 - DNA, 21 bp, Homo sapiens
cccaccggtccagctggcctg

SEQ ID NO: 5869038 - DNA, 19 bp, Homo sapiens
cccaccgtccgccctgctc

SEQ ID NO: 5869039 - DNA, 21 bp, Homo sapiens
cccaccgtccgccctgctcct

SEQ ID NO: 5869040 - DNA, 22 bp, Homo sapiens
cccaccgtctcggccctgaacc

SEQ ID NO: 5869041 - DNA, 23 bp, Homo sapiens
cccaccgtctcggccctgaacca

SEQ ID NO: 5869042 - DNA, 21 bp, Homo sapiens
cccaccgtcttgggtcgccct

SEQ ID NO: 5869043 - DNA, 15 bp, Homo sapiens
cccaccgtgggcagg

SEQ ID NO: 5869044 - DNA, 17 bp, Homo sapiens
cccaccgtgggcaggga

SEQ ID NO: 5869045 - DNA, 22 bp, Homo sapiens
cccaccgttaggattcaggcag

SEQ ID NO: 5869046 - DNA, 23 bp, Homo sapiens
cccaccgttaggattcaggcagc

SEQ ID NO: 5869047 - DNA, 20 bp, Homo sapiens
cccacctaaagggaagccct

SEQ ID NO: 5869048 - DNA, 14 bp, Homo sapiens
cccacctaccttca

SEQ ID NO: 5869049 - DNA, 20 bp, Homo sapiens
cccacctaccttcaaagctg

SEQ ID NO: 5869050 - DNA, 16 bp, Homo sapiens
cccacctactgcactt

SEQ ID NO: 5869051 - DNA, 18 bp, Homo sapiens
cccacctacttgtgactg

SEQ ID NO: 5869052 - DNA, 13 bp, Homo sapiens
cccacctcacccc

SEQ ID NO: 5869053 - DNA, 15 bp, Homo sapiens
cccacctcagcctcc

SEQ ID NO: 5869054 - DNA, 17 bp, Homo sapiens
cccacctcagcctcccg

SEQ ID NO: 5869055 - DNA, 20 bp, Homo sapiens
cccacctcatgcctggcccc

SEQ ID NO: 5869056 - DNA, 12 bp, Homo sapiens
cccacctccacc

SEQ ID NO: 5869057 - DNA, 13 bp, Homo sapiens
cccacctccaccc

SEQ ID NO: 5869058 - DNA, 16 bp, Homo sapiens
cccacctccacccagc

SEQ ID NO: 5869059 - DNA, 17 bp, Homo sapiens
cccacctccacccagcc

SEQ ID NO: 5869060 - DNA, 20 bp, Homo sapiens
cccacctccacccagcccct

SEQ ID NO: 5869061 - DNA, 18 bp, Homo sapiens
cccacctccacctgtgag

SEQ ID NO: 5869062 - DNA, 15 bp, Homo sapiens
cccacctccactccc

SEQ ID NO: 5869063 - DNA, 12 bp, Homo sapiens
cccacctccagc

SEQ ID NO: 5869064 - DNA, 15 bp, Homo sapiens
cccacctccagccca

SEQ ID NO: 5869065 - DNA, 14 bp, Homo sapiens
cccacctccaggct

SEQ ID NO: 5869066 - DNA, 17 bp, Homo sapiens
cccacctccccacgccc

SEQ ID NO: 5869067 - DNA, 18 bp, Homo sapiens
cccacctccccagagccc

SEQ ID NO: 5869068 - DNA, 13 bp, Homo sapiens
cccacctccccct

SEQ ID NO: 5869069 - DNA, 22 bp, Homo sapiens
cccacctcccgccctcacctgc

SEQ ID NO: 5869070 - DNA, 16 bp, Homo sapiens
cccacctccctgcagc

SEQ ID NO: 5869071 - DNA, 16 bp, Homo sapiens
cccacctccctgccca

SEQ ID NO: 5869072 - DNA, 18 bp, Homo sapiens
cccacctccctgcccagg

SEQ ID NO: 5869073 - DNA, 19 bp, Homo sapiens
cccacctccctgcccaggc

SEQ ID NO: 5869074 - DNA, 16 bp, Homo sapiens
cccacctccctgcctc

SEQ ID NO: 5869075 - DNA, 12 bp, Homo sapiens
cccacctcctgc

SEQ ID NO: 5869076 - DNA, 15 bp, Homo sapiens
cccacctcctgcggc

SEQ ID NO: 5869077 - DNA, 22 bp, Homo sapiens
cccacctcctgcggctcagcct

SEQ ID NO: 5869078 - DNA, 15 bp, Homo sapiens
cccacctccttcctc

SEQ ID NO: 5869079 - DNA, 13 bp, Homo sapiens
cccacctcgctcc

SEQ ID NO: 5869080 - DNA, 14 bp, Homo sapiens
cccacctcggcaca

SEQ ID NO: 5869081 - DNA, 17 bp, Homo sapiens
cccacctcggcacacac

SEQ ID NO: 5869082 - DNA, 16 bp, Homo sapiens
cccacctcggcctccc

SEQ ID NO: 5869083 - DNA, 15 bp, Homo sapiens
cccacctctccctgc

SEQ ID NO: 5869084 - DNA, 18 bp, Homo sapiens
cccacctctcctgccctg

SEQ ID NO: 5869085 - DNA, 13 bp, Homo sapiens
cccacctctctca

SEQ ID NO: 5869086 - DNA, 19 bp, Homo sapiens
cccacctctctcactcctt

SEQ ID NO: 5869087 - DNA, 15 bp, Homo sapiens
cccacctctctcccc

SEQ ID NO: 5869088 - DNA, 20 bp, Homo sapiens
cccacctctcttttcctctc

SEQ ID NO: 5869089 - DNA, 23 bp, Homo sapiens
cccacctctcttttcctctctgt

SEQ ID NO: 5869090 - DNA, 15 bp, Homo sapiens
cccacctctgaggac

SEQ ID NO: 5869091 - DNA, 19 bp, Homo sapiens
cccacctctgctgcccacg

SEQ ID NO: 5869092 - DNA, 21 bp, Homo sapiens
cccacctctgctgcccacggc

SEQ ID NO: 5869093 - DNA, 12 bp, Homo sapiens
cccacctctggc

SEQ ID NO: 5869094 - DNA, 17 bp, Homo sapiens
cccacctctgtgacctc

SEQ ID NO: 5869095 - DNA, 21 bp, Homo sapiens
cccacctctgtgacctcaggc

SEQ ID NO: 5869096 - DNA, 22 bp, Homo sapiens
cccacctcttccttccgctcct

SEQ ID NO: 5869097 - DNA, 16 bp, Homo sapiens
cccacctcttttccta

SEQ ID NO: 5869098 - DNA, 18 bp, Homo sapiens
cccacctgaaagcctgtc

SEQ ID NO: 5869099 - DNA, 21 bp, Homo sapiens
cccacctgacaatggcagcta

SEQ ID NO: 5869100 - DNA, 17 bp, Homo sapiens
cccacctgagctttgga

SEQ ID NO: 5869101 - DNA, 16 bp, Homo sapiens
cccacctgaggcccca

SEQ ID NO: 5869102 - DNA, 16 bp, Homo sapiens
cccacctgcacccagg

SEQ ID NO: 5869103 - DNA, 12 bp, Homo sapiens
cccacctgcact

SEQ ID NO: 5869104 - DNA, 13 bp, Homo sapiens
cccacctgcatca

SEQ ID NO: 5869105 - DNA, 24 bp, Homo sapiens
cccacctgcatcagcctctggcca

SEQ ID NO: 5869106 - DNA, 21 bp, Homo sapiens
cccacctgccactaggctggg

SEQ ID NO: 5869107 - DNA, 13 bp, Homo sapiens
cccacctgccagg

SEQ ID NO: 5869108 - DNA, 23 bp, Homo sapiens
cccacctgcccatcacagggttg

SEQ ID NO: 5869109 - DNA, 13 bp, Homo sapiens
cccacctgcctga

SEQ ID NO: 5869110 - DNA, 15 bp, Homo sapiens
cccacctgctcacca

SEQ ID NO: 5869111 - DNA, 17 bp, Homo sapiens
cccacctgctcccaggc

SEQ ID NO: 5869112 - DNA, 13 bp, Homo sapiens
cccacctgctgag

SEQ ID NO: 5869113 - DNA, 13 bp, Homo sapiens
cccacctgctgct

SEQ ID NO: 5869114 - DNA, 14 bp, Homo sapiens
cccacctgctgctg

SEQ ID NO: 5869115 - DNA, 13 bp, Homo sapiens
cccacctggccac

SEQ ID NO: 5869116 - DNA, 13 bp, Homo sapiens
cccacctggccct

SEQ ID NO: 5869117 - DNA, 20 bp, Homo sapiens
cccacctggcttcatacaga

SEQ ID NO: 5869118 - DNA, 18 bp, Homo sapiens
cccacctgggccaaggac

SEQ ID NO: 5869119 - DNA, 13 bp, Homo sapiens
cccacctgggccc

SEQ ID NO: 5869120 - DNA, 18 bp, Homo sapiens
cccacctgggccctaggc

SEQ ID NO: 5869121 - DNA, 22 bp, Homo sapiens
cccacctgggccctaggcatac

SEQ ID NO: 5869122 - DNA, 12 bp, Homo sapiens
cccacctgggct

SEQ ID NO: 5869123 - DNA, 15 bp, Homo sapiens
cccacctgggctggg

SEQ ID NO: 5869124 - DNA, 16 bp, Homo sapiens
cccacctggggtctct

SEQ ID NO: 5869125 - DNA, 21 bp, Homo sapiens
cccacctggtactgacccagg

SEQ ID NO: 5869126 - DNA, 20 bp, Homo sapiens
cccacctggtggcctctgcc

SEQ ID NO: 5869127 - DNA, 13 bp, Homo sapiens
cccacctgtgggg

SEQ ID NO: 5869128 - DNA, 19 bp, Homo sapiens
cccacctgtggggcctggg

SEQ ID NO: 5869129 - DNA, 22 bp, Homo sapiens
cccacctgtggggcctggggag

SEQ ID NO: 5869130 - DNA, 19 bp, Homo sapiens
cccaccttcaattcctggg

SEQ ID NO: 5869131 - DNA, 20 bp, Homo sapiens
cccaccttcaattcctgggc

SEQ ID NO: 5869132 - DNA, 17 bp, Homo sapiens
cccaccttcccccaact

SEQ ID NO: 5869133 - DNA, 15 bp, Homo sapiens
cccaccttcttggga

SEQ ID NO: 5869134 - DNA, 20 bp, Homo sapiens
cccaccttgccaagctttct

SEQ ID NO: 5869135 - DNA, 13 bp, Homo sapiens
cccaccttggcct

SEQ ID NO: 5869136 - DNA, 22 bp, Homo sapiens
cccaccttggctcaagtcctct

SEQ ID NO: 5869137 - DNA, 14 bp, Homo sapiens
cccaccttggctgc

SEQ ID NO: 5869138 - DNA, 15 bp, Homo sapiens
cccaccttggctgca

SEQ ID NO: 5869139 - DNA, 16 bp, Homo sapiens
cccaccttggctgcag

SEQ ID NO: 5869140 - DNA, 17 bp, Homo sapiens
cccaccttgttggagcc

SEQ ID NO: 5869141 - DNA, 18 bp, Homo sapiens
cccacctttaagtcctct

SEQ ID NO: 5869142 - DNA, 15 bp, Homo sapiens
cccacctttcccaga

SEQ ID NO: 5869143 - DNA, 19 bp, Homo sapiens
cccacctttctcgctggaa

SEQ ID NO: 5869144 - DNA, 19 bp, Homo sapiens
cccacctttgggatcagcc

SEQ ID NO: 5869145 - DNA, 16 bp, Homo sapiens
cccacgacactgcagc

SEQ ID NO: 5869146 - DNA, 23 bp, Homo sapiens
cccacgacccctgcctcgagggc

SEQ ID NO: 5869147 - DNA, 19 bp, Homo sapiens
cccacgacctgtcctgtct

SEQ ID NO: 5869148 - DNA, 20 bp, Homo sapiens
cccacgactgttgtacaagc

SEQ ID NO: 5869149 - DNA, 22 bp, Homo sapiens
cccacgaggaggaaccaggcta

SEQ ID NO: 5869150 - DNA, 16 bp, Homo sapiens
cccacgaggggaccca

SEQ ID NO: 5869151 - DNA, 16 bp, Homo sapiens
cccacgagggtcagga

SEQ ID NO: 5869152 - DNA, 16 bp, Homo sapiens
cccacgagtcacctgc

SEQ ID NO: 5869153 - DNA, 17 bp, Homo sapiens
cccacgagtcacctgca

SEQ ID NO: 5869154 - DNA, 15 bp, Homo sapiens
cccacgattggccac

SEQ ID NO: 5869155 - DNA, 20 bp, Homo sapiens
cccacgattttctccagctc

SEQ ID NO: 5869156 - DNA, 20 bp, Homo sapiens
cccacgcagacctgcagcgg

SEQ ID NO: 5869157 - DNA, 20 bp, Homo sapiens
cccacgcagagccccggagc

SEQ ID NO: 5869158 - DNA, 15 bp, Homo sapiens
cccacgcagaggacg

SEQ ID NO: 5869159 - DNA, 21 bp, Homo sapiens
cccacgcatacacacatgccc

SEQ ID NO: 5869160 - DNA, 14 bp, Homo sapiens
cccacgccacagcc

SEQ ID NO: 5869161 - DNA, 15 bp, Homo sapiens
cccacgccacagccc

SEQ ID NO: 5869162 - DNA, 16 bp, Homo sapiens
cccacgccacagccct

SEQ ID NO: 5869163 - DNA, 12 bp, Homo sapiens
cccacgccagct

SEQ ID NO: 5869164 - DNA, 18 bp, Homo sapiens
cccacgccagctggccca

SEQ ID NO: 5869165 - DNA, 12 bp, Homo sapiens
cccacgcccgca

SEQ ID NO: 5869166 - DNA, 15 bp, Homo sapiens
cccacgcccgtctct

SEQ ID NO: 5869167 - DNA, 22 bp, Homo sapiens
cccacgccctcattacggctcc

SEQ ID NO: 5869168 - DNA, 18 bp, Homo sapiens
cccacgccctcctccctc

SEQ ID NO: 5869169 - DNA, 16 bp, Homo sapiens
cccacgccgggaacca

SEQ ID NO: 5869170 - DNA, 15 bp, Homo sapiens
cccacgctcctgccc

SEQ ID NO: 5869171 - DNA, 22 bp, Homo sapiens
cccacgctcctgccctcgtctc

SEQ ID NO: 5869172 - DNA, 14 bp, Homo sapiens
cccacgctgactac

SEQ ID NO: 5869173 - DNA, 19 bp, Homo sapiens
cccacgctgactacagggc

SEQ ID NO: 5869174 - DNA, 19 bp, Homo sapiens
cccagacttgtttcctgtg

SEQ ID NO: 5869175 - DNA, 16 bp, Homo sapiens
cccagagaacaatcac

SEQ ID NO: 5869176 - DNA, 12 bp, Homo sapiens
cccagagaagcc

SEQ ID NO: 5869177 - DNA, 15 bp, Homo sapiens
cccagagaagcccct

SEQ ID NO: 5869178 - DNA, 21 bp, Homo sapiens
cccagagaagccccttcccca

SEQ ID NO: 5869179 - DNA, 20 bp, Homo sapiens
cccagagaaggacggtgcca

SEQ ID NO: 5869180 - DNA, 15 bp, Homo sapiens
cccagagacaggaaa

SEQ ID NO: 5869181 - DNA, 16 bp, Homo sapiens
cccagagacaggaaaa

SEQ ID NO: 5869182 - DNA, 18 bp, Homo sapiens
cccagagacatacttgaa

SEQ ID NO: 5869183 - DNA, 13 bp, Homo sapiens
cccagagacccag

SEQ ID NO: 5869184 - DNA, 14 bp, Homo sapiens
cccagagacccagc

SEQ ID NO: 5869185 - DNA, 23 bp, Homo sapiens
cccagagaccccttcctttcctc

SEQ ID NO: 5869186 - DNA, 14 bp, Homo sapiens
cccagagacctcat

SEQ ID NO: 5869187 - DNA, 18 bp, Homo sapiens
cccagagacctcatcagc

SEQ ID NO: 5869188 - DNA, 20 bp, Homo sapiens
cccagagacctcatcagcct

SEQ ID NO: 5869189 - DNA, 22 bp, Homo sapiens
cccagagaccttttctctccca

SEQ ID NO: 5869190 - DNA, 19 bp, Homo sapiens
cccagagactgcccaccct

SEQ ID NO: 5869191 - DNA, 21 bp, Homo sapiens
cccagagactgcccaccctgg

SEQ ID NO: 5869192 - DNA, 19 bp, Homo sapiens
cccagagagaaaaagagag

SEQ ID NO: 5869193 - DNA, 21 bp, Homo sapiens
cccagagagaaaaagagagag

SEQ ID NO: 5869194 - DNA, 19 bp, Homo sapiens
cccagagagacgctgtgat

SEQ ID NO: 5869195 - DNA, 21 bp, Homo sapiens
cccagagagaggggcctgcag

SEQ ID NO: 5869196 - DNA, 13 bp, Homo sapiens
cccagagagcagg

SEQ ID NO: 5869197 - DNA, 12 bp, Homo sapiens
cccagagagctg

SEQ ID NO: 5869198 - DNA, 13 bp, Homo sapiens
cccagagagctga

SEQ ID NO: 5869199 - DNA, 17 bp, Homo sapiens
cccagagaggcactcag

SEQ ID NO: 5869200 - DNA, 15 bp, Homo sapiens
cccagagagggaaga

SEQ ID NO: 5869201 - DNA, 13 bp, Homo sapiens
cccagagatgcca

SEQ ID NO: 5869202 - DNA, 15 bp, Homo sapiens
cccagagatgccagc

SEQ ID NO: 5869203 - DNA, 18 bp, Homo sapiens
cccagagatgccagccct

SEQ ID NO: 5869204 - DNA, 17 bp, Homo sapiens
cccagagatgcctccac

SEQ ID NO: 5869205 - DNA, 15 bp, Homo sapiens
cccagagatggctcc

SEQ ID NO: 5869206 - DNA, 21 bp, Homo sapiens
cccagagatgggactgggagg

SEQ ID NO: 5869207 - DNA, 13 bp, Homo sapiens
cccagagatgtca

SEQ ID NO: 5869208 - DNA, 20 bp, Homo sapiens
cccagagcacaagaaggcca

SEQ ID NO: 5869209 - DNA, 20 bp, Homo sapiens
cccagagcaccccctgctcc

SEQ ID NO: 5869210 - DNA, 17 bp, Homo sapiens
cccagagcacctgctgt

SEQ ID NO: 5869211 - DNA, 20 bp, Homo sapiens
cccagagcacctgctgtctg

SEQ ID NO: 5869212 - DNA, 14 bp, Homo sapiens
cccagagcacttta

SEQ ID NO: 5869213 - DNA, 16 bp, Homo sapiens
cccagagcaggaagca

SEQ ID NO: 5869214 - DNA, 16 bp, Homo sapiens
cccagagcaggaggcc

SEQ ID NO: 5869215 - DNA, 15 bp, Homo sapiens
cccagagcagggtct

SEQ ID NO: 5869216 - DNA, 19 bp, Homo sapiens
cccagagcagggtctctct

SEQ ID NO: 5869217 - DNA, 14 bp, Homo sapiens
cccagagcatctgc

SEQ ID NO: 5869218 - DNA, 18 bp, Homo sapiens
cccagagcatctgcccca

SEQ ID NO: 5869219 - DNA, 24 bp, Homo sapiens
cccagagcatctgccccaggtaca

SEQ ID NO: 5869220 - DNA, 22 bp, Homo sapiens
cccagagcattacgtgagccag

SEQ ID NO: 5869221 - DNA, 14 bp, Homo sapiens
cccagagccacaca

SEQ ID NO: 5869222 - DNA, 13 bp, Homo sapiens
cccagagccacag

SEQ ID NO: 5869223 - DNA, 14 bp, Homo sapiens
cccagagccacctg

SEQ ID NO: 5869224 - DNA, 12 bp, Homo sapiens
cccagagccagg

SEQ ID NO: 5869225 - DNA, 13 bp, Homo sapiens
cccagagccaggg

SEQ ID NO: 5869226 - DNA, 15 bp, Homo sapiens
cccagagccagggct

SEQ ID NO: 5869227 - DNA, 17 bp, Homo sapiens
cccagagccagggctgt

SEQ ID NO: 5869228 - DNA, 19 bp, Homo sapiens
cccagagccagggctgtcc

SEQ ID NO: 5869229 - DNA, 13 bp, Homo sapiens
cccagagcccagc

SEQ ID NO: 5869230 - DNA, 17 bp, Homo sapiens
cccagagcccagctctt

SEQ ID NO: 5869231 - DNA, 21 bp, Homo sapiens
cccagagcccagctcttgctc

SEQ ID NO: 5869232 - DNA, 11 bp, Homo sapiens
cccagagcccc

SEQ ID NO: 5869233 - DNA, 15 bp, Homo sapiens
cccagagccccactc

SEQ ID NO: 5869234 - DNA, 20 bp, Homo sapiens
cccagagcccctcctccagc

SEQ ID NO: 5869235 - DNA, 14 bp, Homo sapiens
cccagagccctgca

SEQ ID NO: 5869236 - DNA, 16 bp, Homo sapiens
cccagagccctgcagt

SEQ ID NO: 5869237 - DNA, 15 bp, Homo sapiens
cccagagccctggac

SEQ ID NO: 5869238 - DNA, 12 bp, Homo sapiens
cccagagccctt

SEQ ID NO: 5869239 - DNA, 13 bp, Homo sapiens
cccagagcccttg

SEQ ID NO: 5869240 - DNA, 18 bp, Homo sapiens
cccagagcctctgctgga

SEQ ID NO: 5869241 - DNA, 20 bp, Homo sapiens
cccagagcctggctgcccat

SEQ ID NO: 5869242 - DNA, 20 bp, Homo sapiens
cccagagcgaggaaaggatt

SEQ ID NO: 5869243 - DNA, 13 bp, Homo sapiens
cccagagctcccc

SEQ ID NO: 5869244 - DNA, 13 bp, Homo sapiens
cccagagctgcct

SEQ ID NO: 5869245 - DNA, 12 bp, Homo sapiens
cccagagctggc

SEQ ID NO: 5869246 - DNA, 14 bp, Homo sapiens
cccagagctggcgc

SEQ ID NO: 5869247 - DNA, 14 bp, Homo sapiens
cccagagctgggtg

SEQ ID NO: 5869248 - DNA, 13 bp, Homo sapiens
cccagagctgttt

SEQ ID NO: 5869249 - DNA, 19 bp, Homo sapiens
cccagagcttattggccac

SEQ ID NO: 5869250 - DNA, 21 bp, Homo sapiens
cccagagcttattggccactg

SEQ ID NO: 5869251 - DNA, 17 bp, Homo sapiens
cccagagcttcccagga

SEQ ID NO: 5869252 - DNA, 20 bp, Homo sapiens
cccagaggacagcacagact

SEQ ID NO: 5869253 - DNA, 15 bp, Homo sapiens
cccagaggagaggag

SEQ ID NO: 5869254 - DNA, 19 bp, Homo sapiens
cccagaggagaggagacag

SEQ ID NO: 5869255 - DNA, 22 bp, Homo sapiens
cccagaggagctgggagccggg

SEQ ID NO: 5869256 - DNA, 13 bp, Homo sapiens
cccagaggcaggc

SEQ ID NO: 5869257 - DNA, 13 bp, Homo sapiens
cccagaggccctg

SEQ ID NO: 5869258 - DNA, 14 bp, Homo sapiens
cccagaggcctctc

SEQ ID NO: 5869259 - DNA, 22 bp, Homo sapiens
cccagaggcgtcccgcacctgt

SEQ ID NO: 5869260 - DNA, 13 bp, Homo sapiens
cccagaggctccc

SEQ ID NO: 5869261 - DNA, 15 bp, Homo sapiens
cccagaggctcctgg

SEQ ID NO: 5869262 - DNA, 20 bp, Homo sapiens
cccagaggctcctggagcca

SEQ ID NO: 5869263 - DNA, 12 bp, Homo sapiens
cccagaggctga

SEQ ID NO: 5869264 - DNA, 15 bp, Homo sapiens
cccagaggctgagtt

SEQ ID NO: 5869265 - DNA, 16 bp, Homo sapiens
cccagaggctgggtga

SEQ ID NO: 5869266 - DNA, 15 bp, Homo sapiens
cccagagggaccagc

SEQ ID NO: 5869267 - DNA, 16 bp, Homo sapiens
cccagagggaccagct

SEQ ID NO: 5869268 - DNA, 19 bp, Homo sapiens
cccagagggaccagctggg

SEQ ID NO: 5869269 - DNA, 20 bp, Homo sapiens
cccagagggaccagctgggg

SEQ ID NO: 5869270 - DNA, 18 bp, Homo sapiens
cccagagggcccaggcag

SEQ ID NO: 5869271 - DNA, 20 bp, Homo sapiens
cccagaggggaatgagggct

SEQ ID NO: 5869272 - DNA, 18 bp, Homo sapiens
cccagaggggacgctgag

SEQ ID NO: 5869273 - DNA, 19 bp, Homo sapiens
cccagaggggacgctgagg

SEQ ID NO: 5869274 - DNA, 15 bp, Homo sapiens
cccagaggggcctgc

SEQ ID NO: 5869275 - DNA, 19 bp, Homo sapiens
cccagaggggcctgccacc

SEQ ID NO: 5869276 - DNA, 20 bp, Homo sapiens
cccagagggtagggcagcag

SEQ ID NO: 5869277 - DNA, 17 bp, Homo sapiens
cccagaggtccagccca

SEQ ID NO: 5869278 - DNA, 18 bp, Homo sapiens
cccagaggtcgcagctac

SEQ ID NO: 5869279 - DNA, 16 bp, Homo sapiens
cccagaggtctcccta

SEQ ID NO: 5869280 - DNA, 18 bp, Homo sapiens
cccagaggtggatactgg

SEQ ID NO: 5869281 - DNA, 14 bp, Homo sapiens
cccagaggtggccc

SEQ ID NO: 5869282 - DNA, 18 bp, Homo sapiens
cccagaggtggccctccc

SEQ ID NO: 5869283 - DNA, 21 bp, Homo sapiens
cccagaggtggggaagagagc

SEQ ID NO: 5869284 - DNA, 23 bp, Homo sapiens
cccagaggtggggaagagagcct

SEQ ID NO: 5869285 - DNA, 16 bp, Homo sapiens
cccagagtagagccag

SEQ ID NO: 5869286 - DNA, 21 bp, Homo sapiens
cccagagtagagccaggtgct

SEQ ID NO: 5869287 - DNA, 16 bp, Homo sapiens
cccagagtatgggcac

SEQ ID NO: 5869288 - DNA, 15 bp, Homo sapiens
cccagagtcccaggc

SEQ ID NO: 5869289 - DNA, 14 bp, Homo sapiens
cccagagtgactga

SEQ ID NO: 5869290 - DNA, 20 bp, Homo sapiens
cccagagtgctgggattaca

SEQ ID NO: 5869291 - DNA, 18 bp, Homo sapiens
cccagagtgctgtcggga

SEQ ID NO: 5869292 - DNA, 21 bp, Homo sapiens
cccagagtgctttaaaaaatt

SEQ ID NO: 5869293 - DNA, 21 bp, Homo sapiens
cccagagtgggagaggctggg

SEQ ID NO: 5869294 - DNA, 21 bp, Homo sapiens
cccagagtgggatccacttct

SEQ ID NO: 5869295 - DNA, 17 bp, Homo sapiens
cccagagtgtagggggc

SEQ ID NO: 5869296 - DNA, 15 bp, Homo sapiens
cccagagtgtgaaac

SEQ ID NO: 5869297 - DNA, 14 bp, Homo sapiens
cccagagtttttat

SEQ ID NO: 5869298 - DNA, 21 bp, Homo sapiens
cccagagtttttatgtagcag

SEQ ID NO: 5869299 - DNA, 19 bp, Homo sapiens
cccagatacgggggctgtg

SEQ ID NO: 5869300 - DNA, 16 bp, Homo sapiens
cccagatagagctggg

SEQ ID NO: 5869301 - DNA, 14 bp, Homo sapiens
cccagatagtccca

SEQ ID NO: 5869302 - DNA, 23 bp, Homo sapiens
cccagatagtcccagcagcctcc

SEQ ID NO: 5869303 - DNA, 14 bp, Homo sapiens
cccagatcagccag

SEQ ID NO: 5869304 - DNA, 16 bp, Homo sapiens
cccagatcagctccta

SEQ ID NO: 5869305 - DNA, 14 bp, Homo sapiens
cccagatcaggaac

SEQ ID NO: 5869306 - DNA, 15 bp, Homo sapiens
cccagatcaggaacc

SEQ ID NO: 5869307 - DNA, 22 bp, Homo sapiens
cccagatcaggaaccagggcct

SEQ ID NO: 5869308 - DNA, 14 bp, Homo sapiens
cccagatcatgccg

SEQ ID NO: 5869309 - DNA, 22 bp, Homo sapiens
cccagatcatgccgccgcagct

SEQ ID NO: 5869310 - DNA, 22 bp, Homo sapiens
cccagatccaaggccgcggccc

SEQ ID NO: 5869311 - DNA, 23 bp, Homo sapiens
cccagatccaggaacacatgcac

SEQ ID NO: 5869312 - DNA, 14 bp, Homo sapiens
cccagatcccaaga

SEQ ID NO: 5869313 - DNA, 14 bp, Homo sapiens
cccagatcccagaa

SEQ ID NO: 5869314 - DNA, 16 bp, Homo sapiens
cccagatcccagaagg

SEQ ID NO: 5869315 - DNA, 12 bp, Homo sapiens
cccagatcctca

SEQ ID NO: 5869316 - DNA, 17 bp, Homo sapiens
cccagatcctggaaaca

SEQ ID NO: 5869317 - DNA, 18 bp, Homo sapiens
cccagatcgttctgccac

SEQ ID NO: 5869318 - DNA, 21 bp, Homo sapiens
cccagatcgttctgccacttg

SEQ ID NO: 5869319 - DNA, 18 bp, Homo sapiens
cccagatctgcctgggcc

SEQ ID NO: 5869320 - DNA, 23 bp, Homo sapiens
cccagatctgcctgggcctgtgc

SEQ ID NO: 5869321 - DNA, 19 bp, Homo sapiens
cccagatctggtcccttgc

SEQ ID NO: 5869322 - DNA, 17 bp, Homo sapiens
cccagatctgtcctggg

SEQ ID NO: 5869323 - DNA, 18 bp, Homo sapiens
cccagatctgtcctgggg

SEQ ID NO: 5869324 - DNA, 18 bp, Homo sapiens
cccagatggctccctggg

SEQ ID NO: 5869325 - DNA, 21 bp, Homo sapiens
cccagatggctccctgggctg

SEQ ID NO: 5869326 - DNA, 23 bp, Homo sapiens
cccagatggctccctgggctggc

SEQ ID NO: 5869327 - DNA, 21 bp, Homo sapiens
cccagatgggggaaagcacag

SEQ ID NO: 5869328 - DNA, 13 bp, Homo sapiens
cccagatgtgtcc

SEQ ID NO: 5869329 - DNA, 15 bp, Homo sapiens
cccagatgtgtcccc

SEQ ID NO: 5869330 - DNA, 21 bp, Homo sapiens
cccagatgtgtcccccccagg

SEQ ID NO: 5869331 - DNA, 18 bp, Homo sapiens
cccagatgttttatttat

SEQ ID NO: 5869332 - DNA, 14 bp, Homo sapiens
cccagattcccaga

SEQ ID NO: 5869333 - DNA, 22 bp, Homo sapiens
cccagattctgaaacaggccct

SEQ ID NO: 5869334 - DNA, 18 bp, Homo sapiens
cccagattgataagtaat

SEQ ID NO: 5869335 - DNA, 20 bp, Homo sapiens
cccagattgcaacaggctgg

SEQ ID NO: 5869336 - DNA, 22 bp, Homo sapiens
cccagattgcaacaggctgggc

SEQ ID NO: 5869337 - DNA, 23 bp, Homo sapiens
cccagattgcaacaggctgggct

SEQ ID NO: 5869338 - DNA, 17 bp, Homo sapiens
cccagattggctcacac

SEQ ID NO: 5869339 - DNA, 19 bp, Homo sapiens
cccagattggctcacactg

SEQ ID NO: 5869340 - DNA, 21 bp, Homo sapiens
cccagattggctcacactgag

SEQ ID NO: 5869341 - DNA, 22 bp, Homo sapiens
cccagattggctcacactgaga

SEQ ID NO: 5869342 - DNA, 16 bp, Homo sapiens
cccagattttatttat

SEQ ID NO: 5869343 - DNA, 14 bp, Homo sapiens
cccagcaaatgggc

SEQ ID NO: 5869344 - DNA, 20 bp, Homo sapiens
cccagcaacgcccctccaaa

SEQ ID NO: 5869345 - DNA, 18 bp, Homo sapiens
cccagcaaggcacaggct

SEQ ID NO: 5869346 - DNA, 16 bp, Homo sapiens
cccagcaagtgagagc

SEQ ID NO: 5869347 - DNA, 22 bp, Homo sapiens
cccagcaagtgagagctgggtg

SEQ ID NO: 5869348 - DNA, 23 bp, Homo sapiens
cccagcacaaagcactggccttg

SEQ ID NO: 5869349 - DNA, 19 bp, Homo sapiens
cccagcacaattcattgtt

SEQ ID NO: 5869350 - DNA, 21 bp, Homo sapiens
cccagcacagatgaggagcag

SEQ ID NO: 5869351 - DNA, 13 bp, Homo sapiens
cccagcacagctc

SEQ ID NO: 5869352 - DNA, 14 bp, Homo sapiens
cccagcacagctcc

SEQ ID NO: 5869353 - DNA, 19 bp, Homo sapiens
cccagcacagctcctcccc

SEQ ID NO: 5869354 - DNA, 18 bp, Homo sapiens
cccagcacagcttgacct

SEQ ID NO: 5869355 - DNA, 14 bp, Homo sapiens
cccagcacaggcac

SEQ ID NO: 5869356 - DNA, 21 bp, Homo sapiens
cccagcacaggcaggggtaga

SEQ ID NO: 5869357 - DNA, 22 bp, Homo sapiens
cccagcacatcgccagccctgg

SEQ ID NO: 5869358 - DNA, 19 bp, Homo sapiens
cccagcaccaccaggtctc

SEQ ID NO: 5869359 - DNA, 16 bp, Homo sapiens
cccagcaccccttcct

SEQ ID NO: 5869360 - DNA, 17 bp, Homo sapiens
cccagcacctcagcctg

SEQ ID NO: 5869361 - DNA, 19 bp, Homo sapiens
cccagcacctgccagggcc

SEQ ID NO: 5869362 - DNA, 15 bp, Homo sapiens
cccagcacctgctcc

SEQ ID NO: 5869363 - DNA, 16 bp, Homo sapiens
cccagcacctgctccc

SEQ ID NO: 5869364 - DNA, 13 bp, Homo sapiens
cccagcacctgga

SEQ ID NO: 5869365 - DNA, 15 bp, Homo sapiens
cccagcacctggcac

SEQ ID NO: 5869366 - DNA, 16 bp, Homo sapiens
cccagcacctggcaca

SEQ ID NO: 5869367 - DNA, 16 bp, Homo sapiens
cccagcacgagcctgg

SEQ ID NO: 5869368 - DNA, 20 bp, Homo sapiens
cccagcactaaggccgtgtc

SEQ ID NO: 5869369 - DNA, 15 bp, Homo sapiens
cccagcactcccctt

SEQ ID NO: 5869370 - DNA, 15 bp, Homo sapiens
cccagcactcctctg

SEQ ID NO: 5869371 - DNA, 19 bp, Homo sapiens
cccagcactcctctgtctc

SEQ ID NO: 5869372 - DNA, 22 bp, Homo sapiens
cccagcactcctctgtctctgc

SEQ ID NO: 5869373 - DNA, 24 bp, Homo sapiens
cccagcactgaggaagaacggggc

SEQ ID NO: 5869374 - DNA, 18 bp, Homo sapiens
cccagcactgcccatccc

SEQ ID NO: 5869375 - DNA, 20 bp, Homo sapiens
cccagcactgcccatcccac

SEQ ID NO: 5869376 - DNA, 22 bp, Homo sapiens
cccagcactgcccatcccaccc

SEQ ID NO: 5869377 - DNA, 18 bp, Homo sapiens
cccagcactgcctcctgt

SEQ ID NO: 5869378 - DNA, 11 bp, Homo sapiens
cccagcactgt

SEQ ID NO: 5869379 - DNA, 14 bp, Homo sapiens
cccagcactgtgaa

SEQ ID NO: 5869380 - DNA, 20 bp, Homo sapiens
cccagcactttgggaggcag

SEQ ID NO: 5869381 - DNA, 16 bp, Homo sapiens
cccagcacttttggag

SEQ ID NO: 5869382 - DNA, 19 bp, Homo sapiens
cccagcagaaccagcctca

SEQ ID NO: 5869383 - DNA, 14 bp, Homo sapiens
cccagcagaagagg

SEQ ID NO: 5869384 - DNA, 13 bp, Homo sapiens
cccagcagagccg

SEQ ID NO: 5869385 - DNA, 13 bp, Homo sapiens
cccagcagaggca

SEQ ID NO: 5869386 - DNA, 15 bp, Homo sapiens
cccagcagaggcagg

SEQ ID NO: 5869387 - DNA, 12 bp, Homo sapiens
cccagcagaggg

SEQ ID NO: 5869388 - DNA, 12 bp, Homo sapiens
cccagcagccag

SEQ ID NO: 5869389 - DNA, 17 bp, Homo sapiens
cccagcagcccctcagc

SEQ ID NO: 5869390 - DNA, 12 bp, Homo sapiens
cccagcagccct

SEQ ID NO: 5869391 - DNA, 14 bp, Homo sapiens
cccagcagcctccc

SEQ ID NO: 5869392 - DNA, 16 bp, Homo sapiens
cccagcagcggcccag

SEQ ID NO: 5869393 - DNA, 17 bp, Homo sapiens
cccagcagcggcccaga

SEQ ID NO: 5869394 - DNA, 14 bp, Homo sapiens
cccagcagctgcca

SEQ ID NO: 5869395 - DNA, 14 bp, Homo sapiens
cccagcagctgggc

SEQ ID NO: 5869396 - DNA, 14 bp, Homo sapiens
cccagcagcttggc

SEQ ID NO: 5869397 - DNA, 15 bp, Homo sapiens
cccagcagcttggct

SEQ ID NO: 5869398 - DNA, 21 bp, Homo sapiens
cccagcaggagagactgagca

SEQ ID NO: 5869399 - DNA, 12 bp, Homo sapiens
cccagcaggagg

SEQ ID NO: 5869400 - DNA, 13 bp, Homo sapiens
cccagcaggcaga

SEQ ID NO: 5869401 - DNA, 14 bp, Homo sapiens
cccagcaggcaggc

SEQ ID NO: 5869402 - DNA, 12 bp, Homo sapiens
cccagcaggccc

SEQ ID NO: 5869403 - DNA, 16 bp, Homo sapiens
cccagcaggcccagca

SEQ ID NO: 5869404 - DNA, 18 bp, Homo sapiens
cccagcaggcccagcatg

SEQ ID NO: 5869405 - DNA, 21 bp, Homo sapiens
cccagcaggcccagcatgcag

SEQ ID NO: 5869406 - DNA, 18 bp, Homo sapiens
cccagcagggccactccc

SEQ ID NO: 5869407 - DNA, 20 bp, Homo sapiens
cccagcaggggccctcactc

SEQ ID NO: 5869408 - DNA, 16 bp, Homo sapiens
cccagcaggtggggag

SEQ ID NO: 5869409 - DNA, 19 bp, Homo sapiens
cccagcaggtggggagggg

SEQ ID NO: 5869410 - DNA, 16 bp, Homo sapiens
cccagcagtggcttgc

SEQ ID NO: 5869411 - DNA, 17 bp, Homo sapiens
cccagcatcactcccca

SEQ ID NO: 5869412 - DNA, 17 bp, Homo sapiens
cccagcatccctggagc

SEQ ID NO: 5869413 - DNA, 20 bp, Homo sapiens
cccagcatccctggagcagg

SEQ ID NO: 5869414 - DNA, 19 bp, Homo sapiens
cccagcatcgggggcctgc

SEQ ID NO: 5869415 - DNA, 15 bp, Homo sapiens
cccagcatctcagag

SEQ ID NO: 5869416 - DNA, 19 bp, Homo sapiens
cccagcatgcaccacgggc

SEQ ID NO: 5869417 - DNA, 23 bp, Homo sapiens
cccagcatgcaccacgggcccgg

SEQ ID NO: 5869418 - DNA, 13 bp, Homo sapiens
cccagcatgcagg

SEQ ID NO: 5869419 - DNA, 15 bp, Homo sapiens
cccagcatgcaggtg

SEQ ID NO: 5869420 - DNA, 15 bp, Homo sapiens
cccagcattccagct

SEQ ID NO: 5869421 - DNA, 17 bp, Homo sapiens
cccagcattccagctct

SEQ ID NO: 5869422 - DNA, 22 bp, Homo sapiens
cccagcattccagctctgcccc

SEQ ID NO: 5869423 - DNA, 13 bp, Homo sapiens
cccagcattctca

SEQ ID NO: 5869424 - DNA, 15 bp, Homo sapiens
cccagcattctcagg

SEQ ID NO: 5869425 - DNA, 16 bp, Homo sapiens
cccagcattctcaggc

SEQ ID NO: 5869426 - DNA, 17 bp, Homo sapiens
cccagcattctcaggca

SEQ ID NO: 5869427 - DNA, 18 bp, Homo sapiens
cccagccaacgagattgc

SEQ ID NO: 5869428 - DNA, 14 bp, Homo sapiens
cccagccaagcctg

SEQ ID NO: 5869429 - DNA, 14 bp, Homo sapiens
cccagccaagtgcc

SEQ ID NO: 5869430 - DNA, 16 bp, Homo sapiens
cccagccacaggccaa

SEQ ID NO: 5869431 - DNA, 23 bp, Homo sapiens
cccagccacagtgttatgctctg

SEQ ID NO: 5869432 - DNA, 17 bp, Homo sapiens
cccagccaccaccctca

SEQ ID NO: 5869433 - DNA, 22 bp, Homo sapiens
cccagccaccaccctcaggtgc

SEQ ID NO: 5869434 - DNA, 14 bp, Homo sapiens
cccagccacccctc

SEQ ID NO: 5869435 - DNA, 15 bp, Homo sapiens
cccagccacccctca

SEQ ID NO: 5869436 - DNA, 14 bp, Homo sapiens
cccagccacccgga

SEQ ID NO: 5869437 - DNA, 18 bp, Homo sapiens
cccagccacctcccaagg

SEQ ID NO: 5869438 - DNA, 21 bp, Homo sapiens
cccagccaccttcctgactgg

SEQ ID NO: 5869439 - DNA, 17 bp, Homo sapiens
cccagccacgactgcca

SEQ ID NO: 5869440 - DNA, 23 bp, Homo sapiens
cccagccactccaagccccctgg

SEQ ID NO: 5869441 - DNA, 21 bp, Homo sapiens
cccagccactcctcaaccttg

SEQ ID NO: 5869442 - DNA, 15 bp, Homo sapiens
cccagccactgccaa

SEQ ID NO: 5869443 - DNA, 13 bp, Homo sapiens
cccagccagaggt

SEQ ID NO: 5869444 - DNA, 17 bp, Homo sapiens
cccagccagagttcctg

SEQ ID NO: 5869445 - DNA, 18 bp, Homo sapiens
cccagccagagttcctgc

SEQ ID NO: 5869446 - DNA, 13 bp, Homo sapiens
cccagccagcagg

SEQ ID NO: 5869447 - DNA, 17 bp, Homo sapiens
cccagccagcagttcag

SEQ ID NO: 5869448 - DNA, 21 bp, Homo sapiens
cccagccagccacccctgcca

SEQ ID NO: 5869449 - DNA, 15 bp, Homo sapiens
cccagccagccagga

SEQ ID NO: 5869450 - DNA, 20 bp, Homo sapiens
cccagccagccatcggaaga

SEQ ID NO: 5869451 - DNA, 14 bp, Homo sapiens
cccagccagcccgc

SEQ ID NO: 5869452 - DNA, 13 bp, Homo sapiens
cccagccagccct

SEQ ID NO: 5869453 - DNA, 14 bp, Homo sapiens
cccagccagccctt

SEQ ID NO: 5869454 - DNA, 19 bp, Homo sapiens
cccagccagcccttcccag

SEQ ID NO: 5869455 - DNA, 20 bp, Homo sapiens
cccagccagcccttcccagg

SEQ ID NO: 5869456 - DNA, 23 bp, Homo sapiens
cccagccagcccttcccaggcca

SEQ ID NO: 5869457 - DNA, 12 bp, Homo sapiens
cccagccagctg

SEQ ID NO: 5869458 - DNA, 20 bp, Homo sapiens
cccagccagctgcagggcac

SEQ ID NO: 5869459 - DNA, 19 bp, Homo sapiens
cccagccagggctcaatct

SEQ ID NO: 5869460 - DNA, 19 bp, Homo sapiens
cccagccagttggtggggc

SEQ ID NO: 5869461 - DNA, 15 bp, Homo sapiens
cccagccatctgccc

SEQ ID NO: 5869462 - DNA, 16 bp, Homo sapiens
cccagccatctgccca

SEQ ID NO: 5869463 - DNA, 17 bp, Homo sapiens
cccagccatctgcccag

SEQ ID NO: 5869464 - DNA, 18 bp, Homo sapiens
cccagccatgccagctgg

SEQ ID NO: 5869465 - DNA, 19 bp, Homo sapiens
cccagccatgccagctggc

SEQ ID NO: 5869466 - DNA, 15 bp, Homo sapiens
cccagccatgcccag

SEQ ID NO: 5869467 - DNA, 17 bp, Homo sapiens
cccagccatgcccagga

SEQ ID NO: 5869468 - DNA, 20 bp, Homo sapiens
cccagccatggctggatgtg

SEQ ID NO: 5869469 - DNA, 16 bp, Homo sapiens
cccagccatgggccct

SEQ ID NO: 5869470 - DNA, 17 bp, Homo sapiens
cccagccatgggccctc

SEQ ID NO: 5869471 - DNA, 18 bp, Homo sapiens
cccagccatgggccctct

SEQ ID NO: 5869472 - DNA, 12 bp, Homo sapiens
cccagcccaagt

SEQ ID NO: 5869473 - DNA, 13 bp, Homo sapiens
cccagcccaagtc

SEQ ID NO: 5869474 - DNA, 11 bp, Homo sapiens
cccagcccaat

SEQ ID NO: 5869475 - DNA, 17 bp, Homo sapiens
cccagcccaataaaggt

SEQ ID NO: 5869476 - DNA, 14 bp, Homo sapiens
cccagcccacagag

SEQ ID NO: 5869477 - DNA, 16 bp, Homo sapiens
cccagcccacagagcc

SEQ ID NO: 5869478 - DNA, 14 bp, Homo sapiens
cccagcccaccctc

SEQ ID NO: 5869479 - DNA, 16 bp, Homo sapiens
cccagcccaccctcct

SEQ ID NO: 5869480 - DNA, 20 bp, Homo sapiens
cccagcccaccctgctcctc

SEQ ID NO: 5869481 - DNA, 23 bp, Homo sapiens
cccagcccaccctgctcctcctg

SEQ ID NO: 5869482 - DNA, 16 bp, Homo sapiens
cccagcccacctgctc

SEQ ID NO: 5869483 - DNA, 10 bp, Homo sapiens
cccagcccag

SEQ ID NO: 5869484 - DNA, 13 bp, Homo sapiens
cccagcccagaca

SEQ ID NO: 5869485 - DNA, 12 bp, Homo sapiens
cccagcccagag

SEQ ID NO: 5869486 - DNA, 16 bp, Homo sapiens
cccagcccagagacat

SEQ ID NO: 5869487 - DNA, 14 bp, Homo sapiens
cccagcccagagcc

SEQ ID NO: 5869488 - DNA, 20 bp, Homo sapiens
cccagcccagattcccctgt

SEQ ID NO: 5869489 - DNA, 17 bp, Homo sapiens
cccagcccagcacccct

SEQ ID NO: 5869490 - DNA, 18 bp, Homo sapiens
cccagcccagctgctctg

SEQ ID NO: 5869491 - DNA, 20 bp, Homo sapiens
cccagcccagctgctctgcc

SEQ ID NO: 5869492 - DNA, 18 bp, Homo sapiens
cccagcccagctggtggg

SEQ ID NO: 5869493 - DNA, 17 bp, Homo sapiens
cccagcccaggcctggt

SEQ ID NO: 5869494 - DNA, 18 bp, Homo sapiens
cccagcccagggctcctg

SEQ ID NO: 5869495 - DNA, 15 bp, Homo sapiens
cccagcccatggaga

SEQ ID NO: 5869496 - DNA, 21 bp, Homo sapiens
cccagcccattctctctcctg

SEQ ID NO: 5869497 - DNA, 21 bp, Homo sapiens
cccagccccaaaactctcctc

SEQ ID NO: 5869498 - DNA, 19 bp, Homo sapiens
cccagccccaatccagaga

SEQ ID NO: 5869499 - DNA, 20 bp, Homo sapiens
cccagccccaatccagagaa

SEQ ID NO: 5869500 - DNA, 13 bp, Homo sapiens
cccagccccacac

SEQ ID NO: 5869501 - DNA, 15 bp, Homo sapiens
cccagccccacccct

SEQ ID NO: 5869502 - DNA, 21 bp, Homo sapiens
cccagccccacccctaagtgc

SEQ ID NO: 5869503 - DNA, 14 bp, Homo sapiens
cccagccccactgc

SEQ ID NO: 5869504 - DNA, 18 bp, Homo sapiens
cccagccccactgccctc

SEQ ID NO: 5869505 - DNA, 16 bp, Homo sapiens
cccagccccacttacc

SEQ ID NO: 5869506 - DNA, 11 bp, Homo sapiens
cccagccccag

SEQ ID NO: 5869507 - DNA, 12 bp, Homo sapiens
cccagccccagc

SEQ ID NO: 5869508 - DNA, 15 bp, Homo sapiens
cccagccccagccag

SEQ ID NO: 5869509 - DNA, 15 bp, Homo sapiens
cccagccccaggcct

SEQ ID NO: 5869510 - DNA, 13 bp, Homo sapiens
cccagccccaggg

SEQ ID NO: 5869511 - DNA, 14 bp, Homo sapiens
cccagccccatccc

SEQ ID NO: 5869512 - DNA, 16 bp, Homo sapiens
cccagccccatccctg

SEQ ID NO: 5869513 - DNA, 20 bp, Homo sapiens
cccagccccatccctgtcct

SEQ ID NO: 5869514 - DNA, 21 bp, Homo sapiens
cccagccccatccctgtcctc

SEQ ID NO: 5869515 - DNA, 15 bp, Homo sapiens
cccagccccatcctc

SEQ ID NO: 5869516 - DNA, 19 bp, Homo sapiens
cccagccccatcctctgta

SEQ ID NO: 5869517 - DNA, 21 bp, Homo sapiens
cccagcccccaaccccaagac

SEQ ID NO: 5869518 - DNA, 16 bp, Homo sapiens
cccagcccccacagtg

SEQ ID NO: 5869519 - DNA, 17 bp, Homo sapiens
cccagcccccacagtgc

SEQ ID NO: 5869520 - DNA, 15 bp, Homo sapiens
cccagcccccagggc

SEQ ID NO: 5869521 - DNA, 13 bp, Homo sapiens
cccagccccctgg

SEQ ID NO: 5869522 - DNA, 14 bp, Homo sapiens
cccagccccctggc

SEQ ID NO: 5869523 - DNA, 16 bp, Homo sapiens
cccagccccctggccc

SEQ ID NO: 5869524 - DNA, 18 bp, Homo sapiens
cccagccccctggcccct

SEQ ID NO: 5869525 - DNA, 16 bp, Homo sapiens
cccagccccctttggg

SEQ ID NO: 5869526 - DNA, 17 bp, Homo sapiens
cccagccccgactccag

SEQ ID NO: 5869527 - DNA, 21 bp, Homo sapiens
cccagccccgactccagccag

SEQ ID NO: 5869528 - DNA, 23 bp, Homo sapiens
cccagccccgactccagccagcg

SEQ ID NO: 5869529 - DNA, 15 bp, Homo sapiens
cccagccccggggtg

SEQ ID NO: 5869530 - DNA, 20 bp, Homo sapiens
cccagccccggtggctgggc

SEQ ID NO: 5869531 - DNA, 18 bp, Homo sapiens
cccagccccgtcccagag

SEQ ID NO: 5869532 - DNA, 11 bp, Homo sapiens
cccagccccta

SEQ ID NO: 5869533 - DNA, 15 bp, Homo sapiens
cccaggacactgcct

SEQ ID NO: 5869534 - DNA, 17 bp, Homo sapiens
cccaggacactgccttt

SEQ ID NO: 5869535 - DNA, 10 bp, Homo sapiens
cccaggacag

SEQ ID NO: 5869536 - DNA, 17 bp, Homo sapiens
cccaggacagcacacgg

SEQ ID NO: 5869537 - DNA, 14 bp, Homo sapiens
cccaggacaggaaa

SEQ ID NO: 5869538 - DNA, 18 bp, Homo sapiens
cccaggacaggaaatatg

SEQ ID NO: 5869539 - DNA, 18 bp, Homo sapiens
cccaggacatctcctggc

SEQ ID NO: 5869540 - DNA, 20 bp, Homo sapiens
cccaggaccaagccacagca

SEQ ID NO: 5869541 - DNA, 17 bp, Homo sapiens
cccaggaccacaggctc

SEQ ID NO: 5869542 - DNA, 21 bp, Homo sapiens
cccaggaccacaggctcaggc

SEQ ID NO: 5869543 - DNA, 22 bp, Homo sapiens
cccaggaccagaagctccccca

SEQ ID NO: 5869544 - DNA, 16 bp, Homo sapiens
cccaggaccagctcag

SEQ ID NO: 5869545 - DNA, 22 bp, Homo sapiens
cccaggaccagctcaggacaga

SEQ ID NO: 5869546 - DNA, 15 bp, Homo sapiens
cccaggaccagctgg

SEQ ID NO: 5869547 - DNA, 21 bp, Homo sapiens
cccaggaccagctggggcgtg

SEQ ID NO: 5869548 - DNA, 16 bp, Homo sapiens
cccaggacccatcttt

SEQ ID NO: 5869549 - DNA, 15 bp, Homo sapiens
cccaggaccccccca

SEQ ID NO: 5869550 - DNA, 20 bp, Homo sapiens
cccaggacccccccagtccg

SEQ ID NO: 5869551 - DNA, 12 bp, Homo sapiens
cccaggaccctg

SEQ ID NO: 5869552 - DNA, 19 bp, Homo sapiens
cccaggaccctggacccag

SEQ ID NO: 5869553 - DNA, 20 bp, Homo sapiens
cccaggaccctggacccagc

SEQ ID NO: 5869554 - DNA, 15 bp, Homo sapiens
cccaggacctctggg

SEQ ID NO: 5869555 - DNA, 17 bp, Homo sapiens
cccaggacctcttcagc

SEQ ID NO: 5869556 - DNA, 19 bp, Homo sapiens
cccaggacctgagcctggc

SEQ ID NO: 5869557 - DNA, 23 bp, Homo sapiens
cccaggacctgagcctggccatg

SEQ ID NO: 5869558 - DNA, 16 bp, Homo sapiens
cccaggacctggctgc

SEQ ID NO: 5869559 - DNA, 13 bp, Homo sapiens
cccaggacgcagg

SEQ ID NO: 5869560 - DNA, 23 bp, Homo sapiens
cccaggacgcatgcagggccccc

SEQ ID NO: 5869561 - DNA, 19 bp, Homo sapiens
cccaggacgccactcattt

SEQ ID NO: 5869562 - DNA, 16 bp, Homo sapiens
cccaggacgcttctga

SEQ ID NO: 5869563 - DNA, 19 bp, Homo sapiens
cccaggacggggccggcca

SEQ ID NO: 5869564 - DNA, 22 bp, Homo sapiens
cccaggacggggccggccaggt

SEQ ID NO: 5869565 - DNA, 19 bp, Homo sapiens
cccaggacggtctgtgccc

SEQ ID NO: 5869566 - DNA, 23 bp, Homo sapiens
cccaggacgtcctatctccccca

SEQ ID NO: 5869567 - DNA, 19 bp, Homo sapiens
cccaggactctgaccccag

SEQ ID NO: 5869568 - DNA, 23 bp, Homo sapiens
cccaggactctgaccccagcatt

SEQ ID NO: 5869569 - DNA, 14 bp, Homo sapiens
cccaggactctggc

SEQ ID NO: 5869570 - DNA, 22 bp, Homo sapiens
cccaggagaattaggaaggcca

SEQ ID NO: 5869571 - DNA, 24 bp, Homo sapiens
cccaggagaattaggaaggccatg

SEQ ID NO: 5869572 - DNA, 21 bp, Homo sapiens
cccaggagacagaccacttgc

SEQ ID NO: 5869573 - DNA, 15 bp, Homo sapiens
cccaggagacagttc

SEQ ID NO: 5869574 - DNA, 22 bp, Homo sapiens
cccaggagagaacacggggagg

SEQ ID NO: 5869575 - DNA, 15 bp, Homo sapiens
cccaggagagagaaa

SEQ ID NO: 5869576 - DNA, 16 bp, Homo sapiens
cccaggagagagaaag

SEQ ID NO: 5869577 - DNA, 20 bp, Homo sapiens
cccaggagagagaaagccag

SEQ ID NO: 5869578 - DNA, 23 bp, Homo sapiens
cccaggagagagctacggcaggg

SEQ ID NO: 5869579 - DNA, 14 bp, Homo sapiens
cccaggagagccag

SEQ ID NO: 5869580 - DNA, 22 bp, Homo sapiens
cccaggagagccagccctccct

SEQ ID NO: 5869581 - DNA, 21 bp, Homo sapiens
cccaggagagcccccaccagc

SEQ ID NO: 5869582 - DNA, 18 bp, Homo sapiens
cccaggagatgggtccag

SEQ ID NO: 5869583 - DNA, 12 bp, Homo sapiens
cccaggagcagc

SEQ ID NO: 5869584 - DNA, 13 bp, Homo sapiens
cccaggagcagct

SEQ ID NO: 5869585 - DNA, 20 bp, Homo sapiens
cccaggagcagctggcactg

SEQ ID NO: 5869586 - DNA, 23 bp, Homo sapiens
cccaggagcagctggcactgaca

SEQ ID NO: 5869587 - DNA, 18 bp, Homo sapiens
cccaggagcatccacctc

SEQ ID NO: 5869588 - DNA, 12 bp, Homo sapiens
cccaggagccca

SEQ ID NO: 5869589 - DNA, 18 bp, Homo sapiens
cccaggagccccgaggcc

SEQ ID NO: 5869590 - DNA, 17 bp, Homo sapiens
cccaggagcctgcccag

SEQ ID NO: 5869591 - DNA, 19 bp, Homo sapiens
cccaggagcctgcccagcc

SEQ ID NO: 5869592 - DNA, 21 bp, Homo sapiens
cccaggagcggcgatgcactc

SEQ ID NO: 5869593 - DNA, 21 bp, Homo sapiens
cccaggagctcaggtggggag

SEQ ID NO: 5869594 - DNA, 13 bp, Homo sapiens
cccaggagctctc

SEQ ID NO: 5869595 - DNA, 14 bp, Homo sapiens
cccaggagctctct

SEQ ID NO: 5869596 - DNA, 20 bp, Homo sapiens
cccaggagctctctgctgag

SEQ ID NO: 5869597 - DNA, 13 bp, Homo sapiens
cccaggagctctg

SEQ ID NO: 5869598 - DNA, 22 bp, Homo sapiens
cccaggagctctgcgccaggca

SEQ ID NO: 5869599 - DNA, 23 bp, Homo sapiens
cccaggagctctgcgccaggcag

SEQ ID NO: 5869600 - DNA, 18 bp, Homo sapiens
cccaggagctgagtcacc

SEQ ID NO: 5869601 - DNA, 20 bp, Homo sapiens
cccaggagctgagtcacctc

SEQ ID NO: 5869602 - DNA, 19 bp, Homo sapiens
cccaggaggaccgcctgcc

SEQ ID NO: 5869603 - DNA, 21 bp, Homo sapiens
cccaggaggaggattgtgctg

SEQ ID NO: 5869604 - DNA, 20 bp, Homo sapiens
cccaggaggcagaggttgca

SEQ ID NO: 5869605 - DNA, 23 bp, Homo sapiens
cccaggaggcagggaggcagccg

SEQ ID NO: 5869606 - DNA, 18 bp, Homo sapiens
cccaggaggccagccttg

SEQ ID NO: 5869607 - DNA, 20 bp, Homo sapiens
cccaggaggcggaggttgca

SEQ ID NO: 5869608 - DNA, 18 bp, Homo sapiens
cccaggaggctgaggcag

SEQ ID NO: 5869609 - DNA, 18 bp, Homo sapiens
cccaggagggagggggct

SEQ ID NO: 5869610 - DNA, 23 bp, Homo sapiens
cccaggaggggaactgagtcacg

SEQ ID NO: 5869611 - DNA, 23 bp, Homo sapiens
cccaggaggtgcttgaggccccg

SEQ ID NO: 5869612 - DNA, 15 bp, Homo sapiens
cccaggagtccagac

SEQ ID NO: 5869613 - DNA, 16 bp, Homo sapiens
cccaggagtccagacc

SEQ ID NO: 5869614 - DNA, 17 bp, Homo sapiens
cccaggagtccagaccc

SEQ ID NO: 5869615 - DNA, 15 bp, Homo sapiens
cccaggagtccagcc

SEQ ID NO: 5869616 - DNA, 18 bp, Homo sapiens
cccaggagtccagcccct

SEQ ID NO: 5869617 - DNA, 20 bp, Homo sapiens
cccaggagtccaggccccca

SEQ ID NO: 5869618 - DNA, 17 bp, Homo sapiens
cccaggagtttggccag

SEQ ID NO: 5869619 - DNA, 19 bp, Homo sapiens
cccaggagtttggccagaa

SEQ ID NO: 5869620 - DNA, 20 bp, Homo sapiens
cccaggagtttggccagaag

SEQ ID NO: 5869621 - DNA, 20 bp, Homo sapiens
cccaggagttttaagtccag

SEQ ID NO: 5869622 - DNA, 18 bp, Homo sapiens
cccaggatcccagagctt

SEQ ID NO: 5869623 - DNA, 15 bp, Homo sapiens
cccaggatccccaag

SEQ ID NO: 5869624 - DNA, 17 bp, Homo sapiens
cccaggatccctcccag

SEQ ID NO: 5869625 - DNA, 21 bp, Homo sapiens
cccaggatccctcccagatcc

SEQ ID NO: 5869626 - DNA, 20 bp, Homo sapiens
cccaggatctcctgccagcc

SEQ ID NO: 5869627 - DNA, 21 bp, Homo sapiens
cccaggatctcctgccagccc

SEQ ID NO: 5869628 - DNA, 15 bp, Homo sapiens
cccaggatggactct

SEQ ID NO: 5869629 - DNA, 19 bp, Homo sapiens
cccaggatggactcttctc

SEQ ID NO: 5869630 - DNA, 14 bp, Homo sapiens
cccaggcaaataaa

SEQ ID NO: 5869631 - DNA, 21 bp, Homo sapiens
cccaggcaaataaaattccct

SEQ ID NO: 5869632 - DNA, 20 bp, Homo sapiens
cccaggcaaatcagttacta

SEQ ID NO: 5869633 - DNA, 14 bp, Homo sapiens
cccaggcaagcagc

SEQ ID NO: 5869634 - DNA, 13 bp, Homo sapiens
cccaggcaaggaa

SEQ ID NO: 5869635 - DNA, 15 bp, Homo sapiens
cccaggcaaggaaca

SEQ ID NO: 5869636 - DNA, 14 bp, Homo sapiens
cccaggcaatagtg

SEQ ID NO: 5869637 - DNA, 20 bp, Homo sapiens
cccaggcaccaccaggagca

SEQ ID NO: 5869638 - DNA, 20 bp, Homo sapiens
cccaggcaccccctggcttg

SEQ ID NO: 5869639 - DNA, 17 bp, Homo sapiens
cccaggcactgggctcc

SEQ ID NO: 5869640 - DNA, 23 bp, Homo sapiens
cccaggcagaaatagttgtctgt

SEQ ID NO: 5869641 - DNA, 20 bp, Homo sapiens
cccaggcagacaaccttgtc

SEQ ID NO: 5869642 - DNA, 13 bp, Homo sapiens
cccaggcagagct

SEQ ID NO: 5869643 - DNA, 17 bp, Homo sapiens
cccaggcagcacctgga

SEQ ID NO: 5869644 - DNA, 13 bp, Homo sapiens
cccaggcagccac

SEQ ID NO: 5869645 - DNA, 17 bp, Homo sapiens
cccaggcagccaccagt

SEQ ID NO: 5869646 - DNA, 13 bp, Homo sapiens
cccaggcagcctc

SEQ ID NO: 5869647 - DNA, 14 bp, Homo sapiens
cccaggcagcctca

SEQ ID NO: 5869648 - DNA, 22 bp, Homo sapiens
cccaggcagcctcaaggccctc

SEQ ID NO: 5869649 - DNA, 18 bp, Homo sapiens
cccaggcagctatttcag

SEQ ID NO: 5869650 - DNA, 15 bp, Homo sapiens
cccaggcagctcctg

SEQ ID NO: 5869651 - DNA, 13 bp, Homo sapiens
cccaggcaggccc

SEQ ID NO: 5869652 - DNA, 14 bp, Homo sapiens
cccaggcaggccca

SEQ ID NO: 5869653 - DNA, 13 bp, Homo sapiens
cccaggcaggctg

SEQ ID NO: 5869654 - DNA, 15 bp, Homo sapiens
cccaggcagggccaa

SEQ ID NO: 5869655 - DNA, 14 bp, Homo sapiens
cccaggcaggggct

SEQ ID NO: 5869656 - DNA, 11 bp, Homo sapiens
cccaggcaggt

SEQ ID NO: 5869657 - DNA, 16 bp, Homo sapiens
cccaggcaggtctgca

SEQ ID NO: 5869658 - DNA, 17 bp, Homo sapiens
cccaggcaggtcttgaa

SEQ ID NO: 5869659 - DNA, 23 bp, Homo sapiens
cccaggcaggtgcagggaagtgc

SEQ ID NO: 5869660 - DNA, 18 bp, Homo sapiens
cccaggcagtctttgctc

SEQ ID NO: 5869661 - DNA, 14 bp, Homo sapiens
cccaggcatcccat

SEQ ID NO: 5869662 - DNA, 17 bp, Homo sapiens
cccaggcatctgcctct

SEQ ID NO: 5869663 - DNA, 22 bp, Homo sapiens
cccaggcatctgttagcagagt

SEQ ID NO: 5869664 - DNA, 18 bp, Homo sapiens
cccaggcatgcagctgcc

SEQ ID NO: 5869665 - DNA, 19 bp, Homo sapiens
cccaggcatgcagctgcct

SEQ ID NO: 5869666 - DNA, 18 bp, Homo sapiens
cccaggcattccccagga

SEQ ID NO: 5869667 - DNA, 22 bp, Homo sapiens
cccaggcattccccaggaggcc

SEQ ID NO: 5869668 - DNA, 18 bp, Homo sapiens
cccaggccaacagtagcc

SEQ ID NO: 5869669 - DNA, 11 bp, Homo sapiens
cccaggccaca

SEQ ID NO: 5869670 - DNA, 12 bp, Homo sapiens
cccaggccacag

SEQ ID NO: 5869671 - DNA, 13 bp, Homo sapiens
cccaggccacaga

SEQ ID NO: 5869672 - DNA, 16 bp, Homo sapiens
cccaggccacagccag

SEQ ID NO: 5869673 - DNA, 18 bp, Homo sapiens
cccaggccacccccatgg

SEQ ID NO: 5869674 - DNA, 18 bp, Homo sapiens
cccaggccagagtgcagt

SEQ ID NO: 5869675 - DNA, 12 bp, Homo sapiens
cccaggccagct

SEQ ID NO: 5869676 - DNA, 15 bp, Homo sapiens
cccaggccagctgcg

SEQ ID NO: 5869677 - DNA, 24 bp, Homo sapiens
cccaggccagctgcggccaggcct

SEQ ID NO: 5869678 - DNA, 17 bp, Homo sapiens
cccaggccaggactctg

SEQ ID NO: 5869679 - DNA, 21 bp, Homo sapiens
cccaggccaggactctgcagc

SEQ ID NO: 5869680 - DNA, 22 bp, Homo sapiens
cccaggccaggactctgcagcc

SEQ ID NO: 5869681 - DNA, 20 bp, Homo sapiens
cccaggccaggccaccagga

SEQ ID NO: 5869682 - DNA, 22 bp, Homo sapiens
cccaggccaggccaccaggatg

SEQ ID NO: 5869683 - DNA, 13 bp, Homo sapiens
cccaggccaggct

SEQ ID NO: 5869684 - DNA, 18 bp, Homo sapiens
cccaggccaggctccttc

SEQ ID NO: 5869685 - DNA, 19 bp, Homo sapiens
cccaggccaggctccttcc

SEQ ID NO: 5869686 - DNA, 15 bp, Homo sapiens
cccaggccagggctg

SEQ ID NO: 5869687 - DNA, 16 bp, Homo sapiens
cccaggccagggctgg

SEQ ID NO: 5869688 - DNA, 17 bp, Homo sapiens
cccaggccagggctggg

SEQ ID NO: 5869689 - DNA, 19 bp, Homo sapiens
cccaggccagggctgggtc

SEQ ID NO: 5869690 - DNA, 12 bp, Homo sapiens
cccaggccaggt

SEQ ID NO: 5869691 - DNA, 23 bp, Homo sapiens
cccaggccaggtccctggaccag

SEQ ID NO: 5869692 - DNA, 24 bp, Homo sapiens
cccaggccaggtccctggaccagc

SEQ ID NO: 5869693 - DNA, 20 bp, Homo sapiens
cccaggccaggtgaggtcca

SEQ ID NO: 5869694 - DNA, 14 bp, Homo sapiens
cccaggccaggtgc

SEQ ID NO: 5869695 - DNA, 13 bp, Homo sapiens
cccaggccatgtg

SEQ ID NO: 5869696 - DNA, 16 bp, Homo sapiens
cccaggcccactcagg

SEQ ID NO: 5869697 - DNA, 18 bp, Homo sapiens
cccaggcccactgtgcct

SEQ ID NO: 5869698 - DNA, 22 bp, Homo sapiens
cccaggcccactgtgcctcaga

SEQ ID NO: 5869699 - DNA, 14 bp, Homo sapiens
cccaggcccagccc

SEQ ID NO: 5869700 - DNA, 16 bp, Homo sapiens
cccaggcccagccctc

SEQ ID NO: 5869701 - DNA, 13 bp, Homo sapiens
cccaggccccagg

SEQ ID NO: 5869702 - DNA, 16 bp, Homo sapiens
cccaggcccccggctt

SEQ ID NO: 5869703 - DNA, 16 bp, Homo sapiens
cccaggccccctgcat

SEQ ID NO: 5869704 - DNA, 22 bp, Homo sapiens
cccaggccccgaggacccagac

SEQ ID NO: 5869705 - DNA, 11 bp, Homo sapiens
cccaggcccct

SEQ ID NO: 5869706 - DNA, 22 bp, Homo sapiens
cccaggcccctgccaccctggg

SEQ ID NO: 5869707 - DNA, 17 bp, Homo sapiens
cccaggcccgagcgcct

SEQ ID NO: 5869708 - DNA, 12 bp, Homo sapiens
cccaggcccgcc

SEQ ID NO: 5869709 - DNA, 16 bp, Homo sapiens
cccaggcccgccctgc

SEQ ID NO: 5869710 - DNA, 17 bp, Homo sapiens
cccaggcccgccctgcc

SEQ ID NO: 5869711 - DNA, 22 bp, Homo sapiens
cccaggcccgcgggcacagcca

SEQ ID NO: 5869712 - DNA, 13 bp, Homo sapiens
cccaggccctcca

SEQ ID NO: 5869713 - DNA, 15 bp, Homo sapiens
cccaggccctccatg

SEQ ID NO: 5869714 - DNA, 13 bp, Homo sapiens
cccaggccctgcc

SEQ ID NO: 5869715 - DNA, 13 bp, Homo sapiens
cccaggccctttg

SEQ ID NO: 5869716 - DNA, 15 bp, Homo sapiens
cccaggccctttggc

SEQ ID NO: 5869717 - DNA, 16 bp, Homo sapiens
cccaggccctttggct

SEQ ID NO: 5869718 - DNA, 15 bp, Homo sapiens
cccaggccgaggaag

SEQ ID NO: 5869719 - DNA, 19 bp, Homo sapiens
cccaggccgcatggcccct

SEQ ID NO: 5869720 - DNA, 22 bp, Homo sapiens
cccaggccgcatggcccctcca

SEQ ID NO: 5869721 - DNA, 13 bp, Homo sapiens
cccaggccgcctg

SEQ ID NO: 5869722 - DNA, 13 bp, Homo sapiens
cccaggccggagc

SEQ ID NO: 5869723 - DNA, 15 bp, Homo sapiens
cccaggccggagccc

SEQ ID NO: 5869724 - DNA, 17 bp, Homo sapiens
cccaggccggcccagat

SEQ ID NO: 5869725 - DNA, 20 bp, Homo sapiens
cccaggccggcccagatgtg

SEQ ID NO: 5869726 - DNA, 14 bp, Homo sapiens
cccaggccgggaag

SEQ ID NO: 5869727 - DNA, 19 bp, Homo sapiens
cccaggccgggaagagcca

SEQ ID NO: 5869728 - DNA, 20 bp, Homo sapiens
cccaggccgggaagagccac

SEQ ID NO: 5869729 - DNA, 13 bp, Homo sapiens
cccaggccgttcc

SEQ ID NO: 5869730 - DNA, 14 bp, Homo sapiens
cccaggccgttccc

SEQ ID NO: 5869731 - DNA, 15 bp, Homo sapiens
cccaggcctccagcc

SEQ ID NO: 5869732 - DNA, 22 bp, Homo sapiens
cccaggcctccagcctctcccg

SEQ ID NO: 5869733 - DNA, 16 bp, Homo sapiens
cccaggcctccagctc

SEQ ID NO: 5869734 - DNA, 20 bp, Homo sapiens
cccaggcctccagctcagca

SEQ ID NO: 5869735 - DNA, 12 bp, Homo sapiens
cccaggcctccc

SEQ ID NO: 5869736 - DNA, 19 bp, Homo sapiens
cccaggcctccccagcacc

SEQ ID NO: 5869737 - DNA, 16 bp, Homo sapiens
cccaggcctccctgca

SEQ ID NO: 5869738 - DNA, 13 bp, Homo sapiens
cccaggcctccta

SEQ ID NO: 5869739 - DNA, 14 bp, Homo sapiens
cccaggcctctgcc

SEQ ID NO: 5869740 - DNA, 17 bp, Homo sapiens
cccaggcctctgcccca

SEQ ID NO: 5869741 - DNA, 23 bp, Homo sapiens
cccaggcctgattcactggcctg

SEQ ID NO: 5869742 - DNA, 17 bp, Homo sapiens
cccaggcctgccctgct

SEQ ID NO: 5869743 - DNA, 13 bp, Homo sapiens
cccaggcctgcct

SEQ ID NO: 5869744 - DNA, 15 bp, Homo sapiens
cccaggcctgcctgt

SEQ ID NO: 5869745 - DNA, 16 bp, Homo sapiens
cccaggcctgcctgtt

SEQ ID NO: 5869746 - DNA, 13 bp, Homo sapiens
cccaggcctggag

SEQ ID NO: 5869747 - DNA, 21 bp, Homo sapiens
cccaggcctgggatgcagtga

SEQ ID NO: 5869748 - DNA, 14 bp, Homo sapiens
cccaggcctgggtt

SEQ ID NO: 5869749 - DNA, 13 bp, Homo sapiens
cccaggcctggtg

SEQ ID NO: 5869750 - DNA, 15 bp, Homo sapiens
cccaggcctggtgga

SEQ ID NO: 5869751 - DNA, 16 bp, Homo sapiens
cccaggcctgtccacc

SEQ ID NO: 5869752 - DNA, 21 bp, Homo sapiens
cccaggcctgtccaccctgcc

SEQ ID NO: 5869753 - DNA, 13 bp, Homo sapiens
cccaggcgctgca

SEQ ID NO: 5869754 - DNA, 14 bp, Homo sapiens
cccaggcgctgcat

SEQ ID NO: 5869755 - DNA, 22 bp, Homo sapiens
cccaggcgctgcatacagggga

SEQ ID NO: 5869756 - DNA, 15 bp, Homo sapiens
cccaggcggaggggc

SEQ ID NO: 5869757 - DNA, 19 bp, Homo sapiens
cccaggctagagtgcaatg

SEQ ID NO: 5869758 - DNA, 19 bp, Homo sapiens
cccaggctagagtgcagtg

SEQ ID NO: 5869759 - DNA, 19 bp, Homo sapiens
cccaggctcaggctgccca

SEQ ID NO: 5869760 - DNA, 20 bp, Homo sapiens
cccaggctcaggctgcccag

SEQ ID NO: 5869761 - DNA, 10 bp, Homo sapiens
cccaggctcc

SEQ ID NO: 5869762 - DNA, 15 bp, Homo sapiens
cccaggctccatggg

SEQ ID NO: 5869763 - DNA, 19 bp, Homo sapiens
cccaggctcccctggtctc

SEQ ID NO: 5869764 - DNA, 24 bp, Homo sapiens
cccaggctcccctggtctcctccc

SEQ ID NO: 5869765 - DNA, 17 bp, Homo sapiens
cccaggctcggcctgcc

SEQ ID NO: 5869766 - DNA, 22 bp, Homo sapiens
cccaggctcgtggactgagtgg

SEQ ID NO: 5869767 - DNA, 15 bp, Homo sapiens
cccaggctctgctga

SEQ ID NO: 5869768 - DNA, 20 bp, Homo sapiens
cccaggctctggagccagag

SEQ ID NO: 5869769 - DNA, 15 bp, Homo sapiens
cccaggctctgggaa

SEQ ID NO: 5869770 - DNA, 14 bp, Homo sapiens
cccaggctgagcct

SEQ ID NO: 5869771 - DNA, 17 bp, Homo sapiens
cccaggctgagcctcag

SEQ ID NO: 5869772 - DNA, 18 bp, Homo sapiens
cccaggctgccggctccc

SEQ ID NO: 5869773 - DNA, 16 bp, Homo sapiens
cccaggctgcgcctgc

SEQ ID NO: 5869774 - DNA, 18 bp, Homo sapiens
cccaggctgcgcctgccc

SEQ ID NO: 5869775 - DNA, 19 bp, Homo sapiens
cccaggctgcgcctgcccg

SEQ ID NO: 5869776 - DNA, 20 bp, Homo sapiens
cccaggctgcgcctgcccgc

SEQ ID NO: 5869777 - DNA, 22 bp, Homo sapiens
cccaggctgctggagtgcagtg

SEQ ID NO: 5869778 - DNA, 11 bp, Homo sapiens
cccaggctgga

SEQ ID NO: 5869779 - DNA, 17 bp, Homo sapiens
cccaggctggactgcag

SEQ ID NO: 5869780 - DNA, 16 bp, Homo sapiens
cccaggctggagaccc

SEQ ID NO: 5869781 - DNA, 13 bp, Homo sapiens
cccaggctggagt

SEQ ID NO: 5869782 - DNA, 17 bp, Homo sapiens
cccaggctggagtgcaa

SEQ ID NO: 5869783 - DNA, 19 bp, Homo sapiens
cccaggctggagtgcaatg

SEQ ID NO: 5869784 - DNA, 19 bp, Homo sapiens
cccaggctggagtgcagtg

SEQ ID NO: 5869785 - DNA, 19 bp, Homo sapiens
cccaggctggagtgtagtg

SEQ ID NO: 5869786 - DNA, 13 bp, Homo sapiens
cccaggctggcca

SEQ ID NO: 5869787 - DNA, 16 bp, Homo sapiens
cccaggctggccagcc

SEQ ID NO: 5869788 - DNA, 20 bp, Homo sapiens
cccaggctggccagccccac

SEQ ID NO: 5869789 - DNA, 22 bp, Homo sapiens
cccaggctggccagccccacag

SEQ ID NO: 5869790 - DNA, 18 bp, Homo sapiens
cccaggctggcgtgcagt

SEQ ID NO: 5869791 - DNA, 12 bp, Homo sapiens
cccaggctggga

SEQ ID NO: 5869792 - DNA, 19 bp, Homo sapiens
cccaggctgggcaaggagg

SEQ ID NO: 5869793 - DNA, 13 bp, Homo sapiens
cccaggctggtat

SEQ ID NO: 5869794 - DNA, 16 bp, Homo sapiens
cccaggctggtcttga

SEQ ID NO: 5869795 - DNA, 23 bp, Homo sapiens
cccaggctggtcttgaagtcctg

SEQ ID NO: 5869796 - DNA, 14 bp, Homo sapiens
cccaggcttcctgg

SEQ ID NO: 5869797 - DNA, 19 bp, Homo sapiens
cccaggcttgtcactagca

SEQ ID NO: 5869798 - DNA, 16 bp, Homo sapiens
cccaggcttttgctag

SEQ ID NO: 5869799 - DNA, 15 bp, Homo sapiens
cccagggaagcagca

SEQ ID NO: 5869800 - DNA, 20 bp, Homo sapiens
cccagggaagcagcagcctc

SEQ ID NO: 5869801 - DNA, 15 bp, Homo sapiens
cccagggaagttttg

SEQ ID NO: 5869802 - DNA, 22 bp, Homo sapiens
cccagggaatcagggagcactg

SEQ ID NO: 5869803 - DNA, 14 bp, Homo sapiens
cccagggacaccag

SEQ ID NO: 5869804 - DNA, 21 bp, Homo sapiens
cccagggacaccagccaggct

SEQ ID NO: 5869805 - DNA, 19 bp, Homo sapiens
cccagggacacctgggaga

SEQ ID NO: 5869806 - DNA, 14 bp, Homo sapiens
cccagggacagagg

SEQ ID NO: 5869807 - DNA, 15 bp, Homo sapiens
cccagggacagaggc

SEQ ID NO: 5869808 - DNA, 23 bp, Homo sapiens
cccagggacagaggccaaggact

SEQ ID NO: 5869809 - DNA, 13 bp, Homo sapiens
cccagggaccagc

SEQ ID NO: 5869810 - DNA, 17 bp, Homo sapiens
cccagggaccgaaaagt

SEQ ID NO: 5869811 - DNA, 23 bp, Homo sapiens
cccagggacgtgataatgcagat

SEQ ID NO: 5869812 - DNA, 21 bp, Homo sapiens
cccagggagaatctgagacat

SEQ ID NO: 5869813 - DNA, 19 bp, Homo sapiens
cccagggagacgggatgga

SEQ ID NO: 5869814 - DNA, 14 bp, Homo sapiens
cccagggagaggcc

SEQ ID NO: 5869815 - DNA, 18 bp, Homo sapiens
cccagggagaggccatga

SEQ ID NO: 5869816 - DNA, 20 bp, Homo sapiens
cccagggagaggctgtgtcc

SEQ ID NO: 5869817 - DNA, 21 bp, Homo sapiens
cccagggagcaatgggagggg

SEQ ID NO: 5869818 - DNA, 19 bp, Homo sapiens
cccagggaggcagcgtggg

SEQ ID NO: 5869819 - DNA, 16 bp, Homo sapiens
cccagggagggaagtg

SEQ ID NO: 5869820 - DNA, 16 bp, Homo sapiens
cccagggagggggtca

SEQ ID NO: 5869821 - DNA, 14 bp, Homo sapiens
cccagggagtccag

SEQ ID NO: 5869822 - DNA, 15 bp, Homo sapiens
cccagggagtccagg

SEQ ID NO: 5869823 - DNA, 17 bp, Homo sapiens
cccagggagtgagcagc

SEQ ID NO: 5869824 - DNA, 19 bp, Homo sapiens
cccagggagtgagcagcta

SEQ ID NO: 5869825 - DNA, 21 bp, Homo sapiens
cccagggatttgtccttgggg

SEQ ID NO: 5869826 - DNA, 20 bp, Homo sapiens
cccagggcaagctccgcagg

SEQ ID NO: 5869827 - DNA, 15 bp, Homo sapiens
cccagggcacaggag

SEQ ID NO: 5869828 - DNA, 18 bp, Homo sapiens
cccagggcacaggagcta

SEQ ID NO: 5869829 - DNA, 22 bp, Homo sapiens
cccagggcacaggagctacctg

SEQ ID NO: 5869830 - DNA, 12 bp, Homo sapiens
cccagggcaccc

SEQ ID NO: 5869831 - DNA, 18 bp, Homo sapiens
cccagggcactgccagcc

SEQ ID NO: 5869832 - DNA, 20 bp, Homo sapiens
cccagggcacttcacagagt

SEQ ID NO: 5869833 - DNA, 22 bp, Homo sapiens
cccagggcacttcacagagtgt

SEQ ID NO: 5869834 - DNA, 19 bp, Homo sapiens
cccagggcacttcagagta

SEQ ID NO: 5869835 - DNA, 13 bp, Homo sapiens
cccagggcagcct

SEQ ID NO: 5869836 - DNA, 15 bp, Homo sapiens
cccagggcagcctcg

SEQ ID NO: 5869837 - DNA, 12 bp, Homo sapiens
cccagggcagcg

SEQ ID NO: 5869838 - DNA, 13 bp, Homo sapiens
cccagggcagtgt

SEQ ID NO: 5869839 - DNA, 17 bp, Homo sapiens
cccagggcatctgggag

SEQ ID NO: 5869840 - DNA, 23 bp, Homo sapiens
cccagggccactctgcctctgcc

SEQ ID NO: 5869841 - DNA, 16 bp, Homo sapiens
cccagggccagcccac

SEQ ID NO: 5869842 - DNA, 17 bp, Homo sapiens
cccagggcccagagccc

SEQ ID NO: 5869843 - DNA, 19 bp, Homo sapiens
cccagggcccagagcccag

SEQ ID NO: 5869844 - DNA, 20 bp, Homo sapiens
cccagggcccagagcccagc

SEQ ID NO: 5869845 - DNA, 22 bp, Homo sapiens
cccagggcccagagcccagctc

SEQ ID NO: 5869846 - DNA, 17 bp, Homo sapiens
cccagggcccccacagg

SEQ ID NO: 5869847 - DNA, 13 bp, Homo sapiens
cccagggcccctc

SEQ ID NO: 5869848 - DNA, 17 bp, Homo sapiens
cccagggcccctccctc

SEQ ID NO: 5869849 - DNA, 20 bp, Homo sapiens
cccagggcccctccctctgc

SEQ ID NO: 5869850 - DNA, 21 bp, Homo sapiens
cccagggcccctccctctgcc

SEQ ID NO: 5869851 - DNA, 13 bp, Homo sapiens
cccagggcccgag

SEQ ID NO: 5869852 - DNA, 22 bp, Homo sapiens
cccagggcccgggcacccacaa

SEQ ID NO: 5869853 - DNA, 20 bp, Homo sapiens
cccagggccctcccagccca

SEQ ID NO: 5869854 - DNA, 16 bp, Homo sapiens
cccagggccctgctca

SEQ ID NO: 5869855 - DNA, 16 bp, Homo sapiens
cccagggccctggcca

SEQ ID NO: 5869856 - DNA, 17 bp, Homo sapiens
cccagggccctggccag

SEQ ID NO: 5869857 - DNA, 14 bp, Homo sapiens
cccagggcctccag

SEQ ID NO: 5869858 - DNA, 16 bp, Homo sapiens
cccagggcctccaggg

SEQ ID NO: 5869859 - DNA, 13 bp, Homo sapiens
cccagggcctctg

SEQ ID NO: 5869860 - DNA, 20 bp, Homo sapiens
cccagggcctctggcttccc

SEQ ID NO: 5869861 - DNA, 24 bp, Homo sapiens
cccagggcctgacttgagccactc

SEQ ID NO: 5869862 - DNA, 15 bp, Homo sapiens
cccagggcctgagcc

SEQ ID NO: 5869863 - DNA, 13 bp, Homo sapiens
cccagggcctggg

SEQ ID NO: 5869864 - DNA, 23 bp, Homo sapiens
cccagggcctgggggcagtgact

SEQ ID NO: 5869865 - DNA, 22 bp, Homo sapiens
cccagggctacacagaccctgc

SEQ ID NO: 5869866 - DNA, 17 bp, Homo sapiens
cccagggctcagcctgg

SEQ ID NO: 5869867 - DNA, 13 bp, Homo sapiens
cccagggctccct

SEQ ID NO: 5869868 - DNA, 15 bp, Homo sapiens
cccagggctccctta

SEQ ID NO: 5869869 - DNA, 14 bp, Homo sapiens
cccagggctcctgc

SEQ ID NO: 5869870 - DNA, 14 bp, Homo sapiens
cccagggctctctg

SEQ ID NO: 5869871 - DNA, 17 bp, Homo sapiens
cccagggctctgcagca

SEQ ID NO: 5869872 - DNA, 16 bp, Homo sapiens
cccagggctctgcccc

SEQ ID NO: 5869873 - DNA, 18 bp, Homo sapiens
cccagggctctgccccag

SEQ ID NO: 5869874 - DNA, 13 bp, Homo sapiens
cccagggctctgt

SEQ ID NO: 5869875 - DNA, 10 bp, Homo sapiens
cccagggctg

SEQ ID NO: 5869876 - DNA, 23 bp, Homo sapiens
cccagggctgcaaaactggaagc

SEQ ID NO: 5869877 - DNA, 13 bp, Homo sapiens
cccagggctggcc

SEQ ID NO: 5869878 - DNA, 18 bp, Homo sapiens
cccagggctggccctagg

SEQ ID NO: 5869879 - DNA, 20 bp, Homo sapiens
cccagggctggccctaggca

SEQ ID NO: 5869880 - DNA, 23 bp, Homo sapiens
cccagggctggccctaggcactg

SEQ ID NO: 5869881 - DNA, 14 bp, Homo sapiens
cccagggctggctc

SEQ ID NO: 5869882 - DNA, 21 bp, Homo sapiens
cccagggctggctctgcacta

SEQ ID NO: 5869883 - DNA, 17 bp, Homo sapiens
cccagggctgggaggaa

SEQ ID NO: 5869884 - DNA, 21 bp, Homo sapiens
cccagggctgtaactgccagg

SEQ ID NO: 5869885 - DNA, 20 bp, Homo sapiens
cccaggggaactggcagcgc

SEQ ID NO: 5869886 - DNA, 19 bp, Homo sapiens
cccaggggaaggccctgag

SEQ ID NO: 5869887 - DNA, 21 bp, Homo sapiens
cccaggggaaggccctgaggc

SEQ ID NO: 5869888 - DNA, 16 bp, Homo sapiens
cccaggggacaaggga

SEQ ID NO: 5869889 - DNA, 19 bp, Homo sapiens
cccatagaaacatgacact

SEQ ID NO: 5869890 - DNA, 23 bp, Homo sapiens
cccatagaaacatgacactgacc

SEQ ID NO: 5869891 - DNA, 17 bp, Homo sapiens
cccatagagaccaggag

SEQ ID NO: 5869892 - DNA, 21 bp, Homo sapiens
cccatagataggcccctgggg

SEQ ID NO: 5869893 - DNA, 13 bp, Homo sapiens
cccatagccttgg

SEQ ID NO: 5869894 - DNA, 17 bp, Homo sapiens
cccataggccaccccct

SEQ ID NO: 5869895 - DNA, 13 bp, Homo sapiens
cccatagggagct

SEQ ID NO: 5869896 - DNA, 23 bp, Homo sapiens
cccatagggtcggaggtgctgtc

SEQ ID NO: 5869897 - DNA, 19 bp, Homo sapiens
cccatagtgaccggctgct

SEQ ID NO: 5869898 - DNA, 22 bp, Homo sapiens
cccatagtgccttgattttaat

SEQ ID NO: 5869899 - DNA, 13 bp, Homo sapiens
cccatagtgctgg

SEQ ID NO: 5869900 - DNA, 23 bp, Homo sapiens
cccatagtgctgggattcaattt

SEQ ID NO: 5869901 - DNA, 21 bp, Homo sapiens
cccatagtggggcctgggagg

SEQ ID NO: 5869902 - DNA, 11 bp, Homo sapiens
cccatataaaa

SEQ ID NO: 5869903 - DNA, 18 bp, Homo sapiens
cccatatataaattatta

SEQ ID NO: 5869904 - DNA, 24 bp, Homo sapiens
cccatatctgtgtgccctagggct

SEQ ID NO: 5869905 - DNA, 13 bp, Homo sapiens
cccatatttcatc

SEQ ID NO: 5869906 - DNA, 19 bp, Homo sapiens
cccatattttacttggaaa

SEQ ID NO: 5869907 - DNA, 16 bp, Homo sapiens
cccatcaagtgcagtc

SEQ ID NO: 5869908 - DNA, 22 bp, Homo sapiens
cccatcacagggttgggcccag

SEQ ID NO: 5869909 - DNA, 18 bp, Homo sapiens
cccatcacccaagccaca

SEQ ID NO: 5869910 - DNA, 17 bp, Homo sapiens
cccatcaccggaggagc

SEQ ID NO: 5869911 - DNA, 23 bp, Homo sapiens
cccatcacctactcacacaggca

SEQ ID NO: 5869912 - DNA, 23 bp, Homo sapiens
cccatcacctctaatagaggcag

SEQ ID NO: 5869913 - DNA, 21 bp, Homo sapiens
cccatcacctctactgtctcc

SEQ ID NO: 5869914 - DNA, 20 bp, Homo sapiens
cccatcacgtgtactggctc

SEQ ID NO: 5869915 - DNA, 18 bp, Homo sapiens
cccatcactcgcaggacc

SEQ ID NO: 5869916 - DNA, 19 bp, Homo sapiens
cccatcactcgcaggacca

SEQ ID NO: 5869917 - DNA, 21 bp, Homo sapiens
cccatcactgcgccactgctc

SEQ ID NO: 5869918 - DNA, 15 bp, Homo sapiens
cccatcactggagca

SEQ ID NO: 5869919 - DNA, 13 bp, Homo sapiens
cccatcactgtgt

SEQ ID NO: 5869920 - DNA, 14 bp, Homo sapiens
cccatcagaaggag

SEQ ID NO: 5869921 - DNA, 14 bp, Homo sapiens
cccatcagcaccat

SEQ ID NO: 5869922 - DNA, 12 bp, Homo sapiens
cccatcagcact

SEQ ID NO: 5869923 - DNA, 15 bp, Homo sapiens
cccatcagcactctg

SEQ ID NO: 5869924 - DNA, 13 bp, Homo sapiens
cccatcagctccc

SEQ ID NO: 5869925 - DNA, 17 bp, Homo sapiens
cccatcagctcccaacg

SEQ ID NO: 5869926 - DNA, 14 bp, Homo sapiens
cccatcagctgcca

SEQ ID NO: 5869927 - DNA, 16 bp, Homo sapiens
cccatcaggggcagga

SEQ ID NO: 5869928 - DNA, 14 bp, Homo sapiens
cccatcagggtagg

SEQ ID NO: 5869929 - DNA, 21 bp, Homo sapiens
cccatcagtgccagcccctgc

SEQ ID NO: 5869930 - DNA, 23 bp, Homo sapiens
cccatcagtgctccctcacatgt

SEQ ID NO: 5869931 - DNA, 21 bp, Homo sapiens
cccatcagtgtacccccgccc

SEQ ID NO: 5869932 - DNA, 17 bp, Homo sapiens
cccatcagttccagcct

SEQ ID NO: 5869933 - DNA, 17 bp, Homo sapiens
cccatcatacacttcct

SEQ ID NO: 5869934 - DNA, 14 bp, Homo sapiens
cccatcatcccagc

SEQ ID NO: 5869935 - DNA, 19 bp, Homo sapiens
cccatcatcctctggcttg

SEQ ID NO: 5869936 - DNA, 16 bp, Homo sapiens
cccatcatctctgcct

SEQ ID NO: 5869937 - DNA, 22 bp, Homo sapiens
cccatcatgcccggtcccaccc

SEQ ID NO: 5869938 - DNA, 14 bp, Homo sapiens
cccatcatgtggcc

SEQ ID NO: 5869939 - DNA, 21 bp, Homo sapiens
cccatccaccgtcccctccca

SEQ ID NO: 5869940 - DNA, 18 bp, Homo sapiens
cccatccagacctggctc

SEQ ID NO: 5869941 - DNA, 14 bp, Homo sapiens
cccatccagcatgt

SEQ ID NO: 5869942 - DNA, 12 bp, Homo sapiens
cccatccagcca

SEQ ID NO: 5869943 - DNA, 16 bp, Homo sapiens
cccatccagccacgga

SEQ ID NO: 5869944 - DNA, 20 bp, Homo sapiens
cccatccagccacggaggga

SEQ ID NO: 5869945 - DNA, 13 bp, Homo sapiens
cccatccagccag

SEQ ID NO: 5869946 - DNA, 12 bp, Homo sapiens
cccatccagcct

SEQ ID NO: 5869947 - DNA, 13 bp, Homo sapiens
cccatccagcctc

SEQ ID NO: 5869948 - DNA, 21 bp, Homo sapiens
cccatccagttcatgagaatc

SEQ ID NO: 5869949 - DNA, 23 bp, Homo sapiens
cccatccatcttccctacccttc

SEQ ID NO: 5869950 - DNA, 14 bp, Homo sapiens
cccatccattaggc

SEQ ID NO: 5869951 - DNA, 15 bp, Homo sapiens
cccatccattaggcc

SEQ ID NO: 5869952 - DNA, 19 bp, Homo sapiens
cccatccattaggccagca

SEQ ID NO: 5869953 - DNA, 15 bp, Homo sapiens
cccatcccacaccct

SEQ ID NO: 5869954 - DNA, 13 bp, Homo sapiens
cccatcccacccc

SEQ ID NO: 5869955 - DNA, 14 bp, Homo sapiens
cccatcccagggtc

SEQ ID NO: 5869956 - DNA, 17 bp, Homo sapiens
cccatcccagtgtccta

SEQ ID NO: 5869957 - DNA, 18 bp, Homo sapiens
cccatcccatcccatccc

SEQ ID NO: 5869958 - DNA, 13 bp, Homo sapiens
cccatccccacca

SEQ ID NO: 5869959 - DNA, 16 bp, Homo sapiens
cccatccccaccagct

SEQ ID NO: 5869960 - DNA, 18 bp, Homo sapiens
cccatccccagcgattcc

SEQ ID NO: 5869961 - DNA, 12 bp, Homo sapiens
cccatccccagg

SEQ ID NO: 5869962 - DNA, 13 bp, Homo sapiens
cccatccccaggt

SEQ ID NO: 5869963 - DNA, 16 bp, Homo sapiens
cccatccccaggtccc

SEQ ID NO: 5869964 - DNA, 19 bp, Homo sapiens
cccatccccatcctccagc

SEQ ID NO: 5869965 - DNA, 20 bp, Homo sapiens
cccatcccccacctgccagc

SEQ ID NO: 5869966 - DNA, 15 bp, Homo sapiens
cccatccccctgccc

SEQ ID NO: 5869967 - DNA, 17 bp, Homo sapiens
cccatccccctgccctc

SEQ ID NO: 5869968 - DNA, 12 bp, Homo sapiens
cccatcccctca

SEQ ID NO: 5869969 - DNA, 15 bp, Homo sapiens
cccatcccctgcctc

SEQ ID NO: 5869970 - DNA, 21 bp, Homo sapiens
cccatcccctggactgggagg

SEQ ID NO: 5869971 - DNA, 15 bp, Homo sapiens
cccatcccgccttct

SEQ ID NO: 5869972 - DNA, 22 bp, Homo sapiens
cccatccctccccttgccacat

SEQ ID NO: 5869973 - DNA, 13 bp, Homo sapiens
cccatccctcggg

SEQ ID NO: 5869974 - DNA, 14 bp, Homo sapiens
cccatccctgcctg

SEQ ID NO: 5869975 - DNA, 12 bp, Homo sapiens
cccatccctgct

SEQ ID NO: 5869976 - DNA, 13 bp, Homo sapiens
cccatccctgtct

SEQ ID NO: 5869977 - DNA, 19 bp, Homo sapiens
cccatcccttcctccccag

SEQ ID NO: 5869978 - DNA, 14 bp, Homo sapiens
cccatcctaccctc

SEQ ID NO: 5869979 - DNA, 17 bp, Homo sapiens
cccatcctaccctcggg

SEQ ID NO: 5869980 - DNA, 18 bp, Homo sapiens
cccatcctaccctcgggc

SEQ ID NO: 5869981 - DNA, 16 bp, Homo sapiens
cccatcctaggaacca

SEQ ID NO: 5869982 - DNA, 22 bp, Homo sapiens
cccatcctatcagcctgtctct

SEQ ID NO: 5869983 - DNA, 16 bp, Homo sapiens
cccatcctcacacaga

SEQ ID NO: 5869984 - DNA, 16 bp, Homo sapiens
cccatcctcacccaga

SEQ ID NO: 5869985 - DNA, 18 bp, Homo sapiens
cccatcctcatccctgac

SEQ ID NO: 5869986 - DNA, 14 bp, Homo sapiens
cccatcctccagca

SEQ ID NO: 5869987 - DNA, 15 bp, Homo sapiens
cccatcctccagcag

SEQ ID NO: 5869988 - DNA, 18 bp, Homo sapiens
cccatcctccagccctgc

SEQ ID NO: 5869989 - DNA, 13 bp, Homo sapiens
cccatcctccagg

SEQ ID NO: 5869990 - DNA, 18 bp, Homo sapiens
cccatcctccccttccct

SEQ ID NO: 5869991 - DNA, 14 bp, Homo sapiens
cccatcctgccaca

SEQ ID NO: 5869992 - DNA, 15 bp, Homo sapiens
cccatcctgccatcc

SEQ ID NO: 5869993 - DNA, 15 bp, Homo sapiens
cccatcctgctcagc

SEQ ID NO: 5869994 - DNA, 14 bp, Homo sapiens
cccatcctggccca

SEQ ID NO: 5869995 - DNA, 15 bp, Homo sapiens
cccatcctggcccat

SEQ ID NO: 5869996 - DNA, 18 bp, Homo sapiens
cccatcctggcccatcag

SEQ ID NO: 5869997 - DNA, 13 bp, Homo sapiens
cccatcctgggcc

SEQ ID NO: 5869998 - DNA, 14 bp, Homo sapiens
cccatcctggggca

SEQ ID NO: 5869999 - DNA, 22 bp, Homo sapiens
cccatcctgtgtgttaagctct

SEQ ID NO: 5870000 - DNA, 16 bp, Homo sapiens
cccatccttccctcat

SEQ ID NO: 5870001 - DNA, 19 bp, Homo sapiens
cccatcgctggaaaacagc

SEQ ID NO: 5870002 - DNA, 19 bp, Homo sapiens
cccatcggtgtccatttat

SEQ ID NO: 5870003 - DNA, 19 bp, Homo sapiens
cccatcgtctcggccttca

SEQ ID NO: 5870004 - DNA, 18 bp, Homo sapiens
cccatcgtgaagaagcct

SEQ ID NO: 5870005 - DNA, 22 bp, Homo sapiens
cccatcgttgcccccatttctg

SEQ ID NO: 5870006 - DNA, 22 bp, Homo sapiens
cccatctaagcattccacactg

SEQ ID NO: 5870007 - DNA, 21 bp, Homo sapiens
cccatctaagctgcagcttcc

SEQ ID NO: 5870008 - DNA, 22 bp, Homo sapiens
cccatctaagctgcagcttcct

SEQ ID NO: 5870009 - DNA, 16 bp, Homo sapiens
cccatctattctctgc

SEQ ID NO: 5870010 - DNA, 18 bp, Homo sapiens
cccatctattctctgcct

SEQ ID NO: 5870011 - DNA, 13 bp, Homo sapiens
cccatctcacaca

SEQ ID NO: 5870012 - DNA, 18 bp, Homo sapiens
cccatctcacacatgagc

SEQ ID NO: 5870013 - DNA, 13 bp, Homo sapiens
cccatctcactct

SEQ ID NO: 5870014 - DNA, 12 bp, Homo sapiens
cccatctcactt

SEQ ID NO: 5870015 - DNA, 15 bp, Homo sapiens
cccatctcagcctcc

SEQ ID NO: 5870016 - DNA, 16 bp, Homo sapiens
cccatctcagcctcct

SEQ ID NO: 5870017 - DNA, 17 bp, Homo sapiens
cccatctcagcctcctg

SEQ ID NO: 5870018 - DNA, 23 bp, Homo sapiens
cccatctcaggccagagccaagg

SEQ ID NO: 5870019 - DNA, 16 bp, Homo sapiens
cccatctcaggtgcca

SEQ ID NO: 5870020 - DNA, 21 bp, Homo sapiens
cccatctcatgcccctggctg

SEQ ID NO: 5870021 - DNA, 12 bp, Homo sapiens
cccatctccccc

SEQ ID NO: 5870022 - DNA, 13 bp, Homo sapiens
cccatctccctgc

SEQ ID NO: 5870023 - DNA, 15 bp, Homo sapiens
cccatctccctgcct

SEQ ID NO: 5870024 - DNA, 20 bp, Homo sapiens
cccatctccctgcctggccc

SEQ ID NO: 5870025 - DNA, 12 bp, Homo sapiens
cccatctcctga

SEQ ID NO: 5870026 - DNA, 13 bp, Homo sapiens
cccatctccttcc

SEQ ID NO: 5870027 - DNA, 20 bp, Homo sapiens
cccatctcgctccctcccag

SEQ ID NO: 5870028 - DNA, 22 bp, Homo sapiens
cccatctcgctccctcccagga

SEQ ID NO: 5870029 - DNA, 18 bp, Homo sapiens
cccatctctccagagagc

SEQ ID NO: 5870030 - DNA, 19 bp, Homo sapiens
cccatctctccagagagca

SEQ ID NO: 5870031 - DNA, 18 bp, Homo sapiens
cccatctctccctcccct

SEQ ID NO: 5870032 - DNA, 21 bp, Homo sapiens
cccatctctccctcccctgcc

SEQ ID NO: 5870033 - DNA, 24 bp, Homo sapiens
cccatctctctactgctggactgt

SEQ ID NO: 5870034 - DNA, 16 bp, Homo sapiens
cccatctctgagtgga

SEQ ID NO: 5870035 - DNA, 15 bp, Homo sapiens
cccatctctgctgct

SEQ ID NO: 5870036 - DNA, 14 bp, Homo sapiens
cccatctcttctgg

SEQ ID NO: 5870037 - DNA, 15 bp, Homo sapiens
cccatctgagctggg

SEQ ID NO: 5870038 - DNA, 19 bp, Homo sapiens
cccatctgcaccccttctc

SEQ ID NO: 5870039 - DNA, 12 bp, Homo sapiens
cccatctgccca

SEQ ID NO: 5870040 - DNA, 13 bp, Homo sapiens
cccatctgcccag

SEQ ID NO: 5870041 - DNA, 13 bp, Homo sapiens
cccatctgccctc

SEQ ID NO: 5870042 - DNA, 22 bp, Homo sapiens
cccatctgcgggggcagtgctc

SEQ ID NO: 5870043 - DNA, 14 bp, Homo sapiens
cccatctgctcctc

SEQ ID NO: 5870044 - DNA, 18 bp, Homo sapiens
cccatctgctcctcccat

SEQ ID NO: 5870045 - DNA, 15 bp, Homo sapiens
cccatctggatgtaa

SEQ ID NO: 5870046 - DNA, 20 bp, Homo sapiens
cccatctggctttttctgcc

SEQ ID NO: 5870047 - DNA, 22 bp, Homo sapiens
cccatctgggtccttgcacccc

SEQ ID NO: 5870048 - DNA, 13 bp, Homo sapiens
cccatctgtgaat

SEQ ID NO: 5870049 - DNA, 17 bp, Homo sapiens
cccatcttccacctgtg

SEQ ID NO: 5870050 - DNA, 17 bp, Homo sapiens
cccatcttcctgctgct

SEQ ID NO: 5870051 - DNA, 20 bp, Homo sapiens
cccatcttcctgctgctgta

SEQ ID NO: 5870052 - DNA, 21 bp, Homo sapiens
cccatcttgatctttgagccc

SEQ ID NO: 5870053 - DNA, 22 bp, Homo sapiens
cccatcttgatctttgagccca

SEQ ID NO: 5870054 - DNA, 15 bp, Homo sapiens
cccatcttgcttcca

SEQ ID NO: 5870055 - DNA, 22 bp, Homo sapiens
cccatctttgatccttctgagc

SEQ ID NO: 5870056 - DNA, 16 bp, Homo sapiens
cccatgaaattgaccc

SEQ ID NO: 5870057 - DNA, 20 bp, Homo sapiens
cccatgaacacactgtgtcc

SEQ ID NO: 5870058 - DNA, 15 bp, Homo sapiens
cccatgaaccctgcc

SEQ ID NO: 5870059 - DNA, 11 bp, Homo sapiens
cccatgaagcc

SEQ ID NO: 5870060 - DNA, 19 bp, Homo sapiens
cccatgaagctggccctca

SEQ ID NO: 5870061 - DNA, 22 bp, Homo sapiens
cccatgaagctggccctcagct

SEQ ID NO: 5870062 - DNA, 13 bp, Homo sapiens
cccatgacaatca

SEQ ID NO: 5870063 - DNA, 23 bp, Homo sapiens
cccatgacaatgttgtagtgtcc

SEQ ID NO: 5870064 - DNA, 20 bp, Homo sapiens
cccatgacccacccctgtgc

SEQ ID NO: 5870065 - DNA, 21 bp, Homo sapiens
cccatgacccacccctgtgct

SEQ ID NO: 5870066 - DNA, 18 bp, Homo sapiens
cccatgagacagtcccag

SEQ ID NO: 5870067 - DNA, 17 bp, Homo sapiens
cccatgagactgccctg

SEQ ID NO: 5870068 - DNA, 16 bp, Homo sapiens
ccccaataaagccttt

SEQ ID NO: 5870069 - DNA, 17 bp, Homo sapiens
ccccaataaaggcagct

SEQ ID NO: 5870070 - DNA, 24 bp, Homo sapiens
ccccaataaaggcagctgcctctg

SEQ ID NO: 5870071 - DNA, 15 bp, Homo sapiens
ccccaataattgcag

SEQ ID NO: 5870072 - DNA, 22 bp, Homo sapiens
ccccaatatcctcgctcccggg

SEQ ID NO: 5870073 - DNA, 19 bp, Homo sapiens
ccccaatatggtggccctg

SEQ ID NO: 5870074 - DNA, 23 bp, Homo sapiens
ccccaatatggtggccctgggga

SEQ ID NO: 5870075 - DNA, 20 bp, Homo sapiens
ccccaatccagagaagcgct

SEQ ID NO: 5870076 - DNA, 22 bp, Homo sapiens
ccccaatccatttggcagaact

SEQ ID NO: 5870077 - DNA, 13 bp, Homo sapiens
ccccaatccctca

SEQ ID NO: 5870078 - DNA, 20 bp, Homo sapiens
ccccaatccctgccactggg

SEQ ID NO: 5870079 - DNA, 21 bp, Homo sapiens
ccccaatccctgccactgggc

SEQ ID NO: 5870080 - DNA, 14 bp, Homo sapiens
ccccaatcctccca

SEQ ID NO: 5870081 - DNA, 19 bp, Homo sapiens
ccccaatcggactgccaaa

SEQ ID NO: 5870082 - DNA, 19 bp, Homo sapiens
ccccaatcgggtccagaga

SEQ ID NO: 5870083 - DNA, 16 bp, Homo sapiens
ccccaatgctctcctt

SEQ ID NO: 5870084 - DNA, 20 bp, Homo sapiens
ccccaattatcttatttaat

SEQ ID NO: 5870085 - DNA, 15 bp, Homo sapiens
ccccaattctcccct

SEQ ID NO: 5870086 - DNA, 22 bp, Homo sapiens
ccccacaacacaagcaccccag

SEQ ID NO: 5870087 - DNA, 18 bp, Homo sapiens
ccccacaagagccccaaa

SEQ ID NO: 5870088 - DNA, 18 bp, Homo sapiens
ccccacaagcaccactct

SEQ ID NO: 5870089 - DNA, 20 bp, Homo sapiens
ccccacaagctgtccctgca

SEQ ID NO: 5870090 - DNA, 23 bp, Homo sapiens
ccccacaagctgtccctgcaggg

SEQ ID NO: 5870091 - DNA, 21 bp, Homo sapiens
ccccacaaggcccagccctgg

SEQ ID NO: 5870092 - DNA, 22 bp, Homo sapiens
ccccacaaggcccagccctggg

SEQ ID NO: 5870093 - DNA, 19 bp, Homo sapiens
ccccacaaggcctggtctg

SEQ ID NO: 5870094 - DNA, 15 bp, Homo sapiens
ccccacaatgccaga

SEQ ID NO: 5870095 - DNA, 22 bp, Homo sapiens
ccccacaatttctttaaaaaag

SEQ ID NO: 5870096 - DNA, 11 bp, Homo sapiens
ccccacacaca

SEQ ID NO: 5870097 - DNA, 17 bp, Homo sapiens
ccccacacacaggcctt

SEQ ID NO: 5870098 - DNA, 17 bp, Homo sapiens
ccccacacagctacagc

SEQ ID NO: 5870099 - DNA, 14 bp, Homo sapiens
ccccacacaggcct

SEQ ID NO: 5870100 - DNA, 16 bp, Homo sapiens
ccccacacccagggct

SEQ ID NO: 5870101 - DNA, 15 bp, Homo sapiens
ccccacaccccagcc

SEQ ID NO: 5870102 - DNA, 18 bp, Homo sapiens
ccccacaccccagcccac

SEQ ID NO: 5870103 - DNA, 19 bp, Homo sapiens
ccccacaccccagcccacc

SEQ ID NO: 5870104 - DNA, 13 bp, Homo sapiens
ccccacaccctgg

SEQ ID NO: 5870105 - DNA, 16 bp, Homo sapiens
ccccacacctcagttc

SEQ ID NO: 5870106 - DNA, 17 bp, Homo sapiens
ccccacacctccctact

SEQ ID NO: 5870107 - DNA, 15 bp, Homo sapiens
ccccacacctgcagt

SEQ ID NO: 5870108 - DNA, 16 bp, Homo sapiens
ccccacacctggccct

SEQ ID NO: 5870109 - DNA, 21 bp, Homo sapiens
ccccacacgtgctcgcagcct

SEQ ID NO: 5870110 - DNA, 12 bp, Homo sapiens
ccccacactcca

SEQ ID NO: 5870111 - DNA, 23 bp, Homo sapiens
ccccacactccccgccttagagc

SEQ ID NO: 5870112 - DNA, 18 bp, Homo sapiens
ccccacactggggtgccg

SEQ ID NO: 5870113 - DNA, 17 bp, Homo sapiens
ccccacacttccctggc

SEQ ID NO: 5870114 - DNA, 22 bp, Homo sapiens
ccccacacttgttccagctctt

SEQ ID NO: 5870115 - DNA, 21 bp, Homo sapiens
ccccacagactccggcctgta

SEQ ID NO: 5870116 - DNA, 12 bp, Homo sapiens
ccccacagactg

SEQ ID NO: 5870117 - DNA, 21 bp, Homo sapiens
ccccacagactgccccagcca

SEQ ID NO: 5870118 - DNA, 13 bp, Homo sapiens
ccccacagcaccc

SEQ ID NO: 5870119 - DNA, 11 bp, Homo sapiens
ccccacagccc

SEQ ID NO: 5870120 - DNA, 13 bp, Homo sapiens
ccccacagcccac

SEQ ID NO: 5870121 - DNA, 16 bp, Homo sapiens
ccccacagcccacgtc

SEQ ID NO: 5870122 - DNA, 19 bp, Homo sapiens
ccccacagcccacgtcctg

SEQ ID NO: 5870123 - DNA, 13 bp, Homo sapiens
ccccacagccctg

SEQ ID NO: 5870124 - DNA, 14 bp, Homo sapiens
ccccacagcctctg

SEQ ID NO: 5870125 - DNA, 15 bp, Homo sapiens
ccccacagctccagg

SEQ ID NO: 5870126 - DNA, 17 bp, Homo sapiens
ccccacagctccttgca

SEQ ID NO: 5870127 - DNA, 12 bp, Homo sapiens
ccccacagctgg

SEQ ID NO: 5870128 - DNA, 14 bp, Homo sapiens
ccccacaggtcctc

SEQ ID NO: 5870129 - DNA, 12 bp, Homo sapiens
ccccacagtcct

SEQ ID NO: 5870130 - DNA, 16 bp, Homo sapiens
ccccacagtgccaccc

SEQ ID NO: 5870131 - DNA, 14 bp, Homo sapiens
ccccacagttgtgt

SEQ ID NO: 5870132 - DNA, 22 bp, Homo sapiens
ccccacagttgtgttcatgctg

SEQ ID NO: 5870133 - DNA, 18 bp, Homo sapiens
ccccacatcgcacactgg

SEQ ID NO: 5870134 - DNA, 20 bp, Homo sapiens
ccccacatttacctcgaggc

SEQ ID NO: 5870135 - DNA, 19 bp, Homo sapiens
ccccaccaagggcgcaaga

SEQ ID NO: 5870136 - DNA, 21 bp, Homo sapiens
ccccaccaagggcgcaagagt

SEQ ID NO: 5870137 - DNA, 22 bp, Homo sapiens
ccccaccacgtctggctccctg

SEQ ID NO: 5870138 - DNA, 13 bp, Homo sapiens
ccccaccactccc

SEQ ID NO: 5870139 - DNA, 14 bp, Homo sapiens
ccccaccagcagca

SEQ ID NO: 5870140 - DNA, 18 bp, Homo sapiens
ccccaccagcagcacaat

SEQ ID NO: 5870141 - DNA, 17 bp, Homo sapiens
ccccaccagccacctct

SEQ ID NO: 5870142 - DNA, 13 bp, Homo sapiens
ccccaccagtgcc

SEQ ID NO: 5870143 - DNA, 14 bp, Homo sapiens
ccccaccagtgcct

SEQ ID NO: 5870144 - DNA, 15 bp, Homo sapiens
ccccaccagtgcctc

SEQ ID NO: 5870145 - DNA, 16 bp, Homo sapiens
ccccaccagtgcctct

SEQ ID NO: 5870146 - DNA, 17 bp, Homo sapiens
ccccaccagtgcctctc

SEQ ID NO: 5870147 - DNA, 19 bp, Homo sapiens
ccccaccatatgaattgta

SEQ ID NO: 5870148 - DNA, 15 bp, Homo sapiens
ccccaccatctgctg

SEQ ID NO: 5870149 - DNA, 22 bp, Homo sapiens
ccccaccatgcagcccctgggc

SEQ ID NO: 5870150 - DNA, 12 bp, Homo sapiens
ccccaccatggt

SEQ ID NO: 5870151 - DNA, 17 bp, Homo sapiens
ccccacccaagagagga

SEQ ID NO: 5870152 - DNA, 19 bp, Homo sapiens
ccccacccaagcccaaact

SEQ ID NO: 5870153 - DNA, 14 bp, Homo sapiens
ccccacccaagggc

SEQ ID NO: 5870154 - DNA, 21 bp, Homo sapiens
ccccacccaccaaccctcagg

SEQ ID NO: 5870155 - DNA, 16 bp, Homo sapiens
ccccacccaccaccgc

SEQ ID NO: 5870156 - DNA, 12 bp, Homo sapiens
ccccacccaccc

SEQ ID NO: 5870157 - DNA, 18 bp, Homo sapiens
ccccacccacccccaggc

SEQ ID NO: 5870158 - DNA, 23 bp, Homo sapiens
ccccacccacccccaggcctcct

SEQ ID NO: 5870159 - DNA, 16 bp, Homo sapiens
ccccacccacccctcc

SEQ ID NO: 5870160 - DNA, 16 bp, Homo sapiens
ccccacccacctcctg

SEQ ID NO: 5870161 - DNA, 23 bp, Homo sapiens
ccccacccacctcctgcggctca

SEQ ID NO: 5870162 - DNA, 13 bp, Homo sapiens
ccccacccacctt

SEQ ID NO: 5870163 - DNA, 14 bp, Homo sapiens
ccccacccacttct

SEQ ID NO: 5870164 - DNA, 13 bp, Homo sapiens
ccccacccagagg

SEQ ID NO: 5870165 - DNA, 12 bp, Homo sapiens
ccccacccagga

SEQ ID NO: 5870166 - DNA, 18 bp, Homo sapiens
ccccacccaggccaggca

SEQ ID NO: 5870167 - DNA, 13 bp, Homo sapiens
ccccacccagttc

SEQ ID NO: 5870168 - DNA, 12 bp, Homo sapiens
ccccacccatgc

SEQ ID NO: 5870169 - DNA, 15 bp, Homo sapiens
ccccacccatgcgcc

SEQ ID NO: 5870170 - DNA, 13 bp, Homo sapiens
ccccaccccagcc

SEQ ID NO: 5870171 - DNA, 17 bp, Homo sapiens
ccccaccccaggctggg

SEQ ID NO: 5870172 - DNA, 20 bp, Homo sapiens
ccccaccccaggctgggctg

SEQ ID NO: 5870173 - DNA, 17 bp, Homo sapiens
ccccacccccagctcaa

SEQ ID NO: 5870174 - DNA, 20 bp, Homo sapiens
ccccacccccagctcaatgg

SEQ ID NO: 5870175 - DNA, 13 bp, Homo sapiens
ccccacccccagt

SEQ ID NO: 5870176 - DNA, 18 bp, Homo sapiens
ccccacccccgtcacccc

SEQ ID NO: 5870177 - DNA, 16 bp, Homo sapiens
ccccaccccgggctct

SEQ ID NO: 5870178 - DNA, 19 bp, Homo sapiens
ccccaccccggggaccctg

SEQ ID NO: 5870179 - DNA, 23 bp, Homo sapiens
ccccaccccggggaccctgtgac

SEQ ID NO: 5870180 - DNA, 19 bp, Homo sapiens
ccccacccctaagtgccca

SEQ ID NO: 5870181 - DNA, 12 bp, Homo sapiens
ccccacccctac

SEQ ID NO: 5870182 - DNA, 20 bp, Homo sapiens
ccccacccctacagcctgca

SEQ ID NO: 5870183 - DNA, 12 bp, Homo sapiens
ccccacccctcc

SEQ ID NO: 5870184 - DNA, 18 bp, Homo sapiens
ccccacccctgaactggc

SEQ ID NO: 5870185 - DNA, 12 bp, Homo sapiens
ccccacccctgg

SEQ ID NO: 5870186 - DNA, 11 bp, Homo sapiens
ccccacccctt

SEQ ID NO: 5870187 - DNA, 18 bp, Homo sapiens
ccccaccccttccccact

SEQ ID NO: 5870188 - DNA, 14 bp, Homo sapiens
ccccaccccttcct

SEQ ID NO: 5870189 - DNA, 18 bp, Homo sapiens
ccccaccccttgctctca

SEQ ID NO: 5870190 - DNA, 12 bp, Homo sapiens
ccccaccctcat

SEQ ID NO: 5870191 - DNA, 15 bp, Homo sapiens
ccccaccctccactc

SEQ ID NO: 5870192 - DNA, 16 bp, Homo sapiens
ccccaccctcccctct

SEQ ID NO: 5870193 - DNA, 15 bp, Homo sapiens
ccccaccctccctgg

SEQ ID NO: 5870194 - DNA, 12 bp, Homo sapiens
ccccaccctcct

SEQ ID NO: 5870195 - DNA, 21 bp, Homo sapiens
ccccaccctcctggcctcaga

SEQ ID NO: 5870196 - DNA, 13 bp, Homo sapiens
ccccaccctcgac

SEQ ID NO: 5870197 - DNA, 15 bp, Homo sapiens
ccccaccctcgggga

SEQ ID NO: 5870198 - DNA, 11 bp, Homo sapiens
ccccaccctgc

SEQ ID NO: 5870199 - DNA, 16 bp, Homo sapiens
ccccaccctgccactc

SEQ ID NO: 5870200 - DNA, 15 bp, Homo sapiens
ccccaccctgcccac

SEQ ID NO: 5870201 - DNA, 16 bp, Homo sapiens
ccccaccctgcttctg

SEQ ID NO: 5870202 - DNA, 12 bp, Homo sapiens
ccccaccctggg

SEQ ID NO: 5870203 - DNA, 15 bp, Homo sapiens
ccccaccctgggccc

SEQ ID NO: 5870204 - DNA, 14 bp, Homo sapiens
ccccaccctgggct

SEQ ID NO: 5870205 - DNA, 18 bp, Homo sapiens
ccccaccctgtcccaggc

SEQ ID NO: 5870206 - DNA, 14 bp, Homo sapiens
ccccaccctgttcc

SEQ ID NO: 5870207 - DNA, 20 bp, Homo sapiens
ccccaccctgttcctgctgc

SEQ ID NO: 5870208 - DNA, 14 bp, Homo sapiens
ccccaccctttggg

SEQ ID NO: 5870209 - DNA, 19 bp, Homo sapiens
ccccaccgaagagccctga

SEQ ID NO: 5870210 - DNA, 21 bp, Homo sapiens
ccccaccgccggggtcctggg

SEQ ID NO: 5870211 - DNA, 16 bp, Homo sapiens
ccccaccggaactggg

SEQ ID NO: 5870212 - DNA, 24 bp, Homo sapiens
ccccaccggaactgggctggcgct

SEQ ID NO: 5870213 - DNA, 12 bp, Homo sapiens
ccccaccgggct

SEQ ID NO: 5870214 - DNA, 21 bp, Homo sapiens
ccccaccggtccagctggcct

SEQ ID NO: 5870215 - DNA, 22 bp, Homo sapiens
ccccaccggtccagctggcctg

SEQ ID NO: 5870216 - DNA, 17 bp, Homo sapiens
ccccacctacccagctg

SEQ ID NO: 5870217 - DNA, 23 bp, Homo sapiens
ccccacctacccagctgatgggg

SEQ ID NO: 5870218 - DNA, 20 bp, Homo sapiens
ccccacctcacagctactca

SEQ ID NO: 5870219 - DNA, 11 bp, Homo sapiens
ccccacctccc

SEQ ID NO: 5870220 - DNA, 17 bp, Homo sapiens
ccccacctcccatttct

SEQ ID NO: 5870221 - DNA, 17 bp, Homo sapiens
ccccacctccctgcgcc

SEQ ID NO: 5870222 - DNA, 13 bp, Homo sapiens
ccccacctcctgc

SEQ ID NO: 5870223 - DNA, 13 bp, Homo sapiens
ccccacctctcca

SEQ ID NO: 5870224 - DNA, 14 bp, Homo sapiens
ccccacctctggtc

SEQ ID NO: 5870225 - DNA, 13 bp, Homo sapiens
ccccacctgacct

SEQ ID NO: 5870226 - DNA, 14 bp, Homo sapiens
ccccacctgaggca

SEQ ID NO: 5870227 - DNA, 22 bp, Homo sapiens
ccccacctgcagcgctgggccc

SEQ ID NO: 5870228 - DNA, 14 bp, Homo sapiens
ccccacctgccact

SEQ ID NO: 5870229 - DNA, 22 bp, Homo sapiens
ccccacctgccactaggctggg

SEQ ID NO: 5870230 - DNA, 14 bp, Homo sapiens
ccccacctgcctga

SEQ ID NO: 5870231 - DNA, 15 bp, Homo sapiens
ccccacctgcctgac

SEQ ID NO: 5870232 - DNA, 19 bp, Homo sapiens
ccccacctggacacacact

SEQ ID NO: 5870233 - DNA, 14 bp, Homo sapiens
ccccacctggccct

SEQ ID NO: 5870234 - DNA, 21 bp, Homo sapiens
ccccaccttcaattcctgggc

SEQ ID NO: 5870235 - DNA, 14 bp, Homo sapiens
ccccaccttccaag

SEQ ID NO: 5870236 - DNA, 13 bp, Homo sapiens
ccccaccttcccc

SEQ ID NO: 5870237 - DNA, 19 bp, Homo sapiens
ccccaccttgccagggcag

SEQ ID NO: 5870238 - DNA, 15 bp, Homo sapiens
ccccaccttgtctgc

SEQ ID NO: 5870239 - DNA, 14 bp, Homo sapiens
ccccacctttggga

SEQ ID NO: 5870240 - DNA, 18 bp, Homo sapiens
ccccacgacccctgcctc

SEQ ID NO: 5870241 - DNA, 23 bp, Homo sapiens
ccccacgacccctgcctcgaggg

SEQ ID NO: 5870242 - DNA, 15 bp, Homo sapiens
ccccacgagggctgg

SEQ ID NO: 5870243 - DNA, 17 bp, Homo sapiens
ccccacgagggctggct

SEQ ID NO: 5870244 - DNA, 16 bp, Homo sapiens
ccccacgccacagccc

SEQ ID NO: 5870245 - DNA, 17 bp, Homo sapiens
ccccacgccctctcctc

SEQ ID NO: 5870246 - DNA, 14 bp, Homo sapiens
ccccacgcctccat

SEQ ID NO: 5870247 - DNA, 20 bp, Homo sapiens
ccccacgctgtggccctgga

SEQ ID NO: 5870248 - DNA, 23 bp, Homo sapiens
ccccagccccggtggctgggcag

SEQ ID NO: 5870249 - DNA, 18 bp, Homo sapiens
ccccagcccctagcccag

SEQ ID NO: 5870250 - DNA, 22 bp, Homo sapiens
ccccagcccctagcccaggaga

SEQ ID NO: 5870251 - DNA, 19 bp, Homo sapiens
ccccagcccctcctcccct

SEQ ID NO: 5870252 - DNA, 21 bp, Homo sapiens
ccccagcccctcctccccttc

SEQ ID NO: 5870253 - DNA, 20 bp, Homo sapiens
ccccagcccctcctccctca

SEQ ID NO: 5870254 - DNA, 21 bp, Homo sapiens
ccccagcccctcctccctcag

SEQ ID NO: 5870255 - DNA, 14 bp, Homo sapiens
ccccagccccttct

SEQ ID NO: 5870256 - DNA, 22 bp, Homo sapiens
ccccagccccttctcccagcac

SEQ ID NO: 5870257 - DNA, 11 bp, Homo sapiens
ccccagccctc

SEQ ID NO: 5870258 - DNA, 12 bp, Homo sapiens
ccccagccctca

SEQ ID NO: 5870259 - DNA, 13 bp, Homo sapiens
ccccagccctcag

SEQ ID NO: 5870260 - DNA, 19 bp, Homo sapiens
ccccagccctccccacctg

SEQ ID NO: 5870261 - DNA, 17 bp, Homo sapiens
ccccagccctgctgggg

SEQ ID NO: 5870262 - DNA, 15 bp, Homo sapiens
ccccagcccttctgc

SEQ ID NO: 5870263 - DNA, 17 bp, Homo sapiens
ccccagcccttctgcct

SEQ ID NO: 5870264 - DNA, 21 bp, Homo sapiens
ccccagccgcttggcgatgcc

SEQ ID NO: 5870265 - DNA, 21 bp, Homo sapiens
ccccagcctaagatgaagagg

SEQ ID NO: 5870266 - DNA, 14 bp, Homo sapiens
ccccagcctacctc

SEQ ID NO: 5870267 - DNA, 22 bp, Homo sapiens
ccccagcctatgagcatcctga

SEQ ID NO: 5870268 - DNA, 13 bp, Homo sapiens
ccccagcctcact

SEQ ID NO: 5870269 - DNA, 16 bp, Homo sapiens
ccccagcctcagccca

SEQ ID NO: 5870270 - DNA, 20 bp, Homo sapiens
ccccagcctcattgtgccaa

SEQ ID NO: 5870271 - DNA, 15 bp, Homo sapiens
ccccagcctccagag

SEQ ID NO: 5870272 - DNA, 18 bp, Homo sapiens
ccccagcctccagagaag

SEQ ID NO: 5870273 - DNA, 15 bp, Homo sapiens
ccccagcctccaggc

SEQ ID NO: 5870274 - DNA, 13 bp, Homo sapiens
ccccagcctcccc

SEQ ID NO: 5870275 - DNA, 20 bp, Homo sapiens
ccccagcctcccccaggctg

SEQ ID NO: 5870276 - DNA, 15 bp, Homo sapiens
ccccagcctccctga

SEQ ID NO: 5870277 - DNA, 13 bp, Homo sapiens
ccccagcctcctg

SEQ ID NO: 5870278 - DNA, 15 bp, Homo sapiens
ccccagcctcgcctg

SEQ ID NO: 5870279 - DNA, 19 bp, Homo sapiens
ccccagcctctcctccttg

SEQ ID NO: 5870280 - DNA, 13 bp, Homo sapiens
ccccagcctctct

SEQ ID NO: 5870281 - DNA, 10 bp, Homo sapiens
ccccagcctg

SEQ ID NO: 5870282 - DNA, 15 bp, Homo sapiens
ccccagcctgacaaa

SEQ ID NO: 5870283 - DNA, 19 bp, Homo sapiens
ccccagcctgacctgagac

SEQ ID NO: 5870284 - DNA, 20 bp, Homo sapiens
ccccagcctgacctgagact

SEQ ID NO: 5870285 - DNA, 12 bp, Homo sapiens
ccccagcctggc

SEQ ID NO: 5870286 - DNA, 21 bp, Homo sapiens
ccccagcctggccacgcagcc

SEQ ID NO: 5870287 - DNA, 15 bp, Homo sapiens
ccccagcctggccag

SEQ ID NO: 5870288 - DNA, 19 bp, Homo sapiens
ccccagcctggcccagctc

SEQ ID NO: 5870289 - DNA, 22 bp, Homo sapiens
ccccagcctggcccagctcccc

SEQ ID NO: 5870290 - DNA, 15 bp, Homo sapiens
ccccagcctgggccc

SEQ ID NO: 5870291 - DNA, 11 bp, Homo sapiens
ccccagcctgt

SEQ ID NO: 5870292 - DNA, 15 bp, Homo sapiens
ccccagcctgtcctt

SEQ ID NO: 5870293 - DNA, 13 bp, Homo sapiens
ccccagccttggt

SEQ ID NO: 5870294 - DNA, 19 bp, Homo sapiens
ccccagcgagagtccctgc

SEQ ID NO: 5870295 - DNA, 23 bp, Homo sapiens
ccccagcgctggcccccccagcc

SEQ ID NO: 5870296 - DNA, 17 bp, Homo sapiens
ccccagcgggctggcgg

SEQ ID NO: 5870297 - DNA, 15 bp, Homo sapiens
ccccagcgtctgcag

SEQ ID NO: 5870298 - DNA, 16 bp, Homo sapiens
ccccagcgtctgcagg

SEQ ID NO: 5870299 - DNA, 17 bp, Homo sapiens
ccccagcgtctgcaggg

SEQ ID NO: 5870300 - DNA, 18 bp, Homo sapiens
ccccagctaataaaccag

SEQ ID NO: 5870301 - DNA, 21 bp, Homo sapiens
ccccagctaatacccagagca

SEQ ID NO: 5870302 - DNA, 11 bp, Homo sapiens
ccccagctacc

SEQ ID NO: 5870303 - DNA, 19 bp, Homo sapiens
ccccagctactctgatccc

SEQ ID NO: 5870304 - DNA, 12 bp, Homo sapiens
ccccagctagga

SEQ ID NO: 5870305 - DNA, 16 bp, Homo sapiens
ccccagctcaggggca

SEQ ID NO: 5870306 - DNA, 12 bp, Homo sapiens
ccccagctccag

SEQ ID NO: 5870307 - DNA, 13 bp, Homo sapiens
ccccagctccagg

SEQ ID NO: 5870308 - DNA, 14 bp, Homo sapiens
ccccagctcccagg

SEQ ID NO: 5870309 - DNA, 15 bp, Homo sapiens
ccccagctccccagg

SEQ ID NO: 5870310 - DNA, 17 bp, Homo sapiens
ccccagctccccaggac

SEQ ID NO: 5870311 - DNA, 19 bp, Homo sapiens
ccccagctccccaggactc

SEQ ID NO: 5870312 - DNA, 17 bp, Homo sapiens
ccccagctcccttggga

SEQ ID NO: 5870313 - DNA, 11 bp, Homo sapiens
ccccagctccg

SEQ ID NO: 5870314 - DNA, 21 bp, Homo sapiens
ccccagctccgacctctctca

SEQ ID NO: 5870315 - DNA, 11 bp, Homo sapiens
ccccagctcct

SEQ ID NO: 5870316 - DNA, 12 bp, Homo sapiens
ccccagctcctc

SEQ ID NO: 5870317 - DNA, 19 bp, Homo sapiens
ccccagctcctcttcctgc

SEQ ID NO: 5870318 - DNA, 22 bp, Homo sapiens
ccccagctcctttccctggaag

SEQ ID NO: 5870319 - DNA, 22 bp, Homo sapiens
ccccagctctaagcagccagga

SEQ ID NO: 5870320 - DNA, 14 bp, Homo sapiens
ccccagctctggtg

SEQ ID NO: 5870321 - DNA, 15 bp, Homo sapiens
ccccagctgccggca

SEQ ID NO: 5870322 - DNA, 14 bp, Homo sapiens
ccccagctgctcct

SEQ ID NO: 5870323 - DNA, 13 bp, Homo sapiens
ccccagctgcttg

SEQ ID NO: 5870324 - DNA, 21 bp, Homo sapiens
ccccagctggcccgtgacaga

SEQ ID NO: 5870325 - DNA, 14 bp, Homo sapiens
ccccagctggcctc

SEQ ID NO: 5870326 - DNA, 23 bp, Homo sapiens
ccccagctggcctctagaacacc

SEQ ID NO: 5870327 - DNA, 16 bp, Homo sapiens
ccccagctggctgggt

SEQ ID NO: 5870328 - DNA, 11 bp, Homo sapiens
ccccagctggg

SEQ ID NO: 5870329 - DNA, 15 bp, Homo sapiens
ccccagctgggaggc

SEQ ID NO: 5870330 - DNA, 22 bp, Homo sapiens
ccccagctggggccaggctggg

SEQ ID NO: 5870331 - DNA, 11 bp, Homo sapiens
ccccagctggt

SEQ ID NO: 5870332 - DNA, 14 bp, Homo sapiens
ccccagctgtgagc

SEQ ID NO: 5870333 - DNA, 19 bp, Homo sapiens
ccccagcttccagcaggag

SEQ ID NO: 5870334 - DNA, 12 bp, Homo sapiens
ccccagcttcct

SEQ ID NO: 5870335 - DNA, 13 bp, Homo sapiens
ccccagcttcctg

SEQ ID NO: 5870336 - DNA, 15 bp, Homo sapiens
ccccagcttcctgtg

SEQ ID NO: 5870337 - DNA, 22 bp, Homo sapiens
ccccagcttctctctccctgtc

SEQ ID NO: 5870338 - DNA, 22 bp, Homo sapiens
ccccagcttggctcacaaggcc

SEQ ID NO: 5870339 - DNA, 15 bp, Homo sapiens
ccccagcttgggcag

SEQ ID NO: 5870340 - DNA, 13 bp, Homo sapiens
ccccagctttgcc

SEQ ID NO: 5870341 - DNA, 14 bp, Homo sapiens
ccccagctttgccc

SEQ ID NO: 5870342 - DNA, 21 bp, Homo sapiens
ccccagcttttcttgccagct

SEQ ID NO: 5870343 - DNA, 23 bp, Homo sapiens
ccccagcttttcttgccagctca

SEQ ID NO: 5870344 - DNA, 19 bp, Homo sapiens
ccccaggaaactagctttt

SEQ ID NO: 5870345 - DNA, 20 bp, Homo sapiens
ccccaggaagtcatcctgca

SEQ ID NO: 5870346 - DNA, 12 bp, Homo sapiens
ccccaggacaag

SEQ ID NO: 5870347 - DNA, 16 bp, Homo sapiens
ccccaggacagcacac

SEQ ID NO: 5870348 - DNA, 22 bp, Homo sapiens
ccccaggacagcacacggtgag

SEQ ID NO: 5870349 - DNA, 13 bp, Homo sapiens
ccccaggacaggc

SEQ ID NO: 5870350 - DNA, 17 bp, Homo sapiens
ccccaggaccaagctta

SEQ ID NO: 5870351 - DNA, 20 bp, Homo sapiens
ccccaggaccagaagctccc

SEQ ID NO: 5870352 - DNA, 15 bp, Homo sapiens
ccccaggaccagctc

SEQ ID NO: 5870353 - DNA, 21 bp, Homo sapiens
ccccaggaccagctcaggaca

SEQ ID NO: 5870354 - DNA, 16 bp, Homo sapiens
ccccaggaccccccca

SEQ ID NO: 5870355 - DNA, 15 bp, Homo sapiens
ccccaggacctggct

SEQ ID NO: 5870356 - DNA, 18 bp, Homo sapiens
ccccaggactctggcact

SEQ ID NO: 5870357 - DNA, 19 bp, Homo sapiens
ccccaggactggctgcccc

SEQ ID NO: 5870358 - DNA, 22 bp, Homo sapiens
ccccaggactgggccacttctg

SEQ ID NO: 5870359 - DNA, 13 bp, Homo sapiens
ccccaggagcagc

SEQ ID NO: 5870360 - DNA, 14 bp, Homo sapiens
ccccaggagcagct

SEQ ID NO: 5870361 - DNA, 15 bp, Homo sapiens
ccccaggagcagctg

SEQ ID NO: 5870362 - DNA, 17 bp, Homo sapiens
ccccaggagcagctggc

SEQ ID NO: 5870363 - DNA, 21 bp, Homo sapiens
ccccaggagcagctggcactg

SEQ ID NO: 5870364 - DNA, 15 bp, Homo sapiens
ccccaggagctcagg

SEQ ID NO: 5870365 - DNA, 16 bp, Homo sapiens
ccccaggagctcaggt

SEQ ID NO: 5870366 - DNA, 17 bp, Homo sapiens
ccccaggagctctctgc

SEQ ID NO: 5870367 - DNA, 21 bp, Homo sapiens
ccccaggagctctctgctgag

SEQ ID NO: 5870368 - DNA, 22 bp, Homo sapiens
ccccaggaggagaccctcccct

SEQ ID NO: 5870369 - DNA, 23 bp, Homo sapiens
ccccaggaggagaccctcccctg

SEQ ID NO: 5870370 - DNA, 14 bp, Homo sapiens
ccccaggaggcagc

SEQ ID NO: 5870371 - DNA, 12 bp, Homo sapiens
ccccaggaggcc

SEQ ID NO: 5870372 - DNA, 15 bp, Homo sapiens
ccccaggaggccagc

SEQ ID NO: 5870373 - DNA, 19 bp, Homo sapiens
ccccaggaggcctgggccg

SEQ ID NO: 5870374 - DNA, 18 bp, Homo sapiens
ccccaggagggaggcagg

SEQ ID NO: 5870375 - DNA, 18 bp, Homo sapiens
ccccaggatcactctctg

SEQ ID NO: 5870376 - DNA, 19 bp, Homo sapiens
ccccaggatgcatgcaggg

SEQ ID NO: 5870377 - DNA, 18 bp, Homo sapiens
ccccaggattgtgcaata

SEQ ID NO: 5870378 - DNA, 11 bp, Homo sapiens
ccccaggcagc

SEQ ID NO: 5870379 - DNA, 12 bp, Homo sapiens
ccccaggcagcc

SEQ ID NO: 5870380 - DNA, 15 bp, Homo sapiens
ccccaggcagccacc

SEQ ID NO: 5870381 - DNA, 19 bp, Homo sapiens
ccccaggcagccaccagtg

SEQ ID NO: 5870382 - DNA, 14 bp, Homo sapiens
ccccaggcaggctg

SEQ ID NO: 5870383 - DNA, 19 bp, Homo sapiens
ccccaggcatcccatccct

SEQ ID NO: 5870384 - DNA, 23 bp, Homo sapiens
ccccaggcatctgttagcagagt

SEQ ID NO: 5870385 - DNA, 13 bp, Homo sapiens
ccccaggccaccc

SEQ ID NO: 5870386 - DNA, 16 bp, Homo sapiens
ccccaggccagctgcg

SEQ ID NO: 5870387 - DNA, 18 bp, Homo sapiens
ccccaggccagctgcggc

SEQ ID NO: 5870388 - DNA, 14 bp, Homo sapiens
ccccaggccaggtg

SEQ ID NO: 5870389 - DNA, 13 bp, Homo sapiens
ccccaggcccacc

SEQ ID NO: 5870390 - DNA, 15 bp, Homo sapiens
ccccaggcccagccc

SEQ ID NO: 5870391 - DNA, 18 bp, Homo sapiens
ccccaggcccagccctcc

SEQ ID NO: 5870392 - DNA, 12 bp, Homo sapiens
ccccaggcccca

SEQ ID NO: 5870393 - DNA, 18 bp, Homo sapiens
ccccaggccccaggaagc

SEQ ID NO: 5870394 - DNA, 20 bp, Homo sapiens
ccccaggccccgaggaccca

SEQ ID NO: 5870395 - DNA, 22 bp, Homo sapiens
ccccaggccccgcccgtctctg

SEQ ID NO: 5870396 - DNA, 14 bp, Homo sapiens
ccccaggcccgccc

SEQ ID NO: 5870397 - DNA, 21 bp, Homo sapiens
ccccaggcccgcgggcacagc

SEQ ID NO: 5870398 - DNA, 15 bp, Homo sapiens
ccccaggccctacaa

SEQ ID NO: 5870399 - DNA, 22 bp, Homo sapiens
ccccaggccctactacccattg

SEQ ID NO: 5870400 - DNA, 13 bp, Homo sapiens
ccccaggccctcc

SEQ ID NO: 5870401 - DNA, 14 bp, Homo sapiens
ccccaggccctccc

SEQ ID NO: 5870402 - DNA, 13 bp, Homo sapiens
ccccaggccctgc

SEQ ID NO: 5870403 - DNA, 20 bp, Homo sapiens
ccccaggccctgccagagca

SEQ ID NO: 5870404 - DNA, 20 bp, Homo sapiens
ccccaggcccttcaggaact

SEQ ID NO: 5870405 - DNA, 16 bp, Homo sapiens
ccccaggccggagccc

SEQ ID NO: 5870406 - DNA, 18 bp, Homo sapiens
ccccaggcctccagaacc

SEQ ID NO: 5870407 - DNA, 16 bp, Homo sapiens
ccccaggcctccagcc

SEQ ID NO: 5870408 - DNA, 18 bp, Homo sapiens
ccccaggcctccagcctc

SEQ ID NO: 5870409 - DNA, 17 bp, Homo sapiens
ccccaggcctcctaggg

SEQ ID NO: 5870410 - DNA, 21 bp, Homo sapiens
ccccaggcctcctaggggaag

SEQ ID NO: 5870411 - DNA, 20 bp, Homo sapiens
ccccaggcctgagctgcttc

SEQ ID NO: 5870412 - DNA, 22 bp, Homo sapiens
ccccaggcctgagctgcttcac

SEQ ID NO: 5870413 - DNA, 14 bp, Homo sapiens
ccccaggcctgccc

SEQ ID NO: 5870414 - DNA, 13 bp, Homo sapiens
ccccaggcctgga

SEQ ID NO: 5870415 - DNA, 16 bp, Homo sapiens
ccccaggcctggctcc

SEQ ID NO: 5870416 - DNA, 15 bp, Homo sapiens
ccccaggcctgtcca

SEQ ID NO: 5870417 - DNA, 23 bp, Homo sapiens
ccccaggcctgtccaccctgcca

SEQ ID NO: 5870418 - DNA, 19 bp, Homo sapiens
ccccaggcggaggggcttg

SEQ ID NO: 5870419 - DNA, 15 bp, Homo sapiens
ccccaggctcccctg

SEQ ID NO: 5870420 - DNA, 19 bp, Homo sapiens
ccccaggctcccctggtct

SEQ ID NO: 5870421 - DNA, 20 bp, Homo sapiens
ccccaggctgcccagagctg

SEQ ID NO: 5870422 - DNA, 15 bp, Homo sapiens
ccccaggctgcgcct

SEQ ID NO: 5870423 - DNA, 17 bp, Homo sapiens
ccccaggctggatgctg

SEQ ID NO: 5870424 - DNA, 18 bp, Homo sapiens
ccccaggctgttctccag

SEQ ID NO: 5870425 - DNA, 16 bp, Homo sapiens
ccccagggaagcagca

SEQ ID NO: 5870426 - DNA, 18 bp, Homo sapiens
ccccagggaaggaaaaat

SEQ ID NO: 5870427 - DNA, 19 bp, Homo sapiens
ccccagggaatcagggacc

SEQ ID NO: 5870428 - DNA, 22 bp, Homo sapiens
cccccagcgtcagtttcactcc

SEQ ID NO: 5870429 - DNA, 18 bp, Homo sapiens
cccccagctaagaacctg

SEQ ID NO: 5870430 - DNA, 14 bp, Homo sapiens
cccccagctcaggg

SEQ ID NO: 5870431 - DNA, 12 bp, Homo sapiens
cccccagctccc

SEQ ID NO: 5870432 - DNA, 13 bp, Homo sapiens
cccccagctccca

SEQ ID NO: 5870433 - DNA, 15 bp, Homo sapiens
cccccagctcccaca

SEQ ID NO: 5870434 - DNA, 22 bp, Homo sapiens
cccccagctcgctggctttctc

SEQ ID NO: 5870435 - DNA, 22 bp, Homo sapiens
cccccagctctaagcagccagg

SEQ ID NO: 5870436 - DNA, 23 bp, Homo sapiens
cccccagctctaagcagccagga

SEQ ID NO: 5870437 - DNA, 12 bp, Homo sapiens
cccccagctggc

SEQ ID NO: 5870438 - DNA, 15 bp, Homo sapiens
cccccagctgggtct

SEQ ID NO: 5870439 - DNA, 15 bp, Homo sapiens
cccccagcttctctc

SEQ ID NO: 5870440 - DNA, 22 bp, Homo sapiens
cccccaggaacgctctcctcga

SEQ ID NO: 5870441 - DNA, 15 bp, Homo sapiens
cccccaggaccagaa

SEQ ID NO: 5870442 - DNA, 12 bp, Homo sapiens
cccccaggaccc

SEQ ID NO: 5870443 - DNA, 12 bp, Homo sapiens
cccccaggactg

SEQ ID NO: 5870444 - DNA, 13 bp, Homo sapiens
cccccaggactgg

SEQ ID NO: 5870445 - DNA, 22 bp, Homo sapiens
cccccaggagcagctggcactg

SEQ ID NO: 5870446 - DNA, 11 bp, Homo sapiens
cccccaggagg

SEQ ID NO: 5870447 - DNA, 12 bp, Homo sapiens
cccccaggaggc

SEQ ID NO: 5870448 - DNA, 16 bp, Homo sapiens
cccccaggcagccacc

SEQ ID NO: 5870449 - DNA, 18 bp, Homo sapiens
cccccaggcagccaccag

SEQ ID NO: 5870450 - DNA, 20 bp, Homo sapiens
cccccaggccctcccaccac

SEQ ID NO: 5870451 - DNA, 16 bp, Homo sapiens
cccccaggcctccaga

SEQ ID NO: 5870452 - DNA, 15 bp, Homo sapiens
cccccaggcctccta

SEQ ID NO: 5870453 - DNA, 21 bp, Homo sapiens
cccccaggcctgagctgcttc

SEQ ID NO: 5870454 - DNA, 21 bp, Homo sapiens
cccccaggctgcccagagctg

SEQ ID NO: 5870455 - DNA, 16 bp, Homo sapiens
cccccaggctgcgcct

SEQ ID NO: 5870456 - DNA, 18 bp, Homo sapiens
cccccaggctgcgcctgc

SEQ ID NO: 5870457 - DNA, 19 bp, Homo sapiens
cccccaggctgcgcctgcc

SEQ ID NO: 5870458 - DNA, 14 bp, Homo sapiens
cccccagggagggg

SEQ ID NO: 5870459 - DNA, 12 bp, Homo sapiens
cccccagggcct

SEQ ID NO: 5870460 - DNA, 17 bp, Homo sapiens
cccccagggcctccagg

SEQ ID NO: 5870461 - DNA, 14 bp, Homo sapiens
cccccaggggcagg

SEQ ID NO: 5870462 - DNA, 22 bp, Homo sapiens
cccccaggggcccaggctcccc

SEQ ID NO: 5870463 - DNA, 17 bp, Homo sapiens
cccccaggtgctggagg

SEQ ID NO: 5870464 - DNA, 20 bp, Homo sapiens
cccccaggttccgaagaaga

SEQ ID NO: 5870465 - DNA, 14 bp, Homo sapiens
cccccagtacctcc

SEQ ID NO: 5870466 - DNA, 20 bp, Homo sapiens
cccccagtccccacccctgc

SEQ ID NO: 5870467 - DNA, 22 bp, Homo sapiens
cccccagtccccacccctgccc

SEQ ID NO: 5870468 - DNA, 21 bp, Homo sapiens
cccccagtcctcactgtcctg

SEQ ID NO: 5870469 - DNA, 21 bp, Homo sapiens
cccccagtcctccctagctct

SEQ ID NO: 5870470 - DNA, 21 bp, Homo sapiens
cccccagtgccacagagaaga

SEQ ID NO: 5870471 - DNA, 12 bp, Homo sapiens
cccccagtgcct

SEQ ID NO: 5870472 - DNA, 19 bp, Homo sapiens
cccccagtgggatgggaca

SEQ ID NO: 5870473 - DNA, 15 bp, Homo sapiens
cccccagtggggaca

SEQ ID NO: 5870474 - DNA, 20 bp, Homo sapiens
cccccatccagcctccaggg

SEQ ID NO: 5870475 - DNA, 13 bp, Homo sapiens
cccccatcccagg

SEQ ID NO: 5870476 - DNA, 17 bp, Homo sapiens
cccccatcccgtttccc

SEQ ID NO: 5870477 - DNA, 20 bp, Homo sapiens
cccccatcccgtttccctcc

SEQ ID NO: 5870478 - DNA, 22 bp, Homo sapiens
cccccatcccgtttccctccag

SEQ ID NO: 5870479 - DNA, 11 bp, Homo sapiens
cccccatcctt

SEQ ID NO: 5870480 - DNA, 13 bp, Homo sapiens
cccccatcgctct

SEQ ID NO: 5870481 - DNA, 18 bp, Homo sapiens
cccccatctccccaggcc

SEQ ID NO: 5870482 - DNA, 20 bp, Homo sapiens
cccccatctccccaggcctc

SEQ ID NO: 5870483 - DNA, 14 bp, Homo sapiens
cccccatctctgag

SEQ ID NO: 5870484 - DNA, 14 bp, Homo sapiens
cccccatctgagct

SEQ ID NO: 5870485 - DNA, 17 bp, Homo sapiens
cccccatcttcatccca

SEQ ID NO: 5870486 - DNA, 21 bp, Homo sapiens
cccccatcttcgggaccagga

SEQ ID NO: 5870487 - DNA, 12 bp, Homo sapiens
cccccatgccct

SEQ ID NO: 5870488 - DNA, 19 bp, Homo sapiens
cccccatgccctccctgct

SEQ ID NO: 5870489 - DNA, 22 bp, Homo sapiens
cccccatgccctccctgctgcc

SEQ ID NO: 5870490 - DNA, 19 bp, Homo sapiens
cccccatgctgccttcagg

SEQ ID NO: 5870491 - DNA, 20 bp, Homo sapiens
cccccatgctgccttcaggg

SEQ ID NO: 5870492 - DNA, 17 bp, Homo sapiens
cccccatgggctcctgc

SEQ ID NO: 5870493 - DNA, 13 bp, Homo sapiens
cccccatgggctg

SEQ ID NO: 5870494 - DNA, 13 bp, Homo sapiens
cccccatgtggct

SEQ ID NO: 5870495 - DNA, 22 bp, Homo sapiens
cccccatgttgtaatgctgcac

SEQ ID NO: 5870496 - DNA, 17 bp, Homo sapiens
cccccattagaatgtga

SEQ ID NO: 5870497 - DNA, 17 bp, Homo sapiens
cccccattcccagcctg

SEQ ID NO: 5870498 - DNA, 19 bp, Homo sapiens
cccccattctcccagtctc

SEQ ID NO: 5870499 - DNA, 13 bp, Homo sapiens
cccccattgtgaa

SEQ ID NO: 5870500 - DNA, 20 bp, Homo sapiens
cccccattgtgaatgttgtc

SEQ ID NO: 5870501 - DNA, 12 bp, Homo sapiens
cccccattttac

SEQ ID NO: 5870502 - DNA, 19 bp, Homo sapiens
ccccccaagggaggctgct

SEQ ID NO: 5870503 - DNA, 17 bp, Homo sapiens
ccccccacacttccctg

SEQ ID NO: 5870504 - DNA, 13 bp, Homo sapiens
ccccccacccctg

SEQ ID NO: 5870505 - DNA, 11 bp, Homo sapiens
ccccccactct

SEQ ID NO: 5870506 - DNA, 18 bp, Homo sapiens
ccccccagaacctgtcct

SEQ ID NO: 5870507 - DNA, 16 bp, Homo sapiens
ccccccagagccaggg

SEQ ID NO: 5870508 - DNA, 14 bp, Homo sapiens
ccccccagatatca

SEQ ID NO: 5870509 - DNA, 13 bp, Homo sapiens
ccccccagcacta

SEQ ID NO: 5870510 - DNA, 13 bp, Homo sapiens
ccccccagcctcc

SEQ ID NO: 5870511 - DNA, 12 bp, Homo sapiens
ccccccagctca

SEQ ID NO: 5870512 - DNA, 12 bp, Homo sapiens
ccccccagctcc

SEQ ID NO: 5870513 - DNA, 13 bp, Homo sapiens
ccccccagtccgc

SEQ ID NO: 5870514 - DNA, 11 bp, Homo sapiens
ccccccagtgg

SEQ ID NO: 5870515 - DNA, 13 bp, Homo sapiens
ccccccatgccct

SEQ ID NO: 5870516 - DNA, 13 bp, Homo sapiens
cccccccaggccc

SEQ ID NO: 5870517 - DNA, 13 bp, Homo sapiens
cccccccccccgc

SEQ ID NO: 5870518 - DNA, 13 bp, Homo sapiens
cccccccttccac

SEQ ID NO: 5870519 - DNA, 13 bp, Homo sapiens
ccccccgcagcac

SEQ ID NO: 5870520 - DNA, 13 bp, Homo sapiens
ccccccgcccacc

SEQ ID NO: 5870521 - DNA, 15 bp, Homo sapiens
cccccctcctgctcc

SEQ ID NO: 5870522 - DNA, 12 bp, Homo sapiens
cccccctggcct

SEQ ID NO: 5870523 - DNA, 12 bp, Homo sapiens
cccccctgtggt

SEQ ID NO: 5870524 - DNA, 13 bp, Homo sapiens
cccccgacactgc

SEQ ID NO: 5870525 - DNA, 17 bp, Homo sapiens
cccccgacactgctgca

SEQ ID NO: 5870526 - DNA, 23 bp, Homo sapiens
cccccgacactgctgcaccagag

SEQ ID NO: 5870527 - DNA, 19 bp, Homo sapiens
cccccgaccaatccccagc

SEQ ID NO: 5870528 - DNA, 19 bp, Homo sapiens
cccccgacccagctctact

SEQ ID NO: 5870529 - DNA, 17 bp, Homo sapiens
cccccgaccctgccctg

SEQ ID NO: 5870530 - DNA, 21 bp, Homo sapiens
cccccgacgtgctcccctgct

SEQ ID NO: 5870531 - DNA, 14 bp, Homo sapiens
cccccgactgcctg

SEQ ID NO: 5870532 - DNA, 23 bp, Homo sapiens
cccccgagccctgactcctggac

SEQ ID NO: 5870533 - DNA, 19 bp, Homo sapiens
cccccgagctcttggcctt

SEQ ID NO: 5870534 - DNA, 13 bp, Homo sapiens
cccccgagcttgc

SEQ ID NO: 5870535 - DNA, 12 bp, Homo sapiens
cccccgaggccc

SEQ ID NO: 5870536 - DNA, 16 bp, Homo sapiens
cccccgcacagccacc

SEQ ID NO: 5870537 - DNA, 18 bp, Homo sapiens
cccccgcacagccacccg

SEQ ID NO: 5870538 - DNA, 21 bp, Homo sapiens
cccccgcacgcaagcctcagc

SEQ ID NO: 5870539 - DNA, 21 bp, Homo sapiens
cccccgcagtcgtcagcctcc

SEQ ID NO: 5870540 - DNA, 14 bp, Homo sapiens
cccccgccacctca

SEQ ID NO: 5870541 - DNA, 19 bp, Homo sapiens
cccccgccacctccccact

SEQ ID NO: 5870542 - DNA, 13 bp, Homo sapiens
cccccgccacggc

SEQ ID NO: 5870543 - DNA, 15 bp, Homo sapiens
cccccgccacggcca

SEQ ID NO: 5870544 - DNA, 19 bp, Homo sapiens
cccccgccacggccaccct

SEQ ID NO: 5870545 - DNA, 18 bp, Homo sapiens
cccccgcccaggccatca

SEQ ID NO: 5870546 - DNA, 18 bp, Homo sapiens
cccccgcccaggctggcc

SEQ ID NO: 5870547 - DNA, 14 bp, Homo sapiens
cccccgccccacag

SEQ ID NO: 5870548 - DNA, 13 bp, Homo sapiens
cccccgccccagg

SEQ ID NO: 5870549 - DNA, 12 bp, Homo sapiens
cccccgccccct

SEQ ID NO: 5870550 - DNA, 18 bp, Homo sapiens
cccccgccccgccccaca

SEQ ID NO: 5870551 - DNA, 23 bp, Homo sapiens
cccccgccccgcccccgccccgc

SEQ ID NO: 5870552 - DNA, 16 bp, Homo sapiens
cccccgcccggcctcc

SEQ ID NO: 5870553 - DNA, 18 bp, Homo sapiens
cccccgccctcgctccgg

SEQ ID NO: 5870554 - DNA, 18 bp, Homo sapiens
cccccgccggcaggggcc

SEQ ID NO: 5870555 - DNA, 14 bp, Homo sapiens
cccccgcctgccac

SEQ ID NO: 5870556 - DNA, 15 bp, Homo sapiens
cccccgcctgccacc

SEQ ID NO: 5870557 - DNA, 23 bp, Homo sapiens
cccccgcctgggcaccgggaccc

SEQ ID NO: 5870558 - DNA, 18 bp, Homo sapiens
cccccgcgctcgcccagc

SEQ ID NO: 5870559 - DNA, 17 bp, Homo sapiens
cccccgcgggttctaga

SEQ ID NO: 5870560 - DNA, 13 bp, Homo sapiens
cccccgctccaga

SEQ ID NO: 5870561 - DNA, 14 bp, Homo sapiens
cccccgctccagat

SEQ ID NO: 5870562 - DNA, 18 bp, Homo sapiens
cccccgcttagccccgct

SEQ ID NO: 5870563 - DNA, 18 bp, Homo sapiens
cccccggaggcgcccacc

SEQ ID NO: 5870564 - DNA, 15 bp, Homo sapiens
cccccggccaaggac

SEQ ID NO: 5870565 - DNA, 15 bp, Homo sapiens
cccccggcccagtgc

SEQ ID NO: 5870566 - DNA, 13 bp, Homo sapiens
cccccggccccct

SEQ ID NO: 5870567 - DNA, 15 bp, Homo sapiens
cccccggccccctgg

SEQ ID NO: 5870568 - DNA, 15 bp, Homo sapiens
cccccggcctccagg

SEQ ID NO: 5870569 - DNA, 16 bp, Homo sapiens
cccccggctttcctcc

SEQ ID NO: 5870570 - DNA, 19 bp, Homo sapiens
cccccggctttcctccgga

SEQ ID NO: 5870571 - DNA, 22 bp, Homo sapiens
cccccgggaggggcccgcttgc

SEQ ID NO: 5870572 - DNA, 16 bp, Homo sapiens
cccccgggatcctgcc

SEQ ID NO: 5870573 - DNA, 17 bp, Homo sapiens
cccccgggatcctgccc

SEQ ID NO: 5870574 - DNA, 18 bp, Homo sapiens
cccccgggccgacggagc

SEQ ID NO: 5870575 - DNA, 14 bp, Homo sapiens
cccccgggcctgca

SEQ ID NO: 5870576 - DNA, 15 bp, Homo sapiens
cccccgggcctgcac

SEQ ID NO: 5870577 - DNA, 16 bp, Homo sapiens
cccccggggctgggtt

SEQ ID NO: 5870578 - DNA, 23 bp, Homo sapiens
cccccgtgccaaatcctgggcat

SEQ ID NO: 5870579 - DNA, 17 bp, Homo sapiens
cccccgtggggctcccg

SEQ ID NO: 5870580 - DNA, 16 bp, Homo sapiens
cccccgtggtctttga

SEQ ID NO: 5870581 - DNA, 16 bp, Homo sapiens
cccccgtggtgcctgc

SEQ ID NO: 5870582 - DNA, 19 bp, Homo sapiens
ccccctaaacccctgtccc

SEQ ID NO: 5870583 - DNA, 13 bp, Homo sapiens
ccccctaagagac

SEQ ID NO: 5870584 - DNA, 19 bp, Homo sapiens
ccccctaagctccaggtgc

SEQ ID NO: 5870585 - DNA, 22 bp, Homo sapiens
ccccctaaggaatatccagtca

SEQ ID NO: 5870586 - DNA, 17 bp, Homo sapiens
ccccctacagatcctcc

SEQ ID NO: 5870587 - DNA, 19 bp, Homo sapiens
ccccctacagatcctccgc

SEQ ID NO: 5870588 - DNA, 13 bp, Homo sapiens
ccccctacccata

SEQ ID NO: 5870589 - DNA, 22 bp, Homo sapiens
ccccctaccgcatggcagctgg

SEQ ID NO: 5870590 - DNA, 23 bp, Homo sapiens
ccccctaccgcatggcagctggg

SEQ ID NO: 5870591 - DNA, 17 bp, Homo sapiens
ccccctatcttgtcctg

SEQ ID NO: 5870592 - DNA, 16 bp, Homo sapiens
ccccctcaaacctcct

SEQ ID NO: 5870593 - DNA, 15 bp, Homo sapiens
ccccctcaccatcca

SEQ ID NO: 5870594 - DNA, 12 bp, Homo sapiens
ccccctcagcct

SEQ ID NO: 5870595 - DNA, 10 bp, Homo sapiens
ccccctcagg

SEQ ID NO: 5870596 - DNA, 12 bp, Homo sapiens
ccccctcatccc

SEQ ID NO: 5870597 - DNA, 21 bp, Homo sapiens
ccccctcatctcattcaaacc

SEQ ID NO: 5870598 - DNA, 18 bp, Homo sapiens
ccccctccaatcctgccc

SEQ ID NO: 5870599 - DNA, 15 bp, Homo sapiens
ccccctccagctcca

SEQ ID NO: 5870600 - DNA, 20 bp, Homo sapiens
ccccctccaggcatgctggc

SEQ ID NO: 5870601 - DNA, 14 bp, Homo sapiens
ccccctccagtgct

SEQ ID NO: 5870602 - DNA, 21 bp, Homo sapiens
ccccctccattcccacccctc

SEQ ID NO: 5870603 - DNA, 13 bp, Homo sapiens
ccccctcccaggg

SEQ ID NO: 5870604 - DNA, 14 bp, Homo sapiens
ccccctcccccgca

SEQ ID NO: 5870605 - DNA, 13 bp, Homo sapiens
ccccctccctgga

SEQ ID NO: 5870606 - DNA, 20 bp, Homo sapiens
ccccctccctgtcccagggc

SEQ ID NO: 5870607 - DNA, 14 bp, Homo sapiens
ccccctcctccagt

SEQ ID NO: 5870608 - DNA, 18 bp, Homo sapiens
ccccctcctcccagggcc

SEQ ID NO: 5870609 - DNA, 14 bp, Homo sapiens
ccccgccctctgcc

SEQ ID NO: 5870610 - DNA, 17 bp, Homo sapiens
ccccgccgcgccagtcc

SEQ ID NO: 5870611 - DNA, 18 bp, Homo sapiens
ccccgccgcgccagtccc

SEQ ID NO: 5870612 - DNA, 14 bp, Homo sapiens
ccccgcctccactc

SEQ ID NO: 5870613 - DNA, 12 bp, Homo sapiens
ccccgcctctgg

SEQ ID NO: 5870614 - DNA, 13 bp, Homo sapiens
ccccgcctctggg

SEQ ID NO: 5870615 - DNA, 14 bp, Homo sapiens
ccccgcctctgggc

SEQ ID NO: 5870616 - DNA, 15 bp, Homo sapiens
ccccgcctgccaccg

SEQ ID NO: 5870617 - DNA, 18 bp, Homo sapiens
ccccgcctgccctcccac

SEQ ID NO: 5870618 - DNA, 12 bp, Homo sapiens
ccccgcctgcct

SEQ ID NO: 5870619 - DNA, 12 bp, Homo sapiens
ccccgcctggcc

SEQ ID NO: 5870620 - DNA, 14 bp, Homo sapiens
ccccgcctggccag

SEQ ID NO: 5870621 - DNA, 12 bp, Homo sapiens
ccccgcctgtca

SEQ ID NO: 5870622 - DNA, 19 bp, Homo sapiens
ccccgccttccctcactct

SEQ ID NO: 5870623 - DNA, 18 bp, Homo sapiens
ccccgccttttcccccac

SEQ ID NO: 5870624 - DNA, 15 bp, Homo sapiens
ccccgcgaccacccc

SEQ ID NO: 5870625 - DNA, 18 bp, Homo sapiens
ccccgcgaccacccctgt

SEQ ID NO: 5870626 - DNA, 19 bp, Homo sapiens
ccccgcgaccacccctgtg

SEQ ID NO: 5870627 - DNA, 18 bp, Homo sapiens
ccccgcgccccagtcact

SEQ ID NO: 5870628 - DNA, 16 bp, Homo sapiens
ccccgcgcgtgccccc

SEQ ID NO: 5870629 - DNA, 13 bp, Homo sapiens
ccccgcgggcttt

SEQ ID NO: 5870630 - DNA, 13 bp, Homo sapiens
ccccgctccagat

SEQ ID NO: 5870631 - DNA, 17 bp, Homo sapiens
ccccgctcccgctccca

SEQ ID NO: 5870632 - DNA, 12 bp, Homo sapiens
ccccgctccgtc

SEQ ID NO: 5870633 - DNA, 22 bp, Homo sapiens
ccccgctctgcatgcggcccag

SEQ ID NO: 5870634 - DNA, 20 bp, Homo sapiens
ccccgctctgccatcagccc

SEQ ID NO: 5870635 - DNA, 23 bp, Homo sapiens
ccccgctctgccatcagcccctg

SEQ ID NO: 5870636 - DNA, 12 bp, Homo sapiens
ccccgctctgga

SEQ ID NO: 5870637 - DNA, 20 bp, Homo sapiens
ccccgctgatggagccccac

SEQ ID NO: 5870638 - DNA, 21 bp, Homo sapiens
ccccgctgcctggcgggcagc

SEQ ID NO: 5870639 - DNA, 13 bp, Homo sapiens
ccccgctggctca

SEQ ID NO: 5870640 - DNA, 21 bp, Homo sapiens
ccccgcttagccccgctgagc

SEQ ID NO: 5870641 - DNA, 21 bp, Homo sapiens
ccccgcttccccacagaactg

SEQ ID NO: 5870642 - DNA, 21 bp, Homo sapiens
ccccgcttttgcagcagagga

SEQ ID NO: 5870643 - DNA, 16 bp, Homo sapiens
ccccggaagtgcctta

SEQ ID NO: 5870644 - DNA, 19 bp, Homo sapiens
ccccggacaagcccaggac

SEQ ID NO: 5870645 - DNA, 16 bp, Homo sapiens
ccccggacagggtggc

SEQ ID NO: 5870646 - DNA, 20 bp, Homo sapiens
ccccggagcaccacggggtc

SEQ ID NO: 5870647 - DNA, 14 bp, Homo sapiens
ccccggaggaagct

SEQ ID NO: 5870648 - DNA, 20 bp, Homo sapiens
ccccggaggcgcccacctgc

SEQ ID NO: 5870649 - DNA, 15 bp, Homo sapiens
ccccggagggctgcg

SEQ ID NO: 5870650 - DNA, 15 bp, Homo sapiens
ccccggatcagagca

SEQ ID NO: 5870651 - DNA, 14 bp, Homo sapiens
ccccggcaccctct

SEQ ID NO: 5870652 - DNA, 17 bp, Homo sapiens
ccccggcaccctctggc

SEQ ID NO: 5870653 - DNA, 18 bp, Homo sapiens
ccccggcagcagccccca

SEQ ID NO: 5870654 - DNA, 21 bp, Homo sapiens
ccccggcaggccctgcagtgt

SEQ ID NO: 5870655 - DNA, 21 bp, Homo sapiens
ccccggcatgagactcagtgc

SEQ ID NO: 5870656 - DNA, 20 bp, Homo sapiens
ccccggccaaggacccaggc

SEQ ID NO: 5870657 - DNA, 23 bp, Homo sapiens
ccccggccaaggacccaggcgct

SEQ ID NO: 5870658 - DNA, 15 bp, Homo sapiens
ccccggccacctctg

SEQ ID NO: 5870659 - DNA, 16 bp, Homo sapiens
ccccggccacctctgc

SEQ ID NO: 5870660 - DNA, 17 bp, Homo sapiens
ccccggccacctctgcg

SEQ ID NO: 5870661 - DNA, 13 bp, Homo sapiens
ccccggccacctg

SEQ ID NO: 5870662 - DNA, 19 bp, Homo sapiens
ccccggccacgctccctct

SEQ ID NO: 5870663 - DNA, 20 bp, Homo sapiens
ccccggccactccctgccaa

SEQ ID NO: 5870664 - DNA, 16 bp, Homo sapiens
ccccggccactctgtt

SEQ ID NO: 5870665 - DNA, 19 bp, Homo sapiens
ccccggccccagccagagt

SEQ ID NO: 5870666 - DNA, 16 bp, Homo sapiens
ccccggccgggagacc

SEQ ID NO: 5870667 - DNA, 14 bp, Homo sapiens
ccccggcctcagca

SEQ ID NO: 5870668 - DNA, 16 bp, Homo sapiens
ccccggcctctctctt

SEQ ID NO: 5870669 - DNA, 14 bp, Homo sapiens
ccccggcctgatgg

SEQ ID NO: 5870670 - DNA, 16 bp, Homo sapiens
ccccggcctttatgtt

SEQ ID NO: 5870671 - DNA, 20 bp, Homo sapiens
ccccggcggggtgcctgctg

SEQ ID NO: 5870672 - DNA, 13 bp, Homo sapiens
ccccggctcccac

SEQ ID NO: 5870673 - DNA, 24 bp, Homo sapiens
ccccggctgcttggcagttgcagt

SEQ ID NO: 5870674 - DNA, 12 bp, Homo sapiens
ccccggctgggc

SEQ ID NO: 5870675 - DNA, 21 bp, Homo sapiens
ccccggctttcctccggagcc

SEQ ID NO: 5870676 - DNA, 16 bp, Homo sapiens
ccccgggaccgcgcta

SEQ ID NO: 5870677 - DNA, 16 bp, Homo sapiens
ccccgggaggggcccg

SEQ ID NO: 5870678 - DNA, 18 bp, Homo sapiens
ccccgggatcctgccccc

SEQ ID NO: 5870679 - DNA, 20 bp, Homo sapiens
ccccgggcccgggcccccgc

SEQ ID NO: 5870680 - DNA, 14 bp, Homo sapiens
ccccgggcctgcac

SEQ ID NO: 5870681 - DNA, 16 bp, Homo sapiens
ccccgggcctgcctct

SEQ ID NO: 5870682 - DNA, 15 bp, Homo sapiens
ccccgggctctcctg

SEQ ID NO: 5870683 - DNA, 15 bp, Homo sapiens
ccccgggctctctgc

SEQ ID NO: 5870684 - DNA, 17 bp, Homo sapiens
ccccgggctctctgctg

SEQ ID NO: 5870685 - DNA, 16 bp, Homo sapiens
ccccgggctctggcca

SEQ ID NO: 5870686 - DNA, 17 bp, Homo sapiens
ccccgggctctggccac

SEQ ID NO: 5870687 - DNA, 20 bp, Homo sapiens
ccccgggctctggccaccct

SEQ ID NO: 5870688 - DNA, 15 bp, Homo sapiens
ccccgggctgaccca

SEQ ID NO: 5870689 - DNA, 18 bp, Homo sapiens
ccccgggctggccctgtg

SEQ ID NO: 5870690 - DNA, 21 bp, Homo sapiens
ccccgggctggccctgtgcag

SEQ ID NO: 5870691 - DNA, 22 bp, Homo sapiens
ccccggggcatggacagggcca

SEQ ID NO: 5870692 - DNA, 23 bp, Homo sapiens
ccccggggcatggacagggccag

SEQ ID NO: 5870693 - DNA, 19 bp, Homo sapiens
ccccggggccccctggtca

SEQ ID NO: 5870694 - DNA, 15 bp, Homo sapiens
ccccggggctgggtt

SEQ ID NO: 5870695 - DNA, 18 bp, Homo sapiens
ccccgggtccccagctcc

SEQ ID NO: 5870696 - DNA, 15 bp, Homo sapiens
ccccgggtgcctgtg

SEQ ID NO: 5870697 - DNA, 21 bp, Homo sapiens
ccccgggttcagcctggcctg

SEQ ID NO: 5870698 - DNA, 19 bp, Homo sapiens
ccccgggtttggcgggcca

SEQ ID NO: 5870699 - DNA, 20 bp, Homo sapiens
ccccggtcacctagcaagct

SEQ ID NO: 5870700 - DNA, 18 bp, Homo sapiens
ccccggtggcggccccag

SEQ ID NO: 5870701 - DNA, 20 bp, Homo sapiens
ccccggtggcggccccagca

SEQ ID NO: 5870702 - DNA, 18 bp, Homo sapiens
ccccggtgtgcggtgcat

SEQ ID NO: 5870703 - DNA, 14 bp, Homo sapiens
ccccgtcagctgct

SEQ ID NO: 5870704 - DNA, 19 bp, Homo sapiens
ccccgtccccctagagact

SEQ ID NO: 5870705 - DNA, 15 bp, Homo sapiens
ccccgtcccctaacc

SEQ ID NO: 5870706 - DNA, 22 bp, Homo sapiens
ccccgtcccctaacccccagtc

SEQ ID NO: 5870707 - DNA, 15 bp, Homo sapiens
ccccgtcccctgcag

SEQ ID NO: 5870708 - DNA, 16 bp, Homo sapiens
ccccgtcccctgcagc

SEQ ID NO: 5870709 - DNA, 21 bp, Homo sapiens
ccccgtccctgtcccccagca

SEQ ID NO: 5870710 - DNA, 17 bp, Homo sapiens
ccccgtccctttccctg

SEQ ID NO: 5870711 - DNA, 17 bp, Homo sapiens
ccccgtcggactgcccc

SEQ ID NO: 5870712 - DNA, 14 bp, Homo sapiens
ccccgtctctgccc

SEQ ID NO: 5870713 - DNA, 15 bp, Homo sapiens
ccccgtctctgccct

SEQ ID NO: 5870714 - DNA, 21 bp, Homo sapiens
ccccgtctctggttcctcccc

SEQ ID NO: 5870715 - DNA, 22 bp, Homo sapiens
ccccgtctgaccccagcccaga

SEQ ID NO: 5870716 - DNA, 18 bp, Homo sapiens
ccccgtctgcccaccatt

SEQ ID NO: 5870717 - DNA, 14 bp, Homo sapiens
ccccgtctgcccct

SEQ ID NO: 5870718 - DNA, 23 bp, Homo sapiens
ccccgtctgccccttgaccccac

SEQ ID NO: 5870719 - DNA, 15 bp, Homo sapiens
ccccgtctgcctggc

SEQ ID NO: 5870720 - DNA, 13 bp, Homo sapiens
ccccgtgctcaca

SEQ ID NO: 5870721 - DNA, 18 bp, Homo sapiens
ccccgtgctcacagtagc

SEQ ID NO: 5870722 - DNA, 17 bp, Homo sapiens
ccccgtgctcctctgcc

SEQ ID NO: 5870723 - DNA, 13 bp, Homo sapiens
ccccgtggctctg

SEQ ID NO: 5870724 - DNA, 14 bp, Homo sapiens
ccccgtggctctgg

SEQ ID NO: 5870725 - DNA, 21 bp, Homo sapiens
ccccgtggtctttgaataaag

SEQ ID NO: 5870726 - DNA, 17 bp, Homo sapiens
ccccgtggtgcctgcac

SEQ ID NO: 5870727 - DNA, 21 bp, Homo sapiens
ccccgtgtaaaaagcctcctt

SEQ ID NO: 5870728 - DNA, 14 bp, Homo sapiens
ccccgtgtggctta

SEQ ID NO: 5870729 - DNA, 15 bp, Homo sapiens
ccccgtgttcaggac

SEQ ID NO: 5870730 - DNA, 16 bp, Homo sapiens
ccccgttacagctccc

SEQ ID NO: 5870731 - DNA, 21 bp, Homo sapiens
ccccgttccctgtcagaggct

SEQ ID NO: 5870732 - DNA, 18 bp, Homo sapiens
ccccgttgttgtccctgc

SEQ ID NO: 5870733 - DNA, 19 bp, Homo sapiens
ccccgttgttgtccctgca

SEQ ID NO: 5870734 - DNA, 19 bp, Homo sapiens
ccccgtttcagtggaccct

SEQ ID NO: 5870735 - DNA, 13 bp, Homo sapiens
ccccgtttccctg

SEQ ID NO: 5870736 - DNA, 20 bp, Homo sapiens
ccccgtttctccttttccta

SEQ ID NO: 5870737 - DNA, 14 bp, Homo sapiens
ccccgtttctggtg

SEQ ID NO: 5870738 - DNA, 22 bp, Homo sapiens
cccctaaaaacaaaacaaacac

SEQ ID NO: 5870739 - DNA, 20 bp, Homo sapiens
cccctaaaagaaaccctgca

SEQ ID NO: 5870740 - DNA, 17 bp, Homo sapiens
cccctaaagagcatcct

SEQ ID NO: 5870741 - DNA, 18 bp, Homo sapiens
cccctaaagagcatcctg

SEQ ID NO: 5870742 - DNA, 21 bp, Homo sapiens
cccctaaagagcatcctgata

SEQ ID NO: 5870743 - DNA, 15 bp, Homo sapiens
cccctaaagtgccag

SEQ ID NO: 5870744 - DNA, 17 bp, Homo sapiens
cccctaacccccagtcc

SEQ ID NO: 5870745 - DNA, 18 bp, Homo sapiens
cccctaacctctaaccct

SEQ ID NO: 5870746 - DNA, 16 bp, Homo sapiens
cccctaacctggctta

SEQ ID NO: 5870747 - DNA, 17 bp, Homo sapiens
cccctaacctggcttat

SEQ ID NO: 5870748 - DNA, 18 bp, Homo sapiens
cccctaagactgccttca

SEQ ID NO: 5870749 - DNA, 21 bp, Homo sapiens
cccctaagctggctgtacctg

SEQ ID NO: 5870750 - DNA, 13 bp, Homo sapiens
cccctaagtgccc

SEQ ID NO: 5870751 - DNA, 14 bp, Homo sapiens
cccctaagtgccca

SEQ ID NO: 5870752 - DNA, 19 bp, Homo sapiens
cccctaagtgcccaaagtg

SEQ ID NO: 5870753 - DNA, 21 bp, Homo sapiens
cccctaagtggattggctttg

SEQ ID NO: 5870754 - DNA, 17 bp, Homo sapiens
cccctacaactccagcc

SEQ ID NO: 5870755 - DNA, 16 bp, Homo sapiens
cccctacacacacact

SEQ ID NO: 5870756 - DNA, 17 bp, Homo sapiens
cccctacacacacactc

SEQ ID NO: 5870757 - DNA, 14 bp, Homo sapiens
cccctacagatcct

SEQ ID NO: 5870758 - DNA, 15 bp, Homo sapiens
cccctacagcctgca

SEQ ID NO: 5870759 - DNA, 12 bp, Homo sapiens
cccctacccacc

SEQ ID NO: 5870760 - DNA, 16 bp, Homo sapiens
cccctacccaccgatg

SEQ ID NO: 5870761 - DNA, 13 bp, Homo sapiens
cccctaccccaca

SEQ ID NO: 5870762 - DNA, 16 bp, Homo sapiens
cccctacccctgccct

SEQ ID NO: 5870763 - DNA, 17 bp, Homo sapiens
cccctacccctggctgt

SEQ ID NO: 5870764 - DNA, 21 bp, Homo sapiens
cccctaccgcatggcagctgg

SEQ ID NO: 5870765 - DNA, 22 bp, Homo sapiens
cccctacgggcgctgcagcctc

SEQ ID NO: 5870766 - DNA, 19 bp, Homo sapiens
cccctagaaacccaagctc

SEQ ID NO: 5870767 - DNA, 13 bp, Homo sapiens
cccctagacctcc

SEQ ID NO: 5870768 - DNA, 14 bp, Homo sapiens
cccctagatccaga

SEQ ID NO: 5870769 - DNA, 18 bp, Homo sapiens
cccctagatgaagaaaga

SEQ ID NO: 5870770 - DNA, 14 bp, Homo sapiens
cccctagccaccag

SEQ ID NO: 5870771 - DNA, 12 bp, Homo sapiens
cccctagcccag

SEQ ID NO: 5870772 - DNA, 20 bp, Homo sapiens
cccctagcccaggagagaga

SEQ ID NO: 5870773 - DNA, 22 bp, Homo sapiens
cccctaggatgctgcagcagag

SEQ ID NO: 5870774 - DNA, 18 bp, Homo sapiens
cccctagtaagtgccttc

SEQ ID NO: 5870775 - DNA, 22 bp, Homo sapiens
cccctagtccggttcttcttgt

SEQ ID NO: 5870776 - DNA, 18 bp, Homo sapiens
cccctatacctgagcctc

SEQ ID NO: 5870777 - DNA, 21 bp, Homo sapiens
cccctatccacccagcccatt

SEQ ID NO: 5870778 - DNA, 13 bp, Homo sapiens
cccctatcctccc

SEQ ID NO: 5870779 - DNA, 15 bp, Homo sapiens
cccctatcctcccct

SEQ ID NO: 5870780 - DNA, 15 bp, Homo sapiens
cccctatcctctgag

SEQ ID NO: 5870781 - DNA, 16 bp, Homo sapiens
cccctatcctctgagt

SEQ ID NO: 5870782 - DNA, 17 bp, Homo sapiens
cccctatgccactaagc

SEQ ID NO: 5870783 - DNA, 14 bp, Homo sapiens
cccctatttattga

SEQ ID NO: 5870784 - DNA, 19 bp, Homo sapiens
cccctcaaactgcacatct

SEQ ID NO: 5870785 - DNA, 17 bp, Homo sapiens
cccctcaacaccctgct

SEQ ID NO: 5870786 - DNA, 16 bp, Homo sapiens
cccctcaacacctctg

SEQ ID NO: 5870787 - DNA, 12 bp, Homo sapiens
cccctcaacctc

SEQ ID NO: 5870788 - DNA, 13 bp, Homo sapiens
cccctgcccgcca

SEQ ID NO: 5870789 - DNA, 23 bp, Homo sapiens
cccctgccctcccctctctgcac

SEQ ID NO: 5870790 - DNA, 15 bp, Homo sapiens
cccctgccctcgtgg

SEQ ID NO: 5870791 - DNA, 22 bp, Homo sapiens
cccctgccctcgtggccagccc

SEQ ID NO: 5870792 - DNA, 15 bp, Homo sapiens
cccctgccctgagga

SEQ ID NO: 5870793 - DNA, 21 bp, Homo sapiens
cccctgccctgaggagggccc

SEQ ID NO: 5870794 - DNA, 12 bp, Homo sapiens
cccctgccctgc

SEQ ID NO: 5870795 - DNA, 14 bp, Homo sapiens
cccctgccctgcac

SEQ ID NO: 5870796 - DNA, 13 bp, Homo sapiens
cccctgccctgct

SEQ ID NO: 5870797 - DNA, 15 bp, Homo sapiens
cccctgccctgctgc

SEQ ID NO: 5870798 - DNA, 15 bp, Homo sapiens
cccctgccgcctccc

SEQ ID NO: 5870799 - DNA, 17 bp, Homo sapiens
cccctgccggccttggc

SEQ ID NO: 5870800 - DNA, 16 bp, Homo sapiens
cccctgcctccatcct

SEQ ID NO: 5870801 - DNA, 17 bp, Homo sapiens
cccctgcctcccatgcc

SEQ ID NO: 5870802 - DNA, 19 bp, Homo sapiens
cccctgcctcccattctgc

SEQ ID NO: 5870803 - DNA, 18 bp, Homo sapiens
cccctgcctcctgcctcc

SEQ ID NO: 5870804 - DNA, 14 bp, Homo sapiens
cccctgcctcgagg

SEQ ID NO: 5870805 - DNA, 15 bp, Homo sapiens
cccctgcctcgaggg

SEQ ID NO: 5870806 - DNA, 21 bp, Homo sapiens
cccctgcctcgagggccgcct

SEQ ID NO: 5870807 - DNA, 15 bp, Homo sapiens
cccctgcctctctgc

SEQ ID NO: 5870808 - DNA, 17 bp, Homo sapiens
cccctgcctctctgcag

SEQ ID NO: 5870809 - DNA, 12 bp, Homo sapiens
cccctgcctgcc

SEQ ID NO: 5870810 - DNA, 14 bp, Homo sapiens
cccctgcctgccat

SEQ ID NO: 5870811 - DNA, 13 bp, Homo sapiens
cccctgcctgccc

SEQ ID NO: 5870812 - DNA, 19 bp, Homo sapiens
cccctgcctgccctggtga

SEQ ID NO: 5870813 - DNA, 14 bp, Homo sapiens
cccctgcctggaac

SEQ ID NO: 5870814 - DNA, 12 bp, Homo sapiens
cccctgcctggg

SEQ ID NO: 5870815 - DNA, 21 bp, Homo sapiens
cccctgcctgggaacacgtgt

SEQ ID NO: 5870816 - DNA, 16 bp, Homo sapiens
cccctgcctgggttgg

SEQ ID NO: 5870817 - DNA, 11 bp, Homo sapiens
cccctgcctta

SEQ ID NO: 5870818 - DNA, 21 bp, Homo sapiens
cccctgccttaacctgggacc

SEQ ID NO: 5870819 - DNA, 11 bp, Homo sapiens
cccctgccttc

SEQ ID NO: 5870820 - DNA, 12 bp, Homo sapiens
cccctgccttgc

SEQ ID NO: 5870821 - DNA, 15 bp, Homo sapiens
cccctgcctttggga

SEQ ID NO: 5870822 - DNA, 19 bp, Homo sapiens
cccctgcctttgggagcag

SEQ ID NO: 5870823 - DNA, 12 bp, Homo sapiens
cccctgcgcccc

SEQ ID NO: 5870824 - DNA, 14 bp, Homo sapiens
cccctgcgccctcc

SEQ ID NO: 5870825 - DNA, 17 bp, Homo sapiens
cccctgcgtcgagctgg

SEQ ID NO: 5870826 - DNA, 19 bp, Homo sapiens
cccctgcgtcgagctggga

SEQ ID NO: 5870827 - DNA, 21 bp, Homo sapiens
cccctgcgtgggggccagtca

SEQ ID NO: 5870828 - DNA, 19 bp, Homo sapiens
cccctgctactcctgtgct

SEQ ID NO: 5870829 - DNA, 17 bp, Homo sapiens
cccctgctcactgggcc

SEQ ID NO: 5870830 - DNA, 13 bp, Homo sapiens
cccctgctcagca

SEQ ID NO: 5870831 - DNA, 19 bp, Homo sapiens
cccctgctccatgggcacc

SEQ ID NO: 5870832 - DNA, 15 bp, Homo sapiens
cccctgctcccattc

SEQ ID NO: 5870833 - DNA, 13 bp, Homo sapiens
cccctgctgacct

SEQ ID NO: 5870834 - DNA, 18 bp, Homo sapiens
cccctgctgcctccccaa

SEQ ID NO: 5870835 - DNA, 14 bp, Homo sapiens
cccctgctgctgtc

SEQ ID NO: 5870836 - DNA, 16 bp, Homo sapiens
cccctgctgcttggga

SEQ ID NO: 5870837 - DNA, 14 bp, Homo sapiens
cccctgctggacca

SEQ ID NO: 5870838 - DNA, 11 bp, Homo sapiens
cccctgctggt

SEQ ID NO: 5870839 - DNA, 13 bp, Homo sapiens
cccctgctggttc

SEQ ID NO: 5870840 - DNA, 18 bp, Homo sapiens
cccctgcttctcagcccc

SEQ ID NO: 5870841 - DNA, 22 bp, Homo sapiens
cccctgcttctcccgccattgg

SEQ ID NO: 5870842 - DNA, 17 bp, Homo sapiens
cccctgctttgccccac

SEQ ID NO: 5870843 - DNA, 22 bp, Homo sapiens
cccctgctttgggcttgggcct

SEQ ID NO: 5870844 - DNA, 17 bp, Homo sapiens
cccctggaaacccacct

SEQ ID NO: 5870845 - DNA, 23 bp, Homo sapiens
cccctggaagcagtgcccaggtg

SEQ ID NO: 5870846 - DNA, 14 bp, Homo sapiens
cccctggacagagg

SEQ ID NO: 5870847 - DNA, 16 bp, Homo sapiens
cccctggacagaggcg

SEQ ID NO: 5870848 - DNA, 17 bp, Homo sapiens
cccctggacagaggcgg

SEQ ID NO: 5870849 - DNA, 15 bp, Homo sapiens
cccctggacatgcct

SEQ ID NO: 5870850 - DNA, 19 bp, Homo sapiens
cccctggacatgcctgtcc

SEQ ID NO: 5870851 - DNA, 19 bp, Homo sapiens
cccctggaccacacctccg

SEQ ID NO: 5870852 - DNA, 16 bp, Homo sapiens
cccctggaccccagcc

SEQ ID NO: 5870853 - DNA, 15 bp, Homo sapiens
cccctggacccctgg

SEQ ID NO: 5870854 - DNA, 16 bp, Homo sapiens
cccctggacccctggg

SEQ ID NO: 5870855 - DNA, 16 bp, Homo sapiens
cccctggacggggcgg

SEQ ID NO: 5870856 - DNA, 15 bp, Homo sapiens
cccctggactgggag

SEQ ID NO: 5870857 - DNA, 14 bp, Homo sapiens
cccctggacttctt

SEQ ID NO: 5870858 - DNA, 15 bp, Homo sapiens
cccctggagagaagt

SEQ ID NO: 5870859 - DNA, 15 bp, Homo sapiens
cccctggagcctcag

SEQ ID NO: 5870860 - DNA, 17 bp, Homo sapiens
cccctggaggctgcctc

SEQ ID NO: 5870861 - DNA, 19 bp, Homo sapiens
cccctggcacctgggtgct

SEQ ID NO: 5870862 - DNA, 12 bp, Homo sapiens
cccctggcagag

SEQ ID NO: 5870863 - DNA, 19 bp, Homo sapiens
cccctggcagcacagccca

SEQ ID NO: 5870864 - DNA, 12 bp, Homo sapiens
cccctggcagcc

SEQ ID NO: 5870865 - DNA, 15 bp, Homo sapiens
cccctggcagcccct

SEQ ID NO: 5870866 - DNA, 15 bp, Homo sapiens
cccctggcagctgcc

SEQ ID NO: 5870867 - DNA, 16 bp, Homo sapiens
cccctggcagctgccc

SEQ ID NO: 5870868 - DNA, 22 bp, Homo sapiens
cccctggcagctgcccctcctg

SEQ ID NO: 5870869 - DNA, 23 bp, Homo sapiens
cccctggcagctgcccctcctgg

SEQ ID NO: 5870870 - DNA, 12 bp, Homo sapiens
cccctggcaggg

SEQ ID NO: 5870871 - DNA, 23 bp, Homo sapiens
cccctggcaggggaaactctggt

SEQ ID NO: 5870872 - DNA, 17 bp, Homo sapiens
cccctggcagtgctgag

SEQ ID NO: 5870873 - DNA, 15 bp, Homo sapiens
cccctggccacagcc

SEQ ID NO: 5870874 - DNA, 18 bp, Homo sapiens
cccctggccacagccttc

SEQ ID NO: 5870875 - DNA, 14 bp, Homo sapiens
cccctggccagctc

SEQ ID NO: 5870876 - DNA, 19 bp, Homo sapiens
cccctggccagctctgagg

SEQ ID NO: 5870877 - DNA, 12 bp, Homo sapiens
cccctggcccag

SEQ ID NO: 5870878 - DNA, 19 bp, Homo sapiens
cccctggcccatctcagcc

SEQ ID NO: 5870879 - DNA, 20 bp, Homo sapiens
cccctggcccatctcagcct

SEQ ID NO: 5870880 - DNA, 11 bp, Homo sapiens
cccctggccct

SEQ ID NO: 5870881 - DNA, 16 bp, Homo sapiens
cccctggcccttcctt

SEQ ID NO: 5870882 - DNA, 21 bp, Homo sapiens
cccctggcccttccttcaccc

SEQ ID NO: 5870883 - DNA, 23 bp, Homo sapiens
cccctggccgcgctccgggcttt

SEQ ID NO: 5870884 - DNA, 12 bp, Homo sapiens
cccctggcctct

SEQ ID NO: 5870885 - DNA, 14 bp, Homo sapiens
cccctggcctctgt

SEQ ID NO: 5870886 - DNA, 19 bp, Homo sapiens
cccctggcctgactcccat

SEQ ID NO: 5870887 - DNA, 11 bp, Homo sapiens
cccctggcctt

SEQ ID NO: 5870888 - DNA, 14 bp, Homo sapiens
cccctggcggcagg

SEQ ID NO: 5870889 - DNA, 14 bp, Homo sapiens
cccctggctctggg

SEQ ID NO: 5870890 - DNA, 16 bp, Homo sapiens
cccctggctgaacagt

SEQ ID NO: 5870891 - DNA, 22 bp, Homo sapiens
cccctggctgaacagtgctctg

SEQ ID NO: 5870892 - DNA, 23 bp, Homo sapiens
cccctggctgaacagtgctctgc

SEQ ID NO: 5870893 - DNA, 16 bp, Homo sapiens
cccctggctggctcct

SEQ ID NO: 5870894 - DNA, 11 bp, Homo sapiens
cccctggcttt

SEQ ID NO: 5870895 - DNA, 21 bp, Homo sapiens
cccctggctttgcctcttctt

SEQ ID NO: 5870896 - DNA, 22 bp, Homo sapiens
cccctggctttgcctcttcttt

SEQ ID NO: 5870897 - DNA, 18 bp, Homo sapiens
cccctggcttttcactgc

SEQ ID NO: 5870898 - DNA, 15 bp, Homo sapiens
cccctgggaacacag

SEQ ID NO: 5870899 - DNA, 18 bp, Homo sapiens
cccctgggaacacagtgc

SEQ ID NO: 5870900 - DNA, 18 bp, Homo sapiens
cccctgggaactctcctg

SEQ ID NO: 5870901 - DNA, 22 bp, Homo sapiens
cccctgggactttcccacccag

SEQ ID NO: 5870902 - DNA, 18 bp, Homo sapiens
cccctgggatgctgaccc

SEQ ID NO: 5870903 - DNA, 19 bp, Homo sapiens
cccctgggatgctgaccca

SEQ ID NO: 5870904 - DNA, 20 bp, Homo sapiens
cccctgggcatcttctggct

SEQ ID NO: 5870905 - DNA, 15 bp, Homo sapiens
cccctgggccaccct

SEQ ID NO: 5870906 - DNA, 20 bp, Homo sapiens
cccctgggccacccttcacg

SEQ ID NO: 5870907 - DNA, 12 bp, Homo sapiens
cccctgggccct

SEQ ID NO: 5870908 - DNA, 14 bp, Homo sapiens
cccctgggcctgga

SEQ ID NO: 5870909 - DNA, 19 bp, Homo sapiens
cccctgggctaccatctgc

SEQ ID NO: 5870910 - DNA, 11 bp, Homo sapiens
cccctgggctc

SEQ ID NO: 5870911 - DNA, 13 bp, Homo sapiens
cccctgggctctg

SEQ ID NO: 5870912 - DNA, 11 bp, Homo sapiens
cccctggggac

SEQ ID NO: 5870913 - DNA, 18 bp, Homo sapiens
cccctggggacagagcca

SEQ ID NO: 5870914 - DNA, 20 bp, Homo sapiens
cccctggggacgccaaggag

SEQ ID NO: 5870915 - DNA, 14 bp, Homo sapiens
cccctggggctccc

SEQ ID NO: 5870916 - DNA, 22 bp, Homo sapiens
cccctggggctgagtctccagg

SEQ ID NO: 5870917 - DNA, 15 bp, Homo sapiens
cccctggggctggtg

SEQ ID NO: 5870918 - DNA, 17 bp, Homo sapiens
cccctggggctggtgga

SEQ ID NO: 5870919 - DNA, 18 bp, Homo sapiens
cccctggggcttctcctg

SEQ ID NO: 5870920 - DNA, 19 bp, Homo sapiens
cccctggggcttctcctga

SEQ ID NO: 5870921 - DNA, 14 bp, Homo sapiens
cccctgggggaggc

SEQ ID NO: 5870922 - DNA, 19 bp, Homo sapiens
cccctggggggcacagcca

SEQ ID NO: 5870923 - DNA, 20 bp, Homo sapiens
cccctggggggcacagccag

SEQ ID NO: 5870924 - DNA, 22 bp, Homo sapiens
cccctggggggcacagccagaa

SEQ ID NO: 5870925 - DNA, 21 bp, Homo sapiens
cccctggggtacttctgtgtt

SEQ ID NO: 5870926 - DNA, 22 bp, Homo sapiens
cccctggggtctctgctgcatt

SEQ ID NO: 5870927 - DNA, 20 bp, Homo sapiens
cccctggggtggccagggct

SEQ ID NO: 5870928 - DNA, 23 bp, Homo sapiens
cccctggggtgggatctgagctc

SEQ ID NO: 5870929 - DNA, 20 bp, Homo sapiens
cccctgggtcagtctggtgg

SEQ ID NO: 5870930 - DNA, 20 bp, Homo sapiens
cccctgggtgggtggtgggg

SEQ ID NO: 5870931 - DNA, 23 bp, Homo sapiens
cccctgggtgggtggtggggagg

SEQ ID NO: 5870932 - DNA, 19 bp, Homo sapiens
cccctgggttaacaaatga

SEQ ID NO: 5870933 - DNA, 21 bp, Homo sapiens
cccctggtcaccgagactcag

SEQ ID NO: 5870934 - DNA, 15 bp, Homo sapiens
cccctggtcctgcac

SEQ ID NO: 5870935 - DNA, 17 bp, Homo sapiens
cccctggtcctgcactg

SEQ ID NO: 5870936 - DNA, 21 bp, Homo sapiens
cccctggtcctgcactgtccc

SEQ ID NO: 5870937 - DNA, 17 bp, Homo sapiens
cccctggtctgccctgg

SEQ ID NO: 5870938 - DNA, 13 bp, Homo sapiens
cccctggtgcccc

SEQ ID NO: 5870939 - DNA, 14 bp, Homo sapiens
cccctggtggctgc

SEQ ID NO: 5870940 - DNA, 19 bp, Homo sapiens
cccctggtgtccctgcctg

SEQ ID NO: 5870941 - DNA, 15 bp, Homo sapiens
cccctgtaaatagtt

SEQ ID NO: 5870942 - DNA, 17 bp, Homo sapiens
cccctgtacccagccac

SEQ ID NO: 5870943 - DNA, 16 bp, Homo sapiens
cccctgtacccagctc

SEQ ID NO: 5870944 - DNA, 15 bp, Homo sapiens
cccctgtaggcctca

SEQ ID NO: 5870945 - DNA, 22 bp, Homo sapiens
cccctgtagggaaaccttggag

SEQ ID NO: 5870946 - DNA, 21 bp, Homo sapiens
cccctgtcccaccaactctgc

SEQ ID NO: 5870947 - DNA, 16 bp, Homo sapiens
cccctgtcccacctgg

SEQ ID NO: 5870948 - DNA, 21 bp, Homo sapiens
cccctgtcccacctggctccc

SEQ ID NO: 5870949 - DNA, 19 bp, Homo sapiens
cccctgtcccattctagat

SEQ ID NO: 5870950 - DNA, 15 bp, Homo sapiens
cccctgtccccagtc

SEQ ID NO: 5870951 - DNA, 16 bp, Homo sapiens
cccctgtccccagtcc

SEQ ID NO: 5870952 - DNA, 17 bp, Homo sapiens
cccctgtcccctcagct

SEQ ID NO: 5870953 - DNA, 14 bp, Homo sapiens
cccctgtcccctgg

SEQ ID NO: 5870954 - DNA, 18 bp, Homo sapiens
cccctgtcccctggggct

SEQ ID NO: 5870955 - DNA, 14 bp, Homo sapiens
cccctgtcctcact

SEQ ID NO: 5870956 - DNA, 15 bp, Homo sapiens
cccctgtcctcactg

SEQ ID NO: 5870957 - DNA, 16 bp, Homo sapiens
cccctgtcctcactgc

SEQ ID NO: 5870958 - DNA, 20 bp, Homo sapiens
cccctgtccttcccacggcc

SEQ ID NO: 5870959 - DNA, 23 bp, Homo sapiens
cccctgtctctcagggccaggcc

SEQ ID NO: 5870960 - DNA, 19 bp, Homo sapiens
cccctgtctgcgccgctgt

SEQ ID NO: 5870961 - DNA, 23 bp, Homo sapiens
cccctgtctgcgccgctgtgctg

SEQ ID NO: 5870962 - DNA, 16 bp, Homo sapiens
cccctgtctgttccca

SEQ ID NO: 5870963 - DNA, 18 bp, Homo sapiens
cccctgtctgttcccagc

SEQ ID NO: 5870964 - DNA, 19 bp, Homo sapiens
cccctgtctgttcccagcc

SEQ ID NO: 5870965 - DNA, 22 bp, Homo sapiens
cccctgtctgttcccagcccct

SEQ ID NO: 5870966 - DNA, 19 bp, Homo sapiens
cccctgtgaccctctcact

SEQ ID NO: 5870967 - DNA, 14 bp, Homo sapiens
ccccttttgcctgg

SEQ ID NO: 5870968 - DNA, 23 bp, Homo sapiens
ccccttttgcctggctgtggagg

SEQ ID NO: 5870969 - DNA, 18 bp, Homo sapiens
cccctttttactcccctt

SEQ ID NO: 5870970 - DNA, 22 bp, Homo sapiens
cccgaaagaggcacccttccat

SEQ ID NO: 5870971 - DNA, 13 bp, Homo sapiens
cccgaaagcatca

SEQ ID NO: 5870972 - DNA, 20 bp, Homo sapiens
cccgaaaggtcacctcactc

SEQ ID NO: 5870973 - DNA, 22 bp, Homo sapiens
cccgaacgctctgcaccttctg

SEQ ID NO: 5870974 - DNA, 20 bp, Homo sapiens
cccgaactcgcggcaaaatt

SEQ ID NO: 5870975 - DNA, 21 bp, Homo sapiens
cccgaagaatgaacccaagag

SEQ ID NO: 5870976 - DNA, 20 bp, Homo sapiens
cccgaagaatggagaggaac

SEQ ID NO: 5870977 - DNA, 18 bp, Homo sapiens
cccgaagacactccttcc

SEQ ID NO: 5870978 - DNA, 21 bp, Homo sapiens
cccgaagccatcacttctccc

SEQ ID NO: 5870979 - DNA, 15 bp, Homo sapiens
cccgaagggccccca

SEQ ID NO: 5870980 - DNA, 18 bp, Homo sapiens
cccgaagggcccccacat

SEQ ID NO: 5870981 - DNA, 23 bp, Homo sapiens
cccgaaggttatggtcaatccca

SEQ ID NO: 5870982 - DNA, 14 bp, Homo sapiens
cccgaagtcctgtc

SEQ ID NO: 5870983 - DNA, 15 bp, Homo sapiens
cccgaagtcctgtca

SEQ ID NO: 5870984 - DNA, 17 bp, Homo sapiens
cccgaagtcctgtcact

SEQ ID NO: 5870985 - DNA, 19 bp, Homo sapiens
cccgaagtcctgtcactga

SEQ ID NO: 5870986 - DNA, 23 bp, Homo sapiens
cccgaagtcctgtcactgagcac

SEQ ID NO: 5870987 - DNA, 20 bp, Homo sapiens
cccgaatacaaacacctgga

SEQ ID NO: 5870988 - DNA, 14 bp, Homo sapiens
cccgaatcctgagg

SEQ ID NO: 5870989 - DNA, 13 bp, Homo sapiens
cccgaatgcctgt

SEQ ID NO: 5870990 - DNA, 22 bp, Homo sapiens
cccgaatggagtccagacctgg

SEQ ID NO: 5870991 - DNA, 23 bp, Homo sapiens
cccgaattctatttttgtccttg

SEQ ID NO: 5870992 - DNA, 14 bp, Homo sapiens
cccgacactctcac

SEQ ID NO: 5870993 - DNA, 14 bp, Homo sapiens
cccgacactgctgc

SEQ ID NO: 5870994 - DNA, 19 bp, Homo sapiens
cccgacactgctgcaccag

SEQ ID NO: 5870995 - DNA, 12 bp, Homo sapiens
cccgacagaggg

SEQ ID NO: 5870996 - DNA, 15 bp, Homo sapiens
cccgacagagggaag

SEQ ID NO: 5870997 - DNA, 12 bp, Homo sapiens
cccgacagccca

SEQ ID NO: 5870998 - DNA, 13 bp, Homo sapiens
cccgacagcccag

SEQ ID NO: 5870999 - DNA, 13 bp, Homo sapiens
cccgacaggtggg

SEQ ID NO: 5871000 - DNA, 18 bp, Homo sapiens
cccgacaggtgggcctgg

SEQ ID NO: 5871001 - DNA, 19 bp, Homo sapiens
cccgacaggtgggcctggg

SEQ ID NO: 5871002 - DNA, 19 bp, Homo sapiens
cccgacagtgccatcccca

SEQ ID NO: 5871003 - DNA, 20 bp, Homo sapiens
cccgacatggacccggagct

SEQ ID NO: 5871004 - DNA, 12 bp, Homo sapiens
cccgacatggct

SEQ ID NO: 5871005 - DNA, 16 bp, Homo sapiens
cccgaccaatccccag

SEQ ID NO: 5871006 - DNA, 11 bp, Homo sapiens
cccgaccaggt

SEQ ID NO: 5871007 - DNA, 14 bp, Homo sapiens
cccgacccagccag

SEQ ID NO: 5871008 - DNA, 21 bp, Homo sapiens
cccgacccagccagctgcagg

SEQ ID NO: 5871009 - DNA, 23 bp, Homo sapiens
cccgacccagccagctgcagggc

SEQ ID NO: 5871010 - DNA, 14 bp, Homo sapiens
cccgaccccatctc

SEQ ID NO: 5871011 - DNA, 13 bp, Homo sapiens
cccgaccctgccc

SEQ ID NO: 5871012 - DNA, 14 bp, Homo sapiens
cccgacctggctgc

SEQ ID NO: 5871013 - DNA, 19 bp, Homo sapiens
cccgacctggctgcccctc

SEQ ID NO: 5871014 - DNA, 23 bp, Homo sapiens
cccgacgccacagcccagccacg

SEQ ID NO: 5871015 - DNA, 17 bp, Homo sapiens
cccgacgctctctctcg

SEQ ID NO: 5871016 - DNA, 14 bp, Homo sapiens
cccgacggcctcca

SEQ ID NO: 5871017 - DNA, 15 bp, Homo sapiens
cccgacggcctccag

SEQ ID NO: 5871018 - DNA, 19 bp, Homo sapiens
cccgacggcctccaggagg

SEQ ID NO: 5871019 - DNA, 13 bp, Homo sapiens
cccgacggctgtg

SEQ ID NO: 5871020 - DNA, 14 bp, Homo sapiens
cccgacggctgtga

SEQ ID NO: 5871021 - DNA, 17 bp, Homo sapiens
cccgacgtgctcccctg

SEQ ID NO: 5871022 - DNA, 19 bp, Homo sapiens
cccgacgtttgcggcagtg

SEQ ID NO: 5871023 - DNA, 20 bp, Homo sapiens
cccgacgtttgcggcagtgt

SEQ ID NO: 5871024 - DNA, 16 bp, Homo sapiens
cccgactccagccagc

SEQ ID NO: 5871025 - DNA, 14 bp, Homo sapiens
cccgactcctcaaa

SEQ ID NO: 5871026 - DNA, 12 bp, Homo sapiens
cccgactctctc

SEQ ID NO: 5871027 - DNA, 16 bp, Homo sapiens
cccgactgaccactgg

SEQ ID NO: 5871028 - DNA, 12 bp, Homo sapiens
cccgactgcctg

SEQ ID NO: 5871029 - DNA, 17 bp, Homo sapiens
cccgactggggcagggt

SEQ ID NO: 5871030 - DNA, 13 bp, Homo sapiens
cccgactgtgctg

SEQ ID NO: 5871031 - DNA, 14 bp, Homo sapiens
cccgactgtttatt

SEQ ID NO: 5871032 - DNA, 21 bp, Homo sapiens
cccgacttcttttgaaatgtg

SEQ ID NO: 5871033 - DNA, 17 bp, Homo sapiens
cccgagaaccctgagca

SEQ ID NO: 5871034 - DNA, 14 bp, Homo sapiens
cccgagaagtgctc

SEQ ID NO: 5871035 - DNA, 19 bp, Homo sapiens
cccgagaagtgctcttggc

SEQ ID NO: 5871036 - DNA, 18 bp, Homo sapiens
cccgagacacaggcacgg

SEQ ID NO: 5871037 - DNA, 15 bp, Homo sapiens
cccgagacaccatcc

SEQ ID NO: 5871038 - DNA, 16 bp, Homo sapiens
cccgagacaccatcct

SEQ ID NO: 5871039 - DNA, 21 bp, Homo sapiens
cccgagacaccatcctgagcc

SEQ ID NO: 5871040 - DNA, 14 bp, Homo sapiens
cccgagacctcact

SEQ ID NO: 5871041 - DNA, 20 bp, Homo sapiens
cccgagagagaccccaccgc

SEQ ID NO: 5871042 - DNA, 17 bp, Homo sapiens
cccgagagagctctggc

SEQ ID NO: 5871043 - DNA, 20 bp, Homo sapiens
cccgagagagctctggcccc

SEQ ID NO: 5871044 - DNA, 15 bp, Homo sapiens
cccgagagcctcgct

SEQ ID NO: 5871045 - DNA, 12 bp, Homo sapiens
cccgagcagctg

SEQ ID NO: 5871046 - DNA, 15 bp, Homo sapiens
cccgagcagctgagc

SEQ ID NO: 5871047 - DNA, 18 bp, Homo sapiens
cccgagccctgactcctg

SEQ ID NO: 5871048 - DNA, 18 bp, Homo sapiens
cccgagccgagctctcct

SEQ ID NO: 5871049 - DNA, 13 bp, Homo sapiens
cccgagcctggct

SEQ ID NO: 5871050 - DNA, 19 bp, Homo sapiens
cccgagcgcgtgccttccc

SEQ ID NO: 5871051 - DNA, 20 bp, Homo sapiens
cccgagcgcgtgccttcccc

SEQ ID NO: 5871052 - DNA, 23 bp, Homo sapiens
cccgagctactctcttgccagca

SEQ ID NO: 5871053 - DNA, 14 bp, Homo sapiens
cccgagctcctctt

SEQ ID NO: 5871054 - DNA, 16 bp, Homo sapiens
cccgagctcttggcct

SEQ ID NO: 5871055 - DNA, 20 bp, Homo sapiens
cccgagctgggggccatgag

SEQ ID NO: 5871056 - DNA, 23 bp, Homo sapiens
cccgagctgggggccatgagctc

SEQ ID NO: 5871057 - DNA, 23 bp, Homo sapiens
cccgagctggggggttggcagcc

SEQ ID NO: 5871058 - DNA, 17 bp, Homo sapiens
cccgagcttgcctcagg

SEQ ID NO: 5871059 - DNA, 22 bp, Homo sapiens
cccgaggaagcacagcttgggt

SEQ ID NO: 5871060 - DNA, 18 bp, Homo sapiens
cccgaggacccagaccca

SEQ ID NO: 5871061 - DNA, 14 bp, Homo sapiens
cccgaggaggccga

SEQ ID NO: 5871062 - DNA, 12 bp, Homo sapiens
cccgaggagggg

SEQ ID NO: 5871063 - DNA, 17 bp, Homo sapiens
cccgaggaggggcccgg

SEQ ID NO: 5871064 - DNA, 19 bp, Homo sapiens
cccgaggcagcaacaggac

SEQ ID NO: 5871065 - DNA, 22 bp, Homo sapiens
cccgaggcagcaacaggaccag

SEQ ID NO: 5871066 - DNA, 23 bp, Homo sapiens
cccgaggcagcaacaggaccagg

SEQ ID NO: 5871067 - DNA, 15 bp, Homo sapiens
cccgaggcccccctc

SEQ ID NO: 5871068 - DNA, 19 bp, Homo sapiens
cccgaggcccccctctgcc

SEQ ID NO: 5871069 - DNA, 20 bp, Homo sapiens
cccgaggcccccctctgcct

SEQ ID NO: 5871070 - DNA, 23 bp, Homo sapiens
cccgaggcccccctctgcctttg

SEQ ID NO: 5871071 - DNA, 15 bp, Homo sapiens
cccgaggcccgcatg

SEQ ID NO: 5871072 - DNA, 13 bp, Homo sapiens
cccgaggccctgc

SEQ ID NO: 5871073 - DNA, 16 bp, Homo sapiens
cccgaggccctgcatg

SEQ ID NO: 5871074 - DNA, 12 bp, Homo sapiens
cccgaggctgcc

SEQ ID NO: 5871075 - DNA, 14 bp, Homo sapiens
cccgaggctgccca

SEQ ID NO: 5871076 - DNA, 15 bp, Homo sapiens
cccgaggctgcccca

SEQ ID NO: 5871077 - DNA, 19 bp, Homo sapiens
cccgaggctgggacactgt

SEQ ID NO: 5871078 - DNA, 20 bp, Homo sapiens
cccgagggatgatgccacac

SEQ ID NO: 5871079 - DNA, 13 bp, Homo sapiens
cccgagggatggt

SEQ ID NO: 5871080 - DNA, 23 bp, Homo sapiens
cccgagggctgagcctggtccca

SEQ ID NO: 5871081 - DNA, 17 bp, Homo sapiens
cccgaggggggccccgg

SEQ ID NO: 5871082 - DNA, 17 bp, Homo sapiens
cccgaggtggctgcctg

SEQ ID NO: 5871083 - DNA, 22 bp, Homo sapiens
cccgaggtggctgcctggagcc

SEQ ID NO: 5871084 - DNA, 15 bp, Homo sapiens
cccgagtacagtctg

SEQ ID NO: 5871085 - DNA, 14 bp, Homo sapiens
cccgagtacctcca

SEQ ID NO: 5871086 - DNA, 13 bp, Homo sapiens
cccgagtagctgg

SEQ ID NO: 5871087 - DNA, 14 bp, Homo sapiens
cccgagtagctggg

SEQ ID NO: 5871088 - DNA, 18 bp, Homo sapiens
cccgagtagctgggacta

SEQ ID NO: 5871089 - DNA, 22 bp, Homo sapiens
cccgagtagctgggactacagg

SEQ ID NO: 5871090 - DNA, 15 bp, Homo sapiens
cccgagtcctcaggt

SEQ ID NO: 5871091 - DNA, 18 bp, Homo sapiens
cccgagtctgggacacaa

SEQ ID NO: 5871092 - DNA, 19 bp, Homo sapiens
cccgagtgcggcgtggaga

SEQ ID NO: 5871093 - DNA, 21 bp, Homo sapiens
cccgagtgcggcgtggagact

SEQ ID NO: 5871094 - DNA, 23 bp, Homo sapiens
cccgatacctcagccctggccct

SEQ ID NO: 5871095 - DNA, 24 bp, Homo sapiens
cccgatacctcagccctggccctg

SEQ ID NO: 5871096 - DNA, 20 bp, Homo sapiens
cccgatatattttagcattt

SEQ ID NO: 5871097 - DNA, 16 bp, Homo sapiens
cccgatattctccctg

SEQ ID NO: 5871098 - DNA, 18 bp, Homo sapiens
cccgatccagattcccag

SEQ ID NO: 5871099 - DNA, 20 bp, Homo sapiens
cccgatgctgctttcccctg

SEQ ID NO: 5871100 - DNA, 13 bp, Homo sapiens
cccgatggggcat

SEQ ID NO: 5871101 - DNA, 16 bp, Homo sapiens
cccgatggtctctctc

SEQ ID NO: 5871102 - DNA, 21 bp, Homo sapiens
cccgatggtctctctccctct

SEQ ID NO: 5871103 - DNA, 16 bp, Homo sapiens
cccgatgtgagccgcc

SEQ ID NO: 5871104 - DNA, 16 bp, Homo sapiens
cccgatgtggacctct

SEQ ID NO: 5871105 - DNA, 19 bp, Homo sapiens
cccgcaaaccccctttgtg

SEQ ID NO: 5871106 - DNA, 19 bp, Homo sapiens
cccgcaacccacagctcag

SEQ ID NO: 5871107 - DNA, 17 bp, Homo sapiens
cccgcaactctccagcc

SEQ ID NO: 5871108 - DNA, 18 bp, Homo sapiens
cccgcacaaagcggctct

SEQ ID NO: 5871109 - DNA, 13 bp, Homo sapiens
cccgcacagcagc

SEQ ID NO: 5871110 - DNA, 14 bp, Homo sapiens
cccgcacagcagcc

SEQ ID NO: 5871111 - DNA, 15 bp, Homo sapiens
cccgcacagcagcct

SEQ ID NO: 5871112 - DNA, 12 bp, Homo sapiens
cccgcaccccag

SEQ ID NO: 5871113 - DNA, 13 bp, Homo sapiens
cccgcacccccac

SEQ ID NO: 5871114 - DNA, 15 bp, Homo sapiens
cccgcacccccgcca

SEQ ID NO: 5871115 - DNA, 18 bp, Homo sapiens
cccgcacccccgccaggc

SEQ ID NO: 5871116 - DNA, 16 bp, Homo sapiens
cccgcacccctcctcc

SEQ ID NO: 5871117 - DNA, 19 bp, Homo sapiens
cccgcacccctcctccttg

SEQ ID NO: 5871118 - DNA, 20 bp, Homo sapiens
cccgcacgactgcgggagcc

SEQ ID NO: 5871119 - DNA, 16 bp, Homo sapiens
cccgcacgcaagcctc

SEQ ID NO: 5871120 - DNA, 24 bp, Homo sapiens
cccgcacgcaagcctcagccactc

SEQ ID NO: 5871121 - DNA, 15 bp, Homo sapiens
cccgcactcaggagc

SEQ ID NO: 5871122 - DNA, 16 bp, Homo sapiens
cccgcactcaggagca

SEQ ID NO: 5871123 - DNA, 21 bp, Homo sapiens
cccgcactcaggagcacagcc

SEQ ID NO: 5871124 - DNA, 15 bp, Homo sapiens
cccgcactgcagacg

SEQ ID NO: 5871125 - DNA, 15 bp, Homo sapiens
cccgcagacagacag

SEQ ID NO: 5871126 - DNA, 16 bp, Homo sapiens
cccgcagacagacaga

SEQ ID NO: 5871127 - DNA, 15 bp, Homo sapiens
cccgcagacctctgg

SEQ ID NO: 5871128 - DNA, 17 bp, Homo sapiens
cccgcagacctctggat

SEQ ID NO: 5871129 - DNA, 19 bp, Homo sapiens
cccgcagacggtctgtgtg

SEQ ID NO: 5871130 - DNA, 13 bp, Homo sapiens
cccgcagagcgcg

SEQ ID NO: 5871131 - DNA, 23 bp, Homo sapiens
cccgcagaggtggggtgctgggg

SEQ ID NO: 5871132 - DNA, 21 bp, Homo sapiens
cccgcagatggctggaatatt

SEQ ID NO: 5871133 - DNA, 12 bp, Homo sapiens
cccgcagcacca

SEQ ID NO: 5871134 - DNA, 13 bp, Homo sapiens
cccgcagcaccag

SEQ ID NO: 5871135 - DNA, 14 bp, Homo sapiens
cccgcagcaccagc

SEQ ID NO: 5871136 - DNA, 15 bp, Homo sapiens
cccgcagcaccagcc

SEQ ID NO: 5871137 - DNA, 16 bp, Homo sapiens
cccgcagcaccagcct

SEQ ID NO: 5871138 - DNA, 22 bp, Homo sapiens
cccgcagcaccagcctgagcca

SEQ ID NO: 5871139 - DNA, 14 bp, Homo sapiens
cccgcagcacgcct

SEQ ID NO: 5871140 - DNA, 18 bp, Homo sapiens
cccgcagcacgcctctcc

SEQ ID NO: 5871141 - DNA, 23 bp, Homo sapiens
cccgcagcctggcatctgtgcgt

SEQ ID NO: 5871142 - DNA, 18 bp, Homo sapiens
cccgcaggaactgggctg

SEQ ID NO: 5871143 - DNA, 20 bp, Homo sapiens
cccgcaggatccctcctgag

SEQ ID NO: 5871144 - DNA, 23 bp, Homo sapiens
cccgcaggcttcgtttgcctcca

SEQ ID NO: 5871145 - DNA, 16 bp, Homo sapiens
cccgggcccagaggag

SEQ ID NO: 5871146 - DNA, 14 bp, Homo sapiens
cccgggcccaggca

SEQ ID NO: 5871147 - DNA, 20 bp, Homo sapiens
cccgggcccgttgaggatga

SEQ ID NO: 5871148 - DNA, 11 bp, Homo sapiens
cccgggccctc

SEQ ID NO: 5871149 - DNA, 14 bp, Homo sapiens
cccgggccctcagc

SEQ ID NO: 5871150 - DNA, 15 bp, Homo sapiens
cccgggccctcctgg

SEQ ID NO: 5871151 - DNA, 23 bp, Homo sapiens
cccgggcccttcagtccctgagc

SEQ ID NO: 5871152 - DNA, 16 bp, Homo sapiens
cccgggccgaccctgc

SEQ ID NO: 5871153 - DNA, 14 bp, Homo sapiens
cccgggccggacct

SEQ ID NO: 5871154 - DNA, 14 bp, Homo sapiens
cccgggcctgaccc

SEQ ID NO: 5871155 - DNA, 16 bp, Homo sapiens
cccgggcctgcacaga

SEQ ID NO: 5871156 - DNA, 13 bp, Homo sapiens
cccgggcctgcct

SEQ ID NO: 5871157 - DNA, 15 bp, Homo sapiens
cccgggcctgcctct

SEQ ID NO: 5871158 - DNA, 15 bp, Homo sapiens
cccgggctctggcca

SEQ ID NO: 5871159 - DNA, 20 bp, Homo sapiens
cccgggctctggccaccctg

SEQ ID NO: 5871160 - DNA, 13 bp, Homo sapiens
cccgggctggaga

SEQ ID NO: 5871161 - DNA, 14 bp, Homo sapiens
cccgggctggagaa

SEQ ID NO: 5871162 - DNA, 21 bp, Homo sapiens
cccgggctggagaaagagctg

SEQ ID NO: 5871163 - DNA, 18 bp, Homo sapiens
cccggggaccctgtgaca

SEQ ID NO: 5871164 - DNA, 18 bp, Homo sapiens
cccggggagctgcagagc

SEQ ID NO: 5871165 - DNA, 20 bp, Homo sapiens
cccggggagctgcagagcag

SEQ ID NO: 5871166 - DNA, 13 bp, Homo sapiens
cccggggagtttc

SEQ ID NO: 5871167 - DNA, 12 bp, Homo sapiens
cccggggcagca

SEQ ID NO: 5871168 - DNA, 12 bp, Homo sapiens
cccggggcagct

SEQ ID NO: 5871169 - DNA, 21 bp, Homo sapiens
cccggggcatggacagggcca

SEQ ID NO: 5871170 - DNA, 14 bp, Homo sapiens
cccggggccagcac

SEQ ID NO: 5871171 - DNA, 21 bp, Homo sapiens
cccggggccagcttggcaggg

SEQ ID NO: 5871172 - DNA, 14 bp, Homo sapiens
cccggggcccagga

SEQ ID NO: 5871173 - DNA, 15 bp, Homo sapiens
cccggggcccagggg

SEQ ID NO: 5871174 - DNA, 13 bp, Homo sapiens
cccggggccccct

SEQ ID NO: 5871175 - DNA, 20 bp, Homo sapiens
cccggggcccttcctcgcac

SEQ ID NO: 5871176 - DNA, 12 bp, Homo sapiens
cccggggcctgg

SEQ ID NO: 5871177 - DNA, 23 bp, Homo sapiens
cccggggccttccttttgaggag

SEQ ID NO: 5871178 - DNA, 12 bp, Homo sapiens
cccggggctggc

SEQ ID NO: 5871179 - DNA, 23 bp, Homo sapiens
cccggggctggcaagcagggaaa

SEQ ID NO: 5871180 - DNA, 21 bp, Homo sapiens
cccgggggacgcctgccctgc

SEQ ID NO: 5871181 - DNA, 22 bp, Homo sapiens
cccgggggacgcctgccctgcc

SEQ ID NO: 5871182 - DNA, 18 bp, Homo sapiens
cccgggggagcccagtga

SEQ ID NO: 5871183 - DNA, 16 bp, Homo sapiens
cccgggggtccccgga

SEQ ID NO: 5871184 - DNA, 14 bp, Homo sapiens
cccggggtctccac

SEQ ID NO: 5871185 - DNA, 15 bp, Homo sapiens
cccggggtctcctgg

SEQ ID NO: 5871186 - DNA, 19 bp, Homo sapiens
cccggggtctcctggacct

SEQ ID NO: 5871187 - DNA, 19 bp, Homo sapiens
cccgggtactcagtcagcc

SEQ ID NO: 5871188 - DNA, 23 bp, Homo sapiens
cccgggtactcagtcagcccagt

SEQ ID NO: 5871189 - DNA, 16 bp, Homo sapiens
cccgggtccaggagaa

SEQ ID NO: 5871190 - DNA, 12 bp, Homo sapiens
cccgggtcccac

SEQ ID NO: 5871191 - DNA, 17 bp, Homo sapiens
cccgggtccccagctcc

SEQ ID NO: 5871192 - DNA, 12 bp, Homo sapiens
cccgggtgcagg

SEQ ID NO: 5871193 - DNA, 22 bp, Homo sapiens
cccgggtgtgcctgccctggag

SEQ ID NO: 5871194 - DNA, 22 bp, Homo sapiens
cccgggttcacgccattctcct

SEQ ID NO: 5871195 - DNA, 18 bp, Homo sapiens
cccgggttcagcctggcc

SEQ ID NO: 5871196 - DNA, 19 bp, Homo sapiens
cccgggttcagcctggcct

SEQ ID NO: 5871197 - DNA, 22 bp, Homo sapiens
cccgggtttggctgagcctggc

SEQ ID NO: 5871198 - DNA, 17 bp, Homo sapiens
cccggtcagtcagagaa

SEQ ID NO: 5871199 - DNA, 13 bp, Homo sapiens
cccggtccacagg

SEQ ID NO: 5871200 - DNA, 17 bp, Homo sapiens
cccggtccacaggtcca

SEQ ID NO: 5871201 - DNA, 20 bp, Homo sapiens
cccggtcccacccctccctc

SEQ ID NO: 5871202 - DNA, 13 bp, Homo sapiens
cccggtcccccag

SEQ ID NO: 5871203 - DNA, 14 bp, Homo sapiens
cccggtcccccaga

SEQ ID NO: 5871204 - DNA, 17 bp, Homo sapiens
cccggtcccccagagca

SEQ ID NO: 5871205 - DNA, 22 bp, Homo sapiens
cccggtcccttgagacctcagc

SEQ ID NO: 5871206 - DNA, 17 bp, Homo sapiens
cccggtcctggccccag

SEQ ID NO: 5871207 - DNA, 13 bp, Homo sapiens
cccggtgaggcca

SEQ ID NO: 5871208 - DNA, 17 bp, Homo sapiens
cccggtggcggcagggc

SEQ ID NO: 5871209 - DNA, 18 bp, Homo sapiens
cccggtggcggcagggcc

SEQ ID NO: 5871210 - DNA, 14 bp, Homo sapiens
cccggtggcttctg

SEQ ID NO: 5871211 - DNA, 18 bp, Homo sapiens
cccggtggtttgccatgt

SEQ ID NO: 5871212 - DNA, 14 bp, Homo sapiens
cccggtgtgaggag

SEQ ID NO: 5871213 - DNA, 16 bp, Homo sapiens
cccggtgtggtggctc

SEQ ID NO: 5871214 - DNA, 21 bp, Homo sapiens
cccggttccctccccagctcc

SEQ ID NO: 5871215 - DNA, 14 bp, Homo sapiens
cccggttgctggtc

SEQ ID NO: 5871216 - DNA, 18 bp, Homo sapiens
cccggttgctggtcaggt

SEQ ID NO: 5871217 - DNA, 15 bp, Homo sapiens
cccggtttcagaagc

SEQ ID NO: 5871218 - DNA, 16 bp, Homo sapiens
cccggtttcagaagct

SEQ ID NO: 5871219 - DNA, 20 bp, Homo sapiens
cccgtaaaaactatctgaaa

SEQ ID NO: 5871220 - DNA, 22 bp, Homo sapiens
cccgtactttgtcccgtggcat

SEQ ID NO: 5871221 - DNA, 15 bp, Homo sapiens
cccgtagccagtcta

SEQ ID NO: 5871222 - DNA, 13 bp, Homo sapiens
cccgtagccccgg

SEQ ID NO: 5871223 - DNA, 19 bp, Homo sapiens
cccgtaggcagcctctctg

SEQ ID NO: 5871224 - DNA, 15 bp, Homo sapiens
cccgtagtctcctgg

SEQ ID NO: 5871225 - DNA, 14 bp, Homo sapiens
cccgtcagcatcac

SEQ ID NO: 5871226 - DNA, 12 bp, Homo sapiens
cccgtcagctgc

SEQ ID NO: 5871227 - DNA, 22 bp, Homo sapiens
cccgtcagctgcttctgctgcc

SEQ ID NO: 5871228 - DNA, 19 bp, Homo sapiens
cccgtcaggacgttgagga

SEQ ID NO: 5871229 - DNA, 18 bp, Homo sapiens
cccgtcaggccacagccc

SEQ ID NO: 5871230 - DNA, 17 bp, Homo sapiens
cccgtccccccatcccg

SEQ ID NO: 5871231 - DNA, 19 bp, Homo sapiens
cccgtccccctagagactc

SEQ ID NO: 5871232 - DNA, 19 bp, Homo sapiens
cccgtcccctaacccccag

SEQ ID NO: 5871233 - DNA, 23 bp, Homo sapiens
cccgtcccctaacccccagtcct

SEQ ID NO: 5871234 - DNA, 15 bp, Homo sapiens
cccgtcccctgcagc

SEQ ID NO: 5871235 - DNA, 19 bp, Homo sapiens
cccgtcccctgcagcctgg

SEQ ID NO: 5871236 - DNA, 11 bp, Homo sapiens
cccgtccctgc

SEQ ID NO: 5871237 - DNA, 12 bp, Homo sapiens
cccgtccctgcc

SEQ ID NO: 5871238 - DNA, 15 bp, Homo sapiens
cccgtcctccctcag

SEQ ID NO: 5871239 - DNA, 20 bp, Homo sapiens
cccgtcctccctcagcctcc

SEQ ID NO: 5871240 - DNA, 12 bp, Homo sapiens
cccgtcctcctc

SEQ ID NO: 5871241 - DNA, 22 bp, Homo sapiens
cccgtcctctcggctgccaggg

SEQ ID NO: 5871242 - DNA, 18 bp, Homo sapiens
cccgtcgcgctggacagc

SEQ ID NO: 5871243 - DNA, 12 bp, Homo sapiens
cccgtcggagct

SEQ ID NO: 5871244 - DNA, 22 bp, Homo sapiens
cccgtcggagctgcctgcagca

SEQ ID NO: 5871245 - DNA, 12 bp, Homo sapiens
cccgtcggccct

SEQ ID NO: 5871246 - DNA, 14 bp, Homo sapiens
cccgtcggccctgc

SEQ ID NO: 5871247 - DNA, 14 bp, Homo sapiens
cccgtcgtgcagtc

SEQ ID NO: 5871248 - DNA, 17 bp, Homo sapiens
cccgtctccagctgctg

SEQ ID NO: 5871249 - DNA, 23 bp, Homo sapiens
cccgtctcctgagggtcctgctg

SEQ ID NO: 5871250 - DNA, 14 bp, Homo sapiens
cccgtctcgcctgc

SEQ ID NO: 5871251 - DNA, 19 bp, Homo sapiens
cccgtctctactaaaaata

SEQ ID NO: 5871252 - DNA, 12 bp, Homo sapiens
cccgtctctctc

SEQ ID NO: 5871253 - DNA, 15 bp, Homo sapiens
cccgtctctctccca

SEQ ID NO: 5871254 - DNA, 19 bp, Homo sapiens
cccgtctctcttggaccca

SEQ ID NO: 5871255 - DNA, 13 bp, Homo sapiens
cccgtctctgccc

SEQ ID NO: 5871256 - DNA, 13 bp, Homo sapiens
cccgtctgacccc

SEQ ID NO: 5871257 - DNA, 14 bp, Homo sapiens
cccgtctgattgtt

SEQ ID NO: 5871258 - DNA, 16 bp, Homo sapiens
cccgtctgcccaccat

SEQ ID NO: 5871259 - DNA, 20 bp, Homo sapiens
cccgtctggggttcagcccc

SEQ ID NO: 5871260 - DNA, 18 bp, Homo sapiens
cccgtctgtccatctgcc

SEQ ID NO: 5871261 - DNA, 19 bp, Homo sapiens
cccgtctgtccatctgccc

SEQ ID NO: 5871262 - DNA, 23 bp, Homo sapiens
cccgtctgtgtgtgacccctcct

SEQ ID NO: 5871263 - DNA, 12 bp, Homo sapiens
cccgtcttcagc

SEQ ID NO: 5871264 - DNA, 15 bp, Homo sapiens
cccgtcttcagccta

SEQ ID NO: 5871265 - DNA, 16 bp, Homo sapiens
cccgtcttcagcctag

SEQ ID NO: 5871266 - DNA, 20 bp, Homo sapiens
cccgtgaaagaattattttt

SEQ ID NO: 5871267 - DNA, 14 bp, Homo sapiens
cccgtgaagcagtg

SEQ ID NO: 5871268 - DNA, 19 bp, Homo sapiens
cccgtgacctgagatgtgt

SEQ ID NO: 5871269 - DNA, 20 bp, Homo sapiens
cccgtgacctgagatgtgtg

SEQ ID NO: 5871270 - DNA, 16 bp, Homo sapiens
cccgtgacgaggctca

SEQ ID NO: 5871271 - DNA, 17 bp, Homo sapiens
cccgtgacgaggctcaa

SEQ ID NO: 5871272 - DNA, 19 bp, Homo sapiens
cccgtgaggagggggagaa

SEQ ID NO: 5871273 - DNA, 16 bp, Homo sapiens
cccgtgcaaaacatgc

SEQ ID NO: 5871274 - DNA, 16 bp, Homo sapiens
cccgtgcatgctctgc

SEQ ID NO: 5871275 - DNA, 15 bp, Homo sapiens
cccgtgccaagtcca

SEQ ID NO: 5871276 - DNA, 21 bp, Homo sapiens
cccgtgccaagtccaggtcct

SEQ ID NO: 5871277 - DNA, 16 bp, Homo sapiens
cccgtgccacccccag

SEQ ID NO: 5871278 - DNA, 20 bp, Homo sapiens
cccgtgccacgcgctctgca

SEQ ID NO: 5871279 - DNA, 15 bp, Homo sapiens
cccgtgccaggagca

SEQ ID NO: 5871280 - DNA, 19 bp, Homo sapiens
cccgtgccaggagcaatgg

SEQ ID NO: 5871281 - DNA, 15 bp, Homo sapiens
cccgtgcccctggga

SEQ ID NO: 5871282 - DNA, 13 bp, Homo sapiens
cccgtgccctggt

SEQ ID NO: 5871283 - DNA, 11 bp, Homo sapiens
cccgtgcctgg

SEQ ID NO: 5871284 - DNA, 12 bp, Homo sapiens
cccgtgcctggg

SEQ ID NO: 5871285 - DNA, 15 bp, Homo sapiens
cccgtgcctgggaga

SEQ ID NO: 5871286 - DNA, 19 bp, Homo sapiens
cccgtgcctgggcccctcc

SEQ ID NO: 5871287 - DNA, 20 bp, Homo sapiens
cccgtgcggcccgtgcgcag

SEQ ID NO: 5871288 - DNA, 12 bp, Homo sapiens
cccgtgctcaca

SEQ ID NO: 5871289 - DNA, 17 bp, Homo sapiens
cccgtgctcacagtagc

SEQ ID NO: 5871290 - DNA, 22 bp, Homo sapiens
cccgtggatggtctccacctgt

SEQ ID NO: 5871291 - DNA, 18 bp, Homo sapiens
cccgtggccccagcctgg

SEQ ID NO: 5871292 - DNA, 22 bp, Homo sapiens
cccgtggccccagcctggccca

SEQ ID NO: 5871293 - DNA, 11 bp, Homo sapiens
cccgtggcctg

SEQ ID NO: 5871294 - DNA, 23 bp, Homo sapiens
cccgtggctctgggagagccagc

SEQ ID NO: 5871295 - DNA, 19 bp, Homo sapiens
cccgtggcttggcatctgt

SEQ ID NO: 5871296 - DNA, 23 bp, Homo sapiens
cccgtgggcgcaaaggtgcctca

SEQ ID NO: 5871297 - DNA, 14 bp, Homo sapiens
cccgtgggctcccg

SEQ ID NO: 5871298 - DNA, 14 bp, Homo sapiens
cccgtggggcaggg

SEQ ID NO: 5871299 - DNA, 21 bp, Homo sapiens
cccgtggggccggggcttctg

SEQ ID NO: 5871300 - DNA, 23 bp, Homo sapiens
cccgtggggctcccggcatcctg

SEQ ID NO: 5871301 - DNA, 12 bp, Homo sapiens
cccgtggtctct

SEQ ID NO: 5871302 - DNA, 17 bp, Homo sapiens
cccgtggtctttgaata

SEQ ID NO: 5871303 - DNA, 20 bp, Homo sapiens
cccgtggtctttgaataaag

SEQ ID NO: 5871304 - DNA, 12 bp, Homo sapiens
cccgtggtgaca

SEQ ID NO: 5871305 - DNA, 18 bp, Homo sapiens
cccgtgtaaaaagcctcc

SEQ ID NO: 5871306 - DNA, 20 bp, Homo sapiens
cccgtgtaaaaagcctcctt

SEQ ID NO: 5871307 - DNA, 20 bp, Homo sapiens
cccgtgtagccccgggctga

SEQ ID NO: 5871308 - DNA, 20 bp, Homo sapiens
cccgtgtaggaacctgcaca

SEQ ID NO: 5871309 - DNA, 18 bp, Homo sapiens
cccgtgtattcaggaccc

SEQ ID NO: 5871310 - DNA, 14 bp, Homo sapiens
cccgtgtcccccca

SEQ ID NO: 5871311 - DNA, 16 bp, Homo sapiens
cccgtgtccccccagg

SEQ ID NO: 5871312 - DNA, 21 bp, Homo sapiens
cccgtgtccccccaggtgctg

SEQ ID NO: 5871313 - DNA, 15 bp, Homo sapiens
cccgtgtcctgcctt

SEQ ID NO: 5871314 - DNA, 23 bp, Homo sapiens
cccgtgtcggttcttcctggaag

SEQ ID NO: 5871315 - DNA, 14 bp, Homo sapiens
cccgtgtggcccct

SEQ ID NO: 5871316 - DNA, 14 bp, Homo sapiens
cccgtgtggcctgg

SEQ ID NO: 5871317 - DNA, 17 bp, Homo sapiens
cccgtgtggcctgggtc

SEQ ID NO: 5871318 - DNA, 21 bp, Homo sapiens
cccgtgtggtaccttcagccc

SEQ ID NO: 5871319 - DNA, 22 bp, Homo sapiens
cccgtgtggtaccttcagccct

SEQ ID NO: 5871320 - DNA, 11 bp, Homo sapiens
cccgtgtgtgt

SEQ ID NO: 5871321 - DNA, 20 bp, Homo sapiens
cccgtgtgtgtgtatgtgtg

SEQ ID NO: 5871322 - DNA, 16 bp, Homo sapiens
cccgtgttcaggacac

SEQ ID NO: 5871323 - DNA, 23 bp, Homo sapiens
cccgtgttcccctcttgtctccc

SEQ ID NO: 5871324 - DNA, 16 bp, Homo sapiens
cccgttaatttaaagc

SEQ ID NO: 5871325 - DNA, 17 bp, Homo sapiens
ccctcagctctgtcctg

SEQ ID NO: 5871326 - DNA, 23 bp, Homo sapiens
ccctcagctctgtcctgttaggc

SEQ ID NO: 5871327 - DNA, 12 bp, Homo sapiens
ccctcagctctt

SEQ ID NO: 5871328 - DNA, 13 bp, Homo sapiens
ccctcagctgcct

SEQ ID NO: 5871329 - DNA, 14 bp, Homo sapiens
ccctcagctgtcac

SEQ ID NO: 5871330 - DNA, 17 bp, Homo sapiens
ccctcagctgtcacctg

SEQ ID NO: 5871331 - DNA, 21 bp, Homo sapiens
ccctcaggaccctcgctggcc

SEQ ID NO: 5871332 - DNA, 22 bp, Homo sapiens
ccctcaggaccctcgctggccc

SEQ ID NO: 5871333 - DNA, 23 bp, Homo sapiens
ccctcaggaccctcgctggcccc

SEQ ID NO: 5871334 - DNA, 13 bp, Homo sapiens
ccctcaggactgc

SEQ ID NO: 5871335 - DNA, 17 bp, Homo sapiens
ccctcaggcacaccttg

SEQ ID NO: 5871336 - DNA, 19 bp, Homo sapiens
ccctcaggcacaccttgca

SEQ ID NO: 5871337 - DNA, 14 bp, Homo sapiens
ccctcaggccagtg

SEQ ID NO: 5871338 - DNA, 16 bp, Homo sapiens
ccctcaggccagtgcc

SEQ ID NO: 5871339 - DNA, 19 bp, Homo sapiens
ccctcaggccagtgccagg

SEQ ID NO: 5871340 - DNA, 22 bp, Homo sapiens
ccctcaggccagtgccaggaca

SEQ ID NO: 5871341 - DNA, 15 bp, Homo sapiens
ccctcaggccattcc

SEQ ID NO: 5871342 - DNA, 16 bp, Homo sapiens
ccctcaggcccaggag

SEQ ID NO: 5871343 - DNA, 18 bp, Homo sapiens
ccctcaggcccaggagtc

SEQ ID NO: 5871344 - DNA, 13 bp, Homo sapiens
ccctcaggcttgg

SEQ ID NO: 5871345 - DNA, 18 bp, Homo sapiens
ccctcagggcaaagccag

SEQ ID NO: 5871346 - DNA, 19 bp, Homo sapiens
ccctcagggcaaagccagg

SEQ ID NO: 5871347 - DNA, 20 bp, Homo sapiens
ccctcagggcaaagccaggt

SEQ ID NO: 5871348 - DNA, 15 bp, Homo sapiens
ccctcaggggaaaac

SEQ ID NO: 5871349 - DNA, 16 bp, Homo sapiens
ccctcaggggaagctg

SEQ ID NO: 5871350 - DNA, 22 bp, Homo sapiens
ccctcaggggaagctgctaggg

SEQ ID NO: 5871351 - DNA, 13 bp, Homo sapiens
ccctcaggggcag

SEQ ID NO: 5871352 - DNA, 17 bp, Homo sapiens
ccctcagggggccagct

SEQ ID NO: 5871353 - DNA, 20 bp, Homo sapiens
ccctcagggggccagctggg

SEQ ID NO: 5871354 - DNA, 23 bp, Homo sapiens
ccctcagggggccagctggggag

SEQ ID NO: 5871355 - DNA, 15 bp, Homo sapiens
ccctcagggtccctg

SEQ ID NO: 5871356 - DNA, 16 bp, Homo sapiens
ccctcagggtccctgg

SEQ ID NO: 5871357 - DNA, 19 bp, Homo sapiens
ccctcagggtccctggtgg

SEQ ID NO: 5871358 - DNA, 19 bp, Homo sapiens
ccctcaggttctattttct

SEQ ID NO: 5871359 - DNA, 20 bp, Homo sapiens
ccctcaggttctattttctt

SEQ ID NO: 5871360 - DNA, 18 bp, Homo sapiens
ccctcagtcagttcccgg

SEQ ID NO: 5871361 - DNA, 14 bp, Homo sapiens
ccctcagtgcatcc

SEQ ID NO: 5871362 - DNA, 17 bp, Homo sapiens
ccctcagtgctcggcag

SEQ ID NO: 5871363 - DNA, 21 bp, Homo sapiens
ccctcagtgctcggcagtcat

SEQ ID NO: 5871364 - DNA, 15 bp, Homo sapiens
ccctcagtgggctcc

SEQ ID NO: 5871365 - DNA, 15 bp, Homo sapiens
ccctcagtgtgaagc

SEQ ID NO: 5871366 - DNA, 17 bp, Homo sapiens
ccctcagttgtgcagct

SEQ ID NO: 5871367 - DNA, 22 bp, Homo sapiens
ccctcagtttggtagtgcccca

SEQ ID NO: 5871368 - DNA, 21 bp, Homo sapiens
ccctcataaaccaatgtggca

SEQ ID NO: 5871369 - DNA, 23 bp, Homo sapiens
ccctcataagtttgtttaaacac

SEQ ID NO: 5871370 - DNA, 22 bp, Homo sapiens
ccctcatacccatgcacagtac

SEQ ID NO: 5871371 - DNA, 16 bp, Homo sapiens
ccctcatcaaggacac

SEQ ID NO: 5871372 - DNA, 18 bp, Homo sapiens
ccctcatcagccttttca

SEQ ID NO: 5871373 - DNA, 23 bp, Homo sapiens
ccctcatcagccttttcagcagg

SEQ ID NO: 5871374 - DNA, 21 bp, Homo sapiens
ccctcatcgcgtcctcctacc

SEQ ID NO: 5871375 - DNA, 20 bp, Homo sapiens
ccctcatctagtcttgacct

SEQ ID NO: 5871376 - DNA, 13 bp, Homo sapiens
ccctcatctctcc

SEQ ID NO: 5871377 - DNA, 17 bp, Homo sapiens
ccctcatctctctgccc

SEQ ID NO: 5871378 - DNA, 14 bp, Homo sapiens
ccctcatctgcagg

SEQ ID NO: 5871379 - DNA, 13 bp, Homo sapiens
ccctcatctgtct

SEQ ID NO: 5871380 - DNA, 18 bp, Homo sapiens
ccctcatcttgaagggcc

SEQ ID NO: 5871381 - DNA, 21 bp, Homo sapiens
ccctcatctttcatcaatcat

SEQ ID NO: 5871382 - DNA, 12 bp, Homo sapiens
ccctcatgctgt

SEQ ID NO: 5871383 - DNA, 21 bp, Homo sapiens
ccctcatggagaaacatccta

SEQ ID NO: 5871384 - DNA, 19 bp, Homo sapiens
ccctcatggcccccagggg

SEQ ID NO: 5871385 - DNA, 16 bp, Homo sapiens
ccctcatggcccctct

SEQ ID NO: 5871386 - DNA, 16 bp, Homo sapiens
ccctcatgttctcatg

SEQ ID NO: 5871387 - DNA, 18 bp, Homo sapiens
ccctcattactgggcctt

SEQ ID NO: 5871388 - DNA, 20 bp, Homo sapiens
ccctcattcagagactgccc

SEQ ID NO: 5871389 - DNA, 14 bp, Homo sapiens
ccctcattcatctt

SEQ ID NO: 5871390 - DNA, 15 bp, Homo sapiens
ccctcattcatcttg

SEQ ID NO: 5871391 - DNA, 13 bp, Homo sapiens
ccctcattcccct

SEQ ID NO: 5871392 - DNA, 14 bp, Homo sapiens
ccctcattctcatt

SEQ ID NO: 5871393 - DNA, 15 bp, Homo sapiens
ccctcattctcattt

SEQ ID NO: 5871394 - DNA, 15 bp, Homo sapiens
ccctcattgctgtct

SEQ ID NO: 5871395 - DNA, 17 bp, Homo sapiens
ccctcattgctgtcttg

SEQ ID NO: 5871396 - DNA, 20 bp, Homo sapiens
ccctcattgctgtcttgccc

SEQ ID NO: 5871397 - DNA, 21 bp, Homo sapiens
ccctcattgctgtcttgcccc

SEQ ID NO: 5871398 - DNA, 19 bp, Homo sapiens
ccctcattggctcttgaac

SEQ ID NO: 5871399 - DNA, 16 bp, Homo sapiens
ccctcatttctgccag

SEQ ID NO: 5871400 - DNA, 17 bp, Homo sapiens
ccctcatttttccttta

SEQ ID NO: 5871401 - DNA, 15 bp, Homo sapiens
ccctccaaacctcca

SEQ ID NO: 5871402 - DNA, 23 bp, Homo sapiens
ccctccaaatggagaagctgcag

SEQ ID NO: 5871403 - DNA, 12 bp, Homo sapiens
ccctccaacaca

SEQ ID NO: 5871404 - DNA, 21 bp, Homo sapiens
ccctccaagaccttctccttc

SEQ ID NO: 5871405 - DNA, 16 bp, Homo sapiens
ccctccaagcctggca

SEQ ID NO: 5871406 - DNA, 20 bp, Homo sapiens
ccctccaagcctggcaccca

SEQ ID NO: 5871407 - DNA, 21 bp, Homo sapiens
ccctccaagcctggcacccac

SEQ ID NO: 5871408 - DNA, 16 bp, Homo sapiens
ccctccaagggatctg

SEQ ID NO: 5871409 - DNA, 22 bp, Homo sapiens
ccctccaagtggtccacaagct

SEQ ID NO: 5871410 - DNA, 21 bp, Homo sapiens
ccctccacaaagcaaaggcag

SEQ ID NO: 5871411 - DNA, 13 bp, Homo sapiens
ccctccacacact

SEQ ID NO: 5871412 - DNA, 14 bp, Homo sapiens
ccctccacagctgc

SEQ ID NO: 5871413 - DNA, 16 bp, Homo sapiens
ccctccacagctgcag

SEQ ID NO: 5871414 - DNA, 22 bp, Homo sapiens
ccctccacagctgcagctgatc

SEQ ID NO: 5871415 - DNA, 17 bp, Homo sapiens
ccctccacaggagccgc

SEQ ID NO: 5871416 - DNA, 13 bp, Homo sapiens
ccctccacatccc

SEQ ID NO: 5871417 - DNA, 14 bp, Homo sapiens
ccctccacatccct

SEQ ID NO: 5871418 - DNA, 15 bp, Homo sapiens
ccctccacatccctg

SEQ ID NO: 5871419 - DNA, 15 bp, Homo sapiens
ccctccaccagcctg

SEQ ID NO: 5871420 - DNA, 18 bp, Homo sapiens
ccctccaccagcctgctg

SEQ ID NO: 5871421 - DNA, 20 bp, Homo sapiens
ccctccaccagcctgctgac

SEQ ID NO: 5871422 - DNA, 20 bp, Homo sapiens
ccctccacccatccagtgga

SEQ ID NO: 5871423 - DNA, 13 bp, Homo sapiens
ccctccaccccag

SEQ ID NO: 5871424 - DNA, 14 bp, Homo sapiens
ccctccaccgagcc

SEQ ID NO: 5871425 - DNA, 13 bp, Homo sapiens
ccctccacctcaa

SEQ ID NO: 5871426 - DNA, 12 bp, Homo sapiens
ccctccacctcc

SEQ ID NO: 5871427 - DNA, 19 bp, Homo sapiens
ccctccacctccctgcaat

SEQ ID NO: 5871428 - DNA, 15 bp, Homo sapiens
ccctccacctctcac

SEQ ID NO: 5871429 - DNA, 21 bp, Homo sapiens
ccctccacgcaaggctgtgct

SEQ ID NO: 5871430 - DNA, 21 bp, Homo sapiens
ccctccacgcctcctggccag

SEQ ID NO: 5871431 - DNA, 22 bp, Homo sapiens
ccctccacggtccgcggcctgc

SEQ ID NO: 5871432 - DNA, 17 bp, Homo sapiens
ccctccactcagctgtc

SEQ ID NO: 5871433 - DNA, 19 bp, Homo sapiens
ccctccactctgaggtctc

SEQ ID NO: 5871434 - DNA, 13 bp, Homo sapiens
ccctccactgccc

SEQ ID NO: 5871435 - DNA, 14 bp, Homo sapiens
ccctccactgccct

SEQ ID NO: 5871436 - DNA, 13 bp, Homo sapiens
ccctccagacccc

SEQ ID NO: 5871437 - DNA, 17 bp, Homo sapiens
ccctccagacccctacc

SEQ ID NO: 5871438 - DNA, 14 bp, Homo sapiens
ccctccagaccctg

SEQ ID NO: 5871439 - DNA, 15 bp, Homo sapiens
ccctccagaccctgc

SEQ ID NO: 5871440 - DNA, 22 bp, Homo sapiens
ccctccagaccctgcctgagcc

SEQ ID NO: 5871441 - DNA, 14 bp, Homo sapiens
ccctccagagaaag

SEQ ID NO: 5871442 - DNA, 16 bp, Homo sapiens
ccctccagagcaggag

SEQ ID NO: 5871443 - DNA, 11 bp, Homo sapiens
ccctccagagt

SEQ ID NO: 5871444 - DNA, 16 bp, Homo sapiens
ccctccagcacaaaca

SEQ ID NO: 5871445 - DNA, 18 bp, Homo sapiens
ccctccagcacaaacaca

SEQ ID NO: 5871446 - DNA, 13 bp, Homo sapiens
ccctccagcacac

SEQ ID NO: 5871447 - DNA, 23 bp, Homo sapiens
ccctccagcctttggccttggct

SEQ ID NO: 5871448 - DNA, 23 bp, Homo sapiens
ccctccagcgggacaccctggtt

SEQ ID NO: 5871449 - DNA, 13 bp, Homo sapiens
ccctccagctgcg

SEQ ID NO: 5871450 - DNA, 20 bp, Homo sapiens
ccctccagcttgtggagccc

SEQ ID NO: 5871451 - DNA, 11 bp, Homo sapiens
ccctccaggca

SEQ ID NO: 5871452 - DNA, 18 bp, Homo sapiens
ccctccaggcccatctca

SEQ ID NO: 5871453 - DNA, 15 bp, Homo sapiens
ccctccaggcctgca

SEQ ID NO: 5871454 - DNA, 19 bp, Homo sapiens
ccctccaggcctgcagggg

SEQ ID NO: 5871455 - DNA, 16 bp, Homo sapiens
ccctccagggccagga

SEQ ID NO: 5871456 - DNA, 21 bp, Homo sapiens
ccctccagggtcctctcttcc

SEQ ID NO: 5871457 - DNA, 12 bp, Homo sapiens
ccctccagtgct

SEQ ID NO: 5871458 - DNA, 18 bp, Homo sapiens
ccctccagtgctggattt

SEQ ID NO: 5871459 - DNA, 20 bp, Homo sapiens
ccctccagtgcttggctgcc

SEQ ID NO: 5871460 - DNA, 12 bp, Homo sapiens
ccctccatccct

SEQ ID NO: 5871461 - DNA, 17 bp, Homo sapiens
ccctccatcccttcccc

SEQ ID NO: 5871462 - DNA, 11 bp, Homo sapiens
ccctccatccg

SEQ ID NO: 5871463 - DNA, 15 bp, Homo sapiens
ccctccatctgggga

SEQ ID NO: 5871464 - DNA, 19 bp, Homo sapiens
ccctccatggcaggaaggc

SEQ ID NO: 5871465 - DNA, 21 bp, Homo sapiens
ccctccatgtagaagagggag

SEQ ID NO: 5871466 - DNA, 21 bp, Homo sapiens
ccctccatgtggccccaggtg

SEQ ID NO: 5871467 - DNA, 23 bp, Homo sapiens
ccctccatgtggccccaggtgcc

SEQ ID NO: 5871468 - DNA, 15 bp, Homo sapiens
ccctccattcccacc

SEQ ID NO: 5871469 - DNA, 17 bp, Homo sapiens
ccctccattcccacccc

SEQ ID NO: 5871470 - DNA, 23 bp, Homo sapiens
ccctccattctgcactcagaaaa

SEQ ID NO: 5871471 - DNA, 15 bp, Homo sapiens
ccctccattgggcac

SEQ ID NO: 5871472 - DNA, 23 bp, Homo sapiens
ccctccattgggcacagtccaga

SEQ ID NO: 5871473 - DNA, 23 bp, Homo sapiens
ccctcccaacagagctgggctac

SEQ ID NO: 5871474 - DNA, 23 bp, Homo sapiens
ccctcccaacctcaatgccctgc

SEQ ID NO: 5871475 - DNA, 18 bp, Homo sapiens
ccctcccacactcgccat

SEQ ID NO: 5871476 - DNA, 15 bp, Homo sapiens
ccctcccacagcctc

SEQ ID NO: 5871477 - DNA, 12 bp, Homo sapiens
ccctcccaccac

SEQ ID NO: 5871478 - DNA, 16 bp, Homo sapiens
ccctcccaccacccca

SEQ ID NO: 5871479 - DNA, 21 bp, Homo sapiens
ccctcccaccagaacgcaccc

SEQ ID NO: 5871480 - DNA, 12 bp, Homo sapiens
ccctcccaccca

SEQ ID NO: 5871481 - DNA, 21 bp, Homo sapiens
ccctcccacccaaccaacttt

SEQ ID NO: 5871482 - DNA, 14 bp, Homo sapiens
ccctcccacccacc

SEQ ID NO: 5871483 - DNA, 12 bp, Homo sapiens
ccctcccacccc

SEQ ID NO: 5871484 - DNA, 13 bp, Homo sapiens
ccctcccaccccc

SEQ ID NO: 5871485 - DNA, 15 bp, Homo sapiens
ccctcccacctctgt

SEQ ID NO: 5871486 - DNA, 10 bp, Homo sapiens
ccctcccact

SEQ ID NO: 5871487 - DNA, 20 bp, Homo sapiens
ccctcccacttgacctgaga

SEQ ID NO: 5871488 - DNA, 16 bp, Homo sapiens
ccctcccagaaaaact

SEQ ID NO: 5871489 - DNA, 12 bp, Homo sapiens
ccctcccagaca

SEQ ID NO: 5871490 - DNA, 14 bp, Homo sapiens
ccctcccagacagg

SEQ ID NO: 5871491 - DNA, 16 bp, Homo sapiens
ccctcccagacaggcc

SEQ ID NO: 5871492 - DNA, 17 bp, Homo sapiens
ccctcccagagcacctg

SEQ ID NO: 5871493 - DNA, 14 bp, Homo sapiens
ccctcccagatcca

SEQ ID NO: 5871494 - DNA, 13 bp, Homo sapiens
ccctcccagcagt

SEQ ID NO: 5871495 - DNA, 17 bp, Homo sapiens
ccctcccagctgacagt

SEQ ID NO: 5871496 - DNA, 17 bp, Homo sapiens
ccctcccagctgcactt

SEQ ID NO: 5871497 - DNA, 12 bp, Homo sapiens
ccctcccaggcg

SEQ ID NO: 5871498 - DNA, 22 bp, Homo sapiens
ccctcccaggggagccagctgc

SEQ ID NO: 5871499 - DNA, 13 bp, Homo sapiens
ccctcccagtcct

SEQ ID NO: 5871500 - DNA, 15 bp, Homo sapiens
ccctcccagtcctcc

SEQ ID NO: 5871501 - DNA, 16 bp, Homo sapiens
ccctcccatcctccag

SEQ ID NO: 5871502 - DNA, 11 bp, Homo sapiens
ccctcccatgg

SEQ ID NO: 5871503 - DNA, 12 bp, Homo sapiens
ccctcccatggc

SEQ ID NO: 5871504 - DNA, 19 bp, Homo sapiens
ccctccccaaatggctgct

SEQ ID NO: 5871505 - DNA, 21 bp, Homo sapiens
ccctccccaaatggctgcttt

SEQ ID NO: 5871506 - DNA, 22 bp, Homo sapiens
ccctccccaaatggctgctttg

SEQ ID NO: 5871507 - DNA, 16 bp, Homo sapiens
ccctccccaaggaaga

SEQ ID NO: 5871508 - DNA, 10 bp, Homo sapiens
ccctccccac

SEQ ID NO: 5871509 - DNA, 16 bp, Homo sapiens
ccctccccacagtcct

SEQ ID NO: 5871510 - DNA, 18 bp, Homo sapiens
ccctccccacagtcctca

SEQ ID NO: 5871511 - DNA, 16 bp, Homo sapiens
ccctccccacccaaga

SEQ ID NO: 5871512 - DNA, 19 bp, Homo sapiens
ccctccccaccccaaccac

SEQ ID NO: 5871513 - DNA, 13 bp, Homo sapiens
ccctccccacctg

SEQ ID NO: 5871514 - DNA, 17 bp, Homo sapiens
ccctccccacctgctca

SEQ ID NO: 5871515 - DNA, 13 bp, Homo sapiens
ccctccccagccc

SEQ ID NO: 5871516 - DNA, 13 bp, Homo sapiens
ccctccccagtag

SEQ ID NO: 5871517 - DNA, 18 bp, Homo sapiens
ccctccccatctgtgttc

SEQ ID NO: 5871518 - DNA, 16 bp, Homo sapiens
ccctcccccaaccccc

SEQ ID NO: 5871519 - DNA, 15 bp, Homo sapiens
ccctcccccacgtct

SEQ ID NO: 5871520 - DNA, 21 bp, Homo sapiens
ccctcccccacgtctctctgc

SEQ ID NO: 5871521 - DNA, 23 bp, Homo sapiens
ccctcccccacgtctctctgcct

SEQ ID NO: 5871522 - DNA, 14 bp, Homo sapiens
ccctcccccactgc

SEQ ID NO: 5871523 - DNA, 17 bp, Homo sapiens
ccctcccccagacacag

SEQ ID NO: 5871524 - DNA, 13 bp, Homo sapiens
ccctcccccagca

SEQ ID NO: 5871525 - DNA, 23 bp, Homo sapiens
ccctcccccagccatgccagctg

SEQ ID NO: 5871526 - DNA, 15 bp, Homo sapiens
ccctcccccagctcc

SEQ ID NO: 5871527 - DNA, 18 bp, Homo sapiens
ccctcccccattccctcc

SEQ ID NO: 5871528 - DNA, 14 bp, Homo sapiens
ccctccccccagct

SEQ ID NO: 5871529 - DNA, 15 bp, Homo sapiens
ccctcccccgcagac

SEQ ID NO: 5871530 - DNA, 18 bp, Homo sapiens
ccctcccccgcagacaga

SEQ ID NO: 5871531 - DNA, 23 bp, Homo sapiens
ccctccccctacagatcctccgc

SEQ ID NO: 5871532 - DNA, 15 bp, Homo sapiens
ccctccccctcctgc

SEQ ID NO: 5871533 - DNA, 16 bp, Homo sapiens
ccctccccctcctgct

SEQ ID NO: 5871534 - DNA, 13 bp, Homo sapiens
ccctccccctgag

SEQ ID NO: 5871535 - DNA, 19 bp, Homo sapiens
ccctcccccttaagccaac

SEQ ID NO: 5871536 - DNA, 12 bp, Homo sapiens
ccctcccccttg

SEQ ID NO: 5871537 - DNA, 16 bp, Homo sapiens
ccctccccgcaccccc

SEQ ID NO: 5871538 - DNA, 17 bp, Homo sapiens
ccctccccgcacccccc

SEQ ID NO: 5871539 - DNA, 15 bp, Homo sapiens
ccctccccgcccctg

SEQ ID NO: 5871540 - DNA, 16 bp, Homo sapiens
ccctccccgccctttt

SEQ ID NO: 5871541 - DNA, 15 bp, Homo sapiens
ccctccccgcctcct

SEQ ID NO: 5871542 - DNA, 16 bp, Homo sapiens
ccctccccgctgccct

SEQ ID NO: 5871543 - DNA, 14 bp, Homo sapiens
ccctccccgggcag

SEQ ID NO: 5871544 - DNA, 18 bp, Homo sapiens
ccctccccgggcagcaga

SEQ ID NO: 5871545 - DNA, 21 bp, Homo sapiens
ccctccccgggcagcagagag

SEQ ID NO: 5871546 - DNA, 13 bp, Homo sapiens
ccctccccgtccc

SEQ ID NO: 5871547 - DNA, 21 bp, Homo sapiens
ccctccccgtccctgtccccc

SEQ ID NO: 5871548 - DNA, 14 bp, Homo sapiens
ccctcccctcagag

SEQ ID NO: 5871549 - DNA, 13 bp, Homo sapiens
ccctcccctcagc

SEQ ID NO: 5871550 - DNA, 15 bp, Homo sapiens
ccctcccctcagcct

SEQ ID NO: 5871551 - DNA, 20 bp, Homo sapiens
ccctcccctcagcctgccca

SEQ ID NO: 5871552 - DNA, 22 bp, Homo sapiens
ccctcccctcagcctgcccacc

SEQ ID NO: 5871553 - DNA, 14 bp, Homo sapiens
ccctcccctcagcg

SEQ ID NO: 5871554 - DNA, 17 bp, Homo sapiens
ccctcccctcagcgcag

SEQ ID NO: 5871555 - DNA, 16 bp, Homo sapiens
ccctcccctcccctgc

SEQ ID NO: 5871556 - DNA, 14 bp, Homo sapiens
ccctcccctccttt

SEQ ID NO: 5871557 - DNA, 14 bp, Homo sapiens
ccctcccctcgtgt

SEQ ID NO: 5871558 - DNA, 17 bp, Homo sapiens
ccctcccctctcctgag

SEQ ID NO: 5871559 - DNA, 22 bp, Homo sapiens
ccctcccctctcctgagcctgt

SEQ ID NO: 5871560 - DNA, 14 bp, Homo sapiens
ccctcccctctctt

SEQ ID NO: 5871561 - DNA, 14 bp, Homo sapiens
ccctcccctgccct

SEQ ID NO: 5871562 - DNA, 14 bp, Homo sapiens
ccctcccctgcctc

SEQ ID NO: 5871563 - DNA, 14 bp, Homo sapiens
ccctcccctgctca

SEQ ID NO: 5871564 - DNA, 14 bp, Homo sapiens
ccctcccctgctgc

SEQ ID NO: 5871565 - DNA, 18 bp, Homo sapiens
ccctcccctggggacgcc

SEQ ID NO: 5871566 - DNA, 16 bp, Homo sapiens
ccctccccttcccctt

SEQ ID NO: 5871567 - DNA, 22 bp, Homo sapiens
ccctccccttcgtgtttccccc

SEQ ID NO: 5871568 - DNA, 18 bp, Homo sapiens
ccctcccgcaccttcctc

SEQ ID NO: 5871569 - DNA, 14 bp, Homo sapiens
ccctcccgcccctt

SEQ ID NO: 5871570 - DNA, 18 bp, Homo sapiens
ccctcccgcttcctccgg

SEQ ID NO: 5871571 - DNA, 22 bp, Homo sapiens
ccctcccggagaggtggccgcc

SEQ ID NO: 5871572 - DNA, 16 bp, Homo sapiens
ccctcccggcatggga

SEQ ID NO: 5871573 - DNA, 19 bp, Homo sapiens
ccctcccgtagtctcctgg

SEQ ID NO: 5871574 - DNA, 16 bp, Homo sapiens
ccctccctaccctaac

SEQ ID NO: 5871575 - DNA, 12 bp, Homo sapiens
ccctccctacct

SEQ ID NO: 5871576 - DNA, 13 bp, Homo sapiens
ccctccctacctc

SEQ ID NO: 5871577 - DNA, 17 bp, Homo sapiens
ccctccctagcccttcc

SEQ ID NO: 5871578 - DNA, 13 bp, Homo sapiens
ccctccctccacc

SEQ ID NO: 5871579 - DNA, 13 bp, Homo sapiens
ccctccctccagg

SEQ ID NO: 5871580 - DNA, 13 bp, Homo sapiens
ccctccctcccag

SEQ ID NO: 5871581 - DNA, 12 bp, Homo sapiens
ccctccctccct

SEQ ID NO: 5871582 - DNA, 13 bp, Homo sapiens
ccctccctcctct

SEQ ID NO: 5871583 - DNA, 17 bp, Homo sapiens
ccctccctcctggctca

SEQ ID NO: 5871584 - DNA, 14 bp, Homo sapiens
ccctccctccttcc

SEQ ID NO: 5871585 - DNA, 13 bp, Homo sapiens
ccctccctcgtgg

SEQ ID NO: 5871586 - DNA, 15 bp, Homo sapiens
ccctccctcgtgggc

SEQ ID NO: 5871587 - DNA, 14 bp, Homo sapiens
ccctccctctccca

SEQ ID NO: 5871588 - DNA, 13 bp, Homo sapiens
ccctccctctccg

SEQ ID NO: 5871589 - DNA, 14 bp, Homo sapiens
ccctccctctccgc

SEQ ID NO: 5871590 - DNA, 12 bp, Homo sapiens
ccctccctgact

SEQ ID NO: 5871591 - DNA, 13 bp, Homo sapiens
ccctccctgactg

SEQ ID NO: 5871592 - DNA, 12 bp, Homo sapiens
ccctccctgcag

SEQ ID NO: 5871593 - DNA, 15 bp, Homo sapiens
ccctccctgcagggt

SEQ ID NO: 5871594 - DNA, 14 bp, Homo sapiens
ccctccctgcctga

SEQ ID NO: 5871595 - DNA, 14 bp, Homo sapiens
ccctccctgcctgc

SEQ ID NO: 5871596 - DNA, 11 bp, Homo sapiens
ccctccctgct

SEQ ID NO: 5871597 - DNA, 12 bp, Homo sapiens
ccctccctgctg

SEQ ID NO: 5871598 - DNA, 15 bp, Homo sapiens
ccctccctgctgtcc

SEQ ID NO: 5871599 - DNA, 13 bp, Homo sapiens
ccctccctgcttg

SEQ ID NO: 5871600 - DNA, 13 bp, Homo sapiens
ccctccctggagt

SEQ ID NO: 5871601 - DNA, 14 bp, Homo sapiens
ccctccctggcatg

SEQ ID NO: 5871602 - DNA, 12 bp, Homo sapiens
ccctccctggcc

SEQ ID NO: 5871603 - DNA, 13 bp, Homo sapiens
ccctccctggcct

SEQ ID NO: 5871604 - DNA, 17 bp, Homo sapiens
ccctccctggcctgttc

SEQ ID NO: 5871605 - DNA, 16 bp, Homo sapiens
ccctccctggctccca

SEQ ID NO: 5871606 - DNA, 19 bp, Homo sapiens
ccctccctggctcccatga

SEQ ID NO: 5871607 - DNA, 15 bp, Homo sapiens
ccctccctggctgtg

SEQ ID NO: 5871608 - DNA, 21 bp, Homo sapiens
ccctccctgtaatgcactcct

SEQ ID NO: 5871609 - DNA, 18 bp, Homo sapiens
ccctccctgtctccaggg

SEQ ID NO: 5871610 - DNA, 19 bp, Homo sapiens
ccctccctgttccccagag

SEQ ID NO: 5871611 - DNA, 20 bp, Homo sapiens
ccctcccttccttgggcaga

SEQ ID NO: 5871612 - DNA, 16 bp, Homo sapiens
ccctcccttctccctg

SEQ ID NO: 5871613 - DNA, 17 bp, Homo sapiens
ccctcccttgctgaaca

SEQ ID NO: 5871614 - DNA, 21 bp, Homo sapiens
ccctcccttgctgaacacaca

SEQ ID NO: 5871615 - DNA, 12 bp, Homo sapiens
ccctcccttgga

SEQ ID NO: 5871616 - DNA, 21 bp, Homo sapiens
ccctccgaacgctgctccatg

SEQ ID NO: 5871617 - DNA, 21 bp, Homo sapiens
ccctccgaccacttccagggg

SEQ ID NO: 5871618 - DNA, 15 bp, Homo sapiens
ccctccgccagccct

SEQ ID NO: 5871619 - DNA, 17 bp, Homo sapiens
ccctccgccagccctgt

SEQ ID NO: 5871620 - DNA, 16 bp, Homo sapiens
ccctccgccccgtccc

SEQ ID NO: 5871621 - DNA, 19 bp, Homo sapiens
ccctccgccctgccactca

SEQ ID NO: 5871622 - DNA, 14 bp, Homo sapiens
ccctccgcccttcc

SEQ ID NO: 5871623 - DNA, 16 bp, Homo sapiens
ccctccgccgtgccgg

SEQ ID NO: 5871624 - DNA, 22 bp, Homo sapiens
ccctccgccttcactccggtgt

SEQ ID NO: 5871625 - DNA, 18 bp, Homo sapiens
ccctccgctaaggcttcc

SEQ ID NO: 5871626 - DNA, 18 bp, Homo sapiens
ccctccggactggtgccc

SEQ ID NO: 5871627 - DNA, 18 bp, Homo sapiens
ccctccggaggagcagcc

SEQ ID NO: 5871628 - DNA, 21 bp, Homo sapiens
ccctccgggcaggggagccag

SEQ ID NO: 5871629 - DNA, 22 bp, Homo sapiens
ccctccgggcaggggagccagg

SEQ ID NO: 5871630 - DNA, 23 bp, Homo sapiens
ccctccgggcaggggagccaggg

SEQ ID NO: 5871631 - DNA, 16 bp, Homo sapiens
ccctccgtccccaggg

SEQ ID NO: 5871632 - DNA, 19 bp, Homo sapiens
ccctccgtcgggcccctgc

SEQ ID NO: 5871633 - DNA, 14 bp, Homo sapiens
ccctccgttgacag

SEQ ID NO: 5871634 - DNA, 18 bp, Homo sapiens
ccctcctaaatgtcagct

SEQ ID NO: 5871635 - DNA, 19 bp, Homo sapiens
ccctcctaaatgtcagctg

SEQ ID NO: 5871636 - DNA, 15 bp, Homo sapiens
ccctcctacccctcc

SEQ ID NO: 5871637 - DNA, 16 bp, Homo sapiens
ccctcctagacccagg

SEQ ID NO: 5871638 - DNA, 12 bp, Homo sapiens
ccctcctagctc

SEQ ID NO: 5871639 - DNA, 21 bp, Homo sapiens
ccctcctagctctcccagtga

SEQ ID NO: 5871640 - DNA, 14 bp, Homo sapiens
ccctcctagggggt

SEQ ID NO: 5871641 - DNA, 16 bp, Homo sapiens
ccctcctcacactcca

SEQ ID NO: 5871642 - DNA, 16 bp, Homo sapiens
ccctcctcacctctgg

SEQ ID NO: 5871643 - DNA, 21 bp, Homo sapiens
ccctcctcactccctaggccc

SEQ ID NO: 5871644 - DNA, 12 bp, Homo sapiens
ccctcctcactg

SEQ ID NO: 5871645 - DNA, 19 bp, Homo sapiens
ccctcctcactggccatcc

SEQ ID NO: 5871646 - DNA, 22 bp, Homo sapiens
ccctcctcagctccctgcctgt

SEQ ID NO: 5871647 - DNA, 12 bp, Homo sapiens
ccctcctcaggg

SEQ ID NO: 5871648 - DNA, 21 bp, Homo sapiens
ccctcctcagggatcacactg

SEQ ID NO: 5871649 - DNA, 18 bp, Homo sapiens
ccctcctccagcccctgt

SEQ ID NO: 5871650 - DNA, 21 bp, Homo sapiens
ccctcctccagcccctgtccc

SEQ ID NO: 5871651 - DNA, 12 bp, Homo sapiens
ccctcctccagt

SEQ ID NO: 5871652 - DNA, 14 bp, Homo sapiens
ccctcctccagtac

SEQ ID NO: 5871653 - DNA, 13 bp, Homo sapiens
ccctcctcccagg

SEQ ID NO: 5871654 - DNA, 17 bp, Homo sapiens
ccctcctccccagagct

SEQ ID NO: 5871655 - DNA, 14 bp, Homo sapiens
ccctcctcccccac

SEQ ID NO: 5871656 - DNA, 13 bp, Homo sapiens
ccctcctccccct

SEQ ID NO: 5871657 - DNA, 17 bp, Homo sapiens
ccctcctccccctttgg

SEQ ID NO: 5871658 - DNA, 21 bp, Homo sapiens
ccctcctccccgcgccccagt

SEQ ID NO: 5871659 - DNA, 11 bp, Homo sapiens
ccctcctccct

SEQ ID NO: 5871660 - DNA, 12 bp, Homo sapiens
ccctcctccctc

SEQ ID NO: 5871661 - DNA, 16 bp, Homo sapiens
ccctcctccctcagac

SEQ ID NO: 5871662 - DNA, 18 bp, Homo sapiens
ccctcctccctcagactc

SEQ ID NO: 5871663 - DNA, 21 bp, Homo sapiens
ccctcctccctccaagcctgg

SEQ ID NO: 5871664 - DNA, 23 bp, Homo sapiens
ccctcctccctttttccttgtcc

SEQ ID NO: 5871665 - DNA, 11 bp, Homo sapiens
ccctcctcctt

SEQ ID NO: 5871666 - DNA, 15 bp, Homo sapiens
ccctcctcgggccga

SEQ ID NO: 5871667 - DNA, 23 bp, Homo sapiens
ccctcctctagccatcccttggg

SEQ ID NO: 5871668 - DNA, 16 bp, Homo sapiens
ccctcctctcccatcc

SEQ ID NO: 5871669 - DNA, 17 bp, Homo sapiens
ccctcctctcccatccc

SEQ ID NO: 5871670 - DNA, 15 bp, Homo sapiens
ccctcctctcctcgt

SEQ ID NO: 5871671 - DNA, 15 bp, Homo sapiens
ccctcctctctgccc

SEQ ID NO: 5871672 - DNA, 11 bp, Homo sapiens
ccctcctctgc

SEQ ID NO: 5871673 - DNA, 16 bp, Homo sapiens
ccctcctctgccacct

SEQ ID NO: 5871674 - DNA, 13 bp, Homo sapiens
ccctcctctggca

SEQ ID NO: 5871675 - DNA, 13 bp, Homo sapiens
ccctcctcttccc

SEQ ID NO: 5871676 - DNA, 14 bp, Homo sapiens
ccctcctcttccct

SEQ ID NO: 5871677 - DNA, 14 bp, Homo sapiens
ccctcctcttccga

SEQ ID NO: 5871678 - DNA, 14 bp, Homo sapiens
ccctcctcttcctg

SEQ ID NO: 5871679 - DNA, 13 bp, Homo sapiens
ccctcctcttgga

SEQ ID NO: 5871680 - DNA, 16 bp, Homo sapiens
ccctcctgaacccccc

SEQ ID NO: 5871681 - DNA, 14 bp, Homo sapiens
ccctcctgacccca

SEQ ID NO: 5871682 - DNA, 15 bp, Homo sapiens
ccctcctgaccccac

SEQ ID NO: 5871683 - DNA, 23 bp, Homo sapiens
ccctcctgactcatccgcctggc

SEQ ID NO: 5871684 - DNA, 15 bp, Homo sapiens
ccctcctgagcctca

SEQ ID NO: 5871685 - DNA, 18 bp, Homo sapiens
ccctcctgagcctcacct

SEQ ID NO: 5871686 - DNA, 13 bp, Homo sapiens
ccctcctgcaggc

SEQ ID NO: 5871687 - DNA, 18 bp, Homo sapiens
ccctctgttccttccctg

SEQ ID NO: 5871688 - DNA, 15 bp, Homo sapiens
ccctctgttctctcc

SEQ ID NO: 5871689 - DNA, 18 bp, Homo sapiens
ccctctgttctctcccct

SEQ ID NO: 5871690 - DNA, 21 bp, Homo sapiens
ccctctgttctggtggcccca

SEQ ID NO: 5871691 - DNA, 22 bp, Homo sapiens
ccctcttagaagaaatatgagc

SEQ ID NO: 5871692 - DNA, 20 bp, Homo sapiens
ccctcttatgtacctctttt

SEQ ID NO: 5871693 - DNA, 17 bp, Homo sapiens
ccctcttcaaagcagag

SEQ ID NO: 5871694 - DNA, 22 bp, Homo sapiens
ccctcttcactgtggccacagc

SEQ ID NO: 5871695 - DNA, 19 bp, Homo sapiens
ccctcttccaaaggcagcg

SEQ ID NO: 5871696 - DNA, 14 bp, Homo sapiens
ccctcttccagctt

SEQ ID NO: 5871697 - DNA, 17 bp, Homo sapiens
ccctcttccctctccct

SEQ ID NO: 5871698 - DNA, 19 bp, Homo sapiens
ccctcttccctctccctct

SEQ ID NO: 5871699 - DNA, 14 bp, Homo sapiens
ccctcttccctggt

SEQ ID NO: 5871700 - DNA, 22 bp, Homo sapiens
ccctcttccctgtcttccccac

SEQ ID NO: 5871701 - DNA, 14 bp, Homo sapiens
ccctcttcccttcc

SEQ ID NO: 5871702 - DNA, 16 bp, Homo sapiens
ccctcttcccttcctc

SEQ ID NO: 5871703 - DNA, 17 bp, Homo sapiens
ccctcttcccttcctcc

SEQ ID NO: 5871704 - DNA, 11 bp, Homo sapiens
ccctcttcctc

SEQ ID NO: 5871705 - DNA, 23 bp, Homo sapiens
ccctcttcctcttgaccctgcac

SEQ ID NO: 5871706 - DNA, 15 bp, Homo sapiens
ccctcttcctgacga

SEQ ID NO: 5871707 - DNA, 12 bp, Homo sapiens
ccctcttccttc

SEQ ID NO: 5871708 - DNA, 13 bp, Homo sapiens
ccctcttccttcc

SEQ ID NO: 5871709 - DNA, 16 bp, Homo sapiens
ccctcttccttccccc

SEQ ID NO: 5871710 - DNA, 15 bp, Homo sapiens
ccctcttctcaagtg

SEQ ID NO: 5871711 - DNA, 15 bp, Homo sapiens
ccctcttctcagctc

SEQ ID NO: 5871712 - DNA, 23 bp, Homo sapiens
ccctcttctcagctccactctga

SEQ ID NO: 5871713 - DNA, 14 bp, Homo sapiens
ccctcttctctcct

SEQ ID NO: 5871714 - DNA, 14 bp, Homo sapiens
ccctcttctgagct

SEQ ID NO: 5871715 - DNA, 22 bp, Homo sapiens
ccctcttgacccatctccccct

SEQ ID NO: 5871716 - DNA, 23 bp, Homo sapiens
ccctcttgaggtggtgccttctc

SEQ ID NO: 5871717 - DNA, 11 bp, Homo sapiens
ccctcttgcca

SEQ ID NO: 5871718 - DNA, 14 bp, Homo sapiens
ccctcttgccagcc

SEQ ID NO: 5871719 - DNA, 15 bp, Homo sapiens
ccctcttgccagcct

SEQ ID NO: 5871720 - DNA, 19 bp, Homo sapiens
ccctcttgccagcctcctt

SEQ ID NO: 5871721 - DNA, 15 bp, Homo sapiens
ccctcttgccatcct

SEQ ID NO: 5871722 - DNA, 17 bp, Homo sapiens
ccctcttgccatcctga

SEQ ID NO: 5871723 - DNA, 17 bp, Homo sapiens
ccctcttgcccatcctg

SEQ ID NO: 5871724 - DNA, 22 bp, Homo sapiens
ccctcttgcccatcctgactga

SEQ ID NO: 5871725 - DNA, 18 bp, Homo sapiens
ccctcttgccccaacccc

SEQ ID NO: 5871726 - DNA, 23 bp, Homo sapiens
ccctcttgccccaacccccagca

SEQ ID NO: 5871727 - DNA, 16 bp, Homo sapiens
ccctcttgccccccac

SEQ ID NO: 5871728 - DNA, 22 bp, Homo sapiens
ccctcttgccccccaccccagc

SEQ ID NO: 5871729 - DNA, 22 bp, Homo sapiens
ccctcttggattaaggaagact

SEQ ID NO: 5871730 - DNA, 19 bp, Homo sapiens
ccctcttgggggcactgct

SEQ ID NO: 5871731 - DNA, 18 bp, Homo sapiens
ccctcttggtcttcccag

SEQ ID NO: 5871732 - DNA, 15 bp, Homo sapiens
ccctcttgtctcccc

SEQ ID NO: 5871733 - DNA, 16 bp, Homo sapiens
ccctcttgtctcccct

SEQ ID NO: 5871734 - DNA, 18 bp, Homo sapiens
ccctcttgtctcccctgt

SEQ ID NO: 5871735 - DNA, 20 bp, Homo sapiens
ccctcttgttttgtttgtct

SEQ ID NO: 5871736 - DNA, 17 bp, Homo sapiens
ccctctttaatgctgtc

SEQ ID NO: 5871737 - DNA, 18 bp, Homo sapiens
ccctctttaatgctgtct

SEQ ID NO: 5871738 - DNA, 20 bp, Homo sapiens
ccctctttccctcccttcct

SEQ ID NO: 5871739 - DNA, 18 bp, Homo sapiens
ccctctttccctgcgaga

SEQ ID NO: 5871740 - DNA, 18 bp, Homo sapiens
ccctctttcctgtgccag

SEQ ID NO: 5871741 - DNA, 18 bp, Homo sapiens
ccctctttcgtctactgc

SEQ ID NO: 5871742 - DNA, 19 bp, Homo sapiens
ccctctttcgtctactgca

SEQ ID NO: 5871743 - DNA, 15 bp, Homo sapiens
ccctctttctacatt

SEQ ID NO: 5871744 - DNA, 20 bp, Homo sapiens
ccctctttctctctgtgtgg

SEQ ID NO: 5871745 - DNA, 18 bp, Homo sapiens
ccctctttctctttcttc

SEQ ID NO: 5871746 - DNA, 19 bp, Homo sapiens
ccctctttctctttcttcc

SEQ ID NO: 5871747 - DNA, 22 bp, Homo sapiens
ccctctttctctttcttccttt

SEQ ID NO: 5871748 - DNA, 16 bp, Homo sapiens
ccctctttgcacagca

SEQ ID NO: 5871749 - DNA, 19 bp, Homo sapiens
ccctctttgctgcagagaa

SEQ ID NO: 5871750 - DNA, 14 bp, Homo sapiens
ccctctttgggcag

SEQ ID NO: 5871751 - DNA, 22 bp, Homo sapiens
ccctctttgtgtacttcagtct

SEQ ID NO: 5871752 - DNA, 12 bp, Homo sapiens
ccctcttttctt

SEQ ID NO: 5871753 - DNA, 13 bp, Homo sapiens
ccctcttttctta

SEQ ID NO: 5871754 - DNA, 16 bp, Homo sapiens
ccctcttttcttactc

SEQ ID NO: 5871755 - DNA, 14 bp, Homo sapiens
ccctcttttggcct

SEQ ID NO: 5871756 - DNA, 18 bp, Homo sapiens
ccctgaaaacccagagag

SEQ ID NO: 5871757 - DNA, 23 bp, Homo sapiens
ccctgaaaatgtttttctgccag

SEQ ID NO: 5871758 - DNA, 24 bp, Homo sapiens
ccctgaaaatgtttttctgccagg

SEQ ID NO: 5871759 - DNA, 12 bp, Homo sapiens
ccctgaaacacg

SEQ ID NO: 5871760 - DNA, 18 bp, Homo sapiens
ccctgaaacactgcttct

SEQ ID NO: 5871761 - DNA, 20 bp, Homo sapiens
ccctgaaacgagaagtgccc

SEQ ID NO: 5871762 - DNA, 22 bp, Homo sapiens
ccctgaaacttatttttttctg

SEQ ID NO: 5871763 - DNA, 18 bp, Homo sapiens
ccctgaaagcctcacgta

SEQ ID NO: 5871764 - DNA, 19 bp, Homo sapiens
ccctgaaaggaacactggc

SEQ ID NO: 5871765 - DNA, 16 bp, Homo sapiens
ccctgaaatggcctgt

SEQ ID NO: 5871766 - DNA, 24 bp, Homo sapiens
ccctgaaatggcctgtccctaggg

SEQ ID NO: 5871767 - DNA, 22 bp, Homo sapiens
ccctgaacaagagtgtctatgg

SEQ ID NO: 5871768 - DNA, 15 bp, Homo sapiens
ccctgaacatctgtg

SEQ ID NO: 5871769 - DNA, 15 bp, Homo sapiens
ccctgaaccacgagg

SEQ ID NO: 5871770 - DNA, 17 bp, Homo sapiens
ccctgaaccacgaggct

SEQ ID NO: 5871771 - DNA, 21 bp, Homo sapiens
ccctgaaccacgaggctgccc

SEQ ID NO: 5871772 - DNA, 13 bp, Homo sapiens
ccctgaaccatcc

SEQ ID NO: 5871773 - DNA, 14 bp, Homo sapiens
ccctgaacccctgg

SEQ ID NO: 5871774 - DNA, 19 bp, Homo sapiens
ccctgaacccctggccagc

SEQ ID NO: 5871775 - DNA, 19 bp, Homo sapiens
ccctgaaccgcaccccatc

SEQ ID NO: 5871776 - DNA, 15 bp, Homo sapiens
ccctgaacctcagtt

SEQ ID NO: 5871777 - DNA, 17 bp, Homo sapiens
ccctgaacctcagtttc

SEQ ID NO: 5871778 - DNA, 18 bp, Homo sapiens
ccctgaacgttttcttct

SEQ ID NO: 5871779 - DNA, 18 bp, Homo sapiens
ccctgaactggccccagc

SEQ ID NO: 5871780 - DNA, 15 bp, Homo sapiens
ccctgaagagacagg

SEQ ID NO: 5871781 - DNA, 18 bp, Homo sapiens
ccctgaagatttcagagg

SEQ ID NO: 5871782 - DNA, 19 bp, Homo sapiens
ccctgaagatttcagaggc

SEQ ID NO: 5871783 - DNA, 16 bp, Homo sapiens
ccctgaagccagcctt

SEQ ID NO: 5871784 - DNA, 17 bp, Homo sapiens
ccctgaagccagccttc

SEQ ID NO: 5871785 - DNA, 18 bp, Homo sapiens
ccctgaagccagccttct

SEQ ID NO: 5871786 - DNA, 21 bp, Homo sapiens
ccctgaagcctccgtggaaca

SEQ ID NO: 5871787 - DNA, 22 bp, Homo sapiens
ccctgaagcctccgtggaacat

SEQ ID NO: 5871788 - DNA, 23 bp, Homo sapiens
ccctgaaggaacattccttagtc

SEQ ID NO: 5871789 - DNA, 12 bp, Homo sapiens
ccctgaaggccc

SEQ ID NO: 5871790 - DNA, 13 bp, Homo sapiens
ccctgaaggcccc

SEQ ID NO: 5871791 - DNA, 16 bp, Homo sapiens
ccctgaaggccccgcc

SEQ ID NO: 5871792 - DNA, 16 bp, Homo sapiens
ccctgaagtcttgcat

SEQ ID NO: 5871793 - DNA, 18 bp, Homo sapiens
ccctgaagtgaccccagc

SEQ ID NO: 5871794 - DNA, 20 bp, Homo sapiens
ccctgaatcccccttgccac

SEQ ID NO: 5871795 - DNA, 17 bp, Homo sapiens
ccctgaatctgaccaca

SEQ ID NO: 5871796 - DNA, 22 bp, Homo sapiens
ccctgaatctgaccacagacac

SEQ ID NO: 5871797 - DNA, 21 bp, Homo sapiens
ccctgaatctgctgagaggca

SEQ ID NO: 5871798 - DNA, 17 bp, Homo sapiens
ccctgaattgtttgata

SEQ ID NO: 5871799 - DNA, 22 bp, Homo sapiens
ccctgaattgtttgatattgtc

SEQ ID NO: 5871800 - DNA, 16 bp, Homo sapiens
ccctgacaacactcat

SEQ ID NO: 5871801 - DNA, 17 bp, Homo sapiens
ccctgaccaccctgcct

SEQ ID NO: 5871802 - DNA, 19 bp, Homo sapiens
ccctgaccaccctgcctgt

SEQ ID NO: 5871803 - DNA, 22 bp, Homo sapiens
ccctgaccactcagagacatgc

SEQ ID NO: 5871804 - DNA, 15 bp, Homo sapiens
ccctgaccagctccc

SEQ ID NO: 5871805 - DNA, 20 bp, Homo sapiens
ccctgacccccatcgctctg

SEQ ID NO: 5871806 - DNA, 12 bp, Homo sapiens
ccctgaccctgc

SEQ ID NO: 5871807 - DNA, 15 bp, Homo sapiens
ccctgaccctgcaga

SEQ ID NO: 5871808 - DNA, 15 bp, Homo sapiens
ccctgaccctgctcc

SEQ ID NO: 5871809 - DNA, 16 bp, Homo sapiens
ccctgaccctgctcct

SEQ ID NO: 5871810 - DNA, 16 bp, Homo sapiens
ccctgacctaccccag

SEQ ID NO: 5871811 - DNA, 11 bp, Homo sapiens
ccctgacctcc

SEQ ID NO: 5871812 - DNA, 18 bp, Homo sapiens
ccctgacctcccaactct

SEQ ID NO: 5871813 - DNA, 14 bp, Homo sapiens
ccctgacctcccag

SEQ ID NO: 5871814 - DNA, 20 bp, Homo sapiens
ccctgacctcccagccctat

SEQ ID NO: 5871815 - DNA, 21 bp, Homo sapiens
ccctgacctcccagccctatg

SEQ ID NO: 5871816 - DNA, 18 bp, Homo sapiens
ccctgacctccgcccctg

SEQ ID NO: 5871817 - DNA, 16 bp, Homo sapiens
ccctgacctgtgagcc

SEQ ID NO: 5871818 - DNA, 23 bp, Homo sapiens
ccctgaccttggctgactggggc

SEQ ID NO: 5871819 - DNA, 18 bp, Homo sapiens
ccctgactaaactaccac

SEQ ID NO: 5871820 - DNA, 19 bp, Homo sapiens
ccctgactaaactaccacc

SEQ ID NO: 5871821 - DNA, 19 bp, Homo sapiens
ccctgactcattctgaagg

SEQ ID NO: 5871822 - DNA, 14 bp, Homo sapiens
ccctgactcctctg

SEQ ID NO: 5871823 - DNA, 19 bp, Homo sapiens
ccctgactcctctggcttt

SEQ ID NO: 5871824 - DNA, 18 bp, Homo sapiens
ccctgactctctgtgacc

SEQ ID NO: 5871825 - DNA, 12 bp, Homo sapiens
ccctgactgggg

SEQ ID NO: 5871826 - DNA, 19 bp, Homo sapiens
ccctgactgtcagggaggg

SEQ ID NO: 5871827 - DNA, 21 bp, Homo sapiens
ccctgactgtcagggagggcc

SEQ ID NO: 5871828 - DNA, 22 bp, Homo sapiens
ccctgactgtcagggagggcca

SEQ ID NO: 5871829 - DNA, 15 bp, Homo sapiens
ccctgacttcccagc

SEQ ID NO: 5871830 - DNA, 18 bp, Homo sapiens
ccctgacttcccagctgg

SEQ ID NO: 5871831 - DNA, 19 bp, Homo sapiens
ccctgacttcccagctggc

SEQ ID NO: 5871832 - DNA, 21 bp, Homo sapiens
ccctgacttcccagctggcag

SEQ ID NO: 5871833 - DNA, 15 bp, Homo sapiens
ccctgacttgcttta

SEQ ID NO: 5871834 - DNA, 15 bp, Homo sapiens
ccctgagaaacccac

SEQ ID NO: 5871835 - DNA, 19 bp, Homo sapiens
ccctgagaaacccaccagc

SEQ ID NO: 5871836 - DNA, 20 bp, Homo sapiens
ccctgagaagcctcatggga

SEQ ID NO: 5871837 - DNA, 20 bp, Homo sapiens
ccctgagaagctgctccagg

SEQ ID NO: 5871838 - DNA, 23 bp, Homo sapiens
ccctgagacaaatggaggcctgt

SEQ ID NO: 5871839 - DNA, 10 bp, Homo sapiens
ccctgagact

SEQ ID NO: 5871840 - DNA, 19 bp, Homo sapiens
ccctgagactccagaatct

SEQ ID NO: 5871841 - DNA, 15 bp, Homo sapiens
ccctgagagtctggt

SEQ ID NO: 5871842 - DNA, 18 bp, Homo sapiens
ccctgagatcagagtcct

SEQ ID NO: 5871843 - DNA, 16 bp, Homo sapiens
ccctgagatcccctga

SEQ ID NO: 5871844 - DNA, 19 bp, Homo sapiens
ccctgagatcccctgagcc

SEQ ID NO: 5871845 - DNA, 18 bp, Homo sapiens
ccctgagatctctgcagg

SEQ ID NO: 5871846 - DNA, 22 bp, Homo sapiens
ccctgagatctgcacagtcaga

SEQ ID NO: 5871847 - DNA, 16 bp, Homo sapiens
ccctgagcaatgtctg

SEQ ID NO: 5871848 - DNA, 20 bp, Homo sapiens
ccctgagcaatgtctgtgct

SEQ ID NO: 5871849 - DNA, 21 bp, Homo sapiens
ccctgagcactcctggtgcag

SEQ ID NO: 5871850 - DNA, 23 bp, Homo sapiens
ccctgagcagaatactggtctca

SEQ ID NO: 5871851 - DNA, 23 bp, Homo sapiens
ccctgagcagatcgtgccgtgga

SEQ ID NO: 5871852 - DNA, 14 bp, Homo sapiens
ccctgagcaggatt

SEQ ID NO: 5871853 - DNA, 22 bp, Homo sapiens
ccctgagcagggtccacagctg

SEQ ID NO: 5871854 - DNA, 12 bp, Homo sapiens
ccctgagcccct

SEQ ID NO: 5871855 - DNA, 19 bp, Homo sapiens
ccctgagcctgacctttct

SEQ ID NO: 5871856 - DNA, 13 bp, Homo sapiens
ccctgagcctgcc

SEQ ID NO: 5871857 - DNA, 12 bp, Homo sapiens
ccctgagcctgg

SEQ ID NO: 5871858 - DNA, 19 bp, Homo sapiens
ccctgagcctgtgtcctga

SEQ ID NO: 5871859 - DNA, 19 bp, Homo sapiens
ccctgagcgagtggagtct

SEQ ID NO: 5871860 - DNA, 11 bp, Homo sapiens
ccctgagctca

SEQ ID NO: 5871861 - DNA, 15 bp, Homo sapiens
ccctgagctcaggct

SEQ ID NO: 5871862 - DNA, 21 bp, Homo sapiens
ccctgagctcaggctgagccc

SEQ ID NO: 5871863 - DNA, 22 bp, Homo sapiens
ccctgagctcggtggacccagg

SEQ ID NO: 5871864 - DNA, 21 bp, Homo sapiens
ccctgcagtaatctccagggc

SEQ ID NO: 5871865 - DNA, 20 bp, Homo sapiens
ccctgcagtgttcgcttggc

SEQ ID NO: 5871866 - DNA, 21 bp, Homo sapiens
ccctgcagttcccctggaagc

SEQ ID NO: 5871867 - DNA, 19 bp, Homo sapiens
ccctgcagtttggccctgg

SEQ ID NO: 5871868 - DNA, 21 bp, Homo sapiens
ccctgcagtttggccctggag

SEQ ID NO: 5871869 - DNA, 23 bp, Homo sapiens
ccctgcagtttggccctggagcc

SEQ ID NO: 5871870 - DNA, 13 bp, Homo sapiens
ccctgcataatgt

SEQ ID NO: 5871871 - DNA, 19 bp, Homo sapiens
ccctgcatccaatctgctc

SEQ ID NO: 5871872 - DNA, 19 bp, Homo sapiens
ccctgcatctgaccagcag

SEQ ID NO: 5871873 - DNA, 21 bp, Homo sapiens
ccctgcatctgaccagcagcg

SEQ ID NO: 5871874 - DNA, 19 bp, Homo sapiens
ccctgcatgcctggcccct

SEQ ID NO: 5871875 - DNA, 13 bp, Homo sapiens
ccctgcatggctg

SEQ ID NO: 5871876 - DNA, 21 bp, Homo sapiens
ccctgcatggctgagctgccc

SEQ ID NO: 5871877 - DNA, 14 bp, Homo sapiens
ccctgcatgggcca

SEQ ID NO: 5871878 - DNA, 20 bp, Homo sapiens
ccctgcatgggccagcccct

SEQ ID NO: 5871879 - DNA, 21 bp, Homo sapiens
ccctgcattggaactggaggc

SEQ ID NO: 5871880 - DNA, 22 bp, Homo sapiens
ccctgcattggaactggaggca

SEQ ID NO: 5871881 - DNA, 23 bp, Homo sapiens
ccctgcattggaactggaggcag

SEQ ID NO: 5871882 - DNA, 20 bp, Homo sapiens
ccctgcattggcctggcctc

SEQ ID NO: 5871883 - DNA, 16 bp, Homo sapiens
ccctgcattttcctct

SEQ ID NO: 5871884 - DNA, 16 bp, Homo sapiens
ccctgccaaactgaag

SEQ ID NO: 5871885 - DNA, 22 bp, Homo sapiens
ccctgccaactccatgaccagg

SEQ ID NO: 5871886 - DNA, 16 bp, Homo sapiens
ccctgccaagcctgga

SEQ ID NO: 5871887 - DNA, 12 bp, Homo sapiens
ccctgccaaggc

SEQ ID NO: 5871888 - DNA, 19 bp, Homo sapiens
ccctgccaatgctccagct

SEQ ID NO: 5871889 - DNA, 10 bp, Homo sapiens
ccctgccaca

SEQ ID NO: 5871890 - DNA, 13 bp, Homo sapiens
ccctgccacagcc

SEQ ID NO: 5871891 - DNA, 14 bp, Homo sapiens
ccctgccacagcca

SEQ ID NO: 5871892 - DNA, 20 bp, Homo sapiens
ccctgccacagccagaggag

SEQ ID NO: 5871893 - DNA, 14 bp, Homo sapiens
ccctgccaccaggc

SEQ ID NO: 5871894 - DNA, 12 bp, Homo sapiens
ccctgccaccct

SEQ ID NO: 5871895 - DNA, 16 bp, Homo sapiens
ccctgccaccctctgc

SEQ ID NO: 5871896 - DNA, 15 bp, Homo sapiens
ccctgccaccctggg

SEQ ID NO: 5871897 - DNA, 17 bp, Homo sapiens
ccctgccaccctgggga

SEQ ID NO: 5871898 - DNA, 18 bp, Homo sapiens
ccctgccaccctggggag

SEQ ID NO: 5871899 - DNA, 19 bp, Homo sapiens
ccctgccaccgactgccca

SEQ ID NO: 5871900 - DNA, 20 bp, Homo sapiens
ccctgccaccgactgcccag

SEQ ID NO: 5871901 - DNA, 21 bp, Homo sapiens
ccctgccaccgactgcccagc

SEQ ID NO: 5871902 - DNA, 17 bp, Homo sapiens
ccctgccacctccctga

SEQ ID NO: 5871903 - DNA, 18 bp, Homo sapiens
ccctgccacctcctgcct

SEQ ID NO: 5871904 - DNA, 20 bp, Homo sapiens
ccctgccacctcctgcctca

SEQ ID NO: 5871905 - DNA, 14 bp, Homo sapiens
ccctgccacctgtc

SEQ ID NO: 5871906 - DNA, 17 bp, Homo sapiens
ccctgccacctgtctgt

SEQ ID NO: 5871907 - DNA, 18 bp, Homo sapiens
ccctgccacctgtctgtc

SEQ ID NO: 5871908 - DNA, 18 bp, Homo sapiens
ccctgccacgtcccgctg

SEQ ID NO: 5871909 - DNA, 18 bp, Homo sapiens
ccctgccactcaatggga

SEQ ID NO: 5871910 - DNA, 18 bp, Homo sapiens
ccctgccactcacccttc

SEQ ID NO: 5871911 - DNA, 20 bp, Homo sapiens
ccctgccactcactaggccc

SEQ ID NO: 5871912 - DNA, 14 bp, Homo sapiens
ccctgccactgggc

SEQ ID NO: 5871913 - DNA, 21 bp, Homo sapiens
ccctgccactgggctctggac

SEQ ID NO: 5871914 - DNA, 23 bp, Homo sapiens
ccctgccactgggctctggacct

SEQ ID NO: 5871915 - DNA, 21 bp, Homo sapiens
ccctgccacttcaacccccag

SEQ ID NO: 5871916 - DNA, 18 bp, Homo sapiens
ccctgccagaggcctggt

SEQ ID NO: 5871917 - DNA, 13 bp, Homo sapiens
ccctgccagctct

SEQ ID NO: 5871918 - DNA, 22 bp, Homo sapiens
ccctgccaggagctttggacct

SEQ ID NO: 5871919 - DNA, 13 bp, Homo sapiens
ccctgccaggagg

SEQ ID NO: 5871920 - DNA, 13 bp, Homo sapiens
ccctgccaggcac

SEQ ID NO: 5871921 - DNA, 15 bp, Homo sapiens
ccctgccaggcacag

SEQ ID NO: 5871922 - DNA, 18 bp, Homo sapiens
ccctgccaggcacaggca

SEQ ID NO: 5871923 - DNA, 19 bp, Homo sapiens
ccctgccaggcacaggcag

SEQ ID NO: 5871924 - DNA, 20 bp, Homo sapiens
ccctgccaggcacaggcagg

SEQ ID NO: 5871925 - DNA, 13 bp, Homo sapiens
ccctgccaggctg

SEQ ID NO: 5871926 - DNA, 18 bp, Homo sapiens
ccctgccaggctgtcagc

SEQ ID NO: 5871927 - DNA, 14 bp, Homo sapiens
ccctgccagggctc

SEQ ID NO: 5871928 - DNA, 21 bp, Homo sapiens
ccctgccagggctcgggcgct

SEQ ID NO: 5871929 - DNA, 18 bp, Homo sapiens
ccctgccagggggtttga

SEQ ID NO: 5871930 - DNA, 14 bp, Homo sapiens
ccctgccagtgcca

SEQ ID NO: 5871931 - DNA, 16 bp, Homo sapiens
ccctgccagtgccagg

SEQ ID NO: 5871932 - DNA, 19 bp, Homo sapiens
ccctgccagtgccagggtg

SEQ ID NO: 5871933 - DNA, 17 bp, Homo sapiens
ccctgccagttgaagtg

SEQ ID NO: 5871934 - DNA, 12 bp, Homo sapiens
ccctgccatccc

SEQ ID NO: 5871935 - DNA, 13 bp, Homo sapiens
ccctgccatcttc

SEQ ID NO: 5871936 - DNA, 14 bp, Homo sapiens
ccctgccatcttcc

SEQ ID NO: 5871937 - DNA, 17 bp, Homo sapiens
ccctgccatcttcccag

SEQ ID NO: 5871938 - DNA, 18 bp, Homo sapiens
ccctgccatcttcccagc

SEQ ID NO: 5871939 - DNA, 12 bp, Homo sapiens
ccctgccatgga

SEQ ID NO: 5871940 - DNA, 14 bp, Homo sapiens
ccctgccatggagg

SEQ ID NO: 5871941 - DNA, 22 bp, Homo sapiens
ccctgccatggaggcgccttcc

SEQ ID NO: 5871942 - DNA, 18 bp, Homo sapiens
ccctgccattggcctctt

SEQ ID NO: 5871943 - DNA, 22 bp, Homo sapiens
ccctgccattttttaagagaca

SEQ ID NO: 5871944 - DNA, 17 bp, Homo sapiens
ccctgcccaaaccctta

SEQ ID NO: 5871945 - DNA, 13 bp, Homo sapiens
ccctgcccaacct

SEQ ID NO: 5871946 - DNA, 19 bp, Homo sapiens
ccctgcccaagtgaccagg

SEQ ID NO: 5871947 - DNA, 21 bp, Homo sapiens
ccctgcccaagtgaccaggga

SEQ ID NO: 5871948 - DNA, 17 bp, Homo sapiens
ccctgcccaagtggctc

SEQ ID NO: 5871949 - DNA, 19 bp, Homo sapiens
ccctgcccaagtggctctt

SEQ ID NO: 5871950 - DNA, 21 bp, Homo sapiens
ccctgcccaatcctccctgga

SEQ ID NO: 5871951 - DNA, 17 bp, Homo sapiens
ccctgcccacacctcct

SEQ ID NO: 5871952 - DNA, 13 bp, Homo sapiens
ccctgcccacccc

SEQ ID NO: 5871953 - DNA, 22 bp, Homo sapiens
ccctgcccaccccatccctggc

SEQ ID NO: 5871954 - DNA, 20 bp, Homo sapiens
ccctgcccacgcccttggag

SEQ ID NO: 5871955 - DNA, 13 bp, Homo sapiens
ccctgcccactcc

SEQ ID NO: 5871956 - DNA, 12 bp, Homo sapiens
ccctgcccagag

SEQ ID NO: 5871957 - DNA, 16 bp, Homo sapiens
ccctgcccagagctga

SEQ ID NO: 5871958 - DNA, 20 bp, Homo sapiens
ccctgcccagatcagccaga

SEQ ID NO: 5871959 - DNA, 21 bp, Homo sapiens
ccctgcccagatcagccagaa

SEQ ID NO: 5871960 - DNA, 21 bp, Homo sapiens
ccctgcccagcacctcctccg

SEQ ID NO: 5871961 - DNA, 23 bp, Homo sapiens
ccctgcccagcacctcctccgtg

SEQ ID NO: 5871962 - DNA, 12 bp, Homo sapiens
ccctgcccagcc

SEQ ID NO: 5871963 - DNA, 18 bp, Homo sapiens
ccctgcccagccagccat

SEQ ID NO: 5871964 - DNA, 15 bp, Homo sapiens
ccctgcccagcctgt

SEQ ID NO: 5871965 - DNA, 13 bp, Homo sapiens
ccctgcccaggca

SEQ ID NO: 5871966 - DNA, 15 bp, Homo sapiens
ccctgcccaggccgg

SEQ ID NO: 5871967 - DNA, 21 bp, Homo sapiens
ccctgcccaggtggcctcctg

SEQ ID NO: 5871968 - DNA, 10 bp, Homo sapiens
ccctgcccat

SEQ ID NO: 5871969 - DNA, 23 bp, Homo sapiens
ccctgcccatactgagcctgcca

SEQ ID NO: 5871970 - DNA, 13 bp, Homo sapiens
ccctgccccaaat

SEQ ID NO: 5871971 - DNA, 19 bp, Homo sapiens
ccctgccccaacccccacc

SEQ ID NO: 5871972 - DNA, 13 bp, Homo sapiens
ccctgccccacac

SEQ ID NO: 5871973 - DNA, 18 bp, Homo sapiens
ccctgccccacacctcct

SEQ ID NO: 5871974 - DNA, 18 bp, Homo sapiens
ccctgccccactcctgtc

SEQ ID NO: 5871975 - DNA, 10 bp, Homo sapiens
ccctgccccc

SEQ ID NO: 5871976 - DNA, 12 bp, Homo sapiens
ccctgcccccac

SEQ ID NO: 5871977 - DNA, 14 bp, Homo sapiens
ccctgcccccacca

SEQ ID NO: 5871978 - DNA, 15 bp, Homo sapiens
ccctgcccccacccc

SEQ ID NO: 5871979 - DNA, 17 bp, Homo sapiens
ccctgcccccacttcct

SEQ ID NO: 5871980 - DNA, 18 bp, Homo sapiens
ccctgcccccagccccgg

SEQ ID NO: 5871981 - DNA, 22 bp, Homo sapiens
ccctgcccccaggactgggcca

SEQ ID NO: 5871982 - DNA, 13 bp, Homo sapiens
ccctgcccccatc

SEQ ID NO: 5871983 - DNA, 15 bp, Homo sapiens
ccctgcccccatctc

SEQ ID NO: 5871984 - DNA, 23 bp, Homo sapiens
ccctgcccccatctccccaggcc

SEQ ID NO: 5871985 - DNA, 12 bp, Homo sapiens
ccctgcccccca

SEQ ID NO: 5871986 - DNA, 14 bp, Homo sapiens
ccctgccccccaag

SEQ ID NO: 5871987 - DNA, 18 bp, Homo sapiens
ccctgccccccacattct

SEQ ID NO: 5871988 - DNA, 22 bp, Homo sapiens
ccctgccccccacattctggct

SEQ ID NO: 5871989 - DNA, 18 bp, Homo sapiens
ccctgccccctcccactc

SEQ ID NO: 5871990 - DNA, 23 bp, Homo sapiens
ccctgccccctccccttcacacc

SEQ ID NO: 5871991 - DNA, 13 bp, Homo sapiens
ccctgccccctgg

SEQ ID NO: 5871992 - DNA, 17 bp, Homo sapiens
ccctgccccctggctga

SEQ ID NO: 5871993 - DNA, 19 bp, Homo sapiens
ccctgccccgcaggcctgc

SEQ ID NO: 5871994 - DNA, 21 bp, Homo sapiens
ccctgccccgccccccagagc

SEQ ID NO: 5871995 - DNA, 15 bp, Homo sapiens
ccctgcccctaggat

SEQ ID NO: 5871996 - DNA, 21 bp, Homo sapiens
ccctgcccctaggatgctgca

SEQ ID NO: 5871997 - DNA, 11 bp, Homo sapiens
ccctgcccctc

SEQ ID NO: 5871998 - DNA, 21 bp, Homo sapiens
ccctgcccctccccaaaagaa

SEQ ID NO: 5871999 - DNA, 22 bp, Homo sapiens
ccctgcccctccccaaaagaaa

SEQ ID NO: 5872000 - DNA, 19 bp, Homo sapiens
ccctgcccctccccctacc

SEQ ID NO: 5872001 - DNA, 22 bp, Homo sapiens
ccctgcccctccccctaccgca

SEQ ID NO: 5872002 - DNA, 14 bp, Homo sapiens
ccctgcccctccct

SEQ ID NO: 5872003 - DNA, 19 bp, Homo sapiens
ccctgcccctcctctccct

SEQ ID NO: 5872004 - DNA, 18 bp, Homo sapiens
ccctgcccctcctgtaca

SEQ ID NO: 5872005 - DNA, 15 bp, Homo sapiens
ccctgcccctgcaaa

SEQ ID NO: 5872006 - DNA, 13 bp, Homo sapiens
ccctgcccctgcc

SEQ ID NO: 5872007 - DNA, 19 bp, Homo sapiens
ccctgcccctgcccgagag

SEQ ID NO: 5872008 - DNA, 14 bp, Homo sapiens
ccctgcccctgtgg

SEQ ID NO: 5872009 - DNA, 15 bp, Homo sapiens
ccctgcccctgtggg

SEQ ID NO: 5872010 - DNA, 14 bp, Homo sapiens
ccctgccccttaac

SEQ ID NO: 5872011 - DNA, 23 bp, Homo sapiens
ccctgccccttctacactctcct

SEQ ID NO: 5872012 - DNA, 15 bp, Homo sapiens
ccctgccccttgcca

SEQ ID NO: 5872013 - DNA, 22 bp, Homo sapiens
ccctgccccttgtcctctcaga

SEQ ID NO: 5872014 - DNA, 20 bp, Homo sapiens
ccctgcccctttcttcccca

SEQ ID NO: 5872015 - DNA, 22 bp, Homo sapiens
ccctgcccctttcttccccacc

SEQ ID NO: 5872016 - DNA, 18 bp, Homo sapiens
ccctgcccgagagagctc

SEQ ID NO: 5872017 - DNA, 16 bp, Homo sapiens
ccctgcccgagagctc

SEQ ID NO: 5872018 - DNA, 23 bp, Homo sapiens
ccctgcccgaggtcgctgcagcc

SEQ ID NO: 5872019 - DNA, 15 bp, Homo sapiens
ccctgcccgctccca

SEQ ID NO: 5872020 - DNA, 16 bp, Homo sapiens
ccctgcccgctcccaa

SEQ ID NO: 5872021 - DNA, 17 bp, Homo sapiens
ccctgcccggctgcgga

SEQ ID NO: 5872022 - DNA, 21 bp, Homo sapiens
ccctgcccggggagctgcaga

SEQ ID NO: 5872023 - DNA, 22 bp, Homo sapiens
ccctgcccggggagctgcagag

SEQ ID NO: 5872024 - DNA, 22 bp, Homo sapiens
ccctgcccggtggtttgccatg

SEQ ID NO: 5872025 - DNA, 23 bp, Homo sapiens
ccctgcccggtggtttgccatgt

SEQ ID NO: 5872026 - DNA, 14 bp, Homo sapiens
ccctgccctagctc

SEQ ID NO: 5872027 - DNA, 16 bp, Homo sapiens
ccctgccctagctcca

SEQ ID NO: 5872028 - DNA, 17 bp, Homo sapiens
ccctgccctagctccac

SEQ ID NO: 5872029 - DNA, 17 bp, Homo sapiens
ccctgccctcacctccc

SEQ ID NO: 5872030 - DNA, 13 bp, Homo sapiens
ccctgccctcact

SEQ ID NO: 5872031 - DNA, 17 bp, Homo sapiens
ccctgccctcactccac

SEQ ID NO: 5872032 - DNA, 18 bp, Homo sapiens
ccctgccctcactccact

SEQ ID NO: 5872033 - DNA, 20 bp, Homo sapiens
ccctgccctcagcctgttgc

SEQ ID NO: 5872034 - DNA, 13 bp, Homo sapiens
ccctgccctcatc

SEQ ID NO: 5872035 - DNA, 19 bp, Homo sapiens
ccctgccctcccctgctcc

SEQ ID NO: 5872036 - DNA, 20 bp, Homo sapiens
ccctgccctcccctgctccc

SEQ ID NO: 5872037 - DNA, 13 bp, Homo sapiens
ccctgccctcctg

SEQ ID NO: 5872038 - DNA, 15 bp, Homo sapiens
ccctgccctcctgcc

SEQ ID NO: 5872039 - DNA, 18 bp, Homo sapiens
ccctgccctcggccattg

SEQ ID NO: 5872040 - DNA, 20 bp, Homo sapiens
ccctgccctcgtggccagcc

SEQ ID NO: 5872041 - DNA, 11 bp, Homo sapiens
ccctgccctct

SEQ ID NO: 5872042 - DNA, 19 bp, Homo sapiens
ccctgctgcaggggctctg

SEQ ID NO: 5872043 - DNA, 15 bp, Homo sapiens
ccctgctgccacagc

SEQ ID NO: 5872044 - DNA, 18 bp, Homo sapiens
ccctgctgccagcttcag

SEQ ID NO: 5872045 - DNA, 13 bp, Homo sapiens
ccctgctgccatg

SEQ ID NO: 5872046 - DNA, 11 bp, Homo sapiens
ccctgctgccc

SEQ ID NO: 5872047 - DNA, 13 bp, Homo sapiens
ccctgctgcccaa

SEQ ID NO: 5872048 - DNA, 22 bp, Homo sapiens
ccctgctgcccctccctgcctc

SEQ ID NO: 5872049 - DNA, 19 bp, Homo sapiens
ccctgctgccgcctcccag

SEQ ID NO: 5872050 - DNA, 14 bp, Homo sapiens
ccctgctgcctccc

SEQ ID NO: 5872051 - DNA, 21 bp, Homo sapiens
ccctgctgctcctcggccaga

SEQ ID NO: 5872052 - DNA, 13 bp, Homo sapiens
ccctgctgctgcc

SEQ ID NO: 5872053 - DNA, 17 bp, Homo sapiens
ccctgctgctgcctgcc

SEQ ID NO: 5872054 - DNA, 15 bp, Homo sapiens
ccctgctgcttccta

SEQ ID NO: 5872055 - DNA, 18 bp, Homo sapiens
ccctgctgcttcctaact

SEQ ID NO: 5872056 - DNA, 13 bp, Homo sapiens
ccctgctgcttgg

SEQ ID NO: 5872057 - DNA, 13 bp, Homo sapiens
ccctgctggacca

SEQ ID NO: 5872058 - DNA, 13 bp, Homo sapiens
ccctgctggcctg

SEQ ID NO: 5872059 - DNA, 12 bp, Homo sapiens
ccctgctggggt

SEQ ID NO: 5872060 - DNA, 18 bp, Homo sapiens
ccctgctggggtctcagg

SEQ ID NO: 5872061 - DNA, 23 bp, Homo sapiens
ccctgctggggtctcaggtccag

SEQ ID NO: 5872062 - DNA, 16 bp, Homo sapiens
ccctgctgggtgtggc

SEQ ID NO: 5872063 - DNA, 21 bp, Homo sapiens
ccctgctgggtgtggcgcagc

SEQ ID NO: 5872064 - DNA, 19 bp, Homo sapiens
ccctgctggtgcccaccct

SEQ ID NO: 5872065 - DNA, 19 bp, Homo sapiens
ccctgctggttcagggttg

SEQ ID NO: 5872066 - DNA, 23 bp, Homo sapiens
ccctgctgtatcttccagaacct

SEQ ID NO: 5872067 - DNA, 12 bp, Homo sapiens
ccctgctgtccc

SEQ ID NO: 5872068 - DNA, 17 bp, Homo sapiens
ccctgctgtctctctgg

SEQ ID NO: 5872069 - DNA, 20 bp, Homo sapiens
ccctgctgtctctctgggct

SEQ ID NO: 5872070 - DNA, 22 bp, Homo sapiens
ccctgctgtctctctgggctgc

SEQ ID NO: 5872071 - DNA, 13 bp, Homo sapiens
ccctgctgtgcca

SEQ ID NO: 5872072 - DNA, 12 bp, Homo sapiens
ccctgctgtgga

SEQ ID NO: 5872073 - DNA, 13 bp, Homo sapiens
ccctgcttacctg

SEQ ID NO: 5872074 - DNA, 16 bp, Homo sapiens
ccctgcttacctgacg

SEQ ID NO: 5872075 - DNA, 23 bp, Homo sapiens
ccctgcttagaacccttctgctt

SEQ ID NO: 5872076 - DNA, 19 bp, Homo sapiens
ccctgcttcatatctctcc

SEQ ID NO: 5872077 - DNA, 16 bp, Homo sapiens
ccctgcttcctgcttg

SEQ ID NO: 5872078 - DNA, 19 bp, Homo sapiens
ccctgcttcctgcttgcca

SEQ ID NO: 5872079 - DNA, 11 bp, Homo sapiens
ccctgcttctc

SEQ ID NO: 5872080 - DNA, 16 bp, Homo sapiens
ccctgcttctccagcc

SEQ ID NO: 5872081 - DNA, 18 bp, Homo sapiens
ccctgcttctccagcctg

SEQ ID NO: 5872082 - DNA, 23 bp, Homo sapiens
ccctgcttctccagcctggaccc

SEQ ID NO: 5872083 - DNA, 17 bp, Homo sapiens
ccctgcttctcccgcca

SEQ ID NO: 5872084 - DNA, 18 bp, Homo sapiens
ccctgcttctcccgccat

SEQ ID NO: 5872085 - DNA, 19 bp, Homo sapiens
ccctgcttctcccggggac

SEQ ID NO: 5872086 - DNA, 13 bp, Homo sapiens
ccctgcttctgct

SEQ ID NO: 5872087 - DNA, 14 bp, Homo sapiens
ccctgcttctgctg

SEQ ID NO: 5872088 - DNA, 19 bp, Homo sapiens
ccctgcttctgctgccctg

SEQ ID NO: 5872089 - DNA, 18 bp, Homo sapiens
ccctgcttctgctgcctg

SEQ ID NO: 5872090 - DNA, 17 bp, Homo sapiens
ccctgcttgcaggaggc

SEQ ID NO: 5872091 - DNA, 19 bp, Homo sapiens
ccctgcttgcccgctccca

SEQ ID NO: 5872092 - DNA, 17 bp, Homo sapiens
ccctgcttggccaggag

SEQ ID NO: 5872093 - DNA, 18 bp, Homo sapiens
ccctgcttggggcctggc

SEQ ID NO: 5872094 - DNA, 22 bp, Homo sapiens
ccctgctttgggctgccctggt

SEQ ID NO: 5872095 - DNA, 17 bp, Homo sapiens
ccctgcttttctcccag

SEQ ID NO: 5872096 - DNA, 21 bp, Homo sapiens
ccctgcttttctcccagaagg

SEQ ID NO: 5872097 - DNA, 22 bp, Homo sapiens
ccctgcttttctcccagaaggc

SEQ ID NO: 5872098 - DNA, 16 bp, Homo sapiens
ccctgctttttttctt

SEQ ID NO: 5872099 - DNA, 17 bp, Homo sapiens
ccctggaaacccacctc

SEQ ID NO: 5872100 - DNA, 19 bp, Homo sapiens
ccctggaaaccttccaccc

SEQ ID NO: 5872101 - DNA, 21 bp, Homo sapiens
ccctggaaaccttccacccag

SEQ ID NO: 5872102 - DNA, 18 bp, Homo sapiens
ccctggaaattctgcctt

SEQ ID NO: 5872103 - DNA, 19 bp, Homo sapiens
ccctggaacatcctttgca

SEQ ID NO: 5872104 - DNA, 14 bp, Homo sapiens
ccctggaacctttc

SEQ ID NO: 5872105 - DNA, 17 bp, Homo sapiens
ccctggaacctttccct

SEQ ID NO: 5872106 - DNA, 19 bp, Homo sapiens
ccctggaacctttcccttg

SEQ ID NO: 5872107 - DNA, 19 bp, Homo sapiens
ccctggaactcctggcctt

SEQ ID NO: 5872108 - DNA, 18 bp, Homo sapiens
ccctggaactgtctctca

SEQ ID NO: 5872109 - DNA, 16 bp, Homo sapiens
ccctggaagagcccag

SEQ ID NO: 5872110 - DNA, 21 bp, Homo sapiens
ccctggaagagtcctccaccc

SEQ ID NO: 5872111 - DNA, 16 bp, Homo sapiens
ccctggaagcagtgcc

SEQ ID NO: 5872112 - DNA, 18 bp, Homo sapiens
ccctggaagcagtgccca

SEQ ID NO: 5872113 - DNA, 19 bp, Homo sapiens
ccctggaagctggaagact

SEQ ID NO: 5872114 - DNA, 21 bp, Homo sapiens
ccctggaaggacatccatgtt

SEQ ID NO: 5872115 - DNA, 21 bp, Homo sapiens
ccctggaataaatttcgcaat

SEQ ID NO: 5872116 - DNA, 19 bp, Homo sapiens
ccctggaatcgaggctgtg

SEQ ID NO: 5872117 - DNA, 22 bp, Homo sapiens
ccctggaatcgaggctgtgtgt

SEQ ID NO: 5872118 - DNA, 21 bp, Homo sapiens
ccctggaattcagcaccctgg

SEQ ID NO: 5872119 - DNA, 22 bp, Homo sapiens
ccctggaattcagcaccctggg

SEQ ID NO: 5872120 - DNA, 17 bp, Homo sapiens
ccctggacaagcagagg

SEQ ID NO: 5872121 - DNA, 14 bp, Homo sapiens
ccctggacacagcc

SEQ ID NO: 5872122 - DNA, 15 bp, Homo sapiens
ccctggacacagccc

SEQ ID NO: 5872123 - DNA, 17 bp, Homo sapiens
ccctggacacagcccac

SEQ ID NO: 5872124 - DNA, 21 bp, Homo sapiens
ccctggacacagcccaccctc

SEQ ID NO: 5872125 - DNA, 15 bp, Homo sapiens
ccctggacacagctc

SEQ ID NO: 5872126 - DNA, 16 bp, Homo sapiens
ccctggacacagctct

SEQ ID NO: 5872127 - DNA, 17 bp, Homo sapiens
ccctggacacagctctt

SEQ ID NO: 5872128 - DNA, 19 bp, Homo sapiens
ccctggacacagctcttca

SEQ ID NO: 5872129 - DNA, 20 bp, Homo sapiens
ccctggacacagctcttcat

SEQ ID NO: 5872130 - DNA, 15 bp, Homo sapiens
ccctggacagaggcg

SEQ ID NO: 5872131 - DNA, 20 bp, Homo sapiens
ccctggacagatggcccaag

SEQ ID NO: 5872132 - DNA, 16 bp, Homo sapiens
ccctggacatgcctgt

SEQ ID NO: 5872133 - DNA, 20 bp, Homo sapiens
ccctggacatgcctgtcctg

SEQ ID NO: 5872134 - DNA, 22 bp, Homo sapiens
ccctggacatgcctgtcctgaa

SEQ ID NO: 5872135 - DNA, 17 bp, Homo sapiens
ccctggaccaccagccc

SEQ ID NO: 5872136 - DNA, 13 bp, Homo sapiens
ccctggaccacga

SEQ ID NO: 5872137 - DNA, 16 bp, Homo sapiens
ccctggaccacgaggc

SEQ ID NO: 5872138 - DNA, 18 bp, Homo sapiens
ccctggaccacgaggctg

SEQ ID NO: 5872139 - DNA, 18 bp, Homo sapiens
ccctggaccagccgccca

SEQ ID NO: 5872140 - DNA, 16 bp, Homo sapiens
ccctggaccagcctcc

SEQ ID NO: 5872141 - DNA, 16 bp, Homo sapiens
ccctggaccagtggtc

SEQ ID NO: 5872142 - DNA, 13 bp, Homo sapiens
ccctggaccccag

SEQ ID NO: 5872143 - DNA, 16 bp, Homo sapiens
ccctggaccccagcct

SEQ ID NO: 5872144 - DNA, 20 bp, Homo sapiens
ccctggaccccaggctctta

SEQ ID NO: 5872145 - DNA, 15 bp, Homo sapiens
ccctggacccctggg

SEQ ID NO: 5872146 - DNA, 14 bp, Homo sapiens
ccctggacctggga

SEQ ID NO: 5872147 - DNA, 13 bp, Homo sapiens
ccctggactggga

SEQ ID NO: 5872148 - DNA, 14 bp, Homo sapiens
ccctggacttctgg

SEQ ID NO: 5872149 - DNA, 17 bp, Homo sapiens
ccctggacttctgggag

SEQ ID NO: 5872150 - DNA, 14 bp, Homo sapiens
ccctggagaagcac

SEQ ID NO: 5872151 - DNA, 18 bp, Homo sapiens
ccctggagaagcaccagc

SEQ ID NO: 5872152 - DNA, 21 bp, Homo sapiens
ccctggagaagggacatggga

SEQ ID NO: 5872153 - DNA, 10 bp, Homo sapiens
ccctggagag

SEQ ID NO: 5872154 - DNA, 20 bp, Homo sapiens
ccctggagagccccatggtg

SEQ ID NO: 5872155 - DNA, 13 bp, Homo sapiens
ccctggagcagga

SEQ ID NO: 5872156 - DNA, 15 bp, Homo sapiens
ccctggagcaggagc

SEQ ID NO: 5872157 - DNA, 20 bp, Homo sapiens
ccctggagccaactgctgct

SEQ ID NO: 5872158 - DNA, 15 bp, Homo sapiens
ccctggagccagcag

SEQ ID NO: 5872159 - DNA, 15 bp, Homo sapiens
ccctggagccagggc

SEQ ID NO: 5872160 - DNA, 15 bp, Homo sapiens
ccctggagcccggca

SEQ ID NO: 5872161 - DNA, 18 bp, Homo sapiens
ccctggagcccggcagtg

SEQ ID NO: 5872162 - DNA, 12 bp, Homo sapiens
ccctggagccct

SEQ ID NO: 5872163 - DNA, 15 bp, Homo sapiens
ccctggagcctcaga

SEQ ID NO: 5872164 - DNA, 16 bp, Homo sapiens
ccctggagcctcagaa

SEQ ID NO: 5872165 - DNA, 19 bp, Homo sapiens
ccctggagcctcagcagca

SEQ ID NO: 5872166 - DNA, 23 bp, Homo sapiens
ccctggagctcagggtccttgtt

SEQ ID NO: 5872167 - DNA, 19 bp, Homo sapiens
ccctggaggaattcagctc

SEQ ID NO: 5872168 - DNA, 22 bp, Homo sapiens
ccctggaggactctagaagctc

SEQ ID NO: 5872169 - DNA, 19 bp, Homo sapiens
ccctggaggcactgaagtg

SEQ ID NO: 5872170 - DNA, 18 bp, Homo sapiens
ccctggaggctgcctccc

SEQ ID NO: 5872171 - DNA, 14 bp, Homo sapiens
ccctggagggaagg

SEQ ID NO: 5872172 - DNA, 15 bp, Homo sapiens
ccctggagggcagag

SEQ ID NO: 5872173 - DNA, 17 bp, Homo sapiens
ccctggaggtgccagca

SEQ ID NO: 5872174 - DNA, 20 bp, Homo sapiens
ccctggagtcccctgggcct

SEQ ID NO: 5872175 - DNA, 15 bp, Homo sapiens
ccctggagtgcagtt

SEQ ID NO: 5872176 - DNA, 15 bp, Homo sapiens
ccctggagtggcatg

SEQ ID NO: 5872177 - DNA, 21 bp, Homo sapiens
ccctggagtgtggctgaggag

SEQ ID NO: 5872178 - DNA, 23 bp, Homo sapiens
ccctggagtgtggctgaggaggc

SEQ ID NO: 5872179 - DNA, 21 bp, Homo sapiens
ccctggagtgtgtcagagccc

SEQ ID NO: 5872180 - DNA, 17 bp, Homo sapiens
ccctggagttcctcatc

SEQ ID NO: 5872181 - DNA, 22 bp, Homo sapiens
ccctggatcacgacgctgcaga

SEQ ID NO: 5872182 - DNA, 16 bp, Homo sapiens
ccctggatcagggttg

SEQ ID NO: 5872183 - DNA, 23 bp, Homo sapiens
ccctggatcagtcctttgatcag

SEQ ID NO: 5872184 - DNA, 13 bp, Homo sapiens
ccctggatgcagc

SEQ ID NO: 5872185 - DNA, 21 bp, Homo sapiens
ccctggatggcctctggggca

SEQ ID NO: 5872186 - DNA, 15 bp, Homo sapiens
ccctggatgggcatt

SEQ ID NO: 5872187 - DNA, 17 bp, Homo sapiens
ccctggatgggcattgg

SEQ ID NO: 5872188 - DNA, 23 bp, Homo sapiens
ccctggatgggcattgggctgac

SEQ ID NO: 5872189 - DNA, 17 bp, Homo sapiens
ccctggatgtgcccaca

SEQ ID NO: 5872190 - DNA, 19 bp, Homo sapiens
ccctggatgtgcccacagg

SEQ ID NO: 5872191 - DNA, 22 bp, Homo sapiens
ccctggcactgcaggtggcctc

SEQ ID NO: 5872192 - DNA, 20 bp, Homo sapiens
ccctggcactggcaaacagg

SEQ ID NO: 5872193 - DNA, 15 bp, Homo sapiens
ccctggcagagaaga

SEQ ID NO: 5872194 - DNA, 17 bp, Homo sapiens
ccctggcagagaagaga

SEQ ID NO: 5872195 - DNA, 19 bp, Homo sapiens
ccctggcagcacagcccag

SEQ ID NO: 5872196 - DNA, 21 bp, Homo sapiens
ccctggcagcacagcccaggg

SEQ ID NO: 5872197 - DNA, 23 bp, Homo sapiens
ccctggcagcacagcccagggcc

SEQ ID NO: 5872198 - DNA, 13 bp, Homo sapiens
ccctggcagcagc

SEQ ID NO: 5872199 - DNA, 15 bp, Homo sapiens
ccctggcagcccgca

SEQ ID NO: 5872200 - DNA, 15 bp, Homo sapiens
ccctggcagctgccc

SEQ ID NO: 5872201 - DNA, 17 bp, Homo sapiens
ccctggcagctgcccct

SEQ ID NO: 5872202 - DNA, 18 bp, Homo sapiens
ccctggcagctgcccctc

SEQ ID NO: 5872203 - DNA, 22 bp, Homo sapiens
ccctggcaggatgaccctgcga

SEQ ID NO: 5872204 - DNA, 19 bp, Homo sapiens
ccctggcaggatgctgagc

SEQ ID NO: 5872205 - DNA, 14 bp, Homo sapiens
ccctggcaggcagg

SEQ ID NO: 5872206 - DNA, 15 bp, Homo sapiens
ccctggcaggcaggg

SEQ ID NO: 5872207 - DNA, 22 bp, Homo sapiens
ccctggcatcgtgtattccata

SEQ ID NO: 5872208 - DNA, 11 bp, Homo sapiens
ccctggcatga

SEQ ID NO: 5872209 - DNA, 12 bp, Homo sapiens
ccctggcatgtt

SEQ ID NO: 5872210 - DNA, 18 bp, Homo sapiens
ccctggcatttggcctct

SEQ ID NO: 5872211 - DNA, 14 bp, Homo sapiens
ccctggccacagcc

SEQ ID NO: 5872212 - DNA, 17 bp, Homo sapiens
ccctggccacagccttc

SEQ ID NO: 5872213 - DNA, 14 bp, Homo sapiens
ccctggccaccacc

SEQ ID NO: 5872214 - DNA, 18 bp, Homo sapiens
ccctggccacctgccagg

SEQ ID NO: 5872215 - DNA, 16 bp, Homo sapiens
ccctggccagctctga

SEQ ID NO: 5872216 - DNA, 13 bp, Homo sapiens
ccctggccatctc

SEQ ID NO: 5872217 - DNA, 18 bp, Homo sapiens
ccctggcccaccccccag

SEQ ID NO: 5872218 - DNA, 22 bp, Homo sapiens
ccctggcccaccccccagcctc

SEQ ID NO: 5872219 - DNA, 14 bp, Homo sapiens
ccctggcccagagt

SEQ ID NO: 5872220 - DNA, 18 bp, Homo sapiens
ccctgtcccctggggctg

SEQ ID NO: 5872221 - DNA, 10 bp, Homo sapiens
ccctgtccct

SEQ ID NO: 5872222 - DNA, 15 bp, Homo sapiens
ccctgtccctagctc

SEQ ID NO: 5872223 - DNA, 19 bp, Homo sapiens
ccctgtccctagctcacac

SEQ ID NO: 5872224 - DNA, 14 bp, Homo sapiens
ccctgtccctccca

SEQ ID NO: 5872225 - DNA, 15 bp, Homo sapiens
ccctgtccctcccac

SEQ ID NO: 5872226 - DNA, 18 bp, Homo sapiens
ccctgtccctcccacctc

SEQ ID NO: 5872227 - DNA, 23 bp, Homo sapiens
ccctgtccctcccacctctgtga

SEQ ID NO: 5872228 - DNA, 12 bp, Homo sapiens
ccctgtccctgc

SEQ ID NO: 5872229 - DNA, 18 bp, Homo sapiens
ccctgtccctgccccgcc

SEQ ID NO: 5872230 - DNA, 18 bp, Homo sapiens
ccctgtcccttcctttct

SEQ ID NO: 5872231 - DNA, 15 bp, Homo sapiens
ccctgtccggcccag

SEQ ID NO: 5872232 - DNA, 15 bp, Homo sapiens
ccctgtcctcactgc

SEQ ID NO: 5872233 - DNA, 18 bp, Homo sapiens
ccctgtcctcactgctcc

SEQ ID NO: 5872234 - DNA, 18 bp, Homo sapiens
ccctgtcctccagcttcc

SEQ ID NO: 5872235 - DNA, 15 bp, Homo sapiens
ccctgtcctcccacc

SEQ ID NO: 5872236 - DNA, 14 bp, Homo sapiens
ccctgtcctcctcg

SEQ ID NO: 5872237 - DNA, 12 bp, Homo sapiens
ccctgtcctgca

SEQ ID NO: 5872238 - DNA, 14 bp, Homo sapiens
ccctgtcctgcagt

SEQ ID NO: 5872239 - DNA, 20 bp, Homo sapiens
ccctgtcctgcagtcccaca

SEQ ID NO: 5872240 - DNA, 14 bp, Homo sapiens
ccctgtcctggtgg

SEQ ID NO: 5872241 - DNA, 23 bp, Homo sapiens
ccctgtcctggtggtattttcaa

SEQ ID NO: 5872242 - DNA, 20 bp, Homo sapiens
ccctgtcctgtgaatggaag

SEQ ID NO: 5872243 - DNA, 17 bp, Homo sapiens
ccctgtccttagcctag

SEQ ID NO: 5872244 - DNA, 18 bp, Homo sapiens
ccctgtccttcccacggc

SEQ ID NO: 5872245 - DNA, 22 bp, Homo sapiens
ccctgtccttcccacggccact

SEQ ID NO: 5872246 - DNA, 18 bp, Homo sapiens
ccctgtccttccctgttc

SEQ ID NO: 5872247 - DNA, 23 bp, Homo sapiens
ccctgtcgagttcggctctgggt

SEQ ID NO: 5872248 - DNA, 12 bp, Homo sapiens
ccctgtcgccca

SEQ ID NO: 5872249 - DNA, 16 bp, Homo sapiens
ccctgtcgcccaccca

SEQ ID NO: 5872250 - DNA, 13 bp, Homo sapiens
ccctgtctaatga

SEQ ID NO: 5872251 - DNA, 23 bp, Homo sapiens
ccctgtctaggtcagtacccacc

SEQ ID NO: 5872252 - DNA, 16 bp, Homo sapiens
ccctgtctccagctgc

SEQ ID NO: 5872253 - DNA, 15 bp, Homo sapiens
ccctgtctccagggc

SEQ ID NO: 5872254 - DNA, 20 bp, Homo sapiens
ccctgtctccagggccccca

SEQ ID NO: 5872255 - DNA, 22 bp, Homo sapiens
ccctgtctctaaggagcagcgg

SEQ ID NO: 5872256 - DNA, 14 bp, Homo sapiens
ccctgtctctacta

SEQ ID NO: 5872257 - DNA, 16 bp, Homo sapiens
ccctgtctctgcatct

SEQ ID NO: 5872258 - DNA, 13 bp, Homo sapiens
ccctgtctgcagg

SEQ ID NO: 5872259 - DNA, 19 bp, Homo sapiens
ccctgtctgctaggcgctg

SEQ ID NO: 5872260 - DNA, 19 bp, Homo sapiens
ccctgtctgtctgtctctc

SEQ ID NO: 5872261 - DNA, 16 bp, Homo sapiens
ccctgtctgtgtccca

SEQ ID NO: 5872262 - DNA, 19 bp, Homo sapiens
ccctgtctgtgtcccagcc

SEQ ID NO: 5872263 - DNA, 15 bp, Homo sapiens
ccctgtctgttccca

SEQ ID NO: 5872264 - DNA, 16 bp, Homo sapiens
ccctgtctgttcccag

SEQ ID NO: 5872265 - DNA, 16 bp, Homo sapiens
ccctgtcttcacctgc

SEQ ID NO: 5872266 - DNA, 17 bp, Homo sapiens
ccctgtcttcacctgcc

SEQ ID NO: 5872267 - DNA, 19 bp, Homo sapiens
ccctgtcttcacctgccac

SEQ ID NO: 5872268 - DNA, 14 bp, Homo sapiens
ccctgtcttcctct

SEQ ID NO: 5872269 - DNA, 17 bp, Homo sapiens
ccctgtcttcctctgca

SEQ ID NO: 5872270 - DNA, 16 bp, Homo sapiens
ccctgtcttgctgtca

SEQ ID NO: 5872271 - DNA, 19 bp, Homo sapiens
ccctgtctttactcctcac

SEQ ID NO: 5872272 - DNA, 20 bp, Homo sapiens
ccctgtctttactcctcaca

SEQ ID NO: 5872273 - DNA, 21 bp, Homo sapiens
ccctgtgaaacgtcccacact

SEQ ID NO: 5872274 - DNA, 18 bp, Homo sapiens
ccctgtgacatggtgcct

SEQ ID NO: 5872275 - DNA, 19 bp, Homo sapiens
ccctgtgacatggtgcctg

SEQ ID NO: 5872276 - DNA, 21 bp, Homo sapiens
ccctgtgacatggtgcctgag

SEQ ID NO: 5872277 - DNA, 22 bp, Homo sapiens
ccctgtgacatggtgcctgaga

SEQ ID NO: 5872278 - DNA, 14 bp, Homo sapiens
ccctgtgactcctc

SEQ ID NO: 5872279 - DNA, 13 bp, Homo sapiens
ccctgtgatggcc

SEQ ID NO: 5872280 - DNA, 17 bp, Homo sapiens
ccctgtgatggggccct

SEQ ID NO: 5872281 - DNA, 21 bp, Homo sapiens
ccctgtgcagaagggagctgg

SEQ ID NO: 5872282 - DNA, 17 bp, Homo sapiens
ccctgtgcagaccttac

SEQ ID NO: 5872283 - DNA, 18 bp, Homo sapiens
ccctgtgcaggagctagt

SEQ ID NO: 5872284 - DNA, 23 bp, Homo sapiens
ccctgtgcagtagagagcctttc

SEQ ID NO: 5872285 - DNA, 16 bp, Homo sapiens
ccctgtgccatcacca

SEQ ID NO: 5872286 - DNA, 21 bp, Homo sapiens
ccctgtgcccacccagggccc

SEQ ID NO: 5872287 - DNA, 22 bp, Homo sapiens
ccctgtgcccccagcctcagcc

SEQ ID NO: 5872288 - DNA, 17 bp, Homo sapiens
ccctgtgccccgcctcc

SEQ ID NO: 5872289 - DNA, 13 bp, Homo sapiens
ccctgtgcccctt

SEQ ID NO: 5872290 - DNA, 14 bp, Homo sapiens
ccctgtgccctctc

SEQ ID NO: 5872291 - DNA, 18 bp, Homo sapiens
ccctgtgccctctcactg

SEQ ID NO: 5872292 - DNA, 14 bp, Homo sapiens
ccctgtgccgcact

SEQ ID NO: 5872293 - DNA, 15 bp, Homo sapiens
ccctgtgcctgctgg

SEQ ID NO: 5872294 - DNA, 14 bp, Homo sapiens
ccctgtgcctgggc

SEQ ID NO: 5872295 - DNA, 18 bp, Homo sapiens
ccctgtgcctgggccctg

SEQ ID NO: 5872296 - DNA, 14 bp, Homo sapiens
ccctgtgcctgtgt

SEQ ID NO: 5872297 - DNA, 14 bp, Homo sapiens
ccctgtgctgatcc

SEQ ID NO: 5872298 - DNA, 15 bp, Homo sapiens
ccctgtgctgatcct

SEQ ID NO: 5872299 - DNA, 18 bp, Homo sapiens
ccctgtgctgatcctgct

SEQ ID NO: 5872300 - DNA, 21 bp, Homo sapiens
ccctgtgctgatcctgctgac

SEQ ID NO: 5872301 - DNA, 21 bp, Homo sapiens
ccctgtgcttggaaacctttt

SEQ ID NO: 5872302 - DNA, 18 bp, Homo sapiens
ccctgtggaagcatggct

SEQ ID NO: 5872303 - DNA, 20 bp, Homo sapiens
ccctgtggaagcatggctgt

SEQ ID NO: 5872304 - DNA, 21 bp, Homo sapiens
ccctgtggaagcatggctgtc

SEQ ID NO: 5872305 - DNA, 23 bp, Homo sapiens
ccctgtggaatgggctcaaggtt

SEQ ID NO: 5872306 - DNA, 17 bp, Homo sapiens
ccctgtggagcccgcac

SEQ ID NO: 5872307 - DNA, 17 bp, Homo sapiens
ccctgtggagtccagct

SEQ ID NO: 5872308 - DNA, 20 bp, Homo sapiens
ccctgtggagtccagctcta

SEQ ID NO: 5872309 - DNA, 22 bp, Homo sapiens
ccctgtggagtccagctctact

SEQ ID NO: 5872310 - DNA, 19 bp, Homo sapiens
ccctgtggatgctgctgcc

SEQ ID NO: 5872311 - DNA, 21 bp, Homo sapiens
ccctgtggattccagcatttg

SEQ ID NO: 5872312 - DNA, 13 bp, Homo sapiens
ccctgtggatttt

SEQ ID NO: 5872313 - DNA, 12 bp, Homo sapiens
ccctgtggcaga

SEQ ID NO: 5872314 - DNA, 13 bp, Homo sapiens
ccctgtggcagac

SEQ ID NO: 5872315 - DNA, 14 bp, Homo sapiens
ccctgtggccaact

SEQ ID NO: 5872316 - DNA, 18 bp, Homo sapiens
ccctgtggccaactgcaa

SEQ ID NO: 5872317 - DNA, 20 bp, Homo sapiens
ccctgtggccaactgcaaaa

SEQ ID NO: 5872318 - DNA, 20 bp, Homo sapiens
ccctgtggcccacgggccgg

SEQ ID NO: 5872319 - DNA, 14 bp, Homo sapiens
ccctgtggccgcca

SEQ ID NO: 5872320 - DNA, 16 bp, Homo sapiens
ccctgtggccgccacc

SEQ ID NO: 5872321 - DNA, 19 bp, Homo sapiens
ccctgtggccgccacctga

SEQ ID NO: 5872322 - DNA, 19 bp, Homo sapiens
ccctgtgggaccgcctggc

SEQ ID NO: 5872323 - DNA, 22 bp, Homo sapiens
ccctgtgggaccgcctggccct

SEQ ID NO: 5872324 - DNA, 19 bp, Homo sapiens
ccctgtgggactcatcctt

SEQ ID NO: 5872325 - DNA, 17 bp, Homo sapiens
ccctgtgggagccgcag

SEQ ID NO: 5872326 - DNA, 22 bp, Homo sapiens
ccctgtgggagccgcagagcct

SEQ ID NO: 5872327 - DNA, 12 bp, Homo sapiens
ccctgtgggagt

SEQ ID NO: 5872328 - DNA, 20 bp, Homo sapiens
ccctgtgggagtccactttc

SEQ ID NO: 5872329 - DNA, 15 bp, Homo sapiens
ccctgtgggccccca

SEQ ID NO: 5872330 - DNA, 16 bp, Homo sapiens
ccctgtgggcccccaa

SEQ ID NO: 5872331 - DNA, 14 bp, Homo sapiens
ccctgtgggctcac

SEQ ID NO: 5872332 - DNA, 19 bp, Homo sapiens
ccctgtgggctcacaccgg

SEQ ID NO: 5872333 - DNA, 22 bp, Homo sapiens
ccctgtgggcttatgtctctgc

SEQ ID NO: 5872334 - DNA, 19 bp, Homo sapiens
ccctgtggggcaggagtgc

SEQ ID NO: 5872335 - DNA, 20 bp, Homo sapiens
ccctgtggggcaggagtgcc

SEQ ID NO: 5872336 - DNA, 15 bp, Homo sapiens
ccctgtggggcctga

SEQ ID NO: 5872337 - DNA, 18 bp, Homo sapiens
ccctgtggggcctgatgg

SEQ ID NO: 5872338 - DNA, 20 bp, Homo sapiens
ccctgtgggggcggctgtgg

SEQ ID NO: 5872339 - DNA, 16 bp, Homo sapiens
ccctgtggtctgggga

SEQ ID NO: 5872340 - DNA, 13 bp, Homo sapiens
ccctgtggtctgt

SEQ ID NO: 5872341 - DNA, 22 bp, Homo sapiens
ccctgtggtttccaaggagctg

SEQ ID NO: 5872342 - DNA, 17 bp, Homo sapiens
ccctgtgtcagagccta

SEQ ID NO: 5872343 - DNA, 16 bp, Homo sapiens
ccctgtgtcatttcaa

SEQ ID NO: 5872344 - DNA, 23 bp, Homo sapiens
ccctgtgtccgctctctcatgtg

SEQ ID NO: 5872345 - DNA, 21 bp, Homo sapiens
ccctgtgtcctccaccatgca

SEQ ID NO: 5872346 - DNA, 13 bp, Homo sapiens
ccctgtgtctttt

SEQ ID NO: 5872347 - DNA, 11 bp, Homo sapiens
ccctgtgtgca

SEQ ID NO: 5872348 - DNA, 15 bp, Homo sapiens
ccctgtgtggaccat

SEQ ID NO: 5872349 - DNA, 15 bp, Homo sapiens
ccctgtgtggccctg

SEQ ID NO: 5872350 - DNA, 12 bp, Homo sapiens
ccctgtgtgtgt

SEQ ID NO: 5872351 - DNA, 16 bp, Homo sapiens
ccctgtgtgtgtcccc

SEQ ID NO: 5872352 - DNA, 19 bp, Homo sapiens
ccctgtgttctgggctggg

SEQ ID NO: 5872353 - DNA, 20 bp, Homo sapiens
ccctgtgttctgggctgggg

SEQ ID NO: 5872354 - DNA, 16 bp, Homo sapiens
ccctgtgttgtctcta

SEQ ID NO: 5872355 - DNA, 18 bp, Homo sapiens
ccctgtgttgtctctaga

SEQ ID NO: 5872356 - DNA, 23 bp, Homo sapiens
ccctgttacttatgtagaaactg

SEQ ID NO: 5872357 - DNA, 12 bp, Homo sapiens
ccctgttatttt

SEQ ID NO: 5872358 - DNA, 19 bp, Homo sapiens
ccctgttcatgtgcctctg

SEQ ID NO: 5872359 - DNA, 14 bp, Homo sapiens
ccctgttcatgttt

SEQ ID NO: 5872360 - DNA, 16 bp, Homo sapiens
ccctgttcatgttttt

SEQ ID NO: 5872361 - DNA, 20 bp, Homo sapiens
ccctgttccccacaggtcct

SEQ ID NO: 5872362 - DNA, 21 bp, Homo sapiens
ccctgttccccacaggtcctc

SEQ ID NO: 5872363 - DNA, 16 bp, Homo sapiens
ccctgttccccagaga

SEQ ID NO: 5872364 - DNA, 14 bp, Homo sapiens
ccctgttccgcctc

SEQ ID NO: 5872365 - DNA, 14 bp, Homo sapiens
ccctgttcctgctg

SEQ ID NO: 5872366 - DNA, 12 bp, Homo sapiens
ccctgttctaag

SEQ ID NO: 5872367 - DNA, 19 bp, Homo sapiens
ccctgttctcagctccgtc

SEQ ID NO: 5872368 - DNA, 14 bp, Homo sapiens
ccctgttctccctt

SEQ ID NO: 5872369 - DNA, 13 bp, Homo sapiens
ccctgttctcctg

SEQ ID NO: 5872370 - DNA, 18 bp, Homo sapiens
ccctgttctcctgtccct

SEQ ID NO: 5872371 - DNA, 11 bp, Homo sapiens
ccctgttctcg

SEQ ID NO: 5872372 - DNA, 18 bp, Homo sapiens
ccctgttctcgttgccct

SEQ ID NO: 5872373 - DNA, 13 bp, Homo sapiens
ccctgttctggca

SEQ ID NO: 5872374 - DNA, 14 bp, Homo sapiens
ccctgttctggcag

SEQ ID NO: 5872375 - DNA, 22 bp, Homo sapiens
ccctgttctgttggggaggggt

SEQ ID NO: 5872376 - DNA, 12 bp, Homo sapiens
ccctgttcttcc

SEQ ID NO: 5872377 - DNA, 14 bp, Homo sapiens
ccctgttcttcctc

SEQ ID NO: 5872378 - DNA, 16 bp, Homo sapiens
ccctgttcttcctcca

SEQ ID NO: 5872379 - DNA, 20 bp, Homo sapiens
ccctgttcttcctccagctg

SEQ ID NO: 5872380 - DNA, 20 bp, Homo sapiens
ccctgttgaaagttgtctgg

SEQ ID NO: 5872381 - DNA, 22 bp, Homo sapiens
ccctgttgaattttgttctctg

SEQ ID NO: 5872382 - DNA, 15 bp, Homo sapiens
ccctgttgacctgcc

SEQ ID NO: 5872383 - DNA, 17 bp, Homo sapiens
ccctgttgacctgcccg

SEQ ID NO: 5872384 - DNA, 23 bp, Homo sapiens
ccctgttgagtatttgctgtttg

SEQ ID NO: 5872385 - DNA, 18 bp, Homo sapiens
ccctgttgcaaaggaaat

SEQ ID NO: 5872386 - DNA, 18 bp, Homo sapiens
ccctgttggcagctctag

SEQ ID NO: 5872387 - DNA, 11 bp, Homo sapiens
ccctgtttaat

SEQ ID NO: 5872388 - DNA, 17 bp, Homo sapiens
ccctgtttactggttct

SEQ ID NO: 5872389 - DNA, 16 bp, Homo sapiens
ccctgtttcagaggct

SEQ ID NO: 5872390 - DNA, 14 bp, Homo sapiens
ccctgtttcctgag

SEQ ID NO: 5872391 - DNA, 19 bp, Homo sapiens
ccctgtttcctgctgcttt

SEQ ID NO: 5872392 - DNA, 19 bp, Homo sapiens
ccctgtttcctttcaggag

SEQ ID NO: 5872393 - DNA, 15 bp, Homo sapiens
ccctgtttctccaca

SEQ ID NO: 5872394 - DNA, 13 bp, Homo sapiens
ccctgtttgccta

SEQ ID NO: 5872395 - DNA, 16 bp, Homo sapiens
ccctgtttgtttctga

SEQ ID NO: 5872396 - DNA, 15 bp, Homo sapiens
ccctgttttccacac

SEQ ID NO: 5872397 - DNA, 17 bp, Homo sapiens
ccctgttttccacacca

SEQ ID NO: 5872398 - DNA, 18 bp, Homo sapiens
ccctgttttctgagcccg

SEQ ID NO: 5872399 - DNA, 12 bp, Homo sapiens
cccttcctcggt

SEQ ID NO: 5872400 - DNA, 18 bp, Homo sapiens
cccttcctcggtggctct

SEQ ID NO: 5872401 - DNA, 17 bp, Homo sapiens
cccttcctctcactcct

SEQ ID NO: 5872402 - DNA, 19 bp, Homo sapiens
cccttcctctcactcctgc

SEQ ID NO: 5872403 - DNA, 20 bp, Homo sapiens
cccttcctctcactcctgcc

SEQ ID NO: 5872404 - DNA, 13 bp, Homo sapiens
cccttcctctcca

SEQ ID NO: 5872405 - DNA, 15 bp, Homo sapiens
cccttcctctccacc

SEQ ID NO: 5872406 - DNA, 16 bp, Homo sapiens
cccttcctctgctccc

SEQ ID NO: 5872407 - DNA, 18 bp, Homo sapiens
cccttcctcttcctgccc

SEQ ID NO: 5872408 - DNA, 20 bp, Homo sapiens
cccttcctcttcctgccctt

SEQ ID NO: 5872409 - DNA, 22 bp, Homo sapiens
cccttcctcttcggccctcaga

SEQ ID NO: 5872410 - DNA, 20 bp, Homo sapiens
cccttcctcttgtctgattt

SEQ ID NO: 5872411 - DNA, 14 bp, Homo sapiens
cccttcctctttgg

SEQ ID NO: 5872412 - DNA, 11 bp, Homo sapiens
cccttcctgaa

SEQ ID NO: 5872413 - DNA, 18 bp, Homo sapiens
cccttcctgacccggatt

SEQ ID NO: 5872414 - DNA, 12 bp, Homo sapiens
cccttcctgctg

SEQ ID NO: 5872415 - DNA, 11 bp, Homo sapiens
cccttcctgga

SEQ ID NO: 5872416 - DNA, 18 bp, Homo sapiens
cccttcctggaaacagca

SEQ ID NO: 5872417 - DNA, 22 bp, Homo sapiens
cccttcctggaaacagcatgaa

SEQ ID NO: 5872418 - DNA, 13 bp, Homo sapiens
cccttcctggaca

SEQ ID NO: 5872419 - DNA, 17 bp, Homo sapiens
cccttcctggacacact

SEQ ID NO: 5872420 - DNA, 18 bp, Homo sapiens
cccttcctggacacactc

SEQ ID NO: 5872421 - DNA, 18 bp, Homo sapiens
cccttcctggacagctgt

SEQ ID NO: 5872422 - DNA, 18 bp, Homo sapiens
cccttcctggactggccc

SEQ ID NO: 5872423 - DNA, 22 bp, Homo sapiens
cccttcctggactggcccttgc

SEQ ID NO: 5872424 - DNA, 19 bp, Homo sapiens
cccttcctggaggctgcct

SEQ ID NO: 5872425 - DNA, 23 bp, Homo sapiens
cccttcctggaggctgcctatgt

SEQ ID NO: 5872426 - DNA, 20 bp, Homo sapiens
cccttcctggcacattgccc

SEQ ID NO: 5872427 - DNA, 13 bp, Homo sapiens
cccttcctggccc

SEQ ID NO: 5872428 - DNA, 16 bp, Homo sapiens
cccttcctggcccagg

SEQ ID NO: 5872429 - DNA, 17 bp, Homo sapiens
cccttcctggcccaggc

SEQ ID NO: 5872430 - DNA, 14 bp, Homo sapiens
cccttcctggctag

SEQ ID NO: 5872431 - DNA, 18 bp, Homo sapiens
cccttcctgggcacacgc

SEQ ID NO: 5872432 - DNA, 23 bp, Homo sapiens
cccttcctgggcacacgctgctc

SEQ ID NO: 5872433 - DNA, 13 bp, Homo sapiens
cccttcctgggta

SEQ ID NO: 5872434 - DNA, 19 bp, Homo sapiens
cccttcctgtccccagggg

SEQ ID NO: 5872435 - DNA, 17 bp, Homo sapiens
cccttcctgtccgccct

SEQ ID NO: 5872436 - DNA, 14 bp, Homo sapiens
cccttcctgtcctg

SEQ ID NO: 5872437 - DNA, 15 bp, Homo sapiens
cccttcctgtcctgc

SEQ ID NO: 5872438 - DNA, 19 bp, Homo sapiens
cccttcctgtcctgcctcc

SEQ ID NO: 5872439 - DNA, 21 bp, Homo sapiens
cccttcctgtcctgcctcctc

SEQ ID NO: 5872440 - DNA, 17 bp, Homo sapiens
cccttcctgtcctgctc

SEQ ID NO: 5872441 - DNA, 13 bp, Homo sapiens
cccttcctgtctg

SEQ ID NO: 5872442 - DNA, 14 bp, Homo sapiens
cccttcctgtctgg

SEQ ID NO: 5872443 - DNA, 18 bp, Homo sapiens
cccttcctgtctggccca

SEQ ID NO: 5872444 - DNA, 13 bp, Homo sapiens
cccttcctgtgcc

SEQ ID NO: 5872445 - DNA, 11 bp, Homo sapiens
cccttcctgtt

SEQ ID NO: 5872446 - DNA, 18 bp, Homo sapiens
cccttcctgttcttcctt

SEQ ID NO: 5872447 - DNA, 14 bp, Homo sapiens
cccttccttgctct

SEQ ID NO: 5872448 - DNA, 14 bp, Homo sapiens
cccttccttgggca

SEQ ID NO: 5872449 - DNA, 15 bp, Homo sapiens
cccttccttggggaa

SEQ ID NO: 5872450 - DNA, 11 bp, Homo sapiens
cccttcctttc

SEQ ID NO: 5872451 - DNA, 15 bp, Homo sapiens
cccttcctttcctct

SEQ ID NO: 5872452 - DNA, 20 bp, Homo sapiens
cccttcctttcctctgcagc

SEQ ID NO: 5872453 - DNA, 18 bp, Homo sapiens
cccttcgacatgctgcca

SEQ ID NO: 5872454 - DNA, 22 bp, Homo sapiens
cccttcgacatgctgccaggaa

SEQ ID NO: 5872455 - DNA, 14 bp, Homo sapiens
cccttcgctcctgt

SEQ ID NO: 5872456 - DNA, 16 bp, Homo sapiens
cccttcgctctgctgg

SEQ ID NO: 5872457 - DNA, 18 bp, Homo sapiens
cccttcgctgccaggaca

SEQ ID NO: 5872458 - DNA, 16 bp, Homo sapiens
cccttcggagccaaca

SEQ ID NO: 5872459 - DNA, 22 bp, Homo sapiens
cccttcggtattgttcaaagaa

SEQ ID NO: 5872460 - DNA, 23 bp, Homo sapiens
cccttctacactctcctgggccc

SEQ ID NO: 5872461 - DNA, 22 bp, Homo sapiens
cccttctaccccacctgacctc

SEQ ID NO: 5872462 - DNA, 18 bp, Homo sapiens
cccttctactttttcctt

SEQ ID NO: 5872463 - DNA, 23 bp, Homo sapiens
cccttctatttggggcttgatga

SEQ ID NO: 5872464 - DNA, 15 bp, Homo sapiens
cccttctcacagcac

SEQ ID NO: 5872465 - DNA, 15 bp, Homo sapiens
cccttctcagaatct

SEQ ID NO: 5872466 - DNA, 15 bp, Homo sapiens
cccttctcatcactc

SEQ ID NO: 5872467 - DNA, 22 bp, Homo sapiens
cccttctcatctccccacgccc

SEQ ID NO: 5872468 - DNA, 13 bp, Homo sapiens
cccttctccatct

SEQ ID NO: 5872469 - DNA, 17 bp, Homo sapiens
cccttctccatctctct

SEQ ID NO: 5872470 - DNA, 18 bp, Homo sapiens
cccttctccatctctctg

SEQ ID NO: 5872471 - DNA, 22 bp, Homo sapiens
cccttctccatctctctggccc

SEQ ID NO: 5872472 - DNA, 15 bp, Homo sapiens
cccttctcccagcac

SEQ ID NO: 5872473 - DNA, 14 bp, Homo sapiens
cccttctccccagc

SEQ ID NO: 5872474 - DNA, 15 bp, Homo sapiens
cccttctccccagcc

SEQ ID NO: 5872475 - DNA, 14 bp, Homo sapiens
cccttctcccctgc

SEQ ID NO: 5872476 - DNA, 16 bp, Homo sapiens
cccttctcccctgcac

SEQ ID NO: 5872477 - DNA, 21 bp, Homo sapiens
cccttctcccctgcactgtaa

SEQ ID NO: 5872478 - DNA, 13 bp, Homo sapiens
cccttctccctgg

SEQ ID NO: 5872479 - DNA, 14 bp, Homo sapiens
cccttctccctgga

SEQ ID NO: 5872480 - DNA, 18 bp, Homo sapiens
cccttctcctcttgtaaa

SEQ ID NO: 5872481 - DNA, 23 bp, Homo sapiens
cccttctcctttccttcccaggc

SEQ ID NO: 5872482 - DNA, 18 bp, Homo sapiens
cccttctctccttccctc

SEQ ID NO: 5872483 - DNA, 19 bp, Homo sapiens
cccttctctccttccctct

SEQ ID NO: 5872484 - DNA, 14 bp, Homo sapiens
cccttctctctcca

SEQ ID NO: 5872485 - DNA, 15 bp, Homo sapiens
cccttctctctttct

SEQ ID NO: 5872486 - DNA, 23 bp, Homo sapiens
cccttctctgctccaccacatcc

SEQ ID NO: 5872487 - DNA, 12 bp, Homo sapiens
cccttctctgtt

SEQ ID NO: 5872488 - DNA, 13 bp, Homo sapiens
cccttctctgttg

SEQ ID NO: 5872489 - DNA, 15 bp, Homo sapiens
cccttctcttagtta

SEQ ID NO: 5872490 - DNA, 15 bp, Homo sapiens
cccttctcttccagg

SEQ ID NO: 5872491 - DNA, 19 bp, Homo sapiens
cccttctcttccaggcagc

SEQ ID NO: 5872492 - DNA, 17 bp, Homo sapiens
cccttctgactgtttat

SEQ ID NO: 5872493 - DNA, 12 bp, Homo sapiens
cccttctgccct

SEQ ID NO: 5872494 - DNA, 12 bp, Homo sapiens
cccttctgcctt

SEQ ID NO: 5872495 - DNA, 12 bp, Homo sapiens
cccttctgcttt

SEQ ID NO: 5872496 - DNA, 21 bp, Homo sapiens
cccttctgggcatctgttctg

SEQ ID NO: 5872497 - DNA, 16 bp, Homo sapiens
cccttctgtccctcac

SEQ ID NO: 5872498 - DNA, 17 bp, Homo sapiens
cccttctgtccctcaca

SEQ ID NO: 5872499 - DNA, 17 bp, Homo sapiens
cccttctgtgcccagct

SEQ ID NO: 5872500 - DNA, 12 bp, Homo sapiens
cccttctgtgtc

SEQ ID NO: 5872501 - DNA, 12 bp, Homo sapiens
cccttcttcccg

SEQ ID NO: 5872502 - DNA, 13 bp, Homo sapiens
cccttcttcccgc

SEQ ID NO: 5872503 - DNA, 21 bp, Homo sapiens
cccttcttcccgccccacctc

SEQ ID NO: 5872504 - DNA, 14 bp, Homo sapiens
cccttcttcctccc

SEQ ID NO: 5872505 - DNA, 18 bp, Homo sapiens
cccttcttgcctgctggg

SEQ ID NO: 5872506 - DNA, 20 bp, Homo sapiens
cccttcttgcctgctgggct

SEQ ID NO: 5872507 - DNA, 21 bp, Homo sapiens
cccttcttgcctgctgggctc

SEQ ID NO: 5872508 - DNA, 16 bp, Homo sapiens
cccttcttgctgccct

SEQ ID NO: 5872509 - DNA, 22 bp, Homo sapiens
cccttcttgggtctgccctgcc

SEQ ID NO: 5872510 - DNA, 21 bp, Homo sapiens
cccttcttggtgcttacacat

SEQ ID NO: 5872511 - DNA, 18 bp, Homo sapiens
cccttctttaaatcaaaa

SEQ ID NO: 5872512 - DNA, 19 bp, Homo sapiens
cccttctttaaatcaaaag

SEQ ID NO: 5872513 - DNA, 12 bp, Homo sapiens
cccttctttcca

SEQ ID NO: 5872514 - DNA, 14 bp, Homo sapiens
cccttctttcctct

SEQ ID NO: 5872515 - DNA, 16 bp, Homo sapiens
cccttctttgcttctt

SEQ ID NO: 5872516 - DNA, 23 bp, Homo sapiens
cccttctttgtagaactgcccat

SEQ ID NO: 5872517 - DNA, 22 bp, Homo sapiens
cccttcttttatgagcagaagg

SEQ ID NO: 5872518 - DNA, 11 bp, Homo sapiens
cccttcttttt

SEQ ID NO: 5872519 - DNA, 19 bp, Homo sapiens
cccttgaaaactctcagtc

SEQ ID NO: 5872520 - DNA, 13 bp, Homo sapiens
cccttgaacctca

SEQ ID NO: 5872521 - DNA, 21 bp, Homo sapiens
cccttgaactgttctggcctc

SEQ ID NO: 5872522 - DNA, 19 bp, Homo sapiens
cccttgaagcaataactcc

SEQ ID NO: 5872523 - DNA, 22 bp, Homo sapiens
cccttgaagcaataactccaag

SEQ ID NO: 5872524 - DNA, 18 bp, Homo sapiens
cccttgacaactggcagg

SEQ ID NO: 5872525 - DNA, 14 bp, Homo sapiens
cccttgaccccaca

SEQ ID NO: 5872526 - DNA, 15 bp, Homo sapiens
cccttgactgttggg

SEQ ID NO: 5872527 - DNA, 19 bp, Homo sapiens
cccttgactttgctcctca

SEQ ID NO: 5872528 - DNA, 12 bp, Homo sapiens
cccttgagacct

SEQ ID NO: 5872529 - DNA, 15 bp, Homo sapiens
cccttgagacctcag

SEQ ID NO: 5872530 - DNA, 20 bp, Homo sapiens
cccttgagacctcagccatg

SEQ ID NO: 5872531 - DNA, 14 bp, Homo sapiens
cccttgagatgagt

SEQ ID NO: 5872532 - DNA, 22 bp, Homo sapiens
cccttgagccccagaggcagag

SEQ ID NO: 5872533 - DNA, 13 bp, Homo sapiens
cccttgagccctc

SEQ ID NO: 5872534 - DNA, 18 bp, Homo sapiens
cccttgagctccccaaaa

SEQ ID NO: 5872535 - DNA, 20 bp, Homo sapiens
cccttgagctccccaaaaac

SEQ ID NO: 5872536 - DNA, 23 bp, Homo sapiens
cccttgagctggttttctctgat

SEQ ID NO: 5872537 - DNA, 13 bp, Homo sapiens
cccttgaggggcc

SEQ ID NO: 5872538 - DNA, 17 bp, Homo sapiens
cccttgagtaggccctg

SEQ ID NO: 5872539 - DNA, 18 bp, Homo sapiens
cccttgagtaggccctgc

SEQ ID NO: 5872540 - DNA, 20 bp, Homo sapiens
cccttgagtaggccctgctt

SEQ ID NO: 5872541 - DNA, 21 bp, Homo sapiens
cccttgagtaggccctgcttt

SEQ ID NO: 5872542 - DNA, 21 bp, Homo sapiens
cccttgatcagccccaccctg

SEQ ID NO: 5872543 - DNA, 19 bp, Homo sapiens
cccttgatgcacagagaag

SEQ ID NO: 5872544 - DNA, 20 bp, Homo sapiens
cccttgatgcccagctcagt

SEQ ID NO: 5872545 - DNA, 18 bp, Homo sapiens
cccttgatgggtgctgcc

SEQ ID NO: 5872546 - DNA, 19 bp, Homo sapiens
cccttgattcccaccgtac

SEQ ID NO: 5872547 - DNA, 12 bp, Homo sapiens
cccttgcaagcc

SEQ ID NO: 5872548 - DNA, 18 bp, Homo sapiens
cccttgcacagctggaga

SEQ ID NO: 5872549 - DNA, 20 bp, Homo sapiens
cccttgcacaggccacttgc

SEQ ID NO: 5872550 - DNA, 20 bp, Homo sapiens
cccttgcaccgtcctcagca

SEQ ID NO: 5872551 - DNA, 22 bp, Homo sapiens
cccttgcactaaagtatgtaaa

SEQ ID NO: 5872552 - DNA, 14 bp, Homo sapiens
cccttgcactgtat

SEQ ID NO: 5872553 - DNA, 13 bp, Homo sapiens
cccttgcagggtg

SEQ ID NO: 5872554 - DNA, 23 bp, Homo sapiens
cccttgcagttcagcaccaccct

SEQ ID NO: 5872555 - DNA, 13 bp, Homo sapiens
cccttgccaaggc

SEQ ID NO: 5872556 - DNA, 19 bp, Homo sapiens
cccttgccaaggccgccca

SEQ ID NO: 5872557 - DNA, 18 bp, Homo sapiens
cccttgccacatcgcagc

SEQ ID NO: 5872558 - DNA, 16 bp, Homo sapiens
cccttgccactttgca

SEQ ID NO: 5872559 - DNA, 17 bp, Homo sapiens
cccttgccactttgcac

SEQ ID NO: 5872560 - DNA, 13 bp, Homo sapiens
cccttgccagctg

SEQ ID NO: 5872561 - DNA, 18 bp, Homo sapiens
cccttgcccaactcccag

SEQ ID NO: 5872562 - DNA, 20 bp, Homo sapiens
cccttgcccagggctcagcc

SEQ ID NO: 5872563 - DNA, 23 bp, Homo sapiens
cccttgcccagggctcagcctgg

SEQ ID NO: 5872564 - DNA, 23 bp, Homo sapiens
cccttgccccaggccaggtagca

SEQ ID NO: 5872565 - DNA, 15 bp, Homo sapiens
cccttgcccccctgg

SEQ ID NO: 5872566 - DNA, 18 bp, Homo sapiens
cccttgcccgccagccag

SEQ ID NO: 5872567 - DNA, 22 bp, Homo sapiens
cccttgcccgccagccagtggc

SEQ ID NO: 5872568 - DNA, 12 bp, Homo sapiens
cccttgccctga

SEQ ID NO: 5872569 - DNA, 20 bp, Homo sapiens
cccttgccctgacctcccag

SEQ ID NO: 5872570 - DNA, 21 bp, Homo sapiens
cccttgccctgacctcccagc

SEQ ID NO: 5872571 - DNA, 22 bp, Homo sapiens
cccttgccgggccttttttcca

SEQ ID NO: 5872572 - DNA, 18 bp, Homo sapiens
cccttgccggggcctgga

SEQ ID NO: 5872573 - DNA, 19 bp, Homo sapiens
cccttgcctccccatttcc

SEQ ID NO: 5872574 - DNA, 16 bp, Homo sapiens
cccttgcctctgccct

SEQ ID NO: 5872575 - DNA, 17 bp, Homo sapiens
cccttgcctgcctccta

SEQ ID NO: 5872576 - DNA, 20 bp, Homo sapiens
cccttgcctgtgccaggtga

SEQ ID NO: 5872577 - DNA, 14 bp, Homo sapiens
ccctttcttggcca

SEQ ID NO: 5872578 - DNA, 21 bp, Homo sapiens
ccctttcttttcatgcccatc

SEQ ID NO: 5872579 - DNA, 16 bp, Homo sapiens
ccctttgaagataata

SEQ ID NO: 5872580 - DNA, 17 bp, Homo sapiens
ccctttgaagcctcagc

SEQ ID NO: 5872581 - DNA, 15 bp, Homo sapiens
ccctttgaccttccc

SEQ ID NO: 5872582 - DNA, 15 bp, Homo sapiens
ccctttgacttcagc

SEQ ID NO: 5872583 - DNA, 20 bp, Homo sapiens
ccctttgacttcagctgcct

SEQ ID NO: 5872584 - DNA, 21 bp, Homo sapiens
ccctttgacttcagctgcctg

SEQ ID NO: 5872585 - DNA, 18 bp, Homo sapiens
ccctttgagatctgggga

SEQ ID NO: 5872586 - DNA, 16 bp, Homo sapiens
ccctttgcactgtaat

SEQ ID NO: 5872587 - DNA, 18 bp, Homo sapiens
ccctttgcactgtaatga

SEQ ID NO: 5872588 - DNA, 21 bp, Homo sapiens
ccctttgcagtgtgcagggtg

SEQ ID NO: 5872589 - DNA, 21 bp, Homo sapiens
ccctttgcatagctctccttc

SEQ ID NO: 5872590 - DNA, 12 bp, Homo sapiens
ccctttgctctg

SEQ ID NO: 5872591 - DNA, 22 bp, Homo sapiens
ccctttgctctgatttccttcc

SEQ ID NO: 5872592 - DNA, 12 bp, Homo sapiens
ccctttgctgtc

SEQ ID NO: 5872593 - DNA, 14 bp, Homo sapiens
ccctttgctgtgag

SEQ ID NO: 5872594 - DNA, 13 bp, Homo sapiens
ccctttgcttccc

SEQ ID NO: 5872595 - DNA, 22 bp, Homo sapiens
ccctttggattatgcccatgaa

SEQ ID NO: 5872596 - DNA, 18 bp, Homo sapiens
ccctttggccaacagggt

SEQ ID NO: 5872597 - DNA, 21 bp, Homo sapiens
ccctttggccccactttgaag

SEQ ID NO: 5872598 - DNA, 15 bp, Homo sapiens
ccctttggcttctga

SEQ ID NO: 5872599 - DNA, 14 bp, Homo sapiens
ccctttgggcccag

SEQ ID NO: 5872600 - DNA, 17 bp, Homo sapiens
ccctttgggcccaggga

SEQ ID NO: 5872601 - DNA, 15 bp, Homo sapiens
ccctttgggccctgc

SEQ ID NO: 5872602 - DNA, 19 bp, Homo sapiens
ccctttgggccctgcatgt

SEQ ID NO: 5872603 - DNA, 22 bp, Homo sapiens
ccctttgggccctgcatgtagt

SEQ ID NO: 5872604 - DNA, 23 bp, Homo sapiens
ccctttggggatagtctggaaag

SEQ ID NO: 5872605 - DNA, 20 bp, Homo sapiens
ccctttggggtagaccttga

SEQ ID NO: 5872606 - DNA, 21 bp, Homo sapiens
ccctttggtttgacaattttg

SEQ ID NO: 5872607 - DNA, 16 bp, Homo sapiens
ccctttggtttggcct

SEQ ID NO: 5872608 - DNA, 18 bp, Homo sapiens
ccctttggtttggcctcc

SEQ ID NO: 5872609 - DNA, 20 bp, Homo sapiens
ccctttggtttggcctccat

SEQ ID NO: 5872610 - DNA, 16 bp, Homo sapiens
ccctttggttttacta

SEQ ID NO: 5872611 - DNA, 20 bp, Homo sapiens
ccctttggtttttttcttct

SEQ ID NO: 5872612 - DNA, 15 bp, Homo sapiens
ccctttgtattataa

SEQ ID NO: 5872613 - DNA, 17 bp, Homo sapiens
ccctttgtcctcctgct

SEQ ID NO: 5872614 - DNA, 13 bp, Homo sapiens
ccctttgtcctgc

SEQ ID NO: 5872615 - DNA, 17 bp, Homo sapiens
ccctttgtctttcaaac

SEQ ID NO: 5872616 - DNA, 14 bp, Homo sapiens
ccctttgtgctgtg

SEQ ID NO: 5872617 - DNA, 19 bp, Homo sapiens
ccctttgtggattcttttt

SEQ ID NO: 5872618 - DNA, 23 bp, Homo sapiens
ccctttgtgtgctctccattctg

SEQ ID NO: 5872619 - DNA, 15 bp, Homo sapiens
cccttttaaagttga

SEQ ID NO: 5872620 - DNA, 14 bp, Homo sapiens
cccttttaatataa

SEQ ID NO: 5872621 - DNA, 17 bp, Homo sapiens
cccttttacattctgtg

SEQ ID NO: 5872622 - DNA, 17 bp, Homo sapiens
cccttttaccactccca

SEQ ID NO: 5872623 - DNA, 23 bp, Homo sapiens
cccttttagtttgatcagacagc

SEQ ID NO: 5872624 - DNA, 22 bp, Homo sapiens
cccttttatcttctagccacag

SEQ ID NO: 5872625 - DNA, 23 bp, Homo sapiens
cccttttcaagttgagaacaaaa

SEQ ID NO: 5872626 - DNA, 20 bp, Homo sapiens
cccttttcagctgagccctg

SEQ ID NO: 5872627 - DNA, 21 bp, Homo sapiens
cccttttcagctgagccctgg

SEQ ID NO: 5872628 - DNA, 15 bp, Homo sapiens
cccttttcagcttct

SEQ ID NO: 5872629 - DNA, 16 bp, Homo sapiens
cccttttcagcttctg

SEQ ID NO: 5872630 - DNA, 9 bp, Homo sapiens
cccttttcc

SEQ ID NO: 5872631 - DNA, 16 bp, Homo sapiens
cccttttccagcctca

SEQ ID NO: 5872632 - DNA, 15 bp, Homo sapiens
cccttttcccccttc

SEQ ID NO: 5872633 - DNA, 16 bp, Homo sapiens
cccttttcccccttcc

SEQ ID NO: 5872634 - DNA, 13 bp, Homo sapiens
cccttttcctgtc

SEQ ID NO: 5872635 - DNA, 18 bp, Homo sapiens
cccttttcctgtcagtgt

SEQ ID NO: 5872636 - DNA, 19 bp, Homo sapiens
cccttttcctgtcagtgtt

SEQ ID NO: 5872637 - DNA, 11 bp, Homo sapiens
cccttttcctt

SEQ ID NO: 5872638 - DNA, 13 bp, Homo sapiens
cccttttctatgt

SEQ ID NO: 5872639 - DNA, 12 bp, Homo sapiens
cccttttctcag

SEQ ID NO: 5872640 - DNA, 23 bp, Homo sapiens
cccttttctgggtttgaagctgc

SEQ ID NO: 5872641 - DNA, 13 bp, Homo sapiens
cccttttctgttt

SEQ ID NO: 5872642 - DNA, 16 bp, Homo sapiens
cccttttctgtttagg

SEQ ID NO: 5872643 - DNA, 21 bp, Homo sapiens
cccttttctttaagttttatt

SEQ ID NO: 5872644 - DNA, 15 bp, Homo sapiens
cccttttctttcctt

SEQ ID NO: 5872645 - DNA, 13 bp, Homo sapiens
cccttttctttga

SEQ ID NO: 5872646 - DNA, 18 bp, Homo sapiens
cccttttcttttctaccc

SEQ ID NO: 5872647 - DNA, 23 bp, Homo sapiens
cccttttcttttctaccctagcc

SEQ ID NO: 5872648 - DNA, 22 bp, Homo sapiens
cccttttctttttcccttgaac

SEQ ID NO: 5872649 - DNA, 14 bp, Homo sapiens
cccttttgcctggc

SEQ ID NO: 5872650 - DNA, 22 bp, Homo sapiens
cccttttggcccccgagctggg

SEQ ID NO: 5872651 - DNA, 20 bp, Homo sapiens
cccttttgttgagccaggcc

SEQ ID NO: 5872652 - DNA, 21 bp, Homo sapiens
ccctttttatgtgggatatag

SEQ ID NO: 5872653 - DNA, 22 bp, Homo sapiens
ccctttttcaataactggaaca

SEQ ID NO: 5872654 - DNA, 14 bp, Homo sapiens
ccctttttcaatga

SEQ ID NO: 5872655 - DNA, 15 bp, Homo sapiens
ccctttttctccaca

SEQ ID NO: 5872656 - DNA, 21 bp, Homo sapiens
ccctttttctccacactccac

SEQ ID NO: 5872657 - DNA, 22 bp, Homo sapiens
ccctttttctccacactccact

SEQ ID NO: 5872658 - DNA, 15 bp, Homo sapiens
ccctttttgcagggg

SEQ ID NO: 5872659 - DNA, 21 bp, Homo sapiens
cccttttttgtacaatatgtt

SEQ ID NO: 5872660 - DNA, 22 bp, Homo sapiens
ccgaaaaatcctcttcctctga

SEQ ID NO: 5872661 - DNA, 17 bp, Homo sapiens
ccgaaaacgtggctgct

SEQ ID NO: 5872662 - DNA, 19 bp, Homo sapiens
ccgaaaatggacattgaga

SEQ ID NO: 5872663 - DNA, 17 bp, Homo sapiens
ccgaaaccaaagaagaa

SEQ ID NO: 5872664 - DNA, 20 bp, Homo sapiens
ccgaaacccttgactgttat

SEQ ID NO: 5872665 - DNA, 19 bp, Homo sapiens
ccgaaagaggcacccttcc

SEQ ID NO: 5872666 - DNA, 19 bp, Homo sapiens
ccgaaaggcaattatatct

SEQ ID NO: 5872667 - DNA, 23 bp, Homo sapiens
ccgaaagggttaatcatatttga

SEQ ID NO: 5872668 - DNA, 18 bp, Homo sapiens
ccgaaaggtcacctcact

SEQ ID NO: 5872669 - DNA, 23 bp, Homo sapiens
ccgaaaggtcacctcactcagca

SEQ ID NO: 5872670 - DNA, 16 bp, Homo sapiens
ccgaaatcagccccca

SEQ ID NO: 5872671 - DNA, 14 bp, Homo sapiens
ccgaacagggactt

SEQ ID NO: 5872672 - DNA, 18 bp, Homo sapiens
ccgaaccccccactccct

SEQ ID NO: 5872673 - DNA, 22 bp, Homo sapiens
ccgaacccgagtccgcgctggg

SEQ ID NO: 5872674 - DNA, 13 bp, Homo sapiens
ccgaacctcctct

SEQ ID NO: 5872675 - DNA, 14 bp, Homo sapiens
ccgaacgctctgca

SEQ ID NO: 5872676 - DNA, 18 bp, Homo sapiens
ccgaactccaggctgggc

SEQ ID NO: 5872677 - DNA, 19 bp, Homo sapiens
ccgaactccaggctgggct

SEQ ID NO: 5872678 - DNA, 20 bp, Homo sapiens
ccgaactgttcaagtgtccc

SEQ ID NO: 5872679 - DNA, 18 bp, Homo sapiens
ccgaagaatggagaggaa

SEQ ID NO: 5872680 - DNA, 22 bp, Homo sapiens
ccgaagaggaagcaagaaagcc

SEQ ID NO: 5872681 - DNA, 16 bp, Homo sapiens
ccgaagcccaggctga

SEQ ID NO: 5872682 - DNA, 21 bp, Homo sapiens
ccgaagctaacagggaaggca

SEQ ID NO: 5872683 - DNA, 23 bp, Homo sapiens
ccgaagctaacagggaaggcagg

SEQ ID NO: 5872684 - DNA, 19 bp, Homo sapiens
ccgaaggaaaagggctttc

SEQ ID NO: 5872685 - DNA, 20 bp, Homo sapiens
ccgaagggacggggcccgcc

SEQ ID NO: 5872686 - DNA, 22 bp, Homo sapiens
ccgaagggactggatctgcagg

SEQ ID NO: 5872687 - DNA, 15 bp, Homo sapiens
ccgaagggcagcccc

SEQ ID NO: 5872688 - DNA, 15 bp, Homo sapiens
ccgaaggtgctggag

SEQ ID NO: 5872689 - DNA, 21 bp, Homo sapiens
ccgaagtggactggcccctgg

SEQ ID NO: 5872690 - DNA, 15 bp, Homo sapiens
ccgaatatattactg

SEQ ID NO: 5872691 - DNA, 15 bp, Homo sapiens
ccgaatcccccaggg

SEQ ID NO: 5872692 - DNA, 19 bp, Homo sapiens
ccgaatgactatgtccaga

SEQ ID NO: 5872693 - DNA, 13 bp, Homo sapiens
ccgaatgtgtctt

SEQ ID NO: 5872694 - DNA, 22 bp, Homo sapiens
ccgaattcgctgttaccgcctg

SEQ ID NO: 5872695 - DNA, 18 bp, Homo sapiens
ccgaatttggtacacatg

SEQ ID NO: 5872696 - DNA, 20 bp, Homo sapiens
ccgaatttggtacacatgtg

SEQ ID NO: 5872697 - DNA, 23 bp, Homo sapiens
ccgaattttattttacagagctt

SEQ ID NO: 5872698 - DNA, 15 bp, Homo sapiens
ccgacaaccgatgct

SEQ ID NO: 5872699 - DNA, 20 bp, Homo sapiens
ccgacaaccgatgctccagc

SEQ ID NO: 5872700 - DNA, 23 bp, Homo sapiens
ccgacacacggggctcgggcctt

SEQ ID NO: 5872701 - DNA, 21 bp, Homo sapiens
ccgacaccactcctgccagcc

SEQ ID NO: 5872702 - DNA, 13 bp, Homo sapiens
ccgacaccactgg

SEQ ID NO: 5872703 - DNA, 14 bp, Homo sapiens
ccgacaccactggg

SEQ ID NO: 5872704 - DNA, 15 bp, Homo sapiens
ccgacactctcaccc

SEQ ID NO: 5872705 - DNA, 22 bp, Homo sapiens
ccgacactgagctgtgacccag

SEQ ID NO: 5872706 - DNA, 14 bp, Homo sapiens
ccgacactgctgca

SEQ ID NO: 5872707 - DNA, 16 bp, Homo sapiens
ccgacagcccagccta

SEQ ID NO: 5872708 - DNA, 12 bp, Homo sapiens
ccgacagcctgg

SEQ ID NO: 5872709 - DNA, 15 bp, Homo sapiens
ccgacagcctggcac

SEQ ID NO: 5872710 - DNA, 21 bp, Homo sapiens
ccgacagcggccttgaagaca

SEQ ID NO: 5872711 - DNA, 19 bp, Homo sapiens
ccgacagtcggtgacccca

SEQ ID NO: 5872712 - DNA, 13 bp, Homo sapiens
ccgacagtggctc

SEQ ID NO: 5872713 - DNA, 17 bp, Homo sapiens
ccgacagtggctctcca

SEQ ID NO: 5872714 - DNA, 13 bp, Homo sapiens
ccgacatcagcat

SEQ ID NO: 5872715 - DNA, 16 bp, Homo sapiens
ccgacatgtactgcta

SEQ ID NO: 5872716 - DNA, 15 bp, Homo sapiens
ccgacattgtctccc

SEQ ID NO: 5872717 - DNA, 15 bp, Homo sapiens
ccgaccaactgccct

SEQ ID NO: 5872718 - DNA, 15 bp, Homo sapiens
ccgaccaatccccag

SEQ ID NO: 5872719 - DNA, 15 bp, Homo sapiens
ccgaccacctgccca

SEQ ID NO: 5872720 - DNA, 13 bp, Homo sapiens
ccgaccagacacc

SEQ ID NO: 5872721 - DNA, 17 bp, Homo sapiens
ccgaccagaggagcctt

SEQ ID NO: 5872722 - DNA, 22 bp, Homo sapiens
ccgaccaggctggacaccctct

SEQ ID NO: 5872723 - DNA, 12 bp, Homo sapiens
ccgacccagcca

SEQ ID NO: 5872724 - DNA, 13 bp, Homo sapiens
ccgacccagccag

SEQ ID NO: 5872725 - DNA, 13 bp, Homo sapiens
ccgacccagctct

SEQ ID NO: 5872726 - DNA, 21 bp, Homo sapiens
ccgaccccacctgaggcagga

SEQ ID NO: 5872727 - DNA, 14 bp, Homo sapiens
ccgacccctgtcca

SEQ ID NO: 5872728 - DNA, 17 bp, Homo sapiens
ccgacccgaggcccaga

SEQ ID NO: 5872729 - DNA, 22 bp, Homo sapiens
ccgacccgggtctggtgctgag

SEQ ID NO: 5872730 - DNA, 13 bp, Homo sapiens
ccgaccctcctgg

SEQ ID NO: 5872731 - DNA, 18 bp, Homo sapiens
ccgaccctctgggaacct

SEQ ID NO: 5872732 - DNA, 14 bp, Homo sapiens
ccgaccctgccctg

SEQ ID NO: 5872733 - DNA, 12 bp, Homo sapiens
ccgaccctgcgg

SEQ ID NO: 5872734 - DNA, 16 bp, Homo sapiens
ccgaccctgcggcctc

SEQ ID NO: 5872735 - DNA, 16 bp, Homo sapiens
ccgacccttgccgtct

SEQ ID NO: 5872736 - DNA, 14 bp, Homo sapiens
ccgaccgggccagg

SEQ ID NO: 5872737 - DNA, 13 bp, Homo sapiens
ccgacctcagcct

SEQ ID NO: 5872738 - DNA, 15 bp, Homo sapiens
ccgacctcagccttc

SEQ ID NO: 5872739 - DNA, 13 bp, Homo sapiens
ccgacctcgtcct

SEQ ID NO: 5872740 - DNA, 22 bp, Homo sapiens
ccgacctgaggacatggcttct

SEQ ID NO: 5872741 - DNA, 13 bp, Homo sapiens
ccgacctggccgc

SEQ ID NO: 5872742 - DNA, 13 bp, Homo sapiens
ccgacctggctgc

SEQ ID NO: 5872743 - DNA, 23 bp, Homo sapiens
ccgacctggctgcccctcacctt

SEQ ID NO: 5872744 - DNA, 18 bp, Homo sapiens
ccgacgccacagcccagc

SEQ ID NO: 5872745 - DNA, 21 bp, Homo sapiens
ccgacgccacagcccagccac

SEQ ID NO: 5872746 - DNA, 13 bp, Homo sapiens
ccgacgcccaccc

SEQ ID NO: 5872747 - DNA, 16 bp, Homo sapiens
ccgacgcgtctcctgt

SEQ ID NO: 5872748 - DNA, 22 bp, Homo sapiens
ccgacggcctccaggaggggcc

SEQ ID NO: 5872749 - DNA, 22 bp, Homo sapiens
ccgacggctgtgacgcagccgg

SEQ ID NO: 5872750 - DNA, 17 bp, Homo sapiens
ccgacgtctatcctttc

SEQ ID NO: 5872751 - DNA, 15 bp, Homo sapiens
ccgactaccccagtc

SEQ ID NO: 5872752 - DNA, 16 bp, Homo sapiens
ccgactaccccagtcc

SEQ ID NO: 5872753 - DNA, 14 bp, Homo sapiens
ccgactagacacac

SEQ ID NO: 5872754 - DNA, 17 bp, Homo sapiens
ccgactagacacacaaa

SEQ ID NO: 5872755 - DNA, 13 bp, Homo sapiens
ccgagtgagtcag

SEQ ID NO: 5872756 - DNA, 13 bp, Homo sapiens
ccgagtgcactgc

SEQ ID NO: 5872757 - DNA, 17 bp, Homo sapiens
ccgagtgcggcgtggag

SEQ ID NO: 5872758 - DNA, 22 bp, Homo sapiens
ccgagtggatagatgccctgct

SEQ ID NO: 5872759 - DNA, 22 bp, Homo sapiens
ccgagtggctgccggaggagca

SEQ ID NO: 5872760 - DNA, 18 bp, Homo sapiens
ccgagtgtggagctgctt

SEQ ID NO: 5872761 - DNA, 13 bp, Homo sapiens
ccgagtttgctaa

SEQ ID NO: 5872762 - DNA, 15 bp, Homo sapiens
ccgataaatgaacat

SEQ ID NO: 5872763 - DNA, 18 bp, Homo sapiens
ccgataatgcatgaagca

SEQ ID NO: 5872764 - DNA, 17 bp, Homo sapiens
ccgatagagggacggcc

SEQ ID NO: 5872765 - DNA, 16 bp, Homo sapiens
ccgatataagccatag

SEQ ID NO: 5872766 - DNA, 15 bp, Homo sapiens
ccgatattctccctg

SEQ ID NO: 5872767 - DNA, 12 bp, Homo sapiens
ccgatcaacatt

SEQ ID NO: 5872768 - DNA, 13 bp, Homo sapiens
ccgatccacattg

SEQ ID NO: 5872769 - DNA, 20 bp, Homo sapiens
ccgatccccgacagtggctc

SEQ ID NO: 5872770 - DNA, 13 bp, Homo sapiens
ccgatccttcctc

SEQ ID NO: 5872771 - DNA, 20 bp, Homo sapiens
ccgatgagggaaggagccca

SEQ ID NO: 5872772 - DNA, 21 bp, Homo sapiens
ccgatgatactgtttcttgca

SEQ ID NO: 5872773 - DNA, 13 bp, Homo sapiens
ccgatgccaccgg

SEQ ID NO: 5872774 - DNA, 14 bp, Homo sapiens
ccgatgctccagcc

SEQ ID NO: 5872775 - DNA, 13 bp, Homo sapiens
ccgatgctgacct

SEQ ID NO: 5872776 - DNA, 14 bp, Homo sapiens
ccgatgctgacctc

SEQ ID NO: 5872777 - DNA, 18 bp, Homo sapiens
ccgatggactcctgacca

SEQ ID NO: 5872778 - DNA, 12 bp, Homo sapiens
ccgatggagccc

SEQ ID NO: 5872779 - DNA, 18 bp, Homo sapiens
ccgatggcggggatctgg

SEQ ID NO: 5872780 - DNA, 13 bp, Homo sapiens
ccgatgtccctgt

SEQ ID NO: 5872781 - DNA, 17 bp, Homo sapiens
ccgatgtccctgtcccc

SEQ ID NO: 5872782 - DNA, 18 bp, Homo sapiens
ccgatgtccctgtcccct

SEQ ID NO: 5872783 - DNA, 13 bp, Homo sapiens
ccgatgtgagccg

SEQ ID NO: 5872784 - DNA, 18 bp, Homo sapiens
ccgatgtgggtccctctc

SEQ ID NO: 5872785 - DNA, 13 bp, Homo sapiens
ccgattcaccctg

SEQ ID NO: 5872786 - DNA, 13 bp, Homo sapiens
ccgattctctgcc

SEQ ID NO: 5872787 - DNA, 14 bp, Homo sapiens
ccgattctctgccc

SEQ ID NO: 5872788 - DNA, 14 bp, Homo sapiens
ccgatttgtttatt

SEQ ID NO: 5872789 - DNA, 23 bp, Homo sapiens
ccgattttagagttcttttggat

SEQ ID NO: 5872790 - DNA, 22 bp, Homo sapiens
ccgattttttttttttcctctt

SEQ ID NO: 5872791 - DNA, 16 bp, Homo sapiens
ccgcaacccacagctc

SEQ ID NO: 5872792 - DNA, 17 bp, Homo sapiens
ccgcaacccacagctca

SEQ ID NO: 5872793 - DNA, 20 bp, Homo sapiens
ccgcaagagggacagagccc

SEQ ID NO: 5872794 - DNA, 13 bp, Homo sapiens
ccgcaagctctca

SEQ ID NO: 5872795 - DNA, 16 bp, Homo sapiens
ccgcaaggccctgtcc

SEQ ID NO: 5872796 - DNA, 22 bp, Homo sapiens
ccgcaagttcagggaagcaggc

SEQ ID NO: 5872797 - DNA, 23 bp, Homo sapiens
ccgcaagttcagggaagcaggca

SEQ ID NO: 5872798 - DNA, 15 bp, Homo sapiens
ccgcaatacaggaac

SEQ ID NO: 5872799 - DNA, 21 bp, Homo sapiens
ccgcaatgtgcccccagacgc

SEQ ID NO: 5872800 - DNA, 14 bp, Homo sapiens
ccgcacaccctcac

SEQ ID NO: 5872801 - DNA, 19 bp, Homo sapiens
ccgcacaccctcactctgc

SEQ ID NO: 5872802 - DNA, 13 bp, Homo sapiens
ccgcacagaaaat

SEQ ID NO: 5872803 - DNA, 12 bp, Homo sapiens
ccgcacagcagc

SEQ ID NO: 5872804 - DNA, 13 bp, Homo sapiens
ccgcacagcagcc

SEQ ID NO: 5872805 - DNA, 18 bp, Homo sapiens
ccgcacatggtgtggggg

SEQ ID NO: 5872806 - DNA, 13 bp, Homo sapiens
ccgcaccagctgc

SEQ ID NO: 5872807 - DNA, 15 bp, Homo sapiens
ccgcaccagctgctc

SEQ ID NO: 5872808 - DNA, 19 bp, Homo sapiens
ccgcaccagctgctctgcc

SEQ ID NO: 5872809 - DNA, 14 bp, Homo sapiens
ccgcaccccagtgc

SEQ ID NO: 5872810 - DNA, 15 bp, Homo sapiens
ccgcaccccatccca

SEQ ID NO: 5872811 - DNA, 13 bp, Homo sapiens
ccgcacccccgcc

SEQ ID NO: 5872812 - DNA, 20 bp, Homo sapiens
ccgcaccccgatgtggacct

SEQ ID NO: 5872813 - DNA, 17 bp, Homo sapiens
ccgcaccccggcctcag

SEQ ID NO: 5872814 - DNA, 13 bp, Homo sapiens
ccgcacccctcct

SEQ ID NO: 5872815 - DNA, 15 bp, Homo sapiens
ccgcacccctcctcc

SEQ ID NO: 5872816 - DNA, 15 bp, Homo sapiens
ccgcaccctccctag

SEQ ID NO: 5872817 - DNA, 18 bp, Homo sapiens
ccgcaccctgcacctgct

SEQ ID NO: 5872818 - DNA, 12 bp, Homo sapiens
ccgcaccctggc

SEQ ID NO: 5872819 - DNA, 15 bp, Homo sapiens
ccgcaccgggctggc

SEQ ID NO: 5872820 - DNA, 19 bp, Homo sapiens
ccgcacctaaagcagccag

SEQ ID NO: 5872821 - DNA, 21 bp, Homo sapiens
ccgcacgactgcgggagccag

SEQ ID NO: 5872822 - DNA, 18 bp, Homo sapiens
ccgcacgcaagcctcagc

SEQ ID NO: 5872823 - DNA, 19 bp, Homo sapiens
ccgcacgcaagcctcagcc

SEQ ID NO: 5872824 - DNA, 18 bp, Homo sapiens
ccgcacgcctctccctgc

SEQ ID NO: 5872825 - DNA, 19 bp, Homo sapiens
ccgcacgcggccgctctcc

SEQ ID NO: 5872826 - DNA, 20 bp, Homo sapiens
ccgcacgggctgtctgggtg

SEQ ID NO: 5872827 - DNA, 14 bp, Homo sapiens
ccgcacgtccgcgg

SEQ ID NO: 5872828 - DNA, 19 bp, Homo sapiens
ccgcacgtccgcgggtccc

SEQ ID NO: 5872829 - DNA, 15 bp, Homo sapiens
ccgcactcaggagca

SEQ ID NO: 5872830 - DNA, 12 bp, Homo sapiens
ccgcactctgcc

SEQ ID NO: 5872831 - DNA, 14 bp, Homo sapiens
ccgcactctgcccc

SEQ ID NO: 5872832 - DNA, 23 bp, Homo sapiens
ccgcactgggcttggggaccaga

SEQ ID NO: 5872833 - DNA, 13 bp, Homo sapiens
ccgcactgggggc

SEQ ID NO: 5872834 - DNA, 21 bp, Homo sapiens
ccgcactttccacttcttcct

SEQ ID NO: 5872835 - DNA, 22 bp, Homo sapiens
ccgcactttccacttcttcctt

SEQ ID NO: 5872836 - DNA, 14 bp, Homo sapiens
ccgcagaagcagcc

SEQ ID NO: 5872837 - DNA, 17 bp, Homo sapiens
ccgcagaagcagcccct

SEQ ID NO: 5872838 - DNA, 22 bp, Homo sapiens
ccgcagaagcagcccctcgagg

SEQ ID NO: 5872839 - DNA, 20 bp, Homo sapiens
ccgcagaagcctccccagct

SEQ ID NO: 5872840 - DNA, 22 bp, Homo sapiens
ccgcagaagcctccccagctca

SEQ ID NO: 5872841 - DNA, 15 bp, Homo sapiens
ccgcagacaggacca

SEQ ID NO: 5872842 - DNA, 16 bp, Homo sapiens
ccgcagacaggaccag

SEQ ID NO: 5872843 - DNA, 21 bp, Homo sapiens
ccgcagacctccccagcccct

SEQ ID NO: 5872844 - DNA, 16 bp, Homo sapiens
ccgcagacctggagct

SEQ ID NO: 5872845 - DNA, 13 bp, Homo sapiens
ccgcagacgggca

SEQ ID NO: 5872846 - DNA, 15 bp, Homo sapiens
ccgcagacgggcaca

SEQ ID NO: 5872847 - DNA, 17 bp, Homo sapiens
ccgcagacgggcacaga

SEQ ID NO: 5872848 - DNA, 23 bp, Homo sapiens
ccgcagacggtctgtgtgctgtt

SEQ ID NO: 5872849 - DNA, 14 bp, Homo sapiens
ccgcagactgcttg

SEQ ID NO: 5872850 - DNA, 23 bp, Homo sapiens
ccgcagagaagtgacggttccta

SEQ ID NO: 5872851 - DNA, 15 bp, Homo sapiens
ccgcagagcccacgc

SEQ ID NO: 5872852 - DNA, 22 bp, Homo sapiens
ccgcagagcgcgcccctagccg

SEQ ID NO: 5872853 - DNA, 15 bp, Homo sapiens
ccgcagagctggccg

SEQ ID NO: 5872854 - DNA, 12 bp, Homo sapiens
ccgcagaggcag

SEQ ID NO: 5872855 - DNA, 13 bp, Homo sapiens
ccgcagaggcccg

SEQ ID NO: 5872856 - DNA, 23 bp, Homo sapiens
ccgcagatcctgtcccatgggct

SEQ ID NO: 5872857 - DNA, 16 bp, Homo sapiens
ccgcagatggctggaa

SEQ ID NO: 5872858 - DNA, 12 bp, Homo sapiens
ccgcagcaccag

SEQ ID NO: 5872859 - DNA, 16 bp, Homo sapiens
ccgcagcaccagcctg

SEQ ID NO: 5872860 - DNA, 19 bp, Homo sapiens
ccgcagcaccagcctgagc

SEQ ID NO: 5872861 - DNA, 13 bp, Homo sapiens
ccgcagcacgcct

SEQ ID NO: 5872862 - DNA, 14 bp, Homo sapiens
ccgcagcacgcctc

SEQ ID NO: 5872863 - DNA, 17 bp, Homo sapiens
ccgcagcacgcctctcc

SEQ ID NO: 5872864 - DNA, 18 bp, Homo sapiens
ccgcagcacgcctctccc

SEQ ID NO: 5872865 - DNA, 14 bp, Homo sapiens
ccgcagcagctccc

SEQ ID NO: 5872866 - DNA, 13 bp, Homo sapiens
ccgcagcatgtgg

SEQ ID NO: 5872867 - DNA, 12 bp, Homo sapiens
ccgcagccacac

SEQ ID NO: 5872868 - DNA, 22 bp, Homo sapiens
ccgcagccacaccgctggctcc

SEQ ID NO: 5872869 - DNA, 11 bp, Homo sapiens
ccgcagcccag

SEQ ID NO: 5872870 - DNA, 10 bp, Homo sapiens
ccgcagcccc

SEQ ID NO: 5872871 - DNA, 15 bp, Homo sapiens
ccgcagcccccaccc

SEQ ID NO: 5872872 - DNA, 18 bp, Homo sapiens
ccgcagcccccactgacc

SEQ ID NO: 5872873 - DNA, 21 bp, Homo sapiens
ccgcagccctctccacccaga

SEQ ID NO: 5872874 - DNA, 22 bp, Homo sapiens
ccgcagccctctccacccagag

SEQ ID NO: 5872875 - DNA, 23 bp, Homo sapiens
ccgcagccctctccacccagagg

SEQ ID NO: 5872876 - DNA, 14 bp, Homo sapiens
ccgcagccctggca

SEQ ID NO: 5872877 - DNA, 18 bp, Homo sapiens
ccgcagcgtcccccgccg

SEQ ID NO: 5872878 - DNA, 13 bp, Homo sapiens
ccgcagctgctgc

SEQ ID NO: 5872879 - DNA, 14 bp, Homo sapiens
ccgcagctgctgcc

SEQ ID NO: 5872880 - DNA, 16 bp, Homo sapiens
ccgcagctgctgccac

SEQ ID NO: 5872881 - DNA, 19 bp, Homo sapiens
ccgcagctgctgccactct

SEQ ID NO: 5872882 - DNA, 22 bp, Homo sapiens
ccgcagctgctgccactctgct

SEQ ID NO: 5872883 - DNA, 20 bp, Homo sapiens
ccgcaggaactgggctgggc

SEQ ID NO: 5872884 - DNA, 13 bp, Homo sapiens
ccgcaggaagctg

SEQ ID NO: 5872885 - DNA, 15 bp, Homo sapiens
ccgcaggaagctgct

SEQ ID NO: 5872886 - DNA, 14 bp, Homo sapiens
ccgcaggaaggcag

SEQ ID NO: 5872887 - DNA, 12 bp, Homo sapiens
ccgcaggaggga

SEQ ID NO: 5872888 - DNA, 15 bp, Homo sapiens
ccgcaggagggaggc

SEQ ID NO: 5872889 - DNA, 21 bp, Homo sapiens
ccgcaggatccctcctgagct

SEQ ID NO: 5872890 - DNA, 19 bp, Homo sapiens
ccgcaggcccggactcacc

SEQ ID NO: 5872891 - DNA, 22 bp, Homo sapiens
ccgcaggcctgccttctcaggg

SEQ ID NO: 5872892 - DNA, 22 bp, Homo sapiens
ccgcagggacaagccctggaga

SEQ ID NO: 5872893 - DNA, 22 bp, Homo sapiens
ccgcagggacggggactggccc

SEQ ID NO: 5872894 - DNA, 14 bp, Homo sapiens
ccgcagggccatgc

SEQ ID NO: 5872895 - DNA, 20 bp, Homo sapiens
ccgcagggccatgcagacct

SEQ ID NO: 5872896 - DNA, 13 bp, Homo sapiens
ccgcagggcccac

SEQ ID NO: 5872897 - DNA, 15 bp, Homo sapiens
ccgcagggcctgcta

SEQ ID NO: 5872898 - DNA, 16 bp, Homo sapiens
ccgcagggcctgctac

SEQ ID NO: 5872899 - DNA, 17 bp, Homo sapiens
ccgcagggcgctccggc

SEQ ID NO: 5872900 - DNA, 19 bp, Homo sapiens
ccgcagggcgctccggcag

SEQ ID NO: 5872901 - DNA, 21 bp, Homo sapiens
ccgcagggcgctccggcagag

SEQ ID NO: 5872902 - DNA, 18 bp, Homo sapiens
ccgcaggggactgtctca

SEQ ID NO: 5872903 - DNA, 20 bp, Homo sapiens
ccgcaggggactgtctcaga

SEQ ID NO: 5872904 - DNA, 18 bp, Homo sapiens
ccgcaggggcccctcctc

SEQ ID NO: 5872905 - DNA, 21 bp, Homo sapiens
ccgcaggggtttgggtggggg

SEQ ID NO: 5872906 - DNA, 21 bp, Homo sapiens
ccgcaggtgggtgctgccctg

SEQ ID NO: 5872907 - DNA, 22 bp, Homo sapiens
ccgcaggtgggtgctgccctgt

SEQ ID NO: 5872908 - DNA, 15 bp, Homo sapiens
ccgcagtccccagcc

SEQ ID NO: 5872909 - DNA, 16 bp, Homo sapiens
ccgcagtccccagccc

SEQ ID NO: 5872910 - DNA, 17 bp, Homo sapiens
ccgcagtccccagccct

SEQ ID NO: 5872911 - DNA, 20 bp, Homo sapiens
ccgcagtcgtcccaggctgc

SEQ ID NO: 5872912 - DNA, 21 bp, Homo sapiens
ccgcagtcgtcgcacagtctc

SEQ ID NO: 5872913 - DNA, 16 bp, Homo sapiens
ccgcagtgctgggacc

SEQ ID NO: 5872914 - DNA, 17 bp, Homo sapiens
ccgcagtgctgggacca

SEQ ID NO: 5872915 - DNA, 19 bp, Homo sapiens
ccgcagtgctgggaccaga

SEQ ID NO: 5872916 - DNA, 17 bp, Homo sapiens
ccgcagtgggagcaaac

SEQ ID NO: 5872917 - DNA, 23 bp, Homo sapiens
ccgcagtgtgcactaaggggccc

SEQ ID NO: 5872918 - DNA, 13 bp, Homo sapiens
ccgcataagaaaa

SEQ ID NO: 5872919 - DNA, 14 bp, Homo sapiens
ccgcataagaaaaa

SEQ ID NO: 5872920 - DNA, 16 bp, Homo sapiens
ccgcatactgagaatc

SEQ ID NO: 5872921 - DNA, 15 bp, Homo sapiens
ccgcataggcccagc

SEQ ID NO: 5872922 - DNA, 15 bp, Homo sapiens
ccgcatatgcatgcc

SEQ ID NO: 5872923 - DNA, 17 bp, Homo sapiens
ccgcatatgcatgccag

SEQ ID NO: 5872924 - DNA, 14 bp, Homo sapiens
ccgcatcacctcac

SEQ ID NO: 5872925 - DNA, 23 bp, Homo sapiens
ccgcatcatgggagtaagttctt

SEQ ID NO: 5872926 - DNA, 17 bp, Homo sapiens
ccgcatcccctgcctcc

SEQ ID NO: 5872927 - DNA, 22 bp, Homo sapiens
ccgcatcccctgcctccatcct

SEQ ID NO: 5872928 - DNA, 22 bp, Homo sapiens
ccgcatccctgcttctggcgcc

SEQ ID NO: 5872929 - DNA, 15 bp, Homo sapiens
ccgcatcctcactgg

SEQ ID NO: 5872930 - DNA, 15 bp, Homo sapiens
ccgcatctgcctgga

SEQ ID NO: 5872931 - DNA, 16 bp, Homo sapiens
ccgcatcttctccatc

SEQ ID NO: 5872932 - DNA, 19 bp, Homo sapiens
ccgcatgacaactgaaggc

SEQ ID NO: 5872933 - DNA, 14 bp, Homo sapiens
ccgcatgcagcagc

SEQ ID NO: 5872934 - DNA, 21 bp, Homo sapiens
ccgcatgccccctcgtgccag

SEQ ID NO: 5872935 - DNA, 18 bp, Homo sapiens
ccgctacagtttttattt

SEQ ID NO: 5872936 - DNA, 16 bp, Homo sapiens
ccgctacctccctccc

SEQ ID NO: 5872937 - DNA, 16 bp, Homo sapiens
ccgctagaggcctgag

SEQ ID NO: 5872938 - DNA, 18 bp, Homo sapiens
ccgctagaggcctgagga

SEQ ID NO: 5872939 - DNA, 19 bp, Homo sapiens
ccgctagaggcctgaggat

SEQ ID NO: 5872940 - DNA, 20 bp, Homo sapiens
ccgctaggctcgccttccct

SEQ ID NO: 5872941 - DNA, 13 bp, Homo sapiens
ccgctcaccctcc

SEQ ID NO: 5872942 - DNA, 15 bp, Homo sapiens
ccgctcacctagagc

SEQ ID NO: 5872943 - DNA, 18 bp, Homo sapiens
ccgctcacctagagccag

SEQ ID NO: 5872944 - DNA, 20 bp, Homo sapiens
ccgctcacctagagccagac

SEQ ID NO: 5872945 - DNA, 20 bp, Homo sapiens
ccgctcacgctgacagcctc

SEQ ID NO: 5872946 - DNA, 13 bp, Homo sapiens
ccgctcagccctc

SEQ ID NO: 5872947 - DNA, 19 bp, Homo sapiens
ccgctcagccctccctgcc

SEQ ID NO: 5872948 - DNA, 21 bp, Homo sapiens
ccgctcagccctccctgcccc

SEQ ID NO: 5872949 - DNA, 22 bp, Homo sapiens
ccgctcagccctccctgcccct

SEQ ID NO: 5872950 - DNA, 20 bp, Homo sapiens
ccgctcaggctgaccacttt

SEQ ID NO: 5872951 - DNA, 15 bp, Homo sapiens
ccgctcaggggcctg

SEQ ID NO: 5872952 - DNA, 20 bp, Homo sapiens
ccgctcaggggcctggaggt

SEQ ID NO: 5872953 - DNA, 13 bp, Homo sapiens
ccgctcagtatta

SEQ ID NO: 5872954 - DNA, 13 bp, Homo sapiens
ccgctcagtattt

SEQ ID NO: 5872955 - DNA, 12 bp, Homo sapiens
ccgctccagagt

SEQ ID NO: 5872956 - DNA, 11 bp, Homo sapiens
ccgctccagat

SEQ ID NO: 5872957 - DNA, 23 bp, Homo sapiens
ccgctccaggtaccttgaccttt

SEQ ID NO: 5872958 - DNA, 15 bp, Homo sapiens
ccgctcccacagctt

SEQ ID NO: 5872959 - DNA, 18 bp, Homo sapiens
ccgctcccaccgccccca

SEQ ID NO: 5872960 - DNA, 17 bp, Homo sapiens
ccgctcccacctagtgc

SEQ ID NO: 5872961 - DNA, 15 bp, Homo sapiens
ccgctcccagtgtct

SEQ ID NO: 5872962 - DNA, 12 bp, Homo sapiens
ccgctccccagc

SEQ ID NO: 5872963 - DNA, 14 bp, Homo sapiens
ccgctccccagccc

SEQ ID NO: 5872964 - DNA, 17 bp, Homo sapiens
ccgctccccttggacct

SEQ ID NO: 5872965 - DNA, 18 bp, Homo sapiens
ccgctcccctttcccatc

SEQ ID NO: 5872966 - DNA, 17 bp, Homo sapiens
ccgctcccgctcccagg

SEQ ID NO: 5872967 - DNA, 14 bp, Homo sapiens
ccgctcccggttcc

SEQ ID NO: 5872968 - DNA, 11 bp, Homo sapiens
ccgctccctgg

SEQ ID NO: 5872969 - DNA, 23 bp, Homo sapiens
ccgctcctccctgctcctcatgg

SEQ ID NO: 5872970 - DNA, 14 bp, Homo sapiens
ccgctcctgtctgc

SEQ ID NO: 5872971 - DNA, 15 bp, Homo sapiens
ccgctcggaggcccc

SEQ ID NO: 5872972 - DNA, 16 bp, Homo sapiens
ccgctcggaggcccca

SEQ ID NO: 5872973 - DNA, 18 bp, Homo sapiens
ccgctcggaggccccaaa

SEQ ID NO: 5872974 - DNA, 20 bp, Homo sapiens
ccgctcggaggccccaaagg

SEQ ID NO: 5872975 - DNA, 22 bp, Homo sapiens
ccgctcggaggccccaaaggaa

SEQ ID NO: 5872976 - DNA, 23 bp, Homo sapiens
ccgctcggaggccccaaaggaaa

SEQ ID NO: 5872977 - DNA, 18 bp, Homo sapiens
ccgctctcccagacctag

SEQ ID NO: 5872978 - DNA, 15 bp, Homo sapiens
ccgctctccccctgc

SEQ ID NO: 5872979 - DNA, 16 bp, Homo sapiens
ccgctctccccctgca

SEQ ID NO: 5872980 - DNA, 17 bp, Homo sapiens
ccgctctccccctgcag

SEQ ID NO: 5872981 - DNA, 18 bp, Homo sapiens
ccgctctccccctgcagc

SEQ ID NO: 5872982 - DNA, 19 bp, Homo sapiens
ccgctctccccctgcagcc

SEQ ID NO: 5872983 - DNA, 17 bp, Homo sapiens
ccgctctccgccccccg

SEQ ID NO: 5872984 - DNA, 17 bp, Homo sapiens
ccgctctcttcctgccc

SEQ ID NO: 5872985 - DNA, 22 bp, Homo sapiens
ccgctctcttcctgcccctctt

SEQ ID NO: 5872986 - DNA, 11 bp, Homo sapiens
ccgctctgcat

SEQ ID NO: 5872987 - DNA, 13 bp, Homo sapiens
ccgctctggcagt

SEQ ID NO: 5872988 - DNA, 22 bp, Homo sapiens
ccgctcttcccaagtcctcgcc

SEQ ID NO: 5872989 - DNA, 14 bp, Homo sapiens
ccgctgagcccact

SEQ ID NO: 5872990 - DNA, 15 bp, Homo sapiens
ccgctgagcccactc

SEQ ID NO: 5872991 - DNA, 23 bp, Homo sapiens
ccgctgagcgaggagatgctcct

SEQ ID NO: 5872992 - DNA, 19 bp, Homo sapiens
ccgctgagctgagtggcca

SEQ ID NO: 5872993 - DNA, 22 bp, Homo sapiens
ccgctgagctgagtggccagcc

SEQ ID NO: 5872994 - DNA, 13 bp, Homo sapiens
ccgctgagcttgg

SEQ ID NO: 5872995 - DNA, 14 bp, Homo sapiens
ccgctgagcttgga

SEQ ID NO: 5872996 - DNA, 13 bp, Homo sapiens
ccgctgagtggac

SEQ ID NO: 5872997 - DNA, 17 bp, Homo sapiens
ccgctgagtggactgga

SEQ ID NO: 5872998 - DNA, 14 bp, Homo sapiens
ccgctgatggagcc

SEQ ID NO: 5872999 - DNA, 15 bp, Homo sapiens
ccgctgatggagccc

SEQ ID NO: 5873000 - DNA, 13 bp, Homo sapiens
ccgctgattctca

SEQ ID NO: 5873001 - DNA, 22 bp, Homo sapiens
ccgctgattctcagggtctctg

SEQ ID NO: 5873002 - DNA, 21 bp, Homo sapiens
ccgctgcaagtcagattgctg

SEQ ID NO: 5873003 - DNA, 18 bp, Homo sapiens
ccgctgcacacagacggc

SEQ ID NO: 5873004 - DNA, 16 bp, Homo sapiens
ccgctgcacatggaca

SEQ ID NO: 5873005 - DNA, 13 bp, Homo sapiens
ccgctgcaccacg

SEQ ID NO: 5873006 - DNA, 10 bp, Homo sapiens
ccgctgcagg

SEQ ID NO: 5873007 - DNA, 11 bp, Homo sapiens
ccgctgccacc

SEQ ID NO: 5873008 - DNA, 21 bp, Homo sapiens
ccgctgccaccacgtctgcca

SEQ ID NO: 5873009 - DNA, 23 bp, Homo sapiens
ccgctgccaccacgtctgccagg

SEQ ID NO: 5873010 - DNA, 12 bp, Homo sapiens
ccgctgccaccc

SEQ ID NO: 5873011 - DNA, 20 bp, Homo sapiens
ccgctgccacccacctccct

SEQ ID NO: 5873012 - DNA, 23 bp, Homo sapiens
ccgctgccacccacctccctgcc

SEQ ID NO: 5873013 - DNA, 24 bp, Homo sapiens
ccgctgccacccacctccctgcct

SEQ ID NO: 5873014 - DNA, 20 bp, Homo sapiens
ccgctgccacgttggagaag

SEQ ID NO: 5873015 - DNA, 12 bp, Homo sapiens
ccgctgcccagc

SEQ ID NO: 5873016 - DNA, 13 bp, Homo sapiens
ccgctgcccaggt

SEQ ID NO: 5873017 - DNA, 13 bp, Homo sapiens
ccgctgccccagc

SEQ ID NO: 5873018 - DNA, 16 bp, Homo sapiens
ccgctgccccatgtgt

SEQ ID NO: 5873019 - DNA, 16 bp, Homo sapiens
ccgctgcccccaccct

SEQ ID NO: 5873020 - DNA, 20 bp, Homo sapiens
ccgctgcccggcgccctctg

SEQ ID NO: 5873021 - DNA, 11 bp, Homo sapiens
ccgctgccctg

SEQ ID NO: 5873022 - DNA, 23 bp, Homo sapiens
ccgctgccctgggtcctgcctgc

SEQ ID NO: 5873023 - DNA, 17 bp, Homo sapiens
ccgctgccctttggcca

SEQ ID NO: 5873024 - DNA, 19 bp, Homo sapiens
ccgctgccctttggccaac

SEQ ID NO: 5873025 - DNA, 16 bp, Homo sapiens
ccgctgccgctgcacc

SEQ ID NO: 5873026 - DNA, 19 bp, Homo sapiens
ccgctgcctaagtggctgc

SEQ ID NO: 5873027 - DNA, 12 bp, Homo sapiens
ccgctgcctcct

SEQ ID NO: 5873028 - DNA, 13 bp, Homo sapiens
ccgctgcctcctg

SEQ ID NO: 5873029 - DNA, 13 bp, Homo sapiens
ccgctgcctcttg

SEQ ID NO: 5873030 - DNA, 19 bp, Homo sapiens
ccgctgcctggaacaccag

SEQ ID NO: 5873031 - DNA, 12 bp, Homo sapiens
ccgctgcctggc

SEQ ID NO: 5873032 - DNA, 14 bp, Homo sapiens
ccgctgccttcctt

SEQ ID NO: 5873033 - DNA, 18 bp, Homo sapiens
ccgctgcgctgccctgca

SEQ ID NO: 5873034 - DNA, 19 bp, Homo sapiens
ccgctgcgtgccatcactc

SEQ ID NO: 5873035 - DNA, 14 bp, Homo sapiens
ccgctgctccacgc

SEQ ID NO: 5873036 - DNA, 18 bp, Homo sapiens
ccgctgctctcccaggtg

SEQ ID NO: 5873037 - DNA, 16 bp, Homo sapiens
ccgctgctgctgctgc

SEQ ID NO: 5873038 - DNA, 14 bp, Homo sapiens
ccgctgctgtgaca

SEQ ID NO: 5873039 - DNA, 19 bp, Homo sapiens
ccgctgcttccaggctggg

SEQ ID NO: 5873040 - DNA, 15 bp, Homo sapiens
ccgctgcttccaggt

SEQ ID NO: 5873041 - DNA, 16 bp, Homo sapiens
ccgctgcttgagtgga

SEQ ID NO: 5873042 - DNA, 19 bp, Homo sapiens
ccgctgcttgagtggacag

SEQ ID NO: 5873043 - DNA, 23 bp, Homo sapiens
ccgctgcttgagtggacagcagc

SEQ ID NO: 5873044 - DNA, 14 bp, Homo sapiens
ccgctggagcatga

SEQ ID NO: 5873045 - DNA, 15 bp, Homo sapiens
ccgctggagcccaca

SEQ ID NO: 5873046 - DNA, 16 bp, Homo sapiens
ccgctggagcccacag

SEQ ID NO: 5873047 - DNA, 22 bp, Homo sapiens
ccgctggagcccacagcgagcc

SEQ ID NO: 5873048 - DNA, 11 bp, Homo sapiens
ccgctggaggt

SEQ ID NO: 5873049 - DNA, 10 bp, Homo sapiens
ccgctggccc

SEQ ID NO: 5873050 - DNA, 14 bp, Homo sapiens
ccgctggcccaggg

SEQ ID NO: 5873051 - DNA, 12 bp, Homo sapiens
ccgctggccctg

SEQ ID NO: 5873052 - DNA, 13 bp, Homo sapiens
ccgctggctccgc

SEQ ID NO: 5873053 - DNA, 22 bp, Homo sapiens
ccgctggctccgcatggttcat

SEQ ID NO: 5873054 - DNA, 16 bp, Homo sapiens
ccgctggctcctccag

SEQ ID NO: 5873055 - DNA, 17 bp, Homo sapiens
ccgctggctcctccagg

SEQ ID NO: 5873056 - DNA, 15 bp, Homo sapiens
ccgctggctgggggc

SEQ ID NO: 5873057 - DNA, 21 bp, Homo sapiens
ccgctggctggtgggccccca

SEQ ID NO: 5873058 - DNA, 23 bp, Homo sapiens
ccgctggctttgggaaagcccag

SEQ ID NO: 5873059 - DNA, 11 bp, Homo sapiens
ccgctgggaga

SEQ ID NO: 5873060 - DNA, 20 bp, Homo sapiens
ccgctgggagaaaagccaga

SEQ ID NO: 5873061 - DNA, 23 bp, Homo sapiens
ccgctgggagaaaagccagatga

SEQ ID NO: 5873062 - DNA, 14 bp, Homo sapiens
ccgctgggctgagc

SEQ ID NO: 5873063 - DNA, 21 bp, Homo sapiens
ccgctggggaccggttcccac

SEQ ID NO: 5873064 - DNA, 23 bp, Homo sapiens
ccgctggggagcgaaagtttctt

SEQ ID NO: 5873065 - DNA, 15 bp, Homo sapiens
ccgctgggggctggc

SEQ ID NO: 5873066 - DNA, 20 bp, Homo sapiens
ccgctgggtggttttttccc

SEQ ID NO: 5873067 - DNA, 18 bp, Homo sapiens
ccgctgggttctgactct

SEQ ID NO: 5873068 - DNA, 16 bp, Homo sapiens
ccgctggtccctgccc

SEQ ID NO: 5873069 - DNA, 14 bp, Homo sapiens
ccgctggtgcccac

SEQ ID NO: 5873070 - DNA, 18 bp, Homo sapiens
ccgctggtgcccaccagc

SEQ ID NO: 5873071 - DNA, 19 bp, Homo sapiens
ccgctggtgcccaccagct

SEQ ID NO: 5873072 - DNA, 22 bp, Homo sapiens
ccgctggtgcctcccgggacga

SEQ ID NO: 5873073 - DNA, 22 bp, Homo sapiens
ccgctgtcaaggccgagggcca

SEQ ID NO: 5873074 - DNA, 17 bp, Homo sapiens
ccgctgtcccaggggtc

SEQ ID NO: 5873075 - DNA, 18 bp, Homo sapiens
ccgctgtcgccccaggcc

SEQ ID NO: 5873076 - DNA, 19 bp, Homo sapiens
ccgctgtcgccccaggccc

SEQ ID NO: 5873077 - DNA, 22 bp, Homo sapiens
ccgctgtcgccccaggccctcc

SEQ ID NO: 5873078 - DNA, 13 bp, Homo sapiens
ccgctgtctccct

SEQ ID NO: 5873079 - DNA, 14 bp, Homo sapiens
ccgctgtctccctc

SEQ ID NO: 5873080 - DNA, 16 bp, Homo sapiens
ccgctgtctccctcct

SEQ ID NO: 5873081 - DNA, 12 bp, Homo sapiens
ccgctgtctctg

SEQ ID NO: 5873082 - DNA, 15 bp, Homo sapiens
ccgctgtgagcccct

SEQ ID NO: 5873083 - DNA, 19 bp, Homo sapiens
ccgctgtgagcccctggtc

SEQ ID NO: 5873084 - DNA, 22 bp, Homo sapiens
ccgctgtgcccccctcctcccc

SEQ ID NO: 5873085 - DNA, 19 bp, Homo sapiens
ccgctgtgctgttgtctgc

SEQ ID NO: 5873086 - DNA, 21 bp, Homo sapiens
ccgctgtggccggtgccagct

SEQ ID NO: 5873087 - DNA, 22 bp, Homo sapiens
ccgctgtggccggtgccagctg

SEQ ID NO: 5873088 - DNA, 15 bp, Homo sapiens
ccgctgttcacccac

SEQ ID NO: 5873089 - DNA, 13 bp, Homo sapiens
ccgcttagcctgc

SEQ ID NO: 5873090 - DNA, 14 bp, Homo sapiens
ccgcttagcctgcc

SEQ ID NO: 5873091 - DNA, 14 bp, Homo sapiens
ccgcttatcctgct

SEQ ID NO: 5873092 - DNA, 14 bp, Homo sapiens
ccgcttcacccctg

SEQ ID NO: 5873093 - DNA, 18 bp, Homo sapiens
ccgcttcacccctgcact

SEQ ID NO: 5873094 - DNA, 18 bp, Homo sapiens
ccgcttcagacacgcact

SEQ ID NO: 5873095 - DNA, 20 bp, Homo sapiens
ccgcttccagcttcctctga

SEQ ID NO: 5873096 - DNA, 15 bp, Homo sapiens
ccgcttcccagaggc

SEQ ID NO: 5873097 - DNA, 15 bp, Homo sapiens
ccgcttccccacaga

SEQ ID NO: 5873098 - DNA, 17 bp, Homo sapiens
ccgcttccccacagaac

SEQ ID NO: 5873099 - DNA, 14 bp, Homo sapiens
ccgcttccccagct

SEQ ID NO: 5873100 - DNA, 14 bp, Homo sapiens
ccgcttccccttgc

SEQ ID NO: 5873101 - DNA, 15 bp, Homo sapiens
ccgcttccctaccca

SEQ ID NO: 5873102 - DNA, 22 bp, Homo sapiens
ccgcttccctacccacagggcc

SEQ ID NO: 5873103 - DNA, 20 bp, Homo sapiens
ccgcttcctccggctggacc

SEQ ID NO: 5873104 - DNA, 12 bp, Homo sapiens
ccgcttcctggc

SEQ ID NO: 5873105 - DNA, 18 bp, Homo sapiens
ccgcttcgccatgtgctg

SEQ ID NO: 5873106 - DNA, 13 bp, Homo sapiens
ccgcttctcccca

SEQ ID NO: 5873107 - DNA, 19 bp, Homo sapiens
ccgcttctccccagagctg

SEQ ID NO: 5873108 - DNA, 12 bp, Homo sapiens
ccgcttctcctg

SEQ ID NO: 5873109 - DNA, 19 bp, Homo sapiens
ccgcttgaaaagctagtgt

SEQ ID NO: 5873110 - DNA, 20 bp, Homo sapiens
ccgcttgcctcggctcctgc

SEQ ID NO: 5873111 - DNA, 17 bp, Homo sapiens
ccgcttgctcgcttgct

SEQ ID NO: 5873112 - DNA, 18 bp, Homo sapiens
ccgcttgctcgcttgctg

SEQ ID NO: 5873113 - DNA, 15 bp, Homo sapiens
ccgcttgctctcctg

SEQ ID NO: 5873114 - DNA, 20 bp, Homo sapiens
ccgcttggcgatgccagcca

SEQ ID NO: 5873115 - DNA, 17 bp, Homo sapiens
ccgggagaaggcatgag

SEQ ID NO: 5873116 - DNA, 14 bp, Homo sapiens
ccgggagagactcg

SEQ ID NO: 5873117 - DNA, 23 bp, Homo sapiens
ccgggagatccgccctgggctct

SEQ ID NO: 5873118 - DNA, 18 bp, Homo sapiens
ccgggagcctaggaccac

SEQ ID NO: 5873119 - DNA, 18 bp, Homo sapiens
ccgggagcctccccctca

SEQ ID NO: 5873120 - DNA, 22 bp, Homo sapiens
ccgggagcctccccctcagatg

SEQ ID NO: 5873121 - DNA, 22 bp, Homo sapiens
ccgggagcctgcgtggcctggg

SEQ ID NO: 5873122 - DNA, 22 bp, Homo sapiens
ccgggagcgcacctcgccgtgt

SEQ ID NO: 5873123 - DNA, 14 bp, Homo sapiens
ccgggagctgggcc

SEQ ID NO: 5873124 - DNA, 15 bp, Homo sapiens
ccgggagctgggccc

SEQ ID NO: 5873125 - DNA, 12 bp, Homo sapiens
ccgggagctggt

SEQ ID NO: 5873126 - DNA, 19 bp, Homo sapiens
ccgggaggaaaaggcccct

SEQ ID NO: 5873127 - DNA, 22 bp, Homo sapiens
ccgggaggcagccacagggaag

SEQ ID NO: 5873128 - DNA, 21 bp, Homo sapiens
ccgggagggacagtctggagg

SEQ ID NO: 5873129 - DNA, 16 bp, Homo sapiens
ccgggaggggcccgct

SEQ ID NO: 5873130 - DNA, 17 bp, Homo sapiens
ccgggataaactgagcc

SEQ ID NO: 5873131 - DNA, 18 bp, Homo sapiens
ccgggataaactgagcct

SEQ ID NO: 5873132 - DNA, 16 bp, Homo sapiens
ccgggatcctgccccc

SEQ ID NO: 5873133 - DNA, 18 bp, Homo sapiens
ccgggatcctgcccccaa

SEQ ID NO: 5873134 - DNA, 20 bp, Homo sapiens
ccgggatcctgcccccaagt

SEQ ID NO: 5873135 - DNA, 13 bp, Homo sapiens
ccgggatgcaagg

SEQ ID NO: 5873136 - DNA, 17 bp, Homo sapiens
ccgggatgggtggacca

SEQ ID NO: 5873137 - DNA, 22 bp, Homo sapiens
ccgggatggtcttgatctcctg

SEQ ID NO: 5873138 - DNA, 22 bp, Homo sapiens
ccgggcaaatggctgagatgga

SEQ ID NO: 5873139 - DNA, 19 bp, Homo sapiens
ccgggcaccacccccagtc

SEQ ID NO: 5873140 - DNA, 22 bp, Homo sapiens
ccgggcactcagaagacactga

SEQ ID NO: 5873141 - DNA, 16 bp, Homo sapiens
ccgggcactggcactg

SEQ ID NO: 5873142 - DNA, 19 bp, Homo sapiens
ccgggcagagaccaccgcg

SEQ ID NO: 5873143 - DNA, 13 bp, Homo sapiens
ccgggcagcagag

SEQ ID NO: 5873144 - DNA, 17 bp, Homo sapiens
ccgggcagcagagagag

SEQ ID NO: 5873145 - DNA, 20 bp, Homo sapiens
ccgggcaggcaagggctctg

SEQ ID NO: 5873146 - DNA, 11 bp, Homo sapiens
ccgggcagggg

SEQ ID NO: 5873147 - DNA, 14 bp, Homo sapiens
ccgggcaggggagc

SEQ ID NO: 5873148 - DNA, 17 bp, Homo sapiens
ccgggcaggggagccag

SEQ ID NO: 5873149 - DNA, 15 bp, Homo sapiens
ccgggcagggtgtgg

SEQ ID NO: 5873150 - DNA, 19 bp, Homo sapiens
ccgggcaggtcctgcccat

SEQ ID NO: 5873151 - DNA, 14 bp, Homo sapiens
ccgggcatgatggt

SEQ ID NO: 5873152 - DNA, 11 bp, Homo sapiens
ccgggcatggt

SEQ ID NO: 5873153 - DNA, 14 bp, Homo sapiens
ccgggcatggtggc

SEQ ID NO: 5873154 - DNA, 22 bp, Homo sapiens
ccgggcatggtggcatgtgcct

SEQ ID NO: 5873155 - DNA, 21 bp, Homo sapiens
ccgggccacgccccagcccga

SEQ ID NO: 5873156 - DNA, 13 bp, Homo sapiens
ccgggccactcct

SEQ ID NO: 5873157 - DNA, 17 bp, Homo sapiens
ccgggccatgctttcct

SEQ ID NO: 5873158 - DNA, 13 bp, Homo sapiens
ccgggccccacag

SEQ ID NO: 5873159 - DNA, 23 bp, Homo sapiens
ccgggcccccaccgccggggtcc

SEQ ID NO: 5873160 - DNA, 12 bp, Homo sapiens
ccgggcccccgc

SEQ ID NO: 5873161 - DNA, 15 bp, Homo sapiens
ccgggcccccgcccc

SEQ ID NO: 5873162 - DNA, 17 bp, Homo sapiens
ccgggcccccgccccgc

SEQ ID NO: 5873163 - DNA, 10 bp, Homo sapiens
ccgggcccct

SEQ ID NO: 5873164 - DNA, 23 bp, Homo sapiens
ccgggcccctggcacgtcctcca

SEQ ID NO: 5873165 - DNA, 21 bp, Homo sapiens
ccgggcccctgggcttggcct

SEQ ID NO: 5873166 - DNA, 23 bp, Homo sapiens
ccgggcccctgggcttggcctgc

SEQ ID NO: 5873167 - DNA, 17 bp, Homo sapiens
ccgggccctcccttgga

SEQ ID NO: 5873168 - DNA, 23 bp, Homo sapiens
ccgggccctcctgggcaccccag

SEQ ID NO: 5873169 - DNA, 21 bp, Homo sapiens
ccgggccctccttgcctgttt

SEQ ID NO: 5873170 - DNA, 14 bp, Homo sapiens
ccgggccctctgta

SEQ ID NO: 5873171 - DNA, 15 bp, Homo sapiens
ccgggccctgggccc

SEQ ID NO: 5873172 - DNA, 17 bp, Homo sapiens
ccgggcccttcagtccc

SEQ ID NO: 5873173 - DNA, 17 bp, Homo sapiens
ccgggccgaccctgcgg

SEQ ID NO: 5873174 - DNA, 14 bp, Homo sapiens
ccgggcctcagtgc

SEQ ID NO: 5873175 - DNA, 14 bp, Homo sapiens
ccgggcctcccacc

SEQ ID NO: 5873176 - DNA, 15 bp, Homo sapiens
ccgggcctcggcctg

SEQ ID NO: 5873177 - DNA, 13 bp, Homo sapiens
ccgggcctgcaca

SEQ ID NO: 5873178 - DNA, 14 bp, Homo sapiens
ccgggcctgcacag

SEQ ID NO: 5873179 - DNA, 15 bp, Homo sapiens
ccgggcctgcacaga

SEQ ID NO: 5873180 - DNA, 12 bp, Homo sapiens
ccgggcctggac

SEQ ID NO: 5873181 - DNA, 19 bp, Homo sapiens
ccgggcctggagaactaga

SEQ ID NO: 5873182 - DNA, 15 bp, Homo sapiens
ccgggcctgggcctc

SEQ ID NO: 5873183 - DNA, 14 bp, Homo sapiens
ccgggcctggggct

SEQ ID NO: 5873184 - DNA, 14 bp, Homo sapiens
ccgggcctgtacag

SEQ ID NO: 5873185 - DNA, 22 bp, Homo sapiens
ccgggcgcatgcctcccaggcc

SEQ ID NO: 5873186 - DNA, 18 bp, Homo sapiens
ccgggcgccaggacagca

SEQ ID NO: 5873187 - DNA, 19 bp, Homo sapiens
ccgggcgccaggacagcag

SEQ ID NO: 5873188 - DNA, 20 bp, Homo sapiens
ccgggcggaaggggacgcgg

SEQ ID NO: 5873189 - DNA, 20 bp, Homo sapiens
ccgggctcagggaccacagc

SEQ ID NO: 5873190 - DNA, 22 bp, Homo sapiens
ccgggctcagggaccacagcaa

SEQ ID NO: 5873191 - DNA, 12 bp, Homo sapiens
ccgggctcccac

SEQ ID NO: 5873192 - DNA, 23 bp, Homo sapiens
ccgggctctcatggtacttcctc

SEQ ID NO: 5873193 - DNA, 16 bp, Homo sapiens
ccgggctctctgctgt

SEQ ID NO: 5873194 - DNA, 22 bp, Homo sapiens
ccgggctctgcctcccatcacc

SEQ ID NO: 5873195 - DNA, 13 bp, Homo sapiens
ccgggctctggcc

SEQ ID NO: 5873196 - DNA, 16 bp, Homo sapiens
ccgggctctggccacc

SEQ ID NO: 5873197 - DNA, 18 bp, Homo sapiens
ccgggctctggccaccct

SEQ ID NO: 5873198 - DNA, 18 bp, Homo sapiens
ccgggctgagggcctgct

SEQ ID NO: 5873199 - DNA, 14 bp, Homo sapiens
ccgggctgcaggtg

SEQ ID NO: 5873200 - DNA, 20 bp, Homo sapiens
ccgggctgcccttcgctgcc

SEQ ID NO: 5873201 - DNA, 23 bp, Homo sapiens
ccgggctgcccttcgctgccagg

SEQ ID NO: 5873202 - DNA, 14 bp, Homo sapiens
ccgggctgcctgcc

SEQ ID NO: 5873203 - DNA, 22 bp, Homo sapiens
ccgggctgcctgcccctgctgc

SEQ ID NO: 5873204 - DNA, 15 bp, Homo sapiens
ccgggctgcctgggc

SEQ ID NO: 5873205 - DNA, 16 bp, Homo sapiens
ccgggctgcctgggct

SEQ ID NO: 5873206 - DNA, 13 bp, Homo sapiens
ccgggctgctgct

SEQ ID NO: 5873207 - DNA, 15 bp, Homo sapiens
ccgggctgctgctga

SEQ ID NO: 5873208 - DNA, 12 bp, Homo sapiens
ccgggctggaga

SEQ ID NO: 5873209 - DNA, 13 bp, Homo sapiens
ccgggctggagaa

SEQ ID NO: 5873210 - DNA, 18 bp, Homo sapiens
ccgggctggccctgtgca

SEQ ID NO: 5873211 - DNA, 13 bp, Homo sapiens
ccgggctggcctg

SEQ ID NO: 5873212 - DNA, 14 bp, Homo sapiens
ccgggctggctgct

SEQ ID NO: 5873213 - DNA, 19 bp, Homo sapiens
ccgggctgggagctctgca

SEQ ID NO: 5873214 - DNA, 21 bp, Homo sapiens
ccgggcttcccttctccccag

SEQ ID NO: 5873215 - DNA, 17 bp, Homo sapiens
ccgggcttggcctcctg

SEQ ID NO: 5873216 - DNA, 20 bp, Homo sapiens
ccggggaacccagccctggg

SEQ ID NO: 5873217 - DNA, 21 bp, Homo sapiens
ccggggaagagatccaaagac

SEQ ID NO: 5873218 - DNA, 21 bp, Homo sapiens
ccggggaagctgccagcccag

SEQ ID NO: 5873219 - DNA, 14 bp, Homo sapiens
ccggggactcccag

SEQ ID NO: 5873220 - DNA, 16 bp, Homo sapiens
ccggggactcccaggc

SEQ ID NO: 5873221 - DNA, 16 bp, Homo sapiens
ccggggagagcagagg

SEQ ID NO: 5873222 - DNA, 16 bp, Homo sapiens
ccggggagctgagggg

SEQ ID NO: 5873223 - DNA, 17 bp, Homo sapiens
ccggggagctgcagagc

SEQ ID NO: 5873224 - DNA, 11 bp, Homo sapiens
ccggggaggaa

SEQ ID NO: 5873225 - DNA, 19 bp, Homo sapiens
ccggggaggagccttggag

SEQ ID NO: 5873226 - DNA, 10 bp, Homo sapiens
ccggggaggg

SEQ ID NO: 5873227 - DNA, 15 bp, Homo sapiens
ccggggaggggcaga

SEQ ID NO: 5873228 - DNA, 16 bp, Homo sapiens
ccggggcactggctgc

SEQ ID NO: 5873229 - DNA, 18 bp, Homo sapiens
ccggggcactggctgctc

SEQ ID NO: 5873230 - DNA, 19 bp, Homo sapiens
ccggggcactggctgctct

SEQ ID NO: 5873231 - DNA, 20 bp, Homo sapiens
ccggggcactggctgctctg

SEQ ID NO: 5873232 - DNA, 23 bp, Homo sapiens
ccggggcactggctgctctgtct

SEQ ID NO: 5873233 - DNA, 14 bp, Homo sapiens
ccggggcatggaca

SEQ ID NO: 5873234 - DNA, 19 bp, Homo sapiens
ccggggcatggacagggcc

SEQ ID NO: 5873235 - DNA, 20 bp, Homo sapiens
ccggggcatggacagggcca

SEQ ID NO: 5873236 - DNA, 21 bp, Homo sapiens
ccggggccagcttggcaggga

SEQ ID NO: 5873237 - DNA, 13 bp, Homo sapiens
ccggggcccaggg

SEQ ID NO: 5873238 - DNA, 18 bp, Homo sapiens
ccggggccccctggtcac

SEQ ID NO: 5873239 - DNA, 22 bp, Homo sapiens
ccggggccctctctgcaccgga

SEQ ID NO: 5873240 - DNA, 15 bp, Homo sapiens
ccggggcccttcctc

SEQ ID NO: 5873241 - DNA, 12 bp, Homo sapiens
ccggggcctgga

SEQ ID NO: 5873242 - DNA, 15 bp, Homo sapiens
ccggggcctgggcag

SEQ ID NO: 5873243 - DNA, 19 bp, Homo sapiens
ccggggcctgggcaggagg

SEQ ID NO: 5873244 - DNA, 22 bp, Homo sapiens
ccggggctctgggtgctgccct

SEQ ID NO: 5873245 - DNA, 15 bp, Homo sapiens
ccggggctgaagcca

SEQ ID NO: 5873246 - DNA, 16 bp, Homo sapiens
ccggggctggcaagca

SEQ ID NO: 5873247 - DNA, 20 bp, Homo sapiens
ccggggctggcaagcaggga

SEQ ID NO: 5873248 - DNA, 22 bp, Homo sapiens
ccggggctggccctgccctccc

SEQ ID NO: 5873249 - DNA, 15 bp, Homo sapiens
ccggggctgggttgg

SEQ ID NO: 5873250 - DNA, 12 bp, Homo sapiens
ccgggggacaga

SEQ ID NO: 5873251 - DNA, 14 bp, Homo sapiens
ccgggggacagagg

SEQ ID NO: 5873252 - DNA, 22 bp, Homo sapiens
ccgggggagagggacactcctc

SEQ ID NO: 5873253 - DNA, 15 bp, Homo sapiens
ccgggggagcccagt

SEQ ID NO: 5873254 - DNA, 15 bp, Homo sapiens
ccgggggaggaaggg

SEQ ID NO: 5873255 - DNA, 18 bp, Homo sapiens
ccgggggaggggccctca

SEQ ID NO: 5873256 - DNA, 19 bp, Homo sapiens
ccgggggaggggccctcag

SEQ ID NO: 5873257 - DNA, 21 bp, Homo sapiens
ccgggggaggggccctcaggc

SEQ ID NO: 5873258 - DNA, 17 bp, Homo sapiens
ccgggggcagggtgggg

SEQ ID NO: 5873259 - DNA, 14 bp, Homo sapiens
ccgggggccagaca

SEQ ID NO: 5873260 - DNA, 13 bp, Homo sapiens
ccgggggccccac

SEQ ID NO: 5873261 - DNA, 16 bp, Homo sapiens
ccgggggctgctgggc

SEQ ID NO: 5873262 - DNA, 19 bp, Homo sapiens
ccggggggagcaggaggag

SEQ ID NO: 5873263 - DNA, 12 bp, Homo sapiens
ccggggggaggg

SEQ ID NO: 5873264 - DNA, 13 bp, Homo sapiens
ccggggggagggg

SEQ ID NO: 5873265 - DNA, 16 bp, Homo sapiens
ccggggggaggggaca

SEQ ID NO: 5873266 - DNA, 17 bp, Homo sapiens
ccggggggaggggacag

SEQ ID NO: 5873267 - DNA, 18 bp, Homo sapiens
ccggggggaggggacaga

SEQ ID NO: 5873268 - DNA, 19 bp, Homo sapiens
ccggggggaggggacagag

SEQ ID NO: 5873269 - DNA, 18 bp, Homo sapiens
ccggggggggtaggagag

SEQ ID NO: 5873270 - DNA, 23 bp, Homo sapiens
ccggggggggtaggagaggagaa

SEQ ID NO: 5873271 - DNA, 16 bp, Homo sapiens
ccgggggtggctctgt

SEQ ID NO: 5873272 - DNA, 19 bp, Homo sapiens
ccgggggtgggggcctgct

SEQ ID NO: 5873273 - DNA, 15 bp, Homo sapiens
ccggggtccaggcat

SEQ ID NO: 5873274 - DNA, 15 bp, Homo sapiens
ccggggtcctgggag

SEQ ID NO: 5873275 - DNA, 16 bp, Homo sapiens
ccggggtcctgggagg

SEQ ID NO: 5873276 - DNA, 23 bp, Homo sapiens
ccggggtcctgggaggctgcagc

SEQ ID NO: 5873277 - DNA, 14 bp, Homo sapiens
ccggggtctgtgct

SEQ ID NO: 5873278 - DNA, 17 bp, Homo sapiens
ccggggtctgtgctgtg

SEQ ID NO: 5873279 - DNA, 18 bp, Homo sapiens
ccggggtctgtgctgtgc

SEQ ID NO: 5873280 - DNA, 15 bp, Homo sapiens
ccggggtgcccgtgt

SEQ ID NO: 5873281 - DNA, 21 bp, Homo sapiens
ccggggtgcccgtgtggcctg

SEQ ID NO: 5873282 - DNA, 23 bp, Homo sapiens
ccggggtgggtgggtgggcaggg

SEQ ID NO: 5873283 - DNA, 21 bp, Homo sapiens
ccggggtgtaacttcctgctg

SEQ ID NO: 5873284 - DNA, 23 bp, Homo sapiens
ccggggtgtaacttcctgctgca

SEQ ID NO: 5873285 - DNA, 18 bp, Homo sapiens
ccggggttcaagccatgg

SEQ ID NO: 5873286 - DNA, 23 bp, Homo sapiens
ccggggttccccacacagggcac

SEQ ID NO: 5873287 - DNA, 17 bp, Homo sapiens
ccgggtactcagtcagc

SEQ ID NO: 5873288 - DNA, 17 bp, Homo sapiens
ccgggtcaccctgtgac

SEQ ID NO: 5873289 - DNA, 14 bp, Homo sapiens
ccgggtccaggaga

SEQ ID NO: 5873290 - DNA, 18 bp, Homo sapiens
ccgggtccccagctcccc

SEQ ID NO: 5873291 - DNA, 20 bp, Homo sapiens
ccgggtccggcctctccctg

SEQ ID NO: 5873292 - DNA, 16 bp, Homo sapiens
ccgggtctcaggcctc

SEQ ID NO: 5873293 - DNA, 13 bp, Homo sapiens
ccgtggctctggg

SEQ ID NO: 5873294 - DNA, 14 bp, Homo sapiens
ccgtggctctggga

SEQ ID NO: 5873295 - DNA, 20 bp, Homo sapiens
ccgtggctgctgtgggaaat

SEQ ID NO: 5873296 - DNA, 15 bp, Homo sapiens
ccgtggcttcccgct

SEQ ID NO: 5873297 - DNA, 20 bp, Homo sapiens
ccgtggcttggcatctgtgt

SEQ ID NO: 5873298 - DNA, 20 bp, Homo sapiens
ccgtggcttgggctggtcag

SEQ ID NO: 5873299 - DNA, 14 bp, Homo sapiens
ccgtggcttgggga

SEQ ID NO: 5873300 - DNA, 17 bp, Homo sapiens
ccgtgggacccaggctc

SEQ ID NO: 5873301 - DNA, 18 bp, Homo sapiens
ccgtgggaccctcagcag

SEQ ID NO: 5873302 - DNA, 19 bp, Homo sapiens
ccgtgggaccctcagcagc

SEQ ID NO: 5873303 - DNA, 21 bp, Homo sapiens
ccgtgggagaggagaggctgc

SEQ ID NO: 5873304 - DNA, 19 bp, Homo sapiens
ccgtgggccccaccctcgg

SEQ ID NO: 5873305 - DNA, 19 bp, Homo sapiens
ccgtgggccctcaagcttt

SEQ ID NO: 5873306 - DNA, 20 bp, Homo sapiens
ccgtgggctgttacttgctt

SEQ ID NO: 5873307 - DNA, 14 bp, Homo sapiens
ccgtggggcaggga

SEQ ID NO: 5873308 - DNA, 22 bp, Homo sapiens
ccgtggggcagggagctgggcc

SEQ ID NO: 5873309 - DNA, 22 bp, Homo sapiens
ccgtggggccccggctcccacc

SEQ ID NO: 5873310 - DNA, 20 bp, Homo sapiens
ccgtggggccgccgcctctt

SEQ ID NO: 5873311 - DNA, 20 bp, Homo sapiens
ccgtggggccggggcttctg

SEQ ID NO: 5873312 - DNA, 13 bp, Homo sapiens
ccgtggggctccc

SEQ ID NO: 5873313 - DNA, 23 bp, Homo sapiens
ccgtgggggaactgacgctggag

SEQ ID NO: 5873314 - DNA, 16 bp, Homo sapiens
ccgtggggtgctgccc

SEQ ID NO: 5873315 - DNA, 19 bp, Homo sapiens
ccgtggtacattcacagca

SEQ ID NO: 5873316 - DNA, 16 bp, Homo sapiens
ccgtggtagaggcctg

SEQ ID NO: 5873317 - DNA, 19 bp, Homo sapiens
ccgtggtagaggcctgggg

SEQ ID NO: 5873318 - DNA, 20 bp, Homo sapiens
ccgtggtagaggcctggggc

SEQ ID NO: 5873319 - DNA, 15 bp, Homo sapiens
ccgtggtatgtctgc

SEQ ID NO: 5873320 - DNA, 15 bp, Homo sapiens
ccgtggtcagagtgc

SEQ ID NO: 5873321 - DNA, 17 bp, Homo sapiens
ccgtggtcagagtgcca

SEQ ID NO: 5873322 - DNA, 19 bp, Homo sapiens
ccgtggtcagagtgccact

SEQ ID NO: 5873323 - DNA, 13 bp, Homo sapiens
ccgtggtccagct

SEQ ID NO: 5873324 - DNA, 14 bp, Homo sapiens
ccgtggtcctttgg

SEQ ID NO: 5873325 - DNA, 14 bp, Homo sapiens
ccgtggtctttgaa

SEQ ID NO: 5873326 - DNA, 18 bp, Homo sapiens
ccgtggtctttgaataaa

SEQ ID NO: 5873327 - DNA, 23 bp, Homo sapiens
ccgtggtgacatttcccaagtca

SEQ ID NO: 5873328 - DNA, 16 bp, Homo sapiens
ccgtggtgacccctgc

SEQ ID NO: 5873329 - DNA, 14 bp, Homo sapiens
ccgtggtgcctgca

SEQ ID NO: 5873330 - DNA, 21 bp, Homo sapiens
ccgtggtggcaccgagaccaa

SEQ ID NO: 5873331 - DNA, 22 bp, Homo sapiens
ccgtggtggcggtggctgcccc

SEQ ID NO: 5873332 - DNA, 14 bp, Homo sapiens
ccgtggtgtgaggc

SEQ ID NO: 5873333 - DNA, 16 bp, Homo sapiens
ccgtggtgtgaggccc

SEQ ID NO: 5873334 - DNA, 21 bp, Homo sapiens
ccgtggtgtgaggcccccgga

SEQ ID NO: 5873335 - DNA, 23 bp, Homo sapiens
ccgtggtttgaacacgaaagaaa

SEQ ID NO: 5873336 - DNA, 19 bp, Homo sapiens
ccgtgtaaatatgtacatt

SEQ ID NO: 5873337 - DNA, 21 bp, Homo sapiens
ccgtgtaaatatgtacatttc

SEQ ID NO: 5873338 - DNA, 18 bp, Homo sapiens
ccgtgtcaagctgctctg

SEQ ID NO: 5873339 - DNA, 12 bp, Homo sapiens
ccgtgtccaccc

SEQ ID NO: 5873340 - DNA, 15 bp, Homo sapiens
ccgtgtccagcacag

SEQ ID NO: 5873341 - DNA, 15 bp, Homo sapiens
ccgtgtccaggagcc

SEQ ID NO: 5873342 - DNA, 23 bp, Homo sapiens
ccgtgtccaggagccccgccagg

SEQ ID NO: 5873343 - DNA, 14 bp, Homo sapiens
ccgtgtcccaagga

SEQ ID NO: 5873344 - DNA, 15 bp, Homo sapiens
ccgtgtcccaaggag

SEQ ID NO: 5873345 - DNA, 15 bp, Homo sapiens
ccgtgtccccccagg

SEQ ID NO: 5873346 - DNA, 20 bp, Homo sapiens
ccgtgtctcgcgcgactgag

SEQ ID NO: 5873347 - DNA, 23 bp, Homo sapiens
ccgtgtctcgcgcgactgagaac

SEQ ID NO: 5873348 - DNA, 15 bp, Homo sapiens
ccgtgtctggatgca

SEQ ID NO: 5873349 - DNA, 16 bp, Homo sapiens
ccgtgtctgtctggca

SEQ ID NO: 5873350 - DNA, 17 bp, Homo sapiens
ccgtgtctgtggccctc

SEQ ID NO: 5873351 - DNA, 18 bp, Homo sapiens
ccgtgtctgtggccctct

SEQ ID NO: 5873352 - DNA, 12 bp, Homo sapiens
ccgtgtgaatgt

SEQ ID NO: 5873353 - DNA, 23 bp, Homo sapiens
ccgtgtgaatgtagcttccacct

SEQ ID NO: 5873354 - DNA, 18 bp, Homo sapiens
ccgtgtgagtgtgacagg

SEQ ID NO: 5873355 - DNA, 14 bp, Homo sapiens
ccgtgtgccccaag

SEQ ID NO: 5873356 - DNA, 18 bp, Homo sapiens
ccgtgtgcctcctgtgtg

SEQ ID NO: 5873357 - DNA, 19 bp, Homo sapiens
ccgtgtgcctcctgtgtgt

SEQ ID NO: 5873358 - DNA, 23 bp, Homo sapiens
ccgtgtggagggctgcagagcct

SEQ ID NO: 5873359 - DNA, 14 bp, Homo sapiens
ccgtgtggcccctt

SEQ ID NO: 5873360 - DNA, 16 bp, Homo sapiens
ccgtgtggccccttca

SEQ ID NO: 5873361 - DNA, 17 bp, Homo sapiens
ccgtgtggcctgggtcc

SEQ ID NO: 5873362 - DNA, 21 bp, Homo sapiens
ccgtgtggtaagcaacatggc

SEQ ID NO: 5873363 - DNA, 22 bp, Homo sapiens
ccgtgtggtaagcaacatggct

SEQ ID NO: 5873364 - DNA, 16 bp, Homo sapiens
ccgtgtgtccagcatt

SEQ ID NO: 5873365 - DNA, 19 bp, Homo sapiens
ccgtgtgtcccagatgctg

SEQ ID NO: 5873366 - DNA, 15 bp, Homo sapiens
ccgtgtgtgcatgtg

SEQ ID NO: 5873367 - DNA, 19 bp, Homo sapiens
ccgtgtgtggttggaaaac

SEQ ID NO: 5873368 - DNA, 21 bp, Homo sapiens
ccgtgtgtgtggccggcctcc

SEQ ID NO: 5873369 - DNA, 15 bp, Homo sapiens
ccgtgttagccagga

SEQ ID NO: 5873370 - DNA, 19 bp, Homo sapiens
ccgtgttagccaggatggt

SEQ ID NO: 5873371 - DNA, 20 bp, Homo sapiens
ccgtgttagccaggatggtc

SEQ ID NO: 5873372 - DNA, 11 bp, Homo sapiens
ccgtgttcaca

SEQ ID NO: 5873373 - DNA, 15 bp, Homo sapiens
ccgtgttcacacaca

SEQ ID NO: 5873374 - DNA, 14 bp, Homo sapiens
ccgtgttcaggaca

SEQ ID NO: 5873375 - DNA, 11 bp, Homo sapiens
ccgtgttctcc

SEQ ID NO: 5873376 - DNA, 13 bp, Homo sapiens
ccgtgtttctcta

SEQ ID NO: 5873377 - DNA, 18 bp, Homo sapiens
ccgtgtttgtctcttctg

SEQ ID NO: 5873378 - DNA, 19 bp, Homo sapiens
ccgtgtttgtctcttctgg

SEQ ID NO: 5873379 - DNA, 21 bp, Homo sapiens
ccgtgttttatgactaatcct

SEQ ID NO: 5873380 - DNA, 14 bp, Homo sapiens
ccgttaaataattc

SEQ ID NO: 5873381 - DNA, 13 bp, Homo sapiens
ccgttacaaaaga

SEQ ID NO: 5873382 - DNA, 17 bp, Homo sapiens
ccgttacatctgtgcag

SEQ ID NO: 5873383 - DNA, 17 bp, Homo sapiens
ccgttactctccaacct

SEQ ID NO: 5873384 - DNA, 22 bp, Homo sapiens
ccgttactctccaacctggaca

SEQ ID NO: 5873385 - DNA, 13 bp, Homo sapiens
ccgttagctcctg

SEQ ID NO: 5873386 - DNA, 17 bp, Homo sapiens
ccgttagctcctgtggc

SEQ ID NO: 5873387 - DNA, 21 bp, Homo sapiens
ccgttattataattgtatcag

SEQ ID NO: 5873388 - DNA, 20 bp, Homo sapiens
ccgttcaagaggcgtgtgca

SEQ ID NO: 5873389 - DNA, 15 bp, Homo sapiens
ccgttcagcctgtct

SEQ ID NO: 5873390 - DNA, 15 bp, Homo sapiens
ccgttcatctgagga

SEQ ID NO: 5873391 - DNA, 20 bp, Homo sapiens
ccgttcatctgaggagtcca

SEQ ID NO: 5873392 - DNA, 16 bp, Homo sapiens
ccgttcatgggggagg

SEQ ID NO: 5873393 - DNA, 12 bp, Homo sapiens
ccgttcattcat

SEQ ID NO: 5873394 - DNA, 19 bp, Homo sapiens
ccgttcccacctctgagga

SEQ ID NO: 5873395 - DNA, 15 bp, Homo sapiens
ccgttcccagcgcat

SEQ ID NO: 5873396 - DNA, 14 bp, Homo sapiens
ccgttccccttggc

SEQ ID NO: 5873397 - DNA, 15 bp, Homo sapiens
ccgttccctgtcaga

SEQ ID NO: 5873398 - DNA, 18 bp, Homo sapiens
ccgttcctccccctgctc

SEQ ID NO: 5873399 - DNA, 19 bp, Homo sapiens
ccgttcctgacatcacagc

SEQ ID NO: 5873400 - DNA, 20 bp, Homo sapiens
ccgttccttccgatgacagt

SEQ ID NO: 5873401 - DNA, 15 bp, Homo sapiens
ccgttctccattctg

SEQ ID NO: 5873402 - DNA, 12 bp, Homo sapiens
ccgttctgttcc

SEQ ID NO: 5873403 - DNA, 13 bp, Homo sapiens
ccgttctgttcca

SEQ ID NO: 5873404 - DNA, 19 bp, Homo sapiens
ccgttctgttccaacctcc

SEQ ID NO: 5873405 - DNA, 15 bp, Homo sapiens
ccgttgctgacttag

SEQ ID NO: 5873406 - DNA, 16 bp, Homo sapiens
ccgttgcttcccgctg

SEQ ID NO: 5873407 - DNA, 13 bp, Homo sapiens
ccgttgctttcgt

SEQ ID NO: 5873408 - DNA, 14 bp, Homo sapiens
ccgttggaaagaac

SEQ ID NO: 5873409 - DNA, 19 bp, Homo sapiens
ccgttggaaagaacattta

SEQ ID NO: 5873410 - DNA, 11 bp, Homo sapiens
ccgttggccac

SEQ ID NO: 5873411 - DNA, 23 bp, Homo sapiens
ccgttgtctaggagacagagcca

SEQ ID NO: 5873412 - DNA, 12 bp, Homo sapiens
ccgttgtgagct

SEQ ID NO: 5873413 - DNA, 11 bp, Homo sapiens
ccgtttacagt

SEQ ID NO: 5873414 - DNA, 19 bp, Homo sapiens
ccgtttacagtgtatttaa

SEQ ID NO: 5873415 - DNA, 16 bp, Homo sapiens
ccgtttatgggccttg

SEQ ID NO: 5873416 - DNA, 16 bp, Homo sapiens
ccgtttccctccaggt

SEQ ID NO: 5873417 - DNA, 15 bp, Homo sapiens
ccgtttcttccctgt

SEQ ID NO: 5873418 - DNA, 13 bp, Homo sapiens
ccgtttcttgcaa

SEQ ID NO: 5873419 - DNA, 13 bp, Homo sapiens
ccgtttgaccaat

SEQ ID NO: 5873420 - DNA, 23 bp, Homo sapiens
ccgtttgatttgtcactgcttca

SEQ ID NO: 5873421 - DNA, 13 bp, Homo sapiens
ccgtttgcttttg

SEQ ID NO: 5873422 - DNA, 17 bp, Homo sapiens
ccgttttaccaataaac

SEQ ID NO: 5873423 - DNA, 20 bp, Homo sapiens
ccgttttcacttgtctcctt

SEQ ID NO: 5873424 - DNA, 22 bp, Homo sapiens
ccgttttcacttgtctcctttc

SEQ ID NO: 5873425 - DNA, 15 bp, Homo sapiens
ccgttttcatgacca

SEQ ID NO: 5873426 - DNA, 15 bp, Homo sapiens
ccgttttccccatga

SEQ ID NO: 5873427 - DNA, 16 bp, Homo sapiens
ccgttttcctcatcct

SEQ ID NO: 5873428 - DNA, 14 bp, Homo sapiens
ccgttttgtcactt

SEQ ID NO: 5873429 - DNA, 12 bp, Homo sapiens
cctaaaaaagat

SEQ ID NO: 5873430 - DNA, 18 bp, Homo sapiens
cctaaaaaagatatatta

SEQ ID NO: 5873431 - DNA, 17 bp, Homo sapiens
cctaaaaacaaaacaaa

SEQ ID NO: 5873432 - DNA, 14 bp, Homo sapiens
cctaaaaacacaga

SEQ ID NO: 5873433 - DNA, 14 bp, Homo sapiens
cctaaaaattttgt

SEQ ID NO: 5873434 - DNA, 13 bp, Homo sapiens
cctaaaacaaaag

SEQ ID NO: 5873435 - DNA, 18 bp, Homo sapiens
cctaaaacacccttcagc

SEQ ID NO: 5873436 - DNA, 16 bp, Homo sapiens
cctaaaactggcctga

SEQ ID NO: 5873437 - DNA, 14 bp, Homo sapiens
cctaaaagcaaaat

SEQ ID NO: 5873438 - DNA, 13 bp, Homo sapiens
cctaaaagcactc

SEQ ID NO: 5873439 - DNA, 22 bp, Homo sapiens
cctaaaaggaaatctcacccca

SEQ ID NO: 5873440 - DNA, 23 bp, Homo sapiens
cctaaaaggaaatctcaccccat

SEQ ID NO: 5873441 - DNA, 20 bp, Homo sapiens
cctaaaagttgaaaagccaa

SEQ ID NO: 5873442 - DNA, 15 bp, Homo sapiens
cctaaaatacattta

SEQ ID NO: 5873443 - DNA, 16 bp, Homo sapiens
cctaaaattcagtgga

SEQ ID NO: 5873444 - DNA, 17 bp, Homo sapiens
cctaaaattgtatgaaa

SEQ ID NO: 5873445 - DNA, 17 bp, Homo sapiens
cctaaaattgtttccta

SEQ ID NO: 5873446 - DNA, 14 bp, Homo sapiens
cctaaaatttgccc

SEQ ID NO: 5873447 - DNA, 14 bp, Homo sapiens
cctaaacagctgct

SEQ ID NO: 5873448 - DNA, 16 bp, Homo sapiens
cctaaacagctgcttt

SEQ ID NO: 5873449 - DNA, 16 bp, Homo sapiens
cctaaacataattgtg

SEQ ID NO: 5873450 - DNA, 17 bp, Homo sapiens
cctaaacataattgtgg

SEQ ID NO: 5873451 - DNA, 16 bp, Homo sapiens
cctaaaccaaaaactg

SEQ ID NO: 5873452 - DNA, 19 bp, Homo sapiens
cctaaacccccgctccaga

SEQ ID NO: 5873453 - DNA, 17 bp, Homo sapiens
cctaaacccctgtccca

SEQ ID NO: 5873454 - DNA, 15 bp, Homo sapiens
cctaaaccctctgtg

SEQ ID NO: 5873455 - DNA, 15 bp, Homo sapiens
cctaaacctttgccc

SEQ ID NO: 5873456 - DNA, 22 bp, Homo sapiens
cctaaacggggcagtactcctc

SEQ ID NO: 5873457 - DNA, 18 bp, Homo sapiens
cctaaactacctttttgt

SEQ ID NO: 5873458 - DNA, 14 bp, Homo sapiens
cctaaactgcagcc

SEQ ID NO: 5873459 - DNA, 11 bp, Homo sapiens
cctaaactgta

SEQ ID NO: 5873460 - DNA, 19 bp, Homo sapiens
cctaaagacgtctcttttt

SEQ ID NO: 5873461 - DNA, 19 bp, Homo sapiens
cctaaagcaaatctgccac

SEQ ID NO: 5873462 - DNA, 16 bp, Homo sapiens
cctaaagccaaagttt

SEQ ID NO: 5873463 - DNA, 17 bp, Homo sapiens
cctaaagcccattgctg

SEQ ID NO: 5873464 - DNA, 13 bp, Homo sapiens
cctaaagcctcaa

SEQ ID NO: 5873465 - DNA, 17 bp, Homo sapiens
cctaaagggaagccctg

SEQ ID NO: 5873466 - DNA, 18 bp, Homo sapiens
cctaaagggcagggccca

SEQ ID NO: 5873467 - DNA, 19 bp, Homo sapiens
cctaaagtagacttcattt

SEQ ID NO: 5873468 - DNA, 20 bp, Homo sapiens
cctaaagtgaagaagccatc

SEQ ID NO: 5873469 - DNA, 16 bp, Homo sapiens
cctaaagtgctgggat

SEQ ID NO: 5873470 - DNA, 21 bp, Homo sapiens
cctaaagtgctgggattacag

SEQ ID NO: 5873471 - DNA, 14 bp, Homo sapiens
cctaaagtgtattt

SEQ ID NO: 5873472 - DNA, 13 bp, Homo sapiens
cctaaataaacta

SEQ ID NO: 5873473 - DNA, 18 bp, Homo sapiens
cctaatttatcttcatgt

SEQ ID NO: 5873474 - DNA, 19 bp, Homo sapiens
cctaatttattggattccc

SEQ ID NO: 5873475 - DNA, 14 bp, Homo sapiens
cctaatttctcctc

SEQ ID NO: 5873476 - DNA, 16 bp, Homo sapiens
cctaatttctcctccc

SEQ ID NO: 5873477 - DNA, 13 bp, Homo sapiens
cctaatttgaaca

SEQ ID NO: 5873478 - DNA, 23 bp, Homo sapiens
cctaattttgccaaaatcctgaa

SEQ ID NO: 5873479 - DNA, 21 bp, Homo sapiens
cctaattttttaaagaatcca

SEQ ID NO: 5873480 - DNA, 20 bp, Homo sapiens
cctacaaaagcttgtgtatc

SEQ ID NO: 5873481 - DNA, 13 bp, Homo sapiens
cctacaaagaaaa

SEQ ID NO: 5873482 - DNA, 17 bp, Homo sapiens
cctacaaccatccctgc

SEQ ID NO: 5873483 - DNA, 18 bp, Homo sapiens
cctacaaccatccctgcc

SEQ ID NO: 5873484 - DNA, 20 bp, Homo sapiens
cctacaaccatccctgccac

SEQ ID NO: 5873485 - DNA, 17 bp, Homo sapiens
cctacaaccccagcctc

SEQ ID NO: 5873486 - DNA, 16 bp, Homo sapiens
cctacaactaaaaata

SEQ ID NO: 5873487 - DNA, 20 bp, Homo sapiens
cctacaactaaaaataaatt

SEQ ID NO: 5873488 - DNA, 19 bp, Homo sapiens
cctacaagatttagaaaaa

SEQ ID NO: 5873489 - DNA, 14 bp, Homo sapiens
cctacaagatttcc

SEQ ID NO: 5873490 - DNA, 15 bp, Homo sapiens
cctacaagctggcac

SEQ ID NO: 5873491 - DNA, 14 bp, Homo sapiens
cctacaaggcctat

SEQ ID NO: 5873492 - DNA, 21 bp, Homo sapiens
cctacaagttaaccagttgca

SEQ ID NO: 5873493 - DNA, 16 bp, Homo sapiens
cctacaagtttaagta

SEQ ID NO: 5873494 - DNA, 13 bp, Homo sapiens
cctacaataaact

SEQ ID NO: 5873495 - DNA, 22 bp, Homo sapiens
cctacaatatcattttcctggg

SEQ ID NO: 5873496 - DNA, 18 bp, Homo sapiens
cctacaatattttattct

SEQ ID NO: 5873497 - DNA, 16 bp, Homo sapiens
cctacacacacactcc

SEQ ID NO: 5873498 - DNA, 17 bp, Homo sapiens
cctacacagctgtttcc

SEQ ID NO: 5873499 - DNA, 18 bp, Homo sapiens
cctacacagctgtttcct

SEQ ID NO: 5873500 - DNA, 13 bp, Homo sapiens
cctacaccattcc

SEQ ID NO: 5873501 - DNA, 17 bp, Homo sapiens
cctacacccagacccca

SEQ ID NO: 5873502 - DNA, 17 bp, Homo sapiens
cctacacccttggactt

SEQ ID NO: 5873503 - DNA, 20 bp, Homo sapiens
cctacacccttggacttgag

SEQ ID NO: 5873504 - DNA, 18 bp, Homo sapiens
cctacacctctgggccct

SEQ ID NO: 5873505 - DNA, 21 bp, Homo sapiens
cctacactgatgcaaggatta

SEQ ID NO: 5873506 - DNA, 12 bp, Homo sapiens
cctacactgcca

SEQ ID NO: 5873507 - DNA, 13 bp, Homo sapiens
cctacactgccag

SEQ ID NO: 5873508 - DNA, 17 bp, Homo sapiens
cctacagaaaaaccttg

SEQ ID NO: 5873509 - DNA, 12 bp, Homo sapiens
cctacagacagc

SEQ ID NO: 5873510 - DNA, 15 bp, Homo sapiens
cctacagacctggct

SEQ ID NO: 5873511 - DNA, 16 bp, Homo sapiens
cctacagactccatct

SEQ ID NO: 5873512 - DNA, 18 bp, Homo sapiens
cctacagactccatctct

SEQ ID NO: 5873513 - DNA, 13 bp, Homo sapiens
cctacagagctgt

SEQ ID NO: 5873514 - DNA, 18 bp, Homo sapiens
cctacagaggaggcctca

SEQ ID NO: 5873515 - DNA, 22 bp, Homo sapiens
cctacagaggaggcctcaaagc

SEQ ID NO: 5873516 - DNA, 19 bp, Homo sapiens
cctacagcactactgggtg

SEQ ID NO: 5873517 - DNA, 21 bp, Homo sapiens
cctacagcactactgggtgtc

SEQ ID NO: 5873518 - DNA, 22 bp, Homo sapiens
cctacagcactactgggtgtca

SEQ ID NO: 5873519 - DNA, 14 bp, Homo sapiens
cctacagcagatcc

SEQ ID NO: 5873520 - DNA, 15 bp, Homo sapiens
cctacagcagatcca

SEQ ID NO: 5873521 - DNA, 16 bp, Homo sapiens
cctacagcagatccac

SEQ ID NO: 5873522 - DNA, 17 bp, Homo sapiens
cctacagccacatcccc

SEQ ID NO: 5873523 - DNA, 17 bp, Homo sapiens
cctacagctttgatccc

SEQ ID NO: 5873524 - DNA, 14 bp, Homo sapiens
cctacaggactggg

SEQ ID NO: 5873525 - DNA, 23 bp, Homo sapiens
cctacaggactgggccgggccca

SEQ ID NO: 5873526 - DNA, 12 bp, Homo sapiens
cctacaggctga

SEQ ID NO: 5873527 - DNA, 18 bp, Homo sapiens
cctacagggggtctggct

SEQ ID NO: 5873528 - DNA, 21 bp, Homo sapiens
cctacagggggtctggctggt

SEQ ID NO: 5873529 - DNA, 15 bp, Homo sapiens
cctacagtatataag

SEQ ID NO: 5873530 - DNA, 12 bp, Homo sapiens
cctacagtgaaa

SEQ ID NO: 5873531 - DNA, 20 bp, Homo sapiens
cctacagtgactccctggga

SEQ ID NO: 5873532 - DNA, 16 bp, Homo sapiens
cctacagtgctgtgta

SEQ ID NO: 5873533 - DNA, 15 bp, Homo sapiens
cctacagtggctgtc

SEQ ID NO: 5873534 - DNA, 16 bp, Homo sapiens
cctacagtgtacagtc

SEQ ID NO: 5873535 - DNA, 20 bp, Homo sapiens
cctacagtgttgttccctcc

SEQ ID NO: 5873536 - DNA, 17 bp, Homo sapiens
cctacatatcccttcca

SEQ ID NO: 5873537 - DNA, 19 bp, Homo sapiens
cctacatgaaacagaaaca

SEQ ID NO: 5873538 - DNA, 22 bp, Homo sapiens
cctacatgtatttgtttgcata

SEQ ID NO: 5873539 - DNA, 20 bp, Homo sapiens
cctacattccccagagtggg

SEQ ID NO: 5873540 - DNA, 16 bp, Homo sapiens
cctacattccctctcc

SEQ ID NO: 5873541 - DNA, 23 bp, Homo sapiens
cctacattccctctcctgcccag

SEQ ID NO: 5873542 - DNA, 20 bp, Homo sapiens
cctacattctttattctgcg

SEQ ID NO: 5873543 - DNA, 20 bp, Homo sapiens
cctaccaaaaattgccaagt

SEQ ID NO: 5873544 - DNA, 14 bp, Homo sapiens
cctaccaaatataa

SEQ ID NO: 5873545 - DNA, 18 bp, Homo sapiens
cctaccaaatataaactt

SEQ ID NO: 5873546 - DNA, 17 bp, Homo sapiens
cctaccaatagattccc

SEQ ID NO: 5873547 - DNA, 18 bp, Homo sapiens
cctaccaatagattcccc

SEQ ID NO: 5873548 - DNA, 23 bp, Homo sapiens
cctaccaatagattccccattgc

SEQ ID NO: 5873549 - DNA, 23 bp, Homo sapiens
cctaccaatctctgctctctatg

SEQ ID NO: 5873550 - DNA, 12 bp, Homo sapiens
cctaccaatgca

SEQ ID NO: 5873551 - DNA, 13 bp, Homo sapiens
cctaccaatgcat

SEQ ID NO: 5873552 - DNA, 16 bp, Homo sapiens
cctaccacagctgcct

SEQ ID NO: 5873553 - DNA, 14 bp, Homo sapiens
cctaccacatgcca

SEQ ID NO: 5873554 - DNA, 15 bp, Homo sapiens
cctaccaccagggcc

SEQ ID NO: 5873555 - DNA, 14 bp, Homo sapiens
cctaccaccccact

SEQ ID NO: 5873556 - DNA, 13 bp, Homo sapiens
cctaccacccctt

SEQ ID NO: 5873557 - DNA, 17 bp, Homo sapiens
cctaccaccccttcctg

SEQ ID NO: 5873558 - DNA, 18 bp, Homo sapiens
cctaccaccccttcctgt

SEQ ID NO: 5873559 - DNA, 17 bp, Homo sapiens
cctaccaccttccctct

SEQ ID NO: 5873560 - DNA, 21 bp, Homo sapiens
cctaccaccttccctctttct

SEQ ID NO: 5873561 - DNA, 15 bp, Homo sapiens
cctaccactgagccc

SEQ ID NO: 5873562 - DNA, 19 bp, Homo sapiens
cctaccacttttctgctgt

SEQ ID NO: 5873563 - DNA, 20 bp, Homo sapiens
cctaccagcgcccgctgggc

SEQ ID NO: 5873564 - DNA, 14 bp, Homo sapiens
cctaccagctcctc

SEQ ID NO: 5873565 - DNA, 21 bp, Homo sapiens
cctaccagctcctccagccct

SEQ ID NO: 5873566 - DNA, 20 bp, Homo sapiens
cctaccagtcgccctctgtg

SEQ ID NO: 5873567 - DNA, 15 bp, Homo sapiens
cctaccatcagctct

SEQ ID NO: 5873568 - DNA, 19 bp, Homo sapiens
cctaccatcagctctgcct

SEQ ID NO: 5873569 - DNA, 19 bp, Homo sapiens
cctacccacacctctgcca

SEQ ID NO: 5873570 - DNA, 17 bp, Homo sapiens
cctacccacagggcctg

SEQ ID NO: 5873571 - DNA, 20 bp, Homo sapiens
cctacccacagggcctgact

SEQ ID NO: 5873572 - DNA, 12 bp, Homo sapiens
cctacccactct

SEQ ID NO: 5873573 - DNA, 17 bp, Homo sapiens
cctacccactctttgct

SEQ ID NO: 5873574 - DNA, 22 bp, Homo sapiens
cctacccagtccccattttctg

SEQ ID NO: 5873575 - DNA, 17 bp, Homo sapiens
cctaccccaattccttg

SEQ ID NO: 5873576 - DNA, 18 bp, Homo sapiens
cctaccccaattccttgt

SEQ ID NO: 5873577 - DNA, 19 bp, Homo sapiens
cctaccccaattccttgta

SEQ ID NO: 5873578 - DNA, 12 bp, Homo sapiens
cctaccccacac

SEQ ID NO: 5873579 - DNA, 20 bp, Homo sapiens
cctaccccacaccaggccgt

SEQ ID NO: 5873580 - DNA, 19 bp, Homo sapiens
cctaccccacctcatgcct

SEQ ID NO: 5873581 - DNA, 20 bp, Homo sapiens
cctaccccacctcatgcctg

SEQ ID NO: 5873582 - DNA, 14 bp, Homo sapiens
cctaccccagccag

SEQ ID NO: 5873583 - DNA, 20 bp, Homo sapiens
cctaccccagccaggctcct

SEQ ID NO: 5873584 - DNA, 23 bp, Homo sapiens
cctaccccagttcatctctgctg

SEQ ID NO: 5873585 - DNA, 12 bp, Homo sapiens
cctaccccatag

SEQ ID NO: 5873586 - DNA, 16 bp, Homo sapiens
cctaccccctcttcaa

SEQ ID NO: 5873587 - DNA, 21 bp, Homo sapiens
cctaccccctgaaagtgacag

SEQ ID NO: 5873588 - DNA, 19 bp, Homo sapiens
cctacccccttgtctgctg

SEQ ID NO: 5873589 - DNA, 21 bp, Homo sapiens
cctaccccgcagacaccttgg

SEQ ID NO: 5873590 - DNA, 15 bp, Homo sapiens
cctacccctcccagc

SEQ ID NO: 5873591 - DNA, 17 bp, Homo sapiens
cctacccctcccagctg

SEQ ID NO: 5873592 - DNA, 18 bp, Homo sapiens
cctacccctcccagctga

SEQ ID NO: 5873593 - DNA, 15 bp, Homo sapiens
cctacccctcttcca

SEQ ID NO: 5873594 - DNA, 12 bp, Homo sapiens
cctacccctgcc

SEQ ID NO: 5873595 - DNA, 13 bp, Homo sapiens
cctacccctgccc

SEQ ID NO: 5873596 - DNA, 14 bp, Homo sapiens
cctacccctgccct

SEQ ID NO: 5873597 - DNA, 17 bp, Homo sapiens
cctacccctgccctgct

SEQ ID NO: 5873598 - DNA, 23 bp, Homo sapiens
cctaccccttcctgtcctgcctc

SEQ ID NO: 5873599 - DNA, 22 bp, Homo sapiens
cctaccccttggaaatgtctgc

SEQ ID NO: 5873600 - DNA, 23 bp, Homo sapiens
cctaccccttggaaatgtctgct

SEQ ID NO: 5873601 - DNA, 15 bp, Homo sapiens
cctaccctaaccaag

SEQ ID NO: 5873602 - DNA, 16 bp, Homo sapiens
cctaccctaaccaagt

SEQ ID NO: 5873603 - DNA, 21 bp, Homo sapiens
cctaccctatggggaggccct

SEQ ID NO: 5873604 - DNA, 14 bp, Homo sapiens
cctaccctcccacc

SEQ ID NO: 5873605 - DNA, 16 bp, Homo sapiens
cctaccctcctgctga

SEQ ID NO: 5873606 - DNA, 19 bp, Homo sapiens
cctaccctcctgctgagct

SEQ ID NO: 5873607 - DNA, 20 bp, Homo sapiens
cctaccctcctgctgagctg

SEQ ID NO: 5873608 - DNA, 21 bp, Homo sapiens
cctaccctcctgctgagctgc

SEQ ID NO: 5873609 - DNA, 14 bp, Homo sapiens
cctaccctcgggcc

SEQ ID NO: 5873610 - DNA, 13 bp, Homo sapiens
cctaccctctaga

SEQ ID NO: 5873611 - DNA, 14 bp, Homo sapiens
cctaccctggcagg

SEQ ID NO: 5873612 - DNA, 13 bp, Homo sapiens
cctacccttcctg

SEQ ID NO: 5873613 - DNA, 16 bp, Homo sapiens
cctacccttcctgcat

SEQ ID NO: 5873614 - DNA, 22 bp, Homo sapiens
cctaccgagtctcttctccact

SEQ ID NO: 5873615 - DNA, 23 bp, Homo sapiens
cctaccgagtctcttctccactg

SEQ ID NO: 5873616 - DNA, 23 bp, Homo sapiens
cctaccgcatggcagctgggccc

SEQ ID NO: 5873617 - DNA, 16 bp, Homo sapiens
cctaccgctggccctg

SEQ ID NO: 5873618 - DNA, 19 bp, Homo sapiens
cctaccgctggccctgccg

SEQ ID NO: 5873619 - DNA, 21 bp, Homo sapiens
cctaccgctggccctgccgtt

SEQ ID NO: 5873620 - DNA, 22 bp, Homo sapiens
cctaccgtactccctgcaccgt

SEQ ID NO: 5873621 - DNA, 17 bp, Homo sapiens
cctacctaactccctag

SEQ ID NO: 5873622 - DNA, 17 bp, Homo sapiens
cctacctcaacctgtaa

SEQ ID NO: 5873623 - DNA, 20 bp, Homo sapiens
cctacctcaacctgtaaatt

SEQ ID NO: 5873624 - DNA, 14 bp, Homo sapiens
cctacctcagccta

SEQ ID NO: 5873625 - DNA, 16 bp, Homo sapiens
cctacctcagcctaga

SEQ ID NO: 5873626 - DNA, 15 bp, Homo sapiens
cctacctcaggcagg

SEQ ID NO: 5873627 - DNA, 13 bp, Homo sapiens
cctacctcaggtt

SEQ ID NO: 5873628 - DNA, 14 bp, Homo sapiens
cctacctcaggttg

SEQ ID NO: 5873629 - DNA, 14 bp, Homo sapiens
cctacctccctccc

SEQ ID NO: 5873630 - DNA, 16 bp, Homo sapiens
cctacctccctccctc

SEQ ID NO: 5873631 - DNA, 17 bp, Homo sapiens
cctacctccctcctcag

SEQ ID NO: 5873632 - DNA, 15 bp, Homo sapiens
cctacctctggtgat

SEQ ID NO: 5873633 - DNA, 22 bp, Homo sapiens
cctacctgaaggcagggctcct

SEQ ID NO: 5873634 - DNA, 12 bp, Homo sapiens
cctacctgctcc

SEQ ID NO: 5873635 - DNA, 15 bp, Homo sapiens
cctacctgctcccct

SEQ ID NO: 5873636 - DNA, 13 bp, Homo sapiens
cctacctgctctc

SEQ ID NO: 5873637 - DNA, 15 bp, Homo sapiens
cctacctgctgctgc

SEQ ID NO: 5873638 - DNA, 20 bp, Homo sapiens
cctacctggggaaagcctga

SEQ ID NO: 5873639 - DNA, 13 bp, Homo sapiens
cctacctggggac

SEQ ID NO: 5873640 - DNA, 14 bp, Homo sapiens
cctacctgggggca

SEQ ID NO: 5873641 - DNA, 17 bp, Homo sapiens
cctacctgtctgctgcc

SEQ ID NO: 5873642 - DNA, 14 bp, Homo sapiens
cctacctgtgaatc

SEQ ID NO: 5873643 - DNA, 16 bp, Homo sapiens
cctaccttatagagca

SEQ ID NO: 5873644 - DNA, 20 bp, Homo sapiens
cctaccttatagagcacaat

SEQ ID NO: 5873645 - DNA, 16 bp, Homo sapiens
cctaccttcaaagctg

SEQ ID NO: 5873646 - DNA, 15 bp, Homo sapiens
cctaccttccccaga

SEQ ID NO: 5873647 - DNA, 22 bp, Homo sapiens
cctaccttgagaccctcttctc

SEQ ID NO: 5873648 - DNA, 13 bp, Homo sapiens
cctaccttgcctc

SEQ ID NO: 5873649 - DNA, 13 bp, Homo sapiens
cctaccttgcttt

SEQ ID NO: 5873650 - DNA, 20 bp, Homo sapiens
cctaccttttgtctcttggt

SEQ ID NO: 5873651 - DNA, 12 bp, Homo sapiens
cctacgacccca

SEQ ID NO: 5873652 - DNA, 20 bp, Homo sapiens
cctagccaccagtgtcctcc

SEQ ID NO: 5873653 - DNA, 12 bp, Homo sapiens
cctagccaccca

SEQ ID NO: 5873654 - DNA, 11 bp, Homo sapiens
cctagccacct

SEQ ID NO: 5873655 - DNA, 13 bp, Homo sapiens
cctagccacctcc

SEQ ID NO: 5873656 - DNA, 12 bp, Homo sapiens
cctagccagctg

SEQ ID NO: 5873657 - DNA, 21 bp, Homo sapiens
cctagccaggtctcctgggaa

SEQ ID NO: 5873658 - DNA, 14 bp, Homo sapiens
cctagccattcctg

SEQ ID NO: 5873659 - DNA, 15 bp, Homo sapiens
cctagccattcctgg

SEQ ID NO: 5873660 - DNA, 13 bp, Homo sapiens
cctagccattctg

SEQ ID NO: 5873661 - DNA, 16 bp, Homo sapiens
cctagcccaccctgct

SEQ ID NO: 5873662 - DNA, 17 bp, Homo sapiens
cctagcccaccctgctg

SEQ ID NO: 5873663 - DNA, 21 bp, Homo sapiens
cctagcccagactctgagctg

SEQ ID NO: 5873664 - DNA, 11 bp, Homo sapiens
cctagcccagg

SEQ ID NO: 5873665 - DNA, 13 bp, Homo sapiens
cctagcccaggag

SEQ ID NO: 5873666 - DNA, 17 bp, Homo sapiens
cctagcccaggagagag

SEQ ID NO: 5873667 - DNA, 19 bp, Homo sapiens
cctagcccaggagagagaa

SEQ ID NO: 5873668 - DNA, 15 bp, Homo sapiens
cctagccccacccag

SEQ ID NO: 5873669 - DNA, 16 bp, Homo sapiens
cctagccccacccaga

SEQ ID NO: 5873670 - DNA, 17 bp, Homo sapiens
cctagccccacccagag

SEQ ID NO: 5873671 - DNA, 21 bp, Homo sapiens
cctagccccacccagaggtgg

SEQ ID NO: 5873672 - DNA, 23 bp, Homo sapiens
cctagccccgagacaccatcctg

SEQ ID NO: 5873673 - DNA, 14 bp, Homo sapiens
cctagcccctcact

SEQ ID NO: 5873674 - DNA, 14 bp, Homo sapiens
cctagcccctctct

SEQ ID NO: 5873675 - DNA, 22 bp, Homo sapiens
cctagccccttagcccccaccc

SEQ ID NO: 5873676 - DNA, 21 bp, Homo sapiens
cctagccctccccccagctcc

SEQ ID NO: 5873677 - DNA, 15 bp, Homo sapiens
cctagccctcctgag

SEQ ID NO: 5873678 - DNA, 20 bp, Homo sapiens
cctagccctctcacatttat

SEQ ID NO: 5873679 - DNA, 14 bp, Homo sapiens
cctagcccttccag

SEQ ID NO: 5873680 - DNA, 15 bp, Homo sapiens
cctagcccttccagc

SEQ ID NO: 5873681 - DNA, 22 bp, Homo sapiens
cctagcccttccagcctgggac

SEQ ID NO: 5873682 - DNA, 16 bp, Homo sapiens
cctagcccttccctga

SEQ ID NO: 5873683 - DNA, 20 bp, Homo sapiens
cctagcccttctaccccacc

SEQ ID NO: 5873684 - DNA, 22 bp, Homo sapiens
cctagcccttctaccccacctg

SEQ ID NO: 5873685 - DNA, 18 bp, Homo sapiens
cctagcccttgtcccttt

SEQ ID NO: 5873686 - DNA, 14 bp, Homo sapiens
cctagccgacctca

SEQ ID NO: 5873687 - DNA, 17 bp, Homo sapiens
cctagccggttcctgtc

SEQ ID NO: 5873688 - DNA, 21 bp, Homo sapiens
cctagccggttcctgtccctg

SEQ ID NO: 5873689 - DNA, 16 bp, Homo sapiens
cctagcctatgtctgg

SEQ ID NO: 5873690 - DNA, 17 bp, Homo sapiens
cctagcctatgtctggc

SEQ ID NO: 5873691 - DNA, 13 bp, Homo sapiens
cctagcctccacc

SEQ ID NO: 5873692 - DNA, 15 bp, Homo sapiens
cctagcctgctctgc

SEQ ID NO: 5873693 - DNA, 17 bp, Homo sapiens
cctagcctgctctgcca

SEQ ID NO: 5873694 - DNA, 11 bp, Homo sapiens
cctagcctgga

SEQ ID NO: 5873695 - DNA, 16 bp, Homo sapiens
cctagcctggctctgc

SEQ ID NO: 5873696 - DNA, 20 bp, Homo sapiens
cctagcctgtgcctctggga

SEQ ID NO: 5873697 - DNA, 17 bp, Homo sapiens
cctagcctgtttcttcc

SEQ ID NO: 5873698 - DNA, 19 bp, Homo sapiens
cctagccttagaagtcaca

SEQ ID NO: 5873699 - DNA, 22 bp, Homo sapiens
cctagccttagaagtcacacag

SEQ ID NO: 5873700 - DNA, 19 bp, Homo sapiens
cctagccttatcctctgat

SEQ ID NO: 5873701 - DNA, 22 bp, Homo sapiens
cctagccttatcctctgatctc

SEQ ID NO: 5873702 - DNA, 14 bp, Homo sapiens
cctagccttgcttg

SEQ ID NO: 5873703 - DNA, 15 bp, Homo sapiens
cctagccttgcttgt

SEQ ID NO: 5873704 - DNA, 17 bp, Homo sapiens
cctagcgatctctcctg

SEQ ID NO: 5873705 - DNA, 21 bp, Homo sapiens
cctagcgatctctcctggcct

SEQ ID NO: 5873706 - DNA, 19 bp, Homo sapiens
cctagcggagcccagcctg

SEQ ID NO: 5873707 - DNA, 15 bp, Homo sapiens
cctagctaattattt

SEQ ID NO: 5873708 - DNA, 21 bp, Homo sapiens
cctagctatatgcattttatg

SEQ ID NO: 5873709 - DNA, 13 bp, Homo sapiens
cctagctcacact

SEQ ID NO: 5873710 - DNA, 15 bp, Homo sapiens
cctagctcacactca

SEQ ID NO: 5873711 - DNA, 17 bp, Homo sapiens
cctagctcaccaggcct

SEQ ID NO: 5873712 - DNA, 18 bp, Homo sapiens
cctagctcaccaggcctg

SEQ ID NO: 5873713 - DNA, 20 bp, Homo sapiens
cctagctcctccccttcctc

SEQ ID NO: 5873714 - DNA, 16 bp, Homo sapiens
cctagctctcccagtg

SEQ ID NO: 5873715 - DNA, 16 bp, Homo sapiens
cctagctcttgggcct

SEQ ID NO: 5873716 - DNA, 19 bp, Homo sapiens
cctagctgaatgtttttct

SEQ ID NO: 5873717 - DNA, 13 bp, Homo sapiens
cctagctgacgcc

SEQ ID NO: 5873718 - DNA, 21 bp, Homo sapiens
cctagctgcacagggcagctg

SEQ ID NO: 5873719 - DNA, 23 bp, Homo sapiens
cctagctgcacagggcagctggg

SEQ ID NO: 5873720 - DNA, 15 bp, Homo sapiens
cctagctgctacaaa

SEQ ID NO: 5873721 - DNA, 17 bp, Homo sapiens
cctagctgctacaaaga

SEQ ID NO: 5873722 - DNA, 18 bp, Homo sapiens
cctagctgctacaaagaa

SEQ ID NO: 5873723 - DNA, 20 bp, Homo sapiens
cctagctggagaggagccct

SEQ ID NO: 5873724 - DNA, 22 bp, Homo sapiens
cctagctggagaggagccctgc

SEQ ID NO: 5873725 - DNA, 17 bp, Homo sapiens
cctagctggctctgtga

SEQ ID NO: 5873726 - DNA, 22 bp, Homo sapiens
cctagctgggcaaacccttctc

SEQ ID NO: 5873727 - DNA, 18 bp, Homo sapiens
cctagctgtcccatgggg

SEQ ID NO: 5873728 - DNA, 18 bp, Homo sapiens
cctagctgtcctttttcc

SEQ ID NO: 5873729 - DNA, 21 bp, Homo sapiens
cctagctgtgccccctctggt

SEQ ID NO: 5873730 - DNA, 23 bp, Homo sapiens
cctagcttatctccctgcttcat

SEQ ID NO: 5873731 - DNA, 21 bp, Homo sapiens
cctagcttgggaggcttcccc

SEQ ID NO: 5873732 - DNA, 22 bp, Homo sapiens
cctagctttagaccctgggtgg

SEQ ID NO: 5873733 - DNA, 21 bp, Homo sapiens
cctagctttatatatggacat

SEQ ID NO: 5873734 - DNA, 20 bp, Homo sapiens
cctagcttttaaaaaatatt

SEQ ID NO: 5873735 - DNA, 16 bp, Homo sapiens
cctaggaaactcacac

SEQ ID NO: 5873736 - DNA, 17 bp, Homo sapiens
cctaggaccactcagcc

SEQ ID NO: 5873737 - DNA, 19 bp, Homo sapiens
cctaggaccactcagcccc

SEQ ID NO: 5873738 - DNA, 20 bp, Homo sapiens
cctaggaccactcagcccct

SEQ ID NO: 5873739 - DNA, 13 bp, Homo sapiens
cctaggaccagtt

SEQ ID NO: 5873740 - DNA, 13 bp, Homo sapiens
cctaggacctatg

SEQ ID NO: 5873741 - DNA, 13 bp, Homo sapiens
cctaggactgact

SEQ ID NO: 5873742 - DNA, 21 bp, Homo sapiens
cctaggagaagcagcctccta

SEQ ID NO: 5873743 - DNA, 22 bp, Homo sapiens
cctaggagcagtgggccctggc

SEQ ID NO: 5873744 - DNA, 23 bp, Homo sapiens
cctaggagcagtgggccctggct

SEQ ID NO: 5873745 - DNA, 17 bp, Homo sapiens
cctaggagctggctggc

SEQ ID NO: 5873746 - DNA, 20 bp, Homo sapiens
cctaggagctggctggcagg

SEQ ID NO: 5873747 - DNA, 22 bp, Homo sapiens
cctaggagctggctggcaggtg

SEQ ID NO: 5873748 - DNA, 23 bp, Homo sapiens
cctaggagctggggagggagaga

SEQ ID NO: 5873749 - DNA, 15 bp, Homo sapiens
cctaggaggaccccg

SEQ ID NO: 5873750 - DNA, 15 bp, Homo sapiens
cctaggaggactggg

SEQ ID NO: 5873751 - DNA, 18 bp, Homo sapiens
cctaggaggccttctcgc

SEQ ID NO: 5873752 - DNA, 16 bp, Homo sapiens
cctaggaggctggcca

SEQ ID NO: 5873753 - DNA, 22 bp, Homo sapiens
cctaggagggaaggagctgttg

SEQ ID NO: 5873754 - DNA, 15 bp, Homo sapiens
cctaggagggtcctc

SEQ ID NO: 5873755 - DNA, 23 bp, Homo sapiens
cctaggaggttgaggctgcagtg

SEQ ID NO: 5873756 - DNA, 21 bp, Homo sapiens
cctaggagtatatttccgcac

SEQ ID NO: 5873757 - DNA, 20 bp, Homo sapiens
cctaggagttgagtacagtg

SEQ ID NO: 5873758 - DNA, 21 bp, Homo sapiens
cctaggataaaaagccagggc

SEQ ID NO: 5873759 - DNA, 20 bp, Homo sapiens
cctaggatcccgtcttccag

SEQ ID NO: 5873760 - DNA, 17 bp, Homo sapiens
cctaggatgctgcagca

SEQ ID NO: 5873761 - DNA, 22 bp, Homo sapiens
cctaggattcacaccccacctg

SEQ ID NO: 5873762 - DNA, 17 bp, Homo sapiens
cctaggattcctccccc

SEQ ID NO: 5873763 - DNA, 11 bp, Homo sapiens
cctaggattct

SEQ ID NO: 5873764 - DNA, 14 bp, Homo sapiens
cctaggatttcagc

SEQ ID NO: 5873765 - DNA, 18 bp, Homo sapiens
cctaggatttcagccatg

SEQ ID NO: 5873766 - DNA, 14 bp, Homo sapiens
cctaggcagccagc

SEQ ID NO: 5873767 - DNA, 22 bp, Homo sapiens
cctaggcaggacatgctgaagc

SEQ ID NO: 5873768 - DNA, 23 bp, Homo sapiens
cctaggcaggacatgctgaagcc

SEQ ID NO: 5873769 - DNA, 22 bp, Homo sapiens
cctaggcagtaggccggtgtgc

SEQ ID NO: 5873770 - DNA, 13 bp, Homo sapiens
cctaggcagtggg

SEQ ID NO: 5873771 - DNA, 18 bp, Homo sapiens
cctaggcagtgggaggca

SEQ ID NO: 5873772 - DNA, 23 bp, Homo sapiens
cctaggcagtgggaggcaaatgg

SEQ ID NO: 5873773 - DNA, 19 bp, Homo sapiens
cctaggcatactctccagg

SEQ ID NO: 5873774 - DNA, 20 bp, Homo sapiens
cctaggcatactctccagga

SEQ ID NO: 5873775 - DNA, 20 bp, Homo sapiens
cctaggccaaatgcacaagc

SEQ ID NO: 5873776 - DNA, 15 bp, Homo sapiens
cctaggccactcctc

SEQ ID NO: 5873777 - DNA, 12 bp, Homo sapiens
cctaggccagct

SEQ ID NO: 5873778 - DNA, 15 bp, Homo sapiens
cctaggccaggtgca

SEQ ID NO: 5873779 - DNA, 15 bp, Homo sapiens
cctaggcccctccta

SEQ ID NO: 5873780 - DNA, 23 bp, Homo sapiens
cctaggcctcaactcctcccata

SEQ ID NO: 5873781 - DNA, 12 bp, Homo sapiens
cctaggcctcag

SEQ ID NO: 5873782 - DNA, 18 bp, Homo sapiens
cctaggcctcagccagag

SEQ ID NO: 5873783 - DNA, 13 bp, Homo sapiens
cctaggcctgggc

SEQ ID NO: 5873784 - DNA, 15 bp, Homo sapiens
cctaggcctgggcag

SEQ ID NO: 5873785 - DNA, 23 bp, Homo sapiens
cctaggcgattttgtctaccatt

SEQ ID NO: 5873786 - DNA, 17 bp, Homo sapiens
cctaggcgctcagaggc

SEQ ID NO: 5873787 - DNA, 18 bp, Homo sapiens
cctaggcgctcagaggcc

SEQ ID NO: 5873788 - DNA, 20 bp, Homo sapiens
cctaggcgctcagaggccgc

SEQ ID NO: 5873789 - DNA, 21 bp, Homo sapiens
cctaggcgctcagaggccgct

SEQ ID NO: 5873790 - DNA, 17 bp, Homo sapiens
cctaggctacccttgcc

SEQ ID NO: 5873791 - DNA, 16 bp, Homo sapiens
cctaggctagggtggg

SEQ ID NO: 5873792 - DNA, 14 bp, Homo sapiens
cctaggctcatgga

SEQ ID NO: 5873793 - DNA, 17 bp, Homo sapiens
cctaggctccaccccat

SEQ ID NO: 5873794 - DNA, 14 bp, Homo sapiens
cctaggctcctggg

SEQ ID NO: 5873795 - DNA, 17 bp, Homo sapiens
cctaggctcctgggagg

SEQ ID NO: 5873796 - DNA, 17 bp, Homo sapiens
cctaggctgaccttgaa

SEQ ID NO: 5873797 - DNA, 14 bp, Homo sapiens
cctaggctgaggtt

SEQ ID NO: 5873798 - DNA, 14 bp, Homo sapiens
cctaggctggaagc

SEQ ID NO: 5873799 - DNA, 16 bp, Homo sapiens
cctaggctggaaggag

SEQ ID NO: 5873800 - DNA, 23 bp, Homo sapiens
cctagggaaaacacggccctcct

SEQ ID NO: 5873801 - DNA, 23 bp, Homo sapiens
cctagggaagggtggtggagcca

SEQ ID NO: 5873802 - DNA, 15 bp, Homo sapiens
cctagggactgtcct

SEQ ID NO: 5873803 - DNA, 23 bp, Homo sapiens
cctagggaggcatggtctgccct

SEQ ID NO: 5873804 - DNA, 13 bp, Homo sapiens
cctagggatctga

SEQ ID NO: 5873805 - DNA, 20 bp, Homo sapiens
cctagggatgttctggccct

SEQ ID NO: 5873806 - DNA, 20 bp, Homo sapiens
cctagggcccccacagttgc

SEQ ID NO: 5873807 - DNA, 11 bp, Homo sapiens
cctagggctca

SEQ ID NO: 5873808 - DNA, 15 bp, Homo sapiens
cctagggctcagagg

SEQ ID NO: 5873809 - DNA, 16 bp, Homo sapiens
cctagggctctccaag

SEQ ID NO: 5873810 - DNA, 18 bp, Homo sapiens
cctagggctctccaagca

SEQ ID NO: 5873811 - DNA, 23 bp, Homo sapiens
cctaggggaacagaccagtgacc

SEQ ID NO: 5873812 - DNA, 17 bp, Homo sapiens
cctaggggaagagcaga

SEQ ID NO: 5873813 - DNA, 13 bp, Homo sapiens
cctaggggaaggg

SEQ ID NO: 5873814 - DNA, 14 bp, Homo sapiens
cctaggggaagggg

SEQ ID NO: 5873815 - DNA, 18 bp, Homo sapiens
cctaggggacacttccct

SEQ ID NO: 5873816 - DNA, 22 bp, Homo sapiens
cctaggggtgcgctcacctgca

SEQ ID NO: 5873817 - DNA, 17 bp, Homo sapiens
cctaggggtggcgctca

SEQ ID NO: 5873818 - DNA, 13 bp, Homo sapiens
cctagggtccctc

SEQ ID NO: 5873819 - DNA, 22 bp, Homo sapiens
cctagggtctatttgtgtggca

SEQ ID NO: 5873820 - DNA, 20 bp, Homo sapiens
cctagggtcttgggggtcag

SEQ ID NO: 5873821 - DNA, 19 bp, Homo sapiens
cctagggtgagggtgacag

SEQ ID NO: 5873822 - DNA, 20 bp, Homo sapiens
cctagggtgagggtgacaga

SEQ ID NO: 5873823 - DNA, 15 bp, Homo sapiens
cctagggtggcctga

SEQ ID NO: 5873824 - DNA, 19 bp, Homo sapiens
cctagggttgcttgggcca

SEQ ID NO: 5873825 - DNA, 22 bp, Homo sapiens
cctagggttgcttgggccactg

SEQ ID NO: 5873826 - DNA, 15 bp, Homo sapiens
cctaggtccaagccc

SEQ ID NO: 5873827 - DNA, 17 bp, Homo sapiens
cctaggtcccccaagca

SEQ ID NO: 5873828 - DNA, 22 bp, Homo sapiens
cctaggtcccttcccgacccag

SEQ ID NO: 5873829 - DNA, 23 bp, Homo sapiens
cctcaactctcctccagagtcag

SEQ ID NO: 5873830 - DNA, 14 bp, Homo sapiens
cctcaactctgctg

SEQ ID NO: 5873831 - DNA, 18 bp, Homo sapiens
cctcaactctgctgaggg

SEQ ID NO: 5873832 - DNA, 19 bp, Homo sapiens
cctcaactctgctgagggt

SEQ ID NO: 5873833 - DNA, 20 bp, Homo sapiens
cctcaactctgctgagggtc

SEQ ID NO: 5873834 - DNA, 20 bp, Homo sapiens
cctcaactgagaagccaagc

SEQ ID NO: 5873835 - DNA, 22 bp, Homo sapiens
cctcaactgagggccagggacc

SEQ ID NO: 5873836 - DNA, 16 bp, Homo sapiens
cctcaagaaataaaag

SEQ ID NO: 5873837 - DNA, 16 bp, Homo sapiens
cctcaagaacaccttt

SEQ ID NO: 5873838 - DNA, 15 bp, Homo sapiens
cctcaagactttgat

SEQ ID NO: 5873839 - DNA, 21 bp, Homo sapiens
cctcaagactttgatccttgg

SEQ ID NO: 5873840 - DNA, 15 bp, Homo sapiens
cctcaagagaaggca

SEQ ID NO: 5873841 - DNA, 19 bp, Homo sapiens
cctcaagcaaggaagcaga

SEQ ID NO: 5873842 - DNA, 22 bp, Homo sapiens
cctcaagcaataattgtttcca

SEQ ID NO: 5873843 - DNA, 20 bp, Homo sapiens
cctcaagcaatccacctgcc

SEQ ID NO: 5873844 - DNA, 16 bp, Homo sapiens
cctcaagccaatcccc

SEQ ID NO: 5873845 - DNA, 22 bp, Homo sapiens
cctcaagccaggagaccctgtc

SEQ ID NO: 5873846 - DNA, 18 bp, Homo sapiens
cctcaagccatcttcccg

SEQ ID NO: 5873847 - DNA, 11 bp, Homo sapiens
cctcaagcccc

SEQ ID NO: 5873848 - DNA, 14 bp, Homo sapiens
cctcaagccccagc

SEQ ID NO: 5873849 - DNA, 12 bp, Homo sapiens
cctcaagcccct

SEQ ID NO: 5873850 - DNA, 17 bp, Homo sapiens
cctcaagccccttctct

SEQ ID NO: 5873851 - DNA, 15 bp, Homo sapiens
cctcaagcctgtggg

SEQ ID NO: 5873852 - DNA, 16 bp, Homo sapiens
cctcaaggaagagcca

SEQ ID NO: 5873853 - DNA, 21 bp, Homo sapiens
cctcaaggaagagccagccgt

SEQ ID NO: 5873854 - DNA, 13 bp, Homo sapiens
cctcaaggacttg

SEQ ID NO: 5873855 - DNA, 20 bp, Homo sapiens
cctcaaggacttgaaagcat

SEQ ID NO: 5873856 - DNA, 21 bp, Homo sapiens
cctcaaggacttgaaagcatc

SEQ ID NO: 5873857 - DNA, 22 bp, Homo sapiens
cctcaaggccctcggagctggc

SEQ ID NO: 5873858 - DNA, 12 bp, Homo sapiens
cctcaaggccta

SEQ ID NO: 5873859 - DNA, 17 bp, Homo sapiens
cctcaaggcctcccaca

SEQ ID NO: 5873860 - DNA, 19 bp, Homo sapiens
cctcaaggcctcccacagt

SEQ ID NO: 5873861 - DNA, 17 bp, Homo sapiens
cctcaagggcagagaac

SEQ ID NO: 5873862 - DNA, 12 bp, Homo sapiens
cctcaagggctt

SEQ ID NO: 5873863 - DNA, 18 bp, Homo sapiens
cctcaagggctttcccac

SEQ ID NO: 5873864 - DNA, 20 bp, Homo sapiens
cctcaaggggccatcctgtc

SEQ ID NO: 5873865 - DNA, 19 bp, Homo sapiens
cctcaagggggactgtctt

SEQ ID NO: 5873866 - DNA, 23 bp, Homo sapiens
cctcaaggtaacaagagtatgtg

SEQ ID NO: 5873867 - DNA, 19 bp, Homo sapiens
cctcaaggtgcggggagaa

SEQ ID NO: 5873868 - DNA, 22 bp, Homo sapiens
cctcaaggttttaggttctaaa

SEQ ID NO: 5873869 - DNA, 16 bp, Homo sapiens
cctcaagtagcactga

SEQ ID NO: 5873870 - DNA, 22 bp, Homo sapiens
cctcaagtgatccacctgcctt

SEQ ID NO: 5873871 - DNA, 19 bp, Homo sapiens
cctcaagtgatcctcccac

SEQ ID NO: 5873872 - DNA, 15 bp, Homo sapiens
cctcaagtgtcctga

SEQ ID NO: 5873873 - DNA, 18 bp, Homo sapiens
cctcaagttccagtgcag

SEQ ID NO: 5873874 - DNA, 20 bp, Homo sapiens
cctcaagttcttggaccagt

SEQ ID NO: 5873875 - DNA, 22 bp, Homo sapiens
cctcaagttcttggaccagttt

SEQ ID NO: 5873876 - DNA, 14 bp, Homo sapiens
cctcaataaagctc

SEQ ID NO: 5873877 - DNA, 15 bp, Homo sapiens
cctcaataagccttg

SEQ ID NO: 5873878 - DNA, 16 bp, Homo sapiens
cctcaataagccttgt

SEQ ID NO: 5873879 - DNA, 21 bp, Homo sapiens
cctcaatccaccttcaggccc

SEQ ID NO: 5873880 - DNA, 22 bp, Homo sapiens
cctcaatccaccttcaggcccc

SEQ ID NO: 5873881 - DNA, 13 bp, Homo sapiens
cctcaatccagct

SEQ ID NO: 5873882 - DNA, 14 bp, Homo sapiens
cctcaatgccctgc

SEQ ID NO: 5873883 - DNA, 19 bp, Homo sapiens
cctcaatggacttcaaatt

SEQ ID NO: 5873884 - DNA, 21 bp, Homo sapiens
cctcaatgtgaatcagaccct

SEQ ID NO: 5873885 - DNA, 14 bp, Homo sapiens
cctcaatgtgacca

SEQ ID NO: 5873886 - DNA, 17 bp, Homo sapiens
cctcaatgtgatggtat

SEQ ID NO: 5873887 - DNA, 15 bp, Homo sapiens
cctcaattcatcaat

SEQ ID NO: 5873888 - DNA, 17 bp, Homo sapiens
cctcaattcatcaatat

SEQ ID NO: 5873889 - DNA, 17 bp, Homo sapiens
cctcaattgacattcct

SEQ ID NO: 5873890 - DNA, 12 bp, Homo sapiens
cctcacaactcc

SEQ ID NO: 5873891 - DNA, 20 bp, Homo sapiens
cctcacaactccttccatcc

SEQ ID NO: 5873892 - DNA, 22 bp, Homo sapiens
cctcacaagcgctcccagcctg

SEQ ID NO: 5873893 - DNA, 21 bp, Homo sapiens
cctcacaagtgggtaccccca

SEQ ID NO: 5873894 - DNA, 22 bp, Homo sapiens
cctcacaagtgggtacccccag

SEQ ID NO: 5873895 - DNA, 15 bp, Homo sapiens
cctcacacacacagc

SEQ ID NO: 5873896 - DNA, 17 bp, Homo sapiens
cctcacacacacccccc

SEQ ID NO: 5873897 - DNA, 23 bp, Homo sapiens
cctcacacaccctgaggtcaggg

SEQ ID NO: 5873898 - DNA, 16 bp, Homo sapiens
cctcacacacctctgc

SEQ ID NO: 5873899 - DNA, 17 bp, Homo sapiens
cctcacacacctctgcc

SEQ ID NO: 5873900 - DNA, 17 bp, Homo sapiens
cctcacacacggaggcc

SEQ ID NO: 5873901 - DNA, 18 bp, Homo sapiens
cctcacacacggaggcca

SEQ ID NO: 5873902 - DNA, 19 bp, Homo sapiens
cctcacacacggaggccag

SEQ ID NO: 5873903 - DNA, 21 bp, Homo sapiens
cctcacacacggaggccagac

SEQ ID NO: 5873904 - DNA, 23 bp, Homo sapiens
cctcacacacggaggccagacac

SEQ ID NO: 5873905 - DNA, 17 bp, Homo sapiens
cctcacacccacctgct

SEQ ID NO: 5873906 - DNA, 19 bp, Homo sapiens
cctcacacccacctgctgc

SEQ ID NO: 5873907 - DNA, 22 bp, Homo sapiens
cctcacacccacctgctgctgt

SEQ ID NO: 5873908 - DNA, 14 bp, Homo sapiens
cctcacacccctgt

SEQ ID NO: 5873909 - DNA, 13 bp, Homo sapiens
cctcacactccag

SEQ ID NO: 5873910 - DNA, 17 bp, Homo sapiens
cctcacactgctgtcct

SEQ ID NO: 5873911 - DNA, 19 bp, Homo sapiens
cctcacagacctctgcttg

SEQ ID NO: 5873912 - DNA, 12 bp, Homo sapiens
cctcacagactc

SEQ ID NO: 5873913 - DNA, 16 bp, Homo sapiens
cctcacagatgctggc

SEQ ID NO: 5873914 - DNA, 17 bp, Homo sapiens
cctcacagatgctggcc

SEQ ID NO: 5873915 - DNA, 18 bp, Homo sapiens
cctcacagatgctggcct

SEQ ID NO: 5873916 - DNA, 19 bp, Homo sapiens
cctcacagcacagagaaga

SEQ ID NO: 5873917 - DNA, 12 bp, Homo sapiens
cctcacagcagt

SEQ ID NO: 5873918 - DNA, 15 bp, Homo sapiens
cctcacagcatctct

SEQ ID NO: 5873919 - DNA, 17 bp, Homo sapiens
cctcacagcctctccct

SEQ ID NO: 5873920 - DNA, 16 bp, Homo sapiens
cctcacagcctctgac

SEQ ID NO: 5873921 - DNA, 22 bp, Homo sapiens
cctcacagcctctgacccctcc

SEQ ID NO: 5873922 - DNA, 13 bp, Homo sapiens
cctcacaggagca

SEQ ID NO: 5873923 - DNA, 14 bp, Homo sapiens
cctcacaggagcag

SEQ ID NO: 5873924 - DNA, 16 bp, Homo sapiens
cctcacagtcccactg

SEQ ID NO: 5873925 - DNA, 19 bp, Homo sapiens
cctcacagtcccactgtgc

SEQ ID NO: 5873926 - DNA, 22 bp, Homo sapiens
cctcacagtccttaccagcaga

SEQ ID NO: 5873927 - DNA, 16 bp, Homo sapiens
cctcacatcctcctgc

SEQ ID NO: 5873928 - DNA, 14 bp, Homo sapiens
cctcacatctccct

SEQ ID NO: 5873929 - DNA, 16 bp, Homo sapiens
cctcacatctcccttc

SEQ ID NO: 5873930 - DNA, 14 bp, Homo sapiens
cctcacatgcccgc

SEQ ID NO: 5873931 - DNA, 17 bp, Homo sapiens
cctcacatggcgtcctg

SEQ ID NO: 5873932 - DNA, 21 bp, Homo sapiens
cctcaccaaaacgatgaagtt

SEQ ID NO: 5873933 - DNA, 12 bp, Homo sapiens
cctcaccacctg

SEQ ID NO: 5873934 - DNA, 18 bp, Homo sapiens
cctcaccagccctggcaa

SEQ ID NO: 5873935 - DNA, 20 bp, Homo sapiens
cctcaccaggggcaggcaca

SEQ ID NO: 5873936 - DNA, 23 bp, Homo sapiens
cctcaccaggggcaggcacagca

SEQ ID NO: 5873937 - DNA, 21 bp, Homo sapiens
cctcaccatccagtgggcccg

SEQ ID NO: 5873938 - DNA, 12 bp, Homo sapiens
cctcaccattcc

SEQ ID NO: 5873939 - DNA, 12 bp, Homo sapiens
cctcacccacac

SEQ ID NO: 5873940 - DNA, 21 bp, Homo sapiens
cctcacccacccctgcacagt

SEQ ID NO: 5873941 - DNA, 21 bp, Homo sapiens
cctcacccacccttttttaaa

SEQ ID NO: 5873942 - DNA, 15 bp, Homo sapiens
cctcacccacctctg

SEQ ID NO: 5873943 - DNA, 23 bp, Homo sapiens
cctcacccactctggtggccact

SEQ ID NO: 5873944 - DNA, 14 bp, Homo sapiens
cctcacccagaagg

SEQ ID NO: 5873945 - DNA, 20 bp, Homo sapiens
cctcacccagatcaggaacc

SEQ ID NO: 5873946 - DNA, 18 bp, Homo sapiens
cctcaccccaatccctgc

SEQ ID NO: 5873947 - DNA, 23 bp, Homo sapiens
cctcaccccaatccctgccactg

SEQ ID NO: 5873948 - DNA, 12 bp, Homo sapiens
cctcaccccact

SEQ ID NO: 5873949 - DNA, 16 bp, Homo sapiens
cctcaccccagctccg

SEQ ID NO: 5873950 - DNA, 15 bp, Homo sapiens
cctcaccccagtgcc

SEQ ID NO: 5873951 - DNA, 20 bp, Homo sapiens
cctcacccccacccctgtac

SEQ ID NO: 5873952 - DNA, 17 bp, Homo sapiens
cctcacccccagctttg

SEQ ID NO: 5873953 - DNA, 17 bp, Homo sapiens
cctcacccccaggtgtt

SEQ ID NO: 5873954 - DNA, 17 bp, Homo sapiens
cctcaccccctcccacc

SEQ ID NO: 5873955 - DNA, 20 bp, Homo sapiens
cctcaccccctcccaccccc

SEQ ID NO: 5873956 - DNA, 18 bp, Homo sapiens
cctcaccccctcctggca

SEQ ID NO: 5873957 - DNA, 19 bp, Homo sapiens
cctcaccccctcctggcaa

SEQ ID NO: 5873958 - DNA, 24 bp, Homo sapiens
cctcaccccctcctggcaatcaat

SEQ ID NO: 5873959 - DNA, 16 bp, Homo sapiens
cctcaccccgtctggg

SEQ ID NO: 5873960 - DNA, 17 bp, Homo sapiens
cctcaccccgtctgggg

SEQ ID NO: 5873961 - DNA, 22 bp, Homo sapiens
cctcacccctcgccacctttca

SEQ ID NO: 5873962 - DNA, 13 bp, Homo sapiens
cctcacccctgcc

SEQ ID NO: 5873963 - DNA, 14 bp, Homo sapiens
cctcacccctgccc

SEQ ID NO: 5873964 - DNA, 16 bp, Homo sapiens
cctcacccctgcccct

SEQ ID NO: 5873965 - DNA, 17 bp, Homo sapiens
cctcacccctgccctgg

SEQ ID NO: 5873966 - DNA, 15 bp, Homo sapiens
cctcacccctgtagg

SEQ ID NO: 5873967 - DNA, 16 bp, Homo sapiens
cctcacccctgtaggg

SEQ ID NO: 5873968 - DNA, 19 bp, Homo sapiens
cctcacccctgtcctcact

SEQ ID NO: 5873969 - DNA, 19 bp, Homo sapiens
cctcacccgctgcccagcc

SEQ ID NO: 5873970 - DNA, 17 bp, Homo sapiens
cctcacccggcctcttc

SEQ ID NO: 5873971 - DNA, 12 bp, Homo sapiens
cctcaccctcct

SEQ ID NO: 5873972 - DNA, 20 bp, Homo sapiens
cctcaccctctgtccccacg

SEQ ID NO: 5873973 - DNA, 14 bp, Homo sapiens
cctcaccctgcctt

SEQ ID NO: 5873974 - DNA, 15 bp, Homo sapiens
cctcaccctgcttgg

SEQ ID NO: 5873975 - DNA, 14 bp, Homo sapiens
cctcaccctggggc

SEQ ID NO: 5873976 - DNA, 15 bp, Homo sapiens
cctcaccctgtggga

SEQ ID NO: 5873977 - DNA, 19 bp, Homo sapiens
cctcacccttcccggcccc

SEQ ID NO: 5873978 - DNA, 15 bp, Homo sapiens
cctcaccctttacct

SEQ ID NO: 5873979 - DNA, 18 bp, Homo sapiens
cctcaccgagtgggggca

SEQ ID NO: 5873980 - DNA, 16 bp, Homo sapiens
cctcaccgcggctgga

SEQ ID NO: 5873981 - DNA, 13 bp, Homo sapiens
cctcaccggcatg

SEQ ID NO: 5873982 - DNA, 19 bp, Homo sapiens
cctcaccggcatgctggcc

SEQ ID NO: 5873983 - DNA, 16 bp, Homo sapiens
cctcacctaacagtta

SEQ ID NO: 5873984 - DNA, 15 bp, Homo sapiens
cctcacctcatgccc

SEQ ID NO: 5873985 - DNA, 19 bp, Homo sapiens
cctcacctcatgcccaccc

SEQ ID NO: 5873986 - DNA, 17 bp, Homo sapiens
cctcacctccaccccct

SEQ ID NO: 5873987 - DNA, 13 bp, Homo sapiens
cctcacctcctct

SEQ ID NO: 5873988 - DNA, 19 bp, Homo sapiens
cctcacctctgaggacaga

SEQ ID NO: 5873989 - DNA, 20 bp, Homo sapiens
cctcacctctggactggcta

SEQ ID NO: 5873990 - DNA, 22 bp, Homo sapiens
cctcacctgcatcctctccccc

SEQ ID NO: 5873991 - DNA, 21 bp, Homo sapiens
cctcacctgcccctctgttct

SEQ ID NO: 5873992 - DNA, 19 bp, Homo sapiens
cctcacctggcttcccagg

SEQ ID NO: 5873993 - DNA, 17 bp, Homo sapiens
cctcacctgggcctttc

SEQ ID NO: 5873994 - DNA, 23 bp, Homo sapiens
cctcacctgggcctttcctgtgc

SEQ ID NO: 5873995 - DNA, 20 bp, Homo sapiens
cctcacctgggttccccacc

SEQ ID NO: 5873996 - DNA, 14 bp, Homo sapiens
cctcacctggtcct

SEQ ID NO: 5873997 - DNA, 15 bp, Homo sapiens
cctcacctgtagcag

SEQ ID NO: 5873998 - DNA, 22 bp, Homo sapiens
cctcaccttcaactgtctgtct

SEQ ID NO: 5873999 - DNA, 15 bp, Homo sapiens
cctcaccttcctgtg

SEQ ID NO: 5874000 - DNA, 14 bp, Homo sapiens
cctcaccttccttg

SEQ ID NO: 5874001 - DNA, 17 bp, Homo sapiens
cctcaccttccttgaaa

SEQ ID NO: 5874002 - DNA, 18 bp, Homo sapiens
cctcaccttgcaacacac

SEQ ID NO: 5874003 - DNA, 21 bp, Homo sapiens
cctcaccttgcaacacacaga

SEQ ID NO: 5874004 - DNA, 13 bp, Homo sapiens
cctcaccttgggc

SEQ ID NO: 5874005 - DNA, 21 bp, Homo sapiens
cctcaccttgtaaccagtgca

SEQ ID NO: 5874006 - DNA, 21 bp, Homo sapiens
cctcacctttgcaaagttaca

SEQ ID NO: 5874007 - DNA, 16 bp, Homo sapiens
cctcacgaaactggaa

SEQ ID NO: 5874008 - DNA, 15 bp, Homo sapiens
cctcacgcccagcct

SEQ ID NO: 5874009 - DNA, 16 bp, Homo sapiens
cctcacgcccagcctc

SEQ ID NO: 5874010 - DNA, 17 bp, Homo sapiens
cctcacgcccagcctcc

SEQ ID NO: 5874011 - DNA, 22 bp, Homo sapiens
cctcacgcccttcaatgctgca

SEQ ID NO: 5874012 - DNA, 21 bp, Homo sapiens
cctcacgggaccgtcagcatg

SEQ ID NO: 5874013 - DNA, 22 bp, Homo sapiens
cctcacggggttggctgttcca

SEQ ID NO: 5874014 - DNA, 21 bp, Homo sapiens
cctcacggtgccttttttcac

SEQ ID NO: 5874015 - DNA, 21 bp, Homo sapiens
cctcacgtatttcacagagca

SEQ ID NO: 5874016 - DNA, 22 bp, Homo sapiens
cctcacgtatttcacagagcac

SEQ ID NO: 5874017 - DNA, 17 bp, Homo sapiens
cctcacgtgaccagccc

SEQ ID NO: 5874018 - DNA, 16 bp, Homo sapiens
cctcacgtgcaaagcc

SEQ ID NO: 5874019 - DNA, 22 bp, Homo sapiens
cctcacgtgcaggacagctctt

SEQ ID NO: 5874020 - DNA, 14 bp, Homo sapiens
cctcactaccactt

SEQ ID NO: 5874021 - DNA, 22 bp, Homo sapiens
cctcactactacatctgtgatg

SEQ ID NO: 5874022 - DNA, 19 bp, Homo sapiens
cctcactactcgagcccac

SEQ ID NO: 5874023 - DNA, 21 bp, Homo sapiens
cctcactaggcttctggttga

SEQ ID NO: 5874024 - DNA, 20 bp, Homo sapiens
cctcactcaagaccaggctg

SEQ ID NO: 5874025 - DNA, 18 bp, Homo sapiens
cctcactcagcaccactc

SEQ ID NO: 5874026 - DNA, 20 bp, Homo sapiens
cctcactcaggaaccctgga

SEQ ID NO: 5874027 - DNA, 15 bp, Homo sapiens
cctcactccactccc

SEQ ID NO: 5874028 - DNA, 23 bp, Homo sapiens
cctcactccactcccctcatcca

SEQ ID NO: 5874029 - DNA, 20 bp, Homo sapiens
cctcactccatttcccactt

SEQ ID NO: 5874030 - DNA, 13 bp, Homo sapiens
cctcactccccag

SEQ ID NO: 5874031 - DNA, 14 bp, Homo sapiens
cctcactccccagg

SEQ ID NO: 5874032 - DNA, 13 bp, Homo sapiens
cctcactccctct

SEQ ID NO: 5874033 - DNA, 19 bp, Homo sapiens
cctcactcccttctacctg

SEQ ID NO: 5874034 - DNA, 20 bp, Homo sapiens
cctcactcccttctacctgc

SEQ ID NO: 5874035 - DNA, 17 bp, Homo sapiens
cctcactcctccgtgag

SEQ ID NO: 5874036 - DNA, 23 bp, Homo sapiens
cctcactcgggtttctctgtggc

SEQ ID NO: 5874037 - DNA, 13 bp, Homo sapiens
cctcactctcagg

SEQ ID NO: 5874038 - DNA, 12 bp, Homo sapiens
cctcactctgcc

SEQ ID NO: 5874039 - DNA, 15 bp, Homo sapiens
cctcactctgccagg

SEQ ID NO: 5874040 - DNA, 22 bp, Homo sapiens
cctcactctgccagggcagtgc

SEQ ID NO: 5874041 - DNA, 23 bp, Homo sapiens
cctcactctgctaccttgcccca

SEQ ID NO: 5874042 - DNA, 21 bp, Homo sapiens
cctcactcttgaagtccagga

SEQ ID NO: 5874043 - DNA, 22 bp, Homo sapiens
cctcactcttgaagtccaggac

SEQ ID NO: 5874044 - DNA, 23 bp, Homo sapiens
cctcactcttgaagtccaggact

SEQ ID NO: 5874045 - DNA, 20 bp, Homo sapiens
cctcactgaaggacctgagc

SEQ ID NO: 5874046 - DNA, 14 bp, Homo sapiens
cctcactgagaagg

SEQ ID NO: 5874047 - DNA, 20 bp, Homo sapiens
cctcactgagaaggccccag

SEQ ID NO: 5874048 - DNA, 23 bp, Homo sapiens
cctcactgagaaggccccagggc

SEQ ID NO: 5874049 - DNA, 21 bp, Homo sapiens
cctcactgagaggcctggagc

SEQ ID NO: 5874050 - DNA, 13 bp, Homo sapiens
cctcactgagcct

SEQ ID NO: 5874051 - DNA, 11 bp, Homo sapiens
cctcactgcca

SEQ ID NO: 5874052 - DNA, 12 bp, Homo sapiens
cctcactgccac

SEQ ID NO: 5874053 - DNA, 12 bp, Homo sapiens
cctcactgcccc

SEQ ID NO: 5874054 - DNA, 13 bp, Homo sapiens
cctcactgcccca

SEQ ID NO: 5874055 - DNA, 18 bp, Homo sapiens
cctcactgcccgcacacc

SEQ ID NO: 5874056 - DNA, 20 bp, Homo sapiens
cctcactgcccgcacaccct

SEQ ID NO: 5874057 - DNA, 20 bp, Homo sapiens
cctcactgccctccctcggc

SEQ ID NO: 5874058 - DNA, 23 bp, Homo sapiens
cctcactgccctccctcggcccc

SEQ ID NO: 5874059 - DNA, 12 bp, Homo sapiens
cctcactgcctc

SEQ ID NO: 5874060 - DNA, 14 bp, Homo sapiens
cctcactgcctcat

SEQ ID NO: 5874061 - DNA, 16 bp, Homo sapiens
cctcactgccttccag

SEQ ID NO: 5874062 - DNA, 16 bp, Homo sapiens
cctcactgctccctga

SEQ ID NO: 5874063 - DNA, 17 bp, Homo sapiens
cctcactgctccctgaa

SEQ ID NO: 5874064 - DNA, 17 bp, Homo sapiens
cctcactgctggggagt

SEQ ID NO: 5874065 - DNA, 21 bp, Homo sapiens
cctcactggaggagcagcttc

SEQ ID NO: 5874066 - DNA, 17 bp, Homo sapiens
cctcactggccatccct

SEQ ID NO: 5874067 - DNA, 18 bp, Homo sapiens
cctcactggccatccctc

SEQ ID NO: 5874068 - DNA, 12 bp, Homo sapiens
cctcactggcct

SEQ ID NO: 5874069 - DNA, 14 bp, Homo sapiens
cctcactggcctgc

SEQ ID NO: 5874070 - DNA, 18 bp, Homo sapiens
cctcactggcctgccatg

SEQ ID NO: 5874071 - DNA, 21 bp, Homo sapiens
cctcactggcctgccatgcca

SEQ ID NO: 5874072 - DNA, 11 bp, Homo sapiens
cctcactggct

SEQ ID NO: 5874073 - DNA, 13 bp, Homo sapiens
cctcactggctca

SEQ ID NO: 5874074 - DNA, 19 bp, Homo sapiens
cctcactggctctcctggc

SEQ ID NO: 5874075 - DNA, 21 bp, Homo sapiens
cctcactgggactttgtaaac

SEQ ID NO: 5874076 - DNA, 14 bp, Homo sapiens
cctcactgggctca

SEQ ID NO: 5874077 - DNA, 16 bp, Homo sapiens
cctcactgggctcact

SEQ ID NO: 5874078 - DNA, 19 bp, Homo sapiens
cctcactggggtcctgggg

SEQ ID NO: 5874079 - DNA, 12 bp, Homo sapiens
cctcactgggtg

SEQ ID NO: 5874080 - DNA, 14 bp, Homo sapiens
cctcactgggtggg

SEQ ID NO: 5874081 - DNA, 20 bp, Homo sapiens
cctcactggtctacactggt

SEQ ID NO: 5874082 - DNA, 15 bp, Homo sapiens
cctcactgtcatctg

SEQ ID NO: 5874083 - DNA, 16 bp, Homo sapiens
cctcactgtcatctgc

SEQ ID NO: 5874084 - DNA, 20 bp, Homo sapiens
cctcactgtcatctgccagg

SEQ ID NO: 5874085 - DNA, 14 bp, Homo sapiens
cctcactgtcctgt

SEQ ID NO: 5874086 - DNA, 16 bp, Homo sapiens
cctcactgtgacctgc

SEQ ID NO: 5874087 - DNA, 17 bp, Homo sapiens
cctcactgtgacctgct

SEQ ID NO: 5874088 - DNA, 13 bp, Homo sapiens
cctcacttccttt

SEQ ID NO: 5874089 - DNA, 21 bp, Homo sapiens
cctcacttcctttgcccttcc

SEQ ID NO: 5874090 - DNA, 20 bp, Homo sapiens
cctcacttctgtctcctgtc

SEQ ID NO: 5874091 - DNA, 15 bp, Homo sapiens
cctcacttgaggagg

SEQ ID NO: 5874092 - DNA, 19 bp, Homo sapiens
cctcacttgattcatctct

SEQ ID NO: 5874093 - DNA, 22 bp, Homo sapiens
cctcacttgattcatctctggt

SEQ ID NO: 5874094 - DNA, 17 bp, Homo sapiens
cctcacttggctgtctg

SEQ ID NO: 5874095 - DNA, 20 bp, Homo sapiens
cctcacttggctgtctgacc

SEQ ID NO: 5874096 - DNA, 23 bp, Homo sapiens
cctcacttggtctgccaggcccc

SEQ ID NO: 5874097 - DNA, 23 bp, Homo sapiens
cctcactttccaccaagtgtcta

SEQ ID NO: 5874098 - DNA, 20 bp, Homo sapiens
cctcagaaaacaaggatgaa

SEQ ID NO: 5874099 - DNA, 18 bp, Homo sapiens
cctcagaaacactggggc

SEQ ID NO: 5874100 - DNA, 21 bp, Homo sapiens
cctcagaaagtcaccaggact

SEQ ID NO: 5874101 - DNA, 22 bp, Homo sapiens
cctcagaaagtcaccaggactt

SEQ ID NO: 5874102 - DNA, 15 bp, Homo sapiens
cctcagaaagtgcag

SEQ ID NO: 5874103 - DNA, 21 bp, Homo sapiens
cctcagaacccttggcttgcc

SEQ ID NO: 5874104 - DNA, 22 bp, Homo sapiens
cctcagaacccttggcttgccc

SEQ ID NO: 5874105 - DNA, 13 bp, Homo sapiens
cctcagaactctt

SEQ ID NO: 5874106 - DNA, 14 bp, Homo sapiens
cctcagaagaaaac

SEQ ID NO: 5874107 - DNA, 21 bp, Homo sapiens
cctcagaagaaaacaaagttc

SEQ ID NO: 5874108 - DNA, 16 bp, Homo sapiens
cctcagaagccttctt

SEQ ID NO: 5874109 - DNA, 17 bp, Homo sapiens
cctcagaagccttcttg

SEQ ID NO: 5874110 - DNA, 15 bp, Homo sapiens
cctcagaaggcccca

SEQ ID NO: 5874111 - DNA, 22 bp, Homo sapiens
cctcagaatagtgatgtgttcg

SEQ ID NO: 5874112 - DNA, 17 bp, Homo sapiens
cctcagaatattaagca

SEQ ID NO: 5874113 - DNA, 15 bp, Homo sapiens
cctcagacaatccac

SEQ ID NO: 5874114 - DNA, 20 bp, Homo sapiens
cctcagaccaactctctcct

SEQ ID NO: 5874115 - DNA, 22 bp, Homo sapiens
cctcagaccaactctctcctgt

SEQ ID NO: 5874116 - DNA, 18 bp, Homo sapiens
cctcagaccaggtggaat

SEQ ID NO: 5874117 - DNA, 21 bp, Homo sapiens
cctcagaccaggtggaattac

SEQ ID NO: 5874118 - DNA, 20 bp, Homo sapiens
cctcagacccaggagtccag

SEQ ID NO: 5874119 - DNA, 16 bp, Homo sapiens
cctcagacgttgcctg

SEQ ID NO: 5874120 - DNA, 17 bp, Homo sapiens
cctcagacgttgcctga

SEQ ID NO: 5874121 - DNA, 18 bp, Homo sapiens
cctcagacgttgcctgag

SEQ ID NO: 5874122 - DNA, 11 bp, Homo sapiens
cctcagactca

SEQ ID NO: 5874123 - DNA, 15 bp, Homo sapiens
cctcagactcagagg

SEQ ID NO: 5874124 - DNA, 17 bp, Homo sapiens
cctcagactcagaggtc

SEQ ID NO: 5874125 - DNA, 18 bp, Homo sapiens
cctcagactcagaggtcc

SEQ ID NO: 5874126 - DNA, 10 bp, Homo sapiens
cctcagactg

SEQ ID NO: 5874127 - DNA, 20 bp, Homo sapiens
cctcagactgcacccaggag

SEQ ID NO: 5874128 - DNA, 22 bp, Homo sapiens
cctcagacttaccaggaagcag

SEQ ID NO: 5874129 - DNA, 22 bp, Homo sapiens
cctcagagaaatcactgaacct

SEQ ID NO: 5874130 - DNA, 16 bp, Homo sapiens
cctcagagaatgatca

SEQ ID NO: 5874131 - DNA, 14 bp, Homo sapiens
cctcagagacagcg

SEQ ID NO: 5874132 - DNA, 16 bp, Homo sapiens
cctcagagacatcagc

SEQ ID NO: 5874133 - DNA, 20 bp, Homo sapiens
cctcagagacatcagccctt

SEQ ID NO: 5874134 - DNA, 19 bp, Homo sapiens
cctcagagaccagggctcc

SEQ ID NO: 5874135 - DNA, 16 bp, Homo sapiens
cctcagagagttgtct

SEQ ID NO: 5874136 - DNA, 16 bp, Homo sapiens
cctcagagatctccct

SEQ ID NO: 5874137 - DNA, 13 bp, Homo sapiens
cctcagagatgat

SEQ ID NO: 5874138 - DNA, 21 bp, Homo sapiens
cctcagagatggcttccttgt

SEQ ID NO: 5874139 - DNA, 14 bp, Homo sapiens
cctcagagcaggct

SEQ ID NO: 5874140 - DNA, 15 bp, Homo sapiens
cctcagagcaggctc

SEQ ID NO: 5874141 - DNA, 16 bp, Homo sapiens
cctcagagcagggcca

SEQ ID NO: 5874142 - DNA, 19 bp, Homo sapiens
cctcagagcaggggccaga

SEQ ID NO: 5874143 - DNA, 14 bp, Homo sapiens
cctcagagcccatg

SEQ ID NO: 5874144 - DNA, 16 bp, Homo sapiens
cctcagagcccatggt

SEQ ID NO: 5874145 - DNA, 17 bp, Homo sapiens
cctcagagccctgccct

SEQ ID NO: 5874146 - DNA, 11 bp, Homo sapiens
cctcagagctc

SEQ ID NO: 5874147 - DNA, 12 bp, Homo sapiens
cctcagagctct

SEQ ID NO: 5874148 - DNA, 14 bp, Homo sapiens
cctcagagcttcct

SEQ ID NO: 5874149 - DNA, 19 bp, Homo sapiens
cctcagagcttcctgggga

SEQ ID NO: 5874150 - DNA, 17 bp, Homo sapiens
cctcagaggagctctac

SEQ ID NO: 5874151 - DNA, 14 bp, Homo sapiens
cctcagaggcagct

SEQ ID NO: 5874152 - DNA, 17 bp, Homo sapiens
cctcagaggccttggga

SEQ ID NO: 5874153 - DNA, 15 bp, Homo sapiens
cctcagaggctgagc

SEQ ID NO: 5874154 - DNA, 16 bp, Homo sapiens
cctcagaggctgagcc

SEQ ID NO: 5874155 - DNA, 21 bp, Homo sapiens
cctcagaggctgagccctgta

SEQ ID NO: 5874156 - DNA, 22 bp, Homo sapiens
cctcagaggctgagccctgtac

SEQ ID NO: 5874157 - DNA, 19 bp, Homo sapiens
cctcagagggataaggcag

SEQ ID NO: 5874158 - DNA, 15 bp, Homo sapiens
cctcagagtatcttt

SEQ ID NO: 5874159 - DNA, 15 bp, Homo sapiens
cctcagagtccaggc

SEQ ID NO: 5874160 - DNA, 19 bp, Homo sapiens
cctcagagtccaggcccca

SEQ ID NO: 5874161 - DNA, 13 bp, Homo sapiens
cctcagagtcctg

SEQ ID NO: 5874162 - DNA, 16 bp, Homo sapiens
cctcagagtcctgccg

SEQ ID NO: 5874163 - DNA, 17 bp, Homo sapiens
cctcagagtcctgccga

SEQ ID NO: 5874164 - DNA, 21 bp, Homo sapiens
cctcagagtgcaagcccctgc

SEQ ID NO: 5874165 - DNA, 20 bp, Homo sapiens
cctcagatccaggcaggagc

SEQ ID NO: 5874166 - DNA, 15 bp, Homo sapiens
cctcagatcccaggg

SEQ ID NO: 5874167 - DNA, 16 bp, Homo sapiens
cctcagatcttctgtg

SEQ ID NO: 5874168 - DNA, 21 bp, Homo sapiens
cctcagatgaaaataaaataa

SEQ ID NO: 5874169 - DNA, 21 bp, Homo sapiens
cctcagatgatctctccacgg

SEQ ID NO: 5874170 - DNA, 23 bp, Homo sapiens
cctcagatgtcccttgatgcaca

SEQ ID NO: 5874171 - DNA, 14 bp, Homo sapiens
cctcagatgtgttg

SEQ ID NO: 5874172 - DNA, 19 bp, Homo sapiens
cctcagattcaataatgag

SEQ ID NO: 5874173 - DNA, 20 bp, Homo sapiens
cctcagattcaataatgaga

SEQ ID NO: 5874174 - DNA, 16 bp, Homo sapiens
cctcagattccttccc

SEQ ID NO: 5874175 - DNA, 17 bp, Homo sapiens
cctcagattccttccca

SEQ ID NO: 5874176 - DNA, 22 bp, Homo sapiens
cctcagattccttcccatggag

SEQ ID NO: 5874177 - DNA, 17 bp, Homo sapiens
cctcagatttccattgt

SEQ ID NO: 5874178 - DNA, 15 bp, Homo sapiens
cctcagattttatat

SEQ ID NO: 5874179 - DNA, 19 bp, Homo sapiens
cctcagcaaacccaaagat

SEQ ID NO: 5874180 - DNA, 19 bp, Homo sapiens
cctcagcaacatcccatct

SEQ ID NO: 5874181 - DNA, 14 bp, Homo sapiens
cctcagcaagctgc

SEQ ID NO: 5874182 - DNA, 21 bp, Homo sapiens
cctcagcaagctgcccagccc

SEQ ID NO: 5874183 - DNA, 17 bp, Homo sapiens
cctcatcctttccctct

SEQ ID NO: 5874184 - DNA, 14 bp, Homo sapiens
cctcatctagtctt

SEQ ID NO: 5874185 - DNA, 21 bp, Homo sapiens
cctcatctagtcttgacctct

SEQ ID NO: 5874186 - DNA, 21 bp, Homo sapiens
cctcatctataaaatgaggga

SEQ ID NO: 5874187 - DNA, 16 bp, Homo sapiens
cctcatctatgaggaa

SEQ ID NO: 5874188 - DNA, 20 bp, Homo sapiens
cctcatctatggttctaaat

SEQ ID NO: 5874189 - DNA, 13 bp, Homo sapiens
cctcatctccaag

SEQ ID NO: 5874190 - DNA, 15 bp, Homo sapiens
cctcatctccatgct

SEQ ID NO: 5874191 - DNA, 11 bp, Homo sapiens
cctcatctcct

SEQ ID NO: 5874192 - DNA, 16 bp, Homo sapiens
cctcatctctactaaa

SEQ ID NO: 5874193 - DNA, 17 bp, Homo sapiens
cctcatctctctgccca

SEQ ID NO: 5874194 - DNA, 21 bp, Homo sapiens
cctcatctgagaggctctccg

SEQ ID NO: 5874195 - DNA, 17 bp, Homo sapiens
cctcatctgcctgcagt

SEQ ID NO: 5874196 - DNA, 20 bp, Homo sapiens
cctcatctgcctgcagtgtc

SEQ ID NO: 5874197 - DNA, 13 bp, Homo sapiens
cctcatctgctca

SEQ ID NO: 5874198 - DNA, 15 bp, Homo sapiens
cctcatctgtccctc

SEQ ID NO: 5874199 - DNA, 17 bp, Homo sapiens
cctcatctgtccctccg

SEQ ID NO: 5874200 - DNA, 14 bp, Homo sapiens
cctcatctgtctgg

SEQ ID NO: 5874201 - DNA, 18 bp, Homo sapiens
cctcatctgtgcctgtct

SEQ ID NO: 5874202 - DNA, 21 bp, Homo sapiens
cctcatcttccttctcagcct

SEQ ID NO: 5874203 - DNA, 17 bp, Homo sapiens
cctcatcttcttcacca

SEQ ID NO: 5874204 - DNA, 18 bp, Homo sapiens
cctcatcttcttcaccat

SEQ ID NO: 5874205 - DNA, 16 bp, Homo sapiens
cctcatcttgaagggc

SEQ ID NO: 5874206 - DNA, 19 bp, Homo sapiens
cctcatcttggagcttttt

SEQ ID NO: 5874207 - DNA, 15 bp, Homo sapiens
cctcatgaatgtaaa

SEQ ID NO: 5874208 - DNA, 17 bp, Homo sapiens
cctcatgaatgtaaatt

SEQ ID NO: 5874209 - DNA, 23 bp, Homo sapiens
cctcatgaatgtaaatttgtact

SEQ ID NO: 5874210 - DNA, 16 bp, Homo sapiens
cctcatgacagccaga

SEQ ID NO: 5874211 - DNA, 15 bp, Homo sapiens
cctcatgaccctcct

SEQ ID NO: 5874212 - DNA, 17 bp, Homo sapiens
cctcatgaggccatgca

SEQ ID NO: 5874213 - DNA, 15 bp, Homo sapiens
cctcatgcatctcca

SEQ ID NO: 5874214 - DNA, 14 bp, Homo sapiens
cctcatgccaaccc

SEQ ID NO: 5874215 - DNA, 15 bp, Homo sapiens
cctcatgccaaccct

SEQ ID NO: 5874216 - DNA, 21 bp, Homo sapiens
cctcatgccaaccctgggcta

SEQ ID NO: 5874217 - DNA, 15 bp, Homo sapiens
cctcatgccacagtg

SEQ ID NO: 5874218 - DNA, 14 bp, Homo sapiens
cctcatgcccaccc

SEQ ID NO: 5874219 - DNA, 15 bp, Homo sapiens
cctcatgcccacccc

SEQ ID NO: 5874220 - DNA, 21 bp, Homo sapiens
cctcatgcccaccccctgccc

SEQ ID NO: 5874221 - DNA, 16 bp, Homo sapiens
cctcatgccgctgtgt

SEQ ID NO: 5874222 - DNA, 12 bp, Homo sapiens
cctcatgcctgc

SEQ ID NO: 5874223 - DNA, 15 bp, Homo sapiens
cctcatgcctgctga

SEQ ID NO: 5874224 - DNA, 16 bp, Homo sapiens
cctcatgcctgctgag

SEQ ID NO: 5874225 - DNA, 14 bp, Homo sapiens
cctcatgcctggcc

SEQ ID NO: 5874226 - DNA, 22 bp, Homo sapiens
cctcatgcctggcccccctcca

SEQ ID NO: 5874227 - DNA, 23 bp, Homo sapiens
cctcatgcctggcccccctccag

SEQ ID NO: 5874228 - DNA, 13 bp, Homo sapiens
cctcatgctgcca

SEQ ID NO: 5874229 - DNA, 23 bp, Homo sapiens
cctcatggaattggagctcgtgg

SEQ ID NO: 5874230 - DNA, 17 bp, Homo sapiens
cctcatggactccagga

SEQ ID NO: 5874231 - DNA, 23 bp, Homo sapiens
cctcatggagacctcatgccatg

SEQ ID NO: 5874232 - DNA, 18 bp, Homo sapiens
cctcatggattgccacag

SEQ ID NO: 5874233 - DNA, 19 bp, Homo sapiens
cctcatggattgccacagc

SEQ ID NO: 5874234 - DNA, 21 bp, Homo sapiens
cctcatggattgccacagctc

SEQ ID NO: 5874235 - DNA, 22 bp, Homo sapiens
cctcatggattgccacagctca

SEQ ID NO: 5874236 - DNA, 23 bp, Homo sapiens
cctcatggattgccacagctcaa

SEQ ID NO: 5874237 - DNA, 23 bp, Homo sapiens
cctcatggcatcatccattctct

SEQ ID NO: 5874238 - DNA, 21 bp, Homo sapiens
cctcatggccagcgcccctca

SEQ ID NO: 5874239 - DNA, 17 bp, Homo sapiens
cctcatggcccccaggg

SEQ ID NO: 5874240 - DNA, 21 bp, Homo sapiens
cctcatggcccccaggggcag

SEQ ID NO: 5874241 - DNA, 15 bp, Homo sapiens
cctcatggcccctct

SEQ ID NO: 5874242 - DNA, 12 bp, Homo sapiens
cctcatggctgt

SEQ ID NO: 5874243 - DNA, 22 bp, Homo sapiens
cctcatgggaagatgtctcaga

SEQ ID NO: 5874244 - DNA, 14 bp, Homo sapiens
cctcatgggaagca

SEQ ID NO: 5874245 - DNA, 15 bp, Homo sapiens
cctcatgggaagcat

SEQ ID NO: 5874246 - DNA, 23 bp, Homo sapiens
cctcatgggaagtcctggcacag

SEQ ID NO: 5874247 - DNA, 14 bp, Homo sapiens
cctcatgggagtca

SEQ ID NO: 5874248 - DNA, 22 bp, Homo sapiens
cctcatgggtcccttgaaggaa

SEQ ID NO: 5874249 - DNA, 13 bp, Homo sapiens
cctcatgggtcct

SEQ ID NO: 5874250 - DNA, 15 bp, Homo sapiens
cctcatgggtcctag

SEQ ID NO: 5874251 - DNA, 13 bp, Homo sapiens
cctcatgtaacat

SEQ ID NO: 5874252 - DNA, 14 bp, Homo sapiens
cctcatgtaacatt

SEQ ID NO: 5874253 - DNA, 20 bp, Homo sapiens
cctcatgtaacattggtgaa

SEQ ID NO: 5874254 - DNA, 21 bp, Homo sapiens
cctcatgtacataccctggcc

SEQ ID NO: 5874255 - DNA, 16 bp, Homo sapiens
cctcatgtcatttctc

SEQ ID NO: 5874256 - DNA, 20 bp, Homo sapiens
cctcatgtccactggttctt

SEQ ID NO: 5874257 - DNA, 18 bp, Homo sapiens
cctcatgtgatcacaatt

SEQ ID NO: 5874258 - DNA, 16 bp, Homo sapiens
cctcatgtggctggaa

SEQ ID NO: 5874259 - DNA, 18 bp, Homo sapiens
cctcatgtggctggaaga

SEQ ID NO: 5874260 - DNA, 19 bp, Homo sapiens
cctcatgttctcttcccag

SEQ ID NO: 5874261 - DNA, 21 bp, Homo sapiens
cctcatgttctcttcccaggc

SEQ ID NO: 5874262 - DNA, 23 bp, Homo sapiens
cctcatgttctcttcccaggcct

SEQ ID NO: 5874263 - DNA, 24 bp, Homo sapiens
cctcatgttctcttcccaggcctt

SEQ ID NO: 5874264 - DNA, 15 bp, Homo sapiens
cctcatgttgctgaa

SEQ ID NO: 5874265 - DNA, 13 bp, Homo sapiens
cctcatgtttatg

SEQ ID NO: 5874266 - DNA, 21 bp, Homo sapiens
cctcattaaatggtgatttct

SEQ ID NO: 5874267 - DNA, 20 bp, Homo sapiens
cctcattaaccgatgcttta

SEQ ID NO: 5874268 - DNA, 18 bp, Homo sapiens
cctcattaatagctgcct

SEQ ID NO: 5874269 - DNA, 20 bp, Homo sapiens
cctcattaatagctgccttc

SEQ ID NO: 5874270 - DNA, 22 bp, Homo sapiens
cctcattactttaccaccccca

SEQ ID NO: 5874271 - DNA, 18 bp, Homo sapiens
cctcattagcattttgct

SEQ ID NO: 5874272 - DNA, 23 bp, Homo sapiens
cctcattatttatgtccaggtgt

SEQ ID NO: 5874273 - DNA, 18 bp, Homo sapiens
cctcattcagaccaatct

SEQ ID NO: 5874274 - DNA, 13 bp, Homo sapiens
cctcattcaggaa

SEQ ID NO: 5874275 - DNA, 12 bp, Homo sapiens
cctcattcatct

SEQ ID NO: 5874276 - DNA, 20 bp, Homo sapiens
cctcattccaacacctgcca

SEQ ID NO: 5874277 - DNA, 14 bp, Homo sapiens
cctcattcccctcg

SEQ ID NO: 5874278 - DNA, 15 bp, Homo sapiens
cctcattccctcgtc

SEQ ID NO: 5874279 - DNA, 21 bp, Homo sapiens
cctcattccctcgtctttccc

SEQ ID NO: 5874280 - DNA, 19 bp, Homo sapiens
cctcattcgcctgtgggaa

SEQ ID NO: 5874281 - DNA, 18 bp, Homo sapiens
cctcattctagcaccttg

SEQ ID NO: 5874282 - DNA, 13 bp, Homo sapiens
cctcattctcatt

SEQ ID NO: 5874283 - DNA, 12 bp, Homo sapiens
cctcattctgaa

SEQ ID NO: 5874284 - DNA, 17 bp, Homo sapiens
cctcattctgaggcctg

SEQ ID NO: 5874285 - DNA, 18 bp, Homo sapiens
cctcattctgcattaata

SEQ ID NO: 5874286 - DNA, 21 bp, Homo sapiens
cctcattctgcattaataata

SEQ ID NO: 5874287 - DNA, 23 bp, Homo sapiens
cctcattctggttccctgctgcg

SEQ ID NO: 5874288 - DNA, 14 bp, Homo sapiens
cctcattcttctct

SEQ ID NO: 5874289 - DNA, 14 bp, Homo sapiens
cctcattgaatcct

SEQ ID NO: 5874290 - DNA, 19 bp, Homo sapiens
cctcattgacaagaactga

SEQ ID NO: 5874291 - DNA, 17 bp, Homo sapiens
cctcattgcctcctgtt

SEQ ID NO: 5874292 - DNA, 20 bp, Homo sapiens
cctcattgctaccacagact

SEQ ID NO: 5874293 - DNA, 21 bp, Homo sapiens
cctcattgctaccacagactt

SEQ ID NO: 5874294 - DNA, 21 bp, Homo sapiens
cctcattgctgtcttgcccca

SEQ ID NO: 5874295 - DNA, 20 bp, Homo sapiens
cctcattgtgccaagccttc

SEQ ID NO: 5874296 - DNA, 23 bp, Homo sapiens
cctcatttaaaacaagacttcag

SEQ ID NO: 5874297 - DNA, 13 bp, Homo sapiens
cctcatttaaaag

SEQ ID NO: 5874298 - DNA, 21 bp, Homo sapiens
cctcatttaaacccaatcaga

SEQ ID NO: 5874299 - DNA, 22 bp, Homo sapiens
cctcatttatcactctgacctt

SEQ ID NO: 5874300 - DNA, 22 bp, Homo sapiens
cctcatttcaggagcagcctca

SEQ ID NO: 5874301 - DNA, 20 bp, Homo sapiens
cctcatttcttcctctgcat

SEQ ID NO: 5874302 - DNA, 21 bp, Homo sapiens
cctcatttcttgaggcttctg

SEQ ID NO: 5874303 - DNA, 15 bp, Homo sapiens
cctcatttgttcatt

SEQ ID NO: 5874304 - DNA, 12 bp, Homo sapiens
cctcattttgaa

SEQ ID NO: 5874305 - DNA, 20 bp, Homo sapiens
cctcattttgggggtcatct

SEQ ID NO: 5874306 - DNA, 22 bp, Homo sapiens
cctcatttttataacctggcaa

SEQ ID NO: 5874307 - DNA, 13 bp, Homo sapiens
cctcatttttcat

SEQ ID NO: 5874308 - DNA, 23 bp, Homo sapiens
cctcatttttgaatacaggcata

SEQ ID NO: 5874309 - DNA, 18 bp, Homo sapiens
cctcatttttttccttgc

SEQ ID NO: 5874310 - DNA, 16 bp, Homo sapiens
cctccaaacactgggc

SEQ ID NO: 5874311 - DNA, 23 bp, Homo sapiens
cctccaaacactgggctctgagg

SEQ ID NO: 5874312 - DNA, 16 bp, Homo sapiens
cctccaaacctccagc

SEQ ID NO: 5874313 - DNA, 18 bp, Homo sapiens
cctccaaacctccagcct

SEQ ID NO: 5874314 - DNA, 20 bp, Homo sapiens
cctccaaacctccagcctcc

SEQ ID NO: 5874315 - DNA, 10 bp, Homo sapiens
cctccaaaga

SEQ ID NO: 5874316 - DNA, 11 bp, Homo sapiens
cctccaaagag

SEQ ID NO: 5874317 - DNA, 16 bp, Homo sapiens
cctccaaagccccacc

SEQ ID NO: 5874318 - DNA, 19 bp, Homo sapiens
cctccaaagcctgggcaga

SEQ ID NO: 5874319 - DNA, 19 bp, Homo sapiens
cctccaaaggaactctaga

SEQ ID NO: 5874320 - DNA, 17 bp, Homo sapiens
cctccaaaggcccccta

SEQ ID NO: 5874321 - DNA, 17 bp, Homo sapiens
cctccaaagtcttgata

SEQ ID NO: 5874322 - DNA, 18 bp, Homo sapiens
cctccaaagtggagctgg

SEQ ID NO: 5874323 - DNA, 22 bp, Homo sapiens
cctccaaatctcttgcttgtca

SEQ ID NO: 5874324 - DNA, 13 bp, Homo sapiens
cctccaaatgctg

SEQ ID NO: 5874325 - DNA, 11 bp, Homo sapiens
cctccaaatgg

SEQ ID NO: 5874326 - DNA, 19 bp, Homo sapiens
cctccaaatggagaagctg

SEQ ID NO: 5874327 - DNA, 20 bp, Homo sapiens
cctccaaatggagaagctgc

SEQ ID NO: 5874328 - DNA, 23 bp, Homo sapiens
cctccaaatggagaagctgcagg

SEQ ID NO: 5874329 - DNA, 19 bp, Homo sapiens
cctccaacaataaagagct

SEQ ID NO: 5874330 - DNA, 18 bp, Homo sapiens
cctccaaccctagcaaaa

SEQ ID NO: 5874331 - DNA, 15 bp, Homo sapiens
cctccaaccctgccg

SEQ ID NO: 5874332 - DNA, 16 bp, Homo sapiens
cctccaaccttctgcc

SEQ ID NO: 5874333 - DNA, 19 bp, Homo sapiens
cctccaaccttctgccctc

SEQ ID NO: 5874334 - DNA, 21 bp, Homo sapiens
cctccaaccttctgccctcct

SEQ ID NO: 5874335 - DNA, 19 bp, Homo sapiens
cctccaacgcccctgtggc

SEQ ID NO: 5874336 - DNA, 21 bp, Homo sapiens
cctccaacgcccctgtggcca

SEQ ID NO: 5874337 - DNA, 21 bp, Homo sapiens
cctccaactccagctgagtcc

SEQ ID NO: 5874338 - DNA, 16 bp, Homo sapiens
cctccaagaagccctc

SEQ ID NO: 5874339 - DNA, 19 bp, Homo sapiens
cctccaagaccttctcctt

SEQ ID NO: 5874340 - DNA, 14 bp, Homo sapiens
cctccaagcacaga

SEQ ID NO: 5874341 - DNA, 16 bp, Homo sapiens
cctccaagcacagagc

SEQ ID NO: 5874342 - DNA, 21 bp, Homo sapiens
cctccaagcacagagcctggc

SEQ ID NO: 5874343 - DNA, 14 bp, Homo sapiens
cctccaagcatttc

SEQ ID NO: 5874344 - DNA, 17 bp, Homo sapiens
cctccaagccattcact

SEQ ID NO: 5874345 - DNA, 11 bp, Homo sapiens
cctccaagcct

SEQ ID NO: 5874346 - DNA, 15 bp, Homo sapiens
cctccaagcctggca

SEQ ID NO: 5874347 - DNA, 16 bp, Homo sapiens
cctccaagcctggcac

SEQ ID NO: 5874348 - DNA, 21 bp, Homo sapiens
cctccaagcctggcacccacc

SEQ ID NO: 5874349 - DNA, 14 bp, Homo sapiens
cctccaaggactaa

SEQ ID NO: 5874350 - DNA, 13 bp, Homo sapiens
cctccaaggctgt

SEQ ID NO: 5874351 - DNA, 17 bp, Homo sapiens
cctccaaggctgtcttc

SEQ ID NO: 5874352 - DNA, 18 bp, Homo sapiens
cctccaaggctgtcttct

SEQ ID NO: 5874353 - DNA, 21 bp, Homo sapiens
cctccaagggtttcgactggt

SEQ ID NO: 5874354 - DNA, 17 bp, Homo sapiens
cctccaaggtcctctta

SEQ ID NO: 5874355 - DNA, 18 bp, Homo sapiens
cctccaagtccacagtgg

SEQ ID NO: 5874356 - DNA, 21 bp, Homo sapiens
cctccaagtgccccctcacct

SEQ ID NO: 5874357 - DNA, 18 bp, Homo sapiens
cctccaataaagtgcctt

SEQ ID NO: 5874358 - DNA, 22 bp, Homo sapiens
cctccaataaagtgccttctgg

SEQ ID NO: 5874359 - DNA, 19 bp, Homo sapiens
cctcccagccctatggatg

SEQ ID NO: 5874360 - DNA, 14 bp, Homo sapiens
cctcccagccctgc

SEQ ID NO: 5874361 - DNA, 17 bp, Homo sapiens
cctcccagccctgccag

SEQ ID NO: 5874362 - DNA, 17 bp, Homo sapiens
cctcccagccctgccca

SEQ ID NO: 5874363 - DNA, 17 bp, Homo sapiens
cctcccagcgctctggg

SEQ ID NO: 5874364 - DNA, 12 bp, Homo sapiens
cctcccagcgtg

SEQ ID NO: 5874365 - DNA, 20 bp, Homo sapiens
cctcccagcgtgtgtatccg

SEQ ID NO: 5874366 - DNA, 14 bp, Homo sapiens
cctcccagctctga

SEQ ID NO: 5874367 - DNA, 11 bp, Homo sapiens
cctcccagctg

SEQ ID NO: 5874368 - DNA, 19 bp, Homo sapiens
cctcccagctgacagtcct

SEQ ID NO: 5874369 - DNA, 14 bp, Homo sapiens
cctcccagctgcac

SEQ ID NO: 5874370 - DNA, 23 bp, Homo sapiens
cctcccagcttaaatcctagcag

SEQ ID NO: 5874371 - DNA, 14 bp, Homo sapiens
cctcccaggaacca

SEQ ID NO: 5874372 - DNA, 16 bp, Homo sapiens
cctcccaggaagccca

SEQ ID NO: 5874373 - DNA, 19 bp, Homo sapiens
cctcccaggaccctccact

SEQ ID NO: 5874374 - DNA, 23 bp, Homo sapiens
cctcccaggaccctccactcact

SEQ ID NO: 5874375 - DNA, 10 bp, Homo sapiens
cctcccaggc

SEQ ID NO: 5874376 - DNA, 11 bp, Homo sapiens
cctcccaggcc

SEQ ID NO: 5874377 - DNA, 12 bp, Homo sapiens
cctcccaggctg

SEQ ID NO: 5874378 - DNA, 12 bp, Homo sapiens
cctcccagggcc

SEQ ID NO: 5874379 - DNA, 14 bp, Homo sapiens
cctcccagggccag

SEQ ID NO: 5874380 - DNA, 15 bp, Homo sapiens
cctcccagggctaca

SEQ ID NO: 5874381 - DNA, 14 bp, Homo sapiens
cctcccaggggact

SEQ ID NO: 5874382 - DNA, 19 bp, Homo sapiens
cctcccaggggagccagct

SEQ ID NO: 5874383 - DNA, 22 bp, Homo sapiens
cctcccaggggagccagctgct

SEQ ID NO: 5874384 - DNA, 23 bp, Homo sapiens
cctcccaggggagccagctgctt

SEQ ID NO: 5874385 - DNA, 19 bp, Homo sapiens
cctcccaggggctccacct

SEQ ID NO: 5874386 - DNA, 21 bp, Homo sapiens
cctcccagggttttaactttg

SEQ ID NO: 5874387 - DNA, 19 bp, Homo sapiens
cctcccagtctcatctcct

SEQ ID NO: 5874388 - DNA, 21 bp, Homo sapiens
cctcccagtctcatctcctga

SEQ ID NO: 5874389 - DNA, 16 bp, Homo sapiens
cctcccagtgagactg

SEQ ID NO: 5874390 - DNA, 21 bp, Homo sapiens
cctcccatagatactctcttc

SEQ ID NO: 5874391 - DNA, 12 bp, Homo sapiens
cctcccatcacc

SEQ ID NO: 5874392 - DNA, 17 bp, Homo sapiens
cctcccatcacccgcta

SEQ ID NO: 5874393 - DNA, 13 bp, Homo sapiens
cctcccatccagc

SEQ ID NO: 5874394 - DNA, 15 bp, Homo sapiens
cctcccatccagcgt

SEQ ID NO: 5874395 - DNA, 14 bp, Homo sapiens
cctcccatcccacc

SEQ ID NO: 5874396 - DNA, 13 bp, Homo sapiens
cctcccatcccct

SEQ ID NO: 5874397 - DNA, 18 bp, Homo sapiens
cctcccatccttccctca

SEQ ID NO: 5874398 - DNA, 19 bp, Homo sapiens
cctcccatccttccctcat

SEQ ID NO: 5874399 - DNA, 15 bp, Homo sapiens
cctcccatctccttc

SEQ ID NO: 5874400 - DNA, 17 bp, Homo sapiens
cctcccatctccttccc

SEQ ID NO: 5874401 - DNA, 13 bp, Homo sapiens
cctcccatctggg

SEQ ID NO: 5874402 - DNA, 23 bp, Homo sapiens
cctcccatcttggcctcccagag

SEQ ID NO: 5874403 - DNA, 22 bp, Homo sapiens
cctcccatgagactgccctgcc

SEQ ID NO: 5874404 - DNA, 17 bp, Homo sapiens
cctcccatggcccagca

SEQ ID NO: 5874405 - DNA, 18 bp, Homo sapiens
cctcccatgtcactgcag

SEQ ID NO: 5874406 - DNA, 14 bp, Homo sapiens
cctcccattctgca

SEQ ID NO: 5874407 - DNA, 23 bp, Homo sapiens
cctcccattgcccagtgagccct

SEQ ID NO: 5874408 - DNA, 17 bp, Homo sapiens
cctcccatttctaaagc

SEQ ID NO: 5874409 - DNA, 19 bp, Homo sapiens
cctccccaaacccatcaga

SEQ ID NO: 5874410 - DNA, 23 bp, Homo sapiens
cctccccaaagccactggaagga

SEQ ID NO: 5874411 - DNA, 18 bp, Homo sapiens
cctccccaaatggctgct

SEQ ID NO: 5874412 - DNA, 21 bp, Homo sapiens
cctccccaaccctgcccctgc

SEQ ID NO: 5874413 - DNA, 13 bp, Homo sapiens
cctccccaagact

SEQ ID NO: 5874414 - DNA, 15 bp, Homo sapiens
cctccccaaggaaga

SEQ ID NO: 5874415 - DNA, 20 bp, Homo sapiens
cctccccacacacaggcctt

SEQ ID NO: 5874416 - DNA, 21 bp, Homo sapiens
cctccccacacacaggccttc

SEQ ID NO: 5874417 - DNA, 18 bp, Homo sapiens
cctccccacacctcccta

SEQ ID NO: 5874418 - DNA, 18 bp, Homo sapiens
cctccccacactccactc

SEQ ID NO: 5874419 - DNA, 19 bp, Homo sapiens
cctccccacagtgccaccc

SEQ ID NO: 5874420 - DNA, 18 bp, Homo sapiens
cctccccaccagagctgc

SEQ ID NO: 5874421 - DNA, 20 bp, Homo sapiens
cctccccaccagagctgcct

SEQ ID NO: 5874422 - DNA, 22 bp, Homo sapiens
cctccccaccagtctcacccac

SEQ ID NO: 5874423 - DNA, 20 bp, Homo sapiens
cctccccacccaagagagga

SEQ ID NO: 5874424 - DNA, 13 bp, Homo sapiens
cctccccacccct

SEQ ID NO: 5874425 - DNA, 15 bp, Homo sapiens
cctccccacccgctc

SEQ ID NO: 5874426 - DNA, 13 bp, Homo sapiens
cctccccaccctg

SEQ ID NO: 5874427 - DNA, 18 bp, Homo sapiens
cctccccaccctgtccca

SEQ ID NO: 5874428 - DNA, 16 bp, Homo sapiens
cctccccaccttcccc

SEQ ID NO: 5874429 - DNA, 18 bp, Homo sapiens
cctccccaccttccccag

SEQ ID NO: 5874430 - DNA, 19 bp, Homo sapiens
cctccccaccttccccaga

SEQ ID NO: 5874431 - DNA, 23 bp, Homo sapiens
cctccccaccttccccagactca

SEQ ID NO: 5874432 - DNA, 13 bp, Homo sapiens
cctccccacgccc

SEQ ID NO: 5874433 - DNA, 15 bp, Homo sapiens
cctccccactccagc

SEQ ID NO: 5874434 - DNA, 18 bp, Homo sapiens
cctccccactccagcaga

SEQ ID NO: 5874435 - DNA, 12 bp, Homo sapiens
cctccccagaat

SEQ ID NO: 5874436 - DNA, 15 bp, Homo sapiens
cctccccagacaggg

SEQ ID NO: 5874437 - DNA, 18 bp, Homo sapiens
cctccccagacagggctc

SEQ ID NO: 5874438 - DNA, 13 bp, Homo sapiens
cctccccagagct

SEQ ID NO: 5874439 - DNA, 15 bp, Homo sapiens
cctccccagagctgg

SEQ ID NO: 5874440 - DNA, 16 bp, Homo sapiens
cctccccagagctggc

SEQ ID NO: 5874441 - DNA, 18 bp, Homo sapiens
cctccccagatctgtcct

SEQ ID NO: 5874442 - DNA, 20 bp, Homo sapiens
cctccccagcaggtggggag

SEQ ID NO: 5874443 - DNA, 12 bp, Homo sapiens
cctccccagcca

SEQ ID NO: 5874444 - DNA, 14 bp, Homo sapiens
cctccccagccagc

SEQ ID NO: 5874445 - DNA, 12 bp, Homo sapiens
cctccccagccc

SEQ ID NO: 5874446 - DNA, 13 bp, Homo sapiens
cctccccagccca

SEQ ID NO: 5874447 - DNA, 14 bp, Homo sapiens
cctccccagcccct

SEQ ID NO: 5874448 - DNA, 17 bp, Homo sapiens
cctccccagcccctagc

SEQ ID NO: 5874449 - DNA, 14 bp, Homo sapiens
cctccccagcctgc

SEQ ID NO: 5874450 - DNA, 15 bp, Homo sapiens
cctccccagcctgcg

SEQ ID NO: 5874451 - DNA, 16 bp, Homo sapiens
cctccccagcctgcgc

SEQ ID NO: 5874452 - DNA, 19 bp, Homo sapiens
cctccccagctcccttggg

SEQ ID NO: 5874453 - DNA, 15 bp, Homo sapiens
cctccccagctcctc

SEQ ID NO: 5874454 - DNA, 15 bp, Homo sapiens
cctccccagctcttc

SEQ ID NO: 5874455 - DNA, 14 bp, Homo sapiens
cctccccaggggag

SEQ ID NO: 5874456 - DNA, 14 bp, Homo sapiens
cctccccagtagct

SEQ ID NO: 5874457 - DNA, 14 bp, Homo sapiens
cctccccatacaca

SEQ ID NO: 5874458 - DNA, 19 bp, Homo sapiens
cctccccatacttcctggg

SEQ ID NO: 5874459 - DNA, 20 bp, Homo sapiens
cctccccattagagtcagcc

SEQ ID NO: 5874460 - DNA, 21 bp, Homo sapiens
cctccccatttcccatctgca

SEQ ID NO: 5874461 - DNA, 22 bp, Homo sapiens
cctccccatttcccatctgcac

SEQ ID NO: 5874462 - DNA, 17 bp, Homo sapiens
cctcccccaaaccctgc

SEQ ID NO: 5874463 - DNA, 12 bp, Homo sapiens
cctcccccaaga

SEQ ID NO: 5874464 - DNA, 12 bp, Homo sapiens
cctcccccacca

SEQ ID NO: 5874465 - DNA, 12 bp, Homo sapiens
cctcccccacgc

SEQ ID NO: 5874466 - DNA, 19 bp, Homo sapiens
cctcccccacgtctctctg

SEQ ID NO: 5874467 - DNA, 16 bp, Homo sapiens
cctcccccactcctct

SEQ ID NO: 5874468 - DNA, 13 bp, Homo sapiens
cctcccccacttt

SEQ ID NO: 5874469 - DNA, 13 bp, Homo sapiens
cctcccccagcag

SEQ ID NO: 5874470 - DNA, 18 bp, Homo sapiens
cctcccccagccactccc

SEQ ID NO: 5874471 - DNA, 21 bp, Homo sapiens
cctcccccagccatgccagct

SEQ ID NO: 5874472 - DNA, 16 bp, Homo sapiens
cctcccccagcgtcag

SEQ ID NO: 5874473 - DNA, 13 bp, Homo sapiens
cctcccccagctc

SEQ ID NO: 5874474 - DNA, 14 bp, Homo sapiens
cctcccccagctgc

SEQ ID NO: 5874475 - DNA, 23 bp, Homo sapiens
cctcccccaggctgcgcctgccc

SEQ ID NO: 5874476 - DNA, 19 bp, Homo sapiens
cctcccccatctcccaccc

SEQ ID NO: 5874477 - DNA, 14 bp, Homo sapiens
cctccccccactgc

SEQ ID NO: 5874478 - DNA, 16 bp, Homo sapiens
cctccccccactgcag

SEQ ID NO: 5874479 - DNA, 16 bp, Homo sapiens
cctccccccagctccc

SEQ ID NO: 5874480 - DNA, 17 bp, Homo sapiens
cctcccccccatgcact

SEQ ID NO: 5874481 - DNA, 19 bp, Homo sapiens
cctcccccccatgcactgt

SEQ ID NO: 5874482 - DNA, 16 bp, Homo sapiens
cctcccccgccacctg

SEQ ID NO: 5874483 - DNA, 16 bp, Homo sapiens
cctccccctacccata

SEQ ID NO: 5874484 - DNA, 19 bp, Homo sapiens
cctccccctacccatatcc

SEQ ID NO: 5874485 - DNA, 21 bp, Homo sapiens
cctccccctagcaaggtccag

SEQ ID NO: 5874486 - DNA, 14 bp, Homo sapiens
cctccccctcaacc

SEQ ID NO: 5874487 - DNA, 17 bp, Homo sapiens
cctccccctcccccttc

SEQ ID NO: 5874488 - DNA, 12 bp, Homo sapiens
cctccccctcct

SEQ ID NO: 5874489 - DNA, 15 bp, Homo sapiens
cctccccctcctgct

SEQ ID NO: 5874490 - DNA, 16 bp, Homo sapiens
cctccccctcctgctg

SEQ ID NO: 5874491 - DNA, 17 bp, Homo sapiens
cctccccctcctgctgt

SEQ ID NO: 5874492 - DNA, 16 bp, Homo sapiens
cctccccctccttccc

SEQ ID NO: 5874493 - DNA, 17 bp, Homo sapiens
cctccccctcttggtcc

SEQ ID NO: 5874494 - DNA, 12 bp, Homo sapiens
cctccccctgca

SEQ ID NO: 5874495 - DNA, 13 bp, Homo sapiens
cctccccctgcaa

SEQ ID NO: 5874496 - DNA, 12 bp, Homo sapiens
cctccccctgcc

SEQ ID NO: 5874497 - DNA, 16 bp, Homo sapiens
cctccccctgccagag

SEQ ID NO: 5874498 - DNA, 22 bp, Homo sapiens
cctccccctgccagaggcctgg

SEQ ID NO: 5874499 - DNA, 19 bp, Homo sapiens
cctccccctgccagtgcct

SEQ ID NO: 5874500 - DNA, 15 bp, Homo sapiens
cctccccctgttctg

SEQ ID NO: 5874501 - DNA, 12 bp, Homo sapiens
cctcccccttct

SEQ ID NO: 5874502 - DNA, 18 bp, Homo sapiens
cctccccctttggggtag

SEQ ID NO: 5874503 - DNA, 12 bp, Homo sapiens
cctccccgcccc

SEQ ID NO: 5874504 - DNA, 18 bp, Homo sapiens
cctccccgccccctgaaa

SEQ ID NO: 5874505 - DNA, 23 bp, Homo sapiens
cctccccgcccctgtggccctgg

SEQ ID NO: 5874506 - DNA, 12 bp, Homo sapiens
cctccccgcctc

SEQ ID NO: 5874507 - DNA, 14 bp, Homo sapiens
cctccccgcctcct

SEQ ID NO: 5874508 - DNA, 13 bp, Homo sapiens
cctccccgcctgg

SEQ ID NO: 5874509 - DNA, 17 bp, Homo sapiens
cctccccgcctggccag

SEQ ID NO: 5874510 - DNA, 22 bp, Homo sapiens
cctccccgcctggccagggcag

SEQ ID NO: 5874511 - DNA, 19 bp, Homo sapiens
cctccccgcgccccagtca

SEQ ID NO: 5874512 - DNA, 21 bp, Homo sapiens
cctccccgcgcgttccttcgc

SEQ ID NO: 5874513 - DNA, 17 bp, Homo sapiens
cctccccgctctccctg

SEQ ID NO: 5874514 - DNA, 15 bp, Homo sapiens
cctccccgctgggaa

SEQ ID NO: 5874515 - DNA, 13 bp, Homo sapiens
cctccccggccac

SEQ ID NO: 5874516 - DNA, 16 bp, Homo sapiens
cctccccgggcagcag

SEQ ID NO: 5874517 - DNA, 22 bp, Homo sapiens
cctccccgtccctgtcccccag

SEQ ID NO: 5874518 - DNA, 17 bp, Homo sapiens
cctccccgtctcattcc

SEQ ID NO: 5874519 - DNA, 22 bp, Homo sapiens
cctccccgtttcagtggaccct

SEQ ID NO: 5874520 - DNA, 13 bp, Homo sapiens
cctcccctatcca

SEQ ID NO: 5874521 - DNA, 15 bp, Homo sapiens
cctcccctatccacc

SEQ ID NO: 5874522 - DNA, 17 bp, Homo sapiens
cctcccctatccaccca

SEQ ID NO: 5874523 - DNA, 13 bp, Homo sapiens
cctcccctcaagg

SEQ ID NO: 5874524 - DNA, 13 bp, Homo sapiens
cctcccctcacag

SEQ ID NO: 5874525 - DNA, 19 bp, Homo sapiens
cctcccctcacagcctctg

SEQ ID NO: 5874526 - DNA, 15 bp, Homo sapiens
cctcccctcagagcc

SEQ ID NO: 5874527 - DNA, 17 bp, Homo sapiens
cctcccctcagcctgcc

SEQ ID NO: 5874528 - DNA, 13 bp, Homo sapiens
cctcccctcagcg

SEQ ID NO: 5874529 - DNA, 16 bp, Homo sapiens
cctcccctccatccct

SEQ ID NO: 5874530 - DNA, 20 bp, Homo sapiens
cctcccctccatccctggcc

SEQ ID NO: 5874531 - DNA, 16 bp, Homo sapiens
cctcccctcccagtcc

SEQ ID NO: 5874532 - DNA, 15 bp, Homo sapiens
cctcccctccccagc

SEQ ID NO: 5874533 - DNA, 14 bp, Homo sapiens
cctcccctcccccc

SEQ ID NO: 5874534 - DNA, 14 bp, Homo sapiens
cctcccctcccctg

SEQ ID NO: 5874535 - DNA, 15 bp, Homo sapiens
cctcccctcccctgc

SEQ ID NO: 5874536 - DNA, 16 bp, Homo sapiens
cctcccctcccctgct

SEQ ID NO: 5874537 - DNA, 15 bp, Homo sapiens
cctcccctcccgtct

SEQ ID NO: 5874538 - DNA, 12 bp, Homo sapiens
cctcccctcctc

SEQ ID NO: 5874539 - DNA, 15 bp, Homo sapiens
cctcccctcctcctg

SEQ ID NO: 5874540 - DNA, 13 bp, Homo sapiens
cctcccctcctct

SEQ ID NO: 5874541 - DNA, 21 bp, Homo sapiens
cctccctgcttgcacacttcc

SEQ ID NO: 5874542 - DNA, 12 bp, Homo sapiens
cctccctggagt

SEQ ID NO: 5874543 - DNA, 12 bp, Homo sapiens
cctccctggcct

SEQ ID NO: 5874544 - DNA, 14 bp, Homo sapiens
cctccctggcctgt

SEQ ID NO: 5874545 - DNA, 18 bp, Homo sapiens
cctccctggctcaagcga

SEQ ID NO: 5874546 - DNA, 13 bp, Homo sapiens
cctccctggctcc

SEQ ID NO: 5874547 - DNA, 14 bp, Homo sapiens
cctccctggctccc

SEQ ID NO: 5874548 - DNA, 15 bp, Homo sapiens
cctccctggctccca

SEQ ID NO: 5874549 - DNA, 18 bp, Homo sapiens
cctccctggctcctccgt

SEQ ID NO: 5874550 - DNA, 20 bp, Homo sapiens
cctccctggctgccctggcc

SEQ ID NO: 5874551 - DNA, 21 bp, Homo sapiens
cctccctggctgccctggccc

SEQ ID NO: 5874552 - DNA, 12 bp, Homo sapiens
cctccctggctt

SEQ ID NO: 5874553 - DNA, 17 bp, Homo sapiens
cctccctggcttgcctt

SEQ ID NO: 5874554 - DNA, 15 bp, Homo sapiens
cctccctgggccacc

SEQ ID NO: 5874555 - DNA, 18 bp, Homo sapiens
cctccctgggccacctcc

SEQ ID NO: 5874556 - DNA, 13 bp, Homo sapiens
cctccctgggcta

SEQ ID NO: 5874557 - DNA, 18 bp, Homo sapiens
cctccctgggctaagcag

SEQ ID NO: 5874558 - DNA, 21 bp, Homo sapiens
cctccctggggaccaggagct

SEQ ID NO: 5874559 - DNA, 24 bp, Homo sapiens
cctccctggggaccaggagctagc

SEQ ID NO: 5874560 - DNA, 13 bp, Homo sapiens
cctccctgggggc

SEQ ID NO: 5874561 - DNA, 15 bp, Homo sapiens
cctccctgggttcag

SEQ ID NO: 5874562 - DNA, 21 bp, Homo sapiens
cctccctggtttgcagctgtt

SEQ ID NO: 5874563 - DNA, 11 bp, Homo sapiens
cctccctgtcc

SEQ ID NO: 5874564 - DNA, 15 bp, Homo sapiens
cctccctgtcccagg

SEQ ID NO: 5874565 - DNA, 16 bp, Homo sapiens
cctccctgtctccagc

SEQ ID NO: 5874566 - DNA, 17 bp, Homo sapiens
cctccctgtctccagct

SEQ ID NO: 5874567 - DNA, 21 bp, Homo sapiens
cctccctgtctccagctgcct

SEQ ID NO: 5874568 - DNA, 23 bp, Homo sapiens
cctccctgtctccagctgcctgg

SEQ ID NO: 5874569 - DNA, 20 bp, Homo sapiens
cctccctgtctctgcatctg

SEQ ID NO: 5874570 - DNA, 15 bp, Homo sapiens
cctccctgtgccccc

SEQ ID NO: 5874571 - DNA, 22 bp, Homo sapiens
cctccctgtgcccccagcctca

SEQ ID NO: 5874572 - DNA, 20 bp, Homo sapiens
cctccctgttccccacaggt

SEQ ID NO: 5874573 - DNA, 18 bp, Homo sapiens
cctccctgttccccagag

SEQ ID NO: 5874574 - DNA, 15 bp, Homo sapiens
cctcccttcacaggg

SEQ ID NO: 5874575 - DNA, 21 bp, Homo sapiens
cctcccttccgaccctctggg

SEQ ID NO: 5874576 - DNA, 22 bp, Homo sapiens
cctcccttccgaccctctggga

SEQ ID NO: 5874577 - DNA, 11 bp, Homo sapiens
cctcccttcct

SEQ ID NO: 5874578 - DNA, 21 bp, Homo sapiens
cctcccttccttttccctgct

SEQ ID NO: 5874579 - DNA, 22 bp, Homo sapiens
cctcccttccttttccctgctt

SEQ ID NO: 5874580 - DNA, 10 bp, Homo sapiens
cctcccttct

SEQ ID NO: 5874581 - DNA, 21 bp, Homo sapiens
cctcccttctactgcttctac

SEQ ID NO: 5874582 - DNA, 15 bp, Homo sapiens
cctcccttctccctg

SEQ ID NO: 5874583 - DNA, 16 bp, Homo sapiens
cctcccttctccctgg

SEQ ID NO: 5874584 - DNA, 13 bp, Homo sapiens
cctcccttctgct

SEQ ID NO: 5874585 - DNA, 17 bp, Homo sapiens
cctcccttctgctactg

SEQ ID NO: 5874586 - DNA, 18 bp, Homo sapiens
cctcccttctttccttcc

SEQ ID NO: 5874587 - DNA, 18 bp, Homo sapiens
cctcccttgagaattccc

SEQ ID NO: 5874588 - DNA, 23 bp, Homo sapiens
cctcccttgagaattccctgtgg

SEQ ID NO: 5874589 - DNA, 19 bp, Homo sapiens
cctcccttgccccaggcca

SEQ ID NO: 5874590 - DNA, 12 bp, Homo sapiens
cctcccttgctc

SEQ ID NO: 5874591 - DNA, 21 bp, Homo sapiens
cctcccttgctcagtgcctcc

SEQ ID NO: 5874592 - DNA, 13 bp, Homo sapiens
cctcccttgctga

SEQ ID NO: 5874593 - DNA, 20 bp, Homo sapiens
cctcccttgctgaacacaca

SEQ ID NO: 5874594 - DNA, 18 bp, Homo sapiens
cctccctttcctccgcct

SEQ ID NO: 5874595 - DNA, 12 bp, Homo sapiens
cctccctttctc

SEQ ID NO: 5874596 - DNA, 15 bp, Homo sapiens
cctccctttgccagc

SEQ ID NO: 5874597 - DNA, 15 bp, Homo sapiens
cctccctttggggag

SEQ ID NO: 5874598 - DNA, 21 bp, Homo sapiens
cctccctttttaaacaaatgg

SEQ ID NO: 5874599 - DNA, 16 bp, Homo sapiens
cctccctttttccttg

SEQ ID NO: 5874600 - DNA, 16 bp, Homo sapiens
cctccgaccctcatgg

SEQ ID NO: 5874601 - DNA, 15 bp, Homo sapiens
cctccgacctctctc

SEQ ID NO: 5874602 - DNA, 16 bp, Homo sapiens
cctccgactccagata

SEQ ID NO: 5874603 - DNA, 17 bp, Homo sapiens
cctccgagaggcagcca

SEQ ID NO: 5874604 - DNA, 14 bp, Homo sapiens
cctccgagagggag

SEQ ID NO: 5874605 - DNA, 16 bp, Homo sapiens
cctccgagagggagag

SEQ ID NO: 5874606 - DNA, 19 bp, Homo sapiens
cctccgagagggagagaga

SEQ ID NO: 5874607 - DNA, 21 bp, Homo sapiens
cctccgagccggggagtttct

SEQ ID NO: 5874608 - DNA, 16 bp, Homo sapiens
cctccgagggacgcgg

SEQ ID NO: 5874609 - DNA, 22 bp, Homo sapiens
cctccgagtgagtcagtgatga

SEQ ID NO: 5874610 - DNA, 15 bp, Homo sapiens
cctccgatccttcct

SEQ ID NO: 5874611 - DNA, 14 bp, Homo sapiens
cctccgatgctgag

SEQ ID NO: 5874612 - DNA, 18 bp, Homo sapiens
cctccgatgctgaggcca

SEQ ID NO: 5874613 - DNA, 20 bp, Homo sapiens
cctccgatgctgaggccacc

SEQ ID NO: 5874614 - DNA, 22 bp, Homo sapiens
cctccgatgctgaggccaccca

SEQ ID NO: 5874615 - DNA, 18 bp, Homo sapiens
cctccgcagtgtctccac

SEQ ID NO: 5874616 - DNA, 17 bp, Homo sapiens
cctccgccagccctgtt

SEQ ID NO: 5874617 - DNA, 14 bp, Homo sapiens
cctccgccatgggg

SEQ ID NO: 5874618 - DNA, 21 bp, Homo sapiens
cctccgccatggggtcggctc

SEQ ID NO: 5874619 - DNA, 14 bp, Homo sapiens
cctccgcccaaatc

SEQ ID NO: 5874620 - DNA, 12 bp, Homo sapiens
cctccgccccag

SEQ ID NO: 5874621 - DNA, 13 bp, Homo sapiens
cctccgccccaga

SEQ ID NO: 5874622 - DNA, 17 bp, Homo sapiens
cctccgccccagacaca

SEQ ID NO: 5874623 - DNA, 13 bp, Homo sapiens
cctccgccgtgcc

SEQ ID NO: 5874624 - DNA, 16 bp, Homo sapiens
cctccgccgtgccggc

SEQ ID NO: 5874625 - DNA, 14 bp, Homo sapiens
cctccgcctccagg

SEQ ID NO: 5874626 - DNA, 16 bp, Homo sapiens
cctccgcctcccatcc

SEQ ID NO: 5874627 - DNA, 13 bp, Homo sapiens
cctccgcctcccg

SEQ ID NO: 5874628 - DNA, 14 bp, Homo sapiens
cctccgcctcctgg

SEQ ID NO: 5874629 - DNA, 14 bp, Homo sapiens
cctccgcctcttgg

SEQ ID NO: 5874630 - DNA, 16 bp, Homo sapiens
cctccgcctgggtcat

SEQ ID NO: 5874631 - DNA, 17 bp, Homo sapiens
cctccgccttcccagca

SEQ ID NO: 5874632 - DNA, 20 bp, Homo sapiens
cctccgcgagggctactcag

SEQ ID NO: 5874633 - DNA, 15 bp, Homo sapiens
cctccgcgctgtgta

SEQ ID NO: 5874634 - DNA, 16 bp, Homo sapiens
cctccgcggaggcccc

SEQ ID NO: 5874635 - DNA, 18 bp, Homo sapiens
cctccgcggaggcccctg

SEQ ID NO: 5874636 - DNA, 21 bp, Homo sapiens
cctccgcgggggacaggaaca

SEQ ID NO: 5874637 - DNA, 17 bp, Homo sapiens
cctccgctcccctttcc

SEQ ID NO: 5874638 - DNA, 13 bp, Homo sapiens
cctccgctggctt

SEQ ID NO: 5874639 - DNA, 13 bp, Homo sapiens
cctccgctgggct

SEQ ID NO: 5874640 - DNA, 14 bp, Homo sapiens
cctccgctgggctt

SEQ ID NO: 5874641 - DNA, 23 bp, Homo sapiens
cctccgcttatcctgctagcagg

SEQ ID NO: 5874642 - DNA, 20 bp, Homo sapiens
cctccggagagagagagagg

SEQ ID NO: 5874643 - DNA, 14 bp, Homo sapiens
cctccggagcctca

SEQ ID NO: 5874644 - DNA, 22 bp, Homo sapiens
cctccggagcgccctgcagggc

SEQ ID NO: 5874645 - DNA, 13 bp, Homo sapiens
cctccggaggagc

SEQ ID NO: 5874646 - DNA, 15 bp, Homo sapiens
cctccggaggagcag

SEQ ID NO: 5874647 - DNA, 16 bp, Homo sapiens
cctccggaggagcagc

SEQ ID NO: 5874648 - DNA, 17 bp, Homo sapiens
cctccggccctgcccca

SEQ ID NO: 5874649 - DNA, 19 bp, Homo sapiens
cctccggccctgccccaca

SEQ ID NO: 5874650 - DNA, 18 bp, Homo sapiens
cctccggcgtcttgccca

SEQ ID NO: 5874651 - DNA, 23 bp, Homo sapiens
cctccggcgtcttgcccagcagc

SEQ ID NO: 5874652 - DNA, 18 bp, Homo sapiens
cctccgggacctggtgct

SEQ ID NO: 5874653 - DNA, 17 bp, Homo sapiens
cctccgggcagagacca

SEQ ID NO: 5874654 - DNA, 19 bp, Homo sapiens
cctccgggcagagaccacc

SEQ ID NO: 5874655 - DNA, 22 bp, Homo sapiens
cctccgggcagagaccaccgcg

SEQ ID NO: 5874656 - DNA, 15 bp, Homo sapiens
cctccgggcagggga

SEQ ID NO: 5874657 - DNA, 20 bp, Homo sapiens
cctccggggttcagcctcct

SEQ ID NO: 5874658 - DNA, 16 bp, Homo sapiens
cctccgggtcttccta

SEQ ID NO: 5874659 - DNA, 14 bp, Homo sapiens
cctccgtagggtct

SEQ ID NO: 5874660 - DNA, 21 bp, Homo sapiens
cctccgtagggtctttcttgg

SEQ ID NO: 5874661 - DNA, 16 bp, Homo sapiens
cctccgtcactacctg

SEQ ID NO: 5874662 - DNA, 14 bp, Homo sapiens
cctccgtcatccat

SEQ ID NO: 5874663 - DNA, 22 bp, Homo sapiens
cctccgtcatccatgccctccc

SEQ ID NO: 5874664 - DNA, 19 bp, Homo sapiens
cctccgtccacccaggctg

SEQ ID NO: 5874665 - DNA, 18 bp, Homo sapiens
cctccgtccaggagcctg

SEQ ID NO: 5874666 - DNA, 15 bp, Homo sapiens
cctccgtccccaggg

SEQ ID NO: 5874667 - DNA, 15 bp, Homo sapiens
cctccgtcccctgcc

SEQ ID NO: 5874668 - DNA, 20 bp, Homo sapiens
cctccgtcctctccccagcc

SEQ ID NO: 5874669 - DNA, 16 bp, Homo sapiens
cctccgtcgggcccct

SEQ ID NO: 5874670 - DNA, 20 bp, Homo sapiens
cctccgtcgggcccctgcct

SEQ ID NO: 5874671 - DNA, 21 bp, Homo sapiens
cctccgtcgggcccctgcctg

SEQ ID NO: 5874672 - DNA, 15 bp, Homo sapiens
cctccgtctgcaatg

SEQ ID NO: 5874673 - DNA, 16 bp, Homo sapiens
cctccgtctgcaatgt

SEQ ID NO: 5874674 - DNA, 23 bp, Homo sapiens
cctccgtgatccatccatctcca

SEQ ID NO: 5874675 - DNA, 14 bp, Homo sapiens
cctccgtgcttcct

SEQ ID NO: 5874676 - DNA, 13 bp, Homo sapiens
cctccgtggaaca

SEQ ID NO: 5874677 - DNA, 15 bp, Homo sapiens
cctccgtgggcagct

SEQ ID NO: 5874678 - DNA, 20 bp, Homo sapiens
cctccgttcccacctctgag

SEQ ID NO: 5874679 - DNA, 23 bp, Homo sapiens
cctccgttcccacctctgaggac

SEQ ID NO: 5874680 - DNA, 18 bp, Homo sapiens
cctccgtttatgggcctt

SEQ ID NO: 5874681 - DNA, 14 bp, Homo sapiens
cctcctaaaacaac

SEQ ID NO: 5874682 - DNA, 20 bp, Homo sapiens
cctcctaaagacctccaaag

SEQ ID NO: 5874683 - DNA, 13 bp, Homo sapiens
cctcctaaagctg

SEQ ID NO: 5874684 - DNA, 15 bp, Homo sapiens
cctcctaagagagag

SEQ ID NO: 5874685 - DNA, 19 bp, Homo sapiens
cctcctaagcagctgggac

SEQ ID NO: 5874686 - DNA, 17 bp, Homo sapiens
cctcctaaggctcccca

SEQ ID NO: 5874687 - DNA, 20 bp, Homo sapiens
cctcctaaggctccccaccc

SEQ ID NO: 5874688 - DNA, 21 bp, Homo sapiens
cctcctaaggctccccacccc

SEQ ID NO: 5874689 - DNA, 17 bp, Homo sapiens
cctcctaatggcatgga

SEQ ID NO: 5874690 - DNA, 23 bp, Homo sapiens
cctcctaatttgatcacagtggc

SEQ ID NO: 5874691 - DNA, 20 bp, Homo sapiens
cctcctacccctcccagctg

SEQ ID NO: 5874692 - DNA, 19 bp, Homo sapiens
cctcctaccgaaaccttgc

SEQ ID NO: 5874693 - DNA, 22 bp, Homo sapiens
cctcctaccgaaaccttgcctt

SEQ ID NO: 5874694 - DNA, 22 bp, Homo sapiens
cctcctacctcagcctcctggg

SEQ ID NO: 5874695 - DNA, 11 bp, Homo sapiens
cctcctacctg

SEQ ID NO: 5874696 - DNA, 15 bp, Homo sapiens
cctcctacctgggga

SEQ ID NO: 5874697 - DNA, 20 bp, Homo sapiens
cctcctacctggggactcct

SEQ ID NO: 5874698 - DNA, 21 bp, Homo sapiens
cctcctacgcagatgctgtca

SEQ ID NO: 5874699 - DNA, 20 bp, Homo sapiens
cctcctagaggtgggcagct

SEQ ID NO: 5874700 - DNA, 23 bp, Homo sapiens
cctcctagaggtgggcagctggg

SEQ ID NO: 5874701 - DNA, 11 bp, Homo sapiens
cctcctagcct

SEQ ID NO: 5874702 - DNA, 14 bp, Homo sapiens
cctcctagcctctc

SEQ ID NO: 5874703 - DNA, 14 bp, Homo sapiens
cctcctagcctgct

SEQ ID NO: 5874704 - DNA, 22 bp, Homo sapiens
cctcctagcctgctctgccact

SEQ ID NO: 5874705 - DNA, 19 bp, Homo sapiens
cctcctagctccaccctca

SEQ ID NO: 5874706 - DNA, 18 bp, Homo sapiens
cctcctagctctcccagt

SEQ ID NO: 5874707 - DNA, 19 bp, Homo sapiens
cctcctaggcgctcagagg

SEQ ID NO: 5874708 - DNA, 21 bp, Homo sapiens
cctcctaggcgctcagaggcc

SEQ ID NO: 5874709 - DNA, 15 bp, Homo sapiens
cctcctaggctccct

SEQ ID NO: 5874710 - DNA, 18 bp, Homo sapiens
cctcctaggctccctgag

SEQ ID NO: 5874711 - DNA, 21 bp, Homo sapiens
cctcctaggctccctgaggta

SEQ ID NO: 5874712 - DNA, 20 bp, Homo sapiens
cctcctagggaaaagttcat

SEQ ID NO: 5874713 - DNA, 17 bp, Homo sapiens
cctcctagggcttatca

SEQ ID NO: 5874714 - DNA, 23 bp, Homo sapiens
cctcctagggcttatcatcagcc

SEQ ID NO: 5874715 - DNA, 16 bp, Homo sapiens
cctcctaggggaaggg

SEQ ID NO: 5874716 - DNA, 20 bp, Homo sapiens
cctcctaggggaagggggtg

SEQ ID NO: 5874717 - DNA, 19 bp, Homo sapiens
cctcctatcacctcccctc

SEQ ID NO: 5874718 - DNA, 16 bp, Homo sapiens
cctcctatccttggag

SEQ ID NO: 5874719 - DNA, 15 bp, Homo sapiens
cctcctgcccagtcc

SEQ ID NO: 5874720 - DNA, 19 bp, Homo sapiens
cctcctgcccagtccccca

SEQ ID NO: 5874721 - DNA, 13 bp, Homo sapiens
cctcctgccccac

SEQ ID NO: 5874722 - DNA, 16 bp, Homo sapiens
cctcctgcccccaccc

SEQ ID NO: 5874723 - DNA, 19 bp, Homo sapiens
cctcctgccccctgccagt

SEQ ID NO: 5874724 - DNA, 12 bp, Homo sapiens
cctcctgccctt

SEQ ID NO: 5874725 - DNA, 16 bp, Homo sapiens
cctcctgcctcagcct

SEQ ID NO: 5874726 - DNA, 23 bp, Homo sapiens
cctcctgcctcagcctcctgaac

SEQ ID NO: 5874727 - DNA, 12 bp, Homo sapiens
cctcctgcctct

SEQ ID NO: 5874728 - DNA, 18 bp, Homo sapiens
cctcctgcctctactggg

SEQ ID NO: 5874729 - DNA, 14 bp, Homo sapiens
cctcctgcctgggg

SEQ ID NO: 5874730 - DNA, 18 bp, Homo sapiens
cctcctgcggctcagcct

SEQ ID NO: 5874731 - DNA, 9 bp, Homo sapiens
cctcctgct

SEQ ID NO: 5874732 - DNA, 17 bp, Homo sapiens
cctcctgctcctcaccc

SEQ ID NO: 5874733 - DNA, 13 bp, Homo sapiens
cctcctgctctgc

SEQ ID NO: 5874734 - DNA, 14 bp, Homo sapiens
cctcctgctctgct

SEQ ID NO: 5874735 - DNA, 15 bp, Homo sapiens
cctcctgctctgctt

SEQ ID NO: 5874736 - DNA, 17 bp, Homo sapiens
cctcctgctctgcttcc

SEQ ID NO: 5874737 - DNA, 19 bp, Homo sapiens
cctcctgctctgcttcctc

SEQ ID NO: 5874738 - DNA, 22 bp, Homo sapiens
cctcctgctctgcttcctcagg

SEQ ID NO: 5874739 - DNA, 15 bp, Homo sapiens
cctcctgctgagctg

SEQ ID NO: 5874740 - DNA, 12 bp, Homo sapiens
cctcctgctgca

SEQ ID NO: 5874741 - DNA, 20 bp, Homo sapiens
cctcctgctgcagaggggca

SEQ ID NO: 5874742 - DNA, 21 bp, Homo sapiens
cctcctgctgcagaggggcag

SEQ ID NO: 5874743 - DNA, 14 bp, Homo sapiens
cctcctgctgccag

SEQ ID NO: 5874744 - DNA, 16 bp, Homo sapiens
cctcctgctgccagta

SEQ ID NO: 5874745 - DNA, 19 bp, Homo sapiens
cctcctgctgccagtacca

SEQ ID NO: 5874746 - DNA, 17 bp, Homo sapiens
cctcctgctgcctaata

SEQ ID NO: 5874747 - DNA, 17 bp, Homo sapiens
cctcctgctgctcactc

SEQ ID NO: 5874748 - DNA, 12 bp, Homo sapiens
cctcctgctggc

SEQ ID NO: 5874749 - DNA, 13 bp, Homo sapiens
cctcctgctgggc

SEQ ID NO: 5874750 - DNA, 12 bp, Homo sapiens
cctcctgctgta

SEQ ID NO: 5874751 - DNA, 23 bp, Homo sapiens
cctcctgctgtagtcctttctgc

SEQ ID NO: 5874752 - DNA, 15 bp, Homo sapiens
cctcctgctgtgctg

SEQ ID NO: 5874753 - DNA, 20 bp, Homo sapiens
cctcctgctgtgctggaatt

SEQ ID NO: 5874754 - DNA, 14 bp, Homo sapiens
cctcctgctttggg

SEQ ID NO: 5874755 - DNA, 17 bp, Homo sapiens
cctcctggaaccttgct

SEQ ID NO: 5874756 - DNA, 22 bp, Homo sapiens
cctcctggaaccttgctgtcct

SEQ ID NO: 5874757 - DNA, 17 bp, Homo sapiens
cctcctggaagggacct

SEQ ID NO: 5874758 - DNA, 18 bp, Homo sapiens
cctcctggacccagcagg

SEQ ID NO: 5874759 - DNA, 19 bp, Homo sapiens
cctcctggacccagcaggg

SEQ ID NO: 5874760 - DNA, 21 bp, Homo sapiens
cctcctggacccagcaggggc

SEQ ID NO: 5874761 - DNA, 23 bp, Homo sapiens
cctcctggagcagaaagtgcctt

SEQ ID NO: 5874762 - DNA, 20 bp, Homo sapiens
cctcctggagcagcagctga

SEQ ID NO: 5874763 - DNA, 23 bp, Homo sapiens
cctcctggagctctgtgggtctc

SEQ ID NO: 5874764 - DNA, 16 bp, Homo sapiens
cctcctggaggaccag

SEQ ID NO: 5874765 - DNA, 16 bp, Homo sapiens
cctcctggcaatcaat

SEQ ID NO: 5874766 - DNA, 15 bp, Homo sapiens
cctcctggcccaggt

SEQ ID NO: 5874767 - DNA, 16 bp, Homo sapiens
cctcctggccttcctc

SEQ ID NO: 5874768 - DNA, 12 bp, Homo sapiens
cctcctggctca

SEQ ID NO: 5874769 - DNA, 15 bp, Homo sapiens
cctcctggctcacag

SEQ ID NO: 5874770 - DNA, 16 bp, Homo sapiens
cctcctggctcacagc

SEQ ID NO: 5874771 - DNA, 18 bp, Homo sapiens
cctcctggctcacagcca

SEQ ID NO: 5874772 - DNA, 16 bp, Homo sapiens
cctcctggctcaggcc

SEQ ID NO: 5874773 - DNA, 20 bp, Homo sapiens
cctcctgggaaggccacctc

SEQ ID NO: 5874774 - DNA, 18 bp, Homo sapiens
cctcctgggatctgctcg

SEQ ID NO: 5874775 - DNA, 15 bp, Homo sapiens
cctcctgggcacccc

SEQ ID NO: 5874776 - DNA, 20 bp, Homo sapiens
cctcctgggcaccccaggca

SEQ ID NO: 5874777 - DNA, 17 bp, Homo sapiens
cctcctgggcatgtttg

SEQ ID NO: 5874778 - DNA, 22 bp, Homo sapiens
cctcctgggcatgtttgtctgt

SEQ ID NO: 5874779 - DNA, 16 bp, Homo sapiens
cctcctgggcccaggc

SEQ ID NO: 5874780 - DNA, 20 bp, Homo sapiens
cctcctgggccctgggctgg

SEQ ID NO: 5874781 - DNA, 10 bp, Homo sapiens
cctcctgggg

SEQ ID NO: 5874782 - DNA, 23 bp, Homo sapiens
cctcctggggagaggaggaggat

SEQ ID NO: 5874783 - DNA, 13 bp, Homo sapiens
cctcctggggcca

SEQ ID NO: 5874784 - DNA, 16 bp, Homo sapiens
cctcctgggggcccat

SEQ ID NO: 5874785 - DNA, 13 bp, Homo sapiens
cctcctgggggct

SEQ ID NO: 5874786 - DNA, 19 bp, Homo sapiens
cctcctgggtgctcaccgc

SEQ ID NO: 5874787 - DNA, 17 bp, Homo sapiens
cctcctgggttcaagag

SEQ ID NO: 5874788 - DNA, 19 bp, Homo sapiens
cctcctggtaacagctatg

SEQ ID NO: 5874789 - DNA, 23 bp, Homo sapiens
cctcctggtcctggacacctccc

SEQ ID NO: 5874790 - DNA, 17 bp, Homo sapiens
cctcctggtgtcacccc

SEQ ID NO: 5874791 - DNA, 18 bp, Homo sapiens
cctcctggtgtcacccca

SEQ ID NO: 5874792 - DNA, 19 bp, Homo sapiens
cctcctggtgtcaccccag

SEQ ID NO: 5874793 - DNA, 20 bp, Homo sapiens
cctcctggtttcctttctca

SEQ ID NO: 5874794 - DNA, 21 bp, Homo sapiens
cctcctgtcactcactgaggc

SEQ ID NO: 5874795 - DNA, 23 bp, Homo sapiens
cctcctgtcagtgaggactcttt

SEQ ID NO: 5874796 - DNA, 15 bp, Homo sapiens
cctcctgtctcctct

SEQ ID NO: 5874797 - DNA, 17 bp, Homo sapiens
cctcctgtctcctctgt

SEQ ID NO: 5874798 - DNA, 20 bp, Homo sapiens
cctcctgtctcctctgtcag

SEQ ID NO: 5874799 - DNA, 21 bp, Homo sapiens
cctcctgtctcctctgtcagt

SEQ ID NO: 5874800 - DNA, 15 bp, Homo sapiens
cctcctgtctctggc

SEQ ID NO: 5874801 - DNA, 20 bp, Homo sapiens
cctcctgtcttggcctccca

SEQ ID NO: 5874802 - DNA, 14 bp, Homo sapiens
cctcctgtgcccca

SEQ ID NO: 5874803 - DNA, 16 bp, Homo sapiens
cctcctgtgccccagc

SEQ ID NO: 5874804 - DNA, 23 bp, Homo sapiens
cctcctgtgccccagctgccagg

SEQ ID NO: 5874805 - DNA, 24 bp, Homo sapiens
cctcctgtgccccagctgccaggc

SEQ ID NO: 5874806 - DNA, 18 bp, Homo sapiens
cctcctgtgcctcccttt

SEQ ID NO: 5874807 - DNA, 14 bp, Homo sapiens
cctcctgtgctcag

SEQ ID NO: 5874808 - DNA, 16 bp, Homo sapiens
cctcctgtgctcagcc

SEQ ID NO: 5874809 - DNA, 17 bp, Homo sapiens
cctcctgtgctcagccc

SEQ ID NO: 5874810 - DNA, 17 bp, Homo sapiens
cctcctgtgtagctggg

SEQ ID NO: 5874811 - DNA, 20 bp, Homo sapiens
cctcctgtgtggaagaagga

SEQ ID NO: 5874812 - DNA, 22 bp, Homo sapiens
cctcctgtgtgtgcgcctacag

SEQ ID NO: 5874813 - DNA, 23 bp, Homo sapiens
cctcctgttacttgcttctgctg

SEQ ID NO: 5874814 - DNA, 19 bp, Homo sapiens
cctcctgttcctgccttct

SEQ ID NO: 5874815 - DNA, 21 bp, Homo sapiens
cctcctgttcctgccttctct

SEQ ID NO: 5874816 - DNA, 13 bp, Homo sapiens
cctcctgttctgc

SEQ ID NO: 5874817 - DNA, 18 bp, Homo sapiens
cctcctgttgcacccagc

SEQ ID NO: 5874818 - DNA, 23 bp, Homo sapiens
cctcctgttgcacccagccctgg

SEQ ID NO: 5874819 - DNA, 15 bp, Homo sapiens
cctcctgttgccaca

SEQ ID NO: 5874820 - DNA, 17 bp, Homo sapiens
cctcctgttgccacact

SEQ ID NO: 5874821 - DNA, 21 bp, Homo sapiens
cctcctgttttctccctctca

SEQ ID NO: 5874822 - DNA, 17 bp, Homo sapiens
cctccttacctggagta

SEQ ID NO: 5874823 - DNA, 18 bp, Homo sapiens
cctccttagccctgtctg

SEQ ID NO: 5874824 - DNA, 22 bp, Homo sapiens
cctccttagccctgtctgctag

SEQ ID NO: 5874825 - DNA, 22 bp, Homo sapiens
cctccttagctttccctgtgcc

SEQ ID NO: 5874826 - DNA, 17 bp, Homo sapiens
cctccttcaattccata

SEQ ID NO: 5874827 - DNA, 15 bp, Homo sapiens
cctccttccagatgc

SEQ ID NO: 5874828 - DNA, 23 bp, Homo sapiens
cctccttccagatgcccgagcac

SEQ ID NO: 5874829 - DNA, 12 bp, Homo sapiens
cctccttccagg

SEQ ID NO: 5874830 - DNA, 12 bp, Homo sapiens
cctccttcccag

SEQ ID NO: 5874831 - DNA, 13 bp, Homo sapiens
cctccttcccagc

SEQ ID NO: 5874832 - DNA, 15 bp, Homo sapiens
cctccttcccagctc

SEQ ID NO: 5874833 - DNA, 16 bp, Homo sapiens
cctccttcccagctct

SEQ ID NO: 5874834 - DNA, 21 bp, Homo sapiens
cctccttcccagctgcccctc

SEQ ID NO: 5874835 - DNA, 17 bp, Homo sapiens
cctccttcccatgcctg

SEQ ID NO: 5874836 - DNA, 17 bp, Homo sapiens
cctccttccccacccca

SEQ ID NO: 5874837 - DNA, 13 bp, Homo sapiens
cctccttccccag

SEQ ID NO: 5874838 - DNA, 14 bp, Homo sapiens
cctccttccccaga

SEQ ID NO: 5874839 - DNA, 15 bp, Homo sapiens
cctccttccccagac

SEQ ID NO: 5874840 - DNA, 16 bp, Homo sapiens
cctccttccccagacc

SEQ ID NO: 5874841 - DNA, 17 bp, Homo sapiens
cctccttccccagaccc

SEQ ID NO: 5874842 - DNA, 18 bp, Homo sapiens
cctccttccccagaccca

SEQ ID NO: 5874843 - DNA, 13 bp, Homo sapiens
cctccttcccgcc

SEQ ID NO: 5874844 - DNA, 16 bp, Homo sapiens
cctccttcccgccgcc

SEQ ID NO: 5874845 - DNA, 15 bp, Homo sapiens
cctccttccctcacc

SEQ ID NO: 5874846 - DNA, 23 bp, Homo sapiens
cctccttccctcacccccagcac

SEQ ID NO: 5874847 - DNA, 15 bp, Homo sapiens
cctccttccctcctg

SEQ ID NO: 5874848 - DNA, 13 bp, Homo sapiens
cctccttcccttc

SEQ ID NO: 5874849 - DNA, 13 bp, Homo sapiens
cctccttcctaaa

SEQ ID NO: 5874850 - DNA, 21 bp, Homo sapiens
cctccttcctcagtcctggaa

SEQ ID NO: 5874851 - DNA, 13 bp, Homo sapiens
cctccttcctggg

SEQ ID NO: 5874852 - DNA, 16 bp, Homo sapiens
cctccttcctgggacc

SEQ ID NO: 5874853 - DNA, 17 bp, Homo sapiens
cctccttcctgggaccc

SEQ ID NO: 5874854 - DNA, 12 bp, Homo sapiens
cctccttctccc

SEQ ID NO: 5874855 - DNA, 13 bp, Homo sapiens
cctccttctcctg

SEQ ID NO: 5874856 - DNA, 14 bp, Homo sapiens
cctccttctctgtc

SEQ ID NO: 5874857 - DNA, 22 bp, Homo sapiens
cctccttctctgtctcatgtgt

SEQ ID NO: 5874858 - DNA, 15 bp, Homo sapiens
cctccttctgcagtc

SEQ ID NO: 5874859 - DNA, 18 bp, Homo sapiens
cctccttctgcagtcaga

SEQ ID NO: 5874860 - DNA, 20 bp, Homo sapiens
cctccttcttgccctgagct

SEQ ID NO: 5874861 - DNA, 23 bp, Homo sapiens
cctccttcttttcctaacatgca

SEQ ID NO: 5874862 - DNA, 17 bp, Homo sapiens
cctccttgcaaccaggc

SEQ ID NO: 5874863 - DNA, 19 bp, Homo sapiens
cctccttgcaaccaggcag

SEQ ID NO: 5874864 - DNA, 20 bp, Homo sapiens
cctccttgcaaccaggcagc

SEQ ID NO: 5874865 - DNA, 21 bp, Homo sapiens
cctccttgcaaccaggcagct

SEQ ID NO: 5874866 - DNA, 14 bp, Homo sapiens
cctccttgccaccc

SEQ ID NO: 5874867 - DNA, 15 bp, Homo sapiens
cctccttgccacccc

SEQ ID NO: 5874868 - DNA, 17 bp, Homo sapiens
cctccttgccagcccca

SEQ ID NO: 5874869 - DNA, 17 bp, Homo sapiens
cctccttgcccagacta

SEQ ID NO: 5874870 - DNA, 21 bp, Homo sapiens
cctccttgccgctgggagagc

SEQ ID NO: 5874871 - DNA, 19 bp, Homo sapiens
cctccttgcctcctgtgta

SEQ ID NO: 5874872 - DNA, 15 bp, Homo sapiens
cctccttgctctgca

SEQ ID NO: 5874873 - DNA, 18 bp, Homo sapiens
cctccttgctctgcaggc

SEQ ID NO: 5874874 - DNA, 12 bp, Homo sapiens
cctccttgctga

SEQ ID NO: 5874875 - DNA, 14 bp, Homo sapiens
cctccttgctgacc

SEQ ID NO: 5874876 - DNA, 16 bp, Homo sapiens
cctccttgctgatttg

SEQ ID NO: 5874877 - DNA, 20 bp, Homo sapiens
cctccttgggcactttttaa

SEQ ID NO: 5874878 - DNA, 18 bp, Homo sapiens
cctccttgggcagggtct

SEQ ID NO: 5874879 - DNA, 16 bp, Homo sapiens
cctccttggtgcctct

SEQ ID NO: 5874880 - DNA, 21 bp, Homo sapiens
cctccttgtctagtttcccac

SEQ ID NO: 5874881 - DNA, 23 bp, Homo sapiens
cctccttgtctagtttcccacat

SEQ ID NO: 5874882 - DNA, 21 bp, Homo sapiens
cctccttgtgcaattgtcttt

SEQ ID NO: 5874883 - DNA, 16 bp, Homo sapiens
cctccttgtgttgcac

SEQ ID NO: 5874884 - DNA, 17 bp, Homo sapiens
cctcctttaccgaggac

SEQ ID NO: 5874885 - DNA, 22 bp, Homo sapiens
cctcctttaccgaggacagcct

SEQ ID NO: 5874886 - DNA, 19 bp, Homo sapiens
cctcctttcatcacactgg

SEQ ID NO: 5874887 - DNA, 10 bp, Homo sapiens
cctcctttcc

SEQ ID NO: 5874888 - DNA, 20 bp, Homo sapiens
cctcctttcccctttctctt

SEQ ID NO: 5874889 - DNA, 12 bp, Homo sapiens
cctcctttccct

SEQ ID NO: 5874890 - DNA, 14 bp, Homo sapiens
cctcctttccctta

SEQ ID NO: 5874891 - DNA, 14 bp, Homo sapiens
cctcctttcctttt

SEQ ID NO: 5874892 - DNA, 12 bp, Homo sapiens
cctcctttctct

SEQ ID NO: 5874893 - DNA, 20 bp, Homo sapiens
cctcctttctcttctctgtt

SEQ ID NO: 5874894 - DNA, 21 bp, Homo sapiens
cctcctttctttgctgtttgc

SEQ ID NO: 5874895 - DNA, 19 bp, Homo sapiens
cctcctttgtgaggaagcc

SEQ ID NO: 5874896 - DNA, 17 bp, Homo sapiens
cctccttttcttcaccc

SEQ ID NO: 5874897 - DNA, 13 bp, Homo sapiens
cctcgggctgttc

SEQ ID NO: 5874898 - DNA, 13 bp, Homo sapiens
cctcggggagagg

SEQ ID NO: 5874899 - DNA, 13 bp, Homo sapiens
cctcggggatggg

SEQ ID NO: 5874900 - DNA, 16 bp, Homo sapiens
cctcggggatggggag

SEQ ID NO: 5874901 - DNA, 17 bp, Homo sapiens
cctcggggatggggagg

SEQ ID NO: 5874902 - DNA, 16 bp, Homo sapiens
cctcggggatgtgtcc

SEQ ID NO: 5874903 - DNA, 16 bp, Homo sapiens
cctcggggctccaggc

SEQ ID NO: 5874904 - DNA, 16 bp, Homo sapiens
cctcgggggcctgtgg

SEQ ID NO: 5874905 - DNA, 18 bp, Homo sapiens
cctcgggggctcttcccc

SEQ ID NO: 5874906 - DNA, 22 bp, Homo sapiens
cctcgggggctcttcccctaga

SEQ ID NO: 5874907 - DNA, 21 bp, Homo sapiens
cctcggggggtcacaggccca

SEQ ID NO: 5874908 - DNA, 22 bp, Homo sapiens
cctcggggggtcacaggcccag

SEQ ID NO: 5874909 - DNA, 13 bp, Homo sapiens
cctcgggtctccc

SEQ ID NO: 5874910 - DNA, 15 bp, Homo sapiens
cctcggtcacctgtg

SEQ ID NO: 5874911 - DNA, 13 bp, Homo sapiens
cctcggtcactga

SEQ ID NO: 5874912 - DNA, 20 bp, Homo sapiens
cctcggtgatgcggacatct

SEQ ID NO: 5874913 - DNA, 16 bp, Homo sapiens
cctcggtgccttcctc

SEQ ID NO: 5874914 - DNA, 16 bp, Homo sapiens
cctcggtggctctggg

SEQ ID NO: 5874915 - DNA, 21 bp, Homo sapiens
cctcggtggctgcacagaagg

SEQ ID NO: 5874916 - DNA, 17 bp, Homo sapiens
cctcggtgggccagagc

SEQ ID NO: 5874917 - DNA, 15 bp, Homo sapiens
cctcggttgattgtg

SEQ ID NO: 5874918 - DNA, 24 bp, Homo sapiens
cctcggtttcccatttgttgctgc

SEQ ID NO: 5874919 - DNA, 18 bp, Homo sapiens
cctcgtactcaggagccc

SEQ ID NO: 5874920 - DNA, 16 bp, Homo sapiens
cctcgtagagtgacct

SEQ ID NO: 5874921 - DNA, 14 bp, Homo sapiens
cctcgtcagtctct

SEQ ID NO: 5874922 - DNA, 18 bp, Homo sapiens
cctcgtccacaggggcag

SEQ ID NO: 5874923 - DNA, 20 bp, Homo sapiens
cctcgtccaccccccacaca

SEQ ID NO: 5874924 - DNA, 16 bp, Homo sapiens
cctcgtcccctgcctc

SEQ ID NO: 5874925 - DNA, 13 bp, Homo sapiens
cctcgtccctccc

SEQ ID NO: 5874926 - DNA, 19 bp, Homo sapiens
cctcgtccggcctgcagcc

SEQ ID NO: 5874927 - DNA, 21 bp, Homo sapiens
cctcgtccggcctgcagccca

SEQ ID NO: 5874928 - DNA, 21 bp, Homo sapiens
cctcgtcctccccctgccagt

SEQ ID NO: 5874929 - DNA, 18 bp, Homo sapiens
cctcgtcctgtcccagag

SEQ ID NO: 5874930 - DNA, 18 bp, Homo sapiens
cctcgtctccctggccac

SEQ ID NO: 5874931 - DNA, 19 bp, Homo sapiens
cctcgtctccctggtgcct

SEQ ID NO: 5874932 - DNA, 14 bp, Homo sapiens
cctcgtctggcaag

SEQ ID NO: 5874933 - DNA, 23 bp, Homo sapiens
cctcgtgaggggcaagctaggcc

SEQ ID NO: 5874934 - DNA, 22 bp, Homo sapiens
cctcgtgatccgcctgcctctg

SEQ ID NO: 5874935 - DNA, 16 bp, Homo sapiens
cctcgtgatttgcctg

SEQ ID NO: 5874936 - DNA, 19 bp, Homo sapiens
cctcgtgatttgcctgcct

SEQ ID NO: 5874937 - DNA, 15 bp, Homo sapiens
cctcgtgcacacaca

SEQ ID NO: 5874938 - DNA, 13 bp, Homo sapiens
cctcgtgcagagc

SEQ ID NO: 5874939 - DNA, 14 bp, Homo sapiens
cctcgtgccagcag

SEQ ID NO: 5874940 - DNA, 17 bp, Homo sapiens
cctcgtgccagcagcct

SEQ ID NO: 5874941 - DNA, 21 bp, Homo sapiens
cctcgtgccagcagcctcgca

SEQ ID NO: 5874942 - DNA, 12 bp, Homo sapiens
cctcgtgcgccc

SEQ ID NO: 5874943 - DNA, 19 bp, Homo sapiens
cctcgtgctccgcagggcg

SEQ ID NO: 5874944 - DNA, 20 bp, Homo sapiens
cctcgtgctccgcagggcgc

SEQ ID NO: 5874945 - DNA, 15 bp, Homo sapiens
cctcgtggacacctg

SEQ ID NO: 5874946 - DNA, 17 bp, Homo sapiens
cctcgtggccagcccgg

SEQ ID NO: 5874947 - DNA, 20 bp, Homo sapiens
cctcgtggcggggcagcagg

SEQ ID NO: 5874948 - DNA, 22 bp, Homo sapiens
cctcgtgggcttgtgctcggga

SEQ ID NO: 5874949 - DNA, 15 bp, Homo sapiens
cctcgtggtccccaa

SEQ ID NO: 5874950 - DNA, 22 bp, Homo sapiens
cctcgtggttattagcaaggct

SEQ ID NO: 5874951 - DNA, 13 bp, Homo sapiens
cctcgtgtcatct

SEQ ID NO: 5874952 - DNA, 17 bp, Homo sapiens
cctcgtgtcctgctagc

SEQ ID NO: 5874953 - DNA, 21 bp, Homo sapiens
cctcgttaacacatggcttcc

SEQ ID NO: 5874954 - DNA, 22 bp, Homo sapiens
cctcgttactctcacctcgtga

SEQ ID NO: 5874955 - DNA, 20 bp, Homo sapiens
cctcgttagagaatggcctg

SEQ ID NO: 5874956 - DNA, 19 bp, Homo sapiens
cctcgttaggacaaggctg

SEQ ID NO: 5874957 - DNA, 23 bp, Homo sapiens
cctcgttagggaagagaaacagg

SEQ ID NO: 5874958 - DNA, 18 bp, Homo sapiens
cctcgttcaaaacattcc

SEQ ID NO: 5874959 - DNA, 19 bp, Homo sapiens
cctcgttcctttctcctgt

SEQ ID NO: 5874960 - DNA, 21 bp, Homo sapiens
cctcgttcctttctcctgttt

SEQ ID NO: 5874961 - DNA, 18 bp, Homo sapiens
cctcgttctccctgggag

SEQ ID NO: 5874962 - DNA, 21 bp, Homo sapiens
cctcgttgcccagcactgtct

SEQ ID NO: 5874963 - DNA, 21 bp, Homo sapiens
cctcgttgggccgctctgatt

SEQ ID NO: 5874964 - DNA, 22 bp, Homo sapiens
cctcgttgggccgctctgattt

SEQ ID NO: 5874965 - DNA, 13 bp, Homo sapiens
cctcgttttcaaa

SEQ ID NO: 5874966 - DNA, 13 bp, Homo sapiens
cctctaaagcaga

SEQ ID NO: 5874967 - DNA, 14 bp, Homo sapiens
cctctaacaaatga

SEQ ID NO: 5874968 - DNA, 15 bp, Homo sapiens
cctctaacaaatgat

SEQ ID NO: 5874969 - DNA, 14 bp, Homo sapiens
cctctaacaccaca

SEQ ID NO: 5874970 - DNA, 15 bp, Homo sapiens
cctctaacaccacac

SEQ ID NO: 5874971 - DNA, 18 bp, Homo sapiens
cctctaacaccacactga

SEQ ID NO: 5874972 - DNA, 15 bp, Homo sapiens
cctctaacagcacca

SEQ ID NO: 5874973 - DNA, 17 bp, Homo sapiens
cctctaacaggggctgg

SEQ ID NO: 5874974 - DNA, 18 bp, Homo sapiens
cctctaacaggggctggt

SEQ ID NO: 5874975 - DNA, 21 bp, Homo sapiens
cctctaacccccagtgccaca

SEQ ID NO: 5874976 - DNA, 14 bp, Homo sapiens
cctctaaccctcat

SEQ ID NO: 5874977 - DNA, 17 bp, Homo sapiens
cctctaaccctcattgc

SEQ ID NO: 5874978 - DNA, 15 bp, Homo sapiens
cctctaactcactgc

SEQ ID NO: 5874979 - DNA, 19 bp, Homo sapiens
cctctaactcactgcctag

SEQ ID NO: 5874980 - DNA, 19 bp, Homo sapiens
cctctaactccctcctcac

SEQ ID NO: 5874981 - DNA, 15 bp, Homo sapiens
cctctaactcctggg

SEQ ID NO: 5874982 - DNA, 18 bp, Homo sapiens
cctctaactggacagcct

SEQ ID NO: 5874983 - DNA, 19 bp, Homo sapiens
cctctaactggacagcctc

SEQ ID NO: 5874984 - DNA, 19 bp, Homo sapiens
cctctaagccactcttcca

SEQ ID NO: 5874985 - DNA, 16 bp, Homo sapiens
cctctaagctgctcta

SEQ ID NO: 5874986 - DNA, 16 bp, Homo sapiens
cctctaatagaggcag

SEQ ID NO: 5874987 - DNA, 20 bp, Homo sapiens
cctctaatctgagctgcagc

SEQ ID NO: 5874988 - DNA, 21 bp, Homo sapiens
cctctaattctcttacccaga

SEQ ID NO: 5874989 - DNA, 22 bp, Homo sapiens
cctctaattctcttacccagaa

SEQ ID NO: 5874990 - DNA, 14 bp, Homo sapiens
cctctacagccgtc

SEQ ID NO: 5874991 - DNA, 15 bp, Homo sapiens
cctctacagccgtcc

SEQ ID NO: 5874992 - DNA, 11 bp, Homo sapiens
cctctacaggg

SEQ ID NO: 5874993 - DNA, 21 bp, Homo sapiens
cctctacatggactcagagaa

SEQ ID NO: 5874994 - DNA, 14 bp, Homo sapiens
cctctaccaagctg

SEQ ID NO: 5874995 - DNA, 19 bp, Homo sapiens
cctctaccaccacaccaaa

SEQ ID NO: 5874996 - DNA, 13 bp, Homo sapiens
cctctacctctct

SEQ ID NO: 5874997 - DNA, 20 bp, Homo sapiens
cctctacggttatttcctgc

SEQ ID NO: 5874998 - DNA, 23 bp, Homo sapiens
cctctactcttacagagccttga

SEQ ID NO: 5874999 - DNA, 16 bp, Homo sapiens
cctctactcttcctgt

SEQ ID NO: 5875000 - DNA, 22 bp, Homo sapiens
cctctactgggaaggctacttc

SEQ ID NO: 5875001 - DNA, 15 bp, Homo sapiens
cctctactgtctcct

SEQ ID NO: 5875002 - DNA, 19 bp, Homo sapiens
cctctactgtctcctccct

SEQ ID NO: 5875003 - DNA, 18 bp, Homo sapiens
cctctactttccaggcta

SEQ ID NO: 5875004 - DNA, 18 bp, Homo sapiens
cctctactttgattctga

SEQ ID NO: 5875005 - DNA, 18 bp, Homo sapiens
cctctactttgctccgtg

SEQ ID NO: 5875006 - DNA, 22 bp, Homo sapiens
cctctactttgtcccctcacct

SEQ ID NO: 5875007 - DNA, 17 bp, Homo sapiens
cctctagaaatttttca

SEQ ID NO: 5875008 - DNA, 12 bp, Homo sapiens
cctctagaacac

SEQ ID NO: 5875009 - DNA, 17 bp, Homo sapiens
cctctagaacacccact

SEQ ID NO: 5875010 - DNA, 19 bp, Homo sapiens
cctctagaacacccactgg

SEQ ID NO: 5875011 - DNA, 24 bp, Homo sapiens
cctctagaacacccactggccagt

SEQ ID NO: 5875012 - DNA, 16 bp, Homo sapiens
cctctagaagccaagg

SEQ ID NO: 5875013 - DNA, 14 bp, Homo sapiens
cctctagaatccca

SEQ ID NO: 5875014 - DNA, 17 bp, Homo sapiens
cctctagagaaaagatg

SEQ ID NO: 5875015 - DNA, 22 bp, Homo sapiens
cctctagagaaataagatcttt

SEQ ID NO: 5875016 - DNA, 14 bp, Homo sapiens
cctctagagcagac

SEQ ID NO: 5875017 - DNA, 22 bp, Homo sapiens
cctctagagccttcagccttaa

SEQ ID NO: 5875018 - DNA, 15 bp, Homo sapiens
cctctagaggctgcc

SEQ ID NO: 5875019 - DNA, 14 bp, Homo sapiens
cctctagctctggt

SEQ ID NO: 5875020 - DNA, 22 bp, Homo sapiens
cctctagctgtgggggtgaggg

SEQ ID NO: 5875021 - DNA, 17 bp, Homo sapiens
cctctaggcaagcagga

SEQ ID NO: 5875022 - DNA, 21 bp, Homo sapiens
cctctaggcaagcaggacctg

SEQ ID NO: 5875023 - DNA, 17 bp, Homo sapiens
cctctaggccctgtgag

SEQ ID NO: 5875024 - DNA, 21 bp, Homo sapiens
cctctaggccttgccccacct

SEQ ID NO: 5875025 - DNA, 13 bp, Homo sapiens
cctctagggcagg

SEQ ID NO: 5875026 - DNA, 16 bp, Homo sapiens
cctctagggcagggtg

SEQ ID NO: 5875027 - DNA, 17 bp, Homo sapiens
cctctagggcagggtgg

SEQ ID NO: 5875028 - DNA, 14 bp, Homo sapiens
cctctaggggcagc

SEQ ID NO: 5875029 - DNA, 16 bp, Homo sapiens
cctctaggggcagcct

SEQ ID NO: 5875030 - DNA, 18 bp, Homo sapiens
cctctaggggcagcctcc

SEQ ID NO: 5875031 - DNA, 22 bp, Homo sapiens
cctctaggggcagcctccgtca

SEQ ID NO: 5875032 - DNA, 18 bp, Homo sapiens
cctctaggtaaactagca

SEQ ID NO: 5875033 - DNA, 21 bp, Homo sapiens
cctctagtaagatgcactgaa

SEQ ID NO: 5875034 - DNA, 13 bp, Homo sapiens
cctctagtgccct

SEQ ID NO: 5875035 - DNA, 20 bp, Homo sapiens
cctctagttccagaaggatc

SEQ ID NO: 5875036 - DNA, 15 bp, Homo sapiens
cctctatacatctct

SEQ ID NO: 5875037 - DNA, 19 bp, Homo sapiens
cctctatacatctctcccc

SEQ ID NO: 5875038 - DNA, 12 bp, Homo sapiens
cctctatacttt

SEQ ID NO: 5875039 - DNA, 14 bp, Homo sapiens
cctctatactttgt

SEQ ID NO: 5875040 - DNA, 15 bp, Homo sapiens
cctctatactttgtt

SEQ ID NO: 5875041 - DNA, 19 bp, Homo sapiens
cctctatactttgttctgt

SEQ ID NO: 5875042 - DNA, 22 bp, Homo sapiens
cctctatactttgttctgttgt

SEQ ID NO: 5875043 - DNA, 23 bp, Homo sapiens
cctctatactttgttctgttgtc

SEQ ID NO: 5875044 - DNA, 23 bp, Homo sapiens
cctctatatctttaaataaatgt

SEQ ID NO: 5875045 - DNA, 13 bp, Homo sapiens
cctctatccctgg

SEQ ID NO: 5875046 - DNA, 14 bp, Homo sapiens
cctctatccctggc

SEQ ID NO: 5875047 - DNA, 15 bp, Homo sapiens
cctctatgccctgca

SEQ ID NO: 5875048 - DNA, 19 bp, Homo sapiens
cctctatgccctgcagagc

SEQ ID NO: 5875049 - DNA, 21 bp, Homo sapiens
cctctatgccctgcagagcaa

SEQ ID NO: 5875050 - DNA, 19 bp, Homo sapiens
cctctatggaaggaggcct

SEQ ID NO: 5875051 - DNA, 17 bp, Homo sapiens
cctctatttacctgcga

SEQ ID NO: 5875052 - DNA, 16 bp, Homo sapiens
cctctatttagcatga

SEQ ID NO: 5875053 - DNA, 13 bp, Homo sapiens
cctctatttatta

SEQ ID NO: 5875054 - DNA, 17 bp, Homo sapiens
cctctatttattagcca

SEQ ID NO: 5875055 - DNA, 19 bp, Homo sapiens
cctctatttattagccaac

SEQ ID NO: 5875056 - DNA, 23 bp, Homo sapiens
cctctatttcctgaacctggaaa

SEQ ID NO: 5875057 - DNA, 13 bp, Homo sapiens
cctctatttctct

SEQ ID NO: 5875058 - DNA, 14 bp, Homo sapiens
cctctatttctctc

SEQ ID NO: 5875059 - DNA, 14 bp, Homo sapiens
cctctatttcttta

SEQ ID NO: 5875060 - DNA, 16 bp, Homo sapiens
cctctcaaattcagct

SEQ ID NO: 5875061 - DNA, 18 bp, Homo sapiens
cctctcaaattcagctct

SEQ ID NO: 5875062 - DNA, 15 bp, Homo sapiens
cctctcaactgcctc

SEQ ID NO: 5875063 - DNA, 19 bp, Homo sapiens
cctctcaactgcctcagcg

SEQ ID NO: 5875064 - DNA, 17 bp, Homo sapiens
cctctcaagtagctggg

SEQ ID NO: 5875065 - DNA, 18 bp, Homo sapiens
cctctcaatattcaataa

SEQ ID NO: 5875066 - DNA, 12 bp, Homo sapiens
cctctcacccag

SEQ ID NO: 5875067 - DNA, 13 bp, Homo sapiens
cctctcacccaga

SEQ ID NO: 5875068 - DNA, 17 bp, Homo sapiens
cctctcaccccactcct

SEQ ID NO: 5875069 - DNA, 19 bp, Homo sapiens
cctctcaccccactcctgt

SEQ ID NO: 5875070 - DNA, 16 bp, Homo sapiens
cctctcacctcagcct

SEQ ID NO: 5875071 - DNA, 15 bp, Homo sapiens
cctctcacctctgtg

SEQ ID NO: 5875072 - DNA, 17 bp, Homo sapiens
cctctcacgggccctgc

SEQ ID NO: 5875073 - DNA, 18 bp, Homo sapiens
cctctcacgggccctgcc

SEQ ID NO: 5875074 - DNA, 19 bp, Homo sapiens
cctctcactagtgccaatg

SEQ ID NO: 5875075 - DNA, 19 bp, Homo sapiens
cctctgaaagttgtacatg

SEQ ID NO: 5875076 - DNA, 12 bp, Homo sapiens
cctctgaaatac

SEQ ID NO: 5875077 - DNA, 21 bp, Homo sapiens
cctctgaaattaaagaaatga

SEQ ID NO: 5875078 - DNA, 17 bp, Homo sapiens
cctctgaactgctgctg

SEQ ID NO: 5875079 - DNA, 13 bp, Homo sapiens
cctctgaagagac

SEQ ID NO: 5875080 - DNA, 21 bp, Homo sapiens
cctctgaagagaccttggctg

SEQ ID NO: 5875081 - DNA, 14 bp, Homo sapiens
cctctgaagagctg

SEQ ID NO: 5875082 - DNA, 20 bp, Homo sapiens
cctctgaatgaaccttctgg

SEQ ID NO: 5875083 - DNA, 16 bp, Homo sapiens
cctctgaatgtcccag

SEQ ID NO: 5875084 - DNA, 18 bp, Homo sapiens
cctctgaatgtcccagag

SEQ ID NO: 5875085 - DNA, 14 bp, Homo sapiens
cctctgaatgttac

SEQ ID NO: 5875086 - DNA, 22 bp, Homo sapiens
cctctgaatttacttccttgca

SEQ ID NO: 5875087 - DNA, 16 bp, Homo sapiens
cctctgacacacagct

SEQ ID NO: 5875088 - DNA, 18 bp, Homo sapiens
cctctgacacacagctct

SEQ ID NO: 5875089 - DNA, 20 bp, Homo sapiens
cctctgacacacagctctgt

SEQ ID NO: 5875090 - DNA, 21 bp, Homo sapiens
cctctgacacacagctctgtc

SEQ ID NO: 5875091 - DNA, 15 bp, Homo sapiens
cctctgacagcagca

SEQ ID NO: 5875092 - DNA, 16 bp, Homo sapiens
cctctgacagcagcct

SEQ ID NO: 5875093 - DNA, 20 bp, Homo sapiens
cctctgacagcagcctgtga

SEQ ID NO: 5875094 - DNA, 21 bp, Homo sapiens
cctctgacagctgtcctgagc

SEQ ID NO: 5875095 - DNA, 17 bp, Homo sapiens
cctctgacagtccacag

SEQ ID NO: 5875096 - DNA, 22 bp, Homo sapiens
cctctgacatcaagtgtaatta

SEQ ID NO: 5875097 - DNA, 23 bp, Homo sapiens
cctctgacatcaagtgtaattag

SEQ ID NO: 5875098 - DNA, 17 bp, Homo sapiens
cctctgacccagactcc

SEQ ID NO: 5875099 - DNA, 19 bp, Homo sapiens
cctctgacccctcctcact

SEQ ID NO: 5875100 - DNA, 14 bp, Homo sapiens
cctctgaccctcct

SEQ ID NO: 5875101 - DNA, 15 bp, Homo sapiens
cctctgacctgcagg

SEQ ID NO: 5875102 - DNA, 16 bp, Homo sapiens
cctctgacctgcaggc

SEQ ID NO: 5875103 - DNA, 17 bp, Homo sapiens
cctctgacctgcaggcc

SEQ ID NO: 5875104 - DNA, 20 bp, Homo sapiens
cctctgacctgcaggccaag

SEQ ID NO: 5875105 - DNA, 19 bp, Homo sapiens
cctctgacgtccacctcct

SEQ ID NO: 5875106 - DNA, 20 bp, Homo sapiens
cctctgactagtagatttct

SEQ ID NO: 5875107 - DNA, 17 bp, Homo sapiens
cctctgactcaccacga

SEQ ID NO: 5875108 - DNA, 16 bp, Homo sapiens
cctctgactcagggct

SEQ ID NO: 5875109 - DNA, 18 bp, Homo sapiens
cctctgactctgagtcca

SEQ ID NO: 5875110 - DNA, 22 bp, Homo sapiens
cctctgacttaagctgcctcaa

SEQ ID NO: 5875111 - DNA, 16 bp, Homo sapiens
cctctgacttggggac

SEQ ID NO: 5875112 - DNA, 15 bp, Homo sapiens
cctctgagacagaga

SEQ ID NO: 5875113 - DNA, 15 bp, Homo sapiens
cctctgagactccag

SEQ ID NO: 5875114 - DNA, 19 bp, Homo sapiens
cctctgagactccagacct

SEQ ID NO: 5875115 - DNA, 13 bp, Homo sapiens
cctctgagaggcg

SEQ ID NO: 5875116 - DNA, 21 bp, Homo sapiens
cctctgagatgatgcatgatg

SEQ ID NO: 5875117 - DNA, 16 bp, Homo sapiens
cctctgagcaactgtg

SEQ ID NO: 5875118 - DNA, 22 bp, Homo sapiens
cctctgagcaactgtgcagcac

SEQ ID NO: 5875119 - DNA, 23 bp, Homo sapiens
cctctgagcagcctctgccaggc

SEQ ID NO: 5875120 - DNA, 13 bp, Homo sapiens
cctctgagccagg

SEQ ID NO: 5875121 - DNA, 12 bp, Homo sapiens
cctctgagccca

SEQ ID NO: 5875122 - DNA, 14 bp, Homo sapiens
cctctgagcccaag

SEQ ID NO: 5875123 - DNA, 13 bp, Homo sapiens
cctctgagcccag

SEQ ID NO: 5875124 - DNA, 14 bp, Homo sapiens
cctctgagcccagc

SEQ ID NO: 5875125 - DNA, 16 bp, Homo sapiens
cctctgagcccagctg

SEQ ID NO: 5875126 - DNA, 20 bp, Homo sapiens
cctctgagcccagctgcctg

SEQ ID NO: 5875127 - DNA, 19 bp, Homo sapiens
cctctgagcccctgggact

SEQ ID NO: 5875128 - DNA, 11 bp, Homo sapiens
cctctgagccg

SEQ ID NO: 5875129 - DNA, 20 bp, Homo sapiens
cctctgagccgcagggcctg

SEQ ID NO: 5875130 - DNA, 12 bp, Homo sapiens
cctctgagcctt

SEQ ID NO: 5875131 - DNA, 16 bp, Homo sapiens
cctctgagccttggtg

SEQ ID NO: 5875132 - DNA, 17 bp, Homo sapiens
cctctgagctttgcatg

SEQ ID NO: 5875133 - DNA, 18 bp, Homo sapiens
cctctgaggaagcagttg

SEQ ID NO: 5875134 - DNA, 11 bp, Homo sapiens
cctctgaggac

SEQ ID NO: 5875135 - DNA, 14 bp, Homo sapiens
cctctgaggacaga

SEQ ID NO: 5875136 - DNA, 14 bp, Homo sapiens
cctctgaggagccc

SEQ ID NO: 5875137 - DNA, 21 bp, Homo sapiens
cctctgaggagcccacggggc

SEQ ID NO: 5875138 - DNA, 23 bp, Homo sapiens
cctctgaggagcccacggggcaa

SEQ ID NO: 5875139 - DNA, 21 bp, Homo sapiens
cctctgaggctcagccctgag

SEQ ID NO: 5875140 - DNA, 20 bp, Homo sapiens
cctctgagggaaagcccaga

SEQ ID NO: 5875141 - DNA, 22 bp, Homo sapiens
cctctgagggaaagcccagaaa

SEQ ID NO: 5875142 - DNA, 15 bp, Homo sapiens
cctctgatacccaga

SEQ ID NO: 5875143 - DNA, 15 bp, Homo sapiens
cctctgatacctcaa

SEQ ID NO: 5875144 - DNA, 16 bp, Homo sapiens
cctctgatcaaattgg

SEQ ID NO: 5875145 - DNA, 21 bp, Homo sapiens
cctctgatcacattcttcaaa

SEQ ID NO: 5875146 - DNA, 16 bp, Homo sapiens
cctctgatctccatgg

SEQ ID NO: 5875147 - DNA, 23 bp, Homo sapiens
cctctgattctatgtaacttgtt

SEQ ID NO: 5875148 - DNA, 15 bp, Homo sapiens
cctctgatttttcct

SEQ ID NO: 5875149 - DNA, 19 bp, Homo sapiens
cctctgcaagcttcttgct

SEQ ID NO: 5875150 - DNA, 17 bp, Homo sapiens
cctctgcaagtgctcag

SEQ ID NO: 5875151 - DNA, 18 bp, Homo sapiens
cctctgcaagtgctcagg

SEQ ID NO: 5875152 - DNA, 11 bp, Homo sapiens
cctctgcacaa

SEQ ID NO: 5875153 - DNA, 15 bp, Homo sapiens
cctctgcacaagctg

SEQ ID NO: 5875154 - DNA, 17 bp, Homo sapiens
cctctgcacgtgcacac

SEQ ID NO: 5875155 - DNA, 20 bp, Homo sapiens
cctctgcacgtgcacacacc

SEQ ID NO: 5875156 - DNA, 23 bp, Homo sapiens
cctctgcactcccctgctgggtg

SEQ ID NO: 5875157 - DNA, 16 bp, Homo sapiens
cctctgcagaatccct

SEQ ID NO: 5875158 - DNA, 18 bp, Homo sapiens
cctctgcagcaataaagc

SEQ ID NO: 5875159 - DNA, 19 bp, Homo sapiens
cctctgcagcaataaagca

SEQ ID NO: 5875160 - DNA, 23 bp, Homo sapiens
cctctgcagccggaggaggagat

SEQ ID NO: 5875161 - DNA, 14 bp, Homo sapiens
cctctgcagcctga

SEQ ID NO: 5875162 - DNA, 17 bp, Homo sapiens
cctctgcagctgacctc

SEQ ID NO: 5875163 - DNA, 22 bp, Homo sapiens
cctctgcagctgacctctgttg

SEQ ID NO: 5875164 - DNA, 19 bp, Homo sapiens
cctctgcaggacacagatc

SEQ ID NO: 5875165 - DNA, 15 bp, Homo sapiens
cctctgcagggcagc

SEQ ID NO: 5875166 - DNA, 19 bp, Homo sapiens
cctctgcagtcgcttgcca

SEQ ID NO: 5875167 - DNA, 13 bp, Homo sapiens
cctctgcagtctc

SEQ ID NO: 5875168 - DNA, 19 bp, Homo sapiens
cctctgcagtctcatttct

SEQ ID NO: 5875169 - DNA, 16 bp, Homo sapiens
cctctgcagtctctat

SEQ ID NO: 5875170 - DNA, 16 bp, Homo sapiens
cctctgcagtgccttg

SEQ ID NO: 5875171 - DNA, 19 bp, Homo sapiens
cctctgcagtgtggcaagc

SEQ ID NO: 5875172 - DNA, 16 bp, Homo sapiens
cctctgcataaatatt

SEQ ID NO: 5875173 - DNA, 19 bp, Homo sapiens
cctctgccaaaggatgtga

SEQ ID NO: 5875174 - DNA, 13 bp, Homo sapiens
cctctgccacact

SEQ ID NO: 5875175 - DNA, 18 bp, Homo sapiens
cctctgccacactctgac

SEQ ID NO: 5875176 - DNA, 13 bp, Homo sapiens
cctctgccacagc

SEQ ID NO: 5875177 - DNA, 11 bp, Homo sapiens
cctctgccacc

SEQ ID NO: 5875178 - DNA, 14 bp, Homo sapiens
cctctgccacctcc

SEQ ID NO: 5875179 - DNA, 15 bp, Homo sapiens
cctctgccacctccc

SEQ ID NO: 5875180 - DNA, 20 bp, Homo sapiens
cctctgccacctcccctatc

SEQ ID NO: 5875181 - DNA, 17 bp, Homo sapiens
cctctgccactgacagg

SEQ ID NO: 5875182 - DNA, 19 bp, Homo sapiens
cctctgccactgacaggaa

SEQ ID NO: 5875183 - DNA, 23 bp, Homo sapiens
cctctgccagaagatcccctcag

SEQ ID NO: 5875184 - DNA, 15 bp, Homo sapiens
cctctgccagcagga

SEQ ID NO: 5875185 - DNA, 18 bp, Homo sapiens
cctctgccagcaggaata

SEQ ID NO: 5875186 - DNA, 20 bp, Homo sapiens
cctctgccagcaggaataaa

SEQ ID NO: 5875187 - DNA, 22 bp, Homo sapiens
cctctgccagcaggaataaaga

SEQ ID NO: 5875188 - DNA, 14 bp, Homo sapiens
cctctgccagcgcc

SEQ ID NO: 5875189 - DNA, 16 bp, Homo sapiens
cctctgccaggcctgt

SEQ ID NO: 5875190 - DNA, 13 bp, Homo sapiens
cctctgccatcct

SEQ ID NO: 5875191 - DNA, 14 bp, Homo sapiens
cctctgccatgccc

SEQ ID NO: 5875192 - DNA, 16 bp, Homo sapiens
cctctgccatgcccag

SEQ ID NO: 5875193 - DNA, 19 bp, Homo sapiens
cctctgccatgcccagaga

SEQ ID NO: 5875194 - DNA, 14 bp, Homo sapiens
cctctgccatgttt

SEQ ID NO: 5875195 - DNA, 13 bp, Homo sapiens
cctctgcccactc

SEQ ID NO: 5875196 - DNA, 16 bp, Homo sapiens
cctctgcccactccct

SEQ ID NO: 5875197 - DNA, 19 bp, Homo sapiens
cctctgcccactccctgca

SEQ ID NO: 5875198 - DNA, 20 bp, Homo sapiens
cctctgcccactccctgcaa

SEQ ID NO: 5875199 - DNA, 18 bp, Homo sapiens
cctctgcccagcttgggc

SEQ ID NO: 5875200 - DNA, 22 bp, Homo sapiens
cctctgcccaggcactgctagg

SEQ ID NO: 5875201 - DNA, 13 bp, Homo sapiens
cctctgcccaggg

SEQ ID NO: 5875202 - DNA, 19 bp, Homo sapiens
cctctgccccaagcagcca

SEQ ID NO: 5875203 - DNA, 15 bp, Homo sapiens
cctctgccccaaggg

SEQ ID NO: 5875204 - DNA, 19 bp, Homo sapiens
cctctgccccaaggggccc

SEQ ID NO: 5875205 - DNA, 22 bp, Homo sapiens
cctctgccccaaggggcccaca

SEQ ID NO: 5875206 - DNA, 15 bp, Homo sapiens
cctctgccccctccc

SEQ ID NO: 5875207 - DNA, 19 bp, Homo sapiens
cctctgccccctcccccgc

SEQ ID NO: 5875208 - DNA, 16 bp, Homo sapiens
cctctgcccctgcagc

SEQ ID NO: 5875209 - DNA, 19 bp, Homo sapiens
cctctgcccctgcagctgg

SEQ ID NO: 5875210 - DNA, 13 bp, Homo sapiens
cctctgccccttg

SEQ ID NO: 5875211 - DNA, 21 bp, Homo sapiens
cctctgccccttgggcctccc

SEQ ID NO: 5875212 - DNA, 14 bp, Homo sapiens
cctctgcccgcaga

SEQ ID NO: 5875213 - DNA, 17 bp, Homo sapiens
cctctgcccgcagagcc

SEQ ID NO: 5875214 - DNA, 23 bp, Homo sapiens
cctctgccctcattactgggcct

SEQ ID NO: 5875215 - DNA, 13 bp, Homo sapiens
cctctgccctctg

SEQ ID NO: 5875216 - DNA, 16 bp, Homo sapiens
cctctgccctctgctc

SEQ ID NO: 5875217 - DNA, 16 bp, Homo sapiens
cctctgccctgcctcc

SEQ ID NO: 5875218 - DNA, 13 bp, Homo sapiens
cctctgccctgcg

SEQ ID NO: 5875219 - DNA, 14 bp, Homo sapiens
cctctgccctgcgg

SEQ ID NO: 5875220 - DNA, 15 bp, Homo sapiens
cctctgccctggatt

SEQ ID NO: 5875221 - DNA, 13 bp, Homo sapiens
cctctgccctgta

SEQ ID NO: 5875222 - DNA, 12 bp, Homo sapiens
cctctgcccttc

SEQ ID NO: 5875223 - DNA, 16 bp, Homo sapiens
cctctgcccttcccct

SEQ ID NO: 5875224 - DNA, 15 bp, Homo sapiens
cctctgcccttgggg

SEQ ID NO: 5875225 - DNA, 19 bp, Homo sapiens
cctctgccgaccgcctgct

SEQ ID NO: 5875226 - DNA, 16 bp, Homo sapiens
cctctgccgctgccat

SEQ ID NO: 5875227 - DNA, 17 bp, Homo sapiens
cctctgccgctgccatg

SEQ ID NO: 5875228 - DNA, 22 bp, Homo sapiens
cctctgccggtcccccatgcca

SEQ ID NO: 5875229 - DNA, 19 bp, Homo sapiens
cctctgccggtcgggcagc

SEQ ID NO: 5875230 - DNA, 11 bp, Homo sapiens
cctctgcctca

SEQ ID NO: 5875231 - DNA, 14 bp, Homo sapiens
cctctgcctcaatg

SEQ ID NO: 5875232 - DNA, 21 bp, Homo sapiens
cctctgcctcatcctcctcct

SEQ ID NO: 5875233 - DNA, 11 bp, Homo sapiens
cctctgcctcc

SEQ ID NO: 5875234 - DNA, 14 bp, Homo sapiens
cctctgcctccacc

SEQ ID NO: 5875235 - DNA, 18 bp, Homo sapiens
cctctgcctccaccctcc

SEQ ID NO: 5875236 - DNA, 13 bp, Homo sapiens
cctctgcctccca

SEQ ID NO: 5875237 - DNA, 18 bp, Homo sapiens
cctctgcctcccaaagtg

SEQ ID NO: 5875238 - DNA, 15 bp, Homo sapiens
cctctgcctcccagg

SEQ ID NO: 5875239 - DNA, 20 bp, Homo sapiens
cctctgcctctgacacacag

SEQ ID NO: 5875240 - DNA, 21 bp, Homo sapiens
cctctgcctgaaccttccatc

SEQ ID NO: 5875241 - DNA, 19 bp, Homo sapiens
cctctgcctgacagcatcc

SEQ ID NO: 5875242 - DNA, 21 bp, Homo sapiens
cctctgcctgacagcatcctc

SEQ ID NO: 5875243 - DNA, 14 bp, Homo sapiens
cctctgcctgcact

SEQ ID NO: 5875244 - DNA, 12 bp, Homo sapiens
cctctgcctgcc

SEQ ID NO: 5875245 - DNA, 21 bp, Homo sapiens
cctctgcctgccccgccccca

SEQ ID NO: 5875246 - DNA, 13 bp, Homo sapiens
cctctgcctgctg

SEQ ID NO: 5875247 - DNA, 14 bp, Homo sapiens
cctctgcctgctgg

SEQ ID NO: 5875248 - DNA, 11 bp, Homo sapiens
cctctgcctgg

SEQ ID NO: 5875249 - DNA, 12 bp, Homo sapiens
cctctgcctggg

SEQ ID NO: 5875250 - DNA, 18 bp, Homo sapiens
cctctgcctgggatgccc

SEQ ID NO: 5875251 - DNA, 22 bp, Homo sapiens
cctctgcctgggatgcccttcc

SEQ ID NO: 5875252 - DNA, 14 bp, Homo sapiens
cctctgcctggggc

SEQ ID NO: 5875253 - DNA, 12 bp, Homo sapiens
cctctgcctgtc

SEQ ID NO: 5875254 - DNA, 15 bp, Homo sapiens
cctcttggccatcct

SEQ ID NO: 5875255 - DNA, 13 bp, Homo sapiens
cctcttggcttct

SEQ ID NO: 5875256 - DNA, 16 bp, Homo sapiens
cctcttggcttctcag

SEQ ID NO: 5875257 - DNA, 17 bp, Homo sapiens
cctcttggctttgttga

SEQ ID NO: 5875258 - DNA, 23 bp, Homo sapiens
cctcttggggagtttagggtggg

SEQ ID NO: 5875259 - DNA, 14 bp, Homo sapiens
cctcttggtgggtg

SEQ ID NO: 5875260 - DNA, 22 bp, Homo sapiens
cctcttggtgtgattgcacaga

SEQ ID NO: 5875261 - DNA, 16 bp, Homo sapiens
cctcttgtaaagactg

SEQ ID NO: 5875262 - DNA, 14 bp, Homo sapiens
cctcttgtaaataa

SEQ ID NO: 5875263 - DNA, 13 bp, Homo sapiens
cctcttgtagcca

SEQ ID NO: 5875264 - DNA, 12 bp, Homo sapiens
cctcttgtcagt

SEQ ID NO: 5875265 - DNA, 12 bp, Homo sapiens
cctcttgtccct

SEQ ID NO: 5875266 - DNA, 19 bp, Homo sapiens
cctcttgtccctttcccta

SEQ ID NO: 5875267 - DNA, 17 bp, Homo sapiens
cctcttgtcctggccct

SEQ ID NO: 5875268 - DNA, 18 bp, Homo sapiens
cctcttgtcctggccctt

SEQ ID NO: 5875269 - DNA, 20 bp, Homo sapiens
cctcttgtcctggcccttca

SEQ ID NO: 5875270 - DNA, 19 bp, Homo sapiens
cctcttgtcttcctatttc

SEQ ID NO: 5875271 - DNA, 21 bp, Homo sapiens
cctcttgtgcaaggtggcctt

SEQ ID NO: 5875272 - DNA, 22 bp, Homo sapiens
cctcttgtgcaaggtggccttt

SEQ ID NO: 5875273 - DNA, 13 bp, Homo sapiens
cctcttgtgtaac

SEQ ID NO: 5875274 - DNA, 20 bp, Homo sapiens
cctcttgtgtaactaatttg

SEQ ID NO: 5875275 - DNA, 22 bp, Homo sapiens
cctcttgtgtaactaatttgtg

SEQ ID NO: 5875276 - DNA, 18 bp, Homo sapiens
cctcttgttactccctgt

SEQ ID NO: 5875277 - DNA, 18 bp, Homo sapiens
cctcttgttcctgaaatg

SEQ ID NO: 5875278 - DNA, 21 bp, Homo sapiens
cctcttgttcttagggcttgg

SEQ ID NO: 5875279 - DNA, 13 bp, Homo sapiens
cctcttgtttctg

SEQ ID NO: 5875280 - DNA, 16 bp, Homo sapiens
cctcttgtttctgtgc

SEQ ID NO: 5875281 - DNA, 15 bp, Homo sapiens
cctctttaaaacaaa

SEQ ID NO: 5875282 - DNA, 21 bp, Homo sapiens
cctctttaatgctgtctttgt

SEQ ID NO: 5875283 - DNA, 23 bp, Homo sapiens
cctctttactcccttcctggcct

SEQ ID NO: 5875284 - DNA, 23 bp, Homo sapiens
cctctttagtttttggttgggaa

SEQ ID NO: 5875285 - DNA, 15 bp, Homo sapiens
cctctttcagctcct

SEQ ID NO: 5875286 - DNA, 16 bp, Homo sapiens
cctctttcagctcctg

SEQ ID NO: 5875287 - DNA, 18 bp, Homo sapiens
cctctttcagctcctgac

SEQ ID NO: 5875288 - DNA, 13 bp, Homo sapiens
cctctttcatcca

SEQ ID NO: 5875289 - DNA, 22 bp, Homo sapiens
cctctttcatctgtaagggact

SEQ ID NO: 5875290 - DNA, 19 bp, Homo sapiens
cctctttcccaccctccac

SEQ ID NO: 5875291 - DNA, 21 bp, Homo sapiens
cctctttccccacctcttcct

SEQ ID NO: 5875292 - DNA, 16 bp, Homo sapiens
cctctttccccactga

SEQ ID NO: 5875293 - DNA, 16 bp, Homo sapiens
cctctttccctgcgag

SEQ ID NO: 5875294 - DNA, 17 bp, Homo sapiens
cctctttcctcctcatg

SEQ ID NO: 5875295 - DNA, 19 bp, Homo sapiens
cctctttcctcctcatgaa

SEQ ID NO: 5875296 - DNA, 19 bp, Homo sapiens
cctctttcctgtgccagga

SEQ ID NO: 5875297 - DNA, 17 bp, Homo sapiens
cctctttcggaaatgat

SEQ ID NO: 5875298 - DNA, 15 bp, Homo sapiens
cctctttctacagcc

SEQ ID NO: 5875299 - DNA, 16 bp, Homo sapiens
cctctttctagcctgg

SEQ ID NO: 5875300 - DNA, 14 bp, Homo sapiens
cctctttctccagc

SEQ ID NO: 5875301 - DNA, 13 bp, Homo sapiens
cctctttctctct

SEQ ID NO: 5875302 - DNA, 14 bp, Homo sapiens
cctctttctctctg

SEQ ID NO: 5875303 - DNA, 16 bp, Homo sapiens
cctctttctctctgtg

SEQ ID NO: 5875304 - DNA, 21 bp, Homo sapiens
cctctttctctctgtgtggca

SEQ ID NO: 5875305 - DNA, 11 bp, Homo sapiens
cctctttctgc

SEQ ID NO: 5875306 - DNA, 15 bp, Homo sapiens
cctctttctgctctg

SEQ ID NO: 5875307 - DNA, 19 bp, Homo sapiens
cctctttctgctctgccat

SEQ ID NO: 5875308 - DNA, 22 bp, Homo sapiens
cctctttctgctctgccatctt

SEQ ID NO: 5875309 - DNA, 23 bp, Homo sapiens
cctctttcttgtttgtcagcatc

SEQ ID NO: 5875310 - DNA, 19 bp, Homo sapiens
cctctttgaacatggtcta

SEQ ID NO: 5875311 - DNA, 14 bp, Homo sapiens
cctctttgacattt

SEQ ID NO: 5875312 - DNA, 21 bp, Homo sapiens
cctctttgacatttttgccaa

SEQ ID NO: 5875313 - DNA, 22 bp, Homo sapiens
cctctttgagaccccagtgcct

SEQ ID NO: 5875314 - DNA, 23 bp, Homo sapiens
cctctttgagaccccagtgcctg

SEQ ID NO: 5875315 - DNA, 15 bp, Homo sapiens
cctctttgagtgaag

SEQ ID NO: 5875316 - DNA, 14 bp, Homo sapiens
cctctttgcacagc

SEQ ID NO: 5875317 - DNA, 17 bp, Homo sapiens
cctctttgcctgtgtga

SEQ ID NO: 5875318 - DNA, 21 bp, Homo sapiens
cctctttgcctgtgtgagcat

SEQ ID NO: 5875319 - DNA, 16 bp, Homo sapiens
cctctttgcgtttcct

SEQ ID NO: 5875320 - DNA, 11 bp, Homo sapiens
cctctttgctc

SEQ ID NO: 5875321 - DNA, 14 bp, Homo sapiens
cctctttgctgcag

SEQ ID NO: 5875322 - DNA, 19 bp, Homo sapiens
cctctttggctcccctgta

SEQ ID NO: 5875323 - DNA, 13 bp, Homo sapiens
cctctttgggcag

SEQ ID NO: 5875324 - DNA, 17 bp, Homo sapiens
cctctttgtaataaaat

SEQ ID NO: 5875325 - DNA, 20 bp, Homo sapiens
cctctttgtgtttttgttgt

SEQ ID NO: 5875326 - DNA, 21 bp, Homo sapiens
cctcttttacctgctgcttct

SEQ ID NO: 5875327 - DNA, 22 bp, Homo sapiens
cctcttttcacattttttttct

SEQ ID NO: 5875328 - DNA, 17 bp, Homo sapiens
cctcttttccctctcta

SEQ ID NO: 5875329 - DNA, 18 bp, Homo sapiens
cctcttttccctctctag

SEQ ID NO: 5875330 - DNA, 17 bp, Homo sapiens
cctcttttcctgaagaa

SEQ ID NO: 5875331 - DNA, 19 bp, Homo sapiens
cctcttttcctggcagctg

SEQ ID NO: 5875332 - DNA, 21 bp, Homo sapiens
cctcttttcctggcagctgct

SEQ ID NO: 5875333 - DNA, 17 bp, Homo sapiens
cctcttttccttcccaa

SEQ ID NO: 5875334 - DNA, 15 bp, Homo sapiens
cctcttttcttactc

SEQ ID NO: 5875335 - DNA, 22 bp, Homo sapiens
cctcttttcttactcctcctct

SEQ ID NO: 5875336 - DNA, 24 bp, Homo sapiens
cctcttttgcttgccaaagtacag

SEQ ID NO: 5875337 - DNA, 15 bp, Homo sapiens
cctcttttggccttg

SEQ ID NO: 5875338 - DNA, 11 bp, Homo sapiens
cctcttttgta

SEQ ID NO: 5875339 - DNA, 22 bp, Homo sapiens
cctcttttgtattgtttctaca

SEQ ID NO: 5875340 - DNA, 12 bp, Homo sapiens
cctcttttgtgc

SEQ ID NO: 5875341 - DNA, 17 bp, Homo sapiens
cctctttttaaggacac

SEQ ID NO: 5875342 - DNA, 23 bp, Homo sapiens
cctctttttacttggaaataata

SEQ ID NO: 5875343 - DNA, 23 bp, Homo sapiens
cctctttttccaacttggctgca

SEQ ID NO: 5875344 - DNA, 13 bp, Homo sapiens
cctctttttcctc

SEQ ID NO: 5875345 - DNA, 14 bp, Homo sapiens
cctctttttcctcc

SEQ ID NO: 5875346 - DNA, 18 bp, Homo sapiens
cctctttttcctcctgga

SEQ ID NO: 5875347 - DNA, 16 bp, Homo sapiens
cctctttttccttctt

SEQ ID NO: 5875348 - DNA, 20 bp, Homo sapiens
cctctttttccttcttcagc

SEQ ID NO: 5875349 - DNA, 20 bp, Homo sapiens
cctctttttctgtgtgaggt

SEQ ID NO: 5875350 - DNA, 17 bp, Homo sapiens
cctctttttgcccttta

SEQ ID NO: 5875351 - DNA, 22 bp, Homo sapiens
cctgaaaaactgatcaaaaata

SEQ ID NO: 5875352 - DNA, 20 bp, Homo sapiens
cctgaaaaatgactgtccca

SEQ ID NO: 5875353 - DNA, 13 bp, Homo sapiens
cctgaaaacccag

SEQ ID NO: 5875354 - DNA, 21 bp, Homo sapiens
cctgaaaagatgttgtgtctt

SEQ ID NO: 5875355 - DNA, 23 bp, Homo sapiens
cctgaaaagctgcatttaaatca

SEQ ID NO: 5875356 - DNA, 20 bp, Homo sapiens
cctgaaaagggcggaagagt

SEQ ID NO: 5875357 - DNA, 22 bp, Homo sapiens
cctgaaaaggtttatgaaaaag

SEQ ID NO: 5875358 - DNA, 12 bp, Homo sapiens
cctgaaaatatc

SEQ ID NO: 5875359 - DNA, 14 bp, Homo sapiens
cctgaaaatgttac

SEQ ID NO: 5875360 - DNA, 11 bp, Homo sapiens
cctgaaaattc

SEQ ID NO: 5875361 - DNA, 14 bp, Homo sapiens
cctgaaaattccaa

SEQ ID NO: 5875362 - DNA, 16 bp, Homo sapiens
cctgaaaattccaatt

SEQ ID NO: 5875363 - DNA, 13 bp, Homo sapiens
cctgaaaattgta

SEQ ID NO: 5875364 - DNA, 16 bp, Homo sapiens
cctgaaacactgcttc

SEQ ID NO: 5875365 - DNA, 16 bp, Homo sapiens
cctgaaacactggacc

SEQ ID NO: 5875366 - DNA, 19 bp, Homo sapiens
cctgaaacatgtgcccctg

SEQ ID NO: 5875367 - DNA, 22 bp, Homo sapiens
cctgaaacccgccctcaggggc

SEQ ID NO: 5875368 - DNA, 18 bp, Homo sapiens
cctgaaacctcttcctag

SEQ ID NO: 5875369 - DNA, 15 bp, Homo sapiens
cctgaaacttatttt

SEQ ID NO: 5875370 - DNA, 13 bp, Homo sapiens
cctgaaactttga

SEQ ID NO: 5875371 - DNA, 19 bp, Homo sapiens
cctgaaactttgaggataa

SEQ ID NO: 5875372 - DNA, 15 bp, Homo sapiens
cctgaaagaggctga

SEQ ID NO: 5875373 - DNA, 22 bp, Homo sapiens
cctgaaagaggctgaggcctgg

SEQ ID NO: 5875374 - DNA, 19 bp, Homo sapiens
cctgaaagccagcaaagcc

SEQ ID NO: 5875375 - DNA, 18 bp, Homo sapiens
cctgaaagccctgagctt

SEQ ID NO: 5875376 - DNA, 21 bp, Homo sapiens
cctgaaagcccttctcaagac

SEQ ID NO: 5875377 - DNA, 20 bp, Homo sapiens
cctgaaagcctgtctctttc

SEQ ID NO: 5875378 - DNA, 15 bp, Homo sapiens
cctgaaagcggctgc

SEQ ID NO: 5875379 - DNA, 17 bp, Homo sapiens
cctgaaagcggctgcct

SEQ ID NO: 5875380 - DNA, 21 bp, Homo sapiens
cctgaaagcggctgcctccat

SEQ ID NO: 5875381 - DNA, 13 bp, Homo sapiens
cctgaaaggcaac

SEQ ID NO: 5875382 - DNA, 19 bp, Homo sapiens
cctgaaagtaatttcaaga

SEQ ID NO: 5875383 - DNA, 18 bp, Homo sapiens
cctgaaagtgacagagac

SEQ ID NO: 5875384 - DNA, 23 bp, Homo sapiens
cctgaaagtgacagagacccaga

SEQ ID NO: 5875385 - DNA, 21 bp, Homo sapiens
cctgaaagttggggcccagtc

SEQ ID NO: 5875386 - DNA, 21 bp, Homo sapiens
cctgaaatataaactgtagcg

SEQ ID NO: 5875387 - DNA, 17 bp, Homo sapiens
cctgaaatatattttaa

SEQ ID NO: 5875388 - DNA, 16 bp, Homo sapiens
cctgaaatatccagga

SEQ ID NO: 5875389 - DNA, 21 bp, Homo sapiens
cctgaaatcatatagaaaggc

SEQ ID NO: 5875390 - DNA, 15 bp, Homo sapiens
cctgaaatcctggtt

SEQ ID NO: 5875391 - DNA, 20 bp, Homo sapiens
cctgaaatggcctgtcccta

SEQ ID NO: 5875392 - DNA, 18 bp, Homo sapiens
cctgaaatgtgtgtgatg

SEQ ID NO: 5875393 - DNA, 12 bp, Homo sapiens
cctgaaattaat

SEQ ID NO: 5875394 - DNA, 18 bp, Homo sapiens
cctgaaattaatttgtga

SEQ ID NO: 5875395 - DNA, 19 bp, Homo sapiens
cctgaaattaatttgtgaa

SEQ ID NO: 5875396 - DNA, 23 bp, Homo sapiens
cctgaaattaatttgtgaatttg

SEQ ID NO: 5875397 - DNA, 14 bp, Homo sapiens
cctgaaattccaaa

SEQ ID NO: 5875398 - DNA, 21 bp, Homo sapiens
cctgaaattttaaaaaagttg

SEQ ID NO: 5875399 - DNA, 23 bp, Homo sapiens
cctgaacaaagcacctcaagtgc

SEQ ID NO: 5875400 - DNA, 13 bp, Homo sapiens
cctgaacaagaaa

SEQ ID NO: 5875401 - DNA, 21 bp, Homo sapiens
cctgaacaagaattggaagct

SEQ ID NO: 5875402 - DNA, 13 bp, Homo sapiens
cctgaacagctgg

SEQ ID NO: 5875403 - DNA, 15 bp, Homo sapiens
cctgaacaggaatcc

SEQ ID NO: 5875404 - DNA, 20 bp, Homo sapiens
cctgaacaggatattctcac

SEQ ID NO: 5875405 - DNA, 18 bp, Homo sapiens
cctgaacatggcagtcta

SEQ ID NO: 5875406 - DNA, 22 bp, Homo sapiens
cctgaacatttagtaccctgca

SEQ ID NO: 5875407 - DNA, 18 bp, Homo sapiens
cctgaaccacgaggctgc

SEQ ID NO: 5875408 - DNA, 20 bp, Homo sapiens
cctgaaccacgaggctgccc

SEQ ID NO: 5875409 - DNA, 22 bp, Homo sapiens
cctgaaccacgaggctgccccc

SEQ ID NO: 5875410 - DNA, 23 bp, Homo sapiens
cctgaaccacgaggctgccccca

SEQ ID NO: 5875411 - DNA, 18 bp, Homo sapiens
cctgaaccagtcctgctg

SEQ ID NO: 5875412 - DNA, 19 bp, Homo sapiens
cctgaaccagtcctgctgc

SEQ ID NO: 5875413 - DNA, 20 bp, Homo sapiens
cctgaaccagtcctgctgcc

SEQ ID NO: 5875414 - DNA, 16 bp, Homo sapiens
cctgaacccacacctg

SEQ ID NO: 5875415 - DNA, 16 bp, Homo sapiens
cctgaaccccagggct

SEQ ID NO: 5875416 - DNA, 18 bp, Homo sapiens
cctgaaccccagggctgt

SEQ ID NO: 5875417 - DNA, 15 bp, Homo sapiens
cctgaaccccatggg

SEQ ID NO: 5875418 - DNA, 16 bp, Homo sapiens
cctgaacccctggcca

SEQ ID NO: 5875419 - DNA, 15 bp, Homo sapiens
cctgaaccgcacagc

SEQ ID NO: 5875420 - DNA, 22 bp, Homo sapiens
cctgaaccgcacagctcaggag

SEQ ID NO: 5875421 - DNA, 17 bp, Homo sapiens
cctgaaccgcaccccat

SEQ ID NO: 5875422 - DNA, 16 bp, Homo sapiens
cctgaaccgtgtgctc

SEQ ID NO: 5875423 - DNA, 14 bp, Homo sapiens
cctgaacctcagtt

SEQ ID NO: 5875424 - DNA, 18 bp, Homo sapiens
cctgaacctcagtttcct

SEQ ID NO: 5875425 - DNA, 15 bp, Homo sapiens
cctgaaccttcctgt

SEQ ID NO: 5875426 - DNA, 18 bp, Homo sapiens
cctgaaccttcctgtctc

SEQ ID NO: 5875427 - DNA, 23 bp, Homo sapiens
cctgaaccttcctgtctcccagg

SEQ ID NO: 5875428 - DNA, 16 bp, Homo sapiens
cctgaacgttttcttc

SEQ ID NO: 5875429 - DNA, 21 bp, Homo sapiens
cctgaacgttttcttctttcc

SEQ ID NO: 5875430 - DNA, 23 bp, Homo sapiens
cctgacctacctggcccctgagc

SEQ ID NO: 5875431 - DNA, 18 bp, Homo sapiens
cctgacctcaagcaacca

SEQ ID NO: 5875432 - DNA, 14 bp, Homo sapiens
cctgacctcaagtg

SEQ ID NO: 5875433 - DNA, 13 bp, Homo sapiens
cctgacctcaggt

SEQ ID NO: 5875434 - DNA, 21 bp, Homo sapiens
cctgacctcatgatccaccca

SEQ ID NO: 5875435 - DNA, 12 bp, Homo sapiens
cctgacctccag

SEQ ID NO: 5875436 - DNA, 13 bp, Homo sapiens
cctgacctccagt

SEQ ID NO: 5875437 - DNA, 21 bp, Homo sapiens
cctgacctccagtcctgctgg

SEQ ID NO: 5875438 - DNA, 14 bp, Homo sapiens
cctgacctcccagc

SEQ ID NO: 5875439 - DNA, 17 bp, Homo sapiens
cctgacctccccctcct

SEQ ID NO: 5875440 - DNA, 19 bp, Homo sapiens
cctgacctccccctccttc

SEQ ID NO: 5875441 - DNA, 16 bp, Homo sapiens
cctgacctccctctaa

SEQ ID NO: 5875442 - DNA, 22 bp, Homo sapiens
cctgacctcgtgatgggcccgc

SEQ ID NO: 5875443 - DNA, 23 bp, Homo sapiens
cctgacctcgtgatgggcccgcc

SEQ ID NO: 5875444 - DNA, 18 bp, Homo sapiens
cctgacctcttgctgcca

SEQ ID NO: 5875445 - DNA, 19 bp, Homo sapiens
cctgacctcttgctgccag

SEQ ID NO: 5875446 - DNA, 17 bp, Homo sapiens
cctgacctcttgctgtc

SEQ ID NO: 5875447 - DNA, 19 bp, Homo sapiens
cctgacctcttgctgtctc

SEQ ID NO: 5875448 - DNA, 12 bp, Homo sapiens
cctgacctgaga

SEQ ID NO: 5875449 - DNA, 14 bp, Homo sapiens
cctgacctgaggct

SEQ ID NO: 5875450 - DNA, 14 bp, Homo sapiens
cctgacctggcccc

SEQ ID NO: 5875451 - DNA, 14 bp, Homo sapiens
cctgacctgtccag

SEQ ID NO: 5875452 - DNA, 15 bp, Homo sapiens
cctgacctgtccagg

SEQ ID NO: 5875453 - DNA, 20 bp, Homo sapiens
cctgacctgtgagcccagct

SEQ ID NO: 5875454 - DNA, 21 bp, Homo sapiens
cctgacctgtgagcccagctg

SEQ ID NO: 5875455 - DNA, 19 bp, Homo sapiens
cctgaccttagcgttctgg

SEQ ID NO: 5875456 - DNA, 20 bp, Homo sapiens
cctgaccttagcgttctgga

SEQ ID NO: 5875457 - DNA, 14 bp, Homo sapiens
cctgaccttctcca

SEQ ID NO: 5875458 - DNA, 16 bp, Homo sapiens
cctgaccttctccagg

SEQ ID NO: 5875459 - DNA, 18 bp, Homo sapiens
cctgaccttctccaggga

SEQ ID NO: 5875460 - DNA, 21 bp, Homo sapiens
cctgaccttctccagggacag

SEQ ID NO: 5875461 - DNA, 22 bp, Homo sapiens
cctgaccttgaggagtcttgtg

SEQ ID NO: 5875462 - DNA, 18 bp, Homo sapiens
cctgacgccctgcgttgg

SEQ ID NO: 5875463 - DNA, 22 bp, Homo sapiens
cctgacgccctgcgttggagcc

SEQ ID NO: 5875464 - DNA, 13 bp, Homo sapiens
cctgacgctcagc

SEQ ID NO: 5875465 - DNA, 15 bp, Homo sapiens
cctgacgctcagccc

SEQ ID NO: 5875466 - DNA, 16 bp, Homo sapiens
cctgacgctcagcccc

SEQ ID NO: 5875467 - DNA, 20 bp, Homo sapiens
cctgacggcgcccccagtgt

SEQ ID NO: 5875468 - DNA, 16 bp, Homo sapiens
cctgacgtctgccacc

SEQ ID NO: 5875469 - DNA, 21 bp, Homo sapiens
cctgacgttaggaccaggaga

SEQ ID NO: 5875470 - DNA, 16 bp, Homo sapiens
cctgactaaactacca

SEQ ID NO: 5875471 - DNA, 23 bp, Homo sapiens
cctgactaaactaccacctcagg

SEQ ID NO: 5875472 - DNA, 21 bp, Homo sapiens
cctgactagaactcctgtctt

SEQ ID NO: 5875473 - DNA, 17 bp, Homo sapiens
cctgactaggaaaagtt

SEQ ID NO: 5875474 - DNA, 19 bp, Homo sapiens
cctgactagggagccatgt

SEQ ID NO: 5875475 - DNA, 19 bp, Homo sapiens
cctgactaggttctgtaga

SEQ ID NO: 5875476 - DNA, 23 bp, Homo sapiens
cctgactattatgttgttagaga

SEQ ID NO: 5875477 - DNA, 17 bp, Homo sapiens
cctgactcaattatttg

SEQ ID NO: 5875478 - DNA, 13 bp, Homo sapiens
cctgactcattct

SEQ ID NO: 5875479 - DNA, 14 bp, Homo sapiens
cctgactcccatgc

SEQ ID NO: 5875480 - DNA, 19 bp, Homo sapiens
cctgactcccccagtcccc

SEQ ID NO: 5875481 - DNA, 17 bp, Homo sapiens
cctgactcctctggctt

SEQ ID NO: 5875482 - DNA, 14 bp, Homo sapiens
cctgactcctggac

SEQ ID NO: 5875483 - DNA, 16 bp, Homo sapiens
cctgactcctggactc

SEQ ID NO: 5875484 - DNA, 16 bp, Homo sapiens
cctgactcctgggtgg

SEQ ID NO: 5875485 - DNA, 13 bp, Homo sapiens
cctgactccttct

SEQ ID NO: 5875486 - DNA, 19 bp, Homo sapiens
cctgactctcacctgtact

SEQ ID NO: 5875487 - DNA, 15 bp, Homo sapiens
cctgactctctgtga

SEQ ID NO: 5875488 - DNA, 18 bp, Homo sapiens
cctgactctctgtgacct

SEQ ID NO: 5875489 - DNA, 18 bp, Homo sapiens
cctgactgacacaggcca

SEQ ID NO: 5875490 - DNA, 20 bp, Homo sapiens
cctgactgacacaggccagc

SEQ ID NO: 5875491 - DNA, 21 bp, Homo sapiens
cctgactgacacaggccagcc

SEQ ID NO: 5875492 - DNA, 15 bp, Homo sapiens
cctgactgacttttt

SEQ ID NO: 5875493 - DNA, 22 bp, Homo sapiens
cctgactgacttttttgcttaa

SEQ ID NO: 5875494 - DNA, 12 bp, Homo sapiens
cctgactgcaca

SEQ ID NO: 5875495 - DNA, 15 bp, Homo sapiens
cctgactgccaggac

SEQ ID NO: 5875496 - DNA, 23 bp, Homo sapiens
cctgactgccaggaccccaggtc

SEQ ID NO: 5875497 - DNA, 16 bp, Homo sapiens
cctgactgctcggtca

SEQ ID NO: 5875498 - DNA, 13 bp, Homo sapiens
cctgactgggaag

SEQ ID NO: 5875499 - DNA, 14 bp, Homo sapiens
cctgactgggctgg

SEQ ID NO: 5875500 - DNA, 16 bp, Homo sapiens
cctgactgggctgggt

SEQ ID NO: 5875501 - DNA, 18 bp, Homo sapiens
cctgactggttgtcagaa

SEQ ID NO: 5875502 - DNA, 16 bp, Homo sapiens
cctgactgtcagggag

SEQ ID NO: 5875503 - DNA, 17 bp, Homo sapiens
cctgactgtgttgtccc

SEQ ID NO: 5875504 - DNA, 13 bp, Homo sapiens
cctgactgttctc

SEQ ID NO: 5875505 - DNA, 21 bp, Homo sapiens
cctgactgttctcttactgcc

SEQ ID NO: 5875506 - DNA, 19 bp, Homo sapiens
cctgactgttgccccccag

SEQ ID NO: 5875507 - DNA, 22 bp, Homo sapiens
cctgacttagcccgtcaccctt

SEQ ID NO: 5875508 - DNA, 16 bp, Homo sapiens
cctgacttcacatctg

SEQ ID NO: 5875509 - DNA, 21 bp, Homo sapiens
cctgacttcagtgaatatttt

SEQ ID NO: 5875510 - DNA, 16 bp, Homo sapiens
cctgacttcccagctg

SEQ ID NO: 5875511 - DNA, 20 bp, Homo sapiens
cctgacttcccagctggcag

SEQ ID NO: 5875512 - DNA, 23 bp, Homo sapiens
cctgacttctggagatggatcct

SEQ ID NO: 5875513 - DNA, 12 bp, Homo sapiens
cctgacttgagc

SEQ ID NO: 5875514 - DNA, 13 bp, Homo sapiens
cctgacttgagcc

SEQ ID NO: 5875515 - DNA, 23 bp, Homo sapiens
cctgacttgagtgttccttttta

SEQ ID NO: 5875516 - DNA, 24 bp, Homo sapiens
cctgacttggctggggaggaccag

SEQ ID NO: 5875517 - DNA, 23 bp, Homo sapiens
cctgacttggggagatggagttc

SEQ ID NO: 5875518 - DNA, 12 bp, Homo sapiens
cctgactttctc

SEQ ID NO: 5875519 - DNA, 16 bp, Homo sapiens
cctgactttggggaca

SEQ ID NO: 5875520 - DNA, 17 bp, Homo sapiens
cctgacttttacagctt

SEQ ID NO: 5875521 - DNA, 18 bp, Homo sapiens
cctgacttttacagcttt

SEQ ID NO: 5875522 - DNA, 19 bp, Homo sapiens
cctgacttttacagctttt

SEQ ID NO: 5875523 - DNA, 21 bp, Homo sapiens
cctgacttttacagcttttct

SEQ ID NO: 5875524 - DNA, 13 bp, Homo sapiens
cctgacttttctg

SEQ ID NO: 5875525 - DNA, 19 bp, Homo sapiens
cctgagaaacactatttgt

SEQ ID NO: 5875526 - DNA, 15 bp, Homo sapiens
cctgagaaagcccac

SEQ ID NO: 5875527 - DNA, 17 bp, Homo sapiens
cctgagaaagctcaaag

SEQ ID NO: 5875528 - DNA, 13 bp, Homo sapiens
cctgagaactgaa

SEQ ID NO: 5875529 - DNA, 20 bp, Homo sapiens
cctgagaagaagtggctgcc

SEQ ID NO: 5875530 - DNA, 17 bp, Homo sapiens
cctgagaagctgctcca

SEQ ID NO: 5875531 - DNA, 19 bp, Homo sapiens
cctgagaatgagtgggaat

SEQ ID NO: 5875532 - DNA, 21 bp, Homo sapiens
cctgagaatgcctaggccagc

SEQ ID NO: 5875533 - DNA, 13 bp, Homo sapiens
cctgagaattgag

SEQ ID NO: 5875534 - DNA, 16 bp, Homo sapiens
cctgagacagcaccac

SEQ ID NO: 5875535 - DNA, 21 bp, Homo sapiens
cctgagacagcaccactgctg

SEQ ID NO: 5875536 - DNA, 12 bp, Homo sapiens
cctgagacagtg

SEQ ID NO: 5875537 - DNA, 12 bp, Homo sapiens
cctgagaccaca

SEQ ID NO: 5875538 - DNA, 16 bp, Homo sapiens
cctgagaccagggtgg

SEQ ID NO: 5875539 - DNA, 19 bp, Homo sapiens
cctgagaccagggtggcca

SEQ ID NO: 5875540 - DNA, 20 bp, Homo sapiens
cctgagaccagggtggccac

SEQ ID NO: 5875541 - DNA, 21 bp, Homo sapiens
cctgagaccagggtggccaca

SEQ ID NO: 5875542 - DNA, 22 bp, Homo sapiens
cctgagaccagggtggccacac

SEQ ID NO: 5875543 - DNA, 21 bp, Homo sapiens
cctgagaccagttgggagcac

SEQ ID NO: 5875544 - DNA, 14 bp, Homo sapiens
cctgagacccagga

SEQ ID NO: 5875545 - DNA, 15 bp, Homo sapiens
cctgagacccctggc

SEQ ID NO: 5875546 - DNA, 20 bp, Homo sapiens
cctgagacccctggcctccg

SEQ ID NO: 5875547 - DNA, 19 bp, Homo sapiens
cctgagaccctactgaagt

SEQ ID NO: 5875548 - DNA, 13 bp, Homo sapiens
cctgagacctcaa

SEQ ID NO: 5875549 - DNA, 21 bp, Homo sapiens
cctgagactcacactctctgc

SEQ ID NO: 5875550 - DNA, 22 bp, Homo sapiens
cctgagactcacactctctgca

SEQ ID NO: 5875551 - DNA, 23 bp, Homo sapiens
cctgagactccagaatctgctgt

SEQ ID NO: 5875552 - DNA, 13 bp, Homo sapiens
cctgagactcccg

SEQ ID NO: 5875553 - DNA, 14 bp, Homo sapiens
cctgagactcccgc

SEQ ID NO: 5875554 - DNA, 12 bp, Homo sapiens
cctgagactgga

SEQ ID NO: 5875555 - DNA, 20 bp, Homo sapiens
cctgagagaaactgaggtca

SEQ ID NO: 5875556 - DNA, 18 bp, Homo sapiens
cctgagagacatggcttt

SEQ ID NO: 5875557 - DNA, 18 bp, Homo sapiens
cctgagagacctgccctc

SEQ ID NO: 5875558 - DNA, 18 bp, Homo sapiens
cctgagagatttaacatt

SEQ ID NO: 5875559 - DNA, 19 bp, Homo sapiens
cctgagagcatctcaggag

SEQ ID NO: 5875560 - DNA, 22 bp, Homo sapiens
cctgagagcatctcaggagggg

SEQ ID NO: 5875561 - DNA, 13 bp, Homo sapiens
cctgagagcctgt

SEQ ID NO: 5875562 - DNA, 17 bp, Homo sapiens
cctgagagcctgtggag

SEQ ID NO: 5875563 - DNA, 18 bp, Homo sapiens
cctgagagcctgtggagg

SEQ ID NO: 5875564 - DNA, 15 bp, Homo sapiens
cctgagagctggccc

SEQ ID NO: 5875565 - DNA, 17 bp, Homo sapiens
cctgagagctggcccag

SEQ ID NO: 5875566 - DNA, 12 bp, Homo sapiens
cctgagagctgt

SEQ ID NO: 5875567 - DNA, 12 bp, Homo sapiens
cctgagaggcag

SEQ ID NO: 5875568 - DNA, 15 bp, Homo sapiens
cctgagaggcaggca

SEQ ID NO: 5875569 - DNA, 15 bp, Homo sapiens
cctgagaggggaagc

SEQ ID NO: 5875570 - DNA, 23 bp, Homo sapiens
cctgagagtcagctctctgccct

SEQ ID NO: 5875571 - DNA, 14 bp, Homo sapiens
cctgagagtttcct

SEQ ID NO: 5875572 - DNA, 20 bp, Homo sapiens
cctgagagtttcctcagaac

SEQ ID NO: 5875573 - DNA, 17 bp, Homo sapiens
cctgagatcagagtcct

SEQ ID NO: 5875574 - DNA, 20 bp, Homo sapiens
cctgagatgaagattcatgt

SEQ ID NO: 5875575 - DNA, 20 bp, Homo sapiens
cctgagatgcaggtgatgcc

SEQ ID NO: 5875576 - DNA, 22 bp, Homo sapiens
cctgagatgctgggagggctga

SEQ ID NO: 5875577 - DNA, 17 bp, Homo sapiens
cctgagatggagctgcc

SEQ ID NO: 5875578 - DNA, 23 bp, Homo sapiens
cctgagatggatggacagacaga

SEQ ID NO: 5875579 - DNA, 16 bp, Homo sapiens
cctgagatgggccggc

SEQ ID NO: 5875580 - DNA, 21 bp, Homo sapiens
cctgagatgggcttcccaagg

SEQ ID NO: 5875581 - DNA, 22 bp, Homo sapiens
cctgagatggtatgcacaattc

SEQ ID NO: 5875582 - DNA, 14 bp, Homo sapiens
cctgagatgtgtga

SEQ ID NO: 5875583 - DNA, 16 bp, Homo sapiens
cctgagattctgggaa

SEQ ID NO: 5875584 - DNA, 21 bp, Homo sapiens
cctgagattctgggaaaggtg

SEQ ID NO: 5875585 - DNA, 16 bp, Homo sapiens
cctgagattctttaag

SEQ ID NO: 5875586 - DNA, 18 bp, Homo sapiens
cctgagattctttaagga

SEQ ID NO: 5875587 - DNA, 21 bp, Homo sapiens
cctgagattctttaaggagat

SEQ ID NO: 5875588 - DNA, 22 bp, Homo sapiens
cctgagattctttaaggagata

SEQ ID NO: 5875589 - DNA, 14 bp, Homo sapiens
cctgagatttacac

SEQ ID NO: 5875590 - DNA, 23 bp, Homo sapiens
cctgagatttattaaagaaaaaa

SEQ ID NO: 5875591 - DNA, 21 bp, Homo sapiens
cctgagcaacagagtgagacc

SEQ ID NO: 5875592 - DNA, 18 bp, Homo sapiens
cctgagcaactcttgatt

SEQ ID NO: 5875593 - DNA, 16 bp, Homo sapiens
cctgagcacctcccag

SEQ ID NO: 5875594 - DNA, 15 bp, Homo sapiens
cctgagcactcctgg

SEQ ID NO: 5875595 - DNA, 18 bp, Homo sapiens
cctgagcactgccaggag

SEQ ID NO: 5875596 - DNA, 18 bp, Homo sapiens
cctgagcagaatactggt

SEQ ID NO: 5875597 - DNA, 21 bp, Homo sapiens
cctgagcagatcgtgccgtgg

SEQ ID NO: 5875598 - DNA, 12 bp, Homo sapiens
cctgagcaggca

SEQ ID NO: 5875599 - DNA, 12 bp, Homo sapiens
cctgagcagggt

SEQ ID NO: 5875600 - DNA, 13 bp, Homo sapiens
cctgagcagggtc

SEQ ID NO: 5875601 - DNA, 15 bp, Homo sapiens
cctgagcagggtcca

SEQ ID NO: 5875602 - DNA, 16 bp, Homo sapiens
cctgagcagggtccac

SEQ ID NO: 5875603 - DNA, 16 bp, Homo sapiens
cctgagcagtccctgc

SEQ ID NO: 5875604 - DNA, 19 bp, Homo sapiens
cctgagcagtccctgctta

SEQ ID NO: 5875605 - DNA, 14 bp, Homo sapiens
cctgagcagtcctt

SEQ ID NO: 5875606 - DNA, 21 bp, Homo sapiens
cctgagcagtctacttctgtg

SEQ ID NO: 5875607 - DNA, 21 bp, Homo sapiens
cctgatggggtggaaggcatg

SEQ ID NO: 5875608 - DNA, 23 bp, Homo sapiens
cctgatggtcagctcccttctct

SEQ ID NO: 5875609 - DNA, 22 bp, Homo sapiens
cctgatggtgctgctcaggccc

SEQ ID NO: 5875610 - DNA, 13 bp, Homo sapiens
cctgatgtagctt

SEQ ID NO: 5875611 - DNA, 21 bp, Homo sapiens
cctgatgtcagctgctgttga

SEQ ID NO: 5875612 - DNA, 23 bp, Homo sapiens
cctgatgtcttaacgaataaagg

SEQ ID NO: 5875613 - DNA, 19 bp, Homo sapiens
cctgatgtcttggtttcca

SEQ ID NO: 5875614 - DNA, 21 bp, Homo sapiens
cctgatgtgtcctcagggagc

SEQ ID NO: 5875615 - DNA, 23 bp, Homo sapiens
cctgattaaaaagggagaaagaa

SEQ ID NO: 5875616 - DNA, 22 bp, Homo sapiens
cctgattaaggcgtggcttctg

SEQ ID NO: 5875617 - DNA, 21 bp, Homo sapiens
cctgattatttatccttgtct

SEQ ID NO: 5875618 - DNA, 17 bp, Homo sapiens
cctgattcactggcctg

SEQ ID NO: 5875619 - DNA, 15 bp, Homo sapiens
cctgattccaaatat

SEQ ID NO: 5875620 - DNA, 16 bp, Homo sapiens
cctgattcggacggcc

SEQ ID NO: 5875621 - DNA, 23 bp, Homo sapiens
cctgattcggggctgacctttca

SEQ ID NO: 5875622 - DNA, 19 bp, Homo sapiens
cctgattctaaaatgtctc

SEQ ID NO: 5875623 - DNA, 15 bp, Homo sapiens
cctgattcttgattc

SEQ ID NO: 5875624 - DNA, 21 bp, Homo sapiens
cctgattcttgattcctggct

SEQ ID NO: 5875625 - DNA, 21 bp, Homo sapiens
cctgattgatcacacagtgtt

SEQ ID NO: 5875626 - DNA, 23 bp, Homo sapiens
cctgattggccactggatcctgc

SEQ ID NO: 5875627 - DNA, 17 bp, Homo sapiens
cctgattggggcctcac

SEQ ID NO: 5875628 - DNA, 21 bp, Homo sapiens
cctgattggggcctcacccag

SEQ ID NO: 5875629 - DNA, 18 bp, Homo sapiens
cctgattggtttctcttc

SEQ ID NO: 5875630 - DNA, 20 bp, Homo sapiens
cctgattggtttctcttctc

SEQ ID NO: 5875631 - DNA, 15 bp, Homo sapiens
cctgattgtttacag

SEQ ID NO: 5875632 - DNA, 20 bp, Homo sapiens
cctgatttaggagaagccag

SEQ ID NO: 5875633 - DNA, 15 bp, Homo sapiens
cctgatttattctgg

SEQ ID NO: 5875634 - DNA, 17 bp, Homo sapiens
cctgatttattgaaatt

SEQ ID NO: 5875635 - DNA, 15 bp, Homo sapiens
cctgatttctcctgc

SEQ ID NO: 5875636 - DNA, 16 bp, Homo sapiens
cctgatttctctgaac

SEQ ID NO: 5875637 - DNA, 17 bp, Homo sapiens
cctgatttctctgaaca

SEQ ID NO: 5875638 - DNA, 15 bp, Homo sapiens
cctgattttgtagtt

SEQ ID NO: 5875639 - DNA, 18 bp, Homo sapiens
cctgattttttgaggcca

SEQ ID NO: 5875640 - DNA, 12 bp, Homo sapiens
cctgcaaaaaga

SEQ ID NO: 5875641 - DNA, 14 bp, Homo sapiens
cctgcaaaaatgag

SEQ ID NO: 5875642 - DNA, 19 bp, Homo sapiens
cctgcaaaactccaggcag

SEQ ID NO: 5875643 - DNA, 17 bp, Homo sapiens
cctgcaaaaggactctc

SEQ ID NO: 5875644 - DNA, 19 bp, Homo sapiens
cctgcaaaaggactctcag

SEQ ID NO: 5875645 - DNA, 18 bp, Homo sapiens
cctgcaaaatgagaccct

SEQ ID NO: 5875646 - DNA, 18 bp, Homo sapiens
cctgcaaacagaacaggg

SEQ ID NO: 5875647 - DNA, 18 bp, Homo sapiens
cctgcaaacctgctggtg

SEQ ID NO: 5875648 - DNA, 17 bp, Homo sapiens
cctgcaaaccttcctgg

SEQ ID NO: 5875649 - DNA, 19 bp, Homo sapiens
cctgcaaaccttcctggga

SEQ ID NO: 5875650 - DNA, 15 bp, Homo sapiens
cctgcaaacgctgcc

SEQ ID NO: 5875651 - DNA, 22 bp, Homo sapiens
cctgcaaacgctgcctgcccgt

SEQ ID NO: 5875652 - DNA, 14 bp, Homo sapiens
cctgcaaagacagt

SEQ ID NO: 5875653 - DNA, 17 bp, Homo sapiens
cctgcaaagcccagctt

SEQ ID NO: 5875654 - DNA, 18 bp, Homo sapiens
cctgcaaagcccagcttg

SEQ ID NO: 5875655 - DNA, 19 bp, Homo sapiens
cctgcaaagcccagcttga

SEQ ID NO: 5875656 - DNA, 15 bp, Homo sapiens
cctgcaaagctggtt

SEQ ID NO: 5875657 - DNA, 17 bp, Homo sapiens
cctgcaaaggcccttgt

SEQ ID NO: 5875658 - DNA, 19 bp, Homo sapiens
cctgcaaaggcccttgtca

SEQ ID NO: 5875659 - DNA, 23 bp, Homo sapiens
cctgcaaagtacaggtactttgt

SEQ ID NO: 5875660 - DNA, 22 bp, Homo sapiens
cctgcaaatttagtttgttaaa

SEQ ID NO: 5875661 - DNA, 18 bp, Homo sapiens
cctgcaaccactctgtgg

SEQ ID NO: 5875662 - DNA, 17 bp, Homo sapiens
cctgcaactcaaggact

SEQ ID NO: 5875663 - DNA, 20 bp, Homo sapiens
cctgcaactcaaggactttg

SEQ ID NO: 5875664 - DNA, 18 bp, Homo sapiens
cctgcaacttccgctgag

SEQ ID NO: 5875665 - DNA, 23 bp, Homo sapiens
cctgcaagaagcgccgactccct

SEQ ID NO: 5875666 - DNA, 21 bp, Homo sapiens
cctgcaagacacaggctcagc

SEQ ID NO: 5875667 - DNA, 23 bp, Homo sapiens
cctgcaagacacaggctcagcat

SEQ ID NO: 5875668 - DNA, 18 bp, Homo sapiens
cctgcaagaccacggagg

SEQ ID NO: 5875669 - DNA, 14 bp, Homo sapiens
cctgcaagagtggg

SEQ ID NO: 5875670 - DNA, 22 bp, Homo sapiens
cctgcaagagtgggctttccag

SEQ ID NO: 5875671 - DNA, 18 bp, Homo sapiens
cctgcaagagtggtccta

SEQ ID NO: 5875672 - DNA, 13 bp, Homo sapiens
cctgcaagatgga

SEQ ID NO: 5875673 - DNA, 22 bp, Homo sapiens
cctgcaagatggacacgagcca

SEQ ID NO: 5875674 - DNA, 18 bp, Homo sapiens
cctgcaagccccagggcc

SEQ ID NO: 5875675 - DNA, 23 bp, Homo sapiens
cctgcaagccccagggcctgggg

SEQ ID NO: 5875676 - DNA, 13 bp, Homo sapiens
cctgcaaggccca

SEQ ID NO: 5875677 - DNA, 21 bp, Homo sapiens
cctgcaaggcccacaggaggc

SEQ ID NO: 5875678 - DNA, 19 bp, Homo sapiens
cctgcaaggtgaaacgact

SEQ ID NO: 5875679 - DNA, 23 bp, Homo sapiens
cctgcaaggtgcacctgccccag

SEQ ID NO: 5875680 - DNA, 16 bp, Homo sapiens
cctgcaagtatccaga

SEQ ID NO: 5875681 - DNA, 13 bp, Homo sapiens
cctgcaagtgccc

SEQ ID NO: 5875682 - DNA, 22 bp, Homo sapiens
cctgcaagtgcccgccctgccc

SEQ ID NO: 5875683 - DNA, 22 bp, Homo sapiens
cctgcaagtggacgtgggctcc

SEQ ID NO: 5875684 - DNA, 20 bp, Homo sapiens
cctgcaagttgctctgacct

SEQ ID NO: 5875685 - DNA, 13 bp, Homo sapiens
cctgcaatatttg

SEQ ID NO: 5875686 - DNA, 18 bp, Homo sapiens
cctgcaatcactttttgg

SEQ ID NO: 5875687 - DNA, 19 bp, Homo sapiens
cctgcaatcactttttgga

SEQ ID NO: 5875688 - DNA, 20 bp, Homo sapiens
cctgcaatcactttttggaa

SEQ ID NO: 5875689 - DNA, 13 bp, Homo sapiens
cctgcaatcccag

SEQ ID NO: 5875690 - DNA, 15 bp, Homo sapiens
cctgcaatcccagca

SEQ ID NO: 5875691 - DNA, 17 bp, Homo sapiens
cctgcaatcccagcacc

SEQ ID NO: 5875692 - DNA, 18 bp, Homo sapiens
cctgcaatcccagcacct

SEQ ID NO: 5875693 - DNA, 18 bp, Homo sapiens
cctgcaatctccagggct

SEQ ID NO: 5875694 - DNA, 20 bp, Homo sapiens
cctgcaatgaagtctctgaa

SEQ ID NO: 5875695 - DNA, 21 bp, Homo sapiens
cctgcaatgaagtctctgaag

SEQ ID NO: 5875696 - DNA, 21 bp, Homo sapiens
cctgcaatgcgtcttgtgaaa

SEQ ID NO: 5875697 - DNA, 20 bp, Homo sapiens
cctgcacaaagcccttccat

SEQ ID NO: 5875698 - DNA, 16 bp, Homo sapiens
cctgcacaagccaggg

SEQ ID NO: 5875699 - DNA, 22 bp, Homo sapiens
cctgcacacaagcccacagcac

SEQ ID NO: 5875700 - DNA, 13 bp, Homo sapiens
cctgcacacacct

SEQ ID NO: 5875701 - DNA, 14 bp, Homo sapiens
cctgcacacacctg

SEQ ID NO: 5875702 - DNA, 16 bp, Homo sapiens
cctgcacacacctgca

SEQ ID NO: 5875703 - DNA, 17 bp, Homo sapiens
cctgcacacacctgcac

SEQ ID NO: 5875704 - DNA, 16 bp, Homo sapiens
cctgcacacacctgcc

SEQ ID NO: 5875705 - DNA, 17 bp, Homo sapiens
cctgcacacacctgcct

SEQ ID NO: 5875706 - DNA, 18 bp, Homo sapiens
cctgcacacacctgcctg

SEQ ID NO: 5875707 - DNA, 11 bp, Homo sapiens
cctgcacacag

SEQ ID NO: 5875708 - DNA, 22 bp, Homo sapiens
cctgcacacagaatgctcaggg

SEQ ID NO: 5875709 - DNA, 15 bp, Homo sapiens
cctgcacacagagtg

SEQ ID NO: 5875710 - DNA, 14 bp, Homo sapiens
cctgcacacaggac

SEQ ID NO: 5875711 - DNA, 19 bp, Homo sapiens
cctgcacacaggacagcgg

SEQ ID NO: 5875712 - DNA, 20 bp, Homo sapiens
cctgcacacagggcagtcct

SEQ ID NO: 5875713 - DNA, 14 bp, Homo sapiens
cctgcacacccctg

SEQ ID NO: 5875714 - DNA, 15 bp, Homo sapiens
cctgcacacccctgc

SEQ ID NO: 5875715 - DNA, 18 bp, Homo sapiens
cctgcacacccctgcaca

SEQ ID NO: 5875716 - DNA, 15 bp, Homo sapiens
cctgcacaccctggg

SEQ ID NO: 5875717 - DNA, 15 bp, Homo sapiens
cctgcacaccgtccc

SEQ ID NO: 5875718 - DNA, 18 bp, Homo sapiens
cctgcacaccgtccctct

SEQ ID NO: 5875719 - DNA, 19 bp, Homo sapiens
cctgcacaccgtccctctc

SEQ ID NO: 5875720 - DNA, 22 bp, Homo sapiens
cctgcacaccgtccctctcccc

SEQ ID NO: 5875721 - DNA, 23 bp, Homo sapiens
cctgcacacggcacagagcatcc

SEQ ID NO: 5875722 - DNA, 17 bp, Homo sapiens
cctgcacactccatctc

SEQ ID NO: 5875723 - DNA, 18 bp, Homo sapiens
cctgcacactccatctcc

SEQ ID NO: 5875724 - DNA, 17 bp, Homo sapiens
cctgcacagattcccag

SEQ ID NO: 5875725 - DNA, 18 bp, Homo sapiens
cctgcacagattcccagg

SEQ ID NO: 5875726 - DNA, 13 bp, Homo sapiens
cctgcacagcctc

SEQ ID NO: 5875727 - DNA, 17 bp, Homo sapiens
cctgcacaggcacacag

SEQ ID NO: 5875728 - DNA, 22 bp, Homo sapiens
cctgcacaggcacacagggccc

SEQ ID NO: 5875729 - DNA, 21 bp, Homo sapiens
cctgcacagtgacttctgaga

SEQ ID NO: 5875730 - DNA, 21 bp, Homo sapiens
cctgcacagtggtccagggtc

SEQ ID NO: 5875731 - DNA, 12 bp, Homo sapiens
cctgcacagttt

SEQ ID NO: 5875732 - DNA, 14 bp, Homo sapiens
cctgcacataaact

SEQ ID NO: 5875733 - DNA, 17 bp, Homo sapiens
cctgcacataaactccg

SEQ ID NO: 5875734 - DNA, 18 bp, Homo sapiens
cctgcacatcatgagcct

SEQ ID NO: 5875735 - DNA, 21 bp, Homo sapiens
cctgcaccaaatgtcagaagc

SEQ ID NO: 5875736 - DNA, 15 bp, Homo sapiens
cctgcaccactctct

SEQ ID NO: 5875737 - DNA, 14 bp, Homo sapiens
cctgcaccaggaga

SEQ ID NO: 5875738 - DNA, 20 bp, Homo sapiens
cctgcaccaggggtgcacaa

SEQ ID NO: 5875739 - DNA, 14 bp, Homo sapiens
cctgcacccacccc

SEQ ID NO: 5875740 - DNA, 13 bp, Homo sapiens
cctgcaccccagc

SEQ ID NO: 5875741 - DNA, 17 bp, Homo sapiens
cctgcaccccagcattc

SEQ ID NO: 5875742 - DNA, 22 bp, Homo sapiens
cctgcaccccagcattccagct

SEQ ID NO: 5875743 - DNA, 16 bp, Homo sapiens
cctgcacccctccggc

SEQ ID NO: 5875744 - DNA, 17 bp, Homo sapiens
cctgcacccctccggcc

SEQ ID NO: 5875745 - DNA, 15 bp, Homo sapiens
cctgcacccgtaccc

SEQ ID NO: 5875746 - DNA, 11 bp, Homo sapiens
cctgcaccctc

SEQ ID NO: 5875747 - DNA, 14 bp, Homo sapiens
cctgcaccctccta

SEQ ID NO: 5875748 - DNA, 13 bp, Homo sapiens
cctgcaccctctg

SEQ ID NO: 5875749 - DNA, 13 bp, Homo sapiens
cctgcaccctgga

SEQ ID NO: 5875750 - DNA, 15 bp, Homo sapiens
cctgcaccctggaaa

SEQ ID NO: 5875751 - DNA, 21 bp, Homo sapiens
cctgcaccctggaaaggggag

SEQ ID NO: 5875752 - DNA, 12 bp, Homo sapiens
cctgcacccttc

SEQ ID NO: 5875753 - DNA, 23 bp, Homo sapiens
cctgcacccttccacagctggcc

SEQ ID NO: 5875754 - DNA, 15 bp, Homo sapiens
cctgcacccttccct

SEQ ID NO: 5875755 - DNA, 18 bp, Homo sapiens
cctgcaccgacccgaggc

SEQ ID NO: 5875756 - DNA, 21 bp, Homo sapiens
cctgcaccgacccgaggccca

SEQ ID NO: 5875757 - DNA, 21 bp, Homo sapiens
cctgcaccgccgcagaagcag

SEQ ID NO: 5875758 - DNA, 15 bp, Homo sapiens
cctgcaccgccgcca

SEQ ID NO: 5875759 - DNA, 14 bp, Homo sapiens
cctgcacctccccc

SEQ ID NO: 5875760 - DNA, 17 bp, Homo sapiens
cctgcacctccccccac

SEQ ID NO: 5875761 - DNA, 18 bp, Homo sapiens
cctgcacctccccccact

SEQ ID NO: 5875762 - DNA, 17 bp, Homo sapiens
cctgcacctgccccgtg

SEQ ID NO: 5875763 - DNA, 19 bp, Homo sapiens
cctgcacctggcctgggcc

SEQ ID NO: 5875764 - DNA, 12 bp, Homo sapiens
cctgcacctggt

SEQ ID NO: 5875765 - DNA, 15 bp, Homo sapiens
cctgcacctgtgcag

SEQ ID NO: 5875766 - DNA, 18 bp, Homo sapiens
cctgcaccttgggcacgg

SEQ ID NO: 5875767 - DNA, 15 bp, Homo sapiens
cctgcacctttcggc

SEQ ID NO: 5875768 - DNA, 19 bp, Homo sapiens
cctgcacgcggactccggg

SEQ ID NO: 5875769 - DNA, 20 bp, Homo sapiens
cctgcacggggcattcctgc

SEQ ID NO: 5875770 - DNA, 20 bp, Homo sapiens
cctgcacgtatacacccaga

SEQ ID NO: 5875771 - DNA, 23 bp, Homo sapiens
cctgcacgtcatgggagggggct

SEQ ID NO: 5875772 - DNA, 20 bp, Homo sapiens
cctgcactaaagccagcctg

SEQ ID NO: 5875773 - DNA, 21 bp, Homo sapiens
cctgcactaaagccagcctga

SEQ ID NO: 5875774 - DNA, 21 bp, Homo sapiens
cctgcactaatttgatgttta

SEQ ID NO: 5875775 - DNA, 13 bp, Homo sapiens
cctgcactcacag

SEQ ID NO: 5875776 - DNA, 21 bp, Homo sapiens
cctgcactccatccagctaca

SEQ ID NO: 5875777 - DNA, 23 bp, Homo sapiens
cctgcactcccccagttcccggg

SEQ ID NO: 5875778 - DNA, 17 bp, Homo sapiens
cctgcactccccgaacc

SEQ ID NO: 5875779 - DNA, 21 bp, Homo sapiens
cctgcactcccgaccttagct

SEQ ID NO: 5875780 - DNA, 17 bp, Homo sapiens
cctgcactccctcctgg

SEQ ID NO: 5875781 - DNA, 14 bp, Homo sapiens
cctgcactccctgg

SEQ ID NO: 5875782 - DNA, 17 bp, Homo sapiens
cctgcactccctggcct

SEQ ID NO: 5875783 - DNA, 13 bp, Homo sapiens
cctgcatgctgaa

SEQ ID NO: 5875784 - DNA, 14 bp, Homo sapiens
cctgcatgctgaaa

SEQ ID NO: 5875785 - DNA, 16 bp, Homo sapiens
cctgcatgctgaaaca

SEQ ID NO: 5875786 - DNA, 14 bp, Homo sapiens
cctgcatgctgccc

SEQ ID NO: 5875787 - DNA, 19 bp, Homo sapiens
cctgcatggcatcctccag

SEQ ID NO: 5875788 - DNA, 10 bp, Homo sapiens
cctgcatggg

SEQ ID NO: 5875789 - DNA, 18 bp, Homo sapiens
cctgcatgggaaaaatgt

SEQ ID NO: 5875790 - DNA, 19 bp, Homo sapiens
cctgcatggggcagaggct

SEQ ID NO: 5875791 - DNA, 20 bp, Homo sapiens
cctgcatggggcagaggctt

SEQ ID NO: 5875792 - DNA, 22 bp, Homo sapiens
cctgcatggggcagaggcttcc

SEQ ID NO: 5875793 - DNA, 18 bp, Homo sapiens
cctgcatgggggcaccgg

SEQ ID NO: 5875794 - DNA, 20 bp, Homo sapiens
cctgcatgggggcaccgggc

SEQ ID NO: 5875795 - DNA, 21 bp, Homo sapiens
cctgcatgtaaacacgcctgc

SEQ ID NO: 5875796 - DNA, 21 bp, Homo sapiens
cctgcatgtcggggcccctgc

SEQ ID NO: 5875797 - DNA, 22 bp, Homo sapiens
cctgcatgtcggggcccctgcg

SEQ ID NO: 5875798 - DNA, 14 bp, Homo sapiens
cctgcatgtgtata

SEQ ID NO: 5875799 - DNA, 19 bp, Homo sapiens
cctgcatgtgtatatatgt

SEQ ID NO: 5875800 - DNA, 13 bp, Homo sapiens
cctgcatgttctg

SEQ ID NO: 5875801 - DNA, 16 bp, Homo sapiens
cctgcattcccaggaa

SEQ ID NO: 5875802 - DNA, 22 bp, Homo sapiens
cctgcattctgcacgctgccca

SEQ ID NO: 5875803 - DNA, 12 bp, Homo sapiens
cctgcattcttt

SEQ ID NO: 5875804 - DNA, 18 bp, Homo sapiens
cctgcattggaactggag

SEQ ID NO: 5875805 - DNA, 14 bp, Homo sapiens
cctgcattggcctg

SEQ ID NO: 5875806 - DNA, 21 bp, Homo sapiens
cctgcattggcctggcctcca

SEQ ID NO: 5875807 - DNA, 23 bp, Homo sapiens
cctgcattggcctggcctccagc

SEQ ID NO: 5875808 - DNA, 15 bp, Homo sapiens
cctgcatttaagaac

SEQ ID NO: 5875809 - DNA, 22 bp, Homo sapiens
cctgcatttaagaacagaacag

SEQ ID NO: 5875810 - DNA, 22 bp, Homo sapiens
cctgcatttgatagcaatgtaa

SEQ ID NO: 5875811 - DNA, 23 bp, Homo sapiens
cctgcatttgtgaaatgatggtg

SEQ ID NO: 5875812 - DNA, 10 bp, Homo sapiens
cctgcatttt

SEQ ID NO: 5875813 - DNA, 11 bp, Homo sapiens
cctgcatttta

SEQ ID NO: 5875814 - DNA, 18 bp, Homo sapiens
cctgcattttcctcttgt

SEQ ID NO: 5875815 - DNA, 22 bp, Homo sapiens
cctgcattttcctcttgtcctg

SEQ ID NO: 5875816 - DNA, 19 bp, Homo sapiens
cctgcatttttaaaggaca

SEQ ID NO: 5875817 - DNA, 16 bp, Homo sapiens
cctgccaaagacgtgt

SEQ ID NO: 5875818 - DNA, 19 bp, Homo sapiens
cctgccaaagtagtcctgg

SEQ ID NO: 5875819 - DNA, 22 bp, Homo sapiens
cctgccaaagtagtcctggcag

SEQ ID NO: 5875820 - DNA, 23 bp, Homo sapiens
cctgccaaagtagtcctggcagc

SEQ ID NO: 5875821 - DNA, 22 bp, Homo sapiens
cctgccaaagtgcctgggaagc

SEQ ID NO: 5875822 - DNA, 18 bp, Homo sapiens
cctgccaactccatgacc

SEQ ID NO: 5875823 - DNA, 19 bp, Homo sapiens
cctgccaactccatgacca

SEQ ID NO: 5875824 - DNA, 21 bp, Homo sapiens
cctgccaactccatgaccagg

SEQ ID NO: 5875825 - DNA, 16 bp, Homo sapiens
cctgccaactttccag

SEQ ID NO: 5875826 - DNA, 15 bp, Homo sapiens
cctgccaagactcct

SEQ ID NO: 5875827 - DNA, 15 bp, Homo sapiens
cctgccaagcctgga

SEQ ID NO: 5875828 - DNA, 22 bp, Homo sapiens
cctgccaagcctggagcccctg

SEQ ID NO: 5875829 - DNA, 15 bp, Homo sapiens
cctgccaaggagcat

SEQ ID NO: 5875830 - DNA, 24 bp, Homo sapiens
cctgccaaggagcatccttggcag

SEQ ID NO: 5875831 - DNA, 12 bp, Homo sapiens
cctgccaaggcc

SEQ ID NO: 5875832 - DNA, 20 bp, Homo sapiens
cctgccaagtctcagaagag

SEQ ID NO: 5875833 - DNA, 19 bp, Homo sapiens
cctgccaatggactaactt

SEQ ID NO: 5875834 - DNA, 19 bp, Homo sapiens
cctgccacaacagaataaa

SEQ ID NO: 5875835 - DNA, 22 bp, Homo sapiens
cctgccacaacagaataaagca

SEQ ID NO: 5875836 - DNA, 23 bp, Homo sapiens
cctgccacaacagaataaagcag

SEQ ID NO: 5875837 - DNA, 19 bp, Homo sapiens
cctgccacaatgtgatatg

SEQ ID NO: 5875838 - DNA, 14 bp, Homo sapiens
cctgccacactgat

SEQ ID NO: 5875839 - DNA, 11 bp, Homo sapiens
cctgccacagc

SEQ ID NO: 5875840 - DNA, 12 bp, Homo sapiens
cctgccacagcc

SEQ ID NO: 5875841 - DNA, 13 bp, Homo sapiens
cctgccacagcca

SEQ ID NO: 5875842 - DNA, 16 bp, Homo sapiens
cctgccacagccagag

SEQ ID NO: 5875843 - DNA, 18 bp, Homo sapiens
cctgccacagccagagga

SEQ ID NO: 5875844 - DNA, 18 bp, Homo sapiens
cctgccacatacaggtgc

SEQ ID NO: 5875845 - DNA, 19 bp, Homo sapiens
cctgccacatacaggtgct

SEQ ID NO: 5875846 - DNA, 19 bp, Homo sapiens
cctgccacattagaacttc

SEQ ID NO: 5875847 - DNA, 15 bp, Homo sapiens
cctgccaccacacac

SEQ ID NO: 5875848 - DNA, 17 bp, Homo sapiens
cctgccaccacacacac

SEQ ID NO: 5875849 - DNA, 15 bp, Homo sapiens
cctgccaccaccctg

SEQ ID NO: 5875850 - DNA, 21 bp, Homo sapiens
cctgccaccaccctgtcttcc

SEQ ID NO: 5875851 - DNA, 22 bp, Homo sapiens
cctgccaccaccctgtcttcct

SEQ ID NO: 5875852 - DNA, 12 bp, Homo sapiens
cctgccaccagg

SEQ ID NO: 5875853 - DNA, 13 bp, Homo sapiens
cctgccaccaggc

SEQ ID NO: 5875854 - DNA, 14 bp, Homo sapiens
cctgccaccaggcc

SEQ ID NO: 5875855 - DNA, 15 bp, Homo sapiens
cctgccaccagggag

SEQ ID NO: 5875856 - DNA, 14 bp, Homo sapiens
cctgccacccccag

SEQ ID NO: 5875857 - DNA, 17 bp, Homo sapiens
cctgccacccccaggtc

SEQ ID NO: 5875858 - DNA, 15 bp, Homo sapiens
cctgccaccctctgc

SEQ ID NO: 5875859 - DNA, 20 bp, Homo sapiens
cctgccaccctctgctgcac

SEQ ID NO: 5875860 - DNA, 12 bp, Homo sapiens
cctgccaccctg

SEQ ID NO: 5875861 - DNA, 18 bp, Homo sapiens
cctgccaccgccagagga

SEQ ID NO: 5875862 - DNA, 16 bp, Homo sapiens
cctgccacctctccca

SEQ ID NO: 5875863 - DNA, 18 bp, Homo sapiens
cctgccacctctcccagc

SEQ ID NO: 5875864 - DNA, 15 bp, Homo sapiens
cctgccacctggacc

SEQ ID NO: 5875865 - DNA, 13 bp, Homo sapiens
cctgccacctggg

SEQ ID NO: 5875866 - DNA, 13 bp, Homo sapiens
cctgccacctgtc

SEQ ID NO: 5875867 - DNA, 15 bp, Homo sapiens
cctgccacctgtctg

SEQ ID NO: 5875868 - DNA, 22 bp, Homo sapiens
cctgccacgtcccgctgcctcc

SEQ ID NO: 5875869 - DNA, 19 bp, Homo sapiens
cctgccactaggctgggtg

SEQ ID NO: 5875870 - DNA, 20 bp, Homo sapiens
cctgccactaggctgggtgc

SEQ ID NO: 5875871 - DNA, 16 bp, Homo sapiens
cctgccactcacacag

SEQ ID NO: 5875872 - DNA, 20 bp, Homo sapiens
cctgccactcacacagccag

SEQ ID NO: 5875873 - DNA, 21 bp, Homo sapiens
cctgccactcacacagccagg

SEQ ID NO: 5875874 - DNA, 23 bp, Homo sapiens
cctgccactcacacagccaggtg

SEQ ID NO: 5875875 - DNA, 17 bp, Homo sapiens
cctgccactcacccttc

SEQ ID NO: 5875876 - DNA, 16 bp, Homo sapiens
cctgccactcactagg

SEQ ID NO: 5875877 - DNA, 22 bp, Homo sapiens
cctgccactcactaggccccca

SEQ ID NO: 5875878 - DNA, 23 bp, Homo sapiens
cctgccactcaggcccaaagcct

SEQ ID NO: 5875879 - DNA, 16 bp, Homo sapiens
cctgccactctctggg

SEQ ID NO: 5875880 - DNA, 18 bp, Homo sapiens
cctgccactctctgggac

SEQ ID NO: 5875881 - DNA, 15 bp, Homo sapiens
cctgccactgacctc

SEQ ID NO: 5875882 - DNA, 13 bp, Homo sapiens
cctgccactgggc

SEQ ID NO: 5875883 - DNA, 14 bp, Homo sapiens
cctgccactgggct

SEQ ID NO: 5875884 - DNA, 17 bp, Homo sapiens
cctgccactgggctctg

SEQ ID NO: 5875885 - DNA, 16 bp, Homo sapiens
cctgccactgtgtgaa

SEQ ID NO: 5875886 - DNA, 12 bp, Homo sapiens
cctgccactgtt

SEQ ID NO: 5875887 - DNA, 14 bp, Homo sapiens
cctgccagagcagg

SEQ ID NO: 5875888 - DNA, 22 bp, Homo sapiens
cctgccagagcccaagtgccat

SEQ ID NO: 5875889 - DNA, 15 bp, Homo sapiens
cctgccagaggatgc

SEQ ID NO: 5875890 - DNA, 18 bp, Homo sapiens
cctgccagaggggaagga

SEQ ID NO: 5875891 - DNA, 12 bp, Homo sapiens
cctgccagcaac

SEQ ID NO: 5875892 - DNA, 13 bp, Homo sapiens
cctgccagcaccc

SEQ ID NO: 5875893 - DNA, 14 bp, Homo sapiens
cctgccagcacccc

SEQ ID NO: 5875894 - DNA, 11 bp, Homo sapiens
cctgccagcag

SEQ ID NO: 5875895 - DNA, 14 bp, Homo sapiens
cctgccagccactg

SEQ ID NO: 5875896 - DNA, 18 bp, Homo sapiens
cctgccagccccacacag

SEQ ID NO: 5875897 - DNA, 15 bp, Homo sapiens
cctgccagcctggct

SEQ ID NO: 5875898 - DNA, 21 bp, Homo sapiens
cctgccagcctggcttctgga

SEQ ID NO: 5875899 - DNA, 12 bp, Homo sapiens
cctgccagctct

SEQ ID NO: 5875900 - DNA, 15 bp, Homo sapiens
cctgccagctctgtc

SEQ ID NO: 5875901 - DNA, 13 bp, Homo sapiens
cctgccagctgca

SEQ ID NO: 5875902 - DNA, 20 bp, Homo sapiens
cctgccagctgcagcctggt

SEQ ID NO: 5875903 - DNA, 14 bp, Homo sapiens
cctgccagctgcct

SEQ ID NO: 5875904 - DNA, 21 bp, Homo sapiens
cctgccagctggatcgctgca

SEQ ID NO: 5875905 - DNA, 10 bp, Homo sapiens
cctgccagga

SEQ ID NO: 5875906 - DNA, 19 bp, Homo sapiens
cctgccaggaagccagcag

SEQ ID NO: 5875907 - DNA, 12 bp, Homo sapiens
cctgccaggagc

SEQ ID NO: 5875908 - DNA, 12 bp, Homo sapiens
cctgccaggagg

SEQ ID NO: 5875909 - DNA, 13 bp, Homo sapiens
cctgccaggagga

SEQ ID NO: 5875910 - DNA, 19 bp, Homo sapiens
cctgccaggaggacccagg

SEQ ID NO: 5875911 - DNA, 12 bp, Homo sapiens
cctgccaggcac

SEQ ID NO: 5875912 - DNA, 23 bp, Homo sapiens
cctgccaggcacaggcagggcag

SEQ ID NO: 5875913 - DNA, 14 bp, Homo sapiens
cctgccaggcctcc

SEQ ID NO: 5875914 - DNA, 11 bp, Homo sapiens
cctgccaggct

SEQ ID NO: 5875915 - DNA, 13 bp, Homo sapiens
cctgccaggctgc

SEQ ID NO: 5875916 - DNA, 14 bp, Homo sapiens
cctgccaggctgca

SEQ ID NO: 5875917 - DNA, 16 bp, Homo sapiens
cctgccaggctgcagg

SEQ ID NO: 5875918 - DNA, 17 bp, Homo sapiens
cctgccaggctgtcagc

SEQ ID NO: 5875919 - DNA, 11 bp, Homo sapiens
cctgccaggga

SEQ ID NO: 5875920 - DNA, 16 bp, Homo sapiens
cctgccagggaactgg

SEQ ID NO: 5875921 - DNA, 13 bp, Homo sapiens
cctgccagggaca

SEQ ID NO: 5875922 - DNA, 14 bp, Homo sapiens
cctgccagggacag

SEQ ID NO: 5875923 - DNA, 16 bp, Homo sapiens
cctgccagggacagag

SEQ ID NO: 5875924 - DNA, 22 bp, Homo sapiens
cctgccagggacagagggggtg

SEQ ID NO: 5875925 - DNA, 16 bp, Homo sapiens
cctgccagggagacag

SEQ ID NO: 5875926 - DNA, 19 bp, Homo sapiens
cctgccagggagacagagc

SEQ ID NO: 5875927 - DNA, 13 bp, Homo sapiens
cctgccagggctc

SEQ ID NO: 5875928 - DNA, 14 bp, Homo sapiens
cctgccagtcctag

SEQ ID NO: 5875929 - DNA, 15 bp, Homo sapiens
cctgccagtcctagc

SEQ ID NO: 5875930 - DNA, 21 bp, Homo sapiens
cctgccagtcctagctgcaca

SEQ ID NO: 5875931 - DNA, 15 bp, Homo sapiens
cctgccagtgccagg

SEQ ID NO: 5875932 - DNA, 17 bp, Homo sapiens
cctgccagtgccttacc

SEQ ID NO: 5875933 - DNA, 20 bp, Homo sapiens
cctgccagtgccttacctcc

SEQ ID NO: 5875934 - DNA, 22 bp, Homo sapiens
cctgccagtgccttacctcctg

SEQ ID NO: 5875935 - DNA, 17 bp, Homo sapiens
cctgccagttctctgtg

SEQ ID NO: 5875936 - DNA, 15 bp, Homo sapiens
cctgccagttgaagt

SEQ ID NO: 5875937 - DNA, 17 bp, Homo sapiens
cctgccataccgctggg

SEQ ID NO: 5875938 - DNA, 21 bp, Homo sapiens
cctgccataccgctggggaac

SEQ ID NO: 5875939 - DNA, 13 bp, Homo sapiens
cctgccatagcca

SEQ ID NO: 5875940 - DNA, 16 bp, Homo sapiens
cctgccatagccagga

SEQ ID NO: 5875941 - DNA, 19 bp, Homo sapiens
cctgccatagccaggagcg

SEQ ID NO: 5875942 - DNA, 22 bp, Homo sapiens
cctgccatccccctctcacgcc

SEQ ID NO: 5875943 - DNA, 20 bp, Homo sapiens
cctgccatggaactgtttcc

SEQ ID NO: 5875944 - DNA, 18 bp, Homo sapiens
cctgccatggaggcgcct

SEQ ID NO: 5875945 - DNA, 12 bp, Homo sapiens
cctgccatggct

SEQ ID NO: 5875946 - DNA, 13 bp, Homo sapiens
cctgccatggctg

SEQ ID NO: 5875947 - DNA, 16 bp, Homo sapiens
cctgccatgggccagc

SEQ ID NO: 5875948 - DNA, 19 bp, Homo sapiens
cctgccatgtacctcccct

SEQ ID NO: 5875949 - DNA, 21 bp, Homo sapiens
cctgccatgtacctcccctgc

SEQ ID NO: 5875950 - DNA, 14 bp, Homo sapiens
cctgccatgtgtga

SEQ ID NO: 5875951 - DNA, 21 bp, Homo sapiens
cctgccattcttctggtgcta

SEQ ID NO: 5875952 - DNA, 14 bp, Homo sapiens
cctgccatttaaaa

SEQ ID NO: 5875953 - DNA, 17 bp, Homo sapiens
cctgccatttgcaccct

SEQ ID NO: 5875954 - DNA, 23 bp, Homo sapiens
cctgccatttgcaccctccgcct

SEQ ID NO: 5875955 - DNA, 22 bp, Homo sapiens
cctgcccaaacagctgtattta

SEQ ID NO: 5875956 - DNA, 21 bp, Homo sapiens
cctgcccaaacccttaactga

SEQ ID NO: 5875957 - DNA, 17 bp, Homo sapiens
cctgcccaaactcccct

SEQ ID NO: 5875958 - DNA, 22 bp, Homo sapiens
cctgcccaaactccccttccct

SEQ ID NO: 5875959 - DNA, 12 bp, Homo sapiens
cctgcccaacct

SEQ ID NO: 5875960 - DNA, 23 bp, Homo sapiens
cctgcccaaggcctaccccagtt

SEQ ID NO: 5875961 - DNA, 15 bp, Homo sapiens
cctgcccaagtgacc

SEQ ID NO: 5875962 - DNA, 20 bp, Homo sapiens
cctgcctcctgcctgcccct

SEQ ID NO: 5875963 - DNA, 21 bp, Homo sapiens
cctgcctcctggaggaccaga

SEQ ID NO: 5875964 - DNA, 13 bp, Homo sapiens
cctgcctcctggg

SEQ ID NO: 5875965 - DNA, 17 bp, Homo sapiens
cctgcctcctgggaaga

SEQ ID NO: 5875966 - DNA, 17 bp, Homo sapiens
cctgcctccttgatatt

SEQ ID NO: 5875967 - DNA, 13 bp, Homo sapiens
cctgcctcctttg

SEQ ID NO: 5875968 - DNA, 19 bp, Homo sapiens
cctgcctcctttgtgagga

SEQ ID NO: 5875969 - DNA, 20 bp, Homo sapiens
cctgcctcctttgtgaggaa

SEQ ID NO: 5875970 - DNA, 23 bp, Homo sapiens
cctgcctcctttgtgaggaagcc

SEQ ID NO: 5875971 - DNA, 23 bp, Homo sapiens
cctgcctcgaactggctgcaaag

SEQ ID NO: 5875972 - DNA, 18 bp, Homo sapiens
cctgcctcgagggccgcc

SEQ ID NO: 5875973 - DNA, 19 bp, Homo sapiens
cctgcctcgcccccacttt

SEQ ID NO: 5875974 - DNA, 20 bp, Homo sapiens
cctgcctctaatctgagctg

SEQ ID NO: 5875975 - DNA, 18 bp, Homo sapiens
cctgcctctcccaggcag

SEQ ID NO: 5875976 - DNA, 13 bp, Homo sapiens
cctgcctctcccc

SEQ ID NO: 5875977 - DNA, 14 bp, Homo sapiens
cctgcctctctgca

SEQ ID NO: 5875978 - DNA, 17 bp, Homo sapiens
cctgcctctctgcaggt

SEQ ID NO: 5875979 - DNA, 20 bp, Homo sapiens
cctgcctctctgcaggtccc

SEQ ID NO: 5875980 - DNA, 20 bp, Homo sapiens
cctgcctctctgctccagag

SEQ ID NO: 5875981 - DNA, 19 bp, Homo sapiens
cctgcctctgaccccagca

SEQ ID NO: 5875982 - DNA, 15 bp, Homo sapiens
cctgcctctgactca

SEQ ID NO: 5875983 - DNA, 21 bp, Homo sapiens
cctgcctctgtgtagccgccc

SEQ ID NO: 5875984 - DNA, 15 bp, Homo sapiens
cctgcctcttctcta

SEQ ID NO: 5875985 - DNA, 17 bp, Homo sapiens
cctgcctcttgtttctg

SEQ ID NO: 5875986 - DNA, 14 bp, Homo sapiens
cctgcctctttgag

SEQ ID NO: 5875987 - DNA, 16 bp, Homo sapiens
cctgcctgaacagccc

SEQ ID NO: 5875988 - DNA, 14 bp, Homo sapiens
cctgcctgaagaga

SEQ ID NO: 5875989 - DNA, 15 bp, Homo sapiens
cctgcctgaagagag

SEQ ID NO: 5875990 - DNA, 14 bp, Homo sapiens
cctgcctgacagcc

SEQ ID NO: 5875991 - DNA, 22 bp, Homo sapiens
cctgcctgacagccttccccag

SEQ ID NO: 5875992 - DNA, 20 bp, Homo sapiens
cctgcctgaccatcccatga

SEQ ID NO: 5875993 - DNA, 12 bp, Homo sapiens
cctgcctgaccc

SEQ ID NO: 5875994 - DNA, 16 bp, Homo sapiens
cctgcctgacccatcc

SEQ ID NO: 5875995 - DNA, 13 bp, Homo sapiens
cctgcctgagaat

SEQ ID NO: 5875996 - DNA, 18 bp, Homo sapiens
cctgcctgagcccaggag

SEQ ID NO: 5875997 - DNA, 12 bp, Homo sapiens
cctgcctgaggg

SEQ ID NO: 5875998 - DNA, 13 bp, Homo sapiens
cctgcctgagggc

SEQ ID NO: 5875999 - DNA, 14 bp, Homo sapiens
cctgcctgagggcc

SEQ ID NO: 5876000 - DNA, 18 bp, Homo sapiens
cctgcctgagggcccctc

SEQ ID NO: 5876001 - DNA, 19 bp, Homo sapiens
cctgcctgagggcccctct

SEQ ID NO: 5876002 - DNA, 22 bp, Homo sapiens
cctgcctgagggcccctctgcc

SEQ ID NO: 5876003 - DNA, 17 bp, Homo sapiens
cctgcctgagggtgggc

SEQ ID NO: 5876004 - DNA, 19 bp, Homo sapiens
cctgcctgcaaacctgctg

SEQ ID NO: 5876005 - DNA, 14 bp, Homo sapiens
cctgcctgcacctc

SEQ ID NO: 5876006 - DNA, 16 bp, Homo sapiens
cctgcctgcacctccg

SEQ ID NO: 5876007 - DNA, 13 bp, Homo sapiens
cctgcctgcagca

SEQ ID NO: 5876008 - DNA, 15 bp, Homo sapiens
cctgcctgcagcagg

SEQ ID NO: 5876009 - DNA, 14 bp, Homo sapiens
cctgcctgcagcca

SEQ ID NO: 5876010 - DNA, 20 bp, Homo sapiens
cctgcctgcagccagggctg

SEQ ID NO: 5876011 - DNA, 14 bp, Homo sapiens
cctgcctgccaccc

SEQ ID NO: 5876012 - DNA, 12 bp, Homo sapiens
cctgcctgccat

SEQ ID NO: 5876013 - DNA, 15 bp, Homo sapiens
cctgcctgcccccac

SEQ ID NO: 5876014 - DNA, 17 bp, Homo sapiens
cctgcctgcccccacac

SEQ ID NO: 5876015 - DNA, 18 bp, Homo sapiens
cctgcctgccctgcctca

SEQ ID NO: 5876016 - DNA, 16 bp, Homo sapiens
cctgcctgccctggtg

SEQ ID NO: 5876017 - DNA, 13 bp, Homo sapiens
cctgcctgccttc

SEQ ID NO: 5876018 - DNA, 18 bp, Homo sapiens
cctgcctgctcgctccct

SEQ ID NO: 5876019 - DNA, 13 bp, Homo sapiens
cctgcctgctgca

SEQ ID NO: 5876020 - DNA, 12 bp, Homo sapiens
cctgcctgctgg

SEQ ID NO: 5876021 - DNA, 14 bp, Homo sapiens
cctgcctgctgtgg

SEQ ID NO: 5876022 - DNA, 23 bp, Homo sapiens
cctgcctgctgtggagcccattg

SEQ ID NO: 5876023 - DNA, 12 bp, Homo sapiens
cctgcctggaac

SEQ ID NO: 5876024 - DNA, 12 bp, Homo sapiens
cctgcctggacc

SEQ ID NO: 5876025 - DNA, 19 bp, Homo sapiens
cctgcctggaccagcctct

SEQ ID NO: 5876026 - DNA, 11 bp, Homo sapiens
cctgcctggag

SEQ ID NO: 5876027 - DNA, 13 bp, Homo sapiens
cctgcctggagcg

SEQ ID NO: 5876028 - DNA, 22 bp, Homo sapiens
cctgcctggaggacctgagcct

SEQ ID NO: 5876029 - DNA, 23 bp, Homo sapiens
cctgcctggaggacctgagcctg

SEQ ID NO: 5876030 - DNA, 13 bp, Homo sapiens
cctgcctggaggc

SEQ ID NO: 5876031 - DNA, 14 bp, Homo sapiens
cctgcctggaggct

SEQ ID NO: 5876032 - DNA, 22 bp, Homo sapiens
cctgcctggaggctcctctagg

SEQ ID NO: 5876033 - DNA, 23 bp, Homo sapiens
cctgcctggaggctcctctaggc

SEQ ID NO: 5876034 - DNA, 13 bp, Homo sapiens
cctgcctggcact

SEQ ID NO: 5876035 - DNA, 22 bp, Homo sapiens
cctgcctggcacttactggtcc

SEQ ID NO: 5876036 - DNA, 14 bp, Homo sapiens
cctgcctggcaggc

SEQ ID NO: 5876037 - DNA, 11 bp, Homo sapiens
cctgcctggcc

SEQ ID NO: 5876038 - DNA, 13 bp, Homo sapiens
cctgcctggccag

SEQ ID NO: 5876039 - DNA, 22 bp, Homo sapiens
cctgcctggccaggcagatctg

SEQ ID NO: 5876040 - DNA, 17 bp, Homo sapiens
cctgcctggccccctgt

SEQ ID NO: 5876041 - DNA, 14 bp, Homo sapiens
cctgcctggcccct

SEQ ID NO: 5876042 - DNA, 16 bp, Homo sapiens
cctgcctggccctcct

SEQ ID NO: 5876043 - DNA, 12 bp, Homo sapiens
cctgcctgggac

SEQ ID NO: 5876044 - DNA, 22 bp, Homo sapiens
cctgcctgggacagccactgga

SEQ ID NO: 5876045 - DNA, 15 bp, Homo sapiens
cctgcctgggagagc

SEQ ID NO: 5876046 - DNA, 13 bp, Homo sapiens
cctgcctgggcct

SEQ ID NO: 5876047 - DNA, 14 bp, Homo sapiens
cctgcctgggcctc

SEQ ID NO: 5876048 - DNA, 22 bp, Homo sapiens
cctgcctggggtggcctggccc

SEQ ID NO: 5876049 - DNA, 19 bp, Homo sapiens
cctgcctgggttgggggca

SEQ ID NO: 5876050 - DNA, 19 bp, Homo sapiens
cctgcctgggttttctaac

SEQ ID NO: 5876051 - DNA, 18 bp, Homo sapiens
cctgcctggtccagtggg

SEQ ID NO: 5876052 - DNA, 14 bp, Homo sapiens
cctgcctggtctcc

SEQ ID NO: 5876053 - DNA, 23 bp, Homo sapiens
cctgcctggtgcattgctgtgtg

SEQ ID NO: 5876054 - DNA, 13 bp, Homo sapiens
cctgcctgtctcc

SEQ ID NO: 5876055 - DNA, 16 bp, Homo sapiens
cctgcctgtctgcccc

SEQ ID NO: 5876056 - DNA, 11 bp, Homo sapiens
cctgcctgtgc

SEQ ID NO: 5876057 - DNA, 23 bp, Homo sapiens
cctgcctgtggagacagccctgc

SEQ ID NO: 5876058 - DNA, 21 bp, Homo sapiens
cctgcctgtggaggtgacctg

SEQ ID NO: 5876059 - DNA, 13 bp, Homo sapiens
cctgcctgtggca

SEQ ID NO: 5876060 - DNA, 22 bp, Homo sapiens
cctgcctgttcccattcttgca

SEQ ID NO: 5876061 - DNA, 23 bp, Homo sapiens
cctgcctgttgggccaggagcct

SEQ ID NO: 5876062 - DNA, 17 bp, Homo sapiens
cctgccttaacctggga

SEQ ID NO: 5876063 - DNA, 19 bp, Homo sapiens
cctgccttaccgagagcca

SEQ ID NO: 5876064 - DNA, 20 bp, Homo sapiens
cctgccttagagccaggcac

SEQ ID NO: 5876065 - DNA, 16 bp, Homo sapiens
cctgccttatcttgca

SEQ ID NO: 5876066 - DNA, 14 bp, Homo sapiens
cctgccttcatgga

SEQ ID NO: 5876067 - DNA, 17 bp, Homo sapiens
cctgccttcctcctggg

SEQ ID NO: 5876068 - DNA, 22 bp, Homo sapiens
cctgccttcctcctgggccctc

SEQ ID NO: 5876069 - DNA, 18 bp, Homo sapiens
cctgccttcctctgagga

SEQ ID NO: 5876070 - DNA, 14 bp, Homo sapiens
cctgccttcgttaa

SEQ ID NO: 5876071 - DNA, 20 bp, Homo sapiens
cctgccttctcccctccacg

SEQ ID NO: 5876072 - DNA, 13 bp, Homo sapiens
cctgccttctggg

SEQ ID NO: 5876073 - DNA, 19 bp, Homo sapiens
cctgccttgaaaaagacat

SEQ ID NO: 5876074 - DNA, 19 bp, Homo sapiens
cctgccttgaagccactga

SEQ ID NO: 5876075 - DNA, 21 bp, Homo sapiens
cctgccttgaagccactgaag

SEQ ID NO: 5876076 - DNA, 17 bp, Homo sapiens
cctgccttgatgaagcc

SEQ ID NO: 5876077 - DNA, 23 bp, Homo sapiens
cctgccttgatgaagcctgtgcc

SEQ ID NO: 5876078 - DNA, 17 bp, Homo sapiens
cctgccttgccgctccc

SEQ ID NO: 5876079 - DNA, 20 bp, Homo sapiens
cctgccttgctgacaataaa

SEQ ID NO: 5876080 - DNA, 15 bp, Homo sapiens
cctgccttgctgcct

SEQ ID NO: 5876081 - DNA, 22 bp, Homo sapiens
cctgccttggggaaggtctccc

SEQ ID NO: 5876082 - DNA, 22 bp, Homo sapiens
cctgcctttaaatgaaacaagt

SEQ ID NO: 5876083 - DNA, 16 bp, Homo sapiens
cctgcctttaagccaa

SEQ ID NO: 5876084 - DNA, 13 bp, Homo sapiens
cctgcctttctca

SEQ ID NO: 5876085 - DNA, 13 bp, Homo sapiens
cctgcctttgtat

SEQ ID NO: 5876086 - DNA, 17 bp, Homo sapiens
cctgccttttaagtttg

SEQ ID NO: 5876087 - DNA, 15 bp, Homo sapiens
cctgcgaacttgtgt

SEQ ID NO: 5876088 - DNA, 19 bp, Homo sapiens
cctgcgaaggggccctggt

SEQ ID NO: 5876089 - DNA, 20 bp, Homo sapiens
cctgcgaaggggccctggtc

SEQ ID NO: 5876090 - DNA, 21 bp, Homo sapiens
cctgcgaccctgggggcacag

SEQ ID NO: 5876091 - DNA, 18 bp, Homo sapiens
cctgcgagacgcacacag

SEQ ID NO: 5876092 - DNA, 21 bp, Homo sapiens
cctgcgagacgcacacagctg

SEQ ID NO: 5876093 - DNA, 23 bp, Homo sapiens
cctgcgagacgcacacagctgag

SEQ ID NO: 5876094 - DNA, 19 bp, Homo sapiens
cctgcgagagaccctacag

SEQ ID NO: 5876095 - DNA, 18 bp, Homo sapiens
cctgcgatggtgctgcac

SEQ ID NO: 5876096 - DNA, 21 bp, Homo sapiens
cctgcgatggtgctgcacccc

SEQ ID NO: 5876097 - DNA, 18 bp, Homo sapiens
cctgcgattttgcctgtg

SEQ ID NO: 5876098 - DNA, 16 bp, Homo sapiens
cctgcgcaagtgcctg

SEQ ID NO: 5876099 - DNA, 19 bp, Homo sapiens
cctgcgcaagtgcctggga

SEQ ID NO: 5876100 - DNA, 15 bp, Homo sapiens
cctgcgcacaggtgg

SEQ ID NO: 5876101 - DNA, 21 bp, Homo sapiens
cctgcgcaccccgttcccagc

SEQ ID NO: 5876102 - DNA, 22 bp, Homo sapiens
cctgcgcaccccgttcccagcg

SEQ ID NO: 5876103 - DNA, 18 bp, Homo sapiens
cctgcgcagctccttccc

SEQ ID NO: 5876104 - DNA, 17 bp, Homo sapiens
cctgcgccagtcctgct

SEQ ID NO: 5876105 - DNA, 19 bp, Homo sapiens
cctgcgcccaccccgctct

SEQ ID NO: 5876106 - DNA, 17 bp, Homo sapiens
cctgcgcccagagctgg

SEQ ID NO: 5876107 - DNA, 19 bp, Homo sapiens
cctgcgcccagagctggcc

SEQ ID NO: 5876108 - DNA, 18 bp, Homo sapiens
cctgcgcccagtccttcc

SEQ ID NO: 5876109 - DNA, 22 bp, Homo sapiens
cctgcgccccccagtggactcg

SEQ ID NO: 5876110 - DNA, 19 bp, Homo sapiens
cctgcgccccgcccacacc

SEQ ID NO: 5876111 - DNA, 17 bp, Homo sapiens
cctgcgcccctgcccag

SEQ ID NO: 5876112 - DNA, 22 bp, Homo sapiens
cctgcgcccctgcccagcacct

SEQ ID NO: 5876113 - DNA, 15 bp, Homo sapiens
cctgcgccctccctc

SEQ ID NO: 5876114 - DNA, 14 bp, Homo sapiens
cctgcgccctgtgc

SEQ ID NO: 5876115 - DNA, 17 bp, Homo sapiens
cctgcgccctgtgcccg

SEQ ID NO: 5876116 - DNA, 14 bp, Homo sapiens
cctgcgcccttgag

SEQ ID NO: 5876117 - DNA, 20 bp, Homo sapiens
cctgcgcccttgaggggccc

SEQ ID NO: 5876118 - DNA, 16 bp, Homo sapiens
cctgcgcctccatcca

SEQ ID NO: 5876119 - DNA, 13 bp, Homo sapiens
cctgcgcctcctc

SEQ ID NO: 5876120 - DNA, 15 bp, Homo sapiens
cctgcgcctcctcct

SEQ ID NO: 5876121 - DNA, 17 bp, Homo sapiens
cctgcgcctcctcctgc

SEQ ID NO: 5876122 - DNA, 19 bp, Homo sapiens
cctgcgcctgcgcctcctc

SEQ ID NO: 5876123 - DNA, 18 bp, Homo sapiens
cctgcgcctgctgcatgc

SEQ ID NO: 5876124 - DNA, 16 bp, Homo sapiens
cctgcgcctgctgcct

SEQ ID NO: 5876125 - DNA, 15 bp, Homo sapiens
cctgcgcctggctct

SEQ ID NO: 5876126 - DNA, 15 bp, Homo sapiens
cctgcgcctgtgatg

SEQ ID NO: 5876127 - DNA, 13 bp, Homo sapiens
cctgcgctcctct

SEQ ID NO: 5876128 - DNA, 21 bp, Homo sapiens
cctgcgctcctctgcagcctg

SEQ ID NO: 5876129 - DNA, 18 bp, Homo sapiens
cctgcgctcggcaggaag

SEQ ID NO: 5876130 - DNA, 21 bp, Homo sapiens
cctgcgctgccccagagcctg

SEQ ID NO: 5876131 - DNA, 16 bp, Homo sapiens
cctgcgcttcatctca

SEQ ID NO: 5876132 - DNA, 15 bp, Homo sapiens
cctgcgcttcctgag

SEQ ID NO: 5876133 - DNA, 17 bp, Homo sapiens
cctgcgcttctgctgga

SEQ ID NO: 5876134 - DNA, 23 bp, Homo sapiens
cctgcgctttgaacgtgccagca

SEQ ID NO: 5876135 - DNA, 23 bp, Homo sapiens
cctgcggaagccacagggtgagc

SEQ ID NO: 5876136 - DNA, 23 bp, Homo sapiens
cctgcggaaggaattcaggaata

SEQ ID NO: 5876137 - DNA, 19 bp, Homo sapiens
cctgcggactccatggccc

SEQ ID NO: 5876138 - DNA, 15 bp, Homo sapiens
cctgcggagctgcat

SEQ ID NO: 5876139 - DNA, 16 bp, Homo sapiens
cctgcggagtgaagag

SEQ ID NO: 5876140 - DNA, 16 bp, Homo sapiens
cctgctgtccctgtca

SEQ ID NO: 5876141 - DNA, 15 bp, Homo sapiens
cctgctgtcctggtg

SEQ ID NO: 5876142 - DNA, 21 bp, Homo sapiens
cctgctgtcctggtggctggg

SEQ ID NO: 5876143 - DNA, 18 bp, Homo sapiens
cctgctgtctctctgggc

SEQ ID NO: 5876144 - DNA, 18 bp, Homo sapiens
cctgctgtcttccccacc

SEQ ID NO: 5876145 - DNA, 23 bp, Homo sapiens
cctgctgtcttctccctcctcct

SEQ ID NO: 5876146 - DNA, 10 bp, Homo sapiens
cctgctgtgc

SEQ ID NO: 5876147 - DNA, 23 bp, Homo sapiens
cctgctgtgcaccttacattcct

SEQ ID NO: 5876148 - DNA, 12 bp, Homo sapiens
cctgctgtgcct

SEQ ID NO: 5876149 - DNA, 18 bp, Homo sapiens
cctgctgtgcctcgcatc

SEQ ID NO: 5876150 - DNA, 15 bp, Homo sapiens
cctgctgtggcctca

SEQ ID NO: 5876151 - DNA, 13 bp, Homo sapiens
cctgctgtgggag

SEQ ID NO: 5876152 - DNA, 14 bp, Homo sapiens
cctgctgtggggcg

SEQ ID NO: 5876153 - DNA, 20 bp, Homo sapiens
cctgctgtgtgaattcccag

SEQ ID NO: 5876154 - DNA, 19 bp, Homo sapiens
cctgctgtgttaagaggac

SEQ ID NO: 5876155 - DNA, 23 bp, Homo sapiens
cctgctgttggtcctctctctgt

SEQ ID NO: 5876156 - DNA, 18 bp, Homo sapiens
cctgcttaaacttgaccc

SEQ ID NO: 5876157 - DNA, 15 bp, Homo sapiens
cctgcttacctgacg

SEQ ID NO: 5876158 - DNA, 21 bp, Homo sapiens
cctgcttagaacccttctgct

SEQ ID NO: 5876159 - DNA, 14 bp, Homo sapiens
cctgcttcaaatat

SEQ ID NO: 5876160 - DNA, 15 bp, Homo sapiens
cctgcttcacacccc

SEQ ID NO: 5876161 - DNA, 23 bp, Homo sapiens
cctgcttcagatgtggagccagg

SEQ ID NO: 5876162 - DNA, 15 bp, Homo sapiens
cctgcttcatatctc

SEQ ID NO: 5876163 - DNA, 19 bp, Homo sapiens
cctgcttcatatctctccc

SEQ ID NO: 5876164 - DNA, 21 bp, Homo sapiens
cctgcttcatatctctccctt

SEQ ID NO: 5876165 - DNA, 16 bp, Homo sapiens
cctgcttcatgctcag

SEQ ID NO: 5876166 - DNA, 17 bp, Homo sapiens
cctgcttcatgctcagc

SEQ ID NO: 5876167 - DNA, 20 bp, Homo sapiens
cctgcttccacctcacccca

SEQ ID NO: 5876168 - DNA, 21 bp, Homo sapiens
cctgcttccacctcaccccac

SEQ ID NO: 5876169 - DNA, 14 bp, Homo sapiens
cctgcttccaggaa

SEQ ID NO: 5876170 - DNA, 21 bp, Homo sapiens
cctgcttccaggaaactccac

SEQ ID NO: 5876171 - DNA, 12 bp, Homo sapiens
cctgcttcccac

SEQ ID NO: 5876172 - DNA, 18 bp, Homo sapiens
cctgcttcccacctccct

SEQ ID NO: 5876173 - DNA, 20 bp, Homo sapiens
cctgcttcccacctccctgc

SEQ ID NO: 5876174 - DNA, 24 bp, Homo sapiens
cctgcttcccacctccctgcccag

SEQ ID NO: 5876175 - DNA, 13 bp, Homo sapiens
cctgcttccccct

SEQ ID NO: 5876176 - DNA, 23 bp, Homo sapiens
cctgcttccccctccccctcctg

SEQ ID NO: 5876177 - DNA, 14 bp, Homo sapiens
cctgcttccccttc

SEQ ID NO: 5876178 - DNA, 18 bp, Homo sapiens
cctgcttccccttcctaa

SEQ ID NO: 5876179 - DNA, 18 bp, Homo sapiens
cctgcttcctcttttcct

SEQ ID NO: 5876180 - DNA, 11 bp, Homo sapiens
cctgcttcctg

SEQ ID NO: 5876181 - DNA, 13 bp, Homo sapiens
cctgcttcctgaa

SEQ ID NO: 5876182 - DNA, 14 bp, Homo sapiens
cctgcttcctgaaa

SEQ ID NO: 5876183 - DNA, 17 bp, Homo sapiens
cctgcttcctgaaataa

SEQ ID NO: 5876184 - DNA, 22 bp, Homo sapiens
cctgcttcctgaaataaacact

SEQ ID NO: 5876185 - DNA, 15 bp, Homo sapiens
cctgcttcctgcttg

SEQ ID NO: 5876186 - DNA, 15 bp, Homo sapiens
cctgcttcctggacc

SEQ ID NO: 5876187 - DNA, 14 bp, Homo sapiens
cctgcttcctggct

SEQ ID NO: 5876188 - DNA, 16 bp, Homo sapiens
cctgcttcctggctca

SEQ ID NO: 5876189 - DNA, 21 bp, Homo sapiens
cctgcttcctgttacctgtct

SEQ ID NO: 5876190 - DNA, 14 bp, Homo sapiens
cctgcttccttcag

SEQ ID NO: 5876191 - DNA, 13 bp, Homo sapiens
cctgcttctcagc

SEQ ID NO: 5876192 - DNA, 14 bp, Homo sapiens
cctgcttctccagc

SEQ ID NO: 5876193 - DNA, 15 bp, Homo sapiens
cctgcttctccagcc

SEQ ID NO: 5876194 - DNA, 17 bp, Homo sapiens
cctgcttctccagcctg

SEQ ID NO: 5876195 - DNA, 20 bp, Homo sapiens
cctgcttctcccgccattgg

SEQ ID NO: 5876196 - DNA, 21 bp, Homo sapiens
cctgcttctcccgccattggc

SEQ ID NO: 5876197 - DNA, 16 bp, Homo sapiens
cctgcttctcccgggg

SEQ ID NO: 5876198 - DNA, 19 bp, Homo sapiens
cctgcttctcccggggacg

SEQ ID NO: 5876199 - DNA, 12 bp, Homo sapiens
cctgcttctctg

SEQ ID NO: 5876200 - DNA, 14 bp, Homo sapiens
cctgcttctgaact

SEQ ID NO: 5876201 - DNA, 12 bp, Homo sapiens
cctgcttctgct

SEQ ID NO: 5876202 - DNA, 14 bp, Homo sapiens
cctgcttctgctgc

SEQ ID NO: 5876203 - DNA, 15 bp, Homo sapiens
cctgcttctgctgcc

SEQ ID NO: 5876204 - DNA, 17 bp, Homo sapiens
cctgcttctgctgccct

SEQ ID NO: 5876205 - DNA, 19 bp, Homo sapiens
cctgcttctgctgccctga

SEQ ID NO: 5876206 - DNA, 17 bp, Homo sapiens
cctgcttctgctgcctg

SEQ ID NO: 5876207 - DNA, 15 bp, Homo sapiens
cctgcttctggcgcc

SEQ ID NO: 5876208 - DNA, 23 bp, Homo sapiens
cctgcttcttcccctctgcggct

SEQ ID NO: 5876209 - DNA, 19 bp, Homo sapiens
cctgcttcttctctccaca

SEQ ID NO: 5876210 - DNA, 16 bp, Homo sapiens
cctgcttctttccaga

SEQ ID NO: 5876211 - DNA, 20 bp, Homo sapiens
cctgcttgactttccagaat

SEQ ID NO: 5876212 - DNA, 21 bp, Homo sapiens
cctgcttgagctttctgtgca

SEQ ID NO: 5876213 - DNA, 18 bp, Homo sapiens
cctgcttgataatatata

SEQ ID NO: 5876214 - DNA, 17 bp, Homo sapiens
cctgcttgccaaggcag

SEQ ID NO: 5876215 - DNA, 18 bp, Homo sapiens
cctgcttgccaaggcaga

SEQ ID NO: 5876216 - DNA, 17 bp, Homo sapiens
cctgcttgcccgctccc

SEQ ID NO: 5876217 - DNA, 22 bp, Homo sapiens
cctgcttgcccgctcccacagc

SEQ ID NO: 5876218 - DNA, 20 bp, Homo sapiens
cctgcttggcccggccggcc

SEQ ID NO: 5876219 - DNA, 20 bp, Homo sapiens
cctgcttggcttatgaaaac

SEQ ID NO: 5876220 - DNA, 23 bp, Homo sapiens
cctgcttggggggtgatgagggc

SEQ ID NO: 5876221 - DNA, 21 bp, Homo sapiens
cctgcttgtactaagccagga

SEQ ID NO: 5876222 - DNA, 21 bp, Homo sapiens
cctgcttgtgttgggccccag

SEQ ID NO: 5876223 - DNA, 22 bp, Homo sapiens
cctgcttgtgttgggccccagg

SEQ ID NO: 5876224 - DNA, 13 bp, Homo sapiens
cctgcttgttggg

SEQ ID NO: 5876225 - DNA, 19 bp, Homo sapiens
cctgctttaaccaccccat

SEQ ID NO: 5876226 - DNA, 23 bp, Homo sapiens
cctgctttagaatgttttccttc

SEQ ID NO: 5876227 - DNA, 11 bp, Homo sapiens
cctgctttctc

SEQ ID NO: 5876228 - DNA, 15 bp, Homo sapiens
cctgctttctctttc

SEQ ID NO: 5876229 - DNA, 18 bp, Homo sapiens
cctgctttgaggacaaag

SEQ ID NO: 5876230 - DNA, 14 bp, Homo sapiens
cctgctttgcatct

SEQ ID NO: 5876231 - DNA, 16 bp, Homo sapiens
cctgctttgccccact

SEQ ID NO: 5876232 - DNA, 21 bp, Homo sapiens
cctgctttgcctcgaaagtgt

SEQ ID NO: 5876233 - DNA, 23 bp, Homo sapiens
cctgctttgcctcgaaagtgtca

SEQ ID NO: 5876234 - DNA, 13 bp, Homo sapiens
cctgctttggcct

SEQ ID NO: 5876235 - DNA, 16 bp, Homo sapiens
cctgctttggcctttc

SEQ ID NO: 5876236 - DNA, 20 bp, Homo sapiens
cctgctttggcctttccttg

SEQ ID NO: 5876237 - DNA, 22 bp, Homo sapiens
cctgctttggcctttccttgta

SEQ ID NO: 5876238 - DNA, 15 bp, Homo sapiens
cctgctttggcgggc

SEQ ID NO: 5876239 - DNA, 17 bp, Homo sapiens
cctgctttggctgaggg

SEQ ID NO: 5876240 - DNA, 20 bp, Homo sapiens
cctgctttggctgaggggct

SEQ ID NO: 5876241 - DNA, 18 bp, Homo sapiens
cctgcttttccaggatcc

SEQ ID NO: 5876242 - DNA, 17 bp, Homo sapiens
cctgcttttctcccaga

SEQ ID NO: 5876243 - DNA, 12 bp, Homo sapiens
cctgcttttctg

SEQ ID NO: 5876244 - DNA, 14 bp, Homo sapiens
cctgcttttctgtc

SEQ ID NO: 5876245 - DNA, 15 bp, Homo sapiens
cctgctttttggaaa

SEQ ID NO: 5876246 - DNA, 20 bp, Homo sapiens
cctgctttttggaaagtcag

SEQ ID NO: 5876247 - DNA, 15 bp, Homo sapiens
cctgctttttttctt

SEQ ID NO: 5876248 - DNA, 17 bp, Homo sapiens
cctgctttttttcttaa

SEQ ID NO: 5876249 - DNA, 13 bp, Homo sapiens
cctggaaaaacat

SEQ ID NO: 5876250 - DNA, 17 bp, Homo sapiens
cctggaaaaattccaga

SEQ ID NO: 5876251 - DNA, 13 bp, Homo sapiens
cctggaaaactgg

SEQ ID NO: 5876252 - DNA, 22 bp, Homo sapiens
cctggaaacagacagggagaag

SEQ ID NO: 5876253 - DNA, 23 bp, Homo sapiens
cctggaaacagacagggagaagt

SEQ ID NO: 5876254 - DNA, 22 bp, Homo sapiens
cctggaaacagaggtaaaaaaa

SEQ ID NO: 5876255 - DNA, 13 bp, Homo sapiens
cctggaaacagca

SEQ ID NO: 5876256 - DNA, 15 bp, Homo sapiens
cctggaaacagcatg

SEQ ID NO: 5876257 - DNA, 15 bp, Homo sapiens
cctggaaaccacagt

SEQ ID NO: 5876258 - DNA, 22 bp, Homo sapiens
cctggaaacccacctctctgga

SEQ ID NO: 5876259 - DNA, 20 bp, Homo sapiens
cctggaaaccttccacccag

SEQ ID NO: 5876260 - DNA, 16 bp, Homo sapiens
cctggaaactgctcag

SEQ ID NO: 5876261 - DNA, 22 bp, Homo sapiens
cctggaaactgctcagacgtct

SEQ ID NO: 5876262 - DNA, 19 bp, Homo sapiens
cctggaaagcaggatgtag

SEQ ID NO: 5876263 - DNA, 15 bp, Homo sapiens
cctggaaagccaggt

SEQ ID NO: 5876264 - DNA, 13 bp, Homo sapiens
cctggaaagccct

SEQ ID NO: 5876265 - DNA, 20 bp, Homo sapiens
cctggaaaggctcagtctca

SEQ ID NO: 5876266 - DNA, 14 bp, Homo sapiens
cctggaaaggggag

SEQ ID NO: 5876267 - DNA, 14 bp, Homo sapiens
cctggaaagggggt

SEQ ID NO: 5876268 - DNA, 23 bp, Homo sapiens
cctggaaatcagggttagtattg

SEQ ID NO: 5876269 - DNA, 15 bp, Homo sapiens
cctggaaatgatgtt

SEQ ID NO: 5876270 - DNA, 12 bp, Homo sapiens
cctggaaatgtg

SEQ ID NO: 5876271 - DNA, 14 bp, Homo sapiens
cctggaacaccagc

SEQ ID NO: 5876272 - DNA, 17 bp, Homo sapiens
cctggaacaccagcagc

SEQ ID NO: 5876273 - DNA, 23 bp, Homo sapiens
cctggaacaccagcagcactgga

SEQ ID NO: 5876274 - DNA, 24 bp, Homo sapiens
cctggaacatcctttgcagggcag

SEQ ID NO: 5876275 - DNA, 13 bp, Homo sapiens
cctggaaccaatc

SEQ ID NO: 5876276 - DNA, 16 bp, Homo sapiens
cctggaaccagcaagt

SEQ ID NO: 5876277 - DNA, 14 bp, Homo sapiens
cctggaaccaggga

SEQ ID NO: 5876278 - DNA, 15 bp, Homo sapiens
cctggaaccagggag

SEQ ID NO: 5876279 - DNA, 16 bp, Homo sapiens
cctggaaccagggagg

SEQ ID NO: 5876280 - DNA, 22 bp, Homo sapiens
cctggaaccgggaagggtggcc

SEQ ID NO: 5876281 - DNA, 14 bp, Homo sapiens
cctggaacctggca

SEQ ID NO: 5876282 - DNA, 18 bp, Homo sapiens
cctggaacctggcaggcc

SEQ ID NO: 5876283 - DNA, 22 bp, Homo sapiens
cctggaacctggcaggccctgc

SEQ ID NO: 5876284 - DNA, 23 bp, Homo sapiens
cctggaacctggcaggccctgcc

SEQ ID NO: 5876285 - DNA, 17 bp, Homo sapiens
cctggaaccttgctgtc

SEQ ID NO: 5876286 - DNA, 18 bp, Homo sapiens
cctggaaccttgctgtcc

SEQ ID NO: 5876287 - DNA, 20 bp, Homo sapiens
cctggaaccttgctgtcctg

SEQ ID NO: 5876288 - DNA, 19 bp, Homo sapiens
cctggaacctttcccttgt

SEQ ID NO: 5876289 - DNA, 13 bp, Homo sapiens
cctggaactcact

SEQ ID NO: 5876290 - DNA, 20 bp, Homo sapiens
cctggaactcactcactctg

SEQ ID NO: 5876291 - DNA, 18 bp, Homo sapiens
cctggaactgtctctcat

SEQ ID NO: 5876292 - DNA, 22 bp, Homo sapiens
cctggaagaacaaatctaccag

SEQ ID NO: 5876293 - DNA, 19 bp, Homo sapiens
cctggaagacaacccaggc

SEQ ID NO: 5876294 - DNA, 12 bp, Homo sapiens
cctggaagacag

SEQ ID NO: 5876295 - DNA, 22 bp, Homo sapiens
cctggaagacagagacctcctg

SEQ ID NO: 5876296 - DNA, 21 bp, Homo sapiens
cctggaagagccgagcacctg

SEQ ID NO: 5876297 - DNA, 22 bp, Homo sapiens
cctggaagagccgagcacctgt

SEQ ID NO: 5876298 - DNA, 14 bp, Homo sapiens
cctggaagagctgg

SEQ ID NO: 5876299 - DNA, 18 bp, Homo sapiens
cctggaagagctgggtac

SEQ ID NO: 5876300 - DNA, 20 bp, Homo sapiens
cctggaagatcatggacctg

SEQ ID NO: 5876301 - DNA, 12 bp, Homo sapiens
cctggaagcaga

SEQ ID NO: 5876302 - DNA, 15 bp, Homo sapiens
cctggaagcagagca

SEQ ID NO: 5876303 - DNA, 16 bp, Homo sapiens
cctggaagcaggtgct

SEQ ID NO: 5876304 - DNA, 15 bp, Homo sapiens
cctggaagcagtgcc

SEQ ID NO: 5876305 - DNA, 20 bp, Homo sapiens
cctggaagcgacccagggga

SEQ ID NO: 5876306 - DNA, 23 bp, Homo sapiens
cctggaagctttgtcccctgctt

SEQ ID NO: 5876307 - DNA, 12 bp, Homo sapiens
cctggaagggcc

SEQ ID NO: 5876308 - DNA, 24 bp, Homo sapiens
cctggaagggctagaacctgtaga

SEQ ID NO: 5876309 - DNA, 21 bp, Homo sapiens
cctggaaggtgtcatttgaca

SEQ ID NO: 5876310 - DNA, 20 bp, Homo sapiens
cctggaagtcaaataaatgt

SEQ ID NO: 5876311 - DNA, 15 bp, Homo sapiens
cctggaataaaatat

SEQ ID NO: 5876312 - DNA, 17 bp, Homo sapiens
cctggaataaaatataa

SEQ ID NO: 5876313 - DNA, 18 bp, Homo sapiens
cctggaatatataaccag

SEQ ID NO: 5876314 - DNA, 22 bp, Homo sapiens
cctggaatcgaggctgtgtgtc

SEQ ID NO: 5876315 - DNA, 18 bp, Homo sapiens
cctggaatgaagcatgta

SEQ ID NO: 5876316 - DNA, 19 bp, Homo sapiens
cctggaattcaccctctca

SEQ ID NO: 5876317 - DNA, 18 bp, Homo sapiens
cctggaattcagcaccct

SEQ ID NO: 5876318 - DNA, 19 bp, Homo sapiens
cctggaattcagcaccctg

SEQ ID NO: 5876319 - DNA, 17 bp, Homo sapiens
cctggaattgccagctg

SEQ ID NO: 5876320 - DNA, 18 bp, Homo sapiens
cctggaatttgggcagat

SEQ ID NO: 5876321 - DNA, 21 bp, Homo sapiens
cctggaatttgggcagatata

SEQ ID NO: 5876322 - DNA, 22 bp, Homo sapiens
cctggacaaggctaacatccca

SEQ ID NO: 5876323 - DNA, 17 bp, Homo sapiens
cctggacacacactcac

SEQ ID NO: 5876324 - DNA, 20 bp, Homo sapiens
cctggacacacactcaccag

SEQ ID NO: 5876325 - DNA, 13 bp, Homo sapiens
cctggacacactc

SEQ ID NO: 5876326 - DNA, 11 bp, Homo sapiens
cctggacacag

SEQ ID NO: 5876327 - DNA, 19 bp, Homo sapiens
cctggacacagcccaccct

SEQ ID NO: 5876328 - DNA, 15 bp, Homo sapiens
cctggacacagctct

SEQ ID NO: 5876329 - DNA, 16 bp, Homo sapiens
cctggacacaggcctg

SEQ ID NO: 5876330 - DNA, 17 bp, Homo sapiens
cctggacacagtcaggg

SEQ ID NO: 5876331 - DNA, 16 bp, Homo sapiens
cctggacacccctgct

SEQ ID NO: 5876332 - DNA, 13 bp, Homo sapiens
cctggacacctcc

SEQ ID NO: 5876333 - DNA, 14 bp, Homo sapiens
cctggacacctccc

SEQ ID NO: 5876334 - DNA, 16 bp, Homo sapiens
cctggacacctcccag

SEQ ID NO: 5876335 - DNA, 17 bp, Homo sapiens
cctggacacctcccagg

SEQ ID NO: 5876336 - DNA, 18 bp, Homo sapiens
cctggacacctcccaggg

SEQ ID NO: 5876337 - DNA, 19 bp, Homo sapiens
cctggacacctcccagggg

SEQ ID NO: 5876338 - DNA, 23 bp, Homo sapiens
cctggacacctcccaggggactg

SEQ ID NO: 5876339 - DNA, 13 bp, Homo sapiens
cctggacactagg

SEQ ID NO: 5876340 - DNA, 16 bp, Homo sapiens
cctggacactcagacc

SEQ ID NO: 5876341 - DNA, 22 bp, Homo sapiens
cctggacagaggcggggctaca

SEQ ID NO: 5876342 - DNA, 13 bp, Homo sapiens
cctggacagatgg

SEQ ID NO: 5876343 - DNA, 14 bp, Homo sapiens
cctggacagatggc

SEQ ID NO: 5876344 - DNA, 13 bp, Homo sapiens
cctggacagctgt

SEQ ID NO: 5876345 - DNA, 14 bp, Homo sapiens
cctggacagctgtg

SEQ ID NO: 5876346 - DNA, 16 bp, Homo sapiens
cctggacagctgtgcc

SEQ ID NO: 5876347 - DNA, 19 bp, Homo sapiens
cctggacaggcagcctcct

SEQ ID NO: 5876348 - DNA, 20 bp, Homo sapiens
cctggacaggcagcctcctt

SEQ ID NO: 5876349 - DNA, 22 bp, Homo sapiens
cctggacaggcagcctcctttg

SEQ ID NO: 5876350 - DNA, 14 bp, Homo sapiens
cctggacaggccag

SEQ ID NO: 5876351 - DNA, 19 bp, Homo sapiens
cctggacaggcgggctcgg

SEQ ID NO: 5876352 - DNA, 14 bp, Homo sapiens
cctggacaggcttc

SEQ ID NO: 5876353 - DNA, 15 bp, Homo sapiens
cctggacagtgagag

SEQ ID NO: 5876354 - DNA, 18 bp, Homo sapiens
cctggacagtgcctaact

SEQ ID NO: 5876355 - DNA, 15 bp, Homo sapiens
cctggacatgcctgt

SEQ ID NO: 5876356 - DNA, 17 bp, Homo sapiens
cctggacatgcctgtcc

SEQ ID NO: 5876357 - DNA, 20 bp, Homo sapiens
cctggacatgcctgtcctga

SEQ ID NO: 5876358 - DNA, 14 bp, Homo sapiens
cctggaccaaagct

SEQ ID NO: 5876359 - DNA, 20 bp, Homo sapiens
cctggaccaaagggaagtga

SEQ ID NO: 5876360 - DNA, 17 bp, Homo sapiens
cctggaccacacctccg

SEQ ID NO: 5876361 - DNA, 16 bp, Homo sapiens
cctggaccagatgctg

SEQ ID NO: 5876362 - DNA, 15 bp, Homo sapiens
cctggaccagcctcc

SEQ ID NO: 5876363 - DNA, 14 bp, Homo sapiens
cctggaccaggccc

SEQ ID NO: 5876364 - DNA, 19 bp, Homo sapiens
cctggaccattcctgtccc

SEQ ID NO: 5876365 - DNA, 16 bp, Homo sapiens
cctggacccagcaggg

SEQ ID NO: 5876366 - DNA, 15 bp, Homo sapiens
cctggaccccagcct

SEQ ID NO: 5876367 - DNA, 17 bp, Homo sapiens
cctggaccccagccttg

SEQ ID NO: 5876368 - DNA, 13 bp, Homo sapiens
cctggaccccagg

SEQ ID NO: 5876369 - DNA, 12 bp, Homo sapiens
cctggaccccca

SEQ ID NO: 5876370 - DNA, 15 bp, Homo sapiens
cctggacccccagct

SEQ ID NO: 5876371 - DNA, 18 bp, Homo sapiens
cctggacccccctttcac

SEQ ID NO: 5876372 - DNA, 23 bp, Homo sapiens
cctggacccccctttcacaggca

SEQ ID NO: 5876373 - DNA, 16 bp, Homo sapiens
cctggaccccctgccc

SEQ ID NO: 5876374 - DNA, 18 bp, Homo sapiens
cctggaccccctgcccgc

SEQ ID NO: 5876375 - DNA, 15 bp, Homo sapiens
cctggacccctgcat

SEQ ID NO: 5876376 - DNA, 20 bp, Homo sapiens
cctggacccctggggtggcc

SEQ ID NO: 5876377 - DNA, 22 bp, Homo sapiens
cctggacccctggggtggccag

SEQ ID NO: 5876378 - DNA, 23 bp, Homo sapiens
cctggacccctggggtggccagg

SEQ ID NO: 5876379 - DNA, 14 bp, Homo sapiens
cctggaccctggcc

SEQ ID NO: 5876380 - DNA, 19 bp, Homo sapiens
cctggaccgcttcccagag

SEQ ID NO: 5876381 - DNA, 13 bp, Homo sapiens
cctggacctatgc

SEQ ID NO: 5876382 - DNA, 19 bp, Homo sapiens
cctggacctatgcagggag

SEQ ID NO: 5876383 - DNA, 20 bp, Homo sapiens
cctggacctatgcagggagg

SEQ ID NO: 5876384 - DNA, 15 bp, Homo sapiens
cctggacctctgaca

SEQ ID NO: 5876385 - DNA, 19 bp, Homo sapiens
cctggacctctgacagcag

SEQ ID NO: 5876386 - DNA, 20 bp, Homo sapiens
cctggacctctgacagcagc

SEQ ID NO: 5876387 - DNA, 13 bp, Homo sapiens
cctggacctgagt

SEQ ID NO: 5876388 - DNA, 16 bp, Homo sapiens
cctggacctgcctcct

SEQ ID NO: 5876389 - DNA, 13 bp, Homo sapiens
cctggacctggaa

SEQ ID NO: 5876390 - DNA, 21 bp, Homo sapiens
cctggaccttgacagagcagc

SEQ ID NO: 5876391 - DNA, 19 bp, Homo sapiens
cctggaccttttgttttct

SEQ ID NO: 5876392 - DNA, 17 bp, Homo sapiens
cctggacgcagccacac

SEQ ID NO: 5876393 - DNA, 22 bp, Homo sapiens
cctggacgggaagggacagctg

SEQ ID NO: 5876394 - DNA, 23 bp, Homo sapiens
cctggacgggaagggacagctgc

SEQ ID NO: 5876395 - DNA, 23 bp, Homo sapiens
cctggactaaaggcatccttgtc

SEQ ID NO: 5876396 - DNA, 19 bp, Homo sapiens
cctggactagggcctcgga

SEQ ID NO: 5876397 - DNA, 15 bp, Homo sapiens
cctggactcattgct

SEQ ID NO: 5876398 - DNA, 16 bp, Homo sapiens
cctggactcattgctt

SEQ ID NO: 5876399 - DNA, 19 bp, Homo sapiens
cctggactccggaggactg

SEQ ID NO: 5876400 - DNA, 20 bp, Homo sapiens
cctggactctaagctggagc

SEQ ID NO: 5876401 - DNA, 21 bp, Homo sapiens
cctggactctaagctggagct

SEQ ID NO: 5876402 - DNA, 17 bp, Homo sapiens
cctggactctgtgtgag

SEQ ID NO: 5876403 - DNA, 14 bp, Homo sapiens
cctggactgactgc

SEQ ID NO: 5876404 - DNA, 18 bp, Homo sapiens
cctggactgactgcagcc

SEQ ID NO: 5876405 - DNA, 19 bp, Homo sapiens
cctggactgagccaaggag

SEQ ID NO: 5876406 - DNA, 22 bp, Homo sapiens
cctggactgagggggcctggat

SEQ ID NO: 5876407 - DNA, 14 bp, Homo sapiens
cctggactgcacag

SEQ ID NO: 5876408 - DNA, 13 bp, Homo sapiens
cctggactggccc

SEQ ID NO: 5876409 - DNA, 22 bp, Homo sapiens
cctggactggcccttgcccaac

SEQ ID NO: 5876410 - DNA, 14 bp, Homo sapiens
cctggactgggagg

SEQ ID NO: 5876411 - DNA, 18 bp, Homo sapiens
cctggactgggaggtaga

SEQ ID NO: 5876412 - DNA, 17 bp, Homo sapiens
cctggactggtggcccc

SEQ ID NO: 5876413 - DNA, 13 bp, Homo sapiens
cctggactggtta

SEQ ID NO: 5876414 - DNA, 14 bp, Homo sapiens
cctggactgttttc

SEQ ID NO: 5876415 - DNA, 24 bp, Homo sapiens
cctggacttaagcatctggctcta

SEQ ID NO: 5876416 - DNA, 13 bp, Homo sapiens
cctggacttctgg

SEQ ID NO: 5876417 - DNA, 19 bp, Homo sapiens
cctggacttggcccctgcc

SEQ ID NO: 5876418 - DNA, 19 bp, Homo sapiens
cctggactttcctgcaact

SEQ ID NO: 5876419 - DNA, 21 bp, Homo sapiens
cctggactttggttctctcca

SEQ ID NO: 5876420 - DNA, 23 bp, Homo sapiens
cctggactttggttctctccagg

SEQ ID NO: 5876421 - DNA, 15 bp, Homo sapiens
cctggagaaaggatg

SEQ ID NO: 5876422 - DNA, 16 bp, Homo sapiens
cctggagaactagaga

SEQ ID NO: 5876423 - DNA, 17 bp, Homo sapiens
cctggagaaggaagctg

SEQ ID NO: 5876424 - DNA, 20 bp, Homo sapiens
cctggagaagggacatggga

SEQ ID NO: 5876425 - DNA, 20 bp, Homo sapiens
cctggagaagggttcagccc

SEQ ID NO: 5876426 - DNA, 12 bp, Homo sapiens
cctggagaagtg

SEQ ID NO: 5876427 - DNA, 13 bp, Homo sapiens
cctggagacagta

SEQ ID NO: 5876428 - DNA, 21 bp, Homo sapiens
cctggagacccaccccacctg

SEQ ID NO: 5876429 - DNA, 22 bp, Homo sapiens
cctggagacccaccccacctgc

SEQ ID NO: 5876430 - DNA, 22 bp, Homo sapiens
cctggagacgtggaacctctgt

SEQ ID NO: 5876431 - DNA, 19 bp, Homo sapiens
cctggagactaaccccacc

SEQ ID NO: 5876432 - DNA, 21 bp, Homo sapiens
cctggagacttaatagacatt

SEQ ID NO: 5876433 - DNA, 14 bp, Homo sapiens
cctggagagccaga

SEQ ID NO: 5876434 - DNA, 22 bp, Homo sapiens
cctggagagccagaacctggag

SEQ ID NO: 5876435 - DNA, 14 bp, Homo sapiens
cctggagagcccca

SEQ ID NO: 5876436 - DNA, 14 bp, Homo sapiens
cctggagagctaga

SEQ ID NO: 5876437 - DNA, 21 bp, Homo sapiens
cctggagagctagaacctaga

SEQ ID NO: 5876438 - DNA, 21 bp, Homo sapiens
cctggagagctagaacctgga

SEQ ID NO: 5876439 - DNA, 21 bp, Homo sapiens
cctggagaggacggccctgcc

SEQ ID NO: 5876440 - DNA, 23 bp, Homo sapiens
cctggagaggacggccctgcctg

SEQ ID NO: 5876441 - DNA, 13 bp, Homo sapiens
cctggagaggcct

SEQ ID NO: 5876442 - DNA, 15 bp, Homo sapiens
cctggagaggcctgg

SEQ ID NO: 5876443 - DNA, 13 bp, Homo sapiens
cctggagaggggc

SEQ ID NO: 5876444 - DNA, 15 bp, Homo sapiens
cctggagaggggcct

SEQ ID NO: 5876445 - DNA, 16 bp, Homo sapiens
cctggagagtgcacat

SEQ ID NO: 5876446 - DNA, 19 bp, Homo sapiens
cctggagagtgcacatgcc

SEQ ID NO: 5876447 - DNA, 14 bp, Homo sapiens
cctggagatagctg

SEQ ID NO: 5876448 - DNA, 19 bp, Homo sapiens
cctggagatagctggggct

SEQ ID NO: 5876449 - DNA, 15 bp, Homo sapiens
cctggagatcctcct

SEQ ID NO: 5876450 - DNA, 17 bp, Homo sapiens
cctggagatcctcctgc

SEQ ID NO: 5876451 - DNA, 21 bp, Homo sapiens
cctggagatcctcctgcagac

SEQ ID NO: 5876452 - DNA, 21 bp, Homo sapiens
cctggagatgacttgaggcct

SEQ ID NO: 5876453 - DNA, 12 bp, Homo sapiens
cctggagatgat

SEQ ID NO: 5876454 - DNA, 14 bp, Homo sapiens
cctggagatgatga

SEQ ID NO: 5876455 - DNA, 15 bp, Homo sapiens
cctggagatgatgat

SEQ ID NO: 5876456 - DNA, 15 bp, Homo sapiens
cctggagatgcagct

SEQ ID NO: 5876457 - DNA, 22 bp, Homo sapiens
cctggagatgcagctactggaa

SEQ ID NO: 5876458 - DNA, 22 bp, Homo sapiens
cctggagcaagctctgccctgg

SEQ ID NO: 5876459 - DNA, 21 bp, Homo sapiens
cctggagcaatcacagatgag

SEQ ID NO: 5876460 - DNA, 16 bp, Homo sapiens
cctggagcacaaagac

SEQ ID NO: 5876461 - DNA, 17 bp, Homo sapiens
cctggagcagaagcagc

SEQ ID NO: 5876462 - DNA, 22 bp, Homo sapiens
cctggagcagaagcagcaactt

SEQ ID NO: 5876463 - DNA, 18 bp, Homo sapiens
cctggagcagaccacccc

SEQ ID NO: 5876464 - DNA, 17 bp, Homo sapiens
cctggagcaggagcccc

SEQ ID NO: 5876465 - DNA, 13 bp, Homo sapiens
cctggagcaggcc

SEQ ID NO: 5876466 - DNA, 16 bp, Homo sapiens
cctggagcaggcccaa

SEQ ID NO: 5876467 - DNA, 13 bp, Homo sapiens
cctggagcagggg

SEQ ID NO: 5876468 - DNA, 15 bp, Homo sapiens
cctggagccaactgc

SEQ ID NO: 5876469 - DNA, 16 bp, Homo sapiens
cctggagccagactct

SEQ ID NO: 5876470 - DNA, 14 bp, Homo sapiens
cctggagccagcag

SEQ ID NO: 5876471 - DNA, 12 bp, Homo sapiens
cctggagccagg

SEQ ID NO: 5876472 - DNA, 17 bp, Homo sapiens
cctggagccagggcaga

SEQ ID NO: 5876473 - DNA, 13 bp, Homo sapiens
cctggagccatcc

SEQ ID NO: 5876474 - DNA, 17 bp, Homo sapiens
cctggagcccagaggag

SEQ ID NO: 5876475 - DNA, 14 bp, Homo sapiens
cctggagccccaga

SEQ ID NO: 5876476 - DNA, 22 bp, Homo sapiens
cctggagccccagaaccccaac

SEQ ID NO: 5876477 - DNA, 13 bp, Homo sapiens
cctggagcccctg

SEQ ID NO: 5876478 - DNA, 22 bp, Homo sapiens
cctggagcccctgggtgggtgg

SEQ ID NO: 5876479 - DNA, 14 bp, Homo sapiens
cctggagcccctgt

SEQ ID NO: 5876480 - DNA, 15 bp, Homo sapiens
cctggagcccctgtg

SEQ ID NO: 5876481 - DNA, 20 bp, Homo sapiens
cctggagcccctgtgtggga

SEQ ID NO: 5876482 - DNA, 21 bp, Homo sapiens
cctggagcccctgtgttgggg

SEQ ID NO: 5876483 - DNA, 14 bp, Homo sapiens
cctggagcccgagg

SEQ ID NO: 5876484 - DNA, 12 bp, Homo sapiens
cctggagcccgc

SEQ ID NO: 5876485 - DNA, 22 bp, Homo sapiens
cctggagcccgcttcaagctct

SEQ ID NO: 5876486 - DNA, 15 bp, Homo sapiens
cctggagcccggcag

SEQ ID NO: 5876487 - DNA, 21 bp, Homo sapiens
cctggagccctccgccttcac

SEQ ID NO: 5876488 - DNA, 12 bp, Homo sapiens
cctggagccctg

SEQ ID NO: 5876489 - DNA, 13 bp, Homo sapiens
cctggagccctgt

SEQ ID NO: 5876490 - DNA, 15 bp, Homo sapiens
cctggagcctcagaa

SEQ ID NO: 5876491 - DNA, 19 bp, Homo sapiens
cctggagcctgggcagcac

SEQ ID NO: 5876492 - DNA, 23 bp, Homo sapiens
cctggagcggagcttgcctgcct

SEQ ID NO: 5876493 - DNA, 16 bp, Homo sapiens
cctggagcggctctcc

SEQ ID NO: 5876494 - DNA, 20 bp, Homo sapiens
cctggagcggctctcctgag

SEQ ID NO: 5876495 - DNA, 12 bp, Homo sapiens
cctggctgccct

SEQ ID NO: 5876496 - DNA, 13 bp, Homo sapiens
cctggctgccctg

SEQ ID NO: 5876497 - DNA, 16 bp, Homo sapiens
cctggctgccctggcc

SEQ ID NO: 5876498 - DNA, 18 bp, Homo sapiens
cctggctgccctggccct

SEQ ID NO: 5876499 - DNA, 19 bp, Homo sapiens
cctggctgccctggccctg

SEQ ID NO: 5876500 - DNA, 20 bp, Homo sapiens
cctggctgcgaactgtgcag

SEQ ID NO: 5876501 - DNA, 15 bp, Homo sapiens
cctggctgctaggcc

SEQ ID NO: 5876502 - DNA, 18 bp, Homo sapiens
cctggctgctaggccaga

SEQ ID NO: 5876503 - DNA, 22 bp, Homo sapiens
cctggctgctaggccagagcca

SEQ ID NO: 5876504 - DNA, 21 bp, Homo sapiens
cctggctgctgatcgccttcc

SEQ ID NO: 5876505 - DNA, 16 bp, Homo sapiens
cctggctgctgccccc

SEQ ID NO: 5876506 - DNA, 17 bp, Homo sapiens
cctggctgctgccccca

SEQ ID NO: 5876507 - DNA, 22 bp, Homo sapiens
cctggctgctgcccccaccccg

SEQ ID NO: 5876508 - DNA, 18 bp, Homo sapiens
cctggctgctgcttcttg

SEQ ID NO: 5876509 - DNA, 11 bp, Homo sapiens
cctggctggaa

SEQ ID NO: 5876510 - DNA, 13 bp, Homo sapiens
cctggctggaagg

SEQ ID NO: 5876511 - DNA, 13 bp, Homo sapiens
cctggctggaatg

SEQ ID NO: 5876512 - DNA, 13 bp, Homo sapiens
cctggctggctcc

SEQ ID NO: 5876513 - DNA, 16 bp, Homo sapiens
cctggctggctcctag

SEQ ID NO: 5876514 - DNA, 20 bp, Homo sapiens
cctggctggctgtgtcctct

SEQ ID NO: 5876515 - DNA, 24 bp, Homo sapiens
cctggctgggacgtggctcagcca

SEQ ID NO: 5876516 - DNA, 19 bp, Homo sapiens
cctggctgggatcagagca

SEQ ID NO: 5876517 - DNA, 11 bp, Homo sapiens
cctggctgggc

SEQ ID NO: 5876518 - DNA, 17 bp, Homo sapiens
cctggctgggccatcct

SEQ ID NO: 5876519 - DNA, 18 bp, Homo sapiens
cctggctgggccatcctt

SEQ ID NO: 5876520 - DNA, 16 bp, Homo sapiens
cctggctgggcctggg

SEQ ID NO: 5876521 - DNA, 17 bp, Homo sapiens
cctggctgggctctggt

SEQ ID NO: 5876522 - DNA, 18 bp, Homo sapiens
cctggctgggctctggtg

SEQ ID NO: 5876523 - DNA, 16 bp, Homo sapiens
cctggctggggacttg

SEQ ID NO: 5876524 - DNA, 21 bp, Homo sapiens
cctggctggggacttggccgc

SEQ ID NO: 5876525 - DNA, 22 bp, Homo sapiens
cctggctggtaagggccaagtc

SEQ ID NO: 5876526 - DNA, 12 bp, Homo sapiens
cctggctggtcc

SEQ ID NO: 5876527 - DNA, 13 bp, Homo sapiens
cctggctggtcct

SEQ ID NO: 5876528 - DNA, 15 bp, Homo sapiens
cctggctggtcctcc

SEQ ID NO: 5876529 - DNA, 16 bp, Homo sapiens
cctggctggtcctccc

SEQ ID NO: 5876530 - DNA, 19 bp, Homo sapiens
cctggctggtcctcccatt

SEQ ID NO: 5876531 - DNA, 18 bp, Homo sapiens
cctggctgtgacacctgg

SEQ ID NO: 5876532 - DNA, 12 bp, Homo sapiens
cctggctgtgcc

SEQ ID NO: 5876533 - DNA, 23 bp, Homo sapiens
cctggctgtgcccagcaggccca

SEQ ID NO: 5876534 - DNA, 14 bp, Homo sapiens
cctggctgtggagg

SEQ ID NO: 5876535 - DNA, 17 bp, Homo sapiens
cctggctgtggaggcct

SEQ ID NO: 5876536 - DNA, 21 bp, Homo sapiens
cctggctgttctgtggttcct

SEQ ID NO: 5876537 - DNA, 16 bp, Homo sapiens
cctggcttagaaggca

SEQ ID NO: 5876538 - DNA, 17 bp, Homo sapiens
cctggcttagaaggcac

SEQ ID NO: 5876539 - DNA, 17 bp, Homo sapiens
cctggcttcaccgcatt

SEQ ID NO: 5876540 - DNA, 16 bp, Homo sapiens
cctggcttcactctcc

SEQ ID NO: 5876541 - DNA, 14 bp, Homo sapiens
cctggcttcaggca

SEQ ID NO: 5876542 - DNA, 22 bp, Homo sapiens
cctggcttcaggcaattctcct

SEQ ID NO: 5876543 - DNA, 16 bp, Homo sapiens
cctggcttcatacaga

SEQ ID NO: 5876544 - DNA, 15 bp, Homo sapiens
cctggcttcccagga

SEQ ID NO: 5876545 - DNA, 16 bp, Homo sapiens
cctggcttcccaggac

SEQ ID NO: 5876546 - DNA, 20 bp, Homo sapiens
cctggcttcccaggaccctg

SEQ ID NO: 5876547 - DNA, 15 bp, Homo sapiens
cctggcttcccatcc

SEQ ID NO: 5876548 - DNA, 20 bp, Homo sapiens
cctggcttcccatccccagc

SEQ ID NO: 5876549 - DNA, 22 bp, Homo sapiens
cctggcttcccatccccagcga

SEQ ID NO: 5876550 - DNA, 23 bp, Homo sapiens
cctggcttcccatccccagcgat

SEQ ID NO: 5876551 - DNA, 16 bp, Homo sapiens
cctggcttctggagcc

SEQ ID NO: 5876552 - DNA, 17 bp, Homo sapiens
cctggcttctggagccc

SEQ ID NO: 5876553 - DNA, 16 bp, Homo sapiens
cctggcttctgtgggg

SEQ ID NO: 5876554 - DNA, 22 bp, Homo sapiens
cctggcttctgtggggcccctc

SEQ ID NO: 5876555 - DNA, 22 bp, Homo sapiens
cctggcttctttctctcagcct

SEQ ID NO: 5876556 - DNA, 20 bp, Homo sapiens
cctggcttgagtgatcctcc

SEQ ID NO: 5876557 - DNA, 19 bp, Homo sapiens
cctggcttgctccagggtc

SEQ ID NO: 5876558 - DNA, 18 bp, Homo sapiens
cctggcttgtaactccac

SEQ ID NO: 5876559 - DNA, 22 bp, Homo sapiens
cctggcttgtaactccaccaac

SEQ ID NO: 5876560 - DNA, 22 bp, Homo sapiens
cctggctttcattttctctcag

SEQ ID NO: 5876561 - DNA, 23 bp, Homo sapiens
cctggctttcattttctctcagg

SEQ ID NO: 5876562 - DNA, 15 bp, Homo sapiens
cctggctttccagga

SEQ ID NO: 5876563 - DNA, 18 bp, Homo sapiens
cctggctttgacatgaaa

SEQ ID NO: 5876564 - DNA, 15 bp, Homo sapiens
cctggctttgcccaa

SEQ ID NO: 5876565 - DNA, 18 bp, Homo sapiens
cctggctttgcccaacct

SEQ ID NO: 5876566 - DNA, 21 bp, Homo sapiens
cctggctttgcccaacctcag

SEQ ID NO: 5876567 - DNA, 18 bp, Homo sapiens
cctggctttgcctcttct

SEQ ID NO: 5876568 - DNA, 18 bp, Homo sapiens
cctggctttggcgcccca

SEQ ID NO: 5876569 - DNA, 23 bp, Homo sapiens
cctggcttttaaacctgttcctg

SEQ ID NO: 5876570 - DNA, 19 bp, Homo sapiens
cctggcttttctggctggg

SEQ ID NO: 5876571 - DNA, 21 bp, Homo sapiens
cctggcttttctggctgggga

SEQ ID NO: 5876572 - DNA, 14 bp, Homo sapiens
cctgggaaaacaga

SEQ ID NO: 5876573 - DNA, 18 bp, Homo sapiens
cctgggaaaacagaggaa

SEQ ID NO: 5876574 - DNA, 15 bp, Homo sapiens
cctgggaaaagggca

SEQ ID NO: 5876575 - DNA, 22 bp, Homo sapiens
cctgggaaaagggcaggagcct

SEQ ID NO: 5876576 - DNA, 23 bp, Homo sapiens
cctgggaaaccccttctctgtga

SEQ ID NO: 5876577 - DNA, 16 bp, Homo sapiens
cctgggaaaggaccca

SEQ ID NO: 5876578 - DNA, 13 bp, Homo sapiens
cctgggaaaggga

SEQ ID NO: 5876579 - DNA, 19 bp, Homo sapiens
cctgggaacacagtgcccc

SEQ ID NO: 5876580 - DNA, 19 bp, Homo sapiens
cctgggaacacagttctgg

SEQ ID NO: 5876581 - DNA, 22 bp, Homo sapiens
cctgggaacacagttctgggca

SEQ ID NO: 5876582 - DNA, 15 bp, Homo sapiens
cctgggaacaggccc

SEQ ID NO: 5876583 - DNA, 16 bp, Homo sapiens
cctgggaacaggcccc

SEQ ID NO: 5876584 - DNA, 17 bp, Homo sapiens
cctgggaacaggcccca

SEQ ID NO: 5876585 - DNA, 18 bp, Homo sapiens
cctgggaacaggccccac

SEQ ID NO: 5876586 - DNA, 15 bp, Homo sapiens
cctgggaaccactcc

SEQ ID NO: 5876587 - DNA, 19 bp, Homo sapiens
cctgggaaccgccctcctg

SEQ ID NO: 5876588 - DNA, 18 bp, Homo sapiens
cctgggaactctcctggc

SEQ ID NO: 5876589 - DNA, 23 bp, Homo sapiens
cctgggaagatgaggttctgaga

SEQ ID NO: 5876590 - DNA, 12 bp, Homo sapiens
cctgggaagctg

SEQ ID NO: 5876591 - DNA, 15 bp, Homo sapiens
cctgggaagctgccg

SEQ ID NO: 5876592 - DNA, 15 bp, Homo sapiens
cctgggaaggccacc

SEQ ID NO: 5876593 - DNA, 17 bp, Homo sapiens
cctgggaaggccacctc

SEQ ID NO: 5876594 - DNA, 15 bp, Homo sapiens
cctgggaaggccagc

SEQ ID NO: 5876595 - DNA, 12 bp, Homo sapiens
cctgggaagggg

SEQ ID NO: 5876596 - DNA, 14 bp, Homo sapiens
cctgggaagtggag

SEQ ID NO: 5876597 - DNA, 16 bp, Homo sapiens
cctgggaatggaataa

SEQ ID NO: 5876598 - DNA, 19 bp, Homo sapiens
cctgggaatggaataacta

SEQ ID NO: 5876599 - DNA, 20 bp, Homo sapiens
cctgggaatggaataactat

SEQ ID NO: 5876600 - DNA, 13 bp, Homo sapiens
cctgggaatttca

SEQ ID NO: 5876601 - DNA, 19 bp, Homo sapiens
cctgggacaactgctccca

SEQ ID NO: 5876602 - DNA, 17 bp, Homo sapiens
cctgggacaagcaggcc

SEQ ID NO: 5876603 - DNA, 20 bp, Homo sapiens
cctgggacaagcaggccgcc

SEQ ID NO: 5876604 - DNA, 12 bp, Homo sapiens
cctgggacacag

SEQ ID NO: 5876605 - DNA, 16 bp, Homo sapiens
cctgggacacagaccc

SEQ ID NO: 5876606 - DNA, 17 bp, Homo sapiens
cctgggacacagaccca

SEQ ID NO: 5876607 - DNA, 18 bp, Homo sapiens
cctgggacacagacccag

SEQ ID NO: 5876608 - DNA, 23 bp, Homo sapiens
cctgggacacttccctgggcctc

SEQ ID NO: 5876609 - DNA, 13 bp, Homo sapiens
cctgggacagcca

SEQ ID NO: 5876610 - DNA, 14 bp, Homo sapiens
cctgggacccagct

SEQ ID NO: 5876611 - DNA, 23 bp, Homo sapiens
cctgggacccagctactctgtcc

SEQ ID NO: 5876612 - DNA, 14 bp, Homo sapiens
cctgggaccccctc

SEQ ID NO: 5876613 - DNA, 23 bp, Homo sapiens
cctgggaccccctcgccagcttg

SEQ ID NO: 5876614 - DNA, 19 bp, Homo sapiens
cctgggacccttggctatg

SEQ ID NO: 5876615 - DNA, 21 bp, Homo sapiens
cctgggacctccccagcccag

SEQ ID NO: 5876616 - DNA, 20 bp, Homo sapiens
cctgggacctcccctgaggc

SEQ ID NO: 5876617 - DNA, 15 bp, Homo sapiens
cctgggacgcccctt

SEQ ID NO: 5876618 - DNA, 23 bp, Homo sapiens
cctgggacgcccctttctcttgc

SEQ ID NO: 5876619 - DNA, 16 bp, Homo sapiens
cctgggacggctgagc

SEQ ID NO: 5876620 - DNA, 22 bp, Homo sapiens
cctgggactaaagccaggaaca

SEQ ID NO: 5876621 - DNA, 14 bp, Homo sapiens
cctgggactcccag

SEQ ID NO: 5876622 - DNA, 16 bp, Homo sapiens
cctgggactcccagtg

SEQ ID NO: 5876623 - DNA, 18 bp, Homo sapiens
cctgggactcccagtgaa

SEQ ID NO: 5876624 - DNA, 18 bp, Homo sapiens
cctgggacttccatgcct

SEQ ID NO: 5876625 - DNA, 20 bp, Homo sapiens
cctgggactttcccacccag

SEQ ID NO: 5876626 - DNA, 17 bp, Homo sapiens
cctgggagaacctcagg

SEQ ID NO: 5876627 - DNA, 19 bp, Homo sapiens
cctgggagaacctcaggct

SEQ ID NO: 5876628 - DNA, 11 bp, Homo sapiens
cctgggagaga

SEQ ID NO: 5876629 - DNA, 23 bp, Homo sapiens
cctgggagagacttggatgagga

SEQ ID NO: 5876630 - DNA, 17 bp, Homo sapiens
cctgggagaggacaggg

SEQ ID NO: 5876631 - DNA, 22 bp, Homo sapiens
cctgggagagtgaggtcatccc

SEQ ID NO: 5876632 - DNA, 24 bp, Homo sapiens
cctgggagagtggacctgtgctgt

SEQ ID NO: 5876633 - DNA, 14 bp, Homo sapiens
cctgggagatgctg

SEQ ID NO: 5876634 - DNA, 17 bp, Homo sapiens
cctgggagatgctggga

SEQ ID NO: 5876635 - DNA, 22 bp, Homo sapiens
cctgggagatgctgggaccctc

SEQ ID NO: 5876636 - DNA, 20 bp, Homo sapiens
cctgggagcaagttgcagtc

SEQ ID NO: 5876637 - DNA, 18 bp, Homo sapiens
cctgggagccagggtgag

SEQ ID NO: 5876638 - DNA, 21 bp, Homo sapiens
cctgggagcccccaccacaaa

SEQ ID NO: 5876639 - DNA, 15 bp, Homo sapiens
cctgggagccgcctg

SEQ ID NO: 5876640 - DNA, 19 bp, Homo sapiens
cctgggaggacaggcaggc

SEQ ID NO: 5876641 - DNA, 23 bp, Homo sapiens
cctgggaggacaggcaggccaga

SEQ ID NO: 5876642 - DNA, 12 bp, Homo sapiens
cctgggaggaga

SEQ ID NO: 5876643 - DNA, 17 bp, Homo sapiens
cctgggaggctgcagcc

SEQ ID NO: 5876644 - DNA, 20 bp, Homo sapiens
cctgggaggctgcagccagg

SEQ ID NO: 5876645 - DNA, 18 bp, Homo sapiens
cctgggagggttcccctg

SEQ ID NO: 5876646 - DNA, 23 bp, Homo sapiens
cctgggagggttcccctggcctt

SEQ ID NO: 5876647 - DNA, 20 bp, Homo sapiens
cctgggaggtcaaggctgca

SEQ ID NO: 5876648 - DNA, 18 bp, Homo sapiens
cctgggagtgagctggtt

SEQ ID NO: 5876649 - DNA, 21 bp, Homo sapiens
cctgggatcagtggggcccca

SEQ ID NO: 5876650 - DNA, 17 bp, Homo sapiens
cctgggatccgagggcc

SEQ ID NO: 5876651 - DNA, 15 bp, Homo sapiens
cctgggatctggtgg

SEQ ID NO: 5876652 - DNA, 21 bp, Homo sapiens
cctgggatctggtggtcagcc

SEQ ID NO: 5876653 - DNA, 23 bp, Homo sapiens
cctgggatctggtggtcagccct

SEQ ID NO: 5876654 - DNA, 21 bp, Homo sapiens
cctgggatgagagttttggat

SEQ ID NO: 5876655 - DNA, 21 bp, Homo sapiens
cctgggatgatgtgtgaaacc

SEQ ID NO: 5876656 - DNA, 18 bp, Homo sapiens
cctgggatgcagtgatgt

SEQ ID NO: 5876657 - DNA, 14 bp, Homo sapiens
cctgggatgccctt

SEQ ID NO: 5876658 - DNA, 16 bp, Homo sapiens
cctgggatgcccttcc

SEQ ID NO: 5876659 - DNA, 19 bp, Homo sapiens
cctgggatgctagccccag

SEQ ID NO: 5876660 - DNA, 23 bp, Homo sapiens
cctgggatgctagccccagagat

SEQ ID NO: 5876661 - DNA, 14 bp, Homo sapiens
cctgggatggacgc

SEQ ID NO: 5876662 - DNA, 18 bp, Homo sapiens
cctgggatgggaccaggg

SEQ ID NO: 5876663 - DNA, 14 bp, Homo sapiens
cctgggattctacc

SEQ ID NO: 5876664 - DNA, 15 bp, Homo sapiens
cctgggatttgagat

SEQ ID NO: 5876665 - DNA, 19 bp, Homo sapiens
cctgggcaaacagagctac

SEQ ID NO: 5876666 - DNA, 21 bp, Homo sapiens
cctgggcaaatgaatggctca

SEQ ID NO: 5876667 - DNA, 16 bp, Homo sapiens
cctgggcaacagagca

SEQ ID NO: 5876668 - DNA, 17 bp, Homo sapiens
cctgggcaacagagcaa

SEQ ID NO: 5876669 - DNA, 19 bp, Homo sapiens
cctgggcaatgcagtgcag

SEQ ID NO: 5876670 - DNA, 19 bp, Homo sapiens
cctgggcacacgctgctct

SEQ ID NO: 5876671 - DNA, 16 bp, Homo sapiens
cctgggcttccacagt

SEQ ID NO: 5876672 - DNA, 18 bp, Homo sapiens
cctgggcttggcccgcgg

SEQ ID NO: 5876673 - DNA, 14 bp, Homo sapiens
cctgggcttggcct

SEQ ID NO: 5876674 - DNA, 17 bp, Homo sapiens
cctgggcttggcctgct

SEQ ID NO: 5876675 - DNA, 18 bp, Homo sapiens
cctgggcttggcctgctg

SEQ ID NO: 5876676 - DNA, 16 bp, Homo sapiens
cctgggcttggctctt

SEQ ID NO: 5876677 - DNA, 19 bp, Homo sapiens
cctgggcttggctcttggc

SEQ ID NO: 5876678 - DNA, 20 bp, Homo sapiens
cctgggcttttctcccagct

SEQ ID NO: 5876679 - DNA, 18 bp, Homo sapiens
cctggggaaagcctgaag

SEQ ID NO: 5876680 - DNA, 12 bp, Homo sapiens
cctggggaagga

SEQ ID NO: 5876681 - DNA, 22 bp, Homo sapiens
cctggggaccccactccctgct

SEQ ID NO: 5876682 - DNA, 13 bp, Homo sapiens
cctggggaccccc

SEQ ID NO: 5876683 - DNA, 20 bp, Homo sapiens
cctggggacgaattccactc

SEQ ID NO: 5876684 - DNA, 18 bp, Homo sapiens
cctggggacggagcactg

SEQ ID NO: 5876685 - DNA, 22 bp, Homo sapiens
cctggggacggagcactgtgca

SEQ ID NO: 5876686 - DNA, 16 bp, Homo sapiens
cctggggacggggctc

SEQ ID NO: 5876687 - DNA, 17 bp, Homo sapiens
cctggggacggggctcc

SEQ ID NO: 5876688 - DNA, 15 bp, Homo sapiens
cctggggactctgct

SEQ ID NO: 5876689 - DNA, 23 bp, Homo sapiens
cctggggacttcaactgcccagc

SEQ ID NO: 5876690 - DNA, 19 bp, Homo sapiens
cctggggagaaagaggggc

SEQ ID NO: 5876691 - DNA, 15 bp, Homo sapiens
cctggggagaaagta

SEQ ID NO: 5876692 - DNA, 21 bp, Homo sapiens
cctggggagaacccttcctgc

SEQ ID NO: 5876693 - DNA, 14 bp, Homo sapiens
cctggggagccagg

SEQ ID NO: 5876694 - DNA, 13 bp, Homo sapiens
cctggggagccca

SEQ ID NO: 5876695 - DNA, 16 bp, Homo sapiens
cctggggagcccactg

SEQ ID NO: 5876696 - DNA, 18 bp, Homo sapiens
cctggggagccctcaggc

SEQ ID NO: 5876697 - DNA, 23 bp, Homo sapiens
cctggggagccctcaggctcccc

SEQ ID NO: 5876698 - DNA, 18 bp, Homo sapiens
cctggggaggacccctgc

SEQ ID NO: 5876699 - DNA, 13 bp, Homo sapiens
cctggggaggccc

SEQ ID NO: 5876700 - DNA, 13 bp, Homo sapiens
cctggggaggctg

SEQ ID NO: 5876701 - DNA, 18 bp, Homo sapiens
cctggggaggctgagact

SEQ ID NO: 5876702 - DNA, 19 bp, Homo sapiens
cctggggaggctgagactg

SEQ ID NO: 5876703 - DNA, 22 bp, Homo sapiens
cctggggagtgggacagagtct

SEQ ID NO: 5876704 - DNA, 23 bp, Homo sapiens
cctggggagtgggacagagtctg

SEQ ID NO: 5876705 - DNA, 19 bp, Homo sapiens
cctggggatcacagcctca

SEQ ID NO: 5876706 - DNA, 22 bp, Homo sapiens
cctggggatcacagcctcaccc

SEQ ID NO: 5876707 - DNA, 21 bp, Homo sapiens
cctggggatcttcccacagga

SEQ ID NO: 5876708 - DNA, 15 bp, Homo sapiens
cctggggatggccag

SEQ ID NO: 5876709 - DNA, 21 bp, Homo sapiens
cctggggattgggagggacag

SEQ ID NO: 5876710 - DNA, 19 bp, Homo sapiens
cctggggcaaacctagccg

SEQ ID NO: 5876711 - DNA, 22 bp, Homo sapiens
cctggggcacagtccaggaaca

SEQ ID NO: 5876712 - DNA, 13 bp, Homo sapiens
cctggggcagaga

SEQ ID NO: 5876713 - DNA, 16 bp, Homo sapiens
cctggggcagcactcc

SEQ ID NO: 5876714 - DNA, 21 bp, Homo sapiens
cctggggcagggtggggggcc

SEQ ID NO: 5876715 - DNA, 18 bp, Homo sapiens
cctggggcatcatgggca

SEQ ID NO: 5876716 - DNA, 12 bp, Homo sapiens
cctggggcatcc

SEQ ID NO: 5876717 - DNA, 18 bp, Homo sapiens
cctggggcatccatgggg

SEQ ID NO: 5876718 - DNA, 20 bp, Homo sapiens
cctggggccacatagctcat

SEQ ID NO: 5876719 - DNA, 13 bp, Homo sapiens
cctggggccaggc

SEQ ID NO: 5876720 - DNA, 19 bp, Homo sapiens
cctggggcccaagttgcag

SEQ ID NO: 5876721 - DNA, 18 bp, Homo sapiens
cctggggccccgctggga

SEQ ID NO: 5876722 - DNA, 17 bp, Homo sapiens
cctggggccgcctgccc

SEQ ID NO: 5876723 - DNA, 19 bp, Homo sapiens
cctggggccgcctgccctg

SEQ ID NO: 5876724 - DNA, 21 bp, Homo sapiens
cctggggccgcctgccctgcc

SEQ ID NO: 5876725 - DNA, 20 bp, Homo sapiens
cctggggccggtagaggctc

SEQ ID NO: 5876726 - DNA, 13 bp, Homo sapiens
cctggggcctctt

SEQ ID NO: 5876727 - DNA, 13 bp, Homo sapiens
cctggggcctgac

SEQ ID NO: 5876728 - DNA, 14 bp, Homo sapiens
cctggggcctgact

SEQ ID NO: 5876729 - DNA, 16 bp, Homo sapiens
cctggggcctgactgc

SEQ ID NO: 5876730 - DNA, 14 bp, Homo sapiens
cctggggcctgaga

SEQ ID NO: 5876731 - DNA, 15 bp, Homo sapiens
cctggggcctgagag

SEQ ID NO: 5876732 - DNA, 19 bp, Homo sapiens
cctggggcctggacctgcc

SEQ ID NO: 5876733 - DNA, 21 bp, Homo sapiens
cctggggcctggacctgcctc

SEQ ID NO: 5876734 - DNA, 16 bp, Homo sapiens
cctggggcctggcagg

SEQ ID NO: 5876735 - DNA, 18 bp, Homo sapiens
cctggggcctgggccccg

SEQ ID NO: 5876736 - DNA, 16 bp, Homo sapiens
cctggggcctgtactg

SEQ ID NO: 5876737 - DNA, 20 bp, Homo sapiens
cctggggcctgtactgcctg

SEQ ID NO: 5876738 - DNA, 18 bp, Homo sapiens
cctggggcgcgtgaggcc

SEQ ID NO: 5876739 - DNA, 22 bp, Homo sapiens
cctggggcggcatgaaccctct

SEQ ID NO: 5876740 - DNA, 17 bp, Homo sapiens
cctggggcgggcccctc

SEQ ID NO: 5876741 - DNA, 17 bp, Homo sapiens
cctggggcggtgtgtgt

SEQ ID NO: 5876742 - DNA, 20 bp, Homo sapiens
cctggggctcctttctccag

SEQ ID NO: 5876743 - DNA, 20 bp, Homo sapiens
cctggggctctaacgcctga

SEQ ID NO: 5876744 - DNA, 22 bp, Homo sapiens
cctggggctctaacgcctgagc

SEQ ID NO: 5876745 - DNA, 12 bp, Homo sapiens
cctggggctctc

SEQ ID NO: 5876746 - DNA, 15 bp, Homo sapiens
cctggggctctctga

SEQ ID NO: 5876747 - DNA, 19 bp, Homo sapiens
cctggggctgagtctccag

SEQ ID NO: 5876748 - DNA, 23 bp, Homo sapiens
cctggggctgagtctccagggcc

SEQ ID NO: 5876749 - DNA, 22 bp, Homo sapiens
cctggggctgatctcagggaag

SEQ ID NO: 5876750 - DNA, 15 bp, Homo sapiens
cctggggctgccctc

SEQ ID NO: 5876751 - DNA, 14 bp, Homo sapiens
cctggggctgctta

SEQ ID NO: 5876752 - DNA, 12 bp, Homo sapiens
cctggggctggc

SEQ ID NO: 5876753 - DNA, 13 bp, Homo sapiens
cctggggctggct

SEQ ID NO: 5876754 - DNA, 15 bp, Homo sapiens
cctggggctggcttt

SEQ ID NO: 5876755 - DNA, 13 bp, Homo sapiens
cctggggctgggc

SEQ ID NO: 5876756 - DNA, 14 bp, Homo sapiens
cctggggctgggcc

SEQ ID NO: 5876757 - DNA, 17 bp, Homo sapiens
cctggggcttctcctga

SEQ ID NO: 5876758 - DNA, 21 bp, Homo sapiens
cctggggcttctcctgaccca

SEQ ID NO: 5876759 - DNA, 18 bp, Homo sapiens
cctggggcttgaatttgc

SEQ ID NO: 5876760 - DNA, 22 bp, Homo sapiens
cctggggcttgaatttgcatgt

SEQ ID NO: 5876761 - DNA, 13 bp, Homo sapiens
cctgggggaagag

SEQ ID NO: 5876762 - DNA, 16 bp, Homo sapiens
cctgggggaagaggag

SEQ ID NO: 5876763 - DNA, 17 bp, Homo sapiens
cctgggggacagagcaa

SEQ ID NO: 5876764 - DNA, 13 bp, Homo sapiens
cctgggggacctt

SEQ ID NO: 5876765 - DNA, 15 bp, Homo sapiens
cctgggggaggcttc

SEQ ID NO: 5876766 - DNA, 18 bp, Homo sapiens
cctgggggaggcttccag

SEQ ID NO: 5876767 - DNA, 20 bp, Homo sapiens
cctgggggaggcttccagct

SEQ ID NO: 5876768 - DNA, 19 bp, Homo sapiens
cctgggggagttttcctct

SEQ ID NO: 5876769 - DNA, 20 bp, Homo sapiens
cctgggggagttttcctcta

SEQ ID NO: 5876770 - DNA, 20 bp, Homo sapiens
cctgggggataccagctgag

SEQ ID NO: 5876771 - DNA, 19 bp, Homo sapiens
cctgggggattcctgagct

SEQ ID NO: 5876772 - DNA, 19 bp, Homo sapiens
cctgggggcagtgactggc

SEQ ID NO: 5876773 - DNA, 21 bp, Homo sapiens
cctgggggcagtgactggcag

SEQ ID NO: 5876774 - DNA, 23 bp, Homo sapiens
cctgggggcagtgactggcaggt

SEQ ID NO: 5876775 - DNA, 18 bp, Homo sapiens
cctgggggcatcctgctt

SEQ ID NO: 5876776 - DNA, 12 bp, Homo sapiens
cctgggggccag

SEQ ID NO: 5876777 - DNA, 21 bp, Homo sapiens
cctgggggccagctggtgctg

SEQ ID NO: 5876778 - DNA, 18 bp, Homo sapiens
cctgggggccagtgggga

SEQ ID NO: 5876779 - DNA, 23 bp, Homo sapiens
cctgggggcccattctgcatgcc

SEQ ID NO: 5876780 - DNA, 11 bp, Homo sapiens
cctgggggcct

SEQ ID NO: 5876781 - DNA, 12 bp, Homo sapiens
cctgggggcctg

SEQ ID NO: 5876782 - DNA, 15 bp, Homo sapiens
cctgggggcctgacc

SEQ ID NO: 5876783 - DNA, 19 bp, Homo sapiens
cctgggggcctgacctccc

SEQ ID NO: 5876784 - DNA, 15 bp, Homo sapiens
cctgggggcctggct

SEQ ID NO: 5876785 - DNA, 19 bp, Homo sapiens
cctgggggccttgggtgag

SEQ ID NO: 5876786 - DNA, 16 bp, Homo sapiens
cctgggggctcctcac

SEQ ID NO: 5876787 - DNA, 14 bp, Homo sapiens
cctgggggctggct

SEQ ID NO: 5876788 - DNA, 15 bp, Homo sapiens
cctgggggctggctc

SEQ ID NO: 5876789 - DNA, 18 bp, Homo sapiens
cctgggggctgggcagag

SEQ ID NO: 5876790 - DNA, 20 bp, Homo sapiens
cctgggggctgggcagagga

SEQ ID NO: 5876791 - DNA, 22 bp, Homo sapiens
cctgggggctgttagctcagag

SEQ ID NO: 5876792 - DNA, 13 bp, Homo sapiens
cctggggggaggg

SEQ ID NO: 5876793 - DNA, 20 bp, Homo sapiens
cctggggggcacagccagaa

SEQ ID NO: 5876794 - DNA, 18 bp, Homo sapiens
cctggggggcctgaaagc

SEQ ID NO: 5876795 - DNA, 15 bp, Homo sapiens
cctgggggggccgct

SEQ ID NO: 5876796 - DNA, 18 bp, Homo sapiens
cctgggggtaaagccctc

SEQ ID NO: 5876797 - DNA, 18 bp, Homo sapiens
cctgggggtagccccgcc

SEQ ID NO: 5876798 - DNA, 16 bp, Homo sapiens
cctgggggtcccagga

SEQ ID NO: 5876799 - DNA, 19 bp, Homo sapiens
cctgggggtcccaggatcc

SEQ ID NO: 5876800 - DNA, 20 bp, Homo sapiens
cctgggggtcccaggatccc

SEQ ID NO: 5876801 - DNA, 14 bp, Homo sapiens
cctgggggtgccag

SEQ ID NO: 5876802 - DNA, 16 bp, Homo sapiens
cctgggggtggggctc

SEQ ID NO: 5876803 - DNA, 20 bp, Homo sapiens
cctgggggtggggctcctac

SEQ ID NO: 5876804 - DNA, 22 bp, Homo sapiens
cctgggggttctttcttcctct

SEQ ID NO: 5876805 - DNA, 17 bp, Homo sapiens
cctgggggtttcacctg

SEQ ID NO: 5876806 - DNA, 14 bp, Homo sapiens
cctggggtaaagta

SEQ ID NO: 5876807 - DNA, 19 bp, Homo sapiens
cctggggtaggaggaacag

SEQ ID NO: 5876808 - DNA, 18 bp, Homo sapiens
cctggggtcccccctccc

SEQ ID NO: 5876809 - DNA, 22 bp, Homo sapiens
cctggggtccttgctgcaggcc

SEQ ID NO: 5876810 - DNA, 17 bp, Homo sapiens
cctggggtctctctccc

SEQ ID NO: 5876811 - DNA, 22 bp, Homo sapiens
cctggggtgcatcctcctcagc

SEQ ID NO: 5876812 - DNA, 17 bp, Homo sapiens
cctggggtgcatctcct

SEQ ID NO: 5876813 - DNA, 18 bp, Homo sapiens
cctggggtgcatctcctc

SEQ ID NO: 5876814 - DNA, 15 bp, Homo sapiens
cctggggtgccctcc

SEQ ID NO: 5876815 - DNA, 20 bp, Homo sapiens
cctggggtgctgcctctcac

SEQ ID NO: 5876816 - DNA, 23 bp, Homo sapiens
cctggggtgctgcctctcacaca

SEQ ID NO: 5876817 - DNA, 15 bp, Homo sapiens
cctggggtggaggct

SEQ ID NO: 5876818 - DNA, 13 bp, Homo sapiens
cctggggtggcca

SEQ ID NO: 5876819 - DNA, 15 bp, Homo sapiens
cctggggtggccagg

SEQ ID NO: 5876820 - DNA, 18 bp, Homo sapiens
cctggggtggccagggct

SEQ ID NO: 5876821 - DNA, 22 bp, Homo sapiens
cctggggtggcgtctgcctagg

SEQ ID NO: 5876822 - DNA, 18 bp, Homo sapiens
cctggggtgggacaggga

SEQ ID NO: 5876823 - DNA, 19 bp, Homo sapiens
cctggggtgggacagggag

SEQ ID NO: 5876824 - DNA, 23 bp, Homo sapiens
cctggggtgggatctgagctccc

SEQ ID NO: 5876825 - DNA, 15 bp, Homo sapiens
cctggggtggggtca

SEQ ID NO: 5876826 - DNA, 21 bp, Homo sapiens
cctggggtgggtttagcaggc

SEQ ID NO: 5876827 - DNA, 19 bp, Homo sapiens
cctggggtggttggaggcc

SEQ ID NO: 5876828 - DNA, 17 bp, Homo sapiens
cctggggtgtcctacag

SEQ ID NO: 5876829 - DNA, 23 bp, Homo sapiens
cctggggtgtcctacagtgactc

SEQ ID NO: 5876830 - DNA, 23 bp, Homo sapiens
cctggggttgtccccgctggctc

SEQ ID NO: 5876831 - DNA, 23 bp, Homo sapiens
cctggggtttccacacaggccca

SEQ ID NO: 5876832 - DNA, 22 bp, Homo sapiens
cctggggtttgaccacccacct

SEQ ID NO: 5876833 - DNA, 22 bp, Homo sapiens
cctgggtaaatgcagcgtgaag

SEQ ID NO: 5876834 - DNA, 23 bp, Homo sapiens
cctgggtaagaagggtgggagtg

SEQ ID NO: 5876835 - DNA, 19 bp, Homo sapiens
cctgggtactgaggtgcta

SEQ ID NO: 5876836 - DNA, 13 bp, Homo sapiens
cctgggtaggaaa

SEQ ID NO: 5876837 - DNA, 19 bp, Homo sapiens
cctgggtaggccccacaag

SEQ ID NO: 5876838 - DNA, 18 bp, Homo sapiens
cctgggtatcccctgcct

SEQ ID NO: 5876839 - DNA, 19 bp, Homo sapiens
cctgggtatcccctgcctc

SEQ ID NO: 5876840 - DNA, 19 bp, Homo sapiens
cctgggtcaaaaaaaagaa

SEQ ID NO: 5876841 - DNA, 17 bp, Homo sapiens
cctgggtcacagagtga

SEQ ID NO: 5876842 - DNA, 19 bp, Homo sapiens
cctgggtcacagagtgaga

SEQ ID NO: 5876843 - DNA, 17 bp, Homo sapiens
cctgggtcacctagctg

SEQ ID NO: 5876844 - DNA, 19 bp, Homo sapiens
cctgggtcaccttcctggg

SEQ ID NO: 5876845 - DNA, 16 bp, Homo sapiens
cctgggtcacttgctg

SEQ ID NO: 5876846 - DNA, 22 bp, Homo sapiens
cctgggtcatgggcctgtgggg

SEQ ID NO: 5876847 - DNA, 22 bp, Homo sapiens
cctggtgcgctgtgctccagca

SEQ ID NO: 5876848 - DNA, 13 bp, Homo sapiens
cctggtgcgggcc

SEQ ID NO: 5876849 - DNA, 22 bp, Homo sapiens
cctggtgcgggcctggccctca

SEQ ID NO: 5876850 - DNA, 22 bp, Homo sapiens
cctggtgctaacaacaaagttc

SEQ ID NO: 5876851 - DNA, 15 bp, Homo sapiens
cctggtgctcctgcc

SEQ ID NO: 5876852 - DNA, 19 bp, Homo sapiens
cctggtgctctctgccact

SEQ ID NO: 5876853 - DNA, 14 bp, Homo sapiens
cctggtgctgccga

SEQ ID NO: 5876854 - DNA, 21 bp, Homo sapiens
cctggtgctgccgagggctgg

SEQ ID NO: 5876855 - DNA, 20 bp, Homo sapiens
cctggtgctgcctctacctg

SEQ ID NO: 5876856 - DNA, 12 bp, Homo sapiens
cctggtgctgct

SEQ ID NO: 5876857 - DNA, 13 bp, Homo sapiens
cctggtgctgctg

SEQ ID NO: 5876858 - DNA, 15 bp, Homo sapiens
cctggtgctggaggt

SEQ ID NO: 5876859 - DNA, 15 bp, Homo sapiens
cctggtgcttccaaa

SEQ ID NO: 5876860 - DNA, 20 bp, Homo sapiens
cctggtgcttctcctctcct

SEQ ID NO: 5876861 - DNA, 12 bp, Homo sapiens
cctggtggacag

SEQ ID NO: 5876862 - DNA, 19 bp, Homo sapiens
cctggtggacagtcctggg

SEQ ID NO: 5876863 - DNA, 23 bp, Homo sapiens
cctggtggatacctggttgagtg

SEQ ID NO: 5876864 - DNA, 14 bp, Homo sapiens
cctggtggcaccag

SEQ ID NO: 5876865 - DNA, 15 bp, Homo sapiens
cctggtggcaccaga

SEQ ID NO: 5876866 - DNA, 23 bp, Homo sapiens
cctggtggcaccagatgcaacct

SEQ ID NO: 5876867 - DNA, 14 bp, Homo sapiens
cctggtggcagctc

SEQ ID NO: 5876868 - DNA, 13 bp, Homo sapiens
cctggtggcagtg

SEQ ID NO: 5876869 - DNA, 19 bp, Homo sapiens
cctggtggcagtgggagct

SEQ ID NO: 5876870 - DNA, 21 bp, Homo sapiens
cctggtggcagtgggagctgc

SEQ ID NO: 5876871 - DNA, 20 bp, Homo sapiens
cctggtggccatgctcctct

SEQ ID NO: 5876872 - DNA, 20 bp, Homo sapiens
cctggtggccatgtcgcctg

SEQ ID NO: 5876873 - DNA, 21 bp, Homo sapiens
cctggtggccatgtcgcctgc

SEQ ID NO: 5876874 - DNA, 12 bp, Homo sapiens
cctggtggccct

SEQ ID NO: 5876875 - DNA, 16 bp, Homo sapiens
cctggtggccctctcc

SEQ ID NO: 5876876 - DNA, 22 bp, Homo sapiens
cctggtggccctctcccctgcc

SEQ ID NO: 5876877 - DNA, 13 bp, Homo sapiens
cctggtggcctgc

SEQ ID NO: 5876878 - DNA, 14 bp, Homo sapiens
cctggtggcctgcc

SEQ ID NO: 5876879 - DNA, 24 bp, Homo sapiens
cctggtggccttctgctgcccagg

SEQ ID NO: 5876880 - DNA, 13 bp, Homo sapiens
cctggtggctgca

SEQ ID NO: 5876881 - DNA, 13 bp, Homo sapiens
cctggtggctgga

SEQ ID NO: 5876882 - DNA, 16 bp, Homo sapiens
cctggtggctggaggc

SEQ ID NO: 5876883 - DNA, 20 bp, Homo sapiens
cctggtgggagcacctgcca

SEQ ID NO: 5876884 - DNA, 21 bp, Homo sapiens
cctggtggggcagaaaggctg

SEQ ID NO: 5876885 - DNA, 18 bp, Homo sapiens
cctggtggggcagctcct

SEQ ID NO: 5876886 - DNA, 21 bp, Homo sapiens
cctggtggggcagctcctctg

SEQ ID NO: 5876887 - DNA, 16 bp, Homo sapiens
cctggtggggctgagc

SEQ ID NO: 5876888 - DNA, 17 bp, Homo sapiens
cctggtggggctgagcc

SEQ ID NO: 5876889 - DNA, 19 bp, Homo sapiens
cctggtgggggaaggggag

SEQ ID NO: 5876890 - DNA, 20 bp, Homo sapiens
cctggtgggtcagcccagca

SEQ ID NO: 5876891 - DNA, 21 bp, Homo sapiens
cctggtgggtcagcccagcac

SEQ ID NO: 5876892 - DNA, 22 bp, Homo sapiens
cctggtgggtcagcccagcacc

SEQ ID NO: 5876893 - DNA, 19 bp, Homo sapiens
cctggtggtattttcaata

SEQ ID NO: 5876894 - DNA, 19 bp, Homo sapiens
cctggtggtcacaggctgt

SEQ ID NO: 5876895 - DNA, 22 bp, Homo sapiens
cctggtggtcacaggctgtgcc

SEQ ID NO: 5876896 - DNA, 16 bp, Homo sapiens
cctggtggtcagatgc

SEQ ID NO: 5876897 - DNA, 18 bp, Homo sapiens
cctggtggtcagatgcag

SEQ ID NO: 5876898 - DNA, 21 bp, Homo sapiens
cctggtggtggctcgggaggc

SEQ ID NO: 5876899 - DNA, 12 bp, Homo sapiens
cctggtggttca

SEQ ID NO: 5876900 - DNA, 13 bp, Homo sapiens
cctggtggttcac

SEQ ID NO: 5876901 - DNA, 17 bp, Homo sapiens
cctggtgtcaccccaga

SEQ ID NO: 5876902 - DNA, 18 bp, Homo sapiens
cctggtgtcaccccagag

SEQ ID NO: 5876903 - DNA, 20 bp, Homo sapiens
cctggtgtccctgcctggcc

SEQ ID NO: 5876904 - DNA, 16 bp, Homo sapiens
cctggtgtctagtttg

SEQ ID NO: 5876905 - DNA, 13 bp, Homo sapiens
cctggtgtgggta

SEQ ID NO: 5876906 - DNA, 23 bp, Homo sapiens
cctggtgtgggtaaagggacagt

SEQ ID NO: 5876907 - DNA, 12 bp, Homo sapiens
cctggtgtgtaa

SEQ ID NO: 5876908 - DNA, 23 bp, Homo sapiens
cctggtgtttctagcactggcct

SEQ ID NO: 5876909 - DNA, 19 bp, Homo sapiens
cctggtgtttttctctctg

SEQ ID NO: 5876910 - DNA, 22 bp, Homo sapiens
cctggtgtttttctctctggac

SEQ ID NO: 5876911 - DNA, 21 bp, Homo sapiens
cctggttagctgacagtcagc

SEQ ID NO: 5876912 - DNA, 15 bp, Homo sapiens
cctggttcccccagg

SEQ ID NO: 5876913 - DNA, 21 bp, Homo sapiens
cctggttcccccaggaccctg

SEQ ID NO: 5876914 - DNA, 17 bp, Homo sapiens
cctggttccctctttcc

SEQ ID NO: 5876915 - DNA, 20 bp, Homo sapiens
cctggttccctctttcctgt

SEQ ID NO: 5876916 - DNA, 16 bp, Homo sapiens
cctggttcctgctgtc

SEQ ID NO: 5876917 - DNA, 23 bp, Homo sapiens
cctggttcctgctgtcctggtgg

SEQ ID NO: 5876918 - DNA, 17 bp, Homo sapiens
cctggttcgtgccatgc

SEQ ID NO: 5876919 - DNA, 19 bp, Homo sapiens
cctggttctaggctgctgc

SEQ ID NO: 5876920 - DNA, 23 bp, Homo sapiens
cctggttctaggctgctgcacac

SEQ ID NO: 5876921 - DNA, 13 bp, Homo sapiens
cctggttctcatc

SEQ ID NO: 5876922 - DNA, 15 bp, Homo sapiens
cctggttctgatgat

SEQ ID NO: 5876923 - DNA, 16 bp, Homo sapiens
cctggttgcctcatgg

SEQ ID NO: 5876924 - DNA, 14 bp, Homo sapiens
cctggttgcctctc

SEQ ID NO: 5876925 - DNA, 15 bp, Homo sapiens
cctggttgcctctct

SEQ ID NO: 5876926 - DNA, 17 bp, Homo sapiens
cctggttggccgtggtc

SEQ ID NO: 5876927 - DNA, 13 bp, Homo sapiens
cctggttgtctga

SEQ ID NO: 5876928 - DNA, 17 bp, Homo sapiens
cctggttgtctgaaccc

SEQ ID NO: 5876929 - DNA, 20 bp, Homo sapiens
cctggttgtctgaacccagg

SEQ ID NO: 5876930 - DNA, 24 bp, Homo sapiens
cctggttgtctgaacccaggcagc

SEQ ID NO: 5876931 - DNA, 18 bp, Homo sapiens
cctggttgttcctgcatc

SEQ ID NO: 5876932 - DNA, 13 bp, Homo sapiens
cctggtttaattc

SEQ ID NO: 5876933 - DNA, 21 bp, Homo sapiens
cctggtttcataacttcctgt

SEQ ID NO: 5876934 - DNA, 16 bp, Homo sapiens
cctggtttcctcgaga

SEQ ID NO: 5876935 - DNA, 17 bp, Homo sapiens
cctggtttcctcgagag

SEQ ID NO: 5876936 - DNA, 22 bp, Homo sapiens
cctggtttcctgccctgggagg

SEQ ID NO: 5876937 - DNA, 16 bp, Homo sapiens
cctggtttcctggcag

SEQ ID NO: 5876938 - DNA, 17 bp, Homo sapiens
cctggtttcctggcagc

SEQ ID NO: 5876939 - DNA, 18 bp, Homo sapiens
cctggtttcgtgtgctgc

SEQ ID NO: 5876940 - DNA, 13 bp, Homo sapiens
cctggtttctggg

SEQ ID NO: 5876941 - DNA, 20 bp, Homo sapiens
cctggtttgcaaagaccacc

SEQ ID NO: 5876942 - DNA, 13 bp, Homo sapiens
cctggtttgtaat

SEQ ID NO: 5876943 - DNA, 13 bp, Homo sapiens
cctggttttattt

SEQ ID NO: 5876944 - DNA, 13 bp, Homo sapiens
cctggttttcgtc

SEQ ID NO: 5876945 - DNA, 21 bp, Homo sapiens
cctggttttgtacactgctgt

SEQ ID NO: 5876946 - DNA, 14 bp, Homo sapiens
cctggtttttgcct

SEQ ID NO: 5876947 - DNA, 18 bp, Homo sapiens
cctggtttttgtagcctt

SEQ ID NO: 5876948 - DNA, 19 bp, Homo sapiens
cctgtaaaaaaaaaaaagt

SEQ ID NO: 5876949 - DNA, 14 bp, Homo sapiens
cctgtaaaacttta

SEQ ID NO: 5876950 - DNA, 18 bp, Homo sapiens
cctgtaaaagagaggggc

SEQ ID NO: 5876951 - DNA, 13 bp, Homo sapiens
cctgtaaacactc

SEQ ID NO: 5876952 - DNA, 20 bp, Homo sapiens
cctgtaaactttatcactta

SEQ ID NO: 5876953 - DNA, 12 bp, Homo sapiens
cctgtaaataag

SEQ ID NO: 5876954 - DNA, 17 bp, Homo sapiens
cctgtaaataagagttg

SEQ ID NO: 5876955 - DNA, 18 bp, Homo sapiens
cctgtaaataagagttgc

SEQ ID NO: 5876956 - DNA, 21 bp, Homo sapiens
cctgtaaatgtattcattctt

SEQ ID NO: 5876957 - DNA, 16 bp, Homo sapiens
cctgtaaatgtcctga

SEQ ID NO: 5876958 - DNA, 13 bp, Homo sapiens
cctgtaaattatt

SEQ ID NO: 5876959 - DNA, 14 bp, Homo sapiens
cctgtaaattattt

SEQ ID NO: 5876960 - DNA, 17 bp, Homo sapiens
cctgtaaattattttaa

SEQ ID NO: 5876961 - DNA, 16 bp, Homo sapiens
cctgtaacaagccaga

SEQ ID NO: 5876962 - DNA, 21 bp, Homo sapiens
cctgtaacacaagccacagaa

SEQ ID NO: 5876963 - DNA, 22 bp, Homo sapiens
cctgtaacacaagccacagaag

SEQ ID NO: 5876964 - DNA, 23 bp, Homo sapiens
cctgtaacacaagccacagaagc

SEQ ID NO: 5876965 - DNA, 17 bp, Homo sapiens
cctgtaacactcctctg

SEQ ID NO: 5876966 - DNA, 19 bp, Homo sapiens
cctgtaacaggtgtgggga

SEQ ID NO: 5876967 - DNA, 23 bp, Homo sapiens
cctgtaacaggtgtggggacaca

SEQ ID NO: 5876968 - DNA, 19 bp, Homo sapiens
cctgtaacatactggcctg

SEQ ID NO: 5876969 - DNA, 23 bp, Homo sapiens
cctgtaacatactggcctggact

SEQ ID NO: 5876970 - DNA, 21 bp, Homo sapiens
cctgtaacctcttcagaggcc

SEQ ID NO: 5876971 - DNA, 18 bp, Homo sapiens
cctgtaactacaatgatg

SEQ ID NO: 5876972 - DNA, 21 bp, Homo sapiens
cctgtaactacaatgatggta

SEQ ID NO: 5876973 - DNA, 10 bp, Homo sapiens
cctgtaactg

SEQ ID NO: 5876974 - DNA, 15 bp, Homo sapiens
cctgtaagccaaaga

SEQ ID NO: 5876975 - DNA, 16 bp, Homo sapiens
cctgtaagccaaagaa

SEQ ID NO: 5876976 - DNA, 18 bp, Homo sapiens
cctgtaagccaaagaaat

SEQ ID NO: 5876977 - DNA, 18 bp, Homo sapiens
cctgtaaggtttcaatgc

SEQ ID NO: 5876978 - DNA, 12 bp, Homo sapiens
cctgtaataaat

SEQ ID NO: 5876979 - DNA, 14 bp, Homo sapiens
cctgtaataaatat

SEQ ID NO: 5876980 - DNA, 14 bp, Homo sapiens
cctgtaatatattt

SEQ ID NO: 5876981 - DNA, 18 bp, Homo sapiens
cctgtaatatatttatat

SEQ ID NO: 5876982 - DNA, 18 bp, Homo sapiens
cctgtaatcacaactcag

SEQ ID NO: 5876983 - DNA, 21 bp, Homo sapiens
cctgtaatcagctctcctggc

SEQ ID NO: 5876984 - DNA, 23 bp, Homo sapiens
cctgtaatcaggcaaggaggagg

SEQ ID NO: 5876985 - DNA, 15 bp, Homo sapiens
cctgtaatcccaact

SEQ ID NO: 5876986 - DNA, 17 bp, Homo sapiens
cctgtaatcccagaact

SEQ ID NO: 5876987 - DNA, 14 bp, Homo sapiens
cctgtaatcccagc

SEQ ID NO: 5876988 - DNA, 16 bp, Homo sapiens
cctgtaatcccagcac

SEQ ID NO: 5876989 - DNA, 19 bp, Homo sapiens
cctgtaatcccagcacact

SEQ ID NO: 5876990 - DNA, 22 bp, Homo sapiens
cctgtaatcccagcactttggg

SEQ ID NO: 5876991 - DNA, 23 bp, Homo sapiens
cctgtaatcccagcactttggga

SEQ ID NO: 5876992 - DNA, 15 bp, Homo sapiens
cctgtaatcccagct

SEQ ID NO: 5876993 - DNA, 22 bp, Homo sapiens
cctgtaatcccagctacacctg

SEQ ID NO: 5876994 - DNA, 18 bp, Homo sapiens
cctgtaatcccagctact

SEQ ID NO: 5876995 - DNA, 17 bp, Homo sapiens
cctgtaatcccagctat

SEQ ID NO: 5876996 - DNA, 18 bp, Homo sapiens
cctgtaatctcagcactt

SEQ ID NO: 5876997 - DNA, 15 bp, Homo sapiens
cctgtaatctttttc

SEQ ID NO: 5876998 - DNA, 19 bp, Homo sapiens
cctgtaatgcactcctgcc

SEQ ID NO: 5876999 - DNA, 15 bp, Homo sapiens
cctgtaattcagtgt

SEQ ID NO: 5877000 - DNA, 18 bp, Homo sapiens
cctgtaatttttttctta

SEQ ID NO: 5877001 - DNA, 15 bp, Homo sapiens
cctgtacaatattta

SEQ ID NO: 5877002 - DNA, 14 bp, Homo sapiens
cctgtacacacaca

SEQ ID NO: 5877003 - DNA, 22 bp, Homo sapiens
cctgtacacattcctgcattca

SEQ ID NO: 5877004 - DNA, 12 bp, Homo sapiens
cctgtacactga

SEQ ID NO: 5877005 - DNA, 23 bp, Homo sapiens
cctgtacaggaaggtgcctggcc

SEQ ID NO: 5877006 - DNA, 21 bp, Homo sapiens
cctgtacagtagattttccaa

SEQ ID NO: 5877007 - DNA, 22 bp, Homo sapiens
cctgtacagtctgtcttctgta

SEQ ID NO: 5877008 - DNA, 12 bp, Homo sapiens
cctgtacattct

SEQ ID NO: 5877009 - DNA, 16 bp, Homo sapiens
cctgtacattcttcca

SEQ ID NO: 5877010 - DNA, 18 bp, Homo sapiens
cctgtaccaaatctgaca

SEQ ID NO: 5877011 - DNA, 14 bp, Homo sapiens
cctgtacccacccc

SEQ ID NO: 5877012 - DNA, 19 bp, Homo sapiens
cctgtacccagccaccttc

SEQ ID NO: 5877013 - DNA, 23 bp, Homo sapiens
cctgtacccagccaccttcctga

SEQ ID NO: 5877014 - DNA, 13 bp, Homo sapiens
cctgtacccagct

SEQ ID NO: 5877015 - DNA, 17 bp, Homo sapiens
cctgtacccagctcctt

SEQ ID NO: 5877016 - DNA, 15 bp, Homo sapiens
cctgtactagctttt

SEQ ID NO: 5877017 - DNA, 13 bp, Homo sapiens
cctgtactcagga

SEQ ID NO: 5877018 - DNA, 14 bp, Homo sapiens
cctgtactcaggag

SEQ ID NO: 5877019 - DNA, 20 bp, Homo sapiens
cctgtactcgcttgtgcaga

SEQ ID NO: 5877020 - DNA, 15 bp, Homo sapiens
cctgtactgcctgct

SEQ ID NO: 5877021 - DNA, 18 bp, Homo sapiens
cctgtactgttctgtgtc

SEQ ID NO: 5877022 - DNA, 20 bp, Homo sapiens
cctgtactgttctgtgtctt

SEQ ID NO: 5877023 - DNA, 16 bp, Homo sapiens
cctgtagaagatgacc

SEQ ID NO: 5877024 - DNA, 16 bp, Homo sapiens
cctgtcccctatgcca

SEQ ID NO: 5877025 - DNA, 15 bp, Homo sapiens
cctgtcccctcacag

SEQ ID NO: 5877026 - DNA, 16 bp, Homo sapiens
cctgtcccctcacaga

SEQ ID NO: 5877027 - DNA, 20 bp, Homo sapiens
cctgtcccctcacagactct

SEQ ID NO: 5877028 - DNA, 17 bp, Homo sapiens
cctgtcccctcagctcc

SEQ ID NO: 5877029 - DNA, 21 bp, Homo sapiens
cctgtcccctcagctccagac

SEQ ID NO: 5877030 - DNA, 19 bp, Homo sapiens
cctgtcccctgaaaaactg

SEQ ID NO: 5877031 - DNA, 13 bp, Homo sapiens
cctgtcccctgct

SEQ ID NO: 5877032 - DNA, 12 bp, Homo sapiens
cctgtcccctgg

SEQ ID NO: 5877033 - DNA, 14 bp, Homo sapiens
cctgtcccgccttc

SEQ ID NO: 5877034 - DNA, 16 bp, Homo sapiens
cctgtcccgccttcct

SEQ ID NO: 5877035 - DNA, 19 bp, Homo sapiens
cctgtccctacccactctt

SEQ ID NO: 5877036 - DNA, 20 bp, Homo sapiens
cctgtccctacccactcttt

SEQ ID NO: 5877037 - DNA, 16 bp, Homo sapiens
cctgtccctagctcac

SEQ ID NO: 5877038 - DNA, 23 bp, Homo sapiens
cctgtccctagctcacactcatc

SEQ ID NO: 5877039 - DNA, 18 bp, Homo sapiens
cctgtccctagggctctc

SEQ ID NO: 5877040 - DNA, 24 bp, Homo sapiens
cctgtccctagggctctccaagca

SEQ ID NO: 5877041 - DNA, 22 bp, Homo sapiens
cctgtccctcccactccctggg

SEQ ID NO: 5877042 - DNA, 23 bp, Homo sapiens
cctgtccctgcgcctttcctttt

SEQ ID NO: 5877043 - DNA, 14 bp, Homo sapiens
cctgtccctgggag

SEQ ID NO: 5877044 - DNA, 13 bp, Homo sapiens
cctgtccctgtag

SEQ ID NO: 5877045 - DNA, 19 bp, Homo sapiens
cctgtcccttgcctctgcc

SEQ ID NO: 5877046 - DNA, 16 bp, Homo sapiens
cctgtcccttttccct

SEQ ID NO: 5877047 - DNA, 19 bp, Homo sapiens
cctgtccgccctcttcccc

SEQ ID NO: 5877048 - DNA, 22 bp, Homo sapiens
cctgtccggagcgaccctggct

SEQ ID NO: 5877049 - DNA, 14 bp, Homo sapiens
cctgtccggcccag

SEQ ID NO: 5877050 - DNA, 15 bp, Homo sapiens
cctgtccggcccagt

SEQ ID NO: 5877051 - DNA, 18 bp, Homo sapiens
cctgtccggcccagtgcc

SEQ ID NO: 5877052 - DNA, 19 bp, Homo sapiens
cctgtccggcccagtgcca

SEQ ID NO: 5877053 - DNA, 22 bp, Homo sapiens
cctgtccggcccagtgccagct

SEQ ID NO: 5877054 - DNA, 16 bp, Homo sapiens
cctgtcctagcaggat

SEQ ID NO: 5877055 - DNA, 20 bp, Homo sapiens
cctgtcctagtctcctttga

SEQ ID NO: 5877056 - DNA, 10 bp, Homo sapiens
cctgtcctca

SEQ ID NO: 5877057 - DNA, 13 bp, Homo sapiens
cctgtcctcaccg

SEQ ID NO: 5877058 - DNA, 21 bp, Homo sapiens
cctgtcctcactgctccctga

SEQ ID NO: 5877059 - DNA, 15 bp, Homo sapiens
cctgtcctcagcttc

SEQ ID NO: 5877060 - DNA, 14 bp, Homo sapiens
cctgtcctccagct

SEQ ID NO: 5877061 - DNA, 21 bp, Homo sapiens
cctgtcctcccatcccctgga

SEQ ID NO: 5877062 - DNA, 13 bp, Homo sapiens
cctgtcctcctcg

SEQ ID NO: 5877063 - DNA, 14 bp, Homo sapiens
cctgtcctcctcgg

SEQ ID NO: 5877064 - DNA, 23 bp, Homo sapiens
cctgtcctcctcggatcaccgag

SEQ ID NO: 5877065 - DNA, 12 bp, Homo sapiens
cctgtcctcttt

SEQ ID NO: 5877066 - DNA, 17 bp, Homo sapiens
cctgtcctctttcagct

SEQ ID NO: 5877067 - DNA, 18 bp, Homo sapiens
cctgtcctgaaagcggct

SEQ ID NO: 5877068 - DNA, 19 bp, Homo sapiens
cctgtcctgaaagcggctg

SEQ ID NO: 5877069 - DNA, 21 bp, Homo sapiens
cctgtcctgaaagcggctgcc

SEQ ID NO: 5877070 - DNA, 23 bp, Homo sapiens
cctgtcctgatggtcagctccct

SEQ ID NO: 5877071 - DNA, 23 bp, Homo sapiens
cctgtcctgcagtcccacactgt

SEQ ID NO: 5877072 - DNA, 18 bp, Homo sapiens
cctgtcctgccatgcaag

SEQ ID NO: 5877073 - DNA, 12 bp, Homo sapiens
cctgtcctgcct

SEQ ID NO: 5877074 - DNA, 17 bp, Homo sapiens
cctgtcctgcctaaggc

SEQ ID NO: 5877075 - DNA, 14 bp, Homo sapiens
cctgtcctggctcc

SEQ ID NO: 5877076 - DNA, 16 bp, Homo sapiens
cctgtcctgggctggt

SEQ ID NO: 5877077 - DNA, 16 bp, Homo sapiens
cctgtcctggtacagc

SEQ ID NO: 5877078 - DNA, 20 bp, Homo sapiens
cctgtcctggtacagcaggg

SEQ ID NO: 5877079 - DNA, 21 bp, Homo sapiens
cctgtcctggtacagcagggt

SEQ ID NO: 5877080 - DNA, 15 bp, Homo sapiens
cctgtcctggtcctg

SEQ ID NO: 5877081 - DNA, 17 bp, Homo sapiens
cctgtcctggtcctgat

SEQ ID NO: 5877082 - DNA, 14 bp, Homo sapiens
cctgtcctggttcc

SEQ ID NO: 5877083 - DNA, 13 bp, Homo sapiens
cctgtcctgtctt

SEQ ID NO: 5877084 - DNA, 13 bp, Homo sapiens
cctgtcctgtgct

SEQ ID NO: 5877085 - DNA, 18 bp, Homo sapiens
cctgtccttactcagagc

SEQ ID NO: 5877086 - DNA, 22 bp, Homo sapiens
cctgtccttcccacggccactg

SEQ ID NO: 5877087 - DNA, 14 bp, Homo sapiens
cctgtccttccctg

SEQ ID NO: 5877088 - DNA, 18 bp, Homo sapiens
cctgtccttccctgttct

SEQ ID NO: 5877089 - DNA, 14 bp, Homo sapiens
cctgtccttctaca

SEQ ID NO: 5877090 - DNA, 12 bp, Homo sapiens
cctgtccttgca

SEQ ID NO: 5877091 - DNA, 14 bp, Homo sapiens
cctgtcgagacact

SEQ ID NO: 5877092 - DNA, 17 bp, Homo sapiens
cctgtcgagacacttgc

SEQ ID NO: 5877093 - DNA, 16 bp, Homo sapiens
cctgtcgattagactg

SEQ ID NO: 5877094 - DNA, 22 bp, Homo sapiens
cctgtcgattagactggacagc

SEQ ID NO: 5877095 - DNA, 21 bp, Homo sapiens
cctgtcgcccacccagctggt

SEQ ID NO: 5877096 - DNA, 15 bp, Homo sapiens
cctgtcgcccctcct

SEQ ID NO: 5877097 - DNA, 16 bp, Homo sapiens
cctgtcggagccctgt

SEQ ID NO: 5877098 - DNA, 22 bp, Homo sapiens
cctgtcggagccctgtctcctc

SEQ ID NO: 5877099 - DNA, 17 bp, Homo sapiens
cctgtcggcctggtgtt

SEQ ID NO: 5877100 - DNA, 12 bp, Homo sapiens
cctgtcgggccc

SEQ ID NO: 5877101 - DNA, 16 bp, Homo sapiens
cctgtcgggctttgtg

SEQ ID NO: 5877102 - DNA, 22 bp, Homo sapiens
cctgtcgggctttgtgtgaagg

SEQ ID NO: 5877103 - DNA, 18 bp, Homo sapiens
cctgtcgtctctcccacc

SEQ ID NO: 5877104 - DNA, 19 bp, Homo sapiens
cctgtcgtctctcccaccc

SEQ ID NO: 5877105 - DNA, 16 bp, Homo sapiens
cctgtcgtgccagtcc

SEQ ID NO: 5877106 - DNA, 17 bp, Homo sapiens
cctgtcgtgccagtcct

SEQ ID NO: 5877107 - DNA, 15 bp, Homo sapiens
cctgtcgtgtccagc

SEQ ID NO: 5877108 - DNA, 11 bp, Homo sapiens
cctgtctaaag

SEQ ID NO: 5877109 - DNA, 21 bp, Homo sapiens
cctgtctaatttgcacctttg

SEQ ID NO: 5877110 - DNA, 13 bp, Homo sapiens
cctgtctactcat

SEQ ID NO: 5877111 - DNA, 14 bp, Homo sapiens
cctgtctaggcaca

SEQ ID NO: 5877112 - DNA, 22 bp, Homo sapiens
cctgtctaggtcagtacccacc

SEQ ID NO: 5877113 - DNA, 22 bp, Homo sapiens
cctgtctaggtctcctcagggt

SEQ ID NO: 5877114 - DNA, 23 bp, Homo sapiens
cctgtctagtctctcctgtaagc

SEQ ID NO: 5877115 - DNA, 13 bp, Homo sapiens
cctgtctcagcct

SEQ ID NO: 5877116 - DNA, 17 bp, Homo sapiens
cctgtctcagcctcctg

SEQ ID NO: 5877117 - DNA, 19 bp, Homo sapiens
cctgtctcagcctcctgag

SEQ ID NO: 5877118 - DNA, 13 bp, Homo sapiens
cctgtctcagtga

SEQ ID NO: 5877119 - DNA, 20 bp, Homo sapiens
cctgtctcatccccaggggt

SEQ ID NO: 5877120 - DNA, 15 bp, Homo sapiens
cctgtctccagctgc

SEQ ID NO: 5877121 - DNA, 20 bp, Homo sapiens
cctgtctccagctgcctggg

SEQ ID NO: 5877122 - DNA, 14 bp, Homo sapiens
cctgtctcccctct

SEQ ID NO: 5877123 - DNA, 17 bp, Homo sapiens
cctgtctcccctctgct

SEQ ID NO: 5877124 - DNA, 18 bp, Homo sapiens
cctgtctcccctctgctg

SEQ ID NO: 5877125 - DNA, 20 bp, Homo sapiens
cctgtctcccctctgctggc

SEQ ID NO: 5877126 - DNA, 21 bp, Homo sapiens
cctgtctccctcctctgcccg

SEQ ID NO: 5877127 - DNA, 14 bp, Homo sapiens
cctgtctcccttct

SEQ ID NO: 5877128 - DNA, 22 bp, Homo sapiens
cctgtctcctactttgaaaact

SEQ ID NO: 5877129 - DNA, 12 bp, Homo sapiens
cctgtctcctct

SEQ ID NO: 5877130 - DNA, 14 bp, Homo sapiens
cctgtctcctctgt

SEQ ID NO: 5877131 - DNA, 16 bp, Homo sapiens
cctgtctcctctgtca

SEQ ID NO: 5877132 - DNA, 13 bp, Homo sapiens
cctgtctcctggc

SEQ ID NO: 5877133 - DNA, 23 bp, Homo sapiens
cctgtctcctttcaccccagggc

SEQ ID NO: 5877134 - DNA, 15 bp, Homo sapiens
cctgtctcgggctga

SEQ ID NO: 5877135 - DNA, 20 bp, Homo sapiens
cctgtctcggggcttgcccc

SEQ ID NO: 5877136 - DNA, 22 bp, Homo sapiens
cctgtctctaaaaagaagccac

SEQ ID NO: 5877137 - DNA, 19 bp, Homo sapiens
cctgtctctcagggccagg

SEQ ID NO: 5877138 - DNA, 13 bp, Homo sapiens
cctgtctctccct

SEQ ID NO: 5877139 - DNA, 12 bp, Homo sapiens
cctgtctctctc

SEQ ID NO: 5877140 - DNA, 15 bp, Homo sapiens
cctgtctctgcatct

SEQ ID NO: 5877141 - DNA, 16 bp, Homo sapiens
cctgtctctgcatctg

SEQ ID NO: 5877142 - DNA, 15 bp, Homo sapiens
cctgtctctgcctgc

SEQ ID NO: 5877143 - DNA, 16 bp, Homo sapiens
cctgtctctgcctgcg

SEQ ID NO: 5877144 - DNA, 20 bp, Homo sapiens
cctgtctctggctactccct

SEQ ID NO: 5877145 - DNA, 22 bp, Homo sapiens
cctgtctcttgggaagcagttt

SEQ ID NO: 5877146 - DNA, 20 bp, Homo sapiens
cctgtctctttccactttgt

SEQ ID NO: 5877147 - DNA, 23 bp, Homo sapiens
cctgtctgaaaccagaagactgg

SEQ ID NO: 5877148 - DNA, 16 bp, Homo sapiens
cctgtctgaacaaaaa

SEQ ID NO: 5877149 - DNA, 21 bp, Homo sapiens
cctgtctgaaggacacttcct

SEQ ID NO: 5877150 - DNA, 19 bp, Homo sapiens
cctgtctgaatgtacctgt

SEQ ID NO: 5877151 - DNA, 23 bp, Homo sapiens
cctgtctgagactcacaggaagg

SEQ ID NO: 5877152 - DNA, 12 bp, Homo sapiens
cctgtctgcagg

SEQ ID NO: 5877153 - DNA, 21 bp, Homo sapiens
cctgtctgccagccagcagcc

SEQ ID NO: 5877154 - DNA, 23 bp, Homo sapiens
cctgtctgccagccagcagccag

SEQ ID NO: 5877155 - DNA, 20 bp, Homo sapiens
cctgtctgcgccgctgtgct

SEQ ID NO: 5877156 - DNA, 22 bp, Homo sapiens
cctgtctgctaggcgctgggga

SEQ ID NO: 5877157 - DNA, 13 bp, Homo sapiens
cctgtctgctcca

SEQ ID NO: 5877158 - DNA, 18 bp, Homo sapiens
cctgtctgctccagctct

SEQ ID NO: 5877159 - DNA, 12 bp, Homo sapiens
cctgtctgctgc

SEQ ID NO: 5877160 - DNA, 14 bp, Homo sapiens
cctgtctgctgcca

SEQ ID NO: 5877161 - DNA, 16 bp, Homo sapiens
cctgtctgctgccagc

SEQ ID NO: 5877162 - DNA, 17 bp, Homo sapiens
cctgtctgctgccagca

SEQ ID NO: 5877163 - DNA, 14 bp, Homo sapiens
cctgtctgctgggc

SEQ ID NO: 5877164 - DNA, 13 bp, Homo sapiens
cctgtctgcttgc

SEQ ID NO: 5877165 - DNA, 22 bp, Homo sapiens
cctgtctggctcggacccaccc

SEQ ID NO: 5877166 - DNA, 23 bp, Homo sapiens
cctgtctgtccaacccctccccc

SEQ ID NO: 5877167 - DNA, 16 bp, Homo sapiens
cctgtctgtccttctg

SEQ ID NO: 5877168 - DNA, 17 bp, Homo sapiens
cctgtctgtccttctga

SEQ ID NO: 5877169 - DNA, 19 bp, Homo sapiens
cctgtctgtcgctgggctg

SEQ ID NO: 5877170 - DNA, 22 bp, Homo sapiens
cctgtctgtcgctgggctgtgg

SEQ ID NO: 5877171 - DNA, 17 bp, Homo sapiens
cctgtctgtctctccat

SEQ ID NO: 5877172 - DNA, 20 bp, Homo sapiens
cctgtctgtctgtctgtccc

SEQ ID NO: 5877173 - DNA, 18 bp, Homo sapiens
cctgtctgtgcagatgct

SEQ ID NO: 5877174 - DNA, 15 bp, Homo sapiens
cctgtctgtgtccca

SEQ ID NO: 5877175 - DNA, 17 bp, Homo sapiens
cctgtctgtgtcccagc

SEQ ID NO: 5877176 - DNA, 15 bp, Homo sapiens
cctgtctgttcccag

SEQ ID NO: 5877177 - DNA, 23 bp, Homo sapiens
cctgtctgttcccagcccctgca

SEQ ID NO: 5877178 - DNA, 14 bp, Homo sapiens
cctgtctgtttata

SEQ ID NO: 5877179 - DNA, 17 bp, Homo sapiens
cctgtcttatcctccac

SEQ ID NO: 5877180 - DNA, 22 bp, Homo sapiens
cctgtcttatggcgttgcaggc

SEQ ID NO: 5877181 - DNA, 21 bp, Homo sapiens
cctgtcttatggtccagaaac

SEQ ID NO: 5877182 - DNA, 15 bp, Homo sapiens
cctgtcttcacctgc

SEQ ID NO: 5877183 - DNA, 18 bp, Homo sapiens
cctgtcttcacctgccac

SEQ ID NO: 5877184 - DNA, 16 bp, Homo sapiens
cctgtcttcagagcaa

SEQ ID NO: 5877185 - DNA, 21 bp, Homo sapiens
cctgtcttcagatcctgctgc

SEQ ID NO: 5877186 - DNA, 14 bp, Homo sapiens
cctgtcttccaagg

SEQ ID NO: 5877187 - DNA, 14 bp, Homo sapiens
cctgtcttcccagg

SEQ ID NO: 5877188 - DNA, 15 bp, Homo sapiens
cctgtcttcccaggg

SEQ ID NO: 5877189 - DNA, 18 bp, Homo sapiens
cctgtcttcccagggtag

SEQ ID NO: 5877190 - DNA, 17 bp, Homo sapiens
cctgtcttcctctgcaa

SEQ ID NO: 5877191 - DNA, 21 bp, Homo sapiens
cctgtcttctgctttgttgtg

SEQ ID NO: 5877192 - DNA, 21 bp, Homo sapiens
cctgtcttctttctccatgga

SEQ ID NO: 5877193 - DNA, 20 bp, Homo sapiens
cctgtcttgctcctggggag

SEQ ID NO: 5877194 - DNA, 13 bp, Homo sapiens
cctgtcttggcct

SEQ ID NO: 5877195 - DNA, 17 bp, Homo sapiens
cctgtcttggcctccca

SEQ ID NO: 5877196 - DNA, 20 bp, Homo sapiens
cctgtcttggggccactttc

SEQ ID NO: 5877197 - DNA, 18 bp, Homo sapiens
cctgtctttcagcattca

SEQ ID NO: 5877198 - DNA, 19 bp, Homo sapiens
cctgtctttcctaagacct

SEQ ID NO: 5877199 - DNA, 20 bp, Homo sapiens
cctgtctttgttgtctccct

SEQ ID NO: 5877200 - DNA, 14 bp, Homo sapiens
cctgtgaaagctgc

SEQ ID NO: 5877201 - DNA, 16 bp, Homo sapiens
cctgtgaacccaggac

SEQ ID NO: 5877202 - DNA, 12 bp, Homo sapiens
cctgtggccagg

SEQ ID NO: 5877203 - DNA, 23 bp, Homo sapiens
cctgtggccatgaccctgcctct

SEQ ID NO: 5877204 - DNA, 22 bp, Homo sapiens
cctgtggcccacgggccggcca

SEQ ID NO: 5877205 - DNA, 15 bp, Homo sapiens
cctgtggccccaccc

SEQ ID NO: 5877206 - DNA, 17 bp, Homo sapiens
cctgtggccccaccctg

SEQ ID NO: 5877207 - DNA, 16 bp, Homo sapiens
cctgtggcctcagcat

SEQ ID NO: 5877208 - DNA, 14 bp, Homo sapiens
cctgtggcctgctc

SEQ ID NO: 5877209 - DNA, 21 bp, Homo sapiens
cctgtggcctgtgtcccatga

SEQ ID NO: 5877210 - DNA, 23 bp, Homo sapiens
cctgtggcctgtgtcccatgacc

SEQ ID NO: 5877211 - DNA, 15 bp, Homo sapiens
cctgtggccttgccc

SEQ ID NO: 5877212 - DNA, 19 bp, Homo sapiens
cctgtggccttgcccgcca

SEQ ID NO: 5877213 - DNA, 15 bp, Homo sapiens
cctgtggcggtgcag

SEQ ID NO: 5877214 - DNA, 17 bp, Homo sapiens
cctgtggcggtgcctgg

SEQ ID NO: 5877215 - DNA, 19 bp, Homo sapiens
cctgtggcggtgcctgggt

SEQ ID NO: 5877216 - DNA, 18 bp, Homo sapiens
cctgtggctcaggggagc

SEQ ID NO: 5877217 - DNA, 21 bp, Homo sapiens
cctgtggctcaggggagcaag

SEQ ID NO: 5877218 - DNA, 20 bp, Homo sapiens
cctgtggctccaggagcagc

SEQ ID NO: 5877219 - DNA, 13 bp, Homo sapiens
cctgtggctccct

SEQ ID NO: 5877220 - DNA, 20 bp, Homo sapiens
cctgtggctccctctctcct

SEQ ID NO: 5877221 - DNA, 22 bp, Homo sapiens
cctgtggctccctctctcctgg

SEQ ID NO: 5877222 - DNA, 23 bp, Homo sapiens
cctgtggctctacaactgagtcc

SEQ ID NO: 5877223 - DNA, 16 bp, Homo sapiens
cctgtggcttggagtg

SEQ ID NO: 5877224 - DNA, 21 bp, Homo sapiens
cctgtggctttgttttcttag

SEQ ID NO: 5877225 - DNA, 22 bp, Homo sapiens
cctgtgggaccgcctggccctc

SEQ ID NO: 5877226 - DNA, 23 bp, Homo sapiens
cctgtgggactcatccttgccca

SEQ ID NO: 5877227 - DNA, 12 bp, Homo sapiens
cctgtgggagaa

SEQ ID NO: 5877228 - DNA, 19 bp, Homo sapiens
cctgtgggagaagggacag

SEQ ID NO: 5877229 - DNA, 21 bp, Homo sapiens
cctgtgggcagcatgcccaga

SEQ ID NO: 5877230 - DNA, 15 bp, Homo sapiens
cctgtgggccagccg

SEQ ID NO: 5877231 - DNA, 20 bp, Homo sapiens
cctgtgggcccccaaatgga

SEQ ID NO: 5877232 - DNA, 12 bp, Homo sapiens
cctgtgggcctc

SEQ ID NO: 5877233 - DNA, 22 bp, Homo sapiens
cctgtgggcctcacctgcccct

SEQ ID NO: 5877234 - DNA, 15 bp, Homo sapiens
cctgtgggcctggga

SEQ ID NO: 5877235 - DNA, 16 bp, Homo sapiens
cctgtgggctcacacc

SEQ ID NO: 5877236 - DNA, 21 bp, Homo sapiens
cctgtgggcttatgtctctgc

SEQ ID NO: 5877237 - DNA, 18 bp, Homo sapiens
cctgtggggaacaggtct

SEQ ID NO: 5877238 - DNA, 13 bp, Homo sapiens
cctgtggggagcc

SEQ ID NO: 5877239 - DNA, 20 bp, Homo sapiens
cctgtggggatctcaggggc

SEQ ID NO: 5877240 - DNA, 22 bp, Homo sapiens
cctgtggggatttctcccagct

SEQ ID NO: 5877241 - DNA, 14 bp, Homo sapiens
cctgtggggcagga

SEQ ID NO: 5877242 - DNA, 15 bp, Homo sapiens
cctgtggggcctggg

SEQ ID NO: 5877243 - DNA, 14 bp, Homo sapiens
cctgtgggggtggc

SEQ ID NO: 5877244 - DNA, 16 bp, Homo sapiens
cctgtggggttgtttt

SEQ ID NO: 5877245 - DNA, 17 bp, Homo sapiens
cctgtgggtccccactc

SEQ ID NO: 5877246 - DNA, 12 bp, Homo sapiens
cctgtgggtggg

SEQ ID NO: 5877247 - DNA, 14 bp, Homo sapiens
cctgtgggtggggc

SEQ ID NO: 5877248 - DNA, 24 bp, Homo sapiens
cctgtgggtggggcttctctggga

SEQ ID NO: 5877249 - DNA, 18 bp, Homo sapiens
cctgtgggtgtagccagg

SEQ ID NO: 5877250 - DNA, 23 bp, Homo sapiens
cctgtgggtgtagccaggtatgg

SEQ ID NO: 5877251 - DNA, 17 bp, Homo sapiens
cctgtgggtttgggtgc

SEQ ID NO: 5877252 - DNA, 23 bp, Homo sapiens
cctgtgggtttgggtgcctcctg

SEQ ID NO: 5877253 - DNA, 16 bp, Homo sapiens
cctgtggtaccctggc

SEQ ID NO: 5877254 - DNA, 19 bp, Homo sapiens
cctgtggtaccctggcaga

SEQ ID NO: 5877255 - DNA, 22 bp, Homo sapiens
cctgtggtagtcctcccaagct

SEQ ID NO: 5877256 - DNA, 16 bp, Homo sapiens
cctgtggtcactgact

SEQ ID NO: 5877257 - DNA, 20 bp, Homo sapiens
cctgtggtcacttatcctga

SEQ ID NO: 5877258 - DNA, 12 bp, Homo sapiens
cctgtggtctgt

SEQ ID NO: 5877259 - DNA, 14 bp, Homo sapiens
cctgtggtctgtgt

SEQ ID NO: 5877260 - DNA, 17 bp, Homo sapiens
cctgtggtctgtgtgtg

SEQ ID NO: 5877261 - DNA, 22 bp, Homo sapiens
cctgtggtggctccccctctgc

SEQ ID NO: 5877262 - DNA, 23 bp, Homo sapiens
cctgtggtggctccccctctgct

SEQ ID NO: 5877263 - DNA, 15 bp, Homo sapiens
cctgtggttacagtg

SEQ ID NO: 5877264 - DNA, 19 bp, Homo sapiens
cctgtggttacagtgcaga

SEQ ID NO: 5877265 - DNA, 20 bp, Homo sapiens
cctgtggtttccaaggagct

SEQ ID NO: 5877266 - DNA, 21 bp, Homo sapiens
cctgtggtttccaaggagctg

SEQ ID NO: 5877267 - DNA, 21 bp, Homo sapiens
cctgtggtttgctccagaatt

SEQ ID NO: 5877268 - DNA, 13 bp, Homo sapiens
cctgtggtttgtt

SEQ ID NO: 5877269 - DNA, 21 bp, Homo sapiens
cctgtggtttgttatcagtac

SEQ ID NO: 5877270 - DNA, 13 bp, Homo sapiens
cctgtgtaacagc

SEQ ID NO: 5877271 - DNA, 16 bp, Homo sapiens
cctgtgtaacagctcc

SEQ ID NO: 5877272 - DNA, 21 bp, Homo sapiens
cctgtgtaacagctccttggg

SEQ ID NO: 5877273 - DNA, 22 bp, Homo sapiens
cctgtgtaacagctccttggga

SEQ ID NO: 5877274 - DNA, 22 bp, Homo sapiens
cctgtgtaacaggaccccaagg

SEQ ID NO: 5877275 - DNA, 14 bp, Homo sapiens
cctgtgtagctgtg

SEQ ID NO: 5877276 - DNA, 17 bp, Homo sapiens
cctgtgtagctgtgacc

SEQ ID NO: 5877277 - DNA, 19 bp, Homo sapiens
cctgtgtagctgtgacctg

SEQ ID NO: 5877278 - DNA, 22 bp, Homo sapiens
cctgtgtagctgtgacctgctg

SEQ ID NO: 5877279 - DNA, 23 bp, Homo sapiens
cctgtgtagctgtgacctgctga

SEQ ID NO: 5877280 - DNA, 21 bp, Homo sapiens
cctgtgtataaaaaagaaaac

SEQ ID NO: 5877281 - DNA, 23 bp, Homo sapiens
cctgtgtcagaaaccctggtctc

SEQ ID NO: 5877282 - DNA, 13 bp, Homo sapiens
cctgtgtcagagc

SEQ ID NO: 5877283 - DNA, 18 bp, Homo sapiens
cctgtgtcagagcctacc

SEQ ID NO: 5877284 - DNA, 19 bp, Homo sapiens
cctgtgtcagagcctacct

SEQ ID NO: 5877285 - DNA, 14 bp, Homo sapiens
cctgtgtcatctgt

SEQ ID NO: 5877286 - DNA, 17 bp, Homo sapiens
cctgtgtcatctgtcag

SEQ ID NO: 5877287 - DNA, 14 bp, Homo sapiens
cctgtgtccacagt

SEQ ID NO: 5877288 - DNA, 18 bp, Homo sapiens
cctgtgtccacctgtggg

SEQ ID NO: 5877289 - DNA, 15 bp, Homo sapiens
cctgtgtccagcagc

SEQ ID NO: 5877290 - DNA, 18 bp, Homo sapiens
cctgtgtccagcagctgc

SEQ ID NO: 5877291 - DNA, 13 bp, Homo sapiens
cctgtgtccatgc

SEQ ID NO: 5877292 - DNA, 18 bp, Homo sapiens
cctgtgtcccatgaccca

SEQ ID NO: 5877293 - DNA, 23 bp, Homo sapiens
cctgtgtcccatgacccacccct

SEQ ID NO: 5877294 - DNA, 22 bp, Homo sapiens
cctgtgtccccgatgctgacct

SEQ ID NO: 5877295 - DNA, 20 bp, Homo sapiens
cctgtgtcccctgacctgtc

SEQ ID NO: 5877296 - DNA, 18 bp, Homo sapiens
cctgtgtccgatgctgga

SEQ ID NO: 5877297 - DNA, 21 bp, Homo sapiens
cctgtgtcggggctgacctct

SEQ ID NO: 5877298 - DNA, 14 bp, Homo sapiens
cctgtgtctatgta

SEQ ID NO: 5877299 - DNA, 19 bp, Homo sapiens
cctgtgtctccaagcctct

SEQ ID NO: 5877300 - DNA, 13 bp, Homo sapiens
cctgtgtctggcc

SEQ ID NO: 5877301 - DNA, 21 bp, Homo sapiens
cctgtgtctggtccacacacc

SEQ ID NO: 5877302 - DNA, 21 bp, Homo sapiens
cctgtgtcttgcaatggcagc

SEQ ID NO: 5877303 - DNA, 12 bp, Homo sapiens
cctgtgtctttt

SEQ ID NO: 5877304 - DNA, 13 bp, Homo sapiens
cctgtgtcttttt

SEQ ID NO: 5877305 - DNA, 20 bp, Homo sapiens
cctgtgtctttttcgccaaa

SEQ ID NO: 5877306 - DNA, 21 bp, Homo sapiens
cctgtgtgacatcacagggcc

SEQ ID NO: 5877307 - DNA, 22 bp, Homo sapiens
cctgtgtgacatcacagggcct

SEQ ID NO: 5877308 - DNA, 20 bp, Homo sapiens
cctgtgtgaccctgggcagt

SEQ ID NO: 5877309 - DNA, 18 bp, Homo sapiens
cctgtgtgattgacagct

SEQ ID NO: 5877310 - DNA, 22 bp, Homo sapiens
cctgtgtgattgacagctttgc

SEQ ID NO: 5877311 - DNA, 13 bp, Homo sapiens
cctgtgtgcccag

SEQ ID NO: 5877312 - DNA, 15 bp, Homo sapiens
cctgtgtgcttggtc

SEQ ID NO: 5877313 - DNA, 14 bp, Homo sapiens
cctgtgtggacagg

SEQ ID NO: 5877314 - DNA, 12 bp, Homo sapiens
cctgtgtggaga

SEQ ID NO: 5877315 - DNA, 16 bp, Homo sapiens
cctgtgtggagaggga

SEQ ID NO: 5877316 - DNA, 19 bp, Homo sapiens
cctgtgtggatgctgagct

SEQ ID NO: 5877317 - DNA, 20 bp, Homo sapiens
cctgtgtggatgctgagctg

SEQ ID NO: 5877318 - DNA, 12 bp, Homo sapiens
cctgtgtggcca

SEQ ID NO: 5877319 - DNA, 15 bp, Homo sapiens
cctgtgtggggaggc

SEQ ID NO: 5877320 - DNA, 17 bp, Homo sapiens
cctgtgtggtactctga

SEQ ID NO: 5877321 - DNA, 21 bp, Homo sapiens
cctgtgtggtttagtgtaaaa

SEQ ID NO: 5877322 - DNA, 18 bp, Homo sapiens
cctgtgtgtaagctgact

SEQ ID NO: 5877323 - DNA, 19 bp, Homo sapiens
cctgtgtgtaggctggggc

SEQ ID NO: 5877324 - DNA, 21 bp, Homo sapiens
cctgtgtgtccaaaactgcct

SEQ ID NO: 5877325 - DNA, 21 bp, Homo sapiens
cctgtgtgtgaaaggaagctc

SEQ ID NO: 5877326 - DNA, 21 bp, Homo sapiens
cctgtgtgtgcgcctacagga

SEQ ID NO: 5877327 - DNA, 17 bp, Homo sapiens
cctgtgtgtgtcccctc

SEQ ID NO: 5877328 - DNA, 20 bp, Homo sapiens
cctgtgtgtgtgtgtgtaca

SEQ ID NO: 5877329 - DNA, 16 bp, Homo sapiens
cctgtgtgttaagctc

SEQ ID NO: 5877330 - DNA, 14 bp, Homo sapiens
cctgtgtgttcttt

SEQ ID NO: 5877331 - DNA, 19 bp, Homo sapiens
cctgtgtgttcttttgata

SEQ ID NO: 5877332 - DNA, 15 bp, Homo sapiens
cctgtgttacccagg

SEQ ID NO: 5877333 - DNA, 16 bp, Homo sapiens
cctgtgttagtgtctg

SEQ ID NO: 5877334 - DNA, 22 bp, Homo sapiens
cctgtgttcaagcgattctcct

SEQ ID NO: 5877335 - DNA, 22 bp, Homo sapiens
cctgtgttctgggctggggcca

SEQ ID NO: 5877336 - DNA, 20 bp, Homo sapiens
cctgtgttcttcctggccgc

SEQ ID NO: 5877337 - DNA, 17 bp, Homo sapiens
cctgtgttgtcccatct

SEQ ID NO: 5877338 - DNA, 17 bp, Homo sapiens
cctgtgtttgctcccat

SEQ ID NO: 5877339 - DNA, 17 bp, Homo sapiens
cctgtgtttgtcctggg

SEQ ID NO: 5877340 - DNA, 20 bp, Homo sapiens
cctgtgtttgtcctgggttc

SEQ ID NO: 5877341 - DNA, 20 bp, Homo sapiens
cctgttaaaagatgaaaata

SEQ ID NO: 5877342 - DNA, 17 bp, Homo sapiens
cctgttaaaatgtacac

SEQ ID NO: 5877343 - DNA, 13 bp, Homo sapiens
cctgttaaatata

SEQ ID NO: 5877344 - DNA, 13 bp, Homo sapiens
cctgttaaatttt

SEQ ID NO: 5877345 - DNA, 22 bp, Homo sapiens
cctgttaaattttctctaaact

SEQ ID NO: 5877346 - DNA, 15 bp, Homo sapiens
cctgttaagtctgag

SEQ ID NO: 5877347 - DNA, 18 bp, Homo sapiens
cctgttaagtctgagaag

SEQ ID NO: 5877348 - DNA, 23 bp, Homo sapiens
cctgttaatttataatgtatttg

SEQ ID NO: 5877349 - DNA, 16 bp, Homo sapiens
cctgttacactgggct

SEQ ID NO: 5877350 - DNA, 21 bp, Homo sapiens
cctgttacactgggctgggtt

SEQ ID NO: 5877351 - DNA, 22 bp, Homo sapiens
cctgttacctaattagagcaga

SEQ ID NO: 5877352 - DNA, 18 bp, Homo sapiens
cctgttacctactttgac

SEQ ID NO: 5877353 - DNA, 21 bp, Homo sapiens
cctgttacctgtcttgctcct

SEQ ID NO: 5877354 - DNA, 14 bp, Homo sapiens
cctgttactctgtc

SEQ ID NO: 5877355 - DNA, 15 bp, Homo sapiens
cctgttactctgtcc

SEQ ID NO: 5877356 - DNA, 15 bp, Homo sapiens
cctgttagcagacag

SEQ ID NO: 5877357 - DNA, 15 bp, Homo sapiens
cctgttagccaggtg

SEQ ID NO: 5877358 - DNA, 22 bp, Homo sapiens
cctgttagctaaaagaggcctg

SEQ ID NO: 5877359 - DNA, 23 bp, Homo sapiens
cctgttagctaaaagaggcctgt

SEQ ID NO: 5877360 - DNA, 14 bp, Homo sapiens
cctgttagctttcc

SEQ ID NO: 5877361 - DNA, 19 bp, Homo sapiens
cctgttaggagaagctgca

SEQ ID NO: 5877362 - DNA, 18 bp, Homo sapiens
cctgttaggccaactgcc

SEQ ID NO: 5877363 - DNA, 17 bp, Homo sapiens
cctgttaggtctcatgc

SEQ ID NO: 5877364 - DNA, 15 bp, Homo sapiens
cctgttagttttgta

SEQ ID NO: 5877365 - DNA, 23 bp, Homo sapiens
cctgttagttttgtaaaaactga

SEQ ID NO: 5877366 - DNA, 14 bp, Homo sapiens
cctgttatgtttaa

SEQ ID NO: 5877367 - DNA, 15 bp, Homo sapiens
cctgttatttatcaa

SEQ ID NO: 5877368 - DNA, 13 bp, Homo sapiens
cctgttatttcta

SEQ ID NO: 5877369 - DNA, 19 bp, Homo sapiens
cctgttattttatgtctgt

SEQ ID NO: 5877370 - DNA, 19 bp, Homo sapiens
cctgttattttcaagtagc

SEQ ID NO: 5877371 - DNA, 22 bp, Homo sapiens
cctgttcaaaatgttaataaag

SEQ ID NO: 5877372 - DNA, 22 bp, Homo sapiens
cctgttcaaagatgcattttga

SEQ ID NO: 5877373 - DNA, 14 bp, Homo sapiens
cctgttcaaagtac

SEQ ID NO: 5877374 - DNA, 21 bp, Homo sapiens
cctgttcacagaaaaagcatg

SEQ ID NO: 5877375 - DNA, 16 bp, Homo sapiens
cctgttcacgctcacc

SEQ ID NO: 5877376 - DNA, 17 bp, Homo sapiens
cctgttcacgctcaccc

SEQ ID NO: 5877377 - DNA, 15 bp, Homo sapiens
ccttaggcagggaag

SEQ ID NO: 5877378 - DNA, 18 bp, Homo sapiens
ccttaggcattatttaat

SEQ ID NO: 5877379 - DNA, 17 bp, Homo sapiens
ccttaggccccgtggtg

SEQ ID NO: 5877380 - DNA, 19 bp, Homo sapiens
ccttaggcctacctgatgg

SEQ ID NO: 5877381 - DNA, 14 bp, Homo sapiens
ccttaggccttcct

SEQ ID NO: 5877382 - DNA, 23 bp, Homo sapiens
ccttaggccttcctctctccaga

SEQ ID NO: 5877383 - DNA, 19 bp, Homo sapiens
ccttaggctgctgggagat

SEQ ID NO: 5877384 - DNA, 13 bp, Homo sapiens
ccttaggctttgt

SEQ ID NO: 5877385 - DNA, 22 bp, Homo sapiens
ccttagggaagttgtctccttc

SEQ ID NO: 5877386 - DNA, 17 bp, Homo sapiens
ccttagggagggactgg

SEQ ID NO: 5877387 - DNA, 20 bp, Homo sapiens
ccttaggtgatccactcgcc

SEQ ID NO: 5877388 - DNA, 16 bp, Homo sapiens
ccttagtaaattccta

SEQ ID NO: 5877389 - DNA, 18 bp, Homo sapiens
ccttagtacggctgctgc

SEQ ID NO: 5877390 - DNA, 14 bp, Homo sapiens
ccttagtactgagt

SEQ ID NO: 5877391 - DNA, 15 bp, Homo sapiens
ccttagtgcagttat

SEQ ID NO: 5877392 - DNA, 13 bp, Homo sapiens
ccttagtgccagg

SEQ ID NO: 5877393 - DNA, 20 bp, Homo sapiens
ccttagtgccaggagggcac

SEQ ID NO: 5877394 - DNA, 22 bp, Homo sapiens
ccttagtgggccagggctgccc

SEQ ID NO: 5877395 - DNA, 18 bp, Homo sapiens
ccttagtgtcacctttct

SEQ ID NO: 5877396 - DNA, 20 bp, Homo sapiens
ccttagtgtttctgtgcatg

SEQ ID NO: 5877397 - DNA, 18 bp, Homo sapiens
ccttagttatcagtcctg

SEQ ID NO: 5877398 - DNA, 17 bp, Homo sapiens
ccttataaaccaatctt

SEQ ID NO: 5877399 - DNA, 16 bp, Homo sapiens
ccttataagaattaat

SEQ ID NO: 5877400 - DNA, 18 bp, Homo sapiens
ccttatacatcacttcct

SEQ ID NO: 5877401 - DNA, 22 bp, Homo sapiens
ccttatacccccattaaattca

SEQ ID NO: 5877402 - DNA, 13 bp, Homo sapiens
ccttatagagcac

SEQ ID NO: 5877403 - DNA, 21 bp, Homo sapiens
ccttatagttactgtgtaatt

SEQ ID NO: 5877404 - DNA, 16 bp, Homo sapiens
ccttatagtttgggct

SEQ ID NO: 5877405 - DNA, 19 bp, Homo sapiens
ccttatagtttgggcttca

SEQ ID NO: 5877406 - DNA, 20 bp, Homo sapiens
ccttatcacccccttgttgt

SEQ ID NO: 5877407 - DNA, 14 bp, Homo sapiens
ccttatcagagcta

SEQ ID NO: 5877408 - DNA, 14 bp, Homo sapiens
ccttatcataaatt

SEQ ID NO: 5877409 - DNA, 16 bp, Homo sapiens
ccttatcattcattct

SEQ ID NO: 5877410 - DNA, 14 bp, Homo sapiens
ccttatccaggact

SEQ ID NO: 5877411 - DNA, 16 bp, Homo sapiens
ccttatccctctcttc

SEQ ID NO: 5877412 - DNA, 23 bp, Homo sapiens
ccttatcctagcctttgggcaca

SEQ ID NO: 5877413 - DNA, 17 bp, Homo sapiens
ccttatcctccctgtaa

SEQ ID NO: 5877414 - DNA, 16 bp, Homo sapiens
ccttatctccaagacc

SEQ ID NO: 5877415 - DNA, 22 bp, Homo sapiens
ccttatctgaaaggccagcagc

SEQ ID NO: 5877416 - DNA, 17 bp, Homo sapiens
ccttatctgtgctcagg

SEQ ID NO: 5877417 - DNA, 15 bp, Homo sapiens
ccttatctgttcctt

SEQ ID NO: 5877418 - DNA, 13 bp, Homo sapiens
ccttatcttgaaa

SEQ ID NO: 5877419 - DNA, 16 bp, Homo sapiens
ccttatcttgaaaaga

SEQ ID NO: 5877420 - DNA, 19 bp, Homo sapiens
ccttatgaccagtgagaac

SEQ ID NO: 5877421 - DNA, 16 bp, Homo sapiens
ccttatgctacacaga

SEQ ID NO: 5877422 - DNA, 12 bp, Homo sapiens
ccttatggaaca

SEQ ID NO: 5877423 - DNA, 19 bp, Homo sapiens
ccttatggaacactctgag

SEQ ID NO: 5877424 - DNA, 19 bp, Homo sapiens
ccttatgggatcatttttc

SEQ ID NO: 5877425 - DNA, 13 bp, Homo sapiens
ccttatgtattat

SEQ ID NO: 5877426 - DNA, 17 bp, Homo sapiens
ccttattatcccagctt

SEQ ID NO: 5877427 - DNA, 12 bp, Homo sapiens
ccttattcagaa

SEQ ID NO: 5877428 - DNA, 21 bp, Homo sapiens
ccttattgagcgtgattctgt

SEQ ID NO: 5877429 - DNA, 16 bp, Homo sapiens
ccttattgatctttgc

SEQ ID NO: 5877430 - DNA, 14 bp, Homo sapiens
ccttattgctgcca

SEQ ID NO: 5877431 - DNA, 19 bp, Homo sapiens
ccttattgctgtcctggag

SEQ ID NO: 5877432 - DNA, 18 bp, Homo sapiens
ccttattggatatttgat

SEQ ID NO: 5877433 - DNA, 16 bp, Homo sapiens
ccttattgtacctctc

SEQ ID NO: 5877434 - DNA, 18 bp, Homo sapiens
ccttattgtttgtaaaca

SEQ ID NO: 5877435 - DNA, 18 bp, Homo sapiens
ccttatttacctagtgca

SEQ ID NO: 5877436 - DNA, 14 bp, Homo sapiens
ccttatttatatat

SEQ ID NO: 5877437 - DNA, 22 bp, Homo sapiens
ccttatttatatatcagttata

SEQ ID NO: 5877438 - DNA, 22 bp, Homo sapiens
ccttatttatcaacatcttttt

SEQ ID NO: 5877439 - DNA, 19 bp, Homo sapiens
ccttatttatttttgtgta

SEQ ID NO: 5877440 - DNA, 21 bp, Homo sapiens
ccttatttcctcatagactta

SEQ ID NO: 5877441 - DNA, 13 bp, Homo sapiens
ccttatttctcat

SEQ ID NO: 5877442 - DNA, 15 bp, Homo sapiens
ccttatttctcatca

SEQ ID NO: 5877443 - DNA, 20 bp, Homo sapiens
ccttatttctctctcctggt

SEQ ID NO: 5877444 - DNA, 22 bp, Homo sapiens
ccttatttctctctcctggtgt

SEQ ID NO: 5877445 - DNA, 23 bp, Homo sapiens
ccttatttctctctcctggtgtg

SEQ ID NO: 5877446 - DNA, 16 bp, Homo sapiens
ccttatttgccttcta

SEQ ID NO: 5877447 - DNA, 22 bp, Homo sapiens
ccttatttgctaatcaaagcca

SEQ ID NO: 5877448 - DNA, 11 bp, Homo sapiens
ccttatttgtc

SEQ ID NO: 5877449 - DNA, 23 bp, Homo sapiens
ccttatttgtcggggaagatgaa

SEQ ID NO: 5877450 - DNA, 15 bp, Homo sapiens
ccttatttgtctgta

SEQ ID NO: 5877451 - DNA, 20 bp, Homo sapiens
ccttatttgtctgtaaaaaa

SEQ ID NO: 5877452 - DNA, 23 bp, Homo sapiens
ccttatttgtctgtaaaaaatgg

SEQ ID NO: 5877453 - DNA, 18 bp, Homo sapiens
ccttattttcaagaaact

SEQ ID NO: 5877454 - DNA, 20 bp, Homo sapiens
ccttatttttgtatgccttt

SEQ ID NO: 5877455 - DNA, 16 bp, Homo sapiens
ccttattttttcccaa

SEQ ID NO: 5877456 - DNA, 20 bp, Homo sapiens
ccttcaaaaatgtgctgcct

SEQ ID NO: 5877457 - DNA, 20 bp, Homo sapiens
ccttcaaaactatagcttgc

SEQ ID NO: 5877458 - DNA, 20 bp, Homo sapiens
ccttcaaaatatttgtcctt

SEQ ID NO: 5877459 - DNA, 15 bp, Homo sapiens
ccttcaaaatgctgc

SEQ ID NO: 5877460 - DNA, 15 bp, Homo sapiens
ccttcaaagaaactt

SEQ ID NO: 5877461 - DNA, 17 bp, Homo sapiens
ccttcaaagcttttgta

SEQ ID NO: 5877462 - DNA, 19 bp, Homo sapiens
ccttcaacaaggcttgctg

SEQ ID NO: 5877463 - DNA, 15 bp, Homo sapiens
ccttcaacccagtgg

SEQ ID NO: 5877464 - DNA, 14 bp, Homo sapiens
ccttcaaccccact

SEQ ID NO: 5877465 - DNA, 21 bp, Homo sapiens
ccttcaacgtttcttcacttt

SEQ ID NO: 5877466 - DNA, 15 bp, Homo sapiens
ccttcaactcctggc

SEQ ID NO: 5877467 - DNA, 18 bp, Homo sapiens
ccttcaactcctggctcc

SEQ ID NO: 5877468 - DNA, 16 bp, Homo sapiens
ccttcaactctgtgag

SEQ ID NO: 5877469 - DNA, 24 bp, Homo sapiens
ccttcaactgaaaagactcagtgt

SEQ ID NO: 5877470 - DNA, 22 bp, Homo sapiens
ccttcaagacgaggggcaggga

SEQ ID NO: 5877471 - DNA, 15 bp, Homo sapiens
ccttcaagattccat

SEQ ID NO: 5877472 - DNA, 15 bp, Homo sapiens
ccttcaagctctgag

SEQ ID NO: 5877473 - DNA, 18 bp, Homo sapiens
ccttcaagctctgaggga

SEQ ID NO: 5877474 - DNA, 15 bp, Homo sapiens
ccttcaagctgcttt

SEQ ID NO: 5877475 - DNA, 21 bp, Homo sapiens
ccttcaaggctcttcttcctc

SEQ ID NO: 5877476 - DNA, 22 bp, Homo sapiens
ccttcaaggctcttcttcctca

SEQ ID NO: 5877477 - DNA, 14 bp, Homo sapiens
ccttcaagtgccaa

SEQ ID NO: 5877478 - DNA, 19 bp, Homo sapiens
ccttcaagttagctcagga

SEQ ID NO: 5877479 - DNA, 22 bp, Homo sapiens
ccttcaataaatggtatagcaa

SEQ ID NO: 5877480 - DNA, 16 bp, Homo sapiens
ccttcaattatttccc

SEQ ID NO: 5877481 - DNA, 16 bp, Homo sapiens
ccttcaattcctgggc

SEQ ID NO: 5877482 - DNA, 18 bp, Homo sapiens
ccttcacaaagcccaagg

SEQ ID NO: 5877483 - DNA, 16 bp, Homo sapiens
ccttcacaaccagcca

SEQ ID NO: 5877484 - DNA, 18 bp, Homo sapiens
ccttcacaaccagccaca

SEQ ID NO: 5877485 - DNA, 13 bp, Homo sapiens
ccttcacaatttc

SEQ ID NO: 5877486 - DNA, 21 bp, Homo sapiens
ccttcacaatttcaatgcttc

SEQ ID NO: 5877487 - DNA, 18 bp, Homo sapiens
ccttcacaccataactag

SEQ ID NO: 5877488 - DNA, 18 bp, Homo sapiens
ccttcacaccccaggccc

SEQ ID NO: 5877489 - DNA, 19 bp, Homo sapiens
ccttcacaggcagtgcatg

SEQ ID NO: 5877490 - DNA, 13 bp, Homo sapiens
ccttcacatctcc

SEQ ID NO: 5877491 - DNA, 13 bp, Homo sapiens
ccttcacatgaaa

SEQ ID NO: 5877492 - DNA, 19 bp, Homo sapiens
ccttcaccaaagatctgct

SEQ ID NO: 5877493 - DNA, 22 bp, Homo sapiens
ccttcaccaaagatctgctcct

SEQ ID NO: 5877494 - DNA, 23 bp, Homo sapiens
ccttcaccaatagtctctctgca

SEQ ID NO: 5877495 - DNA, 13 bp, Homo sapiens
ccttcaccaccta

SEQ ID NO: 5877496 - DNA, 15 bp, Homo sapiens
ccttcaccagagccc

SEQ ID NO: 5877497 - DNA, 22 bp, Homo sapiens
ccttcaccagagcccatgctca

SEQ ID NO: 5877498 - DNA, 15 bp, Homo sapiens
ccttcacccagagct

SEQ ID NO: 5877499 - DNA, 15 bp, Homo sapiens
ccttcacccagcacc

SEQ ID NO: 5877500 - DNA, 12 bp, Homo sapiens
ccttcaccctga

SEQ ID NO: 5877501 - DNA, 14 bp, Homo sapiens
ccttcaccctgaac

SEQ ID NO: 5877502 - DNA, 17 bp, Homo sapiens
ccttcacctttggtgca

SEQ ID NO: 5877503 - DNA, 19 bp, Homo sapiens
ccttcacctttggtgcaga

SEQ ID NO: 5877504 - DNA, 20 bp, Homo sapiens
ccttcacctttgtccccacc

SEQ ID NO: 5877505 - DNA, 21 bp, Homo sapiens
ccttcacctttgtccccaccg

SEQ ID NO: 5877506 - DNA, 19 bp, Homo sapiens
ccttcacgattaactgtga

SEQ ID NO: 5877507 - DNA, 15 bp, Homo sapiens
ccttcacgctggctt

SEQ ID NO: 5877508 - DNA, 18 bp, Homo sapiens
ccttcacgctggcttcca

SEQ ID NO: 5877509 - DNA, 18 bp, Homo sapiens
ccttcactccctccctgg

SEQ ID NO: 5877510 - DNA, 14 bp, Homo sapiens
ccttcactccggtg

SEQ ID NO: 5877511 - DNA, 17 bp, Homo sapiens
ccttcactctccagggt

SEQ ID NO: 5877512 - DNA, 15 bp, Homo sapiens
ccttcactgaacatg

SEQ ID NO: 5877513 - DNA, 14 bp, Homo sapiens
ccttcactgccatg

SEQ ID NO: 5877514 - DNA, 14 bp, Homo sapiens
ccttcactgcccca

SEQ ID NO: 5877515 - DNA, 21 bp, Homo sapiens
ccttcactgccccacttctgg

SEQ ID NO: 5877516 - DNA, 16 bp, Homo sapiens
ccttcactggagaccg

SEQ ID NO: 5877517 - DNA, 16 bp, Homo sapiens
ccttcactggcgcctt

SEQ ID NO: 5877518 - DNA, 17 bp, Homo sapiens
ccttcactggcgccttc

SEQ ID NO: 5877519 - DNA, 22 bp, Homo sapiens
ccttcactgtgctccaacctga

SEQ ID NO: 5877520 - DNA, 14 bp, Homo sapiens
ccttcactttctcc

SEQ ID NO: 5877521 - DNA, 19 bp, Homo sapiens
ccttcagaatgctcctgag

SEQ ID NO: 5877522 - DNA, 10 bp, Homo sapiens
ccttcagaca

SEQ ID NO: 5877523 - DNA, 11 bp, Homo sapiens
ccttcagacac

SEQ ID NO: 5877524 - DNA, 20 bp, Homo sapiens
ccttcagagagcagtgcttt

SEQ ID NO: 5877525 - DNA, 23 bp, Homo sapiens
ccttcagagagcagtgcttttgg

SEQ ID NO: 5877526 - DNA, 11 bp, Homo sapiens
ccttcagaggc

SEQ ID NO: 5877527 - DNA, 18 bp, Homo sapiens
ccttcagaggtggctctg

SEQ ID NO: 5877528 - DNA, 20 bp, Homo sapiens
ccttcagatcctacccctga

SEQ ID NO: 5877529 - DNA, 23 bp, Homo sapiens
ccttcagatgttctctcccaggg

SEQ ID NO: 5877530 - DNA, 19 bp, Homo sapiens
ccttcagattatttccagt

SEQ ID NO: 5877531 - DNA, 20 bp, Homo sapiens
ccttcagcaacttattttgc

SEQ ID NO: 5877532 - DNA, 11 bp, Homo sapiens
ccttcagcacg

SEQ ID NO: 5877533 - DNA, 21 bp, Homo sapiens
ccttcagcagcagctcacacc

SEQ ID NO: 5877534 - DNA, 13 bp, Homo sapiens
ccttcagccccca

SEQ ID NO: 5877535 - DNA, 17 bp, Homo sapiens
ccttcagcccccagccc

SEQ ID NO: 5877536 - DNA, 15 bp, Homo sapiens
ccttcagccctcacc

SEQ ID NO: 5877537 - DNA, 13 bp, Homo sapiens
ccttcagctcctg

SEQ ID NO: 5877538 - DNA, 14 bp, Homo sapiens
ccttcagctcctga

SEQ ID NO: 5877539 - DNA, 20 bp, Homo sapiens
ccttcagctcctgagtagct

SEQ ID NO: 5877540 - DNA, 23 bp, Homo sapiens
ccttcagctctggggcagaggaa

SEQ ID NO: 5877541 - DNA, 16 bp, Homo sapiens
ccttcagctgttgcag

SEQ ID NO: 5877542 - DNA, 14 bp, Homo sapiens
ccttcagcttgctt

SEQ ID NO: 5877543 - DNA, 16 bp, Homo sapiens
ccttcagctttatttt

SEQ ID NO: 5877544 - DNA, 19 bp, Homo sapiens
ccttcagctttatttttct

SEQ ID NO: 5877545 - DNA, 22 bp, Homo sapiens
ccttcagctttatttttcttta

SEQ ID NO: 5877546 - DNA, 23 bp, Homo sapiens
ccttcaggaactggggctttgcc

SEQ ID NO: 5877547 - DNA, 24 bp, Homo sapiens
ccttcaggactctgcgggaggctg

SEQ ID NO: 5877548 - DNA, 15 bp, Homo sapiens
ccttcaggagcctgg

SEQ ID NO: 5877549 - DNA, 17 bp, Homo sapiens
ccttcaggagcctggcc

SEQ ID NO: 5877550 - DNA, 18 bp, Homo sapiens
ccttcaggagcctggcca

SEQ ID NO: 5877551 - DNA, 23 bp, Homo sapiens
ccttcaggagcctggccaggcag

SEQ ID NO: 5877552 - DNA, 18 bp, Homo sapiens
ccttcaggcagctgaaat

SEQ ID NO: 5877553 - DNA, 15 bp, Homo sapiens
ccttcaggccagctg

SEQ ID NO: 5877554 - DNA, 20 bp, Homo sapiens
ccttcctgcttcctgttacc

SEQ ID NO: 5877555 - DNA, 21 bp, Homo sapiens
ccttcctggaaacagcatgaa

SEQ ID NO: 5877556 - DNA, 12 bp, Homo sapiens
ccttcctggaca

SEQ ID NO: 5877557 - DNA, 14 bp, Homo sapiens
ccttcctggacaca

SEQ ID NO: 5877558 - DNA, 13 bp, Homo sapiens
ccttcctggacag

SEQ ID NO: 5877559 - DNA, 21 bp, Homo sapiens
ccttcctggactggcccttgc

SEQ ID NO: 5877560 - DNA, 13 bp, Homo sapiens
ccttcctggaggc

SEQ ID NO: 5877561 - DNA, 10 bp, Homo sapiens
ccttcctggc

SEQ ID NO: 5877562 - DNA, 12 bp, Homo sapiens
ccttcctggccc

SEQ ID NO: 5877563 - DNA, 14 bp, Homo sapiens
ccttcctggcccag

SEQ ID NO: 5877564 - DNA, 16 bp, Homo sapiens
ccttcctggcctaatc

SEQ ID NO: 5877565 - DNA, 14 bp, Homo sapiens
ccttcctggcctca

SEQ ID NO: 5877566 - DNA, 20 bp, Homo sapiens
ccttcctgggaccccctcgc

SEQ ID NO: 5877567 - DNA, 24 bp, Homo sapiens
ccttcctgggaccccctcgccagc

SEQ ID NO: 5877568 - DNA, 20 bp, Homo sapiens
ccttcctgggcagcccagag

SEQ ID NO: 5877569 - DNA, 23 bp, Homo sapiens
ccttcctgggcagcccagagaga

SEQ ID NO: 5877570 - DNA, 12 bp, Homo sapiens
ccttcctgggtt

SEQ ID NO: 5877571 - DNA, 19 bp, Homo sapiens
ccttcctgtcccacctctt

SEQ ID NO: 5877572 - DNA, 13 bp, Homo sapiens
ccttcctgtcccc

SEQ ID NO: 5877573 - DNA, 15 bp, Homo sapiens
ccttcctgtccccag

SEQ ID NO: 5877574 - DNA, 17 bp, Homo sapiens
ccttcctgtccccaggg

SEQ ID NO: 5877575 - DNA, 18 bp, Homo sapiens
ccttcctgtccctgaggt

SEQ ID NO: 5877576 - DNA, 12 bp, Homo sapiens
ccttcctgtccg

SEQ ID NO: 5877577 - DNA, 13 bp, Homo sapiens
ccttcctgtcctg

SEQ ID NO: 5877578 - DNA, 18 bp, Homo sapiens
ccttcctgtcctgctcac

SEQ ID NO: 5877579 - DNA, 12 bp, Homo sapiens
ccttcctgtctg

SEQ ID NO: 5877580 - DNA, 12 bp, Homo sapiens
ccttcctgtgcc

SEQ ID NO: 5877581 - DNA, 17 bp, Homo sapiens
ccttcctgttctgaact

SEQ ID NO: 5877582 - DNA, 15 bp, Homo sapiens
ccttcctgttctgtg

SEQ ID NO: 5877583 - DNA, 18 bp, Homo sapiens
ccttcctgttcttccttc

SEQ ID NO: 5877584 - DNA, 20 bp, Homo sapiens
ccttcctgttcttccttcct

SEQ ID NO: 5877585 - DNA, 22 bp, Homo sapiens
ccttcctgttcttccttcctag

SEQ ID NO: 5877586 - DNA, 16 bp, Homo sapiens
ccttcctgtttcagac

SEQ ID NO: 5877587 - DNA, 17 bp, Homo sapiens
ccttcctgtttttcaca

SEQ ID NO: 5877588 - DNA, 15 bp, Homo sapiens
ccttccttcaggact

SEQ ID NO: 5877589 - DNA, 16 bp, Homo sapiens
ccttccttcaggactc

SEQ ID NO: 5877590 - DNA, 17 bp, Homo sapiens
ccttccttcaggactct

SEQ ID NO: 5877591 - DNA, 19 bp, Homo sapiens
ccttccttcaggactctgc

SEQ ID NO: 5877592 - DNA, 15 bp, Homo sapiens
ccttccttccacgga

SEQ ID NO: 5877593 - DNA, 22 bp, Homo sapiens
ccttccttccattgctcccagt

SEQ ID NO: 5877594 - DNA, 16 bp, Homo sapiens
ccttccttccattggc

SEQ ID NO: 5877595 - DNA, 15 bp, Homo sapiens
ccttccttccctggc

SEQ ID NO: 5877596 - DNA, 16 bp, Homo sapiens
ccttccttccctggct

SEQ ID NO: 5877597 - DNA, 13 bp, Homo sapiens
ccttccttcctgt

SEQ ID NO: 5877598 - DNA, 14 bp, Homo sapiens
ccttccttgacctt

SEQ ID NO: 5877599 - DNA, 17 bp, Homo sapiens
ccttccttgactgtcta

SEQ ID NO: 5877600 - DNA, 14 bp, Homo sapiens
ccttccttgccagt

SEQ ID NO: 5877601 - DNA, 17 bp, Homo sapiens
ccttccttgcgaccacc

SEQ ID NO: 5877602 - DNA, 16 bp, Homo sapiens
ccttccttgggcgtct

SEQ ID NO: 5877603 - DNA, 17 bp, Homo sapiens
ccttccttgtagccttt

SEQ ID NO: 5877604 - DNA, 9 bp, Homo sapiens
ccttccttt

SEQ ID NO: 5877605 - DNA, 19 bp, Homo sapiens
ccttcctttaggtctggtt

SEQ ID NO: 5877606 - DNA, 12 bp, Homo sapiens
ccttcctttcct

SEQ ID NO: 5877607 - DNA, 13 bp, Homo sapiens
ccttcctttcctc

SEQ ID NO: 5877608 - DNA, 17 bp, Homo sapiens
ccttcctttctatatcc

SEQ ID NO: 5877609 - DNA, 19 bp, Homo sapiens
ccttcctttctccaggacc

SEQ ID NO: 5877610 - DNA, 20 bp, Homo sapiens
ccttcctttctcctgcccca

SEQ ID NO: 5877611 - DNA, 18 bp, Homo sapiens
ccttcctttggtgcctca

SEQ ID NO: 5877612 - DNA, 19 bp, Homo sapiens
ccttcctttggtgcctcac

SEQ ID NO: 5877613 - DNA, 13 bp, Homo sapiens
ccttcctttgtct

SEQ ID NO: 5877614 - DNA, 19 bp, Homo sapiens
ccttccttttacttttctt

SEQ ID NO: 5877615 - DNA, 15 bp, Homo sapiens
ccttccttttccctg

SEQ ID NO: 5877616 - DNA, 16 bp, Homo sapiens
ccttccttttccctgc

SEQ ID NO: 5877617 - DNA, 19 bp, Homo sapiens
ccttccttttccctgcttc

SEQ ID NO: 5877618 - DNA, 19 bp, Homo sapiens
ccttcgaaaggccttcaga

SEQ ID NO: 5877619 - DNA, 23 bp, Homo sapiens
ccttcgaaaggccttcagacaca

SEQ ID NO: 5877620 - DNA, 21 bp, Homo sapiens
ccttcgagggttccaggctgt

SEQ ID NO: 5877621 - DNA, 12 bp, Homo sapiens
ccttcgcctttg

SEQ ID NO: 5877622 - DNA, 18 bp, Homo sapiens
ccttcgctccatgttttt

SEQ ID NO: 5877623 - DNA, 13 bp, Homo sapiens
ccttcgctcctgt

SEQ ID NO: 5877624 - DNA, 15 bp, Homo sapiens
ccttcgctctgctgg

SEQ ID NO: 5877625 - DNA, 21 bp, Homo sapiens
ccttcgctgccaggacacctg

SEQ ID NO: 5877626 - DNA, 22 bp, Homo sapiens
ccttcgctgccaggacacctgc

SEQ ID NO: 5877627 - DNA, 20 bp, Homo sapiens
ccttcgcttcttgcctctgt

SEQ ID NO: 5877628 - DNA, 21 bp, Homo sapiens
ccttcgcttcttgcctctgtg

SEQ ID NO: 5877629 - DNA, 17 bp, Homo sapiens
ccttcggcagtggctgg

SEQ ID NO: 5877630 - DNA, 19 bp, Homo sapiens
ccttcggcagtggctgggg

SEQ ID NO: 5877631 - DNA, 17 bp, Homo sapiens
ccttcggcctccatcct

SEQ ID NO: 5877632 - DNA, 19 bp, Homo sapiens
ccttcggcctccatcctga

SEQ ID NO: 5877633 - DNA, 20 bp, Homo sapiens
ccttcggcctccatcctgag

SEQ ID NO: 5877634 - DNA, 18 bp, Homo sapiens
ccttcgggcgtctgtgtg

SEQ ID NO: 5877635 - DNA, 15 bp, Homo sapiens
ccttcgggctgtgcc

SEQ ID NO: 5877636 - DNA, 15 bp, Homo sapiens
ccttcggtacccacc

SEQ ID NO: 5877637 - DNA, 14 bp, Homo sapiens
ccttcgtatcccga

SEQ ID NO: 5877638 - DNA, 22 bp, Homo sapiens
ccttcgtatcccgagtctggga

SEQ ID NO: 5877639 - DNA, 19 bp, Homo sapiens
ccttcgtgacaatgtttac

SEQ ID NO: 5877640 - DNA, 20 bp, Homo sapiens
ccttcgtgacaatgtttaca

SEQ ID NO: 5877641 - DNA, 23 bp, Homo sapiens
ccttcgtgcctgagaccagggtg

SEQ ID NO: 5877642 - DNA, 22 bp, Homo sapiens
ccttcgtgtgctgctgctgcta

SEQ ID NO: 5877643 - DNA, 17 bp, Homo sapiens
ccttcgttaactgtgta

SEQ ID NO: 5877644 - DNA, 19 bp, Homo sapiens
ccttcgtttactatgcctg

SEQ ID NO: 5877645 - DNA, 23 bp, Homo sapiens
ccttcgtttactatgcctgtgtc

SEQ ID NO: 5877646 - DNA, 15 bp, Homo sapiens
ccttctaaaagccat

SEQ ID NO: 5877647 - DNA, 18 bp, Homo sapiens
ccttctaaacggtgacct

SEQ ID NO: 5877648 - DNA, 13 bp, Homo sapiens
ccttctaaaggtg

SEQ ID NO: 5877649 - DNA, 14 bp, Homo sapiens
ccttctaaaggtgt

SEQ ID NO: 5877650 - DNA, 20 bp, Homo sapiens
ccttctaaagtgctgggatt

SEQ ID NO: 5877651 - DNA, 16 bp, Homo sapiens
ccttctaaattcccaa

SEQ ID NO: 5877652 - DNA, 22 bp, Homo sapiens
ccttctaactgaaggtgcagtt

SEQ ID NO: 5877653 - DNA, 17 bp, Homo sapiens
ccttctaatgaagacaa

SEQ ID NO: 5877654 - DNA, 18 bp, Homo sapiens
ccttctaatgaagacaat

SEQ ID NO: 5877655 - DNA, 14 bp, Homo sapiens
ccttctacactctc

SEQ ID NO: 5877656 - DNA, 21 bp, Homo sapiens
ccttctacactctcctgggcc

SEQ ID NO: 5877657 - DNA, 22 bp, Homo sapiens
ccttctacactctcctgggccc

SEQ ID NO: 5877658 - DNA, 18 bp, Homo sapiens
ccttctacagaacctgag

SEQ ID NO: 5877659 - DNA, 19 bp, Homo sapiens
ccttctaccccaaggccag

SEQ ID NO: 5877660 - DNA, 16 bp, Homo sapiens
ccttctaccctgggtc

SEQ ID NO: 5877661 - DNA, 16 bp, Homo sapiens
ccttctacctgcagga

SEQ ID NO: 5877662 - DNA, 15 bp, Homo sapiens
ccttctacctgccac

SEQ ID NO: 5877663 - DNA, 18 bp, Homo sapiens
ccttctacctgccactca

SEQ ID NO: 5877664 - DNA, 23 bp, Homo sapiens
ccttctacttacacatcttccac

SEQ ID NO: 5877665 - DNA, 19 bp, Homo sapiens
ccttctactttttccttcc

SEQ ID NO: 5877666 - DNA, 20 bp, Homo sapiens
ccttctactttttccttcct

SEQ ID NO: 5877667 - DNA, 21 bp, Homo sapiens
ccttctactttttccttcctg

SEQ ID NO: 5877668 - DNA, 17 bp, Homo sapiens
ccttctagaacctgggc

SEQ ID NO: 5877669 - DNA, 18 bp, Homo sapiens
ccttctagattcactgtc

SEQ ID NO: 5877670 - DNA, 22 bp, Homo sapiens
ccttctaggatagcgctcccct

SEQ ID NO: 5877671 - DNA, 18 bp, Homo sapiens
ccttctaggcatctcctc

SEQ ID NO: 5877672 - DNA, 23 bp, Homo sapiens
ccttctaggcatctcctctcccc

SEQ ID NO: 5877673 - DNA, 17 bp, Homo sapiens
ccttctagtgagcctgg

SEQ ID NO: 5877674 - DNA, 18 bp, Homo sapiens
ccttctagtgagcctggg

SEQ ID NO: 5877675 - DNA, 15 bp, Homo sapiens
ccttctagtttccca

SEQ ID NO: 5877676 - DNA, 18 bp, Homo sapiens
ccttctagtttcccacaa

SEQ ID NO: 5877677 - DNA, 18 bp, Homo sapiens
ccttctatacccacccag

SEQ ID NO: 5877678 - DNA, 19 bp, Homo sapiens
ccttctatacccacccaga

SEQ ID NO: 5877679 - DNA, 20 bp, Homo sapiens
ccttctatacccacccagaa

SEQ ID NO: 5877680 - DNA, 18 bp, Homo sapiens
ccttctatactttctcac

SEQ ID NO: 5877681 - DNA, 19 bp, Homo sapiens
ccttctatagcatcactta

SEQ ID NO: 5877682 - DNA, 15 bp, Homo sapiens
ccttctatgcagtat

SEQ ID NO: 5877683 - DNA, 19 bp, Homo sapiens
ccttctatgcccagctgtg

SEQ ID NO: 5877684 - DNA, 14 bp, Homo sapiens
ccttctatgtatta

SEQ ID NO: 5877685 - DNA, 15 bp, Homo sapiens
ccttctatttggggc

SEQ ID NO: 5877686 - DNA, 11 bp, Homo sapiens
ccttctcacca

SEQ ID NO: 5877687 - DNA, 12 bp, Homo sapiens
ccttctcaccag

SEQ ID NO: 5877688 - DNA, 21 bp, Homo sapiens
ccttctcaccagctgcaaagt

SEQ ID NO: 5877689 - DNA, 22 bp, Homo sapiens
ccttctcaccagctgcaaagtg

SEQ ID NO: 5877690 - DNA, 18 bp, Homo sapiens
ccttctcagaagcacaga

SEQ ID NO: 5877691 - DNA, 22 bp, Homo sapiens
ccttctcagcctacagcagtgt

SEQ ID NO: 5877692 - DNA, 15 bp, Homo sapiens
ccttctcagccttgg

SEQ ID NO: 5877693 - DNA, 20 bp, Homo sapiens
ccttctcagccttggttcct

SEQ ID NO: 5877694 - DNA, 23 bp, Homo sapiens
ccttctcagccttggttcctgat

SEQ ID NO: 5877695 - DNA, 12 bp, Homo sapiens
ccttctcagctc

SEQ ID NO: 5877696 - DNA, 14 bp, Homo sapiens
ccttctcaggcccc

SEQ ID NO: 5877697 - DNA, 21 bp, Homo sapiens
ccttctcatcactcccctcca

SEQ ID NO: 5877698 - DNA, 18 bp, Homo sapiens
ccttctccaaaggctctg

SEQ ID NO: 5877699 - DNA, 12 bp, Homo sapiens
ccttctccagca

SEQ ID NO: 5877700 - DNA, 17 bp, Homo sapiens
ccttctccagcaagcag

SEQ ID NO: 5877701 - DNA, 15 bp, Homo sapiens
ccttctccagggaca

SEQ ID NO: 5877702 - DNA, 17 bp, Homo sapiens
ccttctccatctctctg

SEQ ID NO: 5877703 - DNA, 21 bp, Homo sapiens
ccttctccatctctctggccc

SEQ ID NO: 5877704 - DNA, 22 bp, Homo sapiens
ccttctccatctctctggccct

SEQ ID NO: 5877705 - DNA, 16 bp, Homo sapiens
ccttctcccacactgc

SEQ ID NO: 5877706 - DNA, 15 bp, Homo sapiens
ccttctcccactctc

SEQ ID NO: 5877707 - DNA, 13 bp, Homo sapiens
ccttctcccagca

SEQ ID NO: 5877708 - DNA, 15 bp, Homo sapiens
ccttctcccagcaca

SEQ ID NO: 5877709 - DNA, 19 bp, Homo sapiens
ccttctcccaggcctctgc

SEQ ID NO: 5877710 - DNA, 12 bp, Homo sapiens
ccttctccccag

SEQ ID NO: 5877711 - DNA, 20 bp, Homo sapiens
ccttctccccagccagaggt

SEQ ID NO: 5877712 - DNA, 14 bp, Homo sapiens
ccttctccccagct

SEQ ID NO: 5877713 - DNA, 17 bp, Homo sapiens
ccttctccccagctccc

SEQ ID NO: 5877714 - DNA, 19 bp, Homo sapiens
ccttctccccagctcccag

SEQ ID NO: 5877715 - DNA, 21 bp, Homo sapiens
ccttctccccagctcccagga

SEQ ID NO: 5877716 - DNA, 12 bp, Homo sapiens
ccttctccccct

SEQ ID NO: 5877717 - DNA, 13 bp, Homo sapiens
ccttctcccctcc

SEQ ID NO: 5877718 - DNA, 17 bp, Homo sapiens
ccttctcccctccacgc

SEQ ID NO: 5877719 - DNA, 15 bp, Homo sapiens
ccttctcccctccag

SEQ ID NO: 5877720 - DNA, 17 bp, Homo sapiens
ccttctcccctccccgc

SEQ ID NO: 5877721 - DNA, 16 bp, Homo sapiens
ccttctcccctctccc

SEQ ID NO: 5877722 - DNA, 19 bp, Homo sapiens
ccttctcccctctcccagg

SEQ ID NO: 5877723 - DNA, 16 bp, Homo sapiens
ccttctcccctcttct

SEQ ID NO: 5877724 - DNA, 15 bp, Homo sapiens
ccttctcccctgcac

SEQ ID NO: 5877725 - DNA, 16 bp, Homo sapiens
ccttctcccctgcact

SEQ ID NO: 5877726 - DNA, 17 bp, Homo sapiens
ccttctcccctgcactg

SEQ ID NO: 5877727 - DNA, 15 bp, Homo sapiens
ccttctcccctgccc

SEQ ID NO: 5877728 - DNA, 12 bp, Homo sapiens
ccttctcccctt

SEQ ID NO: 5877729 - DNA, 13 bp, Homo sapiens
ccttctccccttc

SEQ ID NO: 5877730 - DNA, 15 bp, Homo sapiens
ccttctcccggccct

SEQ ID NO: 5877731 - DNA, 13 bp, Homo sapiens
ccttctccctagc

SEQ ID NO: 5877732 - DNA, 14 bp, Homo sapiens
ccttctccctagcc

SEQ ID NO: 5877733 - DNA, 18 bp, Homo sapiens
ccttgcccagcaaggacc

SEQ ID NO: 5877734 - DNA, 17 bp, Homo sapiens
ccttgcccagcctggat

SEQ ID NO: 5877735 - DNA, 11 bp, Homo sapiens
ccttgcccagg

SEQ ID NO: 5877736 - DNA, 17 bp, Homo sapiens
ccttgcccagggctcag

SEQ ID NO: 5877737 - DNA, 19 bp, Homo sapiens
ccttgcccatgcctccagc

SEQ ID NO: 5877738 - DNA, 13 bp, Homo sapiens
ccttgccccacag

SEQ ID NO: 5877739 - DNA, 14 bp, Homo sapiens
ccttgccccacagt

SEQ ID NO: 5877740 - DNA, 19 bp, Homo sapiens
ccttgccccacagttgtgt

SEQ ID NO: 5877741 - DNA, 20 bp, Homo sapiens
ccttgccccacagttgtgtt

SEQ ID NO: 5877742 - DNA, 22 bp, Homo sapiens
ccttgccccacagttgtgttca

SEQ ID NO: 5877743 - DNA, 13 bp, Homo sapiens
ccttgccccacct

SEQ ID NO: 5877744 - DNA, 15 bp, Homo sapiens
ccttgccccacctcc

SEQ ID NO: 5877745 - DNA, 12 bp, Homo sapiens
ccttgccccact

SEQ ID NO: 5877746 - DNA, 21 bp, Homo sapiens
ccttgccccactcctctccac

SEQ ID NO: 5877747 - DNA, 24 bp, Homo sapiens
ccttgccccactcctctccaccag

SEQ ID NO: 5877748 - DNA, 18 bp, Homo sapiens
ccttgccccaggccaggt

SEQ ID NO: 5877749 - DNA, 15 bp, Homo sapiens
ccttgccccagtcct

SEQ ID NO: 5877750 - DNA, 18 bp, Homo sapiens
ccttgcccccagtgcctc

SEQ ID NO: 5877751 - DNA, 20 bp, Homo sapiens
ccttgccccccgccctcatg

SEQ ID NO: 5877752 - DNA, 21 bp, Homo sapiens
ccttgcccccctggcctcccc

SEQ ID NO: 5877753 - DNA, 15 bp, Homo sapiens
ccttgcccctgctct

SEQ ID NO: 5877754 - DNA, 16 bp, Homo sapiens
ccttgcccgccagcct

SEQ ID NO: 5877755 - DNA, 18 bp, Homo sapiens
ccttgcccggattctggg

SEQ ID NO: 5877756 - DNA, 14 bp, Homo sapiens
ccttgccctcctgg

SEQ ID NO: 5877757 - DNA, 15 bp, Homo sapiens
ccttgccctcctggg

SEQ ID NO: 5877758 - DNA, 16 bp, Homo sapiens
ccttgccctcctgggc

SEQ ID NO: 5877759 - DNA, 11 bp, Homo sapiens
ccttgccctgg

SEQ ID NO: 5877760 - DNA, 15 bp, Homo sapiens
ccttgccctgggcca

SEQ ID NO: 5877761 - DNA, 21 bp, Homo sapiens
ccttgccctgggccagcccag

SEQ ID NO: 5877762 - DNA, 13 bp, Homo sapiens
ccttgcccttcct

SEQ ID NO: 5877763 - DNA, 16 bp, Homo sapiens
ccttgcccttgccctg

SEQ ID NO: 5877764 - DNA, 17 bp, Homo sapiens
ccttgcccttgccctga

SEQ ID NO: 5877765 - DNA, 18 bp, Homo sapiens
ccttgcccttgccctgac

SEQ ID NO: 5877766 - DNA, 13 bp, Homo sapiens
ccttgcccttgga

SEQ ID NO: 5877767 - DNA, 19 bp, Homo sapiens
ccttgcccttggagctgcc

SEQ ID NO: 5877768 - DNA, 19 bp, Homo sapiens
ccttgccgccccgtgcctg

SEQ ID NO: 5877769 - DNA, 16 bp, Homo sapiens
ccttgccgctgggaga

SEQ ID NO: 5877770 - DNA, 18 bp, Homo sapiens
ccttgccgctgggagagc

SEQ ID NO: 5877771 - DNA, 20 bp, Homo sapiens
ccttgccgtctacctgaggg

SEQ ID NO: 5877772 - DNA, 22 bp, Homo sapiens
ccttgcctaaatttaatgctgc

SEQ ID NO: 5877773 - DNA, 14 bp, Homo sapiens
ccttgcctccccat

SEQ ID NO: 5877774 - DNA, 17 bp, Homo sapiens
ccttgcctccccatttc

SEQ ID NO: 5877775 - DNA, 19 bp, Homo sapiens
ccttgcctcccctcctctc

SEQ ID NO: 5877776 - DNA, 22 bp, Homo sapiens
ccttgcctcccctcctctcctg

SEQ ID NO: 5877777 - DNA, 14 bp, Homo sapiens
ccttgcctcctgtg

SEQ ID NO: 5877778 - DNA, 16 bp, Homo sapiens
ccttgcctcctgtgta

SEQ ID NO: 5877779 - DNA, 21 bp, Homo sapiens
ccttgcctgaacatccttcct

SEQ ID NO: 5877780 - DNA, 18 bp, Homo sapiens
ccttgcctgaactccaga

SEQ ID NO: 5877781 - DNA, 13 bp, Homo sapiens
ccttgcctgcctc

SEQ ID NO: 5877782 - DNA, 13 bp, Homo sapiens
ccttgcctggcct

SEQ ID NO: 5877783 - DNA, 17 bp, Homo sapiens
ccttgcctggtacagta

SEQ ID NO: 5877784 - DNA, 14 bp, Homo sapiens
ccttgcctgtgcca

SEQ ID NO: 5877785 - DNA, 17 bp, Homo sapiens
ccttgcctgttaggtct

SEQ ID NO: 5877786 - DNA, 14 bp, Homo sapiens
ccttgccttcccct

SEQ ID NO: 5877787 - DNA, 19 bp, Homo sapiens
ccttgcctttgtggccttc

SEQ ID NO: 5877788 - DNA, 19 bp, Homo sapiens
ccttgccttttaaaagaaa

SEQ ID NO: 5877789 - DNA, 14 bp, Homo sapiens
ccttgcgaccacca

SEQ ID NO: 5877790 - DNA, 17 bp, Homo sapiens
ccttgcgaccatgtgta

SEQ ID NO: 5877791 - DNA, 13 bp, Homo sapiens
ccttgcgcctcag

SEQ ID NO: 5877792 - DNA, 14 bp, Homo sapiens
ccttgcgcctcagc

SEQ ID NO: 5877793 - DNA, 20 bp, Homo sapiens
ccttgcgcctcagccctcag

SEQ ID NO: 5877794 - DNA, 21 bp, Homo sapiens
ccttgcgcctcagccctcagt

SEQ ID NO: 5877795 - DNA, 18 bp, Homo sapiens
ccttgcgctgtcccaggc

SEQ ID NO: 5877796 - DNA, 21 bp, Homo sapiens
ccttgcgcttttgctggtcac

SEQ ID NO: 5877797 - DNA, 14 bp, Homo sapiens
ccttgcggaagcca

SEQ ID NO: 5877798 - DNA, 16 bp, Homo sapiens
ccttgcggaagccata

SEQ ID NO: 5877799 - DNA, 17 bp, Homo sapiens
ccttgcggaagccatag

SEQ ID NO: 5877800 - DNA, 19 bp, Homo sapiens
ccttgcggaagccataggg

SEQ ID NO: 5877801 - DNA, 20 bp, Homo sapiens
ccttgcggaagccatagggg

SEQ ID NO: 5877802 - DNA, 15 bp, Homo sapiens
ccttgcggctcctca

SEQ ID NO: 5877803 - DNA, 20 bp, Homo sapiens
ccttgcggctcctcagggac

SEQ ID NO: 5877804 - DNA, 22 bp, Homo sapiens
ccttgctaaattgattgaatta

SEQ ID NO: 5877805 - DNA, 18 bp, Homo sapiens
ccttgctaccacggcctc

SEQ ID NO: 5877806 - DNA, 14 bp, Homo sapiens
ccttgctacccaga

SEQ ID NO: 5877807 - DNA, 17 bp, Homo sapiens
ccttgctacctcaaggg

SEQ ID NO: 5877808 - DNA, 18 bp, Homo sapiens
ccttgctagacagccagg

SEQ ID NO: 5877809 - DNA, 23 bp, Homo sapiens
ccttgctcactcactcactccaa

SEQ ID NO: 5877810 - DNA, 18 bp, Homo sapiens
ccttgctcagtgcctcct

SEQ ID NO: 5877811 - DNA, 19 bp, Homo sapiens
ccttgctcagtgcctcctg

SEQ ID NO: 5877812 - DNA, 12 bp, Homo sapiens
ccttgctcatga

SEQ ID NO: 5877813 - DNA, 14 bp, Homo sapiens
ccttgctcattctt

SEQ ID NO: 5877814 - DNA, 15 bp, Homo sapiens
ccttgctcattcttg

SEQ ID NO: 5877815 - DNA, 17 bp, Homo sapiens
ccttgctcattcttgag

SEQ ID NO: 5877816 - DNA, 17 bp, Homo sapiens
ccttgctccagcctgac

SEQ ID NO: 5877817 - DNA, 18 bp, Homo sapiens
ccttgctccagcctgaca

SEQ ID NO: 5877818 - DNA, 19 bp, Homo sapiens
ccttgctcccaatggtgct

SEQ ID NO: 5877819 - DNA, 23 bp, Homo sapiens
ccttgctcccaatggtgcttgga

SEQ ID NO: 5877820 - DNA, 13 bp, Homo sapiens
ccttgctcccttc

SEQ ID NO: 5877821 - DNA, 18 bp, Homo sapiens
ccttgctcctggaacctg

SEQ ID NO: 5877822 - DNA, 20 bp, Homo sapiens
ccttgctctcccctgccctg

SEQ ID NO: 5877823 - DNA, 13 bp, Homo sapiens
ccttgctctccct

SEQ ID NO: 5877824 - DNA, 15 bp, Homo sapiens
ccttgctctccctct

SEQ ID NO: 5877825 - DNA, 14 bp, Homo sapiens
ccttgctctcctca

SEQ ID NO: 5877826 - DNA, 15 bp, Homo sapiens
ccttgctctcctcat

SEQ ID NO: 5877827 - DNA, 13 bp, Homo sapiens
ccttgctctctgt

SEQ ID NO: 5877828 - DNA, 15 bp, Homo sapiens
ccttgctctctgttc

SEQ ID NO: 5877829 - DNA, 16 bp, Homo sapiens
ccttgctctctgttct

SEQ ID NO: 5877830 - DNA, 18 bp, Homo sapiens
ccttgctctctgttctct

SEQ ID NO: 5877831 - DNA, 16 bp, Homo sapiens
ccttgctctcttcaat

SEQ ID NO: 5877832 - DNA, 17 bp, Homo sapiens
ccttgctctcttcaata

SEQ ID NO: 5877833 - DNA, 19 bp, Homo sapiens
ccttgctctcttcaataaa

SEQ ID NO: 5877834 - DNA, 13 bp, Homo sapiens
ccttgctctgagc

SEQ ID NO: 5877835 - DNA, 18 bp, Homo sapiens
ccttgctctgagcacagg

SEQ ID NO: 5877836 - DNA, 17 bp, Homo sapiens
ccttgctctgcaggcac

SEQ ID NO: 5877837 - DNA, 16 bp, Homo sapiens
ccttgctcttggggaa

SEQ ID NO: 5877838 - DNA, 18 bp, Homo sapiens
ccttgctgaacacacaca

SEQ ID NO: 5877839 - DNA, 15 bp, Homo sapiens
ccttgctgacaataa

SEQ ID NO: 5877840 - DNA, 18 bp, Homo sapiens
ccttgctgacaataaaga

SEQ ID NO: 5877841 - DNA, 13 bp, Homo sapiens
ccttgctgacccc

SEQ ID NO: 5877842 - DNA, 16 bp, Homo sapiens
ccttgctgaccccagg

SEQ ID NO: 5877843 - DNA, 17 bp, Homo sapiens
ccttgctgaccccaggt

SEQ ID NO: 5877844 - DNA, 21 bp, Homo sapiens
ccttgctgacctcccagcctt

SEQ ID NO: 5877845 - DNA, 20 bp, Homo sapiens
ccttgctgactctctgagct

SEQ ID NO: 5877846 - DNA, 16 bp, Homo sapiens
ccttgctgcagtgtcc

SEQ ID NO: 5877847 - DNA, 13 bp, Homo sapiens
ccttgctgccaag

SEQ ID NO: 5877848 - DNA, 12 bp, Homo sapiens
ccttgctgcccg

SEQ ID NO: 5877849 - DNA, 11 bp, Homo sapiens
ccttgctgcct

SEQ ID NO: 5877850 - DNA, 14 bp, Homo sapiens
ccttgctgccttca

SEQ ID NO: 5877851 - DNA, 13 bp, Homo sapiens
ccttgctgctctg

SEQ ID NO: 5877852 - DNA, 16 bp, Homo sapiens
ccttgctgctctgcgt

SEQ ID NO: 5877853 - DNA, 16 bp, Homo sapiens
ccttgctgctgcccgc

SEQ ID NO: 5877854 - DNA, 20 bp, Homo sapiens
ccttgctgctgctgcaccca

SEQ ID NO: 5877855 - DNA, 14 bp, Homo sapiens
ccttgctgctggct

SEQ ID NO: 5877856 - DNA, 15 bp, Homo sapiens
ccttgctgctggctc

SEQ ID NO: 5877857 - DNA, 18 bp, Homo sapiens
ccttgctgctggctccca

SEQ ID NO: 5877858 - DNA, 17 bp, Homo sapiens
ccttgctggaaaaccca

SEQ ID NO: 5877859 - DNA, 12 bp, Homo sapiens
ccttgctggccc

SEQ ID NO: 5877860 - DNA, 13 bp, Homo sapiens
ccttgctggcccc

SEQ ID NO: 5877861 - DNA, 19 bp, Homo sapiens
ccttgctggccccagccct

SEQ ID NO: 5877862 - DNA, 22 bp, Homo sapiens
ccttgctgggccagggaaacaa

SEQ ID NO: 5877863 - DNA, 17 bp, Homo sapiens
ccttgctgtcctgatct

SEQ ID NO: 5877864 - DNA, 13 bp, Homo sapiens
ccttgctgtgtga

SEQ ID NO: 5877865 - DNA, 18 bp, Homo sapiens
ccttgcttatgacatcac

SEQ ID NO: 5877866 - DNA, 16 bp, Homo sapiens
ccttgcttccttctca

SEQ ID NO: 5877867 - DNA, 12 bp, Homo sapiens
ccttgcttctcc

SEQ ID NO: 5877868 - DNA, 23 bp, Homo sapiens
ccttgcttctcccatttcctgat

SEQ ID NO: 5877869 - DNA, 13 bp, Homo sapiens
ccttgcttctctt

SEQ ID NO: 5877870 - DNA, 14 bp, Homo sapiens
ccttgcttctcttc

SEQ ID NO: 5877871 - DNA, 16 bp, Homo sapiens
ccttgcttctcttctt

SEQ ID NO: 5877872 - DNA, 20 bp, Homo sapiens
ccttgcttctgtatttcctt

SEQ ID NO: 5877873 - DNA, 21 bp, Homo sapiens
ccttgcttgcctgcagggcca

SEQ ID NO: 5877874 - DNA, 12 bp, Homo sapiens
ccttgcttgtta

SEQ ID NO: 5877875 - DNA, 21 bp, Homo sapiens
ccttgcttgttgggattcctg

SEQ ID NO: 5877876 - DNA, 13 bp, Homo sapiens
ccttgctttcctg

SEQ ID NO: 5877877 - DNA, 18 bp, Homo sapiens
ccttgctttctcttctaa

SEQ ID NO: 5877878 - DNA, 15 bp, Homo sapiens
ccttgcttttccctc

SEQ ID NO: 5877879 - DNA, 16 bp, Homo sapiens
ccttgcttttccctct

SEQ ID NO: 5877880 - DNA, 19 bp, Homo sapiens
ccttgcttttccctctttt

SEQ ID NO: 5877881 - DNA, 20 bp, Homo sapiens
ccttgcttttccctcttttc

SEQ ID NO: 5877882 - DNA, 17 bp, Homo sapiens
ccttgcttttgcttcta

SEQ ID NO: 5877883 - DNA, 21 bp, Homo sapiens
ccttgcttttgcttctagagc

SEQ ID NO: 5877884 - DNA, 20 bp, Homo sapiens
ccttgctttttgctgtgtag

SEQ ID NO: 5877885 - DNA, 20 bp, Homo sapiens
ccttggaaaccgtgtgtcca

SEQ ID NO: 5877886 - DNA, 19 bp, Homo sapiens
ccttggaaatactttatct

SEQ ID NO: 5877887 - DNA, 22 bp, Homo sapiens
ccttggaaatcaaatgtaaagt

SEQ ID NO: 5877888 - DNA, 20 bp, Homo sapiens
ccttggaaatgtctgctggt

SEQ ID NO: 5877889 - DNA, 18 bp, Homo sapiens
ccttggaacaccctggat

SEQ ID NO: 5877890 - DNA, 19 bp, Homo sapiens
ccttggaacaccctggatg

SEQ ID NO: 5877891 - DNA, 15 bp, Homo sapiens
ccttggaagtttcat

SEQ ID NO: 5877892 - DNA, 16 bp, Homo sapiens
ccttggaccactcctg

SEQ ID NO: 5877893 - DNA, 23 bp, Homo sapiens
ccttggaccactcctgtccctgt

SEQ ID NO: 5877894 - DNA, 22 bp, Homo sapiens
ccttggacggggacacggcctc

SEQ ID NO: 5877895 - DNA, 13 bp, Homo sapiens
ccttggacttgag

SEQ ID NO: 5877896 - DNA, 14 bp, Homo sapiens
ccttggagagcagc

SEQ ID NO: 5877897 - DNA, 15 bp, Homo sapiens
ccttggagagcagct

SEQ ID NO: 5877898 - DNA, 21 bp, Homo sapiens
ccttggagagcagctggctct

SEQ ID NO: 5877899 - DNA, 15 bp, Homo sapiens
ccttggagaggagag

SEQ ID NO: 5877900 - DNA, 13 bp, Homo sapiens
ccttggagcaggc

SEQ ID NO: 5877901 - DNA, 22 bp, Homo sapiens
ccttggagcatttatgtagaca

SEQ ID NO: 5877902 - DNA, 13 bp, Homo sapiens
ccttggagcctga

SEQ ID NO: 5877903 - DNA, 13 bp, Homo sapiens
ccttggagccttc

SEQ ID NO: 5877904 - DNA, 13 bp, Homo sapiens
ccttggagctgcc

SEQ ID NO: 5877905 - DNA, 16 bp, Homo sapiens
ccttggagctgccgtg

SEQ ID NO: 5877906 - DNA, 16 bp, Homo sapiens
ccttggagcttacata

SEQ ID NO: 5877907 - DNA, 20 bp, Homo sapiens
ccttggaggaaatgtgctca

SEQ ID NO: 5877908 - DNA, 13 bp, Homo sapiens
ccttggaggacag

SEQ ID NO: 5877909 - DNA, 20 bp, Homo sapiens
ccttggaggatcgtggccaa

SEQ ID NO: 5877910 - DNA, 22 bp, Homo sapiens
ccttggataatgctgttgcctc

SEQ ID NO: 5877911 - DNA, 15 bp, Homo sapiens
ccttggatcagaggt

SEQ ID NO: 5877912 - DNA, 17 bp, Homo sapiens
ccttggatcagaggtca

SEQ ID NO: 5877913 - DNA, 15 bp, Homo sapiens
ccttgtcatatgtgt

SEQ ID NO: 5877914 - DNA, 22 bp, Homo sapiens
ccttgtcatcctcccttgcccc

SEQ ID NO: 5877915 - DNA, 23 bp, Homo sapiens
ccttgtccaggaactgcctgggc

SEQ ID NO: 5877916 - DNA, 16 bp, Homo sapiens
ccttgtccccacactc

SEQ ID NO: 5877917 - DNA, 16 bp, Homo sapiens
ccttgtccccagctcc

SEQ ID NO: 5877918 - DNA, 14 bp, Homo sapiens
ccttgtccccatga

SEQ ID NO: 5877919 - DNA, 13 bp, Homo sapiens
ccttgtccctggg

SEQ ID NO: 5877920 - DNA, 15 bp, Homo sapiens
ccttgtccctggggc

SEQ ID NO: 5877921 - DNA, 21 bp, Homo sapiens
ccttgtccctggggcactccc

SEQ ID NO: 5877922 - DNA, 19 bp, Homo sapiens
ccttgtcctgaagcccagc

SEQ ID NO: 5877923 - DNA, 16 bp, Homo sapiens
ccttgtcctgccagct

SEQ ID NO: 5877924 - DNA, 14 bp, Homo sapiens
ccttgtcctttccc

SEQ ID NO: 5877925 - DNA, 20 bp, Homo sapiens
ccttgtcgcgcgtctcccat

SEQ ID NO: 5877926 - DNA, 23 bp, Homo sapiens
ccttgtcgtagagccctccacat

SEQ ID NO: 5877927 - DNA, 17 bp, Homo sapiens
ccttgtctccctggttg

SEQ ID NO: 5877928 - DNA, 18 bp, Homo sapiens
ccttgtctccctggttgc

SEQ ID NO: 5877929 - DNA, 20 bp, Homo sapiens
ccttgtctcctactcctgac

SEQ ID NO: 5877930 - DNA, 12 bp, Homo sapiens
ccttgtctctca

SEQ ID NO: 5877931 - DNA, 13 bp, Homo sapiens
ccttgtctctcat

SEQ ID NO: 5877932 - DNA, 12 bp, Homo sapiens
ccttgtctctgg

SEQ ID NO: 5877933 - DNA, 13 bp, Homo sapiens
ccttgtctgagat

SEQ ID NO: 5877934 - DNA, 13 bp, Homo sapiens
ccttgtctgctgc

SEQ ID NO: 5877935 - DNA, 14 bp, Homo sapiens
ccttgtctgctgct

SEQ ID NO: 5877936 - DNA, 23 bp, Homo sapiens
ccttgtctgggtctaccaggaac

SEQ ID NO: 5877937 - DNA, 13 bp, Homo sapiens
ccttgtcttcccc

SEQ ID NO: 5877938 - DNA, 14 bp, Homo sapiens
ccttgtcttccccc

SEQ ID NO: 5877939 - DNA, 12 bp, Homo sapiens
ccttgtcttttc

SEQ ID NO: 5877940 - DNA, 14 bp, Homo sapiens
ccttgtcttttcaa

SEQ ID NO: 5877941 - DNA, 23 bp, Homo sapiens
ccttgtcttttcaagtaattttc

SEQ ID NO: 5877942 - DNA, 21 bp, Homo sapiens
ccttgtgactaagttgcaaga

SEQ ID NO: 5877943 - DNA, 18 bp, Homo sapiens
ccttgtgatcactttctg

SEQ ID NO: 5877944 - DNA, 20 bp, Homo sapiens
ccttgtgatcactttctgaa

SEQ ID NO: 5877945 - DNA, 12 bp, Homo sapiens
ccttgtgccaga

SEQ ID NO: 5877946 - DNA, 13 bp, Homo sapiens
ccttgtgcccgat

SEQ ID NO: 5877947 - DNA, 16 bp, Homo sapiens
ccttgtgcctggctca

SEQ ID NO: 5877948 - DNA, 18 bp, Homo sapiens
ccttgtgcctggctcaga

SEQ ID NO: 5877949 - DNA, 15 bp, Homo sapiens
ccttgtgccttcttt

SEQ ID NO: 5877950 - DNA, 14 bp, Homo sapiens
ccttgtgctgccag

SEQ ID NO: 5877951 - DNA, 22 bp, Homo sapiens
ccttgtggactggctgtgcccc

SEQ ID NO: 5877952 - DNA, 15 bp, Homo sapiens
ccttgtggcacattt

SEQ ID NO: 5877953 - DNA, 13 bp, Homo sapiens
ccttgtggcagag

SEQ ID NO: 5877954 - DNA, 11 bp, Homo sapiens
ccttgtggcct

SEQ ID NO: 5877955 - DNA, 22 bp, Homo sapiens
ccttgtggcctgggcctcctca

SEQ ID NO: 5877956 - DNA, 22 bp, Homo sapiens
ccttgtgggcaaaggcagggcc

SEQ ID NO: 5877957 - DNA, 20 bp, Homo sapiens
ccttgtgggcctgggctcct

SEQ ID NO: 5877958 - DNA, 21 bp, Homo sapiens
ccttgtgggcctgggctcctg

SEQ ID NO: 5877959 - DNA, 11 bp, Homo sapiens
ccttgtggtcc

SEQ ID NO: 5877960 - DNA, 15 bp, Homo sapiens
ccttgtggttagcaa

SEQ ID NO: 5877961 - DNA, 21 bp, Homo sapiens
ccttgtggttagcaagactgc

SEQ ID NO: 5877962 - DNA, 15 bp, Homo sapiens
ccttgtgtatatttg

SEQ ID NO: 5877963 - DNA, 16 bp, Homo sapiens
ccttgtgtatatttgt

SEQ ID NO: 5877964 - DNA, 15 bp, Homo sapiens
ccttgtgtctgttgc

SEQ ID NO: 5877965 - DNA, 15 bp, Homo sapiens
ccttgtgtgtatgtg

SEQ ID NO: 5877966 - DNA, 17 bp, Homo sapiens
ccttgtgtgtatgtgta

SEQ ID NO: 5877967 - DNA, 18 bp, Homo sapiens
ccttgtgtgtcaggccct

SEQ ID NO: 5877968 - DNA, 21 bp, Homo sapiens
ccttgtgtgtcaggccctctg

SEQ ID NO: 5877969 - DNA, 23 bp, Homo sapiens
ccttgtgtgtcaggccctctgcc

SEQ ID NO: 5877970 - DNA, 23 bp, Homo sapiens
ccttgtgttcagctctttccaaa

SEQ ID NO: 5877971 - DNA, 22 bp, Homo sapiens
ccttgtgttccttctgtgaaga

SEQ ID NO: 5877972 - DNA, 13 bp, Homo sapiens
ccttgtgtttctg

SEQ ID NO: 5877973 - DNA, 16 bp, Homo sapiens
ccttgtgtttctgtgg

SEQ ID NO: 5877974 - DNA, 21 bp, Homo sapiens
ccttgtgttttgtcctgcctc

SEQ ID NO: 5877975 - DNA, 16 bp, Homo sapiens
ccttgttacttctgag

SEQ ID NO: 5877976 - DNA, 21 bp, Homo sapiens
ccttgttatttctcagacttt

SEQ ID NO: 5877977 - DNA, 17 bp, Homo sapiens
ccttgttcatggagagc

SEQ ID NO: 5877978 - DNA, 19 bp, Homo sapiens
ccttgttcatggagagctg

SEQ ID NO: 5877979 - DNA, 20 bp, Homo sapiens
ccttgttccagctttgacgt

SEQ ID NO: 5877980 - DNA, 13 bp, Homo sapiens
ccttgttccagtt

SEQ ID NO: 5877981 - DNA, 22 bp, Homo sapiens
ccttgttctatttttcaatcat

SEQ ID NO: 5877982 - DNA, 13 bp, Homo sapiens
ccttgttctctgc

SEQ ID NO: 5877983 - DNA, 17 bp, Homo sapiens
ccttgttcttagagcag

SEQ ID NO: 5877984 - DNA, 15 bp, Homo sapiens
ccttgttgatgccag

SEQ ID NO: 5877985 - DNA, 23 bp, Homo sapiens
ccttgttgatgccagctgtactg

SEQ ID NO: 5877986 - DNA, 22 bp, Homo sapiens
ccttgttgcactgccccctgct

SEQ ID NO: 5877987 - DNA, 12 bp, Homo sapiens
ccttgttgcctg

SEQ ID NO: 5877988 - DNA, 15 bp, Homo sapiens
ccttgttgcctgcac

SEQ ID NO: 5877989 - DNA, 23 bp, Homo sapiens
ccttgttgcctgcacccttccct

SEQ ID NO: 5877990 - DNA, 17 bp, Homo sapiens
ccttgttggtcagagga

SEQ ID NO: 5877991 - DNA, 17 bp, Homo sapiens
ccttgttgtttgctttg

SEQ ID NO: 5877992 - DNA, 11 bp, Homo sapiens
ccttgtttaca

SEQ ID NO: 5877993 - DNA, 18 bp, Homo sapiens
ccttgtttacagtgagga

SEQ ID NO: 5877994 - DNA, 16 bp, Homo sapiens
ccttgtttataaatag

SEQ ID NO: 5877995 - DNA, 20 bp, Homo sapiens
ccttgtttcaaacacaaatg

SEQ ID NO: 5877996 - DNA, 11 bp, Homo sapiens
ccttgtttcag

SEQ ID NO: 5877997 - DNA, 22 bp, Homo sapiens
ccttgtttctgccctgccagct

SEQ ID NO: 5877998 - DNA, 22 bp, Homo sapiens
ccttgtttgattttagctgcag

SEQ ID NO: 5877999 - DNA, 17 bp, Homo sapiens
ccttgtttgttttattc

SEQ ID NO: 5878000 - DNA, 19 bp, Homo sapiens
ccttgttttattcaaagac

SEQ ID NO: 5878001 - DNA, 15 bp, Homo sapiens
ccttgttttcagccc

SEQ ID NO: 5878002 - DNA, 15 bp, Homo sapiens
ccttgttttctctgt

SEQ ID NO: 5878003 - DNA, 18 bp, Homo sapiens
ccttgttttctctgtgtg

SEQ ID NO: 5878004 - DNA, 20 bp, Homo sapiens
ccttgttttgaaaacctaaa

SEQ ID NO: 5878005 - DNA, 21 bp, Homo sapiens
ccttgttttgaaactagaaat

SEQ ID NO: 5878006 - DNA, 22 bp, Homo sapiens
ccttgttttgaaactagaaatc

SEQ ID NO: 5878007 - DNA, 14 bp, Homo sapiens
ccttgttttgccat

SEQ ID NO: 5878008 - DNA, 15 bp, Homo sapiens
cctttaaaaaagaaa

SEQ ID NO: 5878009 - DNA, 20 bp, Homo sapiens
cctttaaaaagcaggaaata

SEQ ID NO: 5878010 - DNA, 20 bp, Homo sapiens
cctttaaaaatgtataatga

SEQ ID NO: 5878011 - DNA, 12 bp, Homo sapiens
cctttaaaatat

SEQ ID NO: 5878012 - DNA, 14 bp, Homo sapiens
cctttaaaatattg

SEQ ID NO: 5878013 - DNA, 12 bp, Homo sapiens
cctttaaaattt

SEQ ID NO: 5878014 - DNA, 14 bp, Homo sapiens
cctttaaagccttt

SEQ ID NO: 5878015 - DNA, 22 bp, Homo sapiens
cctttaaaggtcgcacctcctt

SEQ ID NO: 5878016 - DNA, 23 bp, Homo sapiens
cctttaaagtatgaatctatgcc

SEQ ID NO: 5878017 - DNA, 12 bp, Homo sapiens
cctttaaatact

SEQ ID NO: 5878018 - DNA, 14 bp, Homo sapiens
cctttaaatatcat

SEQ ID NO: 5878019 - DNA, 16 bp, Homo sapiens
cctttaaatatcattc

SEQ ID NO: 5878020 - DNA, 18 bp, Homo sapiens
cctttaaatatcattctt

SEQ ID NO: 5878021 - DNA, 19 bp, Homo sapiens
cctttaaatttcagctttg

SEQ ID NO: 5878022 - DNA, 17 bp, Homo sapiens
cctttaacaacatgttt

SEQ ID NO: 5878023 - DNA, 22 bp, Homo sapiens
cctttaacaacatgtttccagc

SEQ ID NO: 5878024 - DNA, 18 bp, Homo sapiens
cctttaacacagacccct

SEQ ID NO: 5878025 - DNA, 16 bp, Homo sapiens
cctttaaccctgattc

SEQ ID NO: 5878026 - DNA, 23 bp, Homo sapiens
cctttaacttttttttctctctt

SEQ ID NO: 5878027 - DNA, 16 bp, Homo sapiens
cctttaagaaccttaa

SEQ ID NO: 5878028 - DNA, 20 bp, Homo sapiens
cctttaagatatccatcttt

SEQ ID NO: 5878029 - DNA, 19 bp, Homo sapiens
cctttaagtagataagcag

SEQ ID NO: 5878030 - DNA, 11 bp, Homo sapiens
cctttaatatt

SEQ ID NO: 5878031 - DNA, 13 bp, Homo sapiens
cctttaatatttt

SEQ ID NO: 5878032 - DNA, 16 bp, Homo sapiens
cctttaatattttgta

SEQ ID NO: 5878033 - DNA, 13 bp, Homo sapiens
cctttaatgcatc

SEQ ID NO: 5878034 - DNA, 18 bp, Homo sapiens
cctttaattgtaaagtaa

SEQ ID NO: 5878035 - DNA, 15 bp, Homo sapiens
cctttaattttcttg

SEQ ID NO: 5878036 - DNA, 16 bp, Homo sapiens
cctttaattttcttgt

SEQ ID NO: 5878037 - DNA, 18 bp, Homo sapiens
cctttaattttcttgttt

SEQ ID NO: 5878038 - DNA, 15 bp, Homo sapiens
cctttacaactaaat

SEQ ID NO: 5878039 - DNA, 19 bp, Homo sapiens
cctttacattttgtgcagt

SEQ ID NO: 5878040 - DNA, 22 bp, Homo sapiens
cctttaccactgtggttttgac

SEQ ID NO: 5878041 - DNA, 14 bp, Homo sapiens
cctttaccccacat

SEQ ID NO: 5878042 - DNA, 16 bp, Homo sapiens
cctttaccctcatctg

SEQ ID NO: 5878043 - DNA, 15 bp, Homo sapiens
cctttaccctcttgg

SEQ ID NO: 5878044 - DNA, 19 bp, Homo sapiens
cctttaccctctttgctgc

SEQ ID NO: 5878045 - DNA, 23 bp, Homo sapiens
cctttaccgaggacagcctgcct

SEQ ID NO: 5878046 - DNA, 15 bp, Homo sapiens
cctttaccttttcta

SEQ ID NO: 5878047 - DNA, 15 bp, Homo sapiens
cctttacgttcatca

SEQ ID NO: 5878048 - DNA, 19 bp, Homo sapiens
cctttactatcattctcag

SEQ ID NO: 5878049 - DNA, 21 bp, Homo sapiens
cctttactatcattctcagtg

SEQ ID NO: 5878050 - DNA, 13 bp, Homo sapiens
cctttactcctgg

SEQ ID NO: 5878051 - DNA, 20 bp, Homo sapiens
cctttactgaccctggggct

SEQ ID NO: 5878052 - DNA, 14 bp, Homo sapiens
cctttactgatact

SEQ ID NO: 5878053 - DNA, 14 bp, Homo sapiens
cctttactttccct

SEQ ID NO: 5878054 - DNA, 14 bp, Homo sapiens
cctttagaaaatat

SEQ ID NO: 5878055 - DNA, 20 bp, Homo sapiens
cctttagaaactcaaaaact

SEQ ID NO: 5878056 - DNA, 14 bp, Homo sapiens
cctttagaacagga

SEQ ID NO: 5878057 - DNA, 22 bp, Homo sapiens
cctttagaacagggtttctcag

SEQ ID NO: 5878058 - DNA, 20 bp, Homo sapiens
cctttagagtgtaggtgaaa

SEQ ID NO: 5878059 - DNA, 19 bp, Homo sapiens
cctttagccaaacccttgt

SEQ ID NO: 5878060 - DNA, 20 bp, Homo sapiens
cctttagcgcccagttgggt

SEQ ID NO: 5878061 - DNA, 22 bp, Homo sapiens
cctttagcgggactcagtgagc

SEQ ID NO: 5878062 - DNA, 16 bp, Homo sapiens
cctttaggcagcctgc

SEQ ID NO: 5878063 - DNA, 19 bp, Homo sapiens
cctttaggcagcctgccgc

SEQ ID NO: 5878064 - DNA, 18 bp, Homo sapiens
cctttagggctgttgcta

SEQ ID NO: 5878065 - DNA, 19 bp, Homo sapiens
cctttagggttctgcctct

SEQ ID NO: 5878066 - DNA, 18 bp, Homo sapiens
cctttagtatcagtgttt

SEQ ID NO: 5878067 - DNA, 22 bp, Homo sapiens
cctttagttctgctgtctccct

SEQ ID NO: 5878068 - DNA, 22 bp, Homo sapiens
cctttataatgaggatgattat

SEQ ID NO: 5878069 - DNA, 15 bp, Homo sapiens
cctttataattcttt

SEQ ID NO: 5878070 - DNA, 16 bp, Homo sapiens
cctttatagctcatca

SEQ ID NO: 5878071 - DNA, 17 bp, Homo sapiens
cctttatagctcatcac

SEQ ID NO: 5878072 - DNA, 19 bp, Homo sapiens
cctttatagctctcatcac

SEQ ID NO: 5878073 - DNA, 19 bp, Homo sapiens
cctttatatatgtactagc

SEQ ID NO: 5878074 - DNA, 23 bp, Homo sapiens
cctttatccctgaggtcacctgg

SEQ ID NO: 5878075 - DNA, 16 bp, Homo sapiens
cctttatccctgctta

SEQ ID NO: 5878076 - DNA, 11 bp, Homo sapiens
cctttatccta

SEQ ID NO: 5878077 - DNA, 20 bp, Homo sapiens
cctttatctaccaactttca

SEQ ID NO: 5878078 - DNA, 13 bp, Homo sapiens
cctttatctctgt

SEQ ID NO: 5878079 - DNA, 13 bp, Homo sapiens
cctttatgtattc

SEQ ID NO: 5878080 - DNA, 14 bp, Homo sapiens
cctttatgtgaatt

SEQ ID NO: 5878081 - DNA, 19 bp, Homo sapiens
cctttatgtggaaaacaga

SEQ ID NO: 5878082 - DNA, 14 bp, Homo sapiens
cctttattaaaatc

SEQ ID NO: 5878083 - DNA, 23 bp, Homo sapiens
cctttattaccccctccttcaga

SEQ ID NO: 5878084 - DNA, 12 bp, Homo sapiens
cctttattcttt

SEQ ID NO: 5878085 - DNA, 13 bp, Homo sapiens
cctttattcttta

SEQ ID NO: 5878086 - DNA, 14 bp, Homo sapiens
cctttattgcagtt

SEQ ID NO: 5878087 - DNA, 13 bp, Homo sapiens
cctttattgtgat

SEQ ID NO: 5878088 - DNA, 15 bp, Homo sapiens
cctttattgtgtttg

SEQ ID NO: 5878089 - DNA, 20 bp, Homo sapiens
cctttattgtgtttgtcatt

SEQ ID NO: 5878090 - DNA, 20 bp, Homo sapiens
cctttatttattaaacttca

SEQ ID NO: 5878091 - DNA, 21 bp, Homo sapiens
cctttatttattaaacttcag

SEQ ID NO: 5878092 - DNA, 20 bp, Homo sapiens
cctttctgttgccagtcagc

SEQ ID NO: 5878093 - DNA, 19 bp, Homo sapiens
cctttcttaattttgtctt

SEQ ID NO: 5878094 - DNA, 20 bp, Homo sapiens
cctttcttagctgatgtctt

SEQ ID NO: 5878095 - DNA, 18 bp, Homo sapiens
cctttcttattctgtgag

SEQ ID NO: 5878096 - DNA, 20 bp, Homo sapiens
cctttcttccatcagctctc

SEQ ID NO: 5878097 - DNA, 13 bp, Homo sapiens
cctttcttcccca

SEQ ID NO: 5878098 - DNA, 11 bp, Homo sapiens
cctttcttcct

SEQ ID NO: 5878099 - DNA, 13 bp, Homo sapiens
cctttcttcctca

SEQ ID NO: 5878100 - DNA, 15 bp, Homo sapiens
cctttcttcctcatt

SEQ ID NO: 5878101 - DNA, 19 bp, Homo sapiens
cctttcttcctcattccct

SEQ ID NO: 5878102 - DNA, 14 bp, Homo sapiens
cctttcttccttcc

SEQ ID NO: 5878103 - DNA, 16 bp, Homo sapiens
cctttcttctgccctt

SEQ ID NO: 5878104 - DNA, 12 bp, Homo sapiens
cctttcttctgt

SEQ ID NO: 5878105 - DNA, 22 bp, Homo sapiens
cctttcttgcactattccacag

SEQ ID NO: 5878106 - DNA, 16 bp, Homo sapiens
cctttcttgcactgtc

SEQ ID NO: 5878107 - DNA, 13 bp, Homo sapiens
cctttcttggttc

SEQ ID NO: 5878108 - DNA, 17 bp, Homo sapiens
cctttcttgtctttcct

SEQ ID NO: 5878109 - DNA, 18 bp, Homo sapiens
cctttctttgcctctgca

SEQ ID NO: 5878110 - DNA, 22 bp, Homo sapiens
cctttcttttaatgatgccatg

SEQ ID NO: 5878111 - DNA, 16 bp, Homo sapiens
cctttcttttcatgcc

SEQ ID NO: 5878112 - DNA, 12 bp, Homo sapiens
cctttcttttcc

SEQ ID NO: 5878113 - DNA, 21 bp, Homo sapiens
cctttcttttgaatcaatctg

SEQ ID NO: 5878114 - DNA, 15 bp, Homo sapiens
cctttctttttcttc

SEQ ID NO: 5878115 - DNA, 23 bp, Homo sapiens
cctttctttttcttcttccctcc

SEQ ID NO: 5878116 - DNA, 22 bp, Homo sapiens
cctttgaaatattaaaatcact

SEQ ID NO: 5878117 - DNA, 22 bp, Homo sapiens
cctttgaaattcccccacttgg

SEQ ID NO: 5878118 - DNA, 15 bp, Homo sapiens
cctttgaacgtgctt

SEQ ID NO: 5878119 - DNA, 16 bp, Homo sapiens
cctttgaacgtgcttc

SEQ ID NO: 5878120 - DNA, 20 bp, Homo sapiens
cctttgaacgtgcttctttg

SEQ ID NO: 5878121 - DNA, 13 bp, Homo sapiens
cctttgaagaagg

SEQ ID NO: 5878122 - DNA, 21 bp, Homo sapiens
cctttgaagaaggcaaggctg

SEQ ID NO: 5878123 - DNA, 16 bp, Homo sapiens
cctttgaatcctctct

SEQ ID NO: 5878124 - DNA, 14 bp, Homo sapiens
cctttgacaaaggt

SEQ ID NO: 5878125 - DNA, 16 bp, Homo sapiens
cctttgacatttaatt

SEQ ID NO: 5878126 - DNA, 21 bp, Homo sapiens
cctttgaccctattcatgtct

SEQ ID NO: 5878127 - DNA, 14 bp, Homo sapiens
cctttgacctgacg

SEQ ID NO: 5878128 - DNA, 21 bp, Homo sapiens
cctttgacctgcctcccttca

SEQ ID NO: 5878129 - DNA, 22 bp, Homo sapiens
cctttgacctgcctcccttcat

SEQ ID NO: 5878130 - DNA, 17 bp, Homo sapiens
cctttgacgccatccca

SEQ ID NO: 5878131 - DNA, 21 bp, Homo sapiens
cctttgacgccatcccagccc

SEQ ID NO: 5878132 - DNA, 22 bp, Homo sapiens
cctttgacgccatcccagcccc

SEQ ID NO: 5878133 - DNA, 15 bp, Homo sapiens
cctttgacttaaggg

SEQ ID NO: 5878134 - DNA, 15 bp, Homo sapiens
cctttgactttctgt

SEQ ID NO: 5878135 - DNA, 14 bp, Homo sapiens
cctttgagaaagaa

SEQ ID NO: 5878136 - DNA, 17 bp, Homo sapiens
cctttgagaatacaaga

SEQ ID NO: 5878137 - DNA, 13 bp, Homo sapiens
cctttgagacagt

SEQ ID NO: 5878138 - DNA, 15 bp, Homo sapiens
cctttgagacagttt

SEQ ID NO: 5878139 - DNA, 14 bp, Homo sapiens
cctttgagagaggg

SEQ ID NO: 5878140 - DNA, 17 bp, Homo sapiens
cctttgagcttctcctc

SEQ ID NO: 5878141 - DNA, 20 bp, Homo sapiens
cctttgagcttctcctctgc

SEQ ID NO: 5878142 - DNA, 19 bp, Homo sapiens
cctttgaggcaaaggccag

SEQ ID NO: 5878143 - DNA, 13 bp, Homo sapiens
cctttgaggtcta

SEQ ID NO: 5878144 - DNA, 23 bp, Homo sapiens
cctttgagtccagtgtgggacac

SEQ ID NO: 5878145 - DNA, 21 bp, Homo sapiens
cctttgagtgccaatttctta

SEQ ID NO: 5878146 - DNA, 17 bp, Homo sapiens
cctttgagtgtcttcta

SEQ ID NO: 5878147 - DNA, 16 bp, Homo sapiens
cctttgcaacgctcac

SEQ ID NO: 5878148 - DNA, 18 bp, Homo sapiens
cctttgcaagatgcttgg

SEQ ID NO: 5878149 - DNA, 14 bp, Homo sapiens
cctttgcacaggat

SEQ ID NO: 5878150 - DNA, 18 bp, Homo sapiens
cctttgcaccatgtgaag

SEQ ID NO: 5878151 - DNA, 13 bp, Homo sapiens
cctttgcactgag

SEQ ID NO: 5878152 - DNA, 16 bp, Homo sapiens
cctttgcactgagggc

SEQ ID NO: 5878153 - DNA, 22 bp, Homo sapiens
cctttgcactgtaatgaggaaa

SEQ ID NO: 5878154 - DNA, 15 bp, Homo sapiens
cctttgcaggcccag

SEQ ID NO: 5878155 - DNA, 20 bp, Homo sapiens
cctttgcaggcccagcagac

SEQ ID NO: 5878156 - DNA, 14 bp, Homo sapiens
cctttgcagggcag

SEQ ID NO: 5878157 - DNA, 18 bp, Homo sapiens
cctttgcagggcagcccc

SEQ ID NO: 5878158 - DNA, 19 bp, Homo sapiens
cctttgcagtgtgcagggt

SEQ ID NO: 5878159 - DNA, 21 bp, Homo sapiens
cctttgcatagctctccttcc

SEQ ID NO: 5878160 - DNA, 19 bp, Homo sapiens
cctttgcatggcagggcct

SEQ ID NO: 5878161 - DNA, 20 bp, Homo sapiens
cctttgcatggcagggcctc

SEQ ID NO: 5878162 - DNA, 23 bp, Homo sapiens
cctttgcatggcagggcctcatc

SEQ ID NO: 5878163 - DNA, 12 bp, Homo sapiens
cctttgcattta

SEQ ID NO: 5878164 - DNA, 20 bp, Homo sapiens
cctttgcccacacacactcc

SEQ ID NO: 5878165 - DNA, 16 bp, Homo sapiens
cctttgcccagaaaga

SEQ ID NO: 5878166 - DNA, 14 bp, Homo sapiens
cctttgccccaagg

SEQ ID NO: 5878167 - DNA, 15 bp, Homo sapiens
cctttgcctctgcta

SEQ ID NO: 5878168 - DNA, 21 bp, Homo sapiens
cctttgcctttcttctgccct

SEQ ID NO: 5878169 - DNA, 16 bp, Homo sapiens
cctttgcgtggatcaa

SEQ ID NO: 5878170 - DNA, 15 bp, Homo sapiens
cctttgctccctccc

SEQ ID NO: 5878171 - DNA, 14 bp, Homo sapiens
cctttgctcttata

SEQ ID NO: 5878172 - DNA, 18 bp, Homo sapiens
cctttgctgaagtctccc

SEQ ID NO: 5878173 - DNA, 19 bp, Homo sapiens
cctttgctgccttctgtct

SEQ ID NO: 5878174 - DNA, 20 bp, Homo sapiens
cctttgctgccttctgtctc

SEQ ID NO: 5878175 - DNA, 21 bp, Homo sapiens
cctttgctgccttctgtctct

SEQ ID NO: 5878176 - DNA, 17 bp, Homo sapiens
cctttgctggaagaaac

SEQ ID NO: 5878177 - DNA, 14 bp, Homo sapiens
cctttgctgtcact

SEQ ID NO: 5878178 - DNA, 17 bp, Homo sapiens
cctttgctgtgaggctg

SEQ ID NO: 5878179 - DNA, 22 bp, Homo sapiens
cctttgctgtgaggctgtcctg

SEQ ID NO: 5878180 - DNA, 14 bp, Homo sapiens
cctttgctgttcgc

SEQ ID NO: 5878181 - DNA, 23 bp, Homo sapiens
cctttgctgtttagcttcctcca

SEQ ID NO: 5878182 - DNA, 20 bp, Homo sapiens
cctttggaaaaatcttgggc

SEQ ID NO: 5878183 - DNA, 20 bp, Homo sapiens
cctttggaacaagacagcct

SEQ ID NO: 5878184 - DNA, 17 bp, Homo sapiens
cctttggaagaaacagg

SEQ ID NO: 5878185 - DNA, 17 bp, Homo sapiens
cctttggaaggtgacac

SEQ ID NO: 5878186 - DNA, 18 bp, Homo sapiens
cctttggacccagggcct

SEQ ID NO: 5878187 - DNA, 19 bp, Homo sapiens
cctttggacccagggcctg

SEQ ID NO: 5878188 - DNA, 21 bp, Homo sapiens
cctttggagaacgccagtctc

SEQ ID NO: 5878189 - DNA, 20 bp, Homo sapiens
cctttggagaccaggcctca

SEQ ID NO: 5878190 - DNA, 21 bp, Homo sapiens
cctttggagaccaggcctcag

SEQ ID NO: 5878191 - DNA, 20 bp, Homo sapiens
cctttggagatgctgagggt

SEQ ID NO: 5878192 - DNA, 19 bp, Homo sapiens
cctttggcacaccctctct

SEQ ID NO: 5878193 - DNA, 21 bp, Homo sapiens
cctttggcctggggtgcatct

SEQ ID NO: 5878194 - DNA, 15 bp, Homo sapiens
cctttggccttggct

SEQ ID NO: 5878195 - DNA, 12 bp, Homo sapiens
cctttggctctg

SEQ ID NO: 5878196 - DNA, 19 bp, Homo sapiens
cctttggctctggagacag

SEQ ID NO: 5878197 - DNA, 16 bp, Homo sapiens
cctttggctggtagca

SEQ ID NO: 5878198 - DNA, 22 bp, Homo sapiens
cctttggctggtagcagcaggc

SEQ ID NO: 5878199 - DNA, 21 bp, Homo sapiens
cctttggcttctgatttttct

SEQ ID NO: 5878200 - DNA, 22 bp, Homo sapiens
cctttgggcacggccctccttc

SEQ ID NO: 5878201 - DNA, 14 bp, Homo sapiens
cctttgggcccagg

SEQ ID NO: 5878202 - DNA, 16 bp, Homo sapiens
cctttgggccctgcat

SEQ ID NO: 5878203 - DNA, 12 bp, Homo sapiens
cctttggggaga

SEQ ID NO: 5878204 - DNA, 18 bp, Homo sapiens
cctttggggcttctgtga

SEQ ID NO: 5878205 - DNA, 21 bp, Homo sapiens
cctttggggtagaccttgagg

SEQ ID NO: 5878206 - DNA, 12 bp, Homo sapiens
cctttgggtatg

SEQ ID NO: 5878207 - DNA, 23 bp, Homo sapiens
cctttgggtatgttaacctaggc

SEQ ID NO: 5878208 - DNA, 16 bp, Homo sapiens
cctttgggtgctgttt

SEQ ID NO: 5878209 - DNA, 15 bp, Homo sapiens
cctttggtatttcac

SEQ ID NO: 5878210 - DNA, 22 bp, Homo sapiens
cctttggtcctaagtccctgcc

SEQ ID NO: 5878211 - DNA, 19 bp, Homo sapiens
cctttggtgaattccttct

SEQ ID NO: 5878212 - DNA, 20 bp, Homo sapiens
cctttggttctggccagaat

SEQ ID NO: 5878213 - DNA, 15 bp, Homo sapiens
cctttggtttgacaa

SEQ ID NO: 5878214 - DNA, 16 bp, Homo sapiens
cctttggtttgacaat

SEQ ID NO: 5878215 - DNA, 21 bp, Homo sapiens
cctttggtttgacaattttgt

SEQ ID NO: 5878216 - DNA, 16 bp, Homo sapiens
cctttggtttggcctc

SEQ ID NO: 5878217 - DNA, 18 bp, Homo sapiens
cctttggtttggcctcca

SEQ ID NO: 5878218 - DNA, 21 bp, Homo sapiens
cctttggtttggcctccatcc

SEQ ID NO: 5878219 - DNA, 22 bp, Homo sapiens
cctttggtttggcctccatcct

SEQ ID NO: 5878220 - DNA, 21 bp, Homo sapiens
cctttgtaaattgtcagatgc

SEQ ID NO: 5878221 - DNA, 19 bp, Homo sapiens
cctttgtaagacatttgta

SEQ ID NO: 5878222 - DNA, 20 bp, Homo sapiens
cctttgtaagacatttgtat

SEQ ID NO: 5878223 - DNA, 12 bp, Homo sapiens
cctttgtaagtt

SEQ ID NO: 5878224 - DNA, 14 bp, Homo sapiens
cctttgtaagttat

SEQ ID NO: 5878225 - DNA, 17 bp, Homo sapiens
cctttgtaatatgagaa

SEQ ID NO: 5878226 - DNA, 20 bp, Homo sapiens
cctttgtattctctcctgta

SEQ ID NO: 5878227 - DNA, 24 bp, Homo sapiens
cctttgtattctctcctgtacctc

SEQ ID NO: 5878228 - DNA, 16 bp, Homo sapiens
cctttgtcaaatggta

SEQ ID NO: 5878229 - DNA, 15 bp, Homo sapiens
cctttgtcaacttca

SEQ ID NO: 5878230 - DNA, 18 bp, Homo sapiens
cctttgtcaacttcagtt

SEQ ID NO: 5878231 - DNA, 23 bp, Homo sapiens
cctttgtcatcattgtatatatg

SEQ ID NO: 5878232 - DNA, 23 bp, Homo sapiens
cctttgtcatctttcttctattt

SEQ ID NO: 5878233 - DNA, 14 bp, Homo sapiens
cctttgtccccaca

SEQ ID NO: 5878234 - DNA, 17 bp, Homo sapiens
cctttgtccccacacag

SEQ ID NO: 5878235 - DNA, 21 bp, Homo sapiens
cctttgtccccacacagcctc

SEQ ID NO: 5878236 - DNA, 23 bp, Homo sapiens
cctttgtccccaccgcagacagg

SEQ ID NO: 5878237 - DNA, 13 bp, Homo sapiens
cctttgtcctcct

SEQ ID NO: 5878238 - DNA, 21 bp, Homo sapiens
cctttgtcctcctgctgccag

SEQ ID NO: 5878239 - DNA, 12 bp, Homo sapiens
cctttgtcctgc

SEQ ID NO: 5878240 - DNA, 20 bp, Homo sapiens
cctttgtctcacgattccag

SEQ ID NO: 5878241 - DNA, 19 bp, Homo sapiens
cctttgtctggatgcacac

SEQ ID NO: 5878242 - DNA, 19 bp, Homo sapiens
cctttgtctgtcaatcaca

SEQ ID NO: 5878243 - DNA, 14 bp, Homo sapiens
cctttgtcttgtca

SEQ ID NO: 5878244 - DNA, 19 bp, Homo sapiens
cctttgtctttctttgtca

SEQ ID NO: 5878245 - DNA, 20 bp, Homo sapiens
cctttgtcttttttttcatc

SEQ ID NO: 5878246 - DNA, 21 bp, Homo sapiens
cctttgtcttttttttcatcc

SEQ ID NO: 5878247 - DNA, 18 bp, Homo sapiens
cctttgtgagcctatgat

SEQ ID NO: 5878248 - DNA, 16 bp, Homo sapiens
cctttgtgctctatag

SEQ ID NO: 5878249 - DNA, 12 bp, Homo sapiens
cctttgtgctgt

SEQ ID NO: 5878250 - DNA, 13 bp, Homo sapiens
cctttgtgctgtg

SEQ ID NO: 5878251 - DNA, 14 bp, Homo sapiens
cctttgtggacttt

SEQ ID NO: 5878252 - DNA, 22 bp, Homo sapiens
cctttgtggactttatttaatt

SEQ ID NO: 5878253 - DNA, 15 bp, Homo sapiens
cctttgtgtaataaa

SEQ ID NO: 5878254 - DNA, 16 bp, Homo sapiens
cctttgtgtaataaaa

SEQ ID NO: 5878255 - DNA, 23 bp, Homo sapiens
cctttgtgtcagaaaaaggaaac

SEQ ID NO: 5878256 - DNA, 14 bp, Homo sapiens
cctttgtgtgctct

SEQ ID NO: 5878257 - DNA, 17 bp, Homo sapiens
cctttgtgtgctctcca

SEQ ID NO: 5878258 - DNA, 16 bp, Homo sapiens
cctttgtgtggctcct

SEQ ID NO: 5878259 - DNA, 15 bp, Homo sapiens
cctttgtgtggctgc

SEQ ID NO: 5878260 - DNA, 20 bp, Homo sapiens
cctttgtgtgtactcactga

SEQ ID NO: 5878261 - DNA, 15 bp, Homo sapiens
cctttgttaacctta

SEQ ID NO: 5878262 - DNA, 11 bp, Homo sapiens
cctttgttccc

SEQ ID NO: 5878263 - DNA, 20 bp, Homo sapiens
cctttgttccccactggagc

SEQ ID NO: 5878264 - DNA, 21 bp, Homo sapiens
cctttgttccccactggagca

SEQ ID NO: 5878265 - DNA, 15 bp, Homo sapiens
cctttgttcccggct

SEQ ID NO: 5878266 - DNA, 19 bp, Homo sapiens
cctttgttccctaagtcca

SEQ ID NO: 5878267 - DNA, 15 bp, Homo sapiens
cctttgttctggggg

SEQ ID NO: 5878268 - DNA, 17 bp, Homo sapiens
cctttgttgctgttgct

SEQ ID NO: 5878269 - DNA, 12 bp, Homo sapiens
cgaatctctgcc

SEQ ID NO: 5878270 - DNA, 20 bp, Homo sapiens
cgaatcttatttttcctgtc

SEQ ID NO: 5878271 - DNA, 18 bp, Homo sapiens
cgaatgacaaaatcatct

SEQ ID NO: 5878272 - DNA, 20 bp, Homo sapiens
cgaatgagctgggccctggg

SEQ ID NO: 5878273 - DNA, 17 bp, Homo sapiens
cgaatgcccctgttcat

SEQ ID NO: 5878274 - DNA, 20 bp, Homo sapiens
cgaatgcccctgttcatgtt

SEQ ID NO: 5878275 - DNA, 24 bp, Homo sapiens
cgaatgcctgtcagtttcatggag

SEQ ID NO: 5878276 - DNA, 11 bp, Homo sapiens
cgaatggacca

SEQ ID NO: 5878277 - DNA, 23 bp, Homo sapiens
cgaatggggcgatcaagtccaga

SEQ ID NO: 5878278 - DNA, 14 bp, Homo sapiens
cgaatggtctttgc

SEQ ID NO: 5878279 - DNA, 19 bp, Homo sapiens
cgaatggtctttgctccag

SEQ ID NO: 5878280 - DNA, 13 bp, Homo sapiens
cgaatgtgcaggt

SEQ ID NO: 5878281 - DNA, 15 bp, Homo sapiens
cgaatgtgtctttag

SEQ ID NO: 5878282 - DNA, 21 bp, Homo sapiens
cgaatgtgtgggcccaaggcc

SEQ ID NO: 5878283 - DNA, 22 bp, Homo sapiens
cgaattaatagcttttattgta

SEQ ID NO: 5878284 - DNA, 16 bp, Homo sapiens
cgaattagtttgcact

SEQ ID NO: 5878285 - DNA, 15 bp, Homo sapiens
cgaattcagaaagag

SEQ ID NO: 5878286 - DNA, 12 bp, Homo sapiens
cgaattccactc

SEQ ID NO: 5878287 - DNA, 20 bp, Homo sapiens
cgaattgagataatatctgt

SEQ ID NO: 5878288 - DNA, 14 bp, Homo sapiens
cgaattgagcacaa

SEQ ID NO: 5878289 - DNA, 13 bp, Homo sapiens
cgaatttctcact

SEQ ID NO: 5878290 - DNA, 16 bp, Homo sapiens
cgaatttctgtgccct

SEQ ID NO: 5878291 - DNA, 22 bp, Homo sapiens
cgaatttggtgtggctgtattc

SEQ ID NO: 5878292 - DNA, 16 bp, Homo sapiens
cgaattttaaaagatg

SEQ ID NO: 5878293 - DNA, 17 bp, Homo sapiens
cgaatttttcagatgat

SEQ ID NO: 5878294 - DNA, 22 bp, Homo sapiens
cgacaaaaacaagactgcctcc

SEQ ID NO: 5878295 - DNA, 23 bp, Homo sapiens
cgacaaaaacaagactgcctccc

SEQ ID NO: 5878296 - DNA, 21 bp, Homo sapiens
cgacaaaaacgaaactccatc

SEQ ID NO: 5878297 - DNA, 15 bp, Homo sapiens
cgacaaaatctcctg

SEQ ID NO: 5878298 - DNA, 19 bp, Homo sapiens
cgacaaagcatcattgtaa

SEQ ID NO: 5878299 - DNA, 17 bp, Homo sapiens
cgacaaagctgctaaat

SEQ ID NO: 5878300 - DNA, 16 bp, Homo sapiens
cgacaaaggccacagg

SEQ ID NO: 5878301 - DNA, 14 bp, Homo sapiens
cgacaaatctgtct

SEQ ID NO: 5878302 - DNA, 16 bp, Homo sapiens
cgacaaatctgtctgc

SEQ ID NO: 5878303 - DNA, 17 bp, Homo sapiens
cgacaagccttcagcca

SEQ ID NO: 5878304 - DNA, 12 bp, Homo sapiens
cgacaagtgctg

SEQ ID NO: 5878305 - DNA, 20 bp, Homo sapiens
cgacaatgccctgctggcct

SEQ ID NO: 5878306 - DNA, 23 bp, Homo sapiens
cgacaatgccctgctggcctgtc

SEQ ID NO: 5878307 - DNA, 20 bp, Homo sapiens
cgacacacggggctcgggcc

SEQ ID NO: 5878308 - DNA, 13 bp, Homo sapiens
cgacacagcgacg

SEQ ID NO: 5878309 - DNA, 13 bp, Homo sapiens
cgacacaggctgc

SEQ ID NO: 5878310 - DNA, 15 bp, Homo sapiens
cgacacaggctgccg

SEQ ID NO: 5878311 - DNA, 16 bp, Homo sapiens
cgacaccactcctgcc

SEQ ID NO: 5878312 - DNA, 20 bp, Homo sapiens
cgacaccactcctgccagcc

SEQ ID NO: 5878313 - DNA, 13 bp, Homo sapiens
cgacaccactggg

SEQ ID NO: 5878314 - DNA, 14 bp, Homo sapiens
cgacaccagccctg

SEQ ID NO: 5878315 - DNA, 16 bp, Homo sapiens
cgacacggtcggggca

SEQ ID NO: 5878316 - DNA, 16 bp, Homo sapiens
cgacactcagggcagc

SEQ ID NO: 5878317 - DNA, 22 bp, Homo sapiens
cgacactcagggcagctgcctg

SEQ ID NO: 5878318 - DNA, 13 bp, Homo sapiens
cgacactgctgca

SEQ ID NO: 5878319 - DNA, 16 bp, Homo sapiens
cgacactgctgcacca

SEQ ID NO: 5878320 - DNA, 20 bp, Homo sapiens
cgacactgctgcaccagagt

SEQ ID NO: 5878321 - DNA, 17 bp, Homo sapiens
cgacactgggaggccag

SEQ ID NO: 5878322 - DNA, 16 bp, Homo sapiens
cgacagagcgagactt

SEQ ID NO: 5878323 - DNA, 22 bp, Homo sapiens
cgacagagggaagaaaagagct

SEQ ID NO: 5878324 - DNA, 16 bp, Homo sapiens
cgacagcacacacagt

SEQ ID NO: 5878325 - DNA, 17 bp, Homo sapiens
cgacagcccagcctagc

SEQ ID NO: 5878326 - DNA, 14 bp, Homo sapiens
cgacagcctggcac

SEQ ID NO: 5878327 - DNA, 14 bp, Homo sapiens
cgacagcgcccctg

SEQ ID NO: 5878328 - DNA, 18 bp, Homo sapiens
cgacagcgcccctgctgt

SEQ ID NO: 5878329 - DNA, 22 bp, Homo sapiens
cgacaggaatagatgtggtcct

SEQ ID NO: 5878330 - DNA, 16 bp, Homo sapiens
cgacaggagtattttt

SEQ ID NO: 5878331 - DNA, 19 bp, Homo sapiens
cgacaggtgggcctgggag

SEQ ID NO: 5878332 - DNA, 12 bp, Homo sapiens
cgacagtggctc

SEQ ID NO: 5878333 - DNA, 18 bp, Homo sapiens
cgacatacatgctacttt

SEQ ID NO: 5878334 - DNA, 19 bp, Homo sapiens
cgacatcccagaccagcca

SEQ ID NO: 5878335 - DNA, 21 bp, Homo sapiens
cgacatccctcccccagcaga

SEQ ID NO: 5878336 - DNA, 20 bp, Homo sapiens
cgacatccgtcattgctgct

SEQ ID NO: 5878337 - DNA, 18 bp, Homo sapiens
cgacatcctagccccacc

SEQ ID NO: 5878338 - DNA, 19 bp, Homo sapiens
cgacatcttctcaacctta

SEQ ID NO: 5878339 - DNA, 14 bp, Homo sapiens
cgacatgctgccag

SEQ ID NO: 5878340 - DNA, 16 bp, Homo sapiens
cgaccaatccccagcc

SEQ ID NO: 5878341 - DNA, 12 bp, Homo sapiens
cgaccacaccag

SEQ ID NO: 5878342 - DNA, 14 bp, Homo sapiens
cgaccaccaaagtc

SEQ ID NO: 5878343 - DNA, 14 bp, Homo sapiens
cgaccaccaacaca

SEQ ID NO: 5878344 - DNA, 11 bp, Homo sapiens
cgaccaccccc

SEQ ID NO: 5878345 - DNA, 16 bp, Homo sapiens
cgaccacccctgcctc

SEQ ID NO: 5878346 - DNA, 14 bp, Homo sapiens
cgaccacccctgtg

SEQ ID NO: 5878347 - DNA, 15 bp, Homo sapiens
cgaccaggctggaca

SEQ ID NO: 5878348 - DNA, 21 bp, Homo sapiens
cgaccaggctggacaccctct

SEQ ID NO: 5878349 - DNA, 16 bp, Homo sapiens
cgaccagggccgagga

SEQ ID NO: 5878350 - DNA, 16 bp, Homo sapiens
cgaccatgtggccaca

SEQ ID NO: 5878351 - DNA, 18 bp, Homo sapiens
cgaccatgtgtagattgc

SEQ ID NO: 5878352 - DNA, 17 bp, Homo sapiens
cgacccaccccgcgcaa

SEQ ID NO: 5878353 - DNA, 16 bp, Homo sapiens
cgacccactctgcttc

SEQ ID NO: 5878354 - DNA, 12 bp, Homo sapiens
cgacccagccag

SEQ ID NO: 5878355 - DNA, 23 bp, Homo sapiens
cgacccagccagctgcagggcac

SEQ ID NO: 5878356 - DNA, 13 bp, Homo sapiens
cgacccagctcta

SEQ ID NO: 5878357 - DNA, 20 bp, Homo sapiens
cgaccccaaaggaacactga

SEQ ID NO: 5878358 - DNA, 16 bp, Homo sapiens
cgacccccaagggacc

SEQ ID NO: 5878359 - DNA, 19 bp, Homo sapiens
cgaccccccgtgggctccc

SEQ ID NO: 5878360 - DNA, 15 bp, Homo sapiens
cgacccccctacccc

SEQ ID NO: 5878361 - DNA, 18 bp, Homo sapiens
cgaccccctttctaagga

SEQ ID NO: 5878362 - DNA, 13 bp, Homo sapiens
cgacccctcagtg

SEQ ID NO: 5878363 - DNA, 16 bp, Homo sapiens
cgacccctcagtgctc

SEQ ID NO: 5878364 - DNA, 12 bp, Homo sapiens
cgaccctcctgg

SEQ ID NO: 5878365 - DNA, 15 bp, Homo sapiens
cgaccctcctggcct

SEQ ID NO: 5878366 - DNA, 16 bp, Homo sapiens
cgaccctctgggaacc

SEQ ID NO: 5878367 - DNA, 18 bp, Homo sapiens
cgaccctctgggaacctc

SEQ ID NO: 5878368 - DNA, 13 bp, Homo sapiens
cgaccctgccctg

SEQ ID NO: 5878369 - DNA, 14 bp, Homo sapiens
cgaccctgccctgg

SEQ ID NO: 5878370 - DNA, 12 bp, Homo sapiens
cgaccctggctc

SEQ ID NO: 5878371 - DNA, 11 bp, Homo sapiens
cgaccctgggg

SEQ ID NO: 5878372 - DNA, 20 bp, Homo sapiens
cgacccttgccgtctacctg

SEQ ID NO: 5878373 - DNA, 15 bp, Homo sapiens
cgaccctttctctga

SEQ ID NO: 5878374 - DNA, 21 bp, Homo sapiens
cgaccgaggccctcccaaaga

SEQ ID NO: 5878375 - DNA, 13 bp, Homo sapiens
cgaccgccccagt

SEQ ID NO: 5878376 - DNA, 13 bp, Homo sapiens
cgaccgccccctc

SEQ ID NO: 5878377 - DNA, 14 bp, Homo sapiens
cgaccgcctgcttc

SEQ ID NO: 5878378 - DNA, 20 bp, Homo sapiens
cgaccgcctgcttcacaccc

SEQ ID NO: 5878379 - DNA, 16 bp, Homo sapiens
cgacctccccacccgc

SEQ ID NO: 5878380 - DNA, 20 bp, Homo sapiens
cgacctctccatcttcagct

SEQ ID NO: 5878381 - DNA, 19 bp, Homo sapiens
cgacctctctcagccccat

SEQ ID NO: 5878382 - DNA, 15 bp, Homo sapiens
cgacctctctgcctc

SEQ ID NO: 5878383 - DNA, 19 bp, Homo sapiens
cgacctggccgcggagcct

SEQ ID NO: 5878384 - DNA, 12 bp, Homo sapiens
cgacctttacct

SEQ ID NO: 5878385 - DNA, 16 bp, Homo sapiens
cgacgatccccatgga

SEQ ID NO: 5878386 - DNA, 14 bp, Homo sapiens
cgacgcccctccgg

SEQ ID NO: 5878387 - DNA, 15 bp, Homo sapiens
cgacgcgtctcctgt

SEQ ID NO: 5878388 - DNA, 21 bp, Homo sapiens
cgacggagccactggggtggg

SEQ ID NO: 5878389 - DNA, 23 bp, Homo sapiens
cgacggagccactggggtgggag

SEQ ID NO: 5878390 - DNA, 21 bp, Homo sapiens
cgacggaggcaggaccaggca

SEQ ID NO: 5878391 - DNA, 12 bp, Homo sapiens
cgacggcctcca

SEQ ID NO: 5878392 - DNA, 13 bp, Homo sapiens
cgacggcctccag

SEQ ID NO: 5878393 - DNA, 22 bp, Homo sapiens
cgacggtgggcatttgtgaggc

SEQ ID NO: 5878394 - DNA, 16 bp, Homo sapiens
cgacgtccccaaacct

SEQ ID NO: 5878395 - DNA, 20 bp, Homo sapiens
cgactaaaacaagtgtataa

SEQ ID NO: 5878396 - DNA, 14 bp, Homo sapiens
cgactaatttcaaa

SEQ ID NO: 5878397 - DNA, 18 bp, Homo sapiens
cgactacaaaataaaact

SEQ ID NO: 5878398 - DNA, 20 bp, Homo sapiens
cgactagacacacaaagcag

SEQ ID NO: 5878399 - DNA, 13 bp, Homo sapiens
cgactagccagga

SEQ ID NO: 5878400 - DNA, 19 bp, Homo sapiens
cgactcacaccactagcct

SEQ ID NO: 5878401 - DNA, 13 bp, Homo sapiens
cgactcacctgcg

SEQ ID NO: 5878402 - DNA, 13 bp, Homo sapiens
cgactcagcctca

SEQ ID NO: 5878403 - DNA, 21 bp, Homo sapiens
cgactccagccagcgcctccc

SEQ ID NO: 5878404 - DNA, 14 bp, Homo sapiens
cgactcccagctcc

SEQ ID NO: 5878405 - DNA, 21 bp, Homo sapiens
cgactcccccaaccaaggaag

SEQ ID NO: 5878406 - DNA, 11 bp, Homo sapiens
cgactcccggt

SEQ ID NO: 5878407 - DNA, 19 bp, Homo sapiens
cgactccctccccagatct

SEQ ID NO: 5878408 - DNA, 16 bp, Homo sapiens
cgactccgttggccac

SEQ ID NO: 5878409 - DNA, 19 bp, Homo sapiens
cgactccgttggccactcc

SEQ ID NO: 5878410 - DNA, 14 bp, Homo sapiens
cgactctaagctgt

SEQ ID NO: 5878411 - DNA, 15 bp, Homo sapiens
cgactctaagctgtg

SEQ ID NO: 5878412 - DNA, 15 bp, Homo sapiens
cgactctcctgcctc

SEQ ID NO: 5878413 - DNA, 19 bp, Homo sapiens
cgactctcgtgatatgctg

SEQ ID NO: 5878414 - DNA, 10 bp, Homo sapiens
cgactctgct

SEQ ID NO: 5878415 - DNA, 13 bp, Homo sapiens
cgactctgctgct

SEQ ID NO: 5878416 - DNA, 20 bp, Homo sapiens
cgactctgctgctcatggga

SEQ ID NO: 5878417 - DNA, 18 bp, Homo sapiens
cgactctggccctggccc

SEQ ID NO: 5878418 - DNA, 20 bp, Homo sapiens
cgactctgtgctggccagcg

SEQ ID NO: 5878419 - DNA, 12 bp, Homo sapiens
cgactgaagaag

SEQ ID NO: 5878420 - DNA, 15 bp, Homo sapiens
cgactgaccctgagg

SEQ ID NO: 5878421 - DNA, 22 bp, Homo sapiens
cgactgaccctgaggaggccgc

SEQ ID NO: 5878422 - DNA, 19 bp, Homo sapiens
cgactgactggaggaggcc

SEQ ID NO: 5878423 - DNA, 17 bp, Homo sapiens
cgactgagggcaggagg

SEQ ID NO: 5878424 - DNA, 20 bp, Homo sapiens
cgactgcacagcggcccctg

SEQ ID NO: 5878425 - DNA, 13 bp, Homo sapiens
cgactgcccagaa

SEQ ID NO: 5878426 - DNA, 13 bp, Homo sapiens
cgactgcccctgc

SEQ ID NO: 5878427 - DNA, 17 bp, Homo sapiens
cgactgcccctgctgtg

SEQ ID NO: 5878428 - DNA, 11 bp, Homo sapiens
cgactgcctgt

SEQ ID NO: 5878429 - DNA, 14 bp, Homo sapiens
cgactgcctgtctc

SEQ ID NO: 5878430 - DNA, 21 bp, Homo sapiens
cgactgcgggagccagactgt

SEQ ID NO: 5878431 - DNA, 13 bp, Homo sapiens
cgactggactgtc

SEQ ID NO: 5878432 - DNA, 20 bp, Homo sapiens
cgactggccagggccacgct

SEQ ID NO: 5878433 - DNA, 15 bp, Homo sapiens
cgactggctgtgaga

SEQ ID NO: 5878434 - DNA, 17 bp, Homo sapiens
cgactggtccagctctg

SEQ ID NO: 5878435 - DNA, 18 bp, Homo sapiens
cgactggtccagctctga

SEQ ID NO: 5878436 - DNA, 22 bp, Homo sapiens
cgactgtcagtggggcagcctc

SEQ ID NO: 5878437 - DNA, 19 bp, Homo sapiens
cgactgtcatgtggcttgg

SEQ ID NO: 5878438 - DNA, 11 bp, Homo sapiens
cgactgtctcc

SEQ ID NO: 5878439 - DNA, 21 bp, Homo sapiens
cgactgttgtacaagctcagg

SEQ ID NO: 5878440 - DNA, 16 bp, Homo sapiens
cgacttatttcttaaa

SEQ ID NO: 5878441 - DNA, 12 bp, Homo sapiens
cgacttcaggtc

SEQ ID NO: 5878442 - DNA, 18 bp, Homo sapiens
cgacttcccctgggcaag

SEQ ID NO: 5878443 - DNA, 15 bp, Homo sapiens
cgacttcttggtttt

SEQ ID NO: 5878444 - DNA, 18 bp, Homo sapiens
cgacttcttggttttctc

SEQ ID NO: 5878445 - DNA, 20 bp, Homo sapiens
cgacttgaattttcccactg

SEQ ID NO: 5878446 - DNA, 21 bp, Homo sapiens
cgacttgaattttcccactgc

SEQ ID NO: 5878447 - DNA, 22 bp, Homo sapiens
cgacttgaattttcccactgca

SEQ ID NO: 5878448 - DNA, 15 bp, Homo sapiens
cgacttgaccctttc

SEQ ID NO: 5878449 - DNA, 16 bp, Homo sapiens
cgacttggagactcct

SEQ ID NO: 5878450 - DNA, 16 bp, Homo sapiens
cgagcttgcctcaggg

SEQ ID NO: 5878451 - DNA, 15 bp, Homo sapiens
cgagcttggccttgg

SEQ ID NO: 5878452 - DNA, 19 bp, Homo sapiens
cgagcttggccttgggccg

SEQ ID NO: 5878453 - DNA, 20 bp, Homo sapiens
cgagcttggccttgggccgg

SEQ ID NO: 5878454 - DNA, 16 bp, Homo sapiens
cgaggaaaaacaacaa

SEQ ID NO: 5878455 - DNA, 21 bp, Homo sapiens
cgaggaaaaacaacaaataat

SEQ ID NO: 5878456 - DNA, 15 bp, Homo sapiens
cgaggaaaggatttt

SEQ ID NO: 5878457 - DNA, 23 bp, Homo sapiens
cgaggaaaggattttaccaaagc

SEQ ID NO: 5878458 - DNA, 15 bp, Homo sapiens
cgaggaaccagagcc

SEQ ID NO: 5878459 - DNA, 16 bp, Homo sapiens
cgaggaaccagagcca

SEQ ID NO: 5878460 - DNA, 19 bp, Homo sapiens
cgaggaaccagagccatgg

SEQ ID NO: 5878461 - DNA, 23 bp, Homo sapiens
cgaggaagatgctcatctgagcc

SEQ ID NO: 5878462 - DNA, 19 bp, Homo sapiens
cgaggaagcagcaattaat

SEQ ID NO: 5878463 - DNA, 11 bp, Homo sapiens
cgaggaagccc

SEQ ID NO: 5878464 - DNA, 16 bp, Homo sapiens
cgaggaagggccagag

SEQ ID NO: 5878465 - DNA, 22 bp, Homo sapiens
cgaggaatctgtgggtctggga

SEQ ID NO: 5878466 - DNA, 15 bp, Homo sapiens
cgaggacagcctgcc

SEQ ID NO: 5878467 - DNA, 21 bp, Homo sapiens
cgaggacatgcatgacacttc

SEQ ID NO: 5878468 - DNA, 22 bp, Homo sapiens
cgaggacatttgtgggcaagca

SEQ ID NO: 5878469 - DNA, 16 bp, Homo sapiens
cgaggaccaccagcag

SEQ ID NO: 5878470 - DNA, 12 bp, Homo sapiens
cgaggacccaga

SEQ ID NO: 5878471 - DNA, 14 bp, Homo sapiens
cgaggacccatgaa

SEQ ID NO: 5878472 - DNA, 21 bp, Homo sapiens
cgaggacccatgaaacagcag

SEQ ID NO: 5878473 - DNA, 22 bp, Homo sapiens
cgaggaccctggttactctggt

SEQ ID NO: 5878474 - DNA, 16 bp, Homo sapiens
cgaggactccaggggc

SEQ ID NO: 5878475 - DNA, 18 bp, Homo sapiens
cgaggactccaggggctg

SEQ ID NO: 5878476 - DNA, 14 bp, Homo sapiens
cgaggactggactg

SEQ ID NO: 5878477 - DNA, 15 bp, Homo sapiens
cgaggagcagcagcg

SEQ ID NO: 5878478 - DNA, 16 bp, Homo sapiens
cgaggagcagcagcgc

SEQ ID NO: 5878479 - DNA, 13 bp, Homo sapiens
cgaggagccccag

SEQ ID NO: 5878480 - DNA, 20 bp, Homo sapiens
cgaggagcttccagtgcatg

SEQ ID NO: 5878481 - DNA, 21 bp, Homo sapiens
cgaggagcttccagtgcatgt

SEQ ID NO: 5878482 - DNA, 21 bp, Homo sapiens
cgaggaggccgactgggctgc

SEQ ID NO: 5878483 - DNA, 23 bp, Homo sapiens
cgaggaggccgactgggctgctg

SEQ ID NO: 5878484 - DNA, 15 bp, Homo sapiens
cgaggaggcgcggcc

SEQ ID NO: 5878485 - DNA, 17 bp, Homo sapiens
cgaggaggtaatgaatt

SEQ ID NO: 5878486 - DNA, 23 bp, Homo sapiens
cgaggaggtgcctggagtgccca

SEQ ID NO: 5878487 - DNA, 21 bp, Homo sapiens
cgaggaggtgtctcaggctgc

SEQ ID NO: 5878488 - DNA, 12 bp, Homo sapiens
cgaggagtaaca

SEQ ID NO: 5878489 - DNA, 21 bp, Homo sapiens
cgaggagtaacaatacaaatg

SEQ ID NO: 5878490 - DNA, 23 bp, Homo sapiens
cgaggagtccagtttgtgcaaga

SEQ ID NO: 5878491 - DNA, 17 bp, Homo sapiens
cgaggattctgtgcctc

SEQ ID NO: 5878492 - DNA, 15 bp, Homo sapiens
cgaggcaccggcgct

SEQ ID NO: 5878493 - DNA, 16 bp, Homo sapiens
cgaggcaccggcgctg

SEQ ID NO: 5878494 - DNA, 18 bp, Homo sapiens
cgaggcagaaagatacag

SEQ ID NO: 5878495 - DNA, 22 bp, Homo sapiens
cgaggcagcaacaggaccagga

SEQ ID NO: 5878496 - DNA, 20 bp, Homo sapiens
cgaggcaggaggagcccgga

SEQ ID NO: 5878497 - DNA, 13 bp, Homo sapiens
cgaggcaggcaga

SEQ ID NO: 5878498 - DNA, 22 bp, Homo sapiens
cgaggcagggtcaggagagggg

SEQ ID NO: 5878499 - DNA, 17 bp, Homo sapiens
cgaggccacattgctgg

SEQ ID NO: 5878500 - DNA, 19 bp, Homo sapiens
cgaggccacattgctggct

SEQ ID NO: 5878501 - DNA, 21 bp, Homo sapiens
cgaggccacattgctggctgc

SEQ ID NO: 5878502 - DNA, 22 bp, Homo sapiens
cgaggccacattgctggctgcc

SEQ ID NO: 5878503 - DNA, 15 bp, Homo sapiens
cgaggccactcagag

SEQ ID NO: 5878504 - DNA, 18 bp, Homo sapiens
cgaggccactcagaggcc

SEQ ID NO: 5878505 - DNA, 19 bp, Homo sapiens
cgaggcccagatccaaggc

SEQ ID NO: 5878506 - DNA, 20 bp, Homo sapiens
cgaggcccagatccaaggcc

SEQ ID NO: 5878507 - DNA, 12 bp, Homo sapiens
cgaggcccagcg

SEQ ID NO: 5878508 - DNA, 15 bp, Homo sapiens
cgaggcccccctctg

SEQ ID NO: 5878509 - DNA, 13 bp, Homo sapiens
cgaggcccgcatg

SEQ ID NO: 5878510 - DNA, 17 bp, Homo sapiens
cgaggccctcccaaaga

SEQ ID NO: 5878511 - DNA, 14 bp, Homo sapiens
cgaggcctacagag

SEQ ID NO: 5878512 - DNA, 15 bp, Homo sapiens
cgaggcctacagagg

SEQ ID NO: 5878513 - DNA, 17 bp, Homo sapiens
cgaggcctaccccgcag

SEQ ID NO: 5878514 - DNA, 18 bp, Homo sapiens
cgaggcctacctgctccc

SEQ ID NO: 5878515 - DNA, 15 bp, Homo sapiens
cgaggcctagagtgg

SEQ ID NO: 5878516 - DNA, 17 bp, Homo sapiens
cgaggcctagagtggca

SEQ ID NO: 5878517 - DNA, 22 bp, Homo sapiens
cgaggcctattgttgaataaat

SEQ ID NO: 5878518 - DNA, 11 bp, Homo sapiens
cgaggcctgaa

SEQ ID NO: 5878519 - DNA, 13 bp, Homo sapiens
cgaggcctgcaaa

SEQ ID NO: 5878520 - DNA, 15 bp, Homo sapiens
cgaggcctggctctg

SEQ ID NO: 5878521 - DNA, 16 bp, Homo sapiens
cgaggcctggctctgg

SEQ ID NO: 5878522 - DNA, 18 bp, Homo sapiens
cgaggcctggctctggag

SEQ ID NO: 5878523 - DNA, 15 bp, Homo sapiens
cgaggccttcagaaa

SEQ ID NO: 5878524 - DNA, 17 bp, Homo sapiens
cgaggcgaagctgagcg

SEQ ID NO: 5878525 - DNA, 18 bp, Homo sapiens
cgaggcgaggctgcctct

SEQ ID NO: 5878526 - DNA, 22 bp, Homo sapiens
cgaggcgaggctgcctctgggt

SEQ ID NO: 5878527 - DNA, 17 bp, Homo sapiens
cgaggcgatgccacgct

SEQ ID NO: 5878528 - DNA, 18 bp, Homo sapiens
cgaggcgggggagcctgg

SEQ ID NO: 5878529 - DNA, 19 bp, Homo sapiens
cgaggcgggggatcctgga

SEQ ID NO: 5878530 - DNA, 16 bp, Homo sapiens
cgaggctacagctcca

SEQ ID NO: 5878531 - DNA, 19 bp, Homo sapiens
cgaggctacagctccacac

SEQ ID NO: 5878532 - DNA, 15 bp, Homo sapiens
cgaggctagaggcat

SEQ ID NO: 5878533 - DNA, 13 bp, Homo sapiens
cgaggctccccgc

SEQ ID NO: 5878534 - DNA, 21 bp, Homo sapiens
cgaggctccccgcctccactc

SEQ ID NO: 5878535 - DNA, 18 bp, Homo sapiens
cgaggctcggagcaccct

SEQ ID NO: 5878536 - DNA, 15 bp, Homo sapiens
cgaggctcttccatc

SEQ ID NO: 5878537 - DNA, 23 bp, Homo sapiens
cgaggctgattcctctcatttcc

SEQ ID NO: 5878538 - DNA, 15 bp, Homo sapiens
cgaggctgcagtcag

SEQ ID NO: 5878539 - DNA, 14 bp, Homo sapiens
cgaggctgccccag

SEQ ID NO: 5878540 - DNA, 16 bp, Homo sapiens
cgaggctgccccaggc

SEQ ID NO: 5878541 - DNA, 18 bp, Homo sapiens
cgaggctgccccaggccg

SEQ ID NO: 5878542 - DNA, 15 bp, Homo sapiens
cgaggctgcccccat

SEQ ID NO: 5878543 - DNA, 12 bp, Homo sapiens
cgaggctgcctc

SEQ ID NO: 5878544 - DNA, 13 bp, Homo sapiens
cgaggctgcctct

SEQ ID NO: 5878545 - DNA, 19 bp, Homo sapiens
cgaggctgcctctgggtga

SEQ ID NO: 5878546 - DNA, 15 bp, Homo sapiens
cgaggctgcttccca

SEQ ID NO: 5878547 - DNA, 15 bp, Homo sapiens
cgaggctggagctgg

SEQ ID NO: 5878548 - DNA, 16 bp, Homo sapiens
cgaggctgggccaagc

SEQ ID NO: 5878549 - DNA, 18 bp, Homo sapiens
cgaggctgggccaagcca

SEQ ID NO: 5878550 - DNA, 18 bp, Homo sapiens
cgaggctggtgccaggcg

SEQ ID NO: 5878551 - DNA, 13 bp, Homo sapiens
cgaggctggtggt

SEQ ID NO: 5878552 - DNA, 13 bp, Homo sapiens
cgaggcttctcta

SEQ ID NO: 5878553 - DNA, 18 bp, Homo sapiens
cgagggaggaacacctga

SEQ ID NO: 5878554 - DNA, 19 bp, Homo sapiens
cgagggaggaacacctgat

SEQ ID NO: 5878555 - DNA, 13 bp, Homo sapiens
cgagggatgatgc

SEQ ID NO: 5878556 - DNA, 17 bp, Homo sapiens
cgagggatggtgcccct

SEQ ID NO: 5878557 - DNA, 17 bp, Homo sapiens
cgagggatgtggagcac

SEQ ID NO: 5878558 - DNA, 18 bp, Homo sapiens
cgagggcaacagggagca

SEQ ID NO: 5878559 - DNA, 12 bp, Homo sapiens
cgagggcaggga

SEQ ID NO: 5878560 - DNA, 21 bp, Homo sapiens
cgagggcagggaccacaccct

SEQ ID NO: 5878561 - DNA, 14 bp, Homo sapiens
cgagggccccacgt

SEQ ID NO: 5878562 - DNA, 15 bp, Homo sapiens
cgagggccccacgtc

SEQ ID NO: 5878563 - DNA, 12 bp, Homo sapiens
cgagggccgcct

SEQ ID NO: 5878564 - DNA, 15 bp, Homo sapiens
cgagggcctgacagg

SEQ ID NO: 5878565 - DNA, 21 bp, Homo sapiens
cgagggcgaaggccattgggt

SEQ ID NO: 5878566 - DNA, 17 bp, Homo sapiens
cgagggcggccagggac

SEQ ID NO: 5878567 - DNA, 22 bp, Homo sapiens
cgagggcggcccctctgttctg

SEQ ID NO: 5878568 - DNA, 15 bp, Homo sapiens
cgagggcgtcagaga

SEQ ID NO: 5878569 - DNA, 16 bp, Homo sapiens
cgagggcgtcagagag

SEQ ID NO: 5878570 - DNA, 11 bp, Homo sapiens
cgagggctcag

SEQ ID NO: 5878571 - DNA, 19 bp, Homo sapiens
cgagggctcagaagagcag

SEQ ID NO: 5878572 - DNA, 23 bp, Homo sapiens
cgagggctcagaagagcagcttc

SEQ ID NO: 5878573 - DNA, 12 bp, Homo sapiens
cgagggctgagg

SEQ ID NO: 5878574 - DNA, 15 bp, Homo sapiens
cgagggctgaggagc

SEQ ID NO: 5878575 - DNA, 17 bp, Homo sapiens
cgagggctgaggagcag

SEQ ID NO: 5878576 - DNA, 14 bp, Homo sapiens
cgagggctggccgg

SEQ ID NO: 5878577 - DNA, 17 bp, Homo sapiens
cgagggctggctggcct

SEQ ID NO: 5878578 - DNA, 12 bp, Homo sapiens
cgaggggcaggg

SEQ ID NO: 5878579 - DNA, 13 bp, Homo sapiens
cgaggggcaggga

SEQ ID NO: 5878580 - DNA, 17 bp, Homo sapiens
cgaggggcccagggaag

SEQ ID NO: 5878581 - DNA, 22 bp, Homo sapiens
cgaggggccggggaagctgcca

SEQ ID NO: 5878582 - DNA, 22 bp, Homo sapiens
cgaggggcctttgttctggggg

SEQ ID NO: 5878583 - DNA, 17 bp, Homo sapiens
cgaggggcgggacccag

SEQ ID NO: 5878584 - DNA, 18 bp, Homo sapiens
cgagggggctgctcccac

SEQ ID NO: 5878585 - DNA, 22 bp, Homo sapiens
cgagggggctgtcatgcggttt

SEQ ID NO: 5878586 - DNA, 18 bp, Homo sapiens
cgaggggttggtgggagg

SEQ ID NO: 5878587 - DNA, 19 bp, Homo sapiens
cgagggtcccaaggcgtgc

SEQ ID NO: 5878588 - DNA, 17 bp, Homo sapiens
cgagggtcgtgagccca

SEQ ID NO: 5878589 - DNA, 19 bp, Homo sapiens
cgagggtctcccctcctgc

SEQ ID NO: 5878590 - DNA, 20 bp, Homo sapiens
cgagggtctcccctcctgca

SEQ ID NO: 5878591 - DNA, 21 bp, Homo sapiens
cgagggtggtttacctgcacc

SEQ ID NO: 5878592 - DNA, 20 bp, Homo sapiens
cgagggttgattaaggcagt

SEQ ID NO: 5878593 - DNA, 20 bp, Homo sapiens
cgaggtagagtttgaaggag

SEQ ID NO: 5878594 - DNA, 15 bp, Homo sapiens
cgaggtatgtttata

SEQ ID NO: 5878595 - DNA, 14 bp, Homo sapiens
cgaggtcaaggaga

SEQ ID NO: 5878596 - DNA, 19 bp, Homo sapiens
cgaggtcctcctggcctga

SEQ ID NO: 5878597 - DNA, 21 bp, Homo sapiens
cgaggtgccttcttcagggcc

SEQ ID NO: 5878598 - DNA, 20 bp, Homo sapiens
cgaggtggagggtagccctg

SEQ ID NO: 5878599 - DNA, 20 bp, Homo sapiens
cgaggtggctgcctggagcc

SEQ ID NO: 5878600 - DNA, 18 bp, Homo sapiens
cgaggtggtagctctgag

SEQ ID NO: 5878601 - DNA, 21 bp, Homo sapiens
cgaggtggtagctctgagccc

SEQ ID NO: 5878602 - DNA, 23 bp, Homo sapiens
cgaggtgtcaccctgcagagcta

SEQ ID NO: 5878603 - DNA, 13 bp, Homo sapiens
cgaggttgcccct

SEQ ID NO: 5878604 - DNA, 14 bp, Homo sapiens
cgaggttgtgggga

SEQ ID NO: 5878605 - DNA, 23 bp, Homo sapiens
cgaggtttacttattttccactt

SEQ ID NO: 5878606 - DNA, 16 bp, Homo sapiens
cgagtaaacttgaaaa

SEQ ID NO: 5878607 - DNA, 17 bp, Homo sapiens
cgagtaaacttgaaaag

SEQ ID NO: 5878608 - DNA, 22 bp, Homo sapiens
cgagtacctccagtcacactcc

SEQ ID NO: 5878609 - DNA, 16 bp, Homo sapiens
cgagtagaaaatgtga

SEQ ID NO: 5878610 - DNA, 16 bp, Homo sapiens
cgagtagagaggcccg

SEQ ID NO: 5878611 - DNA, 14 bp, Homo sapiens
cgagtagctgggac

SEQ ID NO: 5878612 - DNA, 19 bp, Homo sapiens
cgagtagctgggattacag

SEQ ID NO: 5878613 - DNA, 14 bp, Homo sapiens
cgagtatctgtaac

SEQ ID NO: 5878614 - DNA, 21 bp, Homo sapiens
cgagtatgtgtttgtgtgtgt

SEQ ID NO: 5878615 - DNA, 20 bp, Homo sapiens
cgagtcaaaactcaaatgct

SEQ ID NO: 5878616 - DNA, 14 bp, Homo sapiens
cgagtcacattctg

SEQ ID NO: 5878617 - DNA, 15 bp, Homo sapiens
cgagtcacattctgc

SEQ ID NO: 5878618 - DNA, 17 bp, Homo sapiens
cgagtcacattctgctt

SEQ ID NO: 5878619 - DNA, 14 bp, Homo sapiens
cgagtcaccttcca

SEQ ID NO: 5878620 - DNA, 12 bp, Homo sapiens
cgagtcactgcc

SEQ ID NO: 5878621 - DNA, 17 bp, Homo sapiens
cgagtcatccagaatgt

SEQ ID NO: 5878622 - DNA, 14 bp, Homo sapiens
cgagtcattaaact

SEQ ID NO: 5878623 - DNA, 19 bp, Homo sapiens
cgagtcattcgttctgtgg

SEQ ID NO: 5878624 - DNA, 18 bp, Homo sapiens
cgagtcatttcgttccct

SEQ ID NO: 5878625 - DNA, 13 bp, Homo sapiens
cgagtccaaggcc

SEQ ID NO: 5878626 - DNA, 18 bp, Homo sapiens
cgagtccgcccatccctg

SEQ ID NO: 5878627 - DNA, 17 bp, Homo sapiens
cgagtcctcaggtacag

SEQ ID NO: 5878628 - DNA, 20 bp, Homo sapiens
cgcaaatacatgcctttcca

SEQ ID NO: 5878629 - DNA, 17 bp, Homo sapiens
cgcaacatgaattttta

SEQ ID NO: 5878630 - DNA, 15 bp, Homo sapiens
cgcaacccacagctc

SEQ ID NO: 5878631 - DNA, 14 bp, Homo sapiens
cgcaacccgtgcca

SEQ ID NO: 5878632 - DNA, 15 bp, Homo sapiens
cgcaacctgcaggct

SEQ ID NO: 5878633 - DNA, 12 bp, Homo sapiens
cgcaactctcca

SEQ ID NO: 5878634 - DNA, 21 bp, Homo sapiens
cgcaagaggcatagagggaga

SEQ ID NO: 5878635 - DNA, 13 bp, Homo sapiens
cgcaagcctcagc

SEQ ID NO: 5878636 - DNA, 14 bp, Homo sapiens
cgcaagcctcagcc

SEQ ID NO: 5878637 - DNA, 18 bp, Homo sapiens
cgcaagcctcagccactc

SEQ ID NO: 5878638 - DNA, 21 bp, Homo sapiens
cgcaagcctgtaatcccagct

SEQ ID NO: 5878639 - DNA, 17 bp, Homo sapiens
cgcaagcgacacaggct

SEQ ID NO: 5878640 - DNA, 12 bp, Homo sapiens
cgcaagctctca

SEQ ID NO: 5878641 - DNA, 13 bp, Homo sapiens
cgcaagctctcag

SEQ ID NO: 5878642 - DNA, 15 bp, Homo sapiens
cgcaagctctcagca

SEQ ID NO: 5878643 - DNA, 11 bp, Homo sapiens
cgcaagctgag

SEQ ID NO: 5878644 - DNA, 13 bp, Homo sapiens
cgcaaggaaggac

SEQ ID NO: 5878645 - DNA, 15 bp, Homo sapiens
cgcaaggccctgtcc

SEQ ID NO: 5878646 - DNA, 16 bp, Homo sapiens
cgcaaggccctgtccc

SEQ ID NO: 5878647 - DNA, 17 bp, Homo sapiens
cgcaaggccctgtccca

SEQ ID NO: 5878648 - DNA, 20 bp, Homo sapiens
cgcaaggccctgtcccagca

SEQ ID NO: 5878649 - DNA, 19 bp, Homo sapiens
cgcaaggcctgtgctgcat

SEQ ID NO: 5878650 - DNA, 22 bp, Homo sapiens
cgcaaggcctgtgctgcatgcg

SEQ ID NO: 5878651 - DNA, 19 bp, Homo sapiens
cgcaagggcatcaggcact

SEQ ID NO: 5878652 - DNA, 17 bp, Homo sapiens
cgcaagtcaagccgccc

SEQ ID NO: 5878653 - DNA, 15 bp, Homo sapiens
cgcaagtcacagaaa

SEQ ID NO: 5878654 - DNA, 15 bp, Homo sapiens
cgcaagtgcctggga

SEQ ID NO: 5878655 - DNA, 19 bp, Homo sapiens
cgcaagttcagggaagcag

SEQ ID NO: 5878656 - DNA, 22 bp, Homo sapiens
cgcaatgaaaagtcgttttcca

SEQ ID NO: 5878657 - DNA, 15 bp, Homo sapiens
cgcaatgtggagcag

SEQ ID NO: 5878658 - DNA, 19 bp, Homo sapiens
cgcaattgtatatatatgt

SEQ ID NO: 5878659 - DNA, 16 bp, Homo sapiens
cgcacaaacacacaca

SEQ ID NO: 5878660 - DNA, 19 bp, Homo sapiens
cgcacaaacacacacacta

SEQ ID NO: 5878661 - DNA, 16 bp, Homo sapiens
cgcacaaggctgacca

SEQ ID NO: 5878662 - DNA, 17 bp, Homo sapiens
cgcacaatctacactgc

SEQ ID NO: 5878663 - DNA, 18 bp, Homo sapiens
cgcacaatgcatgtgctg

SEQ ID NO: 5878664 - DNA, 11 bp, Homo sapiens
cgcacacacac

SEQ ID NO: 5878665 - DNA, 13 bp, Homo sapiens
cgcacacacacaa

SEQ ID NO: 5878666 - DNA, 14 bp, Homo sapiens
cgcacacacacaca

SEQ ID NO: 5878667 - DNA, 22 bp, Homo sapiens
cgcacacacacacacacacatc

SEQ ID NO: 5878668 - DNA, 16 bp, Homo sapiens
cgcacacacacacata

SEQ ID NO: 5878669 - DNA, 12 bp, Homo sapiens
cgcacacacact

SEQ ID NO: 5878670 - DNA, 13 bp, Homo sapiens
cgcacacacactc

SEQ ID NO: 5878671 - DNA, 17 bp, Homo sapiens
cgcacacacactcttca

SEQ ID NO: 5878672 - DNA, 17 bp, Homo sapiens
cgcacacagctgagcac

SEQ ID NO: 5878673 - DNA, 13 bp, Homo sapiens
cgcacacagggct

SEQ ID NO: 5878674 - DNA, 14 bp, Homo sapiens
cgcacacagggctc

SEQ ID NO: 5878675 - DNA, 23 bp, Homo sapiens
cgcacacatcttacctctcatgc

SEQ ID NO: 5878676 - DNA, 15 bp, Homo sapiens
cgcacaccaccacac

SEQ ID NO: 5878677 - DNA, 17 bp, Homo sapiens
cgcacaccgccagcagc

SEQ ID NO: 5878678 - DNA, 21 bp, Homo sapiens
cgcacacgcacgcacacacac

SEQ ID NO: 5878679 - DNA, 23 bp, Homo sapiens
cgcacactgtgattttgccctcc

SEQ ID NO: 5878680 - DNA, 13 bp, Homo sapiens
cgcacagacaggt

SEQ ID NO: 5878681 - DNA, 13 bp, Homo sapiens
cgcacagagctgg

SEQ ID NO: 5878682 - DNA, 17 bp, Homo sapiens
cgcacagagctggggct

SEQ ID NO: 5878683 - DNA, 21 bp, Homo sapiens
cgcacagattacttcagggct

SEQ ID NO: 5878684 - DNA, 19 bp, Homo sapiens
cgcacagcactgcctgcca

SEQ ID NO: 5878685 - DNA, 21 bp, Homo sapiens
cgcacagcactgcctgccaag

SEQ ID NO: 5878686 - DNA, 16 bp, Homo sapiens
cgcacagggcatgcct

SEQ ID NO: 5878687 - DNA, 21 bp, Homo sapiens
cgcacagggcatgcctggcct

SEQ ID NO: 5878688 - DNA, 22 bp, Homo sapiens
cgcacagggcatgcctggcctg

SEQ ID NO: 5878689 - DNA, 17 bp, Homo sapiens
cgcacagtggacggagg

SEQ ID NO: 5878690 - DNA, 16 bp, Homo sapiens
cgcacatatacacaca

SEQ ID NO: 5878691 - DNA, 23 bp, Homo sapiens
cgcacatgccgcgggcggccagg

SEQ ID NO: 5878692 - DNA, 21 bp, Homo sapiens
cgcacatgtgccactgttcag

SEQ ID NO: 5878693 - DNA, 19 bp, Homo sapiens
cgcaccaatcagcactctg

SEQ ID NO: 5878694 - DNA, 15 bp, Homo sapiens
cgcaccactgcttcc

SEQ ID NO: 5878695 - DNA, 22 bp, Homo sapiens
cgcaccactgcttcccactggg

SEQ ID NO: 5878696 - DNA, 20 bp, Homo sapiens
cgcaccagcccgaacaccat

SEQ ID NO: 5878697 - DNA, 16 bp, Homo sapiens
cgcaccagctgctctg

SEQ ID NO: 5878698 - DNA, 16 bp, Homo sapiens
cgcaccaggccgggct

SEQ ID NO: 5878699 - DNA, 12 bp, Homo sapiens
cgcacccacacc

SEQ ID NO: 5878700 - DNA, 15 bp, Homo sapiens
cgcaccccacagctg

SEQ ID NO: 5878701 - DNA, 15 bp, Homo sapiens
cgcacccccaccctt

SEQ ID NO: 5878702 - DNA, 13 bp, Homo sapiens
cgcacccccactt

SEQ ID NO: 5878703 - DNA, 21 bp, Homo sapiens
cgcacccccctgttctaaggg

SEQ ID NO: 5878704 - DNA, 14 bp, Homo sapiens
cgcacccccgccag

SEQ ID NO: 5878705 - DNA, 19 bp, Homo sapiens
cgcaccccgcccctgcatg

SEQ ID NO: 5878706 - DNA, 17 bp, Homo sapiens
cgcaccccggcctcagg

SEQ ID NO: 5878707 - DNA, 20 bp, Homo sapiens
cgcaccccggcctcagggcg

SEQ ID NO: 5878708 - DNA, 21 bp, Homo sapiens
cgcaccccggcctcagggcgc

SEQ ID NO: 5878709 - DNA, 14 bp, Homo sapiens
cgcacccctcctcc

SEQ ID NO: 5878710 - DNA, 15 bp, Homo sapiens
cgcacccctcctcct

SEQ ID NO: 5878711 - DNA, 20 bp, Homo sapiens
cgcacccctcctccttgctg

SEQ ID NO: 5878712 - DNA, 18 bp, Homo sapiens
cgcaccctccctagctct

SEQ ID NO: 5878713 - DNA, 16 bp, Homo sapiens
cgcaccgccatgcatg

SEQ ID NO: 5878714 - DNA, 17 bp, Homo sapiens
cgcaccgccatgcatga

SEQ ID NO: 5878715 - DNA, 14 bp, Homo sapiens
cgcaccgcccaacc

SEQ ID NO: 5878716 - DNA, 14 bp, Homo sapiens
cgcaccgccgccac

SEQ ID NO: 5878717 - DNA, 16 bp, Homo sapiens
cgcaccgccgccacca

SEQ ID NO: 5878718 - DNA, 22 bp, Homo sapiens
cgcaccgcctgaaggcacagct

SEQ ID NO: 5878719 - DNA, 16 bp, Homo sapiens
cgcaccgtgctgggct

SEQ ID NO: 5878720 - DNA, 20 bp, Homo sapiens
cgcacctaaagcagccagcc

SEQ ID NO: 5878721 - DNA, 16 bp, Homo sapiens
cgcacctaccatcagg

SEQ ID NO: 5878722 - DNA, 11 bp, Homo sapiens
cgcacctcctt

SEQ ID NO: 5878723 - DNA, 17 bp, Homo sapiens
cgcacctgccccctggt

SEQ ID NO: 5878724 - DNA, 16 bp, Homo sapiens
cgcacctgcctcagga

SEQ ID NO: 5878725 - DNA, 15 bp, Homo sapiens
cgcacctgcttcccc

SEQ ID NO: 5878726 - DNA, 16 bp, Homo sapiens
cgcacctgcttccccc

SEQ ID NO: 5878727 - DNA, 13 bp, Homo sapiens
cgcacctgtacag

SEQ ID NO: 5878728 - DNA, 13 bp, Homo sapiens
cgcaccttgctgt

SEQ ID NO: 5878729 - DNA, 15 bp, Homo sapiens
cgcaccttgctgtgt

SEQ ID NO: 5878730 - DNA, 17 bp, Homo sapiens
cgcaccttgctgtgtga

SEQ ID NO: 5878731 - DNA, 16 bp, Homo sapiens
cgcaccttttatacca

SEQ ID NO: 5878732 - DNA, 17 bp, Homo sapiens
cgcacgacgtcagcctc

SEQ ID NO: 5878733 - DNA, 23 bp, Homo sapiens
cgcacgactgcgggagccagact

SEQ ID NO: 5878734 - DNA, 17 bp, Homo sapiens
cgcacgcaagcctcagc

SEQ ID NO: 5878735 - DNA, 19 bp, Homo sapiens
cgcacgcaagcctcagcca

SEQ ID NO: 5878736 - DNA, 23 bp, Homo sapiens
cgcacgcacacacacatacagag

SEQ ID NO: 5878737 - DNA, 14 bp, Homo sapiens
cgcacgcacccaca

SEQ ID NO: 5878738 - DNA, 17 bp, Homo sapiens
cgcactagcctccctct

SEQ ID NO: 5878739 - DNA, 21 bp, Homo sapiens
cgcactcaggagcacagccat

SEQ ID NO: 5878740 - DNA, 18 bp, Homo sapiens
cgcactctccccgctcag

SEQ ID NO: 5878741 - DNA, 14 bp, Homo sapiens
cgcactggacagca

SEQ ID NO: 5878742 - DNA, 17 bp, Homo sapiens
cgcactgtgacccccag

SEQ ID NO: 5878743 - DNA, 15 bp, Homo sapiens
cgcacttacctgctt

SEQ ID NO: 5878744 - DNA, 20 bp, Homo sapiens
cgcacttctggggccagccc

SEQ ID NO: 5878745 - DNA, 23 bp, Homo sapiens
cgcacttgcagaggagcccagtg

SEQ ID NO: 5878746 - DNA, 23 bp, Homo sapiens
cgcacttgcctgttggctgctgc

SEQ ID NO: 5878747 - DNA, 15 bp, Homo sapiens
cgcactttccacttc

SEQ ID NO: 5878748 - DNA, 20 bp, Homo sapiens
cgcactttccacttcttcct

SEQ ID NO: 5878749 - DNA, 19 bp, Homo sapiens
cgcagaacgaaccttggcc

SEQ ID NO: 5878750 - DNA, 13 bp, Homo sapiens
cgcagaagcagac

SEQ ID NO: 5878751 - DNA, 22 bp, Homo sapiens
cgcagaaggggaatgtgtcctc

SEQ ID NO: 5878752 - DNA, 10 bp, Homo sapiens
cgcagacaca

SEQ ID NO: 5878753 - DNA, 15 bp, Homo sapiens
cgcagacacacacac

SEQ ID NO: 5878754 - DNA, 13 bp, Homo sapiens
cgcagacaggacc

SEQ ID NO: 5878755 - DNA, 17 bp, Homo sapiens
cgcagacctaagccctg

SEQ ID NO: 5878756 - DNA, 13 bp, Homo sapiens
cgcagacctctgg

SEQ ID NO: 5878757 - DNA, 21 bp, Homo sapiens
cgcagacgggcacagacacgc

SEQ ID NO: 5878758 - DNA, 23 bp, Homo sapiens
cgcagacggtctgtgtgctgttt

SEQ ID NO: 5878759 - DNA, 18 bp, Homo sapiens
cgcagactgcttggccag

SEQ ID NO: 5878760 - DNA, 24 bp, Homo sapiens
cgcagactggcggagaaggagagg

SEQ ID NO: 5878761 - DNA, 10 bp, Homo sapiens
cgcagagaaa

SEQ ID NO: 5878762 - DNA, 11 bp, Homo sapiens
cgcagagaaat

SEQ ID NO: 5878763 - DNA, 17 bp, Homo sapiens
cgcagagaaatgcccca

SEQ ID NO: 5878764 - DNA, 18 bp, Homo sapiens
cgcagagaaatgccccag

SEQ ID NO: 5878765 - DNA, 12 bp, Homo sapiens
cgcagagactgt

SEQ ID NO: 5878766 - DNA, 20 bp, Homo sapiens
cgcagagccccggagcacca

SEQ ID NO: 5878767 - DNA, 15 bp, Homo sapiens
cgcagagccctccag

SEQ ID NO: 5878768 - DNA, 17 bp, Homo sapiens
cgcagagccctccaggc

SEQ ID NO: 5878769 - DNA, 19 bp, Homo sapiens
cgcagagcgcgcccctagc

SEQ ID NO: 5878770 - DNA, 21 bp, Homo sapiens
cgcagagcgcgcccctagccg

SEQ ID NO: 5878771 - DNA, 12 bp, Homo sapiens
cgcagagcgggc

SEQ ID NO: 5878772 - DNA, 13 bp, Homo sapiens
cgcagagctccct

SEQ ID NO: 5878773 - DNA, 13 bp, Homo sapiens
cgcagaggcagaa

SEQ ID NO: 5878774 - DNA, 19 bp, Homo sapiens
cgcagaggcggaaaccttg

SEQ ID NO: 5878775 - DNA, 20 bp, Homo sapiens
cgcagaggcggaaaccttgc

SEQ ID NO: 5878776 - DNA, 23 bp, Homo sapiens
cgcagaggcggaaaccttgcagc

SEQ ID NO: 5878777 - DNA, 18 bp, Homo sapiens
cgcagaggcttttccagt

SEQ ID NO: 5878778 - DNA, 19 bp, Homo sapiens
cgcagatctgtgcctggga

SEQ ID NO: 5878779 - DNA, 13 bp, Homo sapiens
cgcagatgctgtc

SEQ ID NO: 5878780 - DNA, 20 bp, Homo sapiens
cgcagatgtgcagcagattg

SEQ ID NO: 5878781 - DNA, 19 bp, Homo sapiens
cgcagattgggctggctct

SEQ ID NO: 5878782 - DNA, 20 bp, Homo sapiens
cgcagattgggctggctctg

SEQ ID NO: 5878783 - DNA, 23 bp, Homo sapiens
cgcagatttttatgttttgaaag

SEQ ID NO: 5878784 - DNA, 12 bp, Homo sapiens
cgcagcaccagc

SEQ ID NO: 5878785 - DNA, 19 bp, Homo sapiens
cgcagcaccagcctgagcc

SEQ ID NO: 5878786 - DNA, 14 bp, Homo sapiens
cgcagcaccctgca

SEQ ID NO: 5878787 - DNA, 16 bp, Homo sapiens
cgcagcaccctgcaga

SEQ ID NO: 5878788 - DNA, 13 bp, Homo sapiens
cgcagcacgcctc

SEQ ID NO: 5878789 - DNA, 19 bp, Homo sapiens
cgcagcacgcctctcccca

SEQ ID NO: 5878790 - DNA, 22 bp, Homo sapiens
cgcagcacgcctctccccacct

SEQ ID NO: 5878791 - DNA, 17 bp, Homo sapiens
cgcagcaggaggccagg

SEQ ID NO: 5878792 - DNA, 18 bp, Homo sapiens
cgcagcaggaggccaggc

SEQ ID NO: 5878793 - DNA, 16 bp, Homo sapiens
cgcagcagggaagctc

SEQ ID NO: 5878794 - DNA, 20 bp, Homo sapiens
cgcagcaggtgcaagagaca

SEQ ID NO: 5878795 - DNA, 20 bp, Homo sapiens
cgcagcatattcaggaagct

SEQ ID NO: 5878796 - DNA, 21 bp, Homo sapiens
cgcagccacacagtggccggg

SEQ ID NO: 5878797 - DNA, 20 bp, Homo sapiens
cgcagccacaccgctggctc

SEQ ID NO: 5878798 - DNA, 12 bp, Homo sapiens
cgcagccaggac

SEQ ID NO: 5878799 - DNA, 19 bp, Homo sapiens
cgcagcccccactgacctg

SEQ ID NO: 5878800 - DNA, 21 bp, Homo sapiens
cgcagcccccactgacctgcc

SEQ ID NO: 5878801 - DNA, 15 bp, Homo sapiens
cgcagcccctggagc

SEQ ID NO: 5878802 - DNA, 15 bp, Homo sapiens
cgcagcccctgttgg

SEQ ID NO: 5878803 - DNA, 16 bp, Homo sapiens
cgcagcccctgttgga

SEQ ID NO: 5878804 - DNA, 16 bp, Homo sapiens
cgcagcccgcctgccg

SEQ ID NO: 5878805 - DNA, 19 bp, Homo sapiens
cgcagcccgcctgccgtgc

SEQ ID NO: 5878806 - DNA, 19 bp, Homo sapiens
cgcagcccgtgaagcagtg

SEQ ID NO: 5878807 - DNA, 19 bp, Homo sapiens
cgcatgtttaatgtgaact

SEQ ID NO: 5878808 - DNA, 13 bp, Homo sapiens
cgcattaagaggt

SEQ ID NO: 5878809 - DNA, 11 bp, Homo sapiens
cgcattaagca

SEQ ID NO: 5878810 - DNA, 16 bp, Homo sapiens
cgcattaagcacacac

SEQ ID NO: 5878811 - DNA, 20 bp, Homo sapiens
cgcattaagggcctgctgga

SEQ ID NO: 5878812 - DNA, 14 bp, Homo sapiens
cgcattccaggctc

SEQ ID NO: 5878813 - DNA, 12 bp, Homo sapiens
cgcattccctga

SEQ ID NO: 5878814 - DNA, 13 bp, Homo sapiens
cgcattctcatgg

SEQ ID NO: 5878815 - DNA, 17 bp, Homo sapiens
cgcattgctgtccttgg

SEQ ID NO: 5878816 - DNA, 12 bp, Homo sapiens
cgcattgtacac

SEQ ID NO: 5878817 - DNA, 15 bp, Homo sapiens
cgcattgttttgcat

SEQ ID NO: 5878818 - DNA, 12 bp, Homo sapiens
cgcatttcctaa

SEQ ID NO: 5878819 - DNA, 17 bp, Homo sapiens
cgcatttctcatgcttc

SEQ ID NO: 5878820 - DNA, 21 bp, Homo sapiens
cgcatttctcatgcttcttct

SEQ ID NO: 5878821 - DNA, 13 bp, Homo sapiens
cgcattttctcta

SEQ ID NO: 5878822 - DNA, 23 bp, Homo sapiens
cgccaaacttctgaactttggaa

SEQ ID NO: 5878823 - DNA, 16 bp, Homo sapiens
cgccaaagtgcagccc

SEQ ID NO: 5878824 - DNA, 20 bp, Homo sapiens
cgccaaagtgcagcccttcc

SEQ ID NO: 5878825 - DNA, 14 bp, Homo sapiens
cgccaaatgttcat

SEQ ID NO: 5878826 - DNA, 21 bp, Homo sapiens
cgccaacaacttctccatcct

SEQ ID NO: 5878827 - DNA, 20 bp, Homo sapiens
cgccaacgttcgatttctac

SEQ ID NO: 5878828 - DNA, 15 bp, Homo sapiens
cgccaacttctccca

SEQ ID NO: 5878829 - DNA, 19 bp, Homo sapiens
cgccaagcaacctgggtcc

SEQ ID NO: 5878830 - DNA, 17 bp, Homo sapiens
cgccaagccatcacagg

SEQ ID NO: 5878831 - DNA, 18 bp, Homo sapiens
cgccaaggagggaagagt

SEQ ID NO: 5878832 - DNA, 16 bp, Homo sapiens
cgccaaggctcacatg

SEQ ID NO: 5878833 - DNA, 12 bp, Homo sapiens
cgccaaggctgg

SEQ ID NO: 5878834 - DNA, 21 bp, Homo sapiens
cgccaaggtagccatcccatg

SEQ ID NO: 5878835 - DNA, 15 bp, Homo sapiens
cgccaagtctggcac

SEQ ID NO: 5878836 - DNA, 23 bp, Homo sapiens
cgccaataataaaaaacaagaaa

SEQ ID NO: 5878837 - DNA, 14 bp, Homo sapiens
cgccaatctggccc

SEQ ID NO: 5878838 - DNA, 15 bp, Homo sapiens
cgccaatctggccct

SEQ ID NO: 5878839 - DNA, 21 bp, Homo sapiens
cgccaatctggcccttacaca

SEQ ID NO: 5878840 - DNA, 18 bp, Homo sapiens
cgccaatgttatgccagc

SEQ ID NO: 5878841 - DNA, 21 bp, Homo sapiens
cgccaatgttatgccagctcc

SEQ ID NO: 5878842 - DNA, 16 bp, Homo sapiens
cgccaatttctctcag

SEQ ID NO: 5878843 - DNA, 12 bp, Homo sapiens
cgccacaggacc

SEQ ID NO: 5878844 - DNA, 13 bp, Homo sapiens
cgccacaggaccc

SEQ ID NO: 5878845 - DNA, 23 bp, Homo sapiens
cgccacatccccgctggctgggg

SEQ ID NO: 5878846 - DNA, 22 bp, Homo sapiens
cgccacatggcttcctcctgcg

SEQ ID NO: 5878847 - DNA, 17 bp, Homo sapiens
cgccacatggtgtggcc

SEQ ID NO: 5878848 - DNA, 18 bp, Homo sapiens
cgccaccacacctggctt

SEQ ID NO: 5878849 - DNA, 15 bp, Homo sapiens
cgccaccagcccgca

SEQ ID NO: 5878850 - DNA, 13 bp, Homo sapiens
cgccaccatgccc

SEQ ID NO: 5878851 - DNA, 12 bp, Homo sapiens
cgccacccccat

SEQ ID NO: 5878852 - DNA, 20 bp, Homo sapiens
cgccacccccatcttccacc

SEQ ID NO: 5878853 - DNA, 17 bp, Homo sapiens
cgccacccctccttcct

SEQ ID NO: 5878854 - DNA, 13 bp, Homo sapiens
cgccaccctgccc

SEQ ID NO: 5878855 - DNA, 15 bp, Homo sapiens
cgccaccctgcccct

SEQ ID NO: 5878856 - DNA, 17 bp, Homo sapiens
cgccacccttgcccact

SEQ ID NO: 5878857 - DNA, 22 bp, Homo sapiens
cgccaccgggcatgtctgcctg

SEQ ID NO: 5878858 - DNA, 14 bp, Homo sapiens
cgccaccgtgcctg

SEQ ID NO: 5878859 - DNA, 16 bp, Homo sapiens
cgccacctccccactc

SEQ ID NO: 5878860 - DNA, 19 bp, Homo sapiens
cgccacctccccactccag

SEQ ID NO: 5878861 - DNA, 21 bp, Homo sapiens
cgccacctggcattccttctg

SEQ ID NO: 5878862 - DNA, 16 bp, Homo sapiens
cgccacgctcagtgcc

SEQ ID NO: 5878863 - DNA, 17 bp, Homo sapiens
cgccacgctcagtgccc

SEQ ID NO: 5878864 - DNA, 19 bp, Homo sapiens
cgccacgctcagtgcccgt

SEQ ID NO: 5878865 - DNA, 17 bp, Homo sapiens
cgccacggcactccagc

SEQ ID NO: 5878866 - DNA, 14 bp, Homo sapiens
cgccacggcctggc

SEQ ID NO: 5878867 - DNA, 19 bp, Homo sapiens
cgccacggcctggctggtg

SEQ ID NO: 5878868 - DNA, 16 bp, Homo sapiens
cgccacggggaggggg

SEQ ID NO: 5878869 - DNA, 21 bp, Homo sapiens
cgccacgtcccagcatccctg

SEQ ID NO: 5878870 - DNA, 16 bp, Homo sapiens
cgccactaggtgtccc

SEQ ID NO: 5878871 - DNA, 14 bp, Homo sapiens
cgccactcatttca

SEQ ID NO: 5878872 - DNA, 17 bp, Homo sapiens
cgccactcatttcatct

SEQ ID NO: 5878873 - DNA, 20 bp, Homo sapiens
cgccactccctgggacacag

SEQ ID NO: 5878874 - DNA, 16 bp, Homo sapiens
cgccactcgccttctt

SEQ ID NO: 5878875 - DNA, 18 bp, Homo sapiens
cgccactgagacggcaga

SEQ ID NO: 5878876 - DNA, 19 bp, Homo sapiens
cgccactgcactccagcct

SEQ ID NO: 5878877 - DNA, 23 bp, Homo sapiens
cgccactgcactccagcctgggc

SEQ ID NO: 5878878 - DNA, 21 bp, Homo sapiens
cgccactgcactccagtctgg

SEQ ID NO: 5878879 - DNA, 20 bp, Homo sapiens
cgccactgcactccggcctg

SEQ ID NO: 5878880 - DNA, 13 bp, Homo sapiens
cgccactgcctcc

SEQ ID NO: 5878881 - DNA, 22 bp, Homo sapiens
cgccactgcctcccccgaatgc

SEQ ID NO: 5878882 - DNA, 18 bp, Homo sapiens
cgccactggggctcagag

SEQ ID NO: 5878883 - DNA, 12 bp, Homo sapiens
cgccacttcctt

SEQ ID NO: 5878884 - DNA, 17 bp, Homo sapiens
cgccacttcctttgtgt

SEQ ID NO: 5878885 - DNA, 22 bp, Homo sapiens
cgccacttcctttgtgtttata

SEQ ID NO: 5878886 - DNA, 19 bp, Homo sapiens
cgccagaagactcctaggc

SEQ ID NO: 5878887 - DNA, 16 bp, Homo sapiens
cgccagaccccgtggc

SEQ ID NO: 5878888 - DNA, 19 bp, Homo sapiens
cgccagaccccgtggctct

SEQ ID NO: 5878889 - DNA, 21 bp, Homo sapiens
cgccagaccccgtggctctgg

SEQ ID NO: 5878890 - DNA, 23 bp, Homo sapiens
cgccagaccccgtggctctggga

SEQ ID NO: 5878891 - DNA, 18 bp, Homo sapiens
cgccagaggacaaggaag

SEQ ID NO: 5878892 - DNA, 19 bp, Homo sapiens
cgccagatgaagctttggc

SEQ ID NO: 5878893 - DNA, 16 bp, Homo sapiens
cgccagattctccctt

SEQ ID NO: 5878894 - DNA, 17 bp, Homo sapiens
cgccagattctccctta

SEQ ID NO: 5878895 - DNA, 17 bp, Homo sapiens
cgccagattctttcctg

SEQ ID NO: 5878896 - DNA, 20 bp, Homo sapiens
cgccagattctttcctgagg

SEQ ID NO: 5878897 - DNA, 15 bp, Homo sapiens
cgccagccacaggac

SEQ ID NO: 5878898 - DNA, 17 bp, Homo sapiens
cgccagccacaggacca

SEQ ID NO: 5878899 - DNA, 22 bp, Homo sapiens
cgccagccacaggaccacctcc

SEQ ID NO: 5878900 - DNA, 16 bp, Homo sapiens
cgccagccccaagctg

SEQ ID NO: 5878901 - DNA, 17 bp, Homo sapiens
cgccagccctgggcctg

SEQ ID NO: 5878902 - DNA, 17 bp, Homo sapiens
cgccagcctacactgcc

SEQ ID NO: 5878903 - DNA, 21 bp, Homo sapiens
cgccagcctacactgccagcc

SEQ ID NO: 5878904 - DNA, 16 bp, Homo sapiens
cgccagcctcagtgcc

SEQ ID NO: 5878905 - DNA, 17 bp, Homo sapiens
cgccagcctcagtgcca

SEQ ID NO: 5878906 - DNA, 15 bp, Homo sapiens
cgccagcctcctctg

SEQ ID NO: 5878907 - DNA, 17 bp, Homo sapiens
cgccagcctcctctgga

SEQ ID NO: 5878908 - DNA, 23 bp, Homo sapiens
cgccagcctcctctggacggcag

SEQ ID NO: 5878909 - DNA, 23 bp, Homo sapiens
cgccagcgacctctctgcctctc

SEQ ID NO: 5878910 - DNA, 16 bp, Homo sapiens
cgccagcgtgtggagc

SEQ ID NO: 5878911 - DNA, 20 bp, Homo sapiens
cgccagcgtgtggagcagag

SEQ ID NO: 5878912 - DNA, 21 bp, Homo sapiens
cgccagcgtgtggagcagagc

SEQ ID NO: 5878913 - DNA, 15 bp, Homo sapiens
cgccagctaattttt

SEQ ID NO: 5878914 - DNA, 18 bp, Homo sapiens
cgccagctgatgactcaa

SEQ ID NO: 5878915 - DNA, 20 bp, Homo sapiens
cgccagctgatgactcaaga

SEQ ID NO: 5878916 - DNA, 18 bp, Homo sapiens
cgccaggaagccagagcc

SEQ ID NO: 5878917 - DNA, 17 bp, Homo sapiens
cgccaggacagcagcac

SEQ ID NO: 5878918 - DNA, 18 bp, Homo sapiens
cgccaggaccgccaaaga

SEQ ID NO: 5878919 - DNA, 16 bp, Homo sapiens
cgccaggacttggcct

SEQ ID NO: 5878920 - DNA, 23 bp, Homo sapiens
cgccaggagcttcttcgttcctg

SEQ ID NO: 5878921 - DNA, 23 bp, Homo sapiens
cgccaggatggcgcaggaactca

SEQ ID NO: 5878922 - DNA, 11 bp, Homo sapiens
cgccagggccc

SEQ ID NO: 5878923 - DNA, 21 bp, Homo sapiens
cgccagggctcagatggggcc

SEQ ID NO: 5878924 - DNA, 11 bp, Homo sapiens
cgccagggctg

SEQ ID NO: 5878925 - DNA, 23 bp, Homo sapiens
cgccaggggaaaatcagcctgct

SEQ ID NO: 5878926 - DNA, 15 bp, Homo sapiens
cgccaggggcaggca

SEQ ID NO: 5878927 - DNA, 16 bp, Homo sapiens
cgccaggggcaggcag

SEQ ID NO: 5878928 - DNA, 14 bp, Homo sapiens
cgccagtctcccag

SEQ ID NO: 5878929 - DNA, 14 bp, Homo sapiens
cgccagtgtttctg

SEQ ID NO: 5878930 - DNA, 15 bp, Homo sapiens
cgccagtgtttctga

SEQ ID NO: 5878931 - DNA, 14 bp, Homo sapiens
cgccataggccaag

SEQ ID NO: 5878932 - DNA, 14 bp, Homo sapiens
cgccatccagggtc

SEQ ID NO: 5878933 - DNA, 20 bp, Homo sapiens
cgccatccagggtctggcag

SEQ ID NO: 5878934 - DNA, 14 bp, Homo sapiens
cgccatcccagccc

SEQ ID NO: 5878935 - DNA, 21 bp, Homo sapiens
cgccatccgggacgcttccag

SEQ ID NO: 5878936 - DNA, 22 bp, Homo sapiens
cgccatccgggacgcttccaga

SEQ ID NO: 5878937 - DNA, 13 bp, Homo sapiens
cgccatccttcac

SEQ ID NO: 5878938 - DNA, 15 bp, Homo sapiens
cgccatctcggctca

SEQ ID NO: 5878939 - DNA, 13 bp, Homo sapiens
cgccatctgatcc

SEQ ID NO: 5878940 - DNA, 22 bp, Homo sapiens
cgccatctgtgcacactaagaa

SEQ ID NO: 5878941 - DNA, 14 bp, Homo sapiens
cgccatcttccatt

SEQ ID NO: 5878942 - DNA, 20 bp, Homo sapiens
cgccatggcttccaaggtgg

SEQ ID NO: 5878943 - DNA, 19 bp, Homo sapiens
cgccatggggtcggctcct

SEQ ID NO: 5878944 - DNA, 20 bp, Homo sapiens
cgccatggggtcggctcctg

SEQ ID NO: 5878945 - DNA, 23 bp, Homo sapiens
cgccatggggtcggctcctgatg

SEQ ID NO: 5878946 - DNA, 18 bp, Homo sapiens
cgccatggtcaccctcag

SEQ ID NO: 5878947 - DNA, 16 bp, Homo sapiens
cgccatgtgctgtgca

SEQ ID NO: 5878948 - DNA, 17 bp, Homo sapiens
cgccatgtgctgtgcac

SEQ ID NO: 5878949 - DNA, 19 bp, Homo sapiens
cgccatgtgtgtcagccca

SEQ ID NO: 5878950 - DNA, 21 bp, Homo sapiens
cgccatgttgacgagactggt

SEQ ID NO: 5878951 - DNA, 18 bp, Homo sapiens
cgccattctcaagccctg

SEQ ID NO: 5878952 - DNA, 15 bp, Homo sapiens
cgccattctcctgcc

SEQ ID NO: 5878953 - DNA, 21 bp, Homo sapiens
cgccattctcctgcctcagcc

SEQ ID NO: 5878954 - DNA, 19 bp, Homo sapiens
cgccattgcactccagcct

SEQ ID NO: 5878955 - DNA, 16 bp, Homo sapiens
cgccattgccaccagg

SEQ ID NO: 5878956 - DNA, 16 bp, Homo sapiens
cgccattggttggaag

SEQ ID NO: 5878957 - DNA, 19 bp, Homo sapiens
cgccattggttggaagcta

SEQ ID NO: 5878958 - DNA, 16 bp, Homo sapiens
cgccattgtactccag

SEQ ID NO: 5878959 - DNA, 13 bp, Homo sapiens
cgccatttcctca

SEQ ID NO: 5878960 - DNA, 17 bp, Homo sapiens
cgccatttcctcacgtg

SEQ ID NO: 5878961 - DNA, 12 bp, Homo sapiens
cgcccaaggcct

SEQ ID NO: 5878962 - DNA, 18 bp, Homo sapiens
cgcccacaggaagcctgc

SEQ ID NO: 5878963 - DNA, 20 bp, Homo sapiens
cgcccacaggaagcctgcag

SEQ ID NO: 5878964 - DNA, 21 bp, Homo sapiens
cgcccacaggaagcctgcagt

SEQ ID NO: 5878965 - DNA, 18 bp, Homo sapiens
cgcccacatcgggctcac

SEQ ID NO: 5878966 - DNA, 19 bp, Homo sapiens
cgcccacatcgggctcacc

SEQ ID NO: 5878967 - DNA, 20 bp, Homo sapiens
cgcccacatcgggctcacct

SEQ ID NO: 5878968 - DNA, 22 bp, Homo sapiens
cgcccaccaccccctcaagccc

SEQ ID NO: 5878969 - DNA, 14 bp, Homo sapiens
cgcccaccagcctt

SEQ ID NO: 5878970 - DNA, 16 bp, Homo sapiens
cgcccaccagccttgc

SEQ ID NO: 5878971 - DNA, 18 bp, Homo sapiens
cgcccaccagccttgctc

SEQ ID NO: 5878972 - DNA, 24 bp, Homo sapiens
cgcccaccagccttgctctcttca

SEQ ID NO: 5878973 - DNA, 13 bp, Homo sapiens
cgcccacccacac

SEQ ID NO: 5878974 - DNA, 14 bp, Homo sapiens
cgcccacccacacc

SEQ ID NO: 5878975 - DNA, 15 bp, Homo sapiens
cgcccacccagcagc

SEQ ID NO: 5878976 - DNA, 19 bp, Homo sapiens
cgcccacccagcagcgccc

SEQ ID NO: 5878977 - DNA, 13 bp, Homo sapiens
cgcccacccagct

SEQ ID NO: 5878978 - DNA, 19 bp, Homo sapiens
cgcccacccagctggtcct

SEQ ID NO: 5878979 - DNA, 18 bp, Homo sapiens
cgcccaccccgctctgca

SEQ ID NO: 5878980 - DNA, 14 bp, Homo sapiens
cgcccaccccgctg

SEQ ID NO: 5878981 - DNA, 20 bp, Homo sapiens
cgcccaccccgctgcctggc

SEQ ID NO: 5878982 - DNA, 22 bp, Homo sapiens
cgcccacccgagtacctccagt

SEQ ID NO: 5878983 - DNA, 19 bp, Homo sapiens
cgcccacccgccttgtgag

SEQ ID NO: 5878984 - DNA, 13 bp, Homo sapiens
cgcccaccctggg

SEQ ID NO: 5878985 - DNA, 15 bp, Homo sapiens
cgcctgcccctccca

SEQ ID NO: 5878986 - DNA, 16 bp, Homo sapiens
cgcctgcccctcccag

SEQ ID NO: 5878987 - DNA, 20 bp, Homo sapiens
cgcctgccctcatggcccct

SEQ ID NO: 5878988 - DNA, 20 bp, Homo sapiens
cgcctgccctccccagagca

SEQ ID NO: 5878989 - DNA, 15 bp, Homo sapiens
cgcctgccctccctg

SEQ ID NO: 5878990 - DNA, 18 bp, Homo sapiens
cgcctgccctccctgggg

SEQ ID NO: 5878991 - DNA, 16 bp, Homo sapiens
cgcctgcctcctggct

SEQ ID NO: 5878992 - DNA, 16 bp, Homo sapiens
cgcctgcctctgcctc

SEQ ID NO: 5878993 - DNA, 10 bp, Homo sapiens
cgcctgcctt

SEQ ID NO: 5878994 - DNA, 19 bp, Homo sapiens
cgcctgcctttggcactct

SEQ ID NO: 5878995 - DNA, 19 bp, Homo sapiens
cgcctgcgatggtgctgca

SEQ ID NO: 5878996 - DNA, 20 bp, Homo sapiens
cgcctgcgatggtgctgcac

SEQ ID NO: 5878997 - DNA, 23 bp, Homo sapiens
cgcctgcgatggtgctgcacccc

SEQ ID NO: 5878998 - DNA, 21 bp, Homo sapiens
cgcctgcgccccccagtggac

SEQ ID NO: 5878999 - DNA, 18 bp, Homo sapiens
cgcctgcgcctcctcctg

SEQ ID NO: 5879000 - DNA, 19 bp, Homo sapiens
cgcctgcgcctcctcctgc

SEQ ID NO: 5879001 - DNA, 20 bp, Homo sapiens
cgcctgcgctcctctgcagc

SEQ ID NO: 5879002 - DNA, 19 bp, Homo sapiens
cgcctgcggactccatggc

SEQ ID NO: 5879003 - DNA, 21 bp, Homo sapiens
cgcctgcggactccatggccc

SEQ ID NO: 5879004 - DNA, 19 bp, Homo sapiens
cgcctgctacacaggcagg

SEQ ID NO: 5879005 - DNA, 17 bp, Homo sapiens
cgcctgctccctccaga

SEQ ID NO: 5879006 - DNA, 18 bp, Homo sapiens
cgcctgctccctccagaa

SEQ ID NO: 5879007 - DNA, 13 bp, Homo sapiens
cgcctgctcctca

SEQ ID NO: 5879008 - DNA, 19 bp, Homo sapiens
cgcctgctcctcactggag

SEQ ID NO: 5879009 - DNA, 18 bp, Homo sapiens
cgcctgctgcctgctgag

SEQ ID NO: 5879010 - DNA, 16 bp, Homo sapiens
cgcctgcttcacaccc

SEQ ID NO: 5879011 - DNA, 17 bp, Homo sapiens
cgcctgcttcacacccc

SEQ ID NO: 5879012 - DNA, 23 bp, Homo sapiens
cgcctgcttcacacccctcagcg

SEQ ID NO: 5879013 - DNA, 17 bp, Homo sapiens
cgcctgcttgtccctgc

SEQ ID NO: 5879014 - DNA, 16 bp, Homo sapiens
cgcctggaaacagagg

SEQ ID NO: 5879015 - DNA, 12 bp, Homo sapiens
cgcctggagccc

SEQ ID NO: 5879016 - DNA, 15 bp, Homo sapiens
cgcctggatttctgg

SEQ ID NO: 5879017 - DNA, 17 bp, Homo sapiens
cgcctggcacatttcag

SEQ ID NO: 5879018 - DNA, 11 bp, Homo sapiens
cgcctggcaga

SEQ ID NO: 5879019 - DNA, 12 bp, Homo sapiens
cgcctggcaggt

SEQ ID NO: 5879020 - DNA, 13 bp, Homo sapiens
cgcctggcaggtg

SEQ ID NO: 5879021 - DNA, 14 bp, Homo sapiens
cgcctggcaggtgg

SEQ ID NO: 5879022 - DNA, 16 bp, Homo sapiens
cgcctggccaggagca

SEQ ID NO: 5879023 - DNA, 19 bp, Homo sapiens
cgcctggccagggcagggc

SEQ ID NO: 5879024 - DNA, 21 bp, Homo sapiens
cgcctggccagggcagggcca

SEQ ID NO: 5879025 - DNA, 17 bp, Homo sapiens
cgcctggccctccctcc

SEQ ID NO: 5879026 - DNA, 16 bp, Homo sapiens
cgcctggcctagactt

SEQ ID NO: 5879027 - DNA, 12 bp, Homo sapiens
cgcctggcctcc

SEQ ID NO: 5879028 - DNA, 14 bp, Homo sapiens
cgcctggcctccag

SEQ ID NO: 5879029 - DNA, 15 bp, Homo sapiens
cgcctggcctccagg

SEQ ID NO: 5879030 - DNA, 14 bp, Homo sapiens
cgcctggcctggcc

SEQ ID NO: 5879031 - DNA, 11 bp, Homo sapiens
cgcctggctcc

SEQ ID NO: 5879032 - DNA, 15 bp, Homo sapiens
cgcctggctccaggc

SEQ ID NO: 5879033 - DNA, 14 bp, Homo sapiens
cgcctggctctgtc

SEQ ID NO: 5879034 - DNA, 16 bp, Homo sapiens
cgcctggctgctgctt

SEQ ID NO: 5879035 - DNA, 24 bp, Homo sapiens
cgcctgggaaattgctccattcct

SEQ ID NO: 5879036 - DNA, 17 bp, Homo sapiens
cgcctgggaatcaggat

SEQ ID NO: 5879037 - DNA, 13 bp, Homo sapiens
cgcctgggcaccg

SEQ ID NO: 5879038 - DNA, 23 bp, Homo sapiens
cgcctgggcccaggctctgggaa

SEQ ID NO: 5879039 - DNA, 19 bp, Homo sapiens
cgcctgggtcctcccagct

SEQ ID NO: 5879040 - DNA, 14 bp, Homo sapiens
cgcctgtaaatgta

SEQ ID NO: 5879041 - DNA, 17 bp, Homo sapiens
cgcctgtaatctcagct

SEQ ID NO: 5879042 - DNA, 14 bp, Homo sapiens
cgcctgtcaataaa

SEQ ID NO: 5879043 - DNA, 15 bp, Homo sapiens
cgcctgtcaataaat

SEQ ID NO: 5879044 - DNA, 23 bp, Homo sapiens
cgcctgtcaataaatgttgaaaa

SEQ ID NO: 5879045 - DNA, 18 bp, Homo sapiens
cgcctgtcacaataaagt

SEQ ID NO: 5879046 - DNA, 19 bp, Homo sapiens
cgcctgtcacaataaagtt

SEQ ID NO: 5879047 - DNA, 22 bp, Homo sapiens
cgcctgtcacaataaagtttat

SEQ ID NO: 5879048 - DNA, 16 bp, Homo sapiens
cgcctgtccacagccc

SEQ ID NO: 5879049 - DNA, 20 bp, Homo sapiens
cgcctgtcccctcacagact

SEQ ID NO: 5879050 - DNA, 17 bp, Homo sapiens
cgcctgtcctcctggaa

SEQ ID NO: 5879051 - DNA, 12 bp, Homo sapiens
cgcctgtccttg

SEQ ID NO: 5879052 - DNA, 15 bp, Homo sapiens
cgcctgtgatgctgg

SEQ ID NO: 5879053 - DNA, 16 bp, Homo sapiens
cgcctgtgatgctggg

SEQ ID NO: 5879054 - DNA, 13 bp, Homo sapiens
cgcctgtgcacac

SEQ ID NO: 5879055 - DNA, 15 bp, Homo sapiens
cgcctgtgcacacac

SEQ ID NO: 5879056 - DNA, 19 bp, Homo sapiens
cgcctgtgccaccccttcc

SEQ ID NO: 5879057 - DNA, 11 bp, Homo sapiens
cgcctgtgccc

SEQ ID NO: 5879058 - DNA, 15 bp, Homo sapiens
cgcctgtgcccacgt

SEQ ID NO: 5879059 - DNA, 18 bp, Homo sapiens
cgcctgtgcccacgtgtg

SEQ ID NO: 5879060 - DNA, 21 bp, Homo sapiens
cgcctgtgcccacgtgtgcag

SEQ ID NO: 5879061 - DNA, 23 bp, Homo sapiens
cgcctgtgcccttgctgggtcca

SEQ ID NO: 5879062 - DNA, 18 bp, Homo sapiens
cgcctgtggagctcagcc

SEQ ID NO: 5879063 - DNA, 14 bp, Homo sapiens
cgcctgtgtccatc

SEQ ID NO: 5879064 - DNA, 19 bp, Homo sapiens
cgcctgttcccccgccgct

SEQ ID NO: 5879065 - DNA, 21 bp, Homo sapiens
cgccttagcatgtttgctgaa

SEQ ID NO: 5879066 - DNA, 15 bp, Homo sapiens
cgccttatttatatt

SEQ ID NO: 5879067 - DNA, 14 bp, Homo sapiens
cgccttcacagcag

SEQ ID NO: 5879068 - DNA, 14 bp, Homo sapiens
cgccttcaggttcc

SEQ ID NO: 5879069 - DNA, 22 bp, Homo sapiens
cgccttcaggttcctcctaggc

SEQ ID NO: 5879070 - DNA, 13 bp, Homo sapiens
cgccttcatgcca

SEQ ID NO: 5879071 - DNA, 21 bp, Homo sapiens
cgccttccaaaacctgcttcc

SEQ ID NO: 5879072 - DNA, 20 bp, Homo sapiens
cgccttccacctctgggagc

SEQ ID NO: 5879073 - DNA, 14 bp, Homo sapiens
cgccttccccaccc

SEQ ID NO: 5879074 - DNA, 12 bp, Homo sapiens
cgccttccctca

SEQ ID NO: 5879075 - DNA, 14 bp, Homo sapiens
cgccttccctcact

SEQ ID NO: 5879076 - DNA, 22 bp, Homo sapiens
cgccttccgccccttcccttcc

SEQ ID NO: 5879077 - DNA, 17 bp, Homo sapiens
cgccttcctcctccaca

SEQ ID NO: 5879078 - DNA, 18 bp, Homo sapiens
cgccttcctcctccacag

SEQ ID NO: 5879079 - DNA, 13 bp, Homo sapiens
cgccttcctgggt

SEQ ID NO: 5879080 - DNA, 19 bp, Homo sapiens
cgccttcggcctctcttgg

SEQ ID NO: 5879081 - DNA, 20 bp, Homo sapiens
cgccttctcccacatgaggc

SEQ ID NO: 5879082 - DNA, 21 bp, Homo sapiens
cgccttctcccccccggggct

SEQ ID NO: 5879083 - DNA, 16 bp, Homo sapiens
cgccttctcccctctc

SEQ ID NO: 5879084 - DNA, 16 bp, Homo sapiens
cgccttctcggagctg

SEQ ID NO: 5879085 - DNA, 19 bp, Homo sapiens
cgccttgaccttcccaagg

SEQ ID NO: 5879086 - DNA, 19 bp, Homo sapiens
cgccttgcccagcctggat

SEQ ID NO: 5879087 - DNA, 20 bp, Homo sapiens
cgccttgctggggcttgtcc

SEQ ID NO: 5879088 - DNA, 14 bp, Homo sapiens
cgccttggcctccc

SEQ ID NO: 5879089 - DNA, 15 bp, Homo sapiens
cgccttggccttgca

SEQ ID NO: 5879090 - DNA, 17 bp, Homo sapiens
cgccttggccttgcagc

SEQ ID NO: 5879091 - DNA, 18 bp, Homo sapiens
cgcctttcagcaggcagc

SEQ ID NO: 5879092 - DNA, 22 bp, Homo sapiens
cgcctttcccaccctcctgccc

SEQ ID NO: 5879093 - DNA, 21 bp, Homo sapiens
cgcctttgctgaagtctcccc

SEQ ID NO: 5879094 - DNA, 11 bp, Homo sapiens
cgcctttgtat

SEQ ID NO: 5879095 - DNA, 15 bp, Homo sapiens
cgccttttcagccct

SEQ ID NO: 5879096 - DNA, 21 bp, Homo sapiens
cgccttttcttggttcttttt

SEQ ID NO: 5879097 - DNA, 19 bp, Homo sapiens
cgcgaaaccaattcctcat

SEQ ID NO: 5879098 - DNA, 22 bp, Homo sapiens
cgcgaaacccggtgcatctggc

SEQ ID NO: 5879099 - DNA, 21 bp, Homo sapiens
cgcgaagtccgaggcctggct

SEQ ID NO: 5879100 - DNA, 16 bp, Homo sapiens
cgcgaccacccctgtg

SEQ ID NO: 5879101 - DNA, 17 bp, Homo sapiens
cgcgagggccccacgtc

SEQ ID NO: 5879102 - DNA, 19 bp, Homo sapiens
cgcgagggctactcagcag

SEQ ID NO: 5879103 - DNA, 19 bp, Homo sapiens
cgcgagtgtgctgtatggc

SEQ ID NO: 5879104 - DNA, 14 bp, Homo sapiens
cgcgatcccacaca

SEQ ID NO: 5879105 - DNA, 15 bp, Homo sapiens
cgcgatctcagctca

SEQ ID NO: 5879106 - DNA, 20 bp, Homo sapiens
cgcgatctcagctcactgca

SEQ ID NO: 5879107 - DNA, 13 bp, Homo sapiens
cgcgatgatgggc

SEQ ID NO: 5879108 - DNA, 14 bp, Homo sapiens
cgcgatgtggaact

SEQ ID NO: 5879109 - DNA, 20 bp, Homo sapiens
cgcgatgtggaactgctgcc

SEQ ID NO: 5879110 - DNA, 13 bp, Homo sapiens
cgcgcacacacac

SEQ ID NO: 5879111 - DNA, 15 bp, Homo sapiens
cgcgcaccgccatgc

SEQ ID NO: 5879112 - DNA, 21 bp, Homo sapiens
cgcgcaccgcccaacccccac

SEQ ID NO: 5879113 - DNA, 12 bp, Homo sapiens
cgcgcactcagc

SEQ ID NO: 5879114 - DNA, 19 bp, Homo sapiens
cgcgcagcgcgtgcacagc

SEQ ID NO: 5879115 - DNA, 22 bp, Homo sapiens
cgcgcagcgcgtgcacagcgcg

SEQ ID NO: 5879116 - DNA, 14 bp, Homo sapiens
cgcgcagctgccta

SEQ ID NO: 5879117 - DNA, 12 bp, Homo sapiens
cgcgcagctggc

SEQ ID NO: 5879118 - DNA, 18 bp, Homo sapiens
cgcgcatctcttcctgat

SEQ ID NO: 5879119 - DNA, 18 bp, Homo sapiens
cgcgcatgtaatcccagc

SEQ ID NO: 5879120 - DNA, 17 bp, Homo sapiens
cgcgccacaggaccctc

SEQ ID NO: 5879121 - DNA, 21 bp, Homo sapiens
cgcgccacaggaccctcgccg

SEQ ID NO: 5879122 - DNA, 22 bp, Homo sapiens
cgcgccactacactccagcctg

SEQ ID NO: 5879123 - DNA, 22 bp, Homo sapiens
cgcgccactcgcttcccccata

SEQ ID NO: 5879124 - DNA, 16 bp, Homo sapiens
cgcgcccccctcccag

SEQ ID NO: 5879125 - DNA, 13 bp, Homo sapiens
cgcgcccctctgc

SEQ ID NO: 5879126 - DNA, 11 bp, Homo sapiens
cgcgcccctgt

SEQ ID NO: 5879127 - DNA, 12 bp, Homo sapiens
cgcgcccctgtc

SEQ ID NO: 5879128 - DNA, 19 bp, Homo sapiens
cgcgcccctgtccatccgt

SEQ ID NO: 5879129 - DNA, 18 bp, Homo sapiens
cgcgcccgccgcctccct

SEQ ID NO: 5879130 - DNA, 16 bp, Homo sapiens
cgcgccctcctgccca

SEQ ID NO: 5879131 - DNA, 14 bp, Homo sapiens
cgcgccgatgccac

SEQ ID NO: 5879132 - DNA, 15 bp, Homo sapiens
cgcgccgccgccgcg

SEQ ID NO: 5879133 - DNA, 12 bp, Homo sapiens
cgcgcctgcctt

SEQ ID NO: 5879134 - DNA, 23 bp, Homo sapiens
cgcgccttctcccccccggggct

SEQ ID NO: 5879135 - DNA, 15 bp, Homo sapiens
cgcgcgactgagaac

SEQ ID NO: 5879136 - DNA, 19 bp, Homo sapiens
cgcgcgcacacacacacat

SEQ ID NO: 5879137 - DNA, 13 bp, Homo sapiens
cgcgcgcccccag

SEQ ID NO: 5879138 - DNA, 21 bp, Homo sapiens
cgcgcgcccccaggacccccc

SEQ ID NO: 5879139 - DNA, 17 bp, Homo sapiens
cgcgcgggacagcggcc

SEQ ID NO: 5879140 - DNA, 19 bp, Homo sapiens
cgcgcgggacagcggcccc

SEQ ID NO: 5879141 - DNA, 16 bp, Homo sapiens
cgcgcgtgcccccagc

SEQ ID NO: 5879142 - DNA, 16 bp, Homo sapiens
cgcgctccgaaccccg

SEQ ID NO: 5879143 - DNA, 21 bp, Homo sapiens
cgcgctccgaaccccgggccc

SEQ ID NO: 5879144 - DNA, 21 bp, Homo sapiens
cgcgctcctgacccctccctg

SEQ ID NO: 5879145 - DNA, 19 bp, Homo sapiens
cgcgctctctctctttctc

SEQ ID NO: 5879146 - DNA, 14 bp, Homo sapiens
cgcgctctgcccct

SEQ ID NO: 5879147 - DNA, 13 bp, Homo sapiens
cgcgctgcctgtg

SEQ ID NO: 5879148 - DNA, 15 bp, Homo sapiens
cgcgctgggggagcc

SEQ ID NO: 5879149 - DNA, 21 bp, Homo sapiens
cgcgctgtgtaaatgctccag

SEQ ID NO: 5879150 - DNA, 18 bp, Homo sapiens
cgcgcttcgaactccagg

SEQ ID NO: 5879151 - DNA, 23 bp, Homo sapiens
cgcgctttcattttttgacctca

SEQ ID NO: 5879152 - DNA, 17 bp, Homo sapiens
cgcggacatcccctgct

SEQ ID NO: 5879153 - DNA, 15 bp, Homo sapiens
cgcggagacctcctg

SEQ ID NO: 5879154 - DNA, 21 bp, Homo sapiens
cgcggaggagctagcctgaag

SEQ ID NO: 5879155 - DNA, 16 bp, Homo sapiens
cgcggaggaggaagag

SEQ ID NO: 5879156 - DNA, 23 bp, Homo sapiens
cgcggaggaggagggaggccagg

SEQ ID NO: 5879157 - DNA, 12 bp, Homo sapiens
cgcggaggcccc

SEQ ID NO: 5879158 - DNA, 22 bp, Homo sapiens
cgcggatttctctttctctctc

SEQ ID NO: 5879159 - DNA, 16 bp, Homo sapiens
cgcggccaggcaccca

SEQ ID NO: 5879160 - DNA, 18 bp, Homo sapiens
cgcggcccagacccagcc

SEQ ID NO: 5879161 - DNA, 21 bp, Homo sapiens
cgcggccctcagtagtccctg

SEQ ID NO: 5879162 - DNA, 17 bp, Homo sapiens
cgcggccctggggcggg

SEQ ID NO: 5879163 - DNA, 16 bp, Homo sapiens
cgcggccgctctccgc

SEQ ID NO: 5879164 - DNA, 20 bp, Homo sapiens
cgcggcctcccgaggagggg

SEQ ID NO: 5879165 - DNA, 21 bp, Homo sapiens
cgcggcctgcaccgacccgag

SEQ ID NO: 5879166 - DNA, 17 bp, Homo sapiens
cgcggcggagctggccc

SEQ ID NO: 5879167 - DNA, 21 bp, Homo sapiens
cgcggcggagctggccccgcc

SEQ ID NO: 5879168 - DNA, 17 bp, Homo sapiens
cgcggcggctctgccca

SEQ ID NO: 5879169 - DNA, 16 bp, Homo sapiens
cgcggcggtgggcgcc

SEQ ID NO: 5879170 - DNA, 18 bp, Homo sapiens
cgcggctcaaaaggaaac

SEQ ID NO: 5879171 - DNA, 21 bp, Homo sapiens
cgcggctcccgccaccctcaa

SEQ ID NO: 5879172 - DNA, 22 bp, Homo sapiens
cgcggctggctctgtggagggg

SEQ ID NO: 5879173 - DNA, 16 bp, Homo sapiens
cgcggctgggaggagg

SEQ ID NO: 5879174 - DNA, 18 bp, Homo sapiens
cgcggcttggccgccatc

SEQ ID NO: 5879175 - DNA, 13 bp, Homo sapiens
cgcgggacaggac

SEQ ID NO: 5879176 - DNA, 22 bp, Homo sapiens
cgcgggagagagtgagagagag

SEQ ID NO: 5879177 - DNA, 15 bp, Homo sapiens
cgcgggaggcaccag

SEQ ID NO: 5879178 - DNA, 14 bp, Homo sapiens
cgcgggcacagcca

SEQ ID NO: 5879179 - DNA, 15 bp, Homo sapiens
cgcgggcacagccag

SEQ ID NO: 5879180 - DNA, 20 bp, Homo sapiens
cgcgggcagcgggccaggcc

SEQ ID NO: 5879181 - DNA, 22 bp, Homo sapiens
cgcgggcagtgacgtgagtggg

SEQ ID NO: 5879182 - DNA, 17 bp, Homo sapiens
cgcgggcccctcacctg

SEQ ID NO: 5879183 - DNA, 18 bp, Homo sapiens
cgcgggctgactgggcca

SEQ ID NO: 5879184 - DNA, 13 bp, Homo sapiens
cgcgggctttgtt

SEQ ID NO: 5879185 - DNA, 14 bp, Homo sapiens
cgcgggggacagga

SEQ ID NO: 5879186 - DNA, 15 bp, Homo sapiens
cgcgggtagatgccg

SEQ ID NO: 5879187 - DNA, 13 bp, Homo sapiens
cgcgggtgggact

SEQ ID NO: 5879188 - DNA, 22 bp, Homo sapiens
cgcgggtgggactcttccctgg

SEQ ID NO: 5879189 - DNA, 17 bp, Homo sapiens
cgcggtacaaaggaaaa

SEQ ID NO: 5879190 - DNA, 13 bp, Homo sapiens
cgcggtcctgact

SEQ ID NO: 5879191 - DNA, 22 bp, Homo sapiens
cgcggtgccatgtctgcagtgt

SEQ ID NO: 5879192 - DNA, 13 bp, Homo sapiens
cgcggtgctctgg

SEQ ID NO: 5879193 - DNA, 14 bp, Homo sapiens
cgcggtgctctggc

SEQ ID NO: 5879194 - DNA, 16 bp, Homo sapiens
cgcggtgctctggcgg

SEQ ID NO: 5879195 - DNA, 20 bp, Homo sapiens
cgcggtgctgactgaggcct

SEQ ID NO: 5879196 - DNA, 19 bp, Homo sapiens
cgcggtggctcacacctgt

SEQ ID NO: 5879197 - DNA, 19 bp, Homo sapiens
cgcggtggctcacgcctgt

SEQ ID NO: 5879198 - DNA, 20 bp, Homo sapiens
cgcggtggctcttgcctgta

SEQ ID NO: 5879199 - DNA, 20 bp, Homo sapiens
cgcggttcaggtcagggcta

SEQ ID NO: 5879200 - DNA, 12 bp, Homo sapiens
cgcgtagagagc

SEQ ID NO: 5879201 - DNA, 13 bp, Homo sapiens
cgcgtcccagctc

SEQ ID NO: 5879202 - DNA, 14 bp, Homo sapiens
cgcgtcccagctcc

SEQ ID NO: 5879203 - DNA, 16 bp, Homo sapiens
cgcgtcccagctcccc

SEQ ID NO: 5879204 - DNA, 15 bp, Homo sapiens
cgcgtcgccgccacc

SEQ ID NO: 5879205 - DNA, 14 bp, Homo sapiens
cgcgtctaccctgg

SEQ ID NO: 5879206 - DNA, 15 bp, Homo sapiens
cgcgtctgcctgggc

SEQ ID NO: 5879207 - DNA, 13 bp, Homo sapiens
cgcgtcttcctga

SEQ ID NO: 5879208 - DNA, 14 bp, Homo sapiens
cgcgtcttcctgag

SEQ ID NO: 5879209 - DNA, 22 bp, Homo sapiens
cgcgtgacacaatgctgggtgg

SEQ ID NO: 5879210 - DNA, 15 bp, Homo sapiens
cgcgtgagtgtgtga

SEQ ID NO: 5879211 - DNA, 20 bp, Homo sapiens
cgcgtgcacacaccagagcc

SEQ ID NO: 5879212 - DNA, 14 bp, Homo sapiens
cgcgtgcccccagc

SEQ ID NO: 5879213 - DNA, 14 bp, Homo sapiens
cgcgtgccgggccc

SEQ ID NO: 5879214 - DNA, 15 bp, Homo sapiens
cgcgtgccgggcccc

SEQ ID NO: 5879215 - DNA, 14 bp, Homo sapiens
cgcgtgccttcccc

SEQ ID NO: 5879216 - DNA, 15 bp, Homo sapiens
cgcgtggttctgcca

SEQ ID NO: 5879217 - DNA, 17 bp, Homo sapiens
cgcgtggttctgccact

SEQ ID NO: 5879218 - DNA, 22 bp, Homo sapiens
cgcgttctgggagctcaaggcc

SEQ ID NO: 5879219 - DNA, 17 bp, Homo sapiens
cgcgttgtaaaatatag

SEQ ID NO: 5879220 - DNA, 15 bp, Homo sapiens
cgcgtttagaccaag

SEQ ID NO: 5879221 - DNA, 15 bp, Homo sapiens
cgctaaaaagaactc

SEQ ID NO: 5879222 - DNA, 20 bp, Homo sapiens
cgctaacttgcttaaatgtg

SEQ ID NO: 5879223 - DNA, 14 bp, Homo sapiens
cgctaagagggagg

SEQ ID NO: 5879224 - DNA, 16 bp, Homo sapiens
cgctaagagggaggga

SEQ ID NO: 5879225 - DNA, 22 bp, Homo sapiens
cgctaagagggagggagggctc

SEQ ID NO: 5879226 - DNA, 13 bp, Homo sapiens
cgctaaggcttcc

SEQ ID NO: 5879227 - DNA, 18 bp, Homo sapiens
cgctaataagtgacaaat

SEQ ID NO: 5879228 - DNA, 23 bp, Homo sapiens
cgctaattcaaggaatttcttaa

SEQ ID NO: 5879229 - DNA, 20 bp, Homo sapiens
cgctacaccactctggcagc

SEQ ID NO: 5879230 - DNA, 21 bp, Homo sapiens
cgctacccgggaagggggctg

SEQ ID NO: 5879231 - DNA, 13 bp, Homo sapiens
cgctacctccctc

SEQ ID NO: 5879232 - DNA, 14 bp, Homo sapiens
cgctacctccctcc

SEQ ID NO: 5879233 - DNA, 15 bp, Homo sapiens
cgctacctccctccc

SEQ ID NO: 5879234 - DNA, 20 bp, Homo sapiens
cgctactaacctgacatcac

SEQ ID NO: 5879235 - DNA, 17 bp, Homo sapiens
cgctactataaagagaa

SEQ ID NO: 5879236 - DNA, 22 bp, Homo sapiens
cgctagagcattctggggtggg

SEQ ID NO: 5879237 - DNA, 12 bp, Homo sapiens
cgctagcagccc

SEQ ID NO: 5879238 - DNA, 15 bp, Homo sapiens
cgctagcagcccttg

SEQ ID NO: 5879239 - DNA, 20 bp, Homo sapiens
cgctaggagagactgaaagc

SEQ ID NO: 5879240 - DNA, 15 bp, Homo sapiens
cgctaggctcgcctt

SEQ ID NO: 5879241 - DNA, 21 bp, Homo sapiens
cgctaggctcgccttccctcc

SEQ ID NO: 5879242 - DNA, 19 bp, Homo sapiens
cgctaggggacttggggat

SEQ ID NO: 5879243 - DNA, 21 bp, Homo sapiens
cgctaggtagagtctgagggc

SEQ ID NO: 5879244 - DNA, 20 bp, Homo sapiens
cgctagtaactcctctgccc

SEQ ID NO: 5879245 - DNA, 17 bp, Homo sapiens
cgctagtgtttaaaagg

SEQ ID NO: 5879246 - DNA, 20 bp, Homo sapiens
cgctatagttactgtcctgt

SEQ ID NO: 5879247 - DNA, 18 bp, Homo sapiens
cgctatctgggaagctat

SEQ ID NO: 5879248 - DNA, 16 bp, Homo sapiens
cgctatgggaggcagc

SEQ ID NO: 5879249 - DNA, 19 bp, Homo sapiens
cgctatgggaggcagccga

SEQ ID NO: 5879250 - DNA, 16 bp, Homo sapiens
cgctattccagctgtc

SEQ ID NO: 5879251 - DNA, 13 bp, Homo sapiens
cgctattcccagg

SEQ ID NO: 5879252 - DNA, 17 bp, Homo sapiens
cgctattcccaggcagg

SEQ ID NO: 5879253 - DNA, 14 bp, Homo sapiens
cgctcaaggaagga

SEQ ID NO: 5879254 - DNA, 16 bp, Homo sapiens
cgctcaatgcccagta

SEQ ID NO: 5879255 - DNA, 23 bp, Homo sapiens
cgctcaccgctggcccttagaga

SEQ ID NO: 5879256 - DNA, 14 bp, Homo sapiens
cgctcacctcagag

SEQ ID NO: 5879257 - DNA, 22 bp, Homo sapiens
cgctcacctttgtttagaacac

SEQ ID NO: 5879258 - DNA, 18 bp, Homo sapiens
cgctcacgctgacagcct

SEQ ID NO: 5879259 - DNA, 23 bp, Homo sapiens
cgctcacgctgacagcctcctag

SEQ ID NO: 5879260 - DNA, 13 bp, Homo sapiens
cgctcactggttt

SEQ ID NO: 5879261 - DNA, 12 bp, Homo sapiens
cgctcagaagag

SEQ ID NO: 5879262 - DNA, 18 bp, Homo sapiens
cgctcagacggcggccag

SEQ ID NO: 5879263 - DNA, 19 bp, Homo sapiens
cgctcagacggcggccagg

SEQ ID NO: 5879264 - DNA, 14 bp, Homo sapiens
cgctcagaggccgc

SEQ ID NO: 5879265 - DNA, 12 bp, Homo sapiens
cgctcagatgcc

SEQ ID NO: 5879266 - DNA, 14 bp, Homo sapiens
cgctcagcagccct

SEQ ID NO: 5879267 - DNA, 23 bp, Homo sapiens
cgctcagcagccctagcggctgc

SEQ ID NO: 5879268 - DNA, 13 bp, Homo sapiens
cgctcagccccag

SEQ ID NO: 5879269 - DNA, 20 bp, Homo sapiens
cgctcagccccaggccagct

SEQ ID NO: 5879270 - DNA, 14 bp, Homo sapiens
cgctcaggacccag

SEQ ID NO: 5879271 - DNA, 19 bp, Homo sapiens
cgctcaggacccaggccct

SEQ ID NO: 5879272 - DNA, 22 bp, Homo sapiens
cgctcaggacccaggccctcca

SEQ ID NO: 5879273 - DNA, 19 bp, Homo sapiens
cgctcagggccatgctgag

SEQ ID NO: 5879274 - DNA, 14 bp, Homo sapiens
cgctcaggggcctg

SEQ ID NO: 5879275 - DNA, 18 bp, Homo sapiens
cgctcaggggcctggagg

SEQ ID NO: 5879276 - DNA, 19 bp, Homo sapiens
cgctcaggtagccaccacc

SEQ ID NO: 5879277 - DNA, 12 bp, Homo sapiens
cgctcagtatta

SEQ ID NO: 5879278 - DNA, 14 bp, Homo sapiens
cgctcagtattact

SEQ ID NO: 5879279 - DNA, 12 bp, Homo sapiens
cgctcagtattt

SEQ ID NO: 5879280 - DNA, 12 bp, Homo sapiens
cgctcagtctgt

SEQ ID NO: 5879281 - DNA, 17 bp, Homo sapiens
cgctcatctctggaagg

SEQ ID NO: 5879282 - DNA, 13 bp, Homo sapiens
cgctcatctggct

SEQ ID NO: 5879283 - DNA, 20 bp, Homo sapiens
cgctcatgggcccctctgac

SEQ ID NO: 5879284 - DNA, 18 bp, Homo sapiens
cgctcatgttgagccagt

SEQ ID NO: 5879285 - DNA, 16 bp, Homo sapiens
cgctcattcagcatct

SEQ ID NO: 5879286 - DNA, 18 bp, Homo sapiens
cgctcattcagcatctga

SEQ ID NO: 5879287 - DNA, 18 bp, Homo sapiens
cgctcattttaggcctcc

SEQ ID NO: 5879288 - DNA, 22 bp, Homo sapiens
cgctcattttaggcctcctctc

SEQ ID NO: 5879289 - DNA, 18 bp, Homo sapiens
cgctccagctgccccggc

SEQ ID NO: 5879290 - DNA, 11 bp, Homo sapiens
cgctccaggta

SEQ ID NO: 5879291 - DNA, 23 bp, Homo sapiens
cgctccatcgcccaggcctggga

SEQ ID NO: 5879292 - DNA, 22 bp, Homo sapiens
cgctcccaagggtctcactgct

SEQ ID NO: 5879293 - DNA, 18 bp, Homo sapiens
cgctcccacagcttcctg

SEQ ID NO: 5879294 - DNA, 15 bp, Homo sapiens
cgctcccacctagtg

SEQ ID NO: 5879295 - DNA, 19 bp, Homo sapiens
cgctcccacctagtgcccc

SEQ ID NO: 5879296 - DNA, 12 bp, Homo sapiens
cgctcccactca

SEQ ID NO: 5879297 - DNA, 13 bp, Homo sapiens
cgctcccagcctg

SEQ ID NO: 5879298 - DNA, 14 bp, Homo sapiens
cgctcccagcctgc

SEQ ID NO: 5879299 - DNA, 15 bp, Homo sapiens
cgctcccagcctgcc

SEQ ID NO: 5879300 - DNA, 20 bp, Homo sapiens
cgctcccaggttcccccagc

SEQ ID NO: 5879301 - DNA, 21 bp, Homo sapiens
cgctcccaggttcccccagca

SEQ ID NO: 5879302 - DNA, 24 bp, Homo sapiens
cgctcccaggttcccccagcaagc

SEQ ID NO: 5879303 - DNA, 16 bp, Homo sapiens
cgctccccactctgct

SEQ ID NO: 5879304 - DNA, 17 bp, Homo sapiens
cgctccccactctgctc

SEQ ID NO: 5879305 - DNA, 20 bp, Homo sapiens
cgctcccccgcagtccccag

SEQ ID NO: 5879306 - DNA, 16 bp, Homo sapiens
cgctccccgcctgttc

SEQ ID NO: 5879307 - DNA, 16 bp, Homo sapiens
cgctcccctccatccc

SEQ ID NO: 5879308 - DNA, 18 bp, Homo sapiens
cgctcccctccatcccca

SEQ ID NO: 5879309 - DNA, 14 bp, Homo sapiens
cgctcccctctgcc

SEQ ID NO: 5879310 - DNA, 20 bp, Homo sapiens
cgctccccttaccccagtca

SEQ ID NO: 5879311 - DNA, 15 bp, Homo sapiens
cgctcccctttccca

SEQ ID NO: 5879312 - DNA, 22 bp, Homo sapiens
cgctcccgcgggaagccagccc

SEQ ID NO: 5879313 - DNA, 13 bp, Homo sapiens
cgctcccgggact

SEQ ID NO: 5879314 - DNA, 22 bp, Homo sapiens
cgctcccgggcctcagggtcct

SEQ ID NO: 5879315 - DNA, 15 bp, Homo sapiens
cgctccctcccagga

SEQ ID NO: 5879316 - DNA, 20 bp, Homo sapiens
cgctccctcccaggactctg

SEQ ID NO: 5879317 - DNA, 17 bp, Homo sapiens
cgctcccttcctgccac

SEQ ID NO: 5879318 - DNA, 18 bp, Homo sapiens
cgctcccttcctgccact

SEQ ID NO: 5879319 - DNA, 16 bp, Homo sapiens
cgctcccttgacctgc

SEQ ID NO: 5879320 - DNA, 23 bp, Homo sapiens
cgctccgaaccccgggcccgggc

SEQ ID NO: 5879321 - DNA, 19 bp, Homo sapiens
cgctccggcagaggcaggg

SEQ ID NO: 5879322 - DNA, 22 bp, Homo sapiens
cgctccgggaacagtgcatgtg

SEQ ID NO: 5879323 - DNA, 17 bp, Homo sapiens
cgctccgtctctgtcct

SEQ ID NO: 5879324 - DNA, 18 bp, Homo sapiens
cgctcctcccagatggct

SEQ ID NO: 5879325 - DNA, 22 bp, Homo sapiens
cgctcctccctctgaggctgta

SEQ ID NO: 5879326 - DNA, 15 bp, Homo sapiens
cgctcctccctgctc

SEQ ID NO: 5879327 - DNA, 17 bp, Homo sapiens
cgctcctccctgctcct

SEQ ID NO: 5879328 - DNA, 23 bp, Homo sapiens
cgctcctccctgctcctcatggg

SEQ ID NO: 5879329 - DNA, 13 bp, Homo sapiens
cgctcctcctgtg

SEQ ID NO: 5879330 - DNA, 21 bp, Homo sapiens
cgctcctcctgtgtgactggc

SEQ ID NO: 5879331 - DNA, 13 bp, Homo sapiens
cgctcctccttcc

SEQ ID NO: 5879332 - DNA, 18 bp, Homo sapiens
cgctcctccttcccaggg

SEQ ID NO: 5879333 - DNA, 19 bp, Homo sapiens
cgctcctccttcccaggga

SEQ ID NO: 5879334 - DNA, 17 bp, Homo sapiens
cgctcctctgcagcctg

SEQ ID NO: 5879335 - DNA, 20 bp, Homo sapiens
cgctcctctgcagcctgagc

SEQ ID NO: 5879336 - DNA, 13 bp, Homo sapiens
cgctcctctgcct

SEQ ID NO: 5879337 - DNA, 16 bp, Homo sapiens
cgctcctctgccttgg

SEQ ID NO: 5879338 - DNA, 22 bp, Homo sapiens
cgctcctgccgcagacgggcac

SEQ ID NO: 5879339 - DNA, 22 bp, Homo sapiens
cgctcctgctaacggtgctcag

SEQ ID NO: 5879340 - DNA, 16 bp, Homo sapiens
cgctcctgcttcccct

SEQ ID NO: 5879341 - DNA, 17 bp, Homo sapiens
cgctcctgcttcccctc

SEQ ID NO: 5879342 - DNA, 22 bp, Homo sapiens
cggaagagagggctgagccatg

SEQ ID NO: 5879343 - DNA, 15 bp, Homo sapiens
cggaagagttacaat

SEQ ID NO: 5879344 - DNA, 14 bp, Homo sapiens
cggaagcagtgcct

SEQ ID NO: 5879345 - DNA, 20 bp, Homo sapiens
cggaagcagtgccttccata

SEQ ID NO: 5879346 - DNA, 22 bp, Homo sapiens
cggaagcagtgccttccataat

SEQ ID NO: 5879347 - DNA, 12 bp, Homo sapiens
cggaagccaaag

SEQ ID NO: 5879348 - DNA, 21 bp, Homo sapiens
cggaagccatagggggctgca

SEQ ID NO: 5879349 - DNA, 21 bp, Homo sapiens
cggaagccgtctgactccaga

SEQ ID NO: 5879350 - DNA, 13 bp, Homo sapiens
cggaagcctgtcc

SEQ ID NO: 5879351 - DNA, 14 bp, Homo sapiens
cggaagcctgtcct

SEQ ID NO: 5879352 - DNA, 19 bp, Homo sapiens
cggaaggacctatgtttgc

SEQ ID NO: 5879353 - DNA, 13 bp, Homo sapiens
cggaaggaggcca

SEQ ID NO: 5879354 - DNA, 17 bp, Homo sapiens
cggaagggtaaacaata

SEQ ID NO: 5879355 - DNA, 21 bp, Homo sapiens
cggaagggttggtgggctggc

SEQ ID NO: 5879356 - DNA, 17 bp, Homo sapiens
cggaaggtttttaaaca

SEQ ID NO: 5879357 - DNA, 20 bp, Homo sapiens
cggaagtaaattatgatgtc

SEQ ID NO: 5879358 - DNA, 20 bp, Homo sapiens
cggaagtacttccctcaggc

SEQ ID NO: 5879359 - DNA, 18 bp, Homo sapiens
cggaagttttcaatgatg

SEQ ID NO: 5879360 - DNA, 15 bp, Homo sapiens
cggaatagagcctcg

SEQ ID NO: 5879361 - DNA, 21 bp, Homo sapiens
cggaatcactctgtccttgga

SEQ ID NO: 5879362 - DNA, 21 bp, Homo sapiens
cggaatcctgtcctcagcttc

SEQ ID NO: 5879363 - DNA, 22 bp, Homo sapiens
cggaatcctgtcgattagactg

SEQ ID NO: 5879364 - DNA, 20 bp, Homo sapiens
cggaattcaccagtgttcct

SEQ ID NO: 5879365 - DNA, 19 bp, Homo sapiens
cggaattcataataaattt

SEQ ID NO: 5879366 - DNA, 11 bp, Homo sapiens
cggaattccaa

SEQ ID NO: 5879367 - DNA, 23 bp, Homo sapiens
cggaattccaatatttataatta

SEQ ID NO: 5879368 - DNA, 18 bp, Homo sapiens
cggacaaaagggccaggt

SEQ ID NO: 5879369 - DNA, 16 bp, Homo sapiens
cggacaagacccccag

SEQ ID NO: 5879370 - DNA, 18 bp, Homo sapiens
cggacaagacccccagca

SEQ ID NO: 5879371 - DNA, 14 bp, Homo sapiens
cggacaagcccagg

SEQ ID NO: 5879372 - DNA, 15 bp, Homo sapiens
cggacaagcccagga

SEQ ID NO: 5879373 - DNA, 16 bp, Homo sapiens
cggacaagcccaggac

SEQ ID NO: 5879374 - DNA, 21 bp, Homo sapiens
cggacaagcccaggacactgc

SEQ ID NO: 5879375 - DNA, 18 bp, Homo sapiens
cggacacaagcggccctg

SEQ ID NO: 5879376 - DNA, 14 bp, Homo sapiens
cggacaccccctcg

SEQ ID NO: 5879377 - DNA, 17 bp, Homo sapiens
cggacaccgtggcctgg

SEQ ID NO: 5879378 - DNA, 21 bp, Homo sapiens
cggacacggcttcactgacca

SEQ ID NO: 5879379 - DNA, 22 bp, Homo sapiens
cggacacggcttcactgaccag

SEQ ID NO: 5879380 - DNA, 22 bp, Homo sapiens
cggacacttttgaggacaagtt

SEQ ID NO: 5879381 - DNA, 19 bp, Homo sapiens
cggacagaatgatgccaaa

SEQ ID NO: 5879382 - DNA, 14 bp, Homo sapiens
cggacagagccccc

SEQ ID NO: 5879383 - DNA, 22 bp, Homo sapiens
cggacagccacggccaggccag

SEQ ID NO: 5879384 - DNA, 23 bp, Homo sapiens
cggacagctgcccagacacatgg

SEQ ID NO: 5879385 - DNA, 21 bp, Homo sapiens
cggacaggaagcacagcaggt

SEQ ID NO: 5879386 - DNA, 18 bp, Homo sapiens
cggacaggtggggcctca

SEQ ID NO: 5879387 - DNA, 23 bp, Homo sapiens
cggacaggtggggcctcagcctg

SEQ ID NO: 5879388 - DNA, 15 bp, Homo sapiens
cggacagtggcagga

SEQ ID NO: 5879389 - DNA, 20 bp, Homo sapiens
cggacatgcttttctgccac

SEQ ID NO: 5879390 - DNA, 19 bp, Homo sapiens
cggaccaaagggagtctgc

SEQ ID NO: 5879391 - DNA, 21 bp, Homo sapiens
cggaccaaagggagtctgcca

SEQ ID NO: 5879392 - DNA, 20 bp, Homo sapiens
cggaccaagatgggcacatg

SEQ ID NO: 5879393 - DNA, 15 bp, Homo sapiens
cggaccaagggactc

SEQ ID NO: 5879394 - DNA, 19 bp, Homo sapiens
cggaccactcgaggcctgc

SEQ ID NO: 5879395 - DNA, 17 bp, Homo sapiens
cggaccagcctggccca

SEQ ID NO: 5879396 - DNA, 16 bp, Homo sapiens
cggacccaccccaact

SEQ ID NO: 5879397 - DNA, 23 bp, Homo sapiens
cggacccccgtcagctgcttctg

SEQ ID NO: 5879398 - DNA, 13 bp, Homo sapiens
cggaccctgtgtg

SEQ ID NO: 5879399 - DNA, 17 bp, Homo sapiens
cggacccttcccagccc

SEQ ID NO: 5879400 - DNA, 19 bp, Homo sapiens
cggacccttcccagccctc

SEQ ID NO: 5879401 - DNA, 20 bp, Homo sapiens
cggacccttttccttagctg

SEQ ID NO: 5879402 - DNA, 18 bp, Homo sapiens
cggaccgcgtagagagcc

SEQ ID NO: 5879403 - DNA, 16 bp, Homo sapiens
cggacctgagcccgca

SEQ ID NO: 5879404 - DNA, 20 bp, Homo sapiens
cggacctggactagggcctc

SEQ ID NO: 5879405 - DNA, 14 bp, Homo sapiens
cggacctttcagct

SEQ ID NO: 5879406 - DNA, 16 bp, Homo sapiens
cggacgcccaggaccc

SEQ ID NO: 5879407 - DNA, 18 bp, Homo sapiens
cggacgctggagaccctg

SEQ ID NO: 5879408 - DNA, 21 bp, Homo sapiens
cggacgctggagaccctgcgc

SEQ ID NO: 5879409 - DNA, 12 bp, Homo sapiens
cggacgggctgt

SEQ ID NO: 5879410 - DNA, 19 bp, Homo sapiens
cggacggggcaggcgctgc

SEQ ID NO: 5879411 - DNA, 15 bp, Homo sapiens
cggacgttccagccg

SEQ ID NO: 5879412 - DNA, 16 bp, Homo sapiens
cggacgttccagccgg

SEQ ID NO: 5879413 - DNA, 19 bp, Homo sapiens
cggacgttggttctgcact

SEQ ID NO: 5879414 - DNA, 16 bp, Homo sapiens
cggacgtttccatcag

SEQ ID NO: 5879415 - DNA, 18 bp, Homo sapiens
cggacgtttccatcaggt

SEQ ID NO: 5879416 - DNA, 23 bp, Homo sapiens
cggactcaccaacttgccacatg

SEQ ID NO: 5879417 - DNA, 17 bp, Homo sapiens
cggactcagactcctgg

SEQ ID NO: 5879418 - DNA, 19 bp, Homo sapiens
cggactccatggcccttcc

SEQ ID NO: 5879419 - DNA, 14 bp, Homo sapiens
cggactccatggct

SEQ ID NO: 5879420 - DNA, 18 bp, Homo sapiens
cggactcccgggccacgc

SEQ ID NO: 5879421 - DNA, 17 bp, Homo sapiens
cggactctcccaggcct

SEQ ID NO: 5879422 - DNA, 12 bp, Homo sapiens
cggactctgccc

SEQ ID NO: 5879423 - DNA, 14 bp, Homo sapiens
cggactctttgctg

SEQ ID NO: 5879424 - DNA, 17 bp, Homo sapiens
cggactgaggtgcctgc

SEQ ID NO: 5879425 - DNA, 21 bp, Homo sapiens
cggactgaggtgcctgctcag

SEQ ID NO: 5879426 - DNA, 16 bp, Homo sapiens
cggactggtgccctcc

SEQ ID NO: 5879427 - DNA, 15 bp, Homo sapiens
cggacttactgcctg

SEQ ID NO: 5879428 - DNA, 16 bp, Homo sapiens
cggacttagctgggag

SEQ ID NO: 5879429 - DNA, 13 bp, Homo sapiens
cggagaaactcat

SEQ ID NO: 5879430 - DNA, 13 bp, Homo sapiens
cggagaaactgag

SEQ ID NO: 5879431 - DNA, 15 bp, Homo sapiens
cggagaacatctgcc

SEQ ID NO: 5879432 - DNA, 18 bp, Homo sapiens
cggagaaccttgtgcctg

SEQ ID NO: 5879433 - DNA, 23 bp, Homo sapiens
cggagaagagctgttcacagcca

SEQ ID NO: 5879434 - DNA, 24 bp, Homo sapiens
cggagaagagctgttcacagccag

SEQ ID NO: 5879435 - DNA, 17 bp, Homo sapiens
cggagaaggccgctgcc

SEQ ID NO: 5879436 - DNA, 23 bp, Homo sapiens
cggagaagtgtgccttctctctc

SEQ ID NO: 5879437 - DNA, 21 bp, Homo sapiens
cggagacagaggaaagggctg

SEQ ID NO: 5879438 - DNA, 15 bp, Homo sapiens
cggagaccctgagtc

SEQ ID NO: 5879439 - DNA, 16 bp, Homo sapiens
cggagagaaaaaagaa

SEQ ID NO: 5879440 - DNA, 16 bp, Homo sapiens
cggagagagagagagg

SEQ ID NO: 5879441 - DNA, 22 bp, Homo sapiens
cggagagagagagaggaaggag

SEQ ID NO: 5879442 - DNA, 14 bp, Homo sapiens
cggagagagccaag

SEQ ID NO: 5879443 - DNA, 15 bp, Homo sapiens
cggagagagccaaga

SEQ ID NO: 5879444 - DNA, 16 bp, Homo sapiens
cggagagcagcagcac

SEQ ID NO: 5879445 - DNA, 17 bp, Homo sapiens
cggagagcagcagcacc

SEQ ID NO: 5879446 - DNA, 16 bp, Homo sapiens
cggagagctggtgact

SEQ ID NO: 5879447 - DNA, 19 bp, Homo sapiens
cggagaggaagagacactc

SEQ ID NO: 5879448 - DNA, 12 bp, Homo sapiens
cggagaggaccc

SEQ ID NO: 5879449 - DNA, 15 bp, Homo sapiens
cggagaggaccccat

SEQ ID NO: 5879450 - DNA, 12 bp, Homo sapiens
cggagaggagtt

SEQ ID NO: 5879451 - DNA, 16 bp, Homo sapiens
cggagaggagttcagg

SEQ ID NO: 5879452 - DNA, 21 bp, Homo sapiens
cggagaggctgtctggggcct

SEQ ID NO: 5879453 - DNA, 19 bp, Homo sapiens
cggagagggctagccctga

SEQ ID NO: 5879454 - DNA, 21 bp, Homo sapiens
cggagagggctagccctgagc

SEQ ID NO: 5879455 - DNA, 23 bp, Homo sapiens
cggagagggctagccctgagccc

SEQ ID NO: 5879456 - DNA, 14 bp, Homo sapiens
cggagaggtggccg

SEQ ID NO: 5879457 - DNA, 18 bp, Homo sapiens
cggagagtacagtgagcc

SEQ ID NO: 5879458 - DNA, 21 bp, Homo sapiens
cggagagtacagtgagccaag

SEQ ID NO: 5879459 - DNA, 14 bp, Homo sapiens
cggagagtgggggt

SEQ ID NO: 5879460 - DNA, 23 bp, Homo sapiens
cggagatgcttctaaggcatggt

SEQ ID NO: 5879461 - DNA, 19 bp, Homo sapiens
cggagattggacggcctga

SEQ ID NO: 5879462 - DNA, 19 bp, Homo sapiens
cggagcaagtttcatcagc

SEQ ID NO: 5879463 - DNA, 14 bp, Homo sapiens
cggagcacagccct

SEQ ID NO: 5879464 - DNA, 18 bp, Homo sapiens
cggagcacagccctggga

SEQ ID NO: 5879465 - DNA, 16 bp, Homo sapiens
cggagcactgtgcagc

SEQ ID NO: 5879466 - DNA, 22 bp, Homo sapiens
cggagcactgtgcagccgggga

SEQ ID NO: 5879467 - DNA, 16 bp, Homo sapiens
cggagcagcctccagt

SEQ ID NO: 5879468 - DNA, 20 bp, Homo sapiens
cggagcagcctccagtgctg

SEQ ID NO: 5879469 - DNA, 21 bp, Homo sapiens
cggagcagcctccagtgctgg

SEQ ID NO: 5879470 - DNA, 22 bp, Homo sapiens
cggagcagcctccagtgctggc

SEQ ID NO: 5879471 - DNA, 23 bp, Homo sapiens
cggagccaatgaacagctcctcc

SEQ ID NO: 5879472 - DNA, 11 bp, Homo sapiens
cggagccactc

SEQ ID NO: 5879473 - DNA, 17 bp, Homo sapiens
cggagccactcctctga

SEQ ID NO: 5879474 - DNA, 21 bp, Homo sapiens
cggagccactcctctgactca

SEQ ID NO: 5879475 - DNA, 16 bp, Homo sapiens
cggagccactggggtg

SEQ ID NO: 5879476 - DNA, 23 bp, Homo sapiens
cggagccactggggtgggagggg

SEQ ID NO: 5879477 - DNA, 18 bp, Homo sapiens
cggagccagcgcctgccc

SEQ ID NO: 5879478 - DNA, 20 bp, Homo sapiens
cggagccatgtcatgtgcca

SEQ ID NO: 5879479 - DNA, 19 bp, Homo sapiens
cggagcccacactgccacc

SEQ ID NO: 5879480 - DNA, 15 bp, Homo sapiens
cggagcccagcctgg

SEQ ID NO: 5879481 - DNA, 22 bp, Homo sapiens
cggagcccagcctgggagccca

SEQ ID NO: 5879482 - DNA, 17 bp, Homo sapiens
cggagccccaagactct

SEQ ID NO: 5879483 - DNA, 22 bp, Homo sapiens
cggagccccaagactctgctct

SEQ ID NO: 5879484 - DNA, 21 bp, Homo sapiens
cggagcccctgaaagcctcac

SEQ ID NO: 5879485 - DNA, 12 bp, Homo sapiens
cggagccctccc

SEQ ID NO: 5879486 - DNA, 18 bp, Homo sapiens
cggagccctccctatgtc

SEQ ID NO: 5879487 - DNA, 17 bp, Homo sapiens
cggagcccttggcccct

SEQ ID NO: 5879488 - DNA, 22 bp, Homo sapiens
cggagcccttggcccctcggac

SEQ ID NO: 5879489 - DNA, 16 bp, Homo sapiens
cggagccgagccatgt

SEQ ID NO: 5879490 - DNA, 17 bp, Homo sapiens
cggagccggcacctaca

SEQ ID NO: 5879491 - DNA, 20 bp, Homo sapiens
cggagccgggaaagaagagc

SEQ ID NO: 5879492 - DNA, 12 bp, Homo sapiens
cggagcctgcct

SEQ ID NO: 5879493 - DNA, 13 bp, Homo sapiens
cggagcctgcctc

SEQ ID NO: 5879494 - DNA, 16 bp, Homo sapiens
cggagcctgtgcagcc

SEQ ID NO: 5879495 - DNA, 21 bp, Homo sapiens
cggagcctgtgttagtgtctg

SEQ ID NO: 5879496 - DNA, 18 bp, Homo sapiens
cggagcgaccctggctct

SEQ ID NO: 5879497 - DNA, 22 bp, Homo sapiens
cggagcgaccctggctctgcca

SEQ ID NO: 5879498 - DNA, 14 bp, Homo sapiens
cggagcgcacctgc

SEQ ID NO: 5879499 - DNA, 16 bp, Homo sapiens
cggagcgccctgcagg

SEQ ID NO: 5879500 - DNA, 20 bp, Homo sapiens
cggagcgttctctgtcctac

SEQ ID NO: 5879501 - DNA, 17 bp, Homo sapiens
cggagctaacactggcc

SEQ ID NO: 5879502 - DNA, 21 bp, Homo sapiens
cggagctaacactggccccta

SEQ ID NO: 5879503 - DNA, 16 bp, Homo sapiens
cggagctccaggatgg

SEQ ID NO: 5879504 - DNA, 16 bp, Homo sapiens
cggagctccggcctgc

SEQ ID NO: 5879505 - DNA, 15 bp, Homo sapiens
cggagctcctggcag

SEQ ID NO: 5879506 - DNA, 12 bp, Homo sapiens
cggagctcctgt

SEQ ID NO: 5879507 - DNA, 14 bp, Homo sapiens
cggagctctggctt

SEQ ID NO: 5879508 - DNA, 19 bp, Homo sapiens
cggagctcttctgtgccct

SEQ ID NO: 5879509 - DNA, 19 bp, Homo sapiens
cggagctgcatggacgcct

SEQ ID NO: 5879510 - DNA, 21 bp, Homo sapiens
cggagctgcatggacgcctgg

SEQ ID NO: 5879511 - DNA, 23 bp, Homo sapiens
cggagctgcatggacgcctggct

SEQ ID NO: 5879512 - DNA, 20 bp, Homo sapiens
cggagctgcccctctctggg

SEQ ID NO: 5879513 - DNA, 13 bp, Homo sapiens
cggagctgcctgc

SEQ ID NO: 5879514 - DNA, 20 bp, Homo sapiens
cggagctgcctgcagcacat

SEQ ID NO: 5879515 - DNA, 19 bp, Homo sapiens
cggagctgctgagtgacag

SEQ ID NO: 5879516 - DNA, 16 bp, Homo sapiens
cggagctggcccaggg

SEQ ID NO: 5879517 - DNA, 20 bp, Homo sapiens
cggagctggggtctgggcag

SEQ ID NO: 5879518 - DNA, 20 bp, Homo sapiens
cggccccctccccccagact

SEQ ID NO: 5879519 - DNA, 16 bp, Homo sapiens
cggcccccttcctggc

SEQ ID NO: 5879520 - DNA, 20 bp, Homo sapiens
cggcccccttcctggcccct

SEQ ID NO: 5879521 - DNA, 16 bp, Homo sapiens
cggccccgcacccctc

SEQ ID NO: 5879522 - DNA, 18 bp, Homo sapiens
cggccccgcgcgtgcccc

SEQ ID NO: 5879523 - DNA, 14 bp, Homo sapiens
cggccccggcccca

SEQ ID NO: 5879524 - DNA, 19 bp, Homo sapiens
cggccccggccccagccag

SEQ ID NO: 5879525 - DNA, 22 bp, Homo sapiens
cggccccgtctctcttggaccc

SEQ ID NO: 5879526 - DNA, 23 bp, Homo sapiens
cggccccgtctctcttggaccca

SEQ ID NO: 5879527 - DNA, 17 bp, Homo sapiens
cggccccgtctgtggct

SEQ ID NO: 5879528 - DNA, 21 bp, Homo sapiens
cggcccctaccagccacgggc

SEQ ID NO: 5879529 - DNA, 13 bp, Homo sapiens
cggcccctcagcc

SEQ ID NO: 5879530 - DNA, 16 bp, Homo sapiens
cggcccctcagcctgc

SEQ ID NO: 5879531 - DNA, 17 bp, Homo sapiens
cggcccctcagcctgcc

SEQ ID NO: 5879532 - DNA, 14 bp, Homo sapiens
cggcccctccccct

SEQ ID NO: 5879533 - DNA, 18 bp, Homo sapiens
cggcccctgctggttcag

SEQ ID NO: 5879534 - DNA, 14 bp, Homo sapiens
cggcccgcctctcc

SEQ ID NO: 5879535 - DNA, 17 bp, Homo sapiens
cggcccgcctctcctcg

SEQ ID NO: 5879536 - DNA, 13 bp, Homo sapiens
cggcccgcctgcc

SEQ ID NO: 5879537 - DNA, 20 bp, Homo sapiens
cggcccggagcagcaggaag

SEQ ID NO: 5879538 - DNA, 17 bp, Homo sapiens
cggcccggcccacgcag

SEQ ID NO: 5879539 - DNA, 20 bp, Homo sapiens
cggcccggcccacgcagagc

SEQ ID NO: 5879540 - DNA, 13 bp, Homo sapiens
cggcccggcccct

SEQ ID NO: 5879541 - DNA, 15 bp, Homo sapiens
cggcccggcccctca

SEQ ID NO: 5879542 - DNA, 15 bp, Homo sapiens
cggcccggccggagg

SEQ ID NO: 5879543 - DNA, 21 bp, Homo sapiens
cggcccggccggagggcagga

SEQ ID NO: 5879544 - DNA, 17 bp, Homo sapiens
cggcccggctgagccct

SEQ ID NO: 5879545 - DNA, 16 bp, Homo sapiens
cggcccgtgcgcagcc

SEQ ID NO: 5879546 - DNA, 15 bp, Homo sapiens
cggccctaagccact

SEQ ID NO: 5879547 - DNA, 12 bp, Homo sapiens
cggccctaaggg

SEQ ID NO: 5879548 - DNA, 14 bp, Homo sapiens
cggccctatgcatg

SEQ ID NO: 5879549 - DNA, 18 bp, Homo sapiens
cggccctcaaaagcactt

SEQ ID NO: 5879550 - DNA, 17 bp, Homo sapiens
cggccctcactaagccc

SEQ ID NO: 5879551 - DNA, 13 bp, Homo sapiens
cggccctcagtgc

SEQ ID NO: 5879552 - DNA, 13 bp, Homo sapiens
cggccctccagag

SEQ ID NO: 5879553 - DNA, 16 bp, Homo sapiens
cggccctccagagccc

SEQ ID NO: 5879554 - DNA, 19 bp, Homo sapiens
cggccctcccccagctcct

SEQ ID NO: 5879555 - DNA, 14 bp, Homo sapiens
cggccctccctgcg

SEQ ID NO: 5879556 - DNA, 19 bp, Homo sapiens
cggccctccctgcgcttcc

SEQ ID NO: 5879557 - DNA, 20 bp, Homo sapiens
cggccctcctaccctgcgcc

SEQ ID NO: 5879558 - DNA, 14 bp, Homo sapiens
cggccctgaaccac

SEQ ID NO: 5879559 - DNA, 22 bp, Homo sapiens
cggccctgatctccgcagaggc

SEQ ID NO: 5879560 - DNA, 12 bp, Homo sapiens
cggccctgcaat

SEQ ID NO: 5879561 - DNA, 22 bp, Homo sapiens
cggccctgcaatgtatcccttc

SEQ ID NO: 5879562 - DNA, 19 bp, Homo sapiens
cggccctgccccatcctgg

SEQ ID NO: 5879563 - DNA, 17 bp, Homo sapiens
cggccctgcccctccct

SEQ ID NO: 5879564 - DNA, 18 bp, Homo sapiens
cggccctgcctgcctctt

SEQ ID NO: 5879565 - DNA, 12 bp, Homo sapiens
cggccctgctga

SEQ ID NO: 5879566 - DNA, 15 bp, Homo sapiens
cggccctgctggggc

SEQ ID NO: 5879567 - DNA, 12 bp, Homo sapiens
cggccctggagg

SEQ ID NO: 5879568 - DNA, 13 bp, Homo sapiens
cggccctgggctc

SEQ ID NO: 5879569 - DNA, 18 bp, Homo sapiens
cggccctgggctcggagg

SEQ ID NO: 5879570 - DNA, 22 bp, Homo sapiens
cggccctgggctcggaggctgc

SEQ ID NO: 5879571 - DNA, 16 bp, Homo sapiens
cggccctgtagccctg

SEQ ID NO: 5879572 - DNA, 23 bp, Homo sapiens
cggccctgtagccctggcccggt

SEQ ID NO: 5879573 - DNA, 20 bp, Homo sapiens
cggccctgtcagagccgcca

SEQ ID NO: 5879574 - DNA, 15 bp, Homo sapiens
cggccctgtcccctg

SEQ ID NO: 5879575 - DNA, 21 bp, Homo sapiens
cggcccttacctttcctgatg

SEQ ID NO: 5879576 - DNA, 18 bp, Homo sapiens
cggcccttctgactgttt

SEQ ID NO: 5879577 - DNA, 15 bp, Homo sapiens
cggccgaccaggctg

SEQ ID NO: 5879578 - DNA, 16 bp, Homo sapiens
cggccgaccaggctgg

SEQ ID NO: 5879579 - DNA, 22 bp, Homo sapiens
cggccgatgggagtctccctcc

SEQ ID NO: 5879580 - DNA, 14 bp, Homo sapiens
cggccgcactggga

SEQ ID NO: 5879581 - DNA, 16 bp, Homo sapiens
cggccgcactgggagc

SEQ ID NO: 5879582 - DNA, 15 bp, Homo sapiens
cggccgcagccccca

SEQ ID NO: 5879583 - DNA, 16 bp, Homo sapiens
cggccgcagcccccac

SEQ ID NO: 5879584 - DNA, 20 bp, Homo sapiens
cggccgcagcccccactgac

SEQ ID NO: 5879585 - DNA, 22 bp, Homo sapiens
cggccgcatgtctgcatggcag

SEQ ID NO: 5879586 - DNA, 15 bp, Homo sapiens
cggccgcattccctg

SEQ ID NO: 5879587 - DNA, 16 bp, Homo sapiens
cggccgcccagacacc

SEQ ID NO: 5879588 - DNA, 21 bp, Homo sapiens
cggccgccccgccccagagct

SEQ ID NO: 5879589 - DNA, 16 bp, Homo sapiens
cggccgcccggcagtg

SEQ ID NO: 5879590 - DNA, 17 bp, Homo sapiens
cggccgcccggcagtgc

SEQ ID NO: 5879591 - DNA, 13 bp, Homo sapiens
cggccgctctccg

SEQ ID NO: 5879592 - DNA, 15 bp, Homo sapiens
cggccggacctctga

SEQ ID NO: 5879593 - DNA, 16 bp, Homo sapiens
cggccggacctctgag

SEQ ID NO: 5879594 - DNA, 14 bp, Homo sapiens
cggccggccagccc

SEQ ID NO: 5879595 - DNA, 23 bp, Homo sapiens
cggccggccagcccctggcccca

SEQ ID NO: 5879596 - DNA, 13 bp, Homo sapiens
cggccggccctgg

SEQ ID NO: 5879597 - DNA, 21 bp, Homo sapiens
cggccggccgcactgggagca

SEQ ID NO: 5879598 - DNA, 16 bp, Homo sapiens
cggccggccggacctc

SEQ ID NO: 5879599 - DNA, 13 bp, Homo sapiens
cggccggcctggc

SEQ ID NO: 5879600 - DNA, 15 bp, Homo sapiens
cggccgtccctgact

SEQ ID NO: 5879601 - DNA, 22 bp, Homo sapiens
cggccgtctgctctcaaggatg

SEQ ID NO: 5879602 - DNA, 14 bp, Homo sapiens
cggcctaggcacct

SEQ ID NO: 5879603 - DNA, 17 bp, Homo sapiens
cggcctatgacttgggc

SEQ ID NO: 5879604 - DNA, 15 bp, Homo sapiens
cggcctcagggcgct

SEQ ID NO: 5879605 - DNA, 14 bp, Homo sapiens
cggcctccacatga

SEQ ID NO: 5879606 - DNA, 13 bp, Homo sapiens
cggcctccaggct

SEQ ID NO: 5879607 - DNA, 16 bp, Homo sapiens
cggcctccaggctggg

SEQ ID NO: 5879608 - DNA, 12 bp, Homo sapiens
cggcctccatcc

SEQ ID NO: 5879609 - DNA, 17 bp, Homo sapiens
cggcctccatcctgagg

SEQ ID NO: 5879610 - DNA, 20 bp, Homo sapiens
cggcctcccaaagtgctggg

SEQ ID NO: 5879611 - DNA, 18 bp, Homo sapiens
cggcctcccacagtgctg

SEQ ID NO: 5879612 - DNA, 14 bp, Homo sapiens
cggcctcccagagt

SEQ ID NO: 5879613 - DNA, 14 bp, Homo sapiens
cggcctccccgagg

SEQ ID NO: 5879614 - DNA, 18 bp, Homo sapiens
cggcctcccgaggagggg

SEQ ID NO: 5879615 - DNA, 16 bp, Homo sapiens
cggcctccgaggctcc

SEQ ID NO: 5879616 - DNA, 21 bp, Homo sapiens
cggcctccgaggctccccgcc

SEQ ID NO: 5879617 - DNA, 17 bp, Homo sapiens
cggcctcctcctcaccc

SEQ ID NO: 5879618 - DNA, 17 bp, Homo sapiens
cggcctcctcggagagc

SEQ ID NO: 5879619 - DNA, 22 bp, Homo sapiens
cggcctcctcggagagcagcag

SEQ ID NO: 5879620 - DNA, 23 bp, Homo sapiens
cggcctcctcttcaccccggcag

SEQ ID NO: 5879621 - DNA, 15 bp, Homo sapiens
cggcctctaacccca

SEQ ID NO: 5879622 - DNA, 16 bp, Homo sapiens
cggcctctccctgcct

SEQ ID NO: 5879623 - DNA, 13 bp, Homo sapiens
cggcctctctggc

SEQ ID NO: 5879624 - DNA, 21 bp, Homo sapiens
cggcctctctggcctcccacc

SEQ ID NO: 5879625 - DNA, 13 bp, Homo sapiens
cggcctctgcctt

SEQ ID NO: 5879626 - DNA, 16 bp, Homo sapiens
cggcctctgctgcccc

SEQ ID NO: 5879627 - DNA, 17 bp, Homo sapiens
cggcctctgctgccccc

SEQ ID NO: 5879628 - DNA, 18 bp, Homo sapiens
cggcctctgctgccccct

SEQ ID NO: 5879629 - DNA, 14 bp, Homo sapiens
cggcctctggggag

SEQ ID NO: 5879630 - DNA, 12 bp, Homo sapiens
cggcctcttcca

SEQ ID NO: 5879631 - DNA, 17 bp, Homo sapiens
cggcctgatgctccctc

SEQ ID NO: 5879632 - DNA, 19 bp, Homo sapiens
cggcctgatgctccctccc

SEQ ID NO: 5879633 - DNA, 22 bp, Homo sapiens
cggcctgcaccgacccgaggcc

SEQ ID NO: 5879634 - DNA, 23 bp, Homo sapiens
cggcctgcaccgacccgaggccc

SEQ ID NO: 5879635 - DNA, 12 bp, Homo sapiens
cggcctgcagcc

SEQ ID NO: 5879636 - DNA, 13 bp, Homo sapiens
cggcctgcagccc

SEQ ID NO: 5879637 - DNA, 15 bp, Homo sapiens
cggcctgcagcccag

SEQ ID NO: 5879638 - DNA, 16 bp, Homo sapiens
cggcctgcagtggtgt

SEQ ID NO: 5879639 - DNA, 13 bp, Homo sapiens
cggcctgccagga

SEQ ID NO: 5879640 - DNA, 20 bp, Homo sapiens
cggcctgcccccaccccatt

SEQ ID NO: 5879641 - DNA, 14 bp, Homo sapiens
cggcctgcgtctcc

SEQ ID NO: 5879642 - DNA, 18 bp, Homo sapiens
cggcctgctcccagcagc

SEQ ID NO: 5879643 - DNA, 15 bp, Homo sapiens
cggcctggatgccag

SEQ ID NO: 5879644 - DNA, 20 bp, Homo sapiens
cggcctggatgccagctgtg

SEQ ID NO: 5879645 - DNA, 21 bp, Homo sapiens
cggcctggatgccagctgtgt

SEQ ID NO: 5879646 - DNA, 22 bp, Homo sapiens
cggcctggcatgcagcttgtcc

SEQ ID NO: 5879647 - DNA, 15 bp, Homo sapiens
cggcctggccccctc

SEQ ID NO: 5879648 - DNA, 16 bp, Homo sapiens
cggcctggccccctcg

SEQ ID NO: 5879649 - DNA, 13 bp, Homo sapiens
cggcctggctcct

SEQ ID NO: 5879650 - DNA, 16 bp, Homo sapiens
cggcctggcttcaccg

SEQ ID NO: 5879651 - DNA, 12 bp, Homo sapiens
cggcctgggagg

SEQ ID NO: 5879652 - DNA, 21 bp, Homo sapiens
cggcctggggccgggctggct

SEQ ID NO: 5879653 - DNA, 22 bp, Homo sapiens
cggcctggggccgggctggctt

SEQ ID NO: 5879654 - DNA, 15 bp, Homo sapiens
cggcctgggtgacag

SEQ ID NO: 5879655 - DNA, 15 bp, Homo sapiens
cggcctggtgttctg

SEQ ID NO: 5879656 - DNA, 21 bp, Homo sapiens
cggcctgtcctccaacaccaa

SEQ ID NO: 5879657 - DNA, 22 bp, Homo sapiens
cggcctgtgcgttcccttcagt

SEQ ID NO: 5879658 - DNA, 19 bp, Homo sapiens
cggcctgtgggtctctgaa

SEQ ID NO: 5879659 - DNA, 21 bp, Homo sapiens
cggcctgtgggtttgggtgcc

SEQ ID NO: 5879660 - DNA, 13 bp, Homo sapiens
cggcctgtgtccc

SEQ ID NO: 5879661 - DNA, 14 bp, Homo sapiens
cggccttcgacctg

SEQ ID NO: 5879662 - DNA, 13 bp, Homo sapiens
cggccttcttggt

SEQ ID NO: 5879663 - DNA, 16 bp, Homo sapiens
cggccttcttggtttc

SEQ ID NO: 5879664 - DNA, 11 bp, Homo sapiens
cggccttgctt

SEQ ID NO: 5879665 - DNA, 22 bp, Homo sapiens
cggccttggccttggggccaga

SEQ ID NO: 5879666 - DNA, 24 bp, Homo sapiens
cggccttggccttggggccagact

SEQ ID NO: 5879667 - DNA, 20 bp, Homo sapiens
cggccttgtctgggtgcagc

SEQ ID NO: 5879668 - DNA, 20 bp, Homo sapiens
cggcgacggagcactgcacc

SEQ ID NO: 5879669 - DNA, 22 bp, Homo sapiens
cggcgagggggccggggggagg

SEQ ID NO: 5879670 - DNA, 16 bp, Homo sapiens
cggcgcagagccctcc

SEQ ID NO: 5879671 - DNA, 23 bp, Homo sapiens
cggcgcagagccctccaggcctg

SEQ ID NO: 5879672 - DNA, 15 bp, Homo sapiens
cggcgcagcccctgg

SEQ ID NO: 5879673 - DNA, 15 bp, Homo sapiens
cggcgccaccatcct

SEQ ID NO: 5879674 - DNA, 18 bp, Homo sapiens
cggcgcccctgccacctc

SEQ ID NO: 5879675 - DNA, 20 bp, Homo sapiens
cggcgcctccgcccaaatca

SEQ ID NO: 5879676 - DNA, 14 bp, Homo sapiens
cggcgcctgccctg

SEQ ID NO: 5879677 - DNA, 19 bp, Homo sapiens
cggcgcctgccctgcccaa

SEQ ID NO: 5879678 - DNA, 16 bp, Homo sapiens
cggcgcctggcctcca

SEQ ID NO: 5879679 - DNA, 18 bp, Homo sapiens
cggcgcctggcctccagg

SEQ ID NO: 5879680 - DNA, 19 bp, Homo sapiens
cggcgccttctacctgcag

SEQ ID NO: 5879681 - DNA, 22 bp, Homo sapiens
cggcgcgctcttcgcgcccgcc

SEQ ID NO: 5879682 - DNA, 20 bp, Homo sapiens
cggcgcggtggctcacgcct

SEQ ID NO: 5879683 - DNA, 13 bp, Homo sapiens
cggcgctgcaggt

SEQ ID NO: 5879684 - DNA, 19 bp, Homo sapiens
cggcggagctggccccgcc

SEQ ID NO: 5879685 - DNA, 19 bp, Homo sapiens
cggcggcacccaggcctcc

SEQ ID NO: 5879686 - DNA, 14 bp, Homo sapiens
cggcggccaggcac

SEQ ID NO: 5879687 - DNA, 20 bp, Homo sapiens
cggcggccaggcacagggcc

SEQ ID NO: 5879688 - DNA, 17 bp, Homo sapiens
cggcggcccctagcgct

SEQ ID NO: 5879689 - DNA, 12 bp, Homo sapiens
cggcggcgccgg

SEQ ID NO: 5879690 - DNA, 18 bp, Homo sapiens
cggcggcttcgcgctgga

SEQ ID NO: 5879691 - DNA, 23 bp, Homo sapiens
cggcgggcttttctggggcccag

SEQ ID NO: 5879692 - DNA, 15 bp, Homo sapiens
cggcggtagcagctg

SEQ ID NO: 5879693 - DNA, 12 bp, Homo sapiens
cggcggtgggcg

SEQ ID NO: 5879694 - DNA, 15 bp, Homo sapiens
cggcgtacaggctgg

SEQ ID NO: 5879695 - DNA, 19 bp, Homo sapiens
cggcgtccctgagggccct

SEQ ID NO: 5879696 - DNA, 23 bp, Homo sapiens
cggcgtccctgagggcccttccc

SEQ ID NO: 5879697 - DNA, 21 bp, Homo sapiens
cgggcagcccctgctggacca

SEQ ID NO: 5879698 - DNA, 13 bp, Homo sapiens
cgggcagcctggc

SEQ ID NO: 5879699 - DNA, 16 bp, Homo sapiens
cgggcagcctggctcc

SEQ ID NO: 5879700 - DNA, 23 bp, Homo sapiens
cgggcagcctggctcccaggaca

SEQ ID NO: 5879701 - DNA, 15 bp, Homo sapiens
cgggcagcgggccag

SEQ ID NO: 5879702 - DNA, 17 bp, Homo sapiens
cgggcagggctcccaca

SEQ ID NO: 5879703 - DNA, 18 bp, Homo sapiens
cgggcagggggacagcag

SEQ ID NO: 5879704 - DNA, 23 bp, Homo sapiens
cgggcaggtcagcgcggtcctga

SEQ ID NO: 5879705 - DNA, 16 bp, Homo sapiens
cgggcagtcgctgcag

SEQ ID NO: 5879706 - DNA, 17 bp, Homo sapiens
cgggcagtcgctgcagg

SEQ ID NO: 5879707 - DNA, 22 bp, Homo sapiens
cgggcagtgacgtgagtgggga

SEQ ID NO: 5879708 - DNA, 19 bp, Homo sapiens
cgggcagtggaggctgctg

SEQ ID NO: 5879709 - DNA, 21 bp, Homo sapiens
cgggcagtggaggctgctgtg

SEQ ID NO: 5879710 - DNA, 15 bp, Homo sapiens
cgggcatcattctct

SEQ ID NO: 5879711 - DNA, 15 bp, Homo sapiens
cgggcatcgcaggag

SEQ ID NO: 5879712 - DNA, 15 bp, Homo sapiens
cgggcatgacacgaa

SEQ ID NO: 5879713 - DNA, 17 bp, Homo sapiens
cgggcatgggcactccc

SEQ ID NO: 5879714 - DNA, 17 bp, Homo sapiens
cgggcatgggcctctct

SEQ ID NO: 5879715 - DNA, 21 bp, Homo sapiens
cgggcatgggcctctctgggg

SEQ ID NO: 5879716 - DNA, 21 bp, Homo sapiens
cgggcatggtggcgcaagcct

SEQ ID NO: 5879717 - DNA, 20 bp, Homo sapiens
cgggcatggtggctcatgcc

SEQ ID NO: 5879718 - DNA, 14 bp, Homo sapiens
cgggcattcacaac

SEQ ID NO: 5879719 - DNA, 17 bp, Homo sapiens
cgggccaagacagatgg

SEQ ID NO: 5879720 - DNA, 14 bp, Homo sapiens
cgggccaaggactg

SEQ ID NO: 5879721 - DNA, 20 bp, Homo sapiens
cgggccaaggactgccgacc

SEQ ID NO: 5879722 - DNA, 17 bp, Homo sapiens
cgggccaagtgaagaat

SEQ ID NO: 5879723 - DNA, 23 bp, Homo sapiens
cgggccacacgtggctggcggcc

SEQ ID NO: 5879724 - DNA, 17 bp, Homo sapiens
cgggccacagagaaagt

SEQ ID NO: 5879725 - DNA, 18 bp, Homo sapiens
cgggccacgccccagccc

SEQ ID NO: 5879726 - DNA, 15 bp, Homo sapiens
cgggccagccaggcg

SEQ ID NO: 5879727 - DNA, 17 bp, Homo sapiens
cgggccagccaggcggg

SEQ ID NO: 5879728 - DNA, 12 bp, Homo sapiens
cgggccaggcag

SEQ ID NO: 5879729 - DNA, 17 bp, Homo sapiens
cgggccagggctgcccc

SEQ ID NO: 5879730 - DNA, 13 bp, Homo sapiens
cgggccagggtgg

SEQ ID NO: 5879731 - DNA, 23 bp, Homo sapiens
cgggccagtttctctgccttctt

SEQ ID NO: 5879732 - DNA, 19 bp, Homo sapiens
cgggcccacctggccacct

SEQ ID NO: 5879733 - DNA, 12 bp, Homo sapiens
cgggcccactca

SEQ ID NO: 5879734 - DNA, 14 bp, Homo sapiens
cgggcccagcactt

SEQ ID NO: 5879735 - DNA, 13 bp, Homo sapiens
cgggcccaggcag

SEQ ID NO: 5879736 - DNA, 13 bp, Homo sapiens
cgggcccaggcct

SEQ ID NO: 5879737 - DNA, 19 bp, Homo sapiens
cgggccccatggtcacaga

SEQ ID NO: 5879738 - DNA, 14 bp, Homo sapiens
cgggcccccaccgc

SEQ ID NO: 5879739 - DNA, 17 bp, Homo sapiens
cgggcccctcacctggt

SEQ ID NO: 5879740 - DNA, 20 bp, Homo sapiens
cgggcccctctctagggacc

SEQ ID NO: 5879741 - DNA, 21 bp, Homo sapiens
cgggcccctctctagggaccc

SEQ ID NO: 5879742 - DNA, 11 bp, Homo sapiens
cgggcccctgc

SEQ ID NO: 5879743 - DNA, 17 bp, Homo sapiens
cgggcccctgcctgcct

SEQ ID NO: 5879744 - DNA, 20 bp, Homo sapiens
cgggcccctgcctgccttct

SEQ ID NO: 5879745 - DNA, 23 bp, Homo sapiens
cgggcccctgggcttggcctgct

SEQ ID NO: 5879746 - DNA, 23 bp, Homo sapiens
cgggcccgcactcaggagcacag

SEQ ID NO: 5879747 - DNA, 17 bp, Homo sapiens
cgggcccgctcaacctc

SEQ ID NO: 5879748 - DNA, 17 bp, Homo sapiens
cgggcccgggcccccgc

SEQ ID NO: 5879749 - DNA, 18 bp, Homo sapiens
cgggcccgggcccccgcc

SEQ ID NO: 5879750 - DNA, 18 bp, Homo sapiens
cgggcccgttgaggatga

SEQ ID NO: 5879751 - DNA, 14 bp, Homo sapiens
cgggccctcagccc

SEQ ID NO: 5879752 - DNA, 13 bp, Homo sapiens
cgggccctccctc

SEQ ID NO: 5879753 - DNA, 18 bp, Homo sapiens
cgggccctctctccgccc

SEQ ID NO: 5879754 - DNA, 11 bp, Homo sapiens
cgggccctgcc

SEQ ID NO: 5879755 - DNA, 18 bp, Homo sapiens
cgggccctgccccagccc

SEQ ID NO: 5879756 - DNA, 15 bp, Homo sapiens
cgggccctgcctgag

SEQ ID NO: 5879757 - DNA, 16 bp, Homo sapiens
cgggccctgcctgagg

SEQ ID NO: 5879758 - DNA, 20 bp, Homo sapiens
cgggccctgcctgagggtgg

SEQ ID NO: 5879759 - DNA, 23 bp, Homo sapiens
cgggccctgctgaggaggggcct

SEQ ID NO: 5879760 - DNA, 15 bp, Homo sapiens
cgggccctgggttcc

SEQ ID NO: 5879761 - DNA, 20 bp, Homo sapiens
cgggccctgtggtgctggga

SEQ ID NO: 5879762 - DNA, 21 bp, Homo sapiens
cgggcccttcttgctgccctg

SEQ ID NO: 5879763 - DNA, 23 bp, Homo sapiens
cgggcccttcttgctgccctgcc

SEQ ID NO: 5879764 - DNA, 17 bp, Homo sapiens
cgggccgaccctgcggc

SEQ ID NO: 5879765 - DNA, 16 bp, Homo sapiens
cgggccgaggcccagc

SEQ ID NO: 5879766 - DNA, 20 bp, Homo sapiens
cgggccgaggcccagcgggc

SEQ ID NO: 5879767 - DNA, 19 bp, Homo sapiens
cgggccgcaggagggaggc

SEQ ID NO: 5879768 - DNA, 20 bp, Homo sapiens
cgggccgcaggagggaggcg

SEQ ID NO: 5879769 - DNA, 22 bp, Homo sapiens
cgggccgcaggagggaggcggg

SEQ ID NO: 5879770 - DNA, 12 bp, Homo sapiens
cgggccgcctcc

SEQ ID NO: 5879771 - DNA, 18 bp, Homo sapiens
cgggccgcctcctccaga

SEQ ID NO: 5879772 - DNA, 14 bp, Homo sapiens
cgggccggccagct

SEQ ID NO: 5879773 - DNA, 23 bp, Homo sapiens
cgggccgtctcccttggcccaga

SEQ ID NO: 5879774 - DNA, 11 bp, Homo sapiens
cgggcctcagt

SEQ ID NO: 5879775 - DNA, 15 bp, Homo sapiens
cgggcctcagtgccc

SEQ ID NO: 5879776 - DNA, 16 bp, Homo sapiens
cgggcctcggcctggc

SEQ ID NO: 5879777 - DNA, 18 bp, Homo sapiens
cgggcctcggcctggctt

SEQ ID NO: 5879778 - DNA, 19 bp, Homo sapiens
cgggcctctgcttgccagc

SEQ ID NO: 5879779 - DNA, 20 bp, Homo sapiens
cgggcctctgcttgccagcc

SEQ ID NO: 5879780 - DNA, 18 bp, Homo sapiens
cgggcctcttccctcagt

SEQ ID NO: 5879781 - DNA, 12 bp, Homo sapiens
cgggcctgcaca

SEQ ID NO: 5879782 - DNA, 17 bp, Homo sapiens
cgggcctgcctctgact

SEQ ID NO: 5879783 - DNA, 15 bp, Homo sapiens
cgggcctgctgtcac

SEQ ID NO: 5879784 - DNA, 21 bp, Homo sapiens
cgggcctgctgtcacctcgct

SEQ ID NO: 5879785 - DNA, 21 bp, Homo sapiens
cgggcctggactgtcctaggt

SEQ ID NO: 5879786 - DNA, 20 bp, Homo sapiens
cgggcctggagaactagaga

SEQ ID NO: 5879787 - DNA, 13 bp, Homo sapiens
cgggcctgtacag

SEQ ID NO: 5879788 - DNA, 20 bp, Homo sapiens
cgggcctgtacagtctgtct

SEQ ID NO: 5879789 - DNA, 15 bp, Homo sapiens
cgggcctgtccacag

SEQ ID NO: 5879790 - DNA, 15 bp, Homo sapiens
cgggcctttttcctg

SEQ ID NO: 5879791 - DNA, 16 bp, Homo sapiens
cgggcgcactgcctct

SEQ ID NO: 5879792 - DNA, 22 bp, Homo sapiens
cgggcgcactgcctctcacagc

SEQ ID NO: 5879793 - DNA, 19 bp, Homo sapiens
cgggcgcatgcctcccagg

SEQ ID NO: 5879794 - DNA, 23 bp, Homo sapiens
cgggcgcatgcctcccaggccac

SEQ ID NO: 5879795 - DNA, 20 bp, Homo sapiens
cgggcgccaggacagcagca

SEQ ID NO: 5879796 - DNA, 22 bp, Homo sapiens
cgggcgcctgcgctcctctgca

SEQ ID NO: 5879797 - DNA, 23 bp, Homo sapiens
cgggcgcctgcgctcctctgcag

SEQ ID NO: 5879798 - DNA, 23 bp, Homo sapiens
cgggcgcctgtagtcccagccac

SEQ ID NO: 5879799 - DNA, 15 bp, Homo sapiens
cgggcgcgggacagg

SEQ ID NO: 5879800 - DNA, 19 bp, Homo sapiens
cgggcgcgggacaggactt

SEQ ID NO: 5879801 - DNA, 14 bp, Homo sapiens
cgggcgcgggcagc

SEQ ID NO: 5879802 - DNA, 18 bp, Homo sapiens
cgggcgcgggcagccacc

SEQ ID NO: 5879803 - DNA, 23 bp, Homo sapiens
cgggcgcgggcagccacccaagc

SEQ ID NO: 5879804 - DNA, 13 bp, Homo sapiens
cgggcgctgcagc

SEQ ID NO: 5879805 - DNA, 18 bp, Homo sapiens
cgggcgctgcagcctccc

SEQ ID NO: 5879806 - DNA, 13 bp, Homo sapiens
cgggcgctgctgg

SEQ ID NO: 5879807 - DNA, 13 bp, Homo sapiens
cgggcggagggag

SEQ ID NO: 5879808 - DNA, 23 bp, Homo sapiens
cgggcggaggggatccagccact

SEQ ID NO: 5879809 - DNA, 13 bp, Homo sapiens
cgggcggccaggc

SEQ ID NO: 5879810 - DNA, 21 bp, Homo sapiens
cgggcgtgggtctctggggac

SEQ ID NO: 5879811 - DNA, 22 bp, Homo sapiens
cgggcgttatgtaagtttctaa

SEQ ID NO: 5879812 - DNA, 20 bp, Homo sapiens
cgggctaacgggaggctggg

SEQ ID NO: 5879813 - DNA, 17 bp, Homo sapiens
cgggctaagtccagctc

SEQ ID NO: 5879814 - DNA, 12 bp, Homo sapiens
cgggctcacctt

SEQ ID NO: 5879815 - DNA, 22 bp, Homo sapiens
cgggctcaccttaaaggtcaag

SEQ ID NO: 5879816 - DNA, 11 bp, Homo sapiens
cgggctcagca

SEQ ID NO: 5879817 - DNA, 19 bp, Homo sapiens
cgggctcagcaaaagatgc

SEQ ID NO: 5879818 - DNA, 18 bp, Homo sapiens
cgggctcagggaccacag

SEQ ID NO: 5879819 - DNA, 19 bp, Homo sapiens
cgggctccagggagtgggg

SEQ ID NO: 5879820 - DNA, 21 bp, Homo sapiens
cgggctccagggagtggggag

SEQ ID NO: 5879821 - DNA, 19 bp, Homo sapiens
cgggctccatgcctctgga

SEQ ID NO: 5879822 - DNA, 12 bp, Homo sapiens
cgggctccctcc

SEQ ID NO: 5879823 - DNA, 22 bp, Homo sapiens
cgggctccctcctctggcaggc

SEQ ID NO: 5879824 - DNA, 22 bp, Homo sapiens
cgggctccgacttgtgcacagg

SEQ ID NO: 5879825 - DNA, 17 bp, Homo sapiens
cgggctcctgtgccctt

SEQ ID NO: 5879826 - DNA, 22 bp, Homo sapiens
cgggctccttcccctgcacctg

SEQ ID NO: 5879827 - DNA, 19 bp, Homo sapiens
cgggctcgaagaaaataat

SEQ ID NO: 5879828 - DNA, 22 bp, Homo sapiens
cgggctcggaggctacccgctg

SEQ ID NO: 5879829 - DNA, 15 bp, Homo sapiens
cgggctctctgctgt

SEQ ID NO: 5879830 - DNA, 14 bp, Homo sapiens
cgggctctggccac

SEQ ID NO: 5879831 - DNA, 15 bp, Homo sapiens
cgggctctggccacc

SEQ ID NO: 5879832 - DNA, 16 bp, Homo sapiens
cgggctctggccaccc

SEQ ID NO: 5879833 - DNA, 23 bp, Homo sapiens
cgggctctggccaccctggcccg

SEQ ID NO: 5879834 - DNA, 17 bp, Homo sapiens
cgggctgaggccagagt

SEQ ID NO: 5879835 - DNA, 20 bp, Homo sapiens
cgggctgagggcatctctga

SEQ ID NO: 5879836 - DNA, 14 bp, Homo sapiens
cgggctgagggcct

SEQ ID NO: 5879837 - DNA, 16 bp, Homo sapiens
cgggctgagggcctgc

SEQ ID NO: 5879838 - DNA, 15 bp, Homo sapiens
cgggctgccagccca

SEQ ID NO: 5879839 - DNA, 21 bp, Homo sapiens
cgggctgcccttcgctgccag

SEQ ID NO: 5879840 - DNA, 13 bp, Homo sapiens
cgggctgcctggg

SEQ ID NO: 5879841 - DNA, 13 bp, Homo sapiens
cgggctggagaaa

SEQ ID NO: 5879842 - DNA, 18 bp, Homo sapiens
cgggctggagaaagagct

SEQ ID NO: 5879843 - DNA, 16 bp, Homo sapiens
cgggctggccctgtgc

SEQ ID NO: 5879844 - DNA, 18 bp, Homo sapiens
cgggctggcgggcctttt

SEQ ID NO: 5879845 - DNA, 21 bp, Homo sapiens
cgggctggctgcttgcagcca

SEQ ID NO: 5879846 - DNA, 20 bp, Homo sapiens
cgggctgggcccctccagga

SEQ ID NO: 5879847 - DNA, 19 bp, Homo sapiens
cgggctgggggtagcctgg

SEQ ID NO: 5879848 - DNA, 16 bp, Homo sapiens
cgggctgtagatcagg

SEQ ID NO: 5879849 - DNA, 19 bp, Homo sapiens
cgggctgtagatcaggttt

SEQ ID NO: 5879850 - DNA, 20 bp, Homo sapiens
cgggctgtccgtgtgcctcc

SEQ ID NO: 5879851 - DNA, 23 bp, Homo sapiens
cgggctgtccgtgtgcctcctgt

SEQ ID NO: 5879852 - DNA, 13 bp, Homo sapiens
cgggctgtgcccg

SEQ ID NO: 5879853 - DNA, 21 bp, Homo sapiens
cgggctgttctggtggcccct

SEQ ID NO: 5879854 - DNA, 16 bp, Homo sapiens
cgggcttccctggcct

SEQ ID NO: 5879855 - DNA, 21 bp, Homo sapiens
cgggcttcccttctccccagc

SEQ ID NO: 5879856 - DNA, 14 bp, Homo sapiens
cgggcttctggagc

SEQ ID NO: 5879857 - DNA, 14 bp, Homo sapiens
cgggcttgcggtgg

SEQ ID NO: 5879858 - DNA, 17 bp, Homo sapiens
cgggcttgggccctgca

SEQ ID NO: 5879859 - DNA, 18 bp, Homo sapiens
cgggcttgggccctgcac

SEQ ID NO: 5879860 - DNA, 20 bp, Homo sapiens
cgggctttccagaaggccac

SEQ ID NO: 5879861 - DNA, 21 bp, Homo sapiens
cgggctttcccccaggcgcct

SEQ ID NO: 5879862 - DNA, 14 bp, Homo sapiens
cgggctttgtggca

SEQ ID NO: 5879863 - DNA, 17 bp, Homo sapiens
cggggaaaatgcatttt

SEQ ID NO: 5879864 - DNA, 15 bp, Homo sapiens
cggggaaacctatca

SEQ ID NO: 5879865 - DNA, 21 bp, Homo sapiens
cggggaacccagccctggggt

SEQ ID NO: 5879866 - DNA, 22 bp, Homo sapiens
cggggaactggccaagctgagg

SEQ ID NO: 5879867 - DNA, 20 bp, Homo sapiens
cggggaagagatccaaagac

SEQ ID NO: 5879868 - DNA, 20 bp, Homo sapiens
cggggaagctgccagcccag

SEQ ID NO: 5879869 - DNA, 15 bp, Homo sapiens
cggggaagctggctt

SEQ ID NO: 5879870 - DNA, 22 bp, Homo sapiens
cggggaaggtttttatgtgcct

SEQ ID NO: 5879871 - DNA, 17 bp, Homo sapiens
cggggacagaggcctgc

SEQ ID NO: 5879872 - DNA, 21 bp, Homo sapiens
cggggacagaggcctgcccgg

SEQ ID NO: 5879873 - DNA, 12 bp, Homo sapiens
cggtctgtgccc

SEQ ID NO: 5879874 - DNA, 14 bp, Homo sapiens
cggtctgtgcccct

SEQ ID NO: 5879875 - DNA, 13 bp, Homo sapiens
cggtctgtgcccg

SEQ ID NO: 5879876 - DNA, 14 bp, Homo sapiens
cggtgaaatccagg

SEQ ID NO: 5879877 - DNA, 16 bp, Homo sapiens
cggtgaatggctttgt

SEQ ID NO: 5879878 - DNA, 16 bp, Homo sapiens
cggtgacacaggtcag

SEQ ID NO: 5879879 - DNA, 21 bp, Homo sapiens
cggtgacacaggtcagggctc

SEQ ID NO: 5879880 - DNA, 22 bp, Homo sapiens
cggtgacacaggtcagggctca

SEQ ID NO: 5879881 - DNA, 16 bp, Homo sapiens
cggtgaccgcctcctg

SEQ ID NO: 5879882 - DNA, 21 bp, Homo sapiens
cggtgaccgcctcctgctctg

SEQ ID NO: 5879883 - DNA, 16 bp, Homo sapiens
cggtgagaactctgcc

SEQ ID NO: 5879884 - DNA, 13 bp, Homo sapiens
cggtgagactctg

SEQ ID NO: 5879885 - DNA, 13 bp, Homo sapiens
cggtgaggcaggg

SEQ ID NO: 5879886 - DNA, 17 bp, Homo sapiens
cggtgaggcaggggagt

SEQ ID NO: 5879887 - DNA, 11 bp, Homo sapiens
cggtgagggga

SEQ ID NO: 5879888 - DNA, 20 bp, Homo sapiens
cggtgaggggaggggcctcc

SEQ ID NO: 5879889 - DNA, 20 bp, Homo sapiens
cggtgcacaggcctctgcct

SEQ ID NO: 5879890 - DNA, 13 bp, Homo sapiens
cggtgcactggtc

SEQ ID NO: 5879891 - DNA, 21 bp, Homo sapiens
cggtgcagcggtggaaggagc

SEQ ID NO: 5879892 - DNA, 16 bp, Homo sapiens
cggtgcagtctgggtg

SEQ ID NO: 5879893 - DNA, 17 bp, Homo sapiens
cggtgcagtggcaaagg

SEQ ID NO: 5879894 - DNA, 18 bp, Homo sapiens
cggtgccaaacccagccc

SEQ ID NO: 5879895 - DNA, 14 bp, Homo sapiens
cggtgccaagggcc

SEQ ID NO: 5879896 - DNA, 18 bp, Homo sapiens
cggtgccaagggccccag

SEQ ID NO: 5879897 - DNA, 13 bp, Homo sapiens
cggtgccagctgc

SEQ ID NO: 5879898 - DNA, 16 bp, Homo sapiens
cggtgccagctgccct

SEQ ID NO: 5879899 - DNA, 23 bp, Homo sapiens
cggtgcccaagccagaggctggg

SEQ ID NO: 5879900 - DNA, 15 bp, Homo sapiens
cggtgccctgtgtcc

SEQ ID NO: 5879901 - DNA, 14 bp, Homo sapiens
cggtgccgcgctcc

SEQ ID NO: 5879902 - DNA, 11 bp, Homo sapiens
cggtgcctggc

SEQ ID NO: 5879903 - DNA, 17 bp, Homo sapiens
cggtgcctgggtggcca

SEQ ID NO: 5879904 - DNA, 19 bp, Homo sapiens
cggtgcctgggtggggctg

SEQ ID NO: 5879905 - DNA, 13 bp, Homo sapiens
cggtgccttccac

SEQ ID NO: 5879906 - DNA, 16 bp, Homo sapiens
cggtgccttccaccct

SEQ ID NO: 5879907 - DNA, 19 bp, Homo sapiens
cggtgccttccaccctgcc

SEQ ID NO: 5879908 - DNA, 21 bp, Homo sapiens
cggtgccttccaccctgccct

SEQ ID NO: 5879909 - DNA, 22 bp, Homo sapiens
cggtgccttttttcacggaagt

SEQ ID NO: 5879910 - DNA, 17 bp, Homo sapiens
cggtgcggcagggaaga

SEQ ID NO: 5879911 - DNA, 18 bp, Homo sapiens
cggtgctaaaaatgaaaa

SEQ ID NO: 5879912 - DNA, 19 bp, Homo sapiens
cggtgctaaaaatgaaaat

SEQ ID NO: 5879913 - DNA, 20 bp, Homo sapiens
cggtgctatctcccccagcc

SEQ ID NO: 5879914 - DNA, 13 bp, Homo sapiens
cggtgctcagggg

SEQ ID NO: 5879915 - DNA, 13 bp, Homo sapiens
cggtgctccaggc

SEQ ID NO: 5879916 - DNA, 16 bp, Homo sapiens
cggtgctccaggcagg

SEQ ID NO: 5879917 - DNA, 16 bp, Homo sapiens
cggtgctccatctccg

SEQ ID NO: 5879918 - DNA, 18 bp, Homo sapiens
cggtgctcggagaagagc

SEQ ID NO: 5879919 - DNA, 21 bp, Homo sapiens
cggtgctgactgaggcctgct

SEQ ID NO: 5879920 - DNA, 13 bp, Homo sapiens
cggtgctgcagga

SEQ ID NO: 5879921 - DNA, 14 bp, Homo sapiens
cggtgctgcaggag

SEQ ID NO: 5879922 - DNA, 17 bp, Homo sapiens
cggtgctgggggcacag

SEQ ID NO: 5879923 - DNA, 16 bp, Homo sapiens
cggtgctgggttccca

SEQ ID NO: 5879924 - DNA, 19 bp, Homo sapiens
cggtgctgggttcccactc

SEQ ID NO: 5879925 - DNA, 16 bp, Homo sapiens
cggtgctgtcctcagg

SEQ ID NO: 5879926 - DNA, 17 bp, Homo sapiens
cggtgctgtcctcaggt

SEQ ID NO: 5879927 - DNA, 21 bp, Homo sapiens
cggtgctgtcctcaggtggcc

SEQ ID NO: 5879928 - DNA, 18 bp, Homo sapiens
cggtgctgtgagggaggg

SEQ ID NO: 5879929 - DNA, 16 bp, Homo sapiens
cggtgcttctggaaac

SEQ ID NO: 5879930 - DNA, 19 bp, Homo sapiens
cggtggaaggagcctgcgg

SEQ ID NO: 5879931 - DNA, 15 bp, Homo sapiens
cggtggaggcagagg

SEQ ID NO: 5879932 - DNA, 14 bp, Homo sapiens
cggtggaggccagg

SEQ ID NO: 5879933 - DNA, 14 bp, Homo sapiens
cggtggcagtaggg

SEQ ID NO: 5879934 - DNA, 18 bp, Homo sapiens
cggtggcatttgctgaat

SEQ ID NO: 5879935 - DNA, 14 bp, Homo sapiens
cggtggccacagcg

SEQ ID NO: 5879936 - DNA, 14 bp, Homo sapiens
cggtggccctgtcc

SEQ ID NO: 5879937 - DNA, 12 bp, Homo sapiens
cggtggccttga

SEQ ID NO: 5879938 - DNA, 13 bp, Homo sapiens
cggtggccttgag

SEQ ID NO: 5879939 - DNA, 17 bp, Homo sapiens
cggtggcggccccagca

SEQ ID NO: 5879940 - DNA, 20 bp, Homo sapiens
cggtggctcacacctgtaat

SEQ ID NO: 5879941 - DNA, 22 bp, Homo sapiens
cggtggctcacgcctgtaatcc

SEQ ID NO: 5879942 - DNA, 14 bp, Homo sapiens
cggtggctctgggg

SEQ ID NO: 5879943 - DNA, 15 bp, Homo sapiens
cggtggctgcacaga

SEQ ID NO: 5879944 - DNA, 13 bp, Homo sapiens
cggtggctgggca

SEQ ID NO: 5879945 - DNA, 14 bp, Homo sapiens
cggtggctgggcag

SEQ ID NO: 5879946 - DNA, 20 bp, Homo sapiens
cggtgggacagccccagggc

SEQ ID NO: 5879947 - DNA, 21 bp, Homo sapiens
cggtgggagccgtcagcctgt

SEQ ID NO: 5879948 - DNA, 15 bp, Homo sapiens
cggtgggcacccacc

SEQ ID NO: 5879949 - DNA, 23 bp, Homo sapiens
cggtgggcacccaccctgggacc

SEQ ID NO: 5879950 - DNA, 14 bp, Homo sapiens
cggtgggcagccat

SEQ ID NO: 5879951 - DNA, 14 bp, Homo sapiens
cggtgggccagagc

SEQ ID NO: 5879952 - DNA, 12 bp, Homo sapiens
cggtgggcctgg

SEQ ID NO: 5879953 - DNA, 19 bp, Homo sapiens
cggtgggccttgtcccctg

SEQ ID NO: 5879954 - DNA, 11 bp, Homo sapiens
cggtgggggta

SEQ ID NO: 5879955 - DNA, 19 bp, Homo sapiens
cggtgggggtagggggctg

SEQ ID NO: 5879956 - DNA, 15 bp, Homo sapiens
cggtggtgaggcagt

SEQ ID NO: 5879957 - DNA, 14 bp, Homo sapiens
cggtggtgccagag

SEQ ID NO: 5879958 - DNA, 16 bp, Homo sapiens
cggtggtgccagaggt

SEQ ID NO: 5879959 - DNA, 22 bp, Homo sapiens
cggtggtgcccgtgcccgcagg

SEQ ID NO: 5879960 - DNA, 15 bp, Homo sapiens
cggtgtatcctggcc

SEQ ID NO: 5879961 - DNA, 16 bp, Homo sapiens
cggtgtatgcagtggt

SEQ ID NO: 5879962 - DNA, 10 bp, Homo sapiens
cggtgtcagg

SEQ ID NO: 5879963 - DNA, 17 bp, Homo sapiens
cggtgtccaccatcccc

SEQ ID NO: 5879964 - DNA, 15 bp, Homo sapiens
cggtgtccatttata

SEQ ID NO: 5879965 - DNA, 24 bp, Homo sapiens
cggtgtcgccgcctgctccctgca

SEQ ID NO: 5879966 - DNA, 17 bp, Homo sapiens
cggtgtgagatggtgcc

SEQ ID NO: 5879967 - DNA, 22 bp, Homo sapiens
cggtgtgagatggtgccccctg

SEQ ID NO: 5879968 - DNA, 12 bp, Homo sapiens
cggtgtgaggag

SEQ ID NO: 5879969 - DNA, 16 bp, Homo sapiens
cggtgtgcaccagggt

SEQ ID NO: 5879970 - DNA, 15 bp, Homo sapiens
cggtgtgcctgcagc

SEQ ID NO: 5879971 - DNA, 20 bp, Homo sapiens
cggtgtgggggccccgtctc

SEQ ID NO: 5879972 - DNA, 18 bp, Homo sapiens
cggtgtggtgcagtgtga

SEQ ID NO: 5879973 - DNA, 18 bp, Homo sapiens
cggtgtgtaacactgtgt

SEQ ID NO: 5879974 - DNA, 19 bp, Homo sapiens
cggtgtgtaacactgtgta

SEQ ID NO: 5879975 - DNA, 20 bp, Homo sapiens
cggtgtgtaacactgtgtac

SEQ ID NO: 5879976 - DNA, 21 bp, Homo sapiens
cggtgtgtcctctgtgcccac

SEQ ID NO: 5879977 - DNA, 22 bp, Homo sapiens
cggtgtgtggccgcctggcagg

SEQ ID NO: 5879978 - DNA, 22 bp, Homo sapiens
cggtgttaattttgctaactgg

SEQ ID NO: 5879979 - DNA, 13 bp, Homo sapiens
cggtgttgcagag

SEQ ID NO: 5879980 - DNA, 19 bp, Homo sapiens
cggtgtttggaggctgctg

SEQ ID NO: 5879981 - DNA, 14 bp, Homo sapiens
cggttaacaaataa

SEQ ID NO: 5879982 - DNA, 16 bp, Homo sapiens
cggttaacttgtatat

SEQ ID NO: 5879983 - DNA, 18 bp, Homo sapiens
cggttaagaaagcactta

SEQ ID NO: 5879984 - DNA, 15 bp, Homo sapiens
cggttcaccagcctc

SEQ ID NO: 5879985 - DNA, 16 bp, Homo sapiens
cggttcagacccctgc

SEQ ID NO: 5879986 - DNA, 19 bp, Homo sapiens
cggttcagacccctgcctg

SEQ ID NO: 5879987 - DNA, 19 bp, Homo sapiens
cggttcagtgtttctgggg

SEQ ID NO: 5879988 - DNA, 19 bp, Homo sapiens
cggttcatcaattttcact

SEQ ID NO: 5879989 - DNA, 19 bp, Homo sapiens
cggttccacgtccccctgg

SEQ ID NO: 5879990 - DNA, 20 bp, Homo sapiens
cggttccacgtccccctggg

SEQ ID NO: 5879991 - DNA, 21 bp, Homo sapiens
cggttcccacaagcctgcctc

SEQ ID NO: 5879992 - DNA, 17 bp, Homo sapiens
cggttcctacacaggac

SEQ ID NO: 5879993 - DNA, 17 bp, Homo sapiens
cggttcctggtgactcc

SEQ ID NO: 5879994 - DNA, 16 bp, Homo sapiens
cggttcctgtccctgc

SEQ ID NO: 5879995 - DNA, 17 bp, Homo sapiens
cggttctaaggctcaga

SEQ ID NO: 5879996 - DNA, 20 bp, Homo sapiens
cggttctgcgccacttcctt

SEQ ID NO: 5879997 - DNA, 21 bp, Homo sapiens
cggttgagttttgactgcttg

SEQ ID NO: 5879998 - DNA, 15 bp, Homo sapiens
cggttgattgtgcat

SEQ ID NO: 5879999 - DNA, 23 bp, Homo sapiens
cggttgctaaattataaaattga

SEQ ID NO: 5880000 - DNA, 17 bp, Homo sapiens
cggttgctggtcaggtc

SEQ ID NO: 5880001 - DNA, 14 bp, Homo sapiens
cggttgcttcacct

SEQ ID NO: 5880002 - DNA, 15 bp, Homo sapiens
cggttgcttctggga

SEQ ID NO: 5880003 - DNA, 20 bp, Homo sapiens
cggttggagcctgctctttg

SEQ ID NO: 5880004 - DNA, 17 bp, Homo sapiens
cggttggccggctggcc

SEQ ID NO: 5880005 - DNA, 21 bp, Homo sapiens
cggttggtgacttgtctgcct

SEQ ID NO: 5880006 - DNA, 18 bp, Homo sapiens
cggttgtttagaaacaga

SEQ ID NO: 5880007 - DNA, 21 bp, Homo sapiens
cggtttaactgtcccagcgac

SEQ ID NO: 5880008 - DNA, 12 bp, Homo sapiens
cggtttcagaag

SEQ ID NO: 5880009 - DNA, 17 bp, Homo sapiens
cggtttcagctagacaa

SEQ ID NO: 5880010 - DNA, 19 bp, Homo sapiens
cggtttcagctagacaatg

SEQ ID NO: 5880011 - DNA, 16 bp, Homo sapiens
cggtttccagggaggg

SEQ ID NO: 5880012 - DNA, 20 bp, Homo sapiens
cggtttccagggaggggccg

SEQ ID NO: 5880013 - DNA, 22 bp, Homo sapiens
cggtttcccatttgttgctgct

SEQ ID NO: 5880014 - DNA, 16 bp, Homo sapiens
cggtttccgtagcagt

SEQ ID NO: 5880015 - DNA, 22 bp, Homo sapiens
cggtttcgaagtcattaaactg

SEQ ID NO: 5880016 - DNA, 17 bp, Homo sapiens
cggtttctagcctctga

SEQ ID NO: 5880017 - DNA, 12 bp, Homo sapiens
cggtttctgagc

SEQ ID NO: 5880018 - DNA, 19 bp, Homo sapiens
cggtttctttttaagtaat

SEQ ID NO: 5880019 - DNA, 16 bp, Homo sapiens
cggtttgggctgtctt

SEQ ID NO: 5880020 - DNA, 22 bp, Homo sapiens
cggtttggtttgttgtaaataa

SEQ ID NO: 5880021 - DNA, 16 bp, Homo sapiens
cggttttactgcagct

SEQ ID NO: 5880022 - DNA, 18 bp, Homo sapiens
cggttttcctcagctcta

SEQ ID NO: 5880023 - DNA, 17 bp, Homo sapiens
cggttttggcagctgac

SEQ ID NO: 5880024 - DNA, 14 bp, Homo sapiens
cggttttgttgttc

SEQ ID NO: 5880025 - DNA, 14 bp, Homo sapiens
cgtaaaattaagaa

SEQ ID NO: 5880026 - DNA, 16 bp, Homo sapiens
cgtaaacctgaaatat

SEQ ID NO: 5880027 - DNA, 12 bp, Homo sapiens
cgtaaactatga

SEQ ID NO: 5880028 - DNA, 19 bp, Homo sapiens
cgtaaacttcagtgtccca

SEQ ID NO: 5880029 - DNA, 17 bp, Homo sapiens
cgtaaagctagaaatga

SEQ ID NO: 5880030 - DNA, 15 bp, Homo sapiens
cgtaaccacggaaaa

SEQ ID NO: 5880031 - DNA, 13 bp, Homo sapiens
cgtaaccagccag

SEQ ID NO: 5880032 - DNA, 14 bp, Homo sapiens
cgtaaccagccaga

SEQ ID NO: 5880033 - DNA, 14 bp, Homo sapiens
cgtaacccaactct

SEQ ID NO: 5880034 - DNA, 15 bp, Homo sapiens
cgtaacccaccccca

SEQ ID NO: 5880035 - DNA, 19 bp, Homo sapiens
cgtaaccctcgccctgtcc

SEQ ID NO: 5880036 - DNA, 21 bp, Homo sapiens
cgtaaccctcgccctgtccct

SEQ ID NO: 5880037 - DNA, 15 bp, Homo sapiens
cgtaactggctgtgt

SEQ ID NO: 5880038 - DNA, 23 bp, Homo sapiens
cgtaacttattatcactttgggg

SEQ ID NO: 5880039 - DNA, 24 bp, Homo sapiens
cgtaagatacaagtttcagacagg

SEQ ID NO: 5880040 - DNA, 19 bp, Homo sapiens
cgtaagatggcttatttgt

SEQ ID NO: 5880041 - DNA, 13 bp, Homo sapiens
cgtaagcagtata

SEQ ID NO: 5880042 - DNA, 15 bp, Homo sapiens
cgtaagctctatctg

SEQ ID NO: 5880043 - DNA, 15 bp, Homo sapiens
cgtaaggatgtgtga

SEQ ID NO: 5880044 - DNA, 17 bp, Homo sapiens
cgtaaggctgtacatag

SEQ ID NO: 5880045 - DNA, 17 bp, Homo sapiens
cgtaagtacagagaagc

SEQ ID NO: 5880046 - DNA, 19 bp, Homo sapiens
cgtaagtacagagaagcca

SEQ ID NO: 5880047 - DNA, 17 bp, Homo sapiens
cgtaatagcttctgtgt

SEQ ID NO: 5880048 - DNA, 14 bp, Homo sapiens
cgtaatcccagcta

SEQ ID NO: 5880049 - DNA, 14 bp, Homo sapiens
cgtaatcctcctga

SEQ ID NO: 5880050 - DNA, 19 bp, Homo sapiens
cgtaatgattatatgacaa

SEQ ID NO: 5880051 - DNA, 17 bp, Homo sapiens
cgtaatgcattgcctgt

SEQ ID NO: 5880052 - DNA, 13 bp, Homo sapiens
cgtaatgcttaga

SEQ ID NO: 5880053 - DNA, 14 bp, Homo sapiens
cgtaatgggcctgc

SEQ ID NO: 5880054 - DNA, 18 bp, Homo sapiens
cgtaattcaatttctcac

SEQ ID NO: 5880055 - DNA, 23 bp, Homo sapiens
cgtaattcttattccatattaga

SEQ ID NO: 5880056 - DNA, 20 bp, Homo sapiens
cgtaattctttctgtctccc

SEQ ID NO: 5880057 - DNA, 19 bp, Homo sapiens
cgtaattgctttgtgcctt

SEQ ID NO: 5880058 - DNA, 13 bp, Homo sapiens
cgtaatttaatgg

SEQ ID NO: 5880059 - DNA, 14 bp, Homo sapiens
cgtaattttattat

SEQ ID NO: 5880060 - DNA, 18 bp, Homo sapiens
cgtaattttattattaga

SEQ ID NO: 5880061 - DNA, 17 bp, Homo sapiens
cgtacaaaactctgtat

SEQ ID NO: 5880062 - DNA, 22 bp, Homo sapiens
cgtacacaccacgtcctggtct

SEQ ID NO: 5880063 - DNA, 11 bp, Homo sapiens
cgtacacagag

SEQ ID NO: 5880064 - DNA, 13 bp, Homo sapiens
cgtacacagagaa

SEQ ID NO: 5880065 - DNA, 20 bp, Homo sapiens
cgtacataatactgaaccac

SEQ ID NO: 5880066 - DNA, 13 bp, Homo sapiens
cgtacatgtttat

SEQ ID NO: 5880067 - DNA, 16 bp, Homo sapiens
cgtacattgtgccctg

SEQ ID NO: 5880068 - DNA, 20 bp, Homo sapiens
cgtaccaagccaccgcagct

SEQ ID NO: 5880069 - DNA, 14 bp, Homo sapiens
cgtaccagccagga

SEQ ID NO: 5880070 - DNA, 19 bp, Homo sapiens
cgtaccccactgggccagc

SEQ ID NO: 5880071 - DNA, 17 bp, Homo sapiens
cgtacccccgtggtctt

SEQ ID NO: 5880072 - DNA, 20 bp, Homo sapiens
cgtacccccgtggtctttga

SEQ ID NO: 5880073 - DNA, 17 bp, Homo sapiens
cgtaccgcttccttaga

SEQ ID NO: 5880074 - DNA, 16 bp, Homo sapiens
cgtacgggaatgtgct

SEQ ID NO: 5880075 - DNA, 20 bp, Homo sapiens
cgtacgggaatgtgctttca

SEQ ID NO: 5880076 - DNA, 17 bp, Homo sapiens
cgtactacccagctctg

SEQ ID NO: 5880077 - DNA, 18 bp, Homo sapiens
cgtactacccagctctgt

SEQ ID NO: 5880078 - DNA, 18 bp, Homo sapiens
cgtactacggagaaactc

SEQ ID NO: 5880079 - DNA, 21 bp, Homo sapiens
cgtactaggttggacagcccc

SEQ ID NO: 5880080 - DNA, 22 bp, Homo sapiens
cgtactaggttggacagccccc

SEQ ID NO: 5880081 - DNA, 14 bp, Homo sapiens
cgtactcaggagcc

SEQ ID NO: 5880082 - DNA, 13 bp, Homo sapiens
cgtactccactgg

SEQ ID NO: 5880083 - DNA, 14 bp, Homo sapiens
cgtactctcacatg

SEQ ID NO: 5880084 - DNA, 23 bp, Homo sapiens
cgtacttaactgtgtgaagaaat

SEQ ID NO: 5880085 - DNA, 13 bp, Homo sapiens
cgtacttgtgatt

SEQ ID NO: 5880086 - DNA, 13 bp, Homo sapiens
cgtactttcacat

SEQ ID NO: 5880087 - DNA, 13 bp, Homo sapiens
cgtagaaaatttg

SEQ ID NO: 5880088 - DNA, 16 bp, Homo sapiens
cgtagaacctgcgcac

SEQ ID NO: 5880089 - DNA, 14 bp, Homo sapiens
cgtagaagctcttg

SEQ ID NO: 5880090 - DNA, 19 bp, Homo sapiens
cgtagaagtttttgtactg

SEQ ID NO: 5880091 - DNA, 16 bp, Homo sapiens
cgtagagaatgtgtgt

SEQ ID NO: 5880092 - DNA, 15 bp, Homo sapiens
cgtagagccctccac

SEQ ID NO: 5880093 - DNA, 16 bp, Homo sapiens
cgtagagggtgctgcc

SEQ ID NO: 5880094 - DNA, 21 bp, Homo sapiens
cgtagagtgacctcggacaga

SEQ ID NO: 5880095 - DNA, 19 bp, Homo sapiens
cgtagagttggccttttta

SEQ ID NO: 5880096 - DNA, 23 bp, Homo sapiens
cgtagatattggacaaagaacct

SEQ ID NO: 5880097 - DNA, 20 bp, Homo sapiens
cgtagatcatccccgagggc

SEQ ID NO: 5880098 - DNA, 14 bp, Homo sapiens
cgtagatgctgcct

SEQ ID NO: 5880099 - DNA, 21 bp, Homo sapiens
cgtagattcccatcatacact

SEQ ID NO: 5880100 - DNA, 12 bp, Homo sapiens
cgtagatttttg

SEQ ID NO: 5880101 - DNA, 20 bp, Homo sapiens
cgtagctatttttatacact

SEQ ID NO: 5880102 - DNA, 15 bp, Homo sapiens
cgtagctcccctggc

SEQ ID NO: 5880103 - DNA, 15 bp, Homo sapiens
cgtagctctgctgct

SEQ ID NO: 5880104 - DNA, 18 bp, Homo sapiens
cgtagctctgctgctgat

SEQ ID NO: 5880105 - DNA, 15 bp, Homo sapiens
cgtagcttcagccag

SEQ ID NO: 5880106 - DNA, 12 bp, Homo sapiens
cgtagcttttta

SEQ ID NO: 5880107 - DNA, 21 bp, Homo sapiens
cgtaggacaagttttagttaa

SEQ ID NO: 5880108 - DNA, 13 bp, Homo sapiens
cgtaggcagccac

SEQ ID NO: 5880109 - DNA, 20 bp, Homo sapiens
cgtaggcagcctctctgcta

SEQ ID NO: 5880110 - DNA, 14 bp, Homo sapiens
cgtaggctacagag

SEQ ID NO: 5880111 - DNA, 16 bp, Homo sapiens
cgtaggctacagagaa

SEQ ID NO: 5880112 - DNA, 17 bp, Homo sapiens
cgtaggctacagagaag

SEQ ID NO: 5880113 - DNA, 23 bp, Homo sapiens
cgtaggctacagagaagccttca

SEQ ID NO: 5880114 - DNA, 12 bp, Homo sapiens
cgtagggccagg

SEQ ID NO: 5880115 - DNA, 23 bp, Homo sapiens
cgtaggggaggggttgccacagg

SEQ ID NO: 5880116 - DNA, 16 bp, Homo sapiens
cgtaggggctcctgag

SEQ ID NO: 5880117 - DNA, 17 bp, Homo sapiens
cgtaggggctcctgagt

SEQ ID NO: 5880118 - DNA, 18 bp, Homo sapiens
cgtagggtggcactggga

SEQ ID NO: 5880119 - DNA, 22 bp, Homo sapiens
cgtaggttccccagagagcagg

SEQ ID NO: 5880120 - DNA, 18 bp, Homo sapiens
cgtagtaaaagtcataaa

SEQ ID NO: 5880121 - DNA, 19 bp, Homo sapiens
cgtagtcggcacagcctgg

SEQ ID NO: 5880122 - DNA, 14 bp, Homo sapiens
cgtagtctcctggg

SEQ ID NO: 5880123 - DNA, 15 bp, Homo sapiens
cgtagtgcagcaggg

SEQ ID NO: 5880124 - DNA, 15 bp, Homo sapiens
cgtagtgtgtttaaa

SEQ ID NO: 5880125 - DNA, 22 bp, Homo sapiens
cgtagttccctgaaaacccaga

SEQ ID NO: 5880126 - DNA, 21 bp, Homo sapiens
cgtataaaagcctgtttaaga

SEQ ID NO: 5880127 - DNA, 15 bp, Homo sapiens
cgtataataaaacca

SEQ ID NO: 5880128 - DNA, 16 bp, Homo sapiens
cgtataatgctttctg

SEQ ID NO: 5880129 - DNA, 21 bp, Homo sapiens
cgtataccgtgccactttcca

SEQ ID NO: 5880130 - DNA, 16 bp, Homo sapiens
cgtatagaaaaagcac

SEQ ID NO: 5880131 - DNA, 15 bp, Homo sapiens
cgtatagctgtattg

SEQ ID NO: 5880132 - DNA, 22 bp, Homo sapiens
cgtatatgtctcaggtccctgc

SEQ ID NO: 5880133 - DNA, 13 bp, Homo sapiens
cgtatatttcatt

SEQ ID NO: 5880134 - DNA, 16 bp, Homo sapiens
cgtatcataatttctt

SEQ ID NO: 5880135 - DNA, 18 bp, Homo sapiens
cgtatcatttctaatttt

SEQ ID NO: 5880136 - DNA, 22 bp, Homo sapiens
cgtatcatttctaattttaagt

SEQ ID NO: 5880137 - DNA, 18 bp, Homo sapiens
cgtatccaccttgcaccc

SEQ ID NO: 5880138 - DNA, 19 bp, Homo sapiens
cgtatctccctggagaagc

SEQ ID NO: 5880139 - DNA, 21 bp, Homo sapiens
cgtatctgagggctgctcccc

SEQ ID NO: 5880140 - DNA, 11 bp, Homo sapiens
cgtatgaaaat

SEQ ID NO: 5880141 - DNA, 14 bp, Homo sapiens
cgtatgaatgatat

SEQ ID NO: 5880142 - DNA, 15 bp, Homo sapiens
cgtatgcatgctaaa

SEQ ID NO: 5880143 - DNA, 14 bp, Homo sapiens
cgtatgtaaacatt

SEQ ID NO: 5880144 - DNA, 15 bp, Homo sapiens
cgtatgtaaatgtat

SEQ ID NO: 5880145 - DNA, 22 bp, Homo sapiens
cgtatgtcggcacgtcccatgt

SEQ ID NO: 5880146 - DNA, 20 bp, Homo sapiens
cgtatgtgctcttataaagt

SEQ ID NO: 5880147 - DNA, 21 bp, Homo sapiens
cgtatgtgtgcaggagcctcc

SEQ ID NO: 5880148 - DNA, 15 bp, Homo sapiens
cgtatgttatacaac

SEQ ID NO: 5880149 - DNA, 21 bp, Homo sapiens
cgtattagttgccaatatgcc

SEQ ID NO: 5880150 - DNA, 16 bp, Homo sapiens
cgtattcattcagtga

SEQ ID NO: 5880151 - DNA, 18 bp, Homo sapiens
cgtattccccttcccact

SEQ ID NO: 5880152 - DNA, 21 bp, Homo sapiens
cgtattctaattcttcattat

SEQ ID NO: 5880153 - DNA, 19 bp, Homo sapiens
cgtattggacctgcccaca

SEQ ID NO: 5880154 - DNA, 20 bp, Homo sapiens
cgtattgtgaaatttgttaa

SEQ ID NO: 5880155 - DNA, 21 bp, Homo sapiens
cgtatttaatagcaaagaatt

SEQ ID NO: 5880156 - DNA, 16 bp, Homo sapiens
cgtatttatatttgga

SEQ ID NO: 5880157 - DNA, 18 bp, Homo sapiens
cgtatttatatttggaaa

SEQ ID NO: 5880158 - DNA, 22 bp, Homo sapiens
cgtatttatttttttattcttc

SEQ ID NO: 5880159 - DNA, 14 bp, Homo sapiens
cgtatttctccaga

SEQ ID NO: 5880160 - DNA, 15 bp, Homo sapiens
cgtatttctccagac

SEQ ID NO: 5880161 - DNA, 20 bp, Homo sapiens
cgtatttctccagacccaga

SEQ ID NO: 5880162 - DNA, 17 bp, Homo sapiens
cgtattttgatcagtgt

SEQ ID NO: 5880163 - DNA, 18 bp, Homo sapiens
cgtattttgatcagtgtt

SEQ ID NO: 5880164 - DNA, 17 bp, Homo sapiens
cgtattttgtatttaaa

SEQ ID NO: 5880165 - DNA, 21 bp, Homo sapiens
cgtcaaaacagattgtttgca

SEQ ID NO: 5880166 - DNA, 17 bp, Homo sapiens
cgtcaacgtgcatttta

SEQ ID NO: 5880167 - DNA, 15 bp, Homo sapiens
cgtcaacgttgtact

SEQ ID NO: 5880168 - DNA, 17 bp, Homo sapiens
cgtcaagagcatgcaca

SEQ ID NO: 5880169 - DNA, 16 bp, Homo sapiens
cgtcaatccatcagca

SEQ ID NO: 5880170 - DNA, 21 bp, Homo sapiens
cgtcacagcagtacttgctca

SEQ ID NO: 5880171 - DNA, 20 bp, Homo sapiens
cgtcacagtgtggggaagcc

SEQ ID NO: 5880172 - DNA, 22 bp, Homo sapiens
cgtcacagtgtggggaagccca

SEQ ID NO: 5880173 - DNA, 12 bp, Homo sapiens
cgtcaccaccac

SEQ ID NO: 5880174 - DNA, 13 bp, Homo sapiens
cgtcaccaccacc

SEQ ID NO: 5880175 - DNA, 16 bp, Homo sapiens
cgtcaccccagccctc

SEQ ID NO: 5880176 - DNA, 14 bp, Homo sapiens
cgtcaccccgccag

SEQ ID NO: 5880177 - DNA, 15 bp, Homo sapiens
cgtcaccccgccagc

SEQ ID NO: 5880178 - DNA, 13 bp, Homo sapiens
cgtcaccctcctg

SEQ ID NO: 5880179 - DNA, 14 bp, Homo sapiens
cgtcaccctcctga

SEQ ID NO: 5880180 - DNA, 20 bp, Homo sapiens
cgtcaccctcctgagcctca

SEQ ID NO: 5880181 - DNA, 22 bp, Homo sapiens
cgtcacctctccctcctcagct

SEQ ID NO: 5880182 - DNA, 22 bp, Homo sapiens
cgtcacgctccctgacttctcc

SEQ ID NO: 5880183 - DNA, 19 bp, Homo sapiens
cgtcacgctttcatgacca

SEQ ID NO: 5880184 - DNA, 16 bp, Homo sapiens
cgtcactacctggctg

SEQ ID NO: 5880185 - DNA, 22 bp, Homo sapiens
cgtcactccacgcagctggcag

SEQ ID NO: 5880186 - DNA, 14 bp, Homo sapiens
cgtcactccagtgc

SEQ ID NO: 5880187 - DNA, 17 bp, Homo sapiens
cgtcactccattctcag

SEQ ID NO: 5880188 - DNA, 18 bp, Homo sapiens
cgtcactgcccaccaaag

SEQ ID NO: 5880189 - DNA, 20 bp, Homo sapiens
cgtcactgcccaccaaaggt

SEQ ID NO: 5880190 - DNA, 22 bp, Homo sapiens
cgtcactgcccaccaaaggtca

SEQ ID NO: 5880191 - DNA, 23 bp, Homo sapiens
cgtcagccaaatgacttcatttc

SEQ ID NO: 5880192 - DNA, 16 bp, Homo sapiens
cgtcagccacctggga

SEQ ID NO: 5880193 - DNA, 21 bp, Homo sapiens
cgtcagccacctgggaacaca

SEQ ID NO: 5880194 - DNA, 12 bp, Homo sapiens
cgtcagcctcca

SEQ ID NO: 5880195 - DNA, 13 bp, Homo sapiens
cgtcagcctccag

SEQ ID NO: 5880196 - DNA, 14 bp, Homo sapiens
cgtcagcctccagc

SEQ ID NO: 5880197 - DNA, 12 bp, Homo sapiens
cgtcagcctgtg

SEQ ID NO: 5880198 - DNA, 13 bp, Homo sapiens
cgtcagcctgtga

SEQ ID NO: 5880199 - DNA, 20 bp, Homo sapiens
cgtcagctgcttctgctgcc

SEQ ID NO: 5880200 - DNA, 22 bp, Homo sapiens
cgtcaggagagacgcagccctg

SEQ ID NO: 5880201 - DNA, 11 bp, Homo sapiens
cgtcaggagca

SEQ ID NO: 5880202 - DNA, 14 bp, Homo sapiens
cgtcaggagcagca

SEQ ID NO: 5880203 - DNA, 22 bp, Homo sapiens
cgtcaggcacgtctcctgctgc

SEQ ID NO: 5880204 - DNA, 23 bp, Homo sapiens
cgtcaggcagaggcaactgactt

SEQ ID NO: 5880205 - DNA, 14 bp, Homo sapiens
cgtcaggccacagc

SEQ ID NO: 5880206 - DNA, 19 bp, Homo sapiens
cgtcaggccacagcccctg

SEQ ID NO: 5880207 - DNA, 23 bp, Homo sapiens
cgtcaggccacagcccctggcac

SEQ ID NO: 5880208 - DNA, 22 bp, Homo sapiens
cgtcaggccctgactcctctgg

SEQ ID NO: 5880209 - DNA, 17 bp, Homo sapiens
cgtcaggcctggcctca

SEQ ID NO: 5880210 - DNA, 14 bp, Homo sapiens
cgtcaggctgccag

SEQ ID NO: 5880211 - DNA, 21 bp, Homo sapiens
cgtcagggagaggtcaccagc

SEQ ID NO: 5880212 - DNA, 20 bp, Homo sapiens
cgtcagggttggtgtgctga

SEQ ID NO: 5880213 - DNA, 23 bp, Homo sapiens
cgtcagtagtttgagaccagcct

SEQ ID NO: 5880214 - DNA, 17 bp, Homo sapiens
cgtcagtctttttctgt

SEQ ID NO: 5880215 - DNA, 22 bp, Homo sapiens
cgtcagtctttttctgttgtaa

SEQ ID NO: 5880216 - DNA, 19 bp, Homo sapiens
cgtcagtttcactccctct

SEQ ID NO: 5880217 - DNA, 20 bp, Homo sapiens
cgtcagtttcactccctctt

SEQ ID NO: 5880218 - DNA, 14 bp, Homo sapiens
cgtcataactagaa

SEQ ID NO: 5880219 - DNA, 16 bp, Homo sapiens
cgtcataactagaact

SEQ ID NO: 5880220 - DNA, 13 bp, Homo sapiens
cgtcatccatgcc

SEQ ID NO: 5880221 - DNA, 16 bp, Homo sapiens
cgtcatccatgccctc

SEQ ID NO: 5880222 - DNA, 14 bp, Homo sapiens
cgtcatctagtttt

SEQ ID NO: 5880223 - DNA, 17 bp, Homo sapiens
cgtcatctagttttaaa

SEQ ID NO: 5880224 - DNA, 15 bp, Homo sapiens
cgtcatctgcggggc

SEQ ID NO: 5880225 - DNA, 20 bp, Homo sapiens
cgtcatctgcggggcttctg

SEQ ID NO: 5880226 - DNA, 13 bp, Homo sapiens
cgtcatcttccct

SEQ ID NO: 5880227 - DNA, 15 bp, Homo sapiens
cgtcatcttccctgc

SEQ ID NO: 5880228 - DNA, 20 bp, Homo sapiens
cgtcatcttccctgcccctg

SEQ ID NO: 5880229 - DNA, 13 bp, Homo sapiens
cgtcatgtctcta

SEQ ID NO: 5880230 - DNA, 19 bp, Homo sapiens
cgtcatgttggccaggctg

SEQ ID NO: 5880231 - DNA, 13 bp, Homo sapiens
cgtgatacatttg

SEQ ID NO: 5880232 - DNA, 23 bp, Homo sapiens
cgtgatcaagttgaggggcttcc

SEQ ID NO: 5880233 - DNA, 17 bp, Homo sapiens
cgtgatccacccgcctc

SEQ ID NO: 5880234 - DNA, 21 bp, Homo sapiens
cgtgatccatccatctccagg

SEQ ID NO: 5880235 - DNA, 16 bp, Homo sapiens
cgtgatccgcctgcct

SEQ ID NO: 5880236 - DNA, 18 bp, Homo sapiens
cgtgatctcggctcactg

SEQ ID NO: 5880237 - DNA, 20 bp, Homo sapiens
cgtgatctcggctcactgca

SEQ ID NO: 5880238 - DNA, 21 bp, Homo sapiens
cgtgatggaccaaagccacct

SEQ ID NO: 5880239 - DNA, 17 bp, Homo sapiens
cgtgatggagaggacag

SEQ ID NO: 5880240 - DNA, 20 bp, Homo sapiens
cgtgatggagaggacagagc

SEQ ID NO: 5880241 - DNA, 19 bp, Homo sapiens
cgtgatgggctaggcctcc

SEQ ID NO: 5880242 - DNA, 13 bp, Homo sapiens
cgtgatgtgccac

SEQ ID NO: 5880243 - DNA, 14 bp, Homo sapiens
cgtgatgtgccact

SEQ ID NO: 5880244 - DNA, 12 bp, Homo sapiens
cgtgatgttttg

SEQ ID NO: 5880245 - DNA, 13 bp, Homo sapiens
cgtgattgaccct

SEQ ID NO: 5880246 - DNA, 13 bp, Homo sapiens
cgtgcaaacaacc

SEQ ID NO: 5880247 - DNA, 17 bp, Homo sapiens
cgtgcaaacaacctgaa

SEQ ID NO: 5880248 - DNA, 17 bp, Homo sapiens
cgtgcaaagccaaggca

SEQ ID NO: 5880249 - DNA, 21 bp, Homo sapiens
cgtgcaacgtgtaacttgtgc

SEQ ID NO: 5880250 - DNA, 16 bp, Homo sapiens
cgtgcaactgacactc

SEQ ID NO: 5880251 - DNA, 15 bp, Homo sapiens
cgtgcacaaaccttc

SEQ ID NO: 5880252 - DNA, 18 bp, Homo sapiens
cgtgcacacaccagagcc

SEQ ID NO: 5880253 - DNA, 16 bp, Homo sapiens
cgtgcacacacctgca

SEQ ID NO: 5880254 - DNA, 22 bp, Homo sapiens
cgtgcacacacctgcacacccc

SEQ ID NO: 5880255 - DNA, 20 bp, Homo sapiens
cgtgcacagcgcgggcggag

SEQ ID NO: 5880256 - DNA, 10 bp, Homo sapiens
cgtgcacagg

SEQ ID NO: 5880257 - DNA, 20 bp, Homo sapiens
cgtgcacgtggagagctggt

SEQ ID NO: 5880258 - DNA, 22 bp, Homo sapiens
cgtgcactccctaagaaacccc

SEQ ID NO: 5880259 - DNA, 13 bp, Homo sapiens
cgtgcactctgct

SEQ ID NO: 5880260 - DNA, 14 bp, Homo sapiens
cgtgcactctgcta

SEQ ID NO: 5880261 - DNA, 17 bp, Homo sapiens
cgtgcactctgctaatc

SEQ ID NO: 5880262 - DNA, 18 bp, Homo sapiens
cgtgcactctgctaatca

SEQ ID NO: 5880263 - DNA, 17 bp, Homo sapiens
cgtgcactgacagcctt

SEQ ID NO: 5880264 - DNA, 17 bp, Homo sapiens
cgtgcacttgtgatcct

SEQ ID NO: 5880265 - DNA, 11 bp, Homo sapiens
cgtgcagagct

SEQ ID NO: 5880266 - DNA, 16 bp, Homo sapiens
cgtgcagagctgcact

SEQ ID NO: 5880267 - DNA, 22 bp, Homo sapiens
cgtgcagagctgcacttggcct

SEQ ID NO: 5880268 - DNA, 14 bp, Homo sapiens
cgtgcagcatatga

SEQ ID NO: 5880269 - DNA, 16 bp, Homo sapiens
cgtgcagcttccaaat

SEQ ID NO: 5880270 - DNA, 14 bp, Homo sapiens
cgtgcaggacagct

SEQ ID NO: 5880271 - DNA, 19 bp, Homo sapiens
cgtgcaggacagctcttga

SEQ ID NO: 5880272 - DNA, 22 bp, Homo sapiens
cgtgcagtcaggtgggcggtgt

SEQ ID NO: 5880273 - DNA, 21 bp, Homo sapiens
cgtgcagtggtgcgatctggg

SEQ ID NO: 5880274 - DNA, 19 bp, Homo sapiens
cgtgcagttcctgctgcct

SEQ ID NO: 5880275 - DNA, 18 bp, Homo sapiens
cgtgcataccacttttgt

SEQ ID NO: 5880276 - DNA, 19 bp, Homo sapiens
cgtgcataccacttttgtt

SEQ ID NO: 5880277 - DNA, 21 bp, Homo sapiens
cgtgcatcccccctgctcagc

SEQ ID NO: 5880278 - DNA, 17 bp, Homo sapiens
cgtgcatccttgtaata

SEQ ID NO: 5880279 - DNA, 14 bp, Homo sapiens
cgtgcatggctcct

SEQ ID NO: 5880280 - DNA, 22 bp, Homo sapiens
cgtgcattggaagaccccaccc

SEQ ID NO: 5880281 - DNA, 15 bp, Homo sapiens
cgtgcatttgtgagc

SEQ ID NO: 5880282 - DNA, 17 bp, Homo sapiens
cgtgccaaatcctgggc

SEQ ID NO: 5880283 - DNA, 17 bp, Homo sapiens
cgtgccaacagagaggt

SEQ ID NO: 5880284 - DNA, 15 bp, Homo sapiens
cgtgccaaggagctc

SEQ ID NO: 5880285 - DNA, 20 bp, Homo sapiens
cgtgccacgcgctctgcatg

SEQ ID NO: 5880286 - DNA, 22 bp, Homo sapiens
cgtgccagatataactgtcttg

SEQ ID NO: 5880287 - DNA, 13 bp, Homo sapiens
cgtgccagcagcc

SEQ ID NO: 5880288 - DNA, 14 bp, Homo sapiens
cgtgccaggagcaa

SEQ ID NO: 5880289 - DNA, 13 bp, Homo sapiens
cgtgccaggcccg

SEQ ID NO: 5880290 - DNA, 21 bp, Homo sapiens
cgtgccagtcaagaagaaaaa

SEQ ID NO: 5880291 - DNA, 19 bp, Homo sapiens
cgtgccatgagtccatgtc

SEQ ID NO: 5880292 - DNA, 16 bp, Homo sapiens
cgtgccatgatctgta

SEQ ID NO: 5880293 - DNA, 18 bp, Homo sapiens
cgtgccattgtactccag

SEQ ID NO: 5880294 - DNA, 19 bp, Homo sapiens
cgtgccattgtactccagc

SEQ ID NO: 5880295 - DNA, 22 bp, Homo sapiens
cgtgccattgtactccagcctg

SEQ ID NO: 5880296 - DNA, 20 bp, Homo sapiens
cgtgcccagccagggaaggc

SEQ ID NO: 5880297 - DNA, 15 bp, Homo sapiens
cgtgcccagctcttc

SEQ ID NO: 5880298 - DNA, 17 bp, Homo sapiens
cgtgccccacctcccca

SEQ ID NO: 5880299 - DNA, 13 bp, Homo sapiens
cgtgcccccagcg

SEQ ID NO: 5880300 - DNA, 19 bp, Homo sapiens
cgtgcccccgcctgccacc

SEQ ID NO: 5880301 - DNA, 17 bp, Homo sapiens
cgtgccccgcctccccg

SEQ ID NO: 5880302 - DNA, 13 bp, Homo sapiens
cgtgcccctgctg

SEQ ID NO: 5880303 - DNA, 23 bp, Homo sapiens
cgtgcccctttccttcactgccc

SEQ ID NO: 5880304 - DNA, 22 bp, Homo sapiens
cgtgcccgcccacctctgctgc

SEQ ID NO: 5880305 - DNA, 14 bp, Homo sapiens
cgtgccctaccaca

SEQ ID NO: 5880306 - DNA, 21 bp, Homo sapiens
cgtgccctggaggctgacaca

SEQ ID NO: 5880307 - DNA, 15 bp, Homo sapiens
cgtgccgagccagca

SEQ ID NO: 5880308 - DNA, 22 bp, Homo sapiens
cgtgccgcctgctcctcactgg

SEQ ID NO: 5880309 - DNA, 19 bp, Homo sapiens
cgtgccgggagaggactct

SEQ ID NO: 5880310 - DNA, 21 bp, Homo sapiens
cgtgccgtggagcttggagcc

SEQ ID NO: 5880311 - DNA, 13 bp, Homo sapiens
cgtgcctccacca

SEQ ID NO: 5880312 - DNA, 14 bp, Homo sapiens
cgtgcctccaccac

SEQ ID NO: 5880313 - DNA, 18 bp, Homo sapiens
cgtgcctccaccaccact

SEQ ID NO: 5880314 - DNA, 19 bp, Homo sapiens
cgtgcctccttccacctcc

SEQ ID NO: 5880315 - DNA, 19 bp, Homo sapiens
cgtgcctgagaccagggtg

SEQ ID NO: 5880316 - DNA, 20 bp, Homo sapiens
cgtgcctgagaccagggtgg

SEQ ID NO: 5880317 - DNA, 16 bp, Homo sapiens
cgtgcctggccacgcc

SEQ ID NO: 5880318 - DNA, 12 bp, Homo sapiens
cgtgcctggctg

SEQ ID NO: 5880319 - DNA, 22 bp, Homo sapiens
cgtgcctttctctggctccaga

SEQ ID NO: 5880320 - DNA, 23 bp, Homo sapiens
cgtgcctttctctggctccagaa

SEQ ID NO: 5880321 - DNA, 15 bp, Homo sapiens
cgtgcgacagagaga

SEQ ID NO: 5880322 - DNA, 17 bp, Homo sapiens
cgtgcgaccagaggtgg

SEQ ID NO: 5880323 - DNA, 14 bp, Homo sapiens
cgtgcgagctgccg

SEQ ID NO: 5880324 - DNA, 13 bp, Homo sapiens
cgtgcgcactgca

SEQ ID NO: 5880325 - DNA, 19 bp, Homo sapiens
cgtgcgcactgcatgggaa

SEQ ID NO: 5880326 - DNA, 21 bp, Homo sapiens
cgtgcgcagccgcgctctgcc

SEQ ID NO: 5880327 - DNA, 22 bp, Homo sapiens
cgtgcgcagccgcgctctgccc

SEQ ID NO: 5880328 - DNA, 21 bp, Homo sapiens
cgtgcgcccgtggggtctgcg

SEQ ID NO: 5880329 - DNA, 12 bp, Homo sapiens
cgtgcggcccgt

SEQ ID NO: 5880330 - DNA, 19 bp, Homo sapiens
cgtgcggcccgtgcgcagc

SEQ ID NO: 5880331 - DNA, 15 bp, Homo sapiens
cgtgcgggcgaggcc

SEQ ID NO: 5880332 - DNA, 19 bp, Homo sapiens
cgtgcgtctgtgtgtgcct

SEQ ID NO: 5880333 - DNA, 15 bp, Homo sapiens
cgtgcgtgtctctgc

SEQ ID NO: 5880334 - DNA, 15 bp, Homo sapiens
cgtgcgtgtgagtgt

SEQ ID NO: 5880335 - DNA, 19 bp, Homo sapiens
cgtgcgtgtgtgtgtgttt

SEQ ID NO: 5880336 - DNA, 12 bp, Homo sapiens
cgtgctaaggac

SEQ ID NO: 5880337 - DNA, 13 bp, Homo sapiens
cgtgctacctgca

SEQ ID NO: 5880338 - DNA, 12 bp, Homo sapiens
cgtgctatgaca

SEQ ID NO: 5880339 - DNA, 16 bp, Homo sapiens
cgtgctccgcagggcg

SEQ ID NO: 5880340 - DNA, 21 bp, Homo sapiens
cgtgctccgtagctctgctgc

SEQ ID NO: 5880341 - DNA, 18 bp, Homo sapiens
cgtgctccttttctcttt

SEQ ID NO: 5880342 - DNA, 16 bp, Homo sapiens
cgtgctcgcagcctgg

SEQ ID NO: 5880343 - DNA, 17 bp, Homo sapiens
cgtgctcgcagcctggc

SEQ ID NO: 5880344 - DNA, 19 bp, Homo sapiens
cgtgctcgcctctgcccag

SEQ ID NO: 5880345 - DNA, 14 bp, Homo sapiens
cgtgctctttgttt

SEQ ID NO: 5880346 - DNA, 22 bp, Homo sapiens
cgtgctgcccgagggcaggggc

SEQ ID NO: 5880347 - DNA, 13 bp, Homo sapiens
cgtgctggaggaa

SEQ ID NO: 5880348 - DNA, 22 bp, Homo sapiens
cgtgctggcgacactcagggca

SEQ ID NO: 5880349 - DNA, 16 bp, Homo sapiens
cgtgctgggcagcccg

SEQ ID NO: 5880350 - DNA, 19 bp, Homo sapiens
cgtgctgggcggctgtgct

SEQ ID NO: 5880351 - DNA, 16 bp, Homo sapiens
cgtgctgtctcctttg

SEQ ID NO: 5880352 - DNA, 22 bp, Homo sapiens
cgtgctgtcttctggtctgtgt

SEQ ID NO: 5880353 - DNA, 15 bp, Homo sapiens
cgtgctgtgggcctc

SEQ ID NO: 5880354 - DNA, 14 bp, Homo sapiens
cgtgcttcctcagt

SEQ ID NO: 5880355 - DNA, 18 bp, Homo sapiens
cgtgcttcctcctgacag

SEQ ID NO: 5880356 - DNA, 22 bp, Homo sapiens
cgtgcttgtttgctcacctggg

SEQ ID NO: 5880357 - DNA, 23 bp, Homo sapiens
cgtggaacattctggatctgacc

SEQ ID NO: 5880358 - DNA, 17 bp, Homo sapiens
cgtggaacctctgtctc

SEQ ID NO: 5880359 - DNA, 20 bp, Homo sapiens
cgtggaagaagggccaccct

SEQ ID NO: 5880360 - DNA, 22 bp, Homo sapiens
cgtggaatgcccttcactgtca

SEQ ID NO: 5880361 - DNA, 19 bp, Homo sapiens
cgtggacaccccagacctg

SEQ ID NO: 5880362 - DNA, 18 bp, Homo sapiens
cgtggacagccggagcag

SEQ ID NO: 5880363 - DNA, 13 bp, Homo sapiens
cgtggacagcgct

SEQ ID NO: 5880364 - DNA, 13 bp, Homo sapiens
cgtggacaggccc

SEQ ID NO: 5880365 - DNA, 15 bp, Homo sapiens
cgtggacaggcccag

SEQ ID NO: 5880366 - DNA, 16 bp, Homo sapiens
cgtggacaggcccagc

SEQ ID NO: 5880367 - DNA, 16 bp, Homo sapiens
cgtggacaggtgtgcc

SEQ ID NO: 5880368 - DNA, 16 bp, Homo sapiens
cgtggacatgcctcaa

SEQ ID NO: 5880369 - DNA, 13 bp, Homo sapiens
cgtggacctgcct

SEQ ID NO: 5880370 - DNA, 15 bp, Homo sapiens
cgtggaccttcctgc

SEQ ID NO: 5880371 - DNA, 17 bp, Homo sapiens
cgtggaccttcctgcca

SEQ ID NO: 5880372 - DNA, 13 bp, Homo sapiens
cgtggactccagc

SEQ ID NO: 5880373 - DNA, 16 bp, Homo sapiens
cgtggactctgtgctc

SEQ ID NO: 5880374 - DNA, 19 bp, Homo sapiens
cgtggactctgtgctcacc

SEQ ID NO: 5880375 - DNA, 21 bp, Homo sapiens
cgtggactgagtgggaagccc

SEQ ID NO: 5880376 - DNA, 14 bp, Homo sapiens
cgtggactgtgctg

SEQ ID NO: 5880377 - DNA, 13 bp, Homo sapiens
cgtggagaaacaa

SEQ ID NO: 5880378 - DNA, 23 bp, Homo sapiens
cgtggagaatcacaggctgggct

SEQ ID NO: 5880379 - DNA, 18 bp, Homo sapiens
cgtggagaattggccaga

SEQ ID NO: 5880380 - DNA, 23 bp, Homo sapiens
cgtggagaatttttactggggat

SEQ ID NO: 5880381 - DNA, 15 bp, Homo sapiens
cgtggagactggcag

SEQ ID NO: 5880382 - DNA, 17 bp, Homo sapiens
cgtggagactggcaggc

SEQ ID NO: 5880383 - DNA, 17 bp, Homo sapiens
cgtggagagctggtgcc

SEQ ID NO: 5880384 - DNA, 12 bp, Homo sapiens
cgtggagaggga

SEQ ID NO: 5880385 - DNA, 16 bp, Homo sapiens
cgtggagatagtgcca

SEQ ID NO: 5880386 - DNA, 15 bp, Homo sapiens
cgtggagatgtcttc

SEQ ID NO: 5880387 - DNA, 16 bp, Homo sapiens
cgtggagatgtcttcg

SEQ ID NO: 5880388 - DNA, 13 bp, Homo sapiens
cgtggagccacag

SEQ ID NO: 5880389 - DNA, 15 bp, Homo sapiens
cgtggagccagggag

SEQ ID NO: 5880390 - DNA, 23 bp, Homo sapiens
cgtggagccattgaacagctgtg

SEQ ID NO: 5880391 - DNA, 20 bp, Homo sapiens
cgtggagcggggtatgaaga

SEQ ID NO: 5880392 - DNA, 14 bp, Homo sapiens
cgtggagctcgccc

SEQ ID NO: 5880393 - DNA, 21 bp, Homo sapiens
cgtggagctcgcccctcccct

SEQ ID NO: 5880394 - DNA, 15 bp, Homo sapiens
cgtggagctgcctga

SEQ ID NO: 5880395 - DNA, 22 bp, Homo sapiens
cgtggaggaatgctcccccatc

SEQ ID NO: 5880396 - DNA, 12 bp, Homo sapiens
cgtggaggagag

SEQ ID NO: 5880397 - DNA, 16 bp, Homo sapiens
cgtggaggagcagtgc

SEQ ID NO: 5880398 - DNA, 22 bp, Homo sapiens
cgtggaggagcagtgcaggcac

SEQ ID NO: 5880399 - DNA, 17 bp, Homo sapiens
cgtggaggaggaaggca

SEQ ID NO: 5880400 - DNA, 19 bp, Homo sapiens
cgtggaggaggttgggagg

SEQ ID NO: 5880401 - DNA, 14 bp, Homo sapiens
cgtggaggctgctc

SEQ ID NO: 5880402 - DNA, 20 bp, Homo sapiens
cgtggagggaggccccaggg

SEQ ID NO: 5880403 - DNA, 18 bp, Homo sapiens
cgtggaggggtaggggct

SEQ ID NO: 5880404 - DNA, 21 bp, Homo sapiens
cgtggaggggtaggggctggg

SEQ ID NO: 5880405 - DNA, 23 bp, Homo sapiens
cgtggaggtgaagtccctgttct

SEQ ID NO: 5880406 - DNA, 15 bp, Homo sapiens
cgtggagtcgagctg

SEQ ID NO: 5880407 - DNA, 18 bp, Homo sapiens
cgtggatcaagcttgtgt

SEQ ID NO: 5880408 - DNA, 23 bp, Homo sapiens
cgtggatcgagtgtagctgtgaa

SEQ ID NO: 5880409 - DNA, 20 bp, Homo sapiens
cgttgcatccacaggattcc

SEQ ID NO: 5880410 - DNA, 12 bp, Homo sapiens
cgttgcccccat

SEQ ID NO: 5880411 - DNA, 21 bp, Homo sapiens
cgttgcccccatttctgaggt

SEQ ID NO: 5880412 - DNA, 23 bp, Homo sapiens
cgttgccctaattcatcttttaa

SEQ ID NO: 5880413 - DNA, 16 bp, Homo sapiens
cgttgcctctctgcca

SEQ ID NO: 5880414 - DNA, 18 bp, Homo sapiens
cgttgcctctctgccagc

SEQ ID NO: 5880415 - DNA, 15 bp, Homo sapiens
cgttgctccagtata

SEQ ID NO: 5880416 - DNA, 22 bp, Homo sapiens
cgttgctccagtataaattaca

SEQ ID NO: 5880417 - DNA, 18 bp, Homo sapiens
cgttgctgacttagaatc

SEQ ID NO: 5880418 - DNA, 15 bp, Homo sapiens
cgttgctgagccagc

SEQ ID NO: 5880419 - DNA, 18 bp, Homo sapiens
cgttgctgagccagctgc

SEQ ID NO: 5880420 - DNA, 23 bp, Homo sapiens
cgttgctgtgggaacgagagggg

SEQ ID NO: 5880421 - DNA, 19 bp, Homo sapiens
cgttggaatcacctggagg

SEQ ID NO: 5880422 - DNA, 21 bp, Homo sapiens
cgttggaatcacctggagggc

SEQ ID NO: 5880423 - DNA, 23 bp, Homo sapiens
cgttggaatcacctggagggctt

SEQ ID NO: 5880424 - DNA, 18 bp, Homo sapiens
cgttggacttttcgttaa

SEQ ID NO: 5880425 - DNA, 23 bp, Homo sapiens
cgttggacttttcgttaacattg

SEQ ID NO: 5880426 - DNA, 16 bp, Homo sapiens
cgttggagaagcccgt

SEQ ID NO: 5880427 - DNA, 13 bp, Homo sapiens
cgttggagactga

SEQ ID NO: 5880428 - DNA, 11 bp, Homo sapiens
cgttggagcca

SEQ ID NO: 5880429 - DNA, 20 bp, Homo sapiens
cgttggagccactcctgtcc

SEQ ID NO: 5880430 - DNA, 19 bp, Homo sapiens
cgttggatgtctgtgagta

SEQ ID NO: 5880431 - DNA, 17 bp, Homo sapiens
cgttggctagattaacc

SEQ ID NO: 5880432 - DNA, 16 bp, Homo sapiens
cgttggcttctccctg

SEQ ID NO: 5880433 - DNA, 15 bp, Homo sapiens
cgttgggagcctagc

SEQ ID NO: 5880434 - DNA, 21 bp, Homo sapiens
cgttggtagagccctcagaac

SEQ ID NO: 5880435 - DNA, 13 bp, Homo sapiens
cgttggtctctgc

SEQ ID NO: 5880436 - DNA, 23 bp, Homo sapiens
cgttggtctctgcatttttctgc

SEQ ID NO: 5880437 - DNA, 20 bp, Homo sapiens
cgttggtgaccagtttctta

SEQ ID NO: 5880438 - DNA, 13 bp, Homo sapiens
cgttggtgcgtga

SEQ ID NO: 5880439 - DNA, 16 bp, Homo sapiens
cgttggttgtttctct

SEQ ID NO: 5880440 - DNA, 14 bp, Homo sapiens
cgttgtaatgcaca

SEQ ID NO: 5880441 - DNA, 20 bp, Homo sapiens
cgttgtattcaccccacacc

SEQ ID NO: 5880442 - DNA, 16 bp, Homo sapiens
cgttgtctccctggcc

SEQ ID NO: 5880443 - DNA, 16 bp, Homo sapiens
cgttgtgtatattaca

SEQ ID NO: 5880444 - DNA, 18 bp, Homo sapiens
cgttgttcccactgaaat

SEQ ID NO: 5880445 - DNA, 11 bp, Homo sapiens
cgttgttgtca

SEQ ID NO: 5880446 - DNA, 18 bp, Homo sapiens
cgttgtttacttaaagat

SEQ ID NO: 5880447 - DNA, 16 bp, Homo sapiens
cgttgttttgtggata

SEQ ID NO: 5880448 - DNA, 19 bp, Homo sapiens
cgttgttttgtggataaga

SEQ ID NO: 5880449 - DNA, 22 bp, Homo sapiens
cgtttaaagtactgagcagtat

SEQ ID NO: 5880450 - DNA, 19 bp, Homo sapiens
cgtttaaagtgtattataa

SEQ ID NO: 5880451 - DNA, 23 bp, Homo sapiens
cgtttaaagtgtattataacagt

SEQ ID NO: 5880452 - DNA, 14 bp, Homo sapiens
cgtttaagttgtat

SEQ ID NO: 5880453 - DNA, 16 bp, Homo sapiens
cgtttaagttgtatta

SEQ ID NO: 5880454 - DNA, 13 bp, Homo sapiens
cgtttaatgaatg

SEQ ID NO: 5880455 - DNA, 14 bp, Homo sapiens
cgtttaatgaatgc

SEQ ID NO: 5880456 - DNA, 23 bp, Homo sapiens
cgtttacaagcccccccttccac

SEQ ID NO: 5880457 - DNA, 14 bp, Homo sapiens
cgtttactatgcct

SEQ ID NO: 5880458 - DNA, 20 bp, Homo sapiens
cgtttacttatcttatgcca

SEQ ID NO: 5880459 - DNA, 13 bp, Homo sapiens
cgtttagaaatga

SEQ ID NO: 5880460 - DNA, 19 bp, Homo sapiens
cgtttagaatcagaataaa

SEQ ID NO: 5880461 - DNA, 13 bp, Homo sapiens
cgtttagaccaag

SEQ ID NO: 5880462 - DNA, 16 bp, Homo sapiens
cgtttagaccaaggaa

SEQ ID NO: 5880463 - DNA, 18 bp, Homo sapiens
cgtttagaccaaggaaca

SEQ ID NO: 5880464 - DNA, 16 bp, Homo sapiens
cgtttagctgacaaaa

SEQ ID NO: 5880465 - DNA, 18 bp, Homo sapiens
cgtttagctgacaaaata

SEQ ID NO: 5880466 - DNA, 23 bp, Homo sapiens
cgtttagtgagttcgttttggag

SEQ ID NO: 5880467 - DNA, 21 bp, Homo sapiens
cgtttagtttctagaggcctc

SEQ ID NO: 5880468 - DNA, 22 bp, Homo sapiens
cgtttatatttttttaactgtg

SEQ ID NO: 5880469 - DNA, 15 bp, Homo sapiens
cgtttcaaaaacaca

SEQ ID NO: 5880470 - DNA, 22 bp, Homo sapiens
cgtttcactgcaaacacacctt

SEQ ID NO: 5880471 - DNA, 22 bp, Homo sapiens
cgtttcagcgactccgttggcc

SEQ ID NO: 5880472 - DNA, 13 bp, Homo sapiens
cgtttcaggacca

SEQ ID NO: 5880473 - DNA, 19 bp, Homo sapiens
cgtttcatgtagccagcag

SEQ ID NO: 5880474 - DNA, 22 bp, Homo sapiens
cgtttcatttagtcatgtgacc

SEQ ID NO: 5880475 - DNA, 15 bp, Homo sapiens
cgtttccaagctgcg

SEQ ID NO: 5880476 - DNA, 16 bp, Homo sapiens
cgtttccaagctgcgg

SEQ ID NO: 5880477 - DNA, 11 bp, Homo sapiens
cgtttccatca

SEQ ID NO: 5880478 - DNA, 21 bp, Homo sapiens
cgtttccccaataaagccttt

SEQ ID NO: 5880479 - DNA, 15 bp, Homo sapiens
cgtttccttacacat

SEQ ID NO: 5880480 - DNA, 18 bp, Homo sapiens
cgtttctccacctagact

SEQ ID NO: 5880481 - DNA, 13 bp, Homo sapiens
cgtttctgcccag

SEQ ID NO: 5880482 - DNA, 12 bp, Homo sapiens
cgtttctggaac

SEQ ID NO: 5880483 - DNA, 12 bp, Homo sapiens
cgtttcttcccc

SEQ ID NO: 5880484 - DNA, 14 bp, Homo sapiens
cgtttcttgcaagg

SEQ ID NO: 5880485 - DNA, 15 bp, Homo sapiens
cgtttcttgcaaggg

SEQ ID NO: 5880486 - DNA, 20 bp, Homo sapiens
cgtttgaagacattgcacca

SEQ ID NO: 5880487 - DNA, 12 bp, Homo sapiens
cgtttgaccaat

SEQ ID NO: 5880488 - DNA, 18 bp, Homo sapiens
cgtttgaccaatttgcac

SEQ ID NO: 5880489 - DNA, 19 bp, Homo sapiens
cgtttgatttcaaagcaag

SEQ ID NO: 5880490 - DNA, 19 bp, Homo sapiens
cgtttgatttgtcactgct

SEQ ID NO: 5880491 - DNA, 19 bp, Homo sapiens
cgtttgcaccgcctgccct

SEQ ID NO: 5880492 - DNA, 12 bp, Homo sapiens
cgtttgcctcct

SEQ ID NO: 5880493 - DNA, 15 bp, Homo sapiens
cgtttgcggcagtgt

SEQ ID NO: 5880494 - DNA, 15 bp, Homo sapiens
cgtttgctgtgccag

SEQ ID NO: 5880495 - DNA, 21 bp, Homo sapiens
cgtttggaggcccctgggctc

SEQ ID NO: 5880496 - DNA, 22 bp, Homo sapiens
cgtttggaggcccctgggctct

SEQ ID NO: 5880497 - DNA, 14 bp, Homo sapiens
cgtttggggccctc

SEQ ID NO: 5880498 - DNA, 15 bp, Homo sapiens
cgtttggggccctct

SEQ ID NO: 5880499 - DNA, 16 bp, Homo sapiens
cgtttggggccctcta

SEQ ID NO: 5880500 - DNA, 15 bp, Homo sapiens
cgtttggttaaagta

SEQ ID NO: 5880501 - DNA, 18 bp, Homo sapiens
cgtttggtttgcgcagta

SEQ ID NO: 5880502 - DNA, 14 bp, Homo sapiens
cgtttgtatgtgtg

SEQ ID NO: 5880503 - DNA, 15 bp, Homo sapiens
cgtttgtatgtgtgt

SEQ ID NO: 5880504 - DNA, 16 bp, Homo sapiens
cgtttgtgagaagaaa

SEQ ID NO: 5880505 - DNA, 18 bp, Homo sapiens
cgtttgtgcagaatctct

SEQ ID NO: 5880506 - DNA, 20 bp, Homo sapiens
cgtttgttccccaagacatt

SEQ ID NO: 5880507 - DNA, 12 bp, Homo sapiens
cgtttgtttgtt

SEQ ID NO: 5880508 - DNA, 13 bp, Homo sapiens
cgttttaaaaaag

SEQ ID NO: 5880509 - DNA, 16 bp, Homo sapiens
cgttttaaggactgac

SEQ ID NO: 5880510 - DNA, 18 bp, Homo sapiens
cgttttaccaataaactg

SEQ ID NO: 5880511 - DNA, 16 bp, Homo sapiens
cgttttagaagagagc

SEQ ID NO: 5880512 - DNA, 18 bp, Homo sapiens
cgttttagtgtctgacct

SEQ ID NO: 5880513 - DNA, 16 bp, Homo sapiens
cgttttataagcatca

SEQ ID NO: 5880514 - DNA, 13 bp, Homo sapiens
cgttttcaaaatt

SEQ ID NO: 5880515 - DNA, 12 bp, Homo sapiens
cgttttcaaaga

SEQ ID NO: 5880516 - DNA, 13 bp, Homo sapiens
cgttttcaaagat

SEQ ID NO: 5880517 - DNA, 14 bp, Homo sapiens
cgttttcatcctgg

SEQ ID NO: 5880518 - DNA, 12 bp, Homo sapiens
cgttttctaatt

SEQ ID NO: 5880519 - DNA, 17 bp, Homo sapiens
cgttttcttaaatgttt

SEQ ID NO: 5880520 - DNA, 19 bp, Homo sapiens
cgttttcttctttccctgg

SEQ ID NO: 5880521 - DNA, 23 bp, Homo sapiens
cgttttcttctttccctggacag

SEQ ID NO: 5880522 - DNA, 18 bp, Homo sapiens
cgttttctttgctgtgcc

SEQ ID NO: 5880523 - DNA, 20 bp, Homo sapiens
cgttttgaagctactgtgtg

SEQ ID NO: 5880524 - DNA, 13 bp, Homo sapiens
cgttttgcacatt

SEQ ID NO: 5880525 - DNA, 12 bp, Homo sapiens
cgttttgcctgt

SEQ ID NO: 5880526 - DNA, 19 bp, Homo sapiens
cgttttgtgtatatttgct

SEQ ID NO: 5880527 - DNA, 23 bp, Homo sapiens
cgttttgtgtggtggcacctcct

SEQ ID NO: 5880528 - DNA, 12 bp, Homo sapiens
cgtttttacata

SEQ ID NO: 5880529 - DNA, 22 bp, Homo sapiens
cgtttttagctttgtgtttact

SEQ ID NO: 5880530 - DNA, 20 bp, Homo sapiens
cgtttttattcctcttattg

SEQ ID NO: 5880531 - DNA, 23 bp, Homo sapiens
cgtttttcagcacccccacccac

SEQ ID NO: 5880532 - DNA, 22 bp, Homo sapiens
cgtttttctcgtccccctccct

SEQ ID NO: 5880533 - DNA, 19 bp, Homo sapiens
cgtttttgctggcttgcac

SEQ ID NO: 5880534 - DNA, 22 bp, Homo sapiens
cgtttttgtgctgtgggcagca

SEQ ID NO: 5880535 - DNA, 15 bp, Homo sapiens
cgtttttttcattcc

SEQ ID NO: 5880536 - DNA, 21 bp, Homo sapiens
cgtttttttggtcactccagt

SEQ ID NO: 5880537 - DNA, 15 bp, Homo sapiens
ctaaaaaaaaaaagg

SEQ ID NO: 5880538 - DNA, 19 bp, Homo sapiens
ctaaaaaaagtgcatgatg

SEQ ID NO: 5880539 - DNA, 21 bp, Homo sapiens
ctaaaaaaatttttgacactt

SEQ ID NO: 5880540 - DNA, 16 bp, Homo sapiens
ctaaaaaacaaaacaa

SEQ ID NO: 5880541 - DNA, 17 bp, Homo sapiens
ctaaaaaacagaggcca

SEQ ID NO: 5880542 - DNA, 20 bp, Homo sapiens
ctaaaaaaccaacaatgtga

SEQ ID NO: 5880543 - DNA, 13 bp, Homo sapiens
ctaaaaaagatat

SEQ ID NO: 5880544 - DNA, 13 bp, Homo sapiens
ctaaaaaataact

SEQ ID NO: 5880545 - DNA, 21 bp, Homo sapiens
ctaaaaacattttaaaatcaa

SEQ ID NO: 5880546 - DNA, 22 bp, Homo sapiens
ctaaaaacccaagtttatttct

SEQ ID NO: 5880547 - DNA, 22 bp, Homo sapiens
ctaaaaacttctttttaatctt

SEQ ID NO: 5880548 - DNA, 23 bp, Homo sapiens
ctaaaaagaactcaaaaggagaa

SEQ ID NO: 5880549 - DNA, 11 bp, Homo sapiens
ctaaaaagaat

SEQ ID NO: 5880550 - DNA, 19 bp, Homo sapiens
ctaaaaagaatgcagagat

SEQ ID NO: 5880551 - DNA, 23 bp, Homo sapiens
ctaaaaaggcccttagagggaat

SEQ ID NO: 5880552 - DNA, 16 bp, Homo sapiens
ctaaaaagtataaaat

SEQ ID NO: 5880553 - DNA, 13 bp, Homo sapiens
ctaaaaagtcaat

SEQ ID NO: 5880554 - DNA, 18 bp, Homo sapiens
ctaaaaagtcagatgttt

SEQ ID NO: 5880555 - DNA, 22 bp, Homo sapiens
ctaaaaagttgaaccattatac

SEQ ID NO: 5880556 - DNA, 11 bp, Homo sapiens
ctaaaaataaa

SEQ ID NO: 5880557 - DNA, 17 bp, Homo sapiens
ctaaaaataaaatgatg

SEQ ID NO: 5880558 - DNA, 18 bp, Homo sapiens
ctaaaaataaaatgatgt

SEQ ID NO: 5880559 - DNA, 15 bp, Homo sapiens
ctaaaaataaagcac

SEQ ID NO: 5880560 - DNA, 13 bp, Homo sapiens
ctaaaaataagct

SEQ ID NO: 5880561 - DNA, 17 bp, Homo sapiens
ctaaaaataagctttat

SEQ ID NO: 5880562 - DNA, 13 bp, Homo sapiens
ctaaaaatacaaa

SEQ ID NO: 5880563 - DNA, 15 bp, Homo sapiens
ctaaaaatacaaaaa

SEQ ID NO: 5880564 - DNA, 21 bp, Homo sapiens
ctaaaaatagacttaaatctc

SEQ ID NO: 5880565 - DNA, 15 bp, Homo sapiens
ctaaaaatatagcaa

SEQ ID NO: 5880566 - DNA, 23 bp, Homo sapiens
ctaaaaatatgcagaatctctgc

SEQ ID NO: 5880567 - DNA, 14 bp, Homo sapiens
ctaaaaatattaaa

SEQ ID NO: 5880568 - DNA, 13 bp, Homo sapiens
ctaaaaatccaga

SEQ ID NO: 5880569 - DNA, 15 bp, Homo sapiens
ctaaaaatgaaaatt

SEQ ID NO: 5880570 - DNA, 22 bp, Homo sapiens
ctaaaaatgcaaaaaaaattag

SEQ ID NO: 5880571 - DNA, 19 bp, Homo sapiens
ctaaaaattcccttcctgt

SEQ ID NO: 5880572 - DNA, 22 bp, Homo sapiens
ctaaaaattttgcatttcatgc

SEQ ID NO: 5880573 - DNA, 16 bp, Homo sapiens
ctaaaacattcccctc

SEQ ID NO: 5880574 - DNA, 17 bp, Homo sapiens
ctaaaacattcccctcc

SEQ ID NO: 5880575 - DNA, 23 bp, Homo sapiens
ctaaaacattctttaacatacat

SEQ ID NO: 5880576 - DNA, 15 bp, Homo sapiens
ctaaaacattgtcta

SEQ ID NO: 5880577 - DNA, 22 bp, Homo sapiens
ctaaaacattgtctacagctcc

SEQ ID NO: 5880578 - DNA, 14 bp, Homo sapiens
ctaaaacctgaaat

SEQ ID NO: 5880579 - DNA, 17 bp, Homo sapiens
ctaaaactactgccttt

SEQ ID NO: 5880580 - DNA, 20 bp, Homo sapiens
ctaaaactactgcctttcaa

SEQ ID NO: 5880581 - DNA, 24 bp, Homo sapiens
ctaaaactcagagaatcaaagatg

SEQ ID NO: 5880582 - DNA, 13 bp, Homo sapiens
ctaaaactctcaa

SEQ ID NO: 5880583 - DNA, 18 bp, Homo sapiens
ctaaaactggcctgactt

SEQ ID NO: 5880584 - DNA, 16 bp, Homo sapiens
ctaaaactgtactttg

SEQ ID NO: 5880585 - DNA, 17 bp, Homo sapiens
ctaaaactgtactttga

SEQ ID NO: 5880586 - DNA, 18 bp, Homo sapiens
ctaaaactgtactttgat

SEQ ID NO: 5880587 - DNA, 20 bp, Homo sapiens
ctaaaacttggatggacttg

SEQ ID NO: 5880588 - DNA, 16 bp, Homo sapiens
ctaaaagacaaattta

SEQ ID NO: 5880589 - DNA, 19 bp, Homo sapiens
ctaaaagacagcagggaca

SEQ ID NO: 5880590 - DNA, 13 bp, Homo sapiens
ctaaaagacaggc

SEQ ID NO: 5880591 - DNA, 23 bp, Homo sapiens
ctaaaagacatgcatttttaaaa

SEQ ID NO: 5880592 - DNA, 21 bp, Homo sapiens
ctaaaagatataagtgctgta

SEQ ID NO: 5880593 - DNA, 15 bp, Homo sapiens
ctaaaagatcctttt

SEQ ID NO: 5880594 - DNA, 16 bp, Homo sapiens
ctaaaagattctttaa

SEQ ID NO: 5880595 - DNA, 12 bp, Homo sapiens
ctaaaagcacct

SEQ ID NO: 5880596 - DNA, 17 bp, Homo sapiens
ctaaaagcatccctgtg

SEQ ID NO: 5880597 - DNA, 21 bp, Homo sapiens
ctaaaagcatgaattggaact

SEQ ID NO: 5880598 - DNA, 21 bp, Homo sapiens
ctaaaagcatggccctgctgc

SEQ ID NO: 5880599 - DNA, 13 bp, Homo sapiens
ctaaaaggcccag

SEQ ID NO: 5880600 - DNA, 15 bp, Homo sapiens
ctaaaaggcttccag

SEQ ID NO: 5880601 - DNA, 16 bp, Homo sapiens
ctaaaaggcttccagg

SEQ ID NO: 5880602 - DNA, 23 bp, Homo sapiens
ctaaaaggcttccaggctgagag

SEQ ID NO: 5880603 - DNA, 16 bp, Homo sapiens
ctaaaaggttcaggga

SEQ ID NO: 5880604 - DNA, 17 bp, Homo sapiens
ctaaaagtactgcattt

SEQ ID NO: 5880605 - DNA, 17 bp, Homo sapiens
ctaaaagtgatgtgatt

SEQ ID NO: 5880606 - DNA, 20 bp, Homo sapiens
ctaaaagtgatgtgatttat

SEQ ID NO: 5880607 - DNA, 21 bp, Homo sapiens
ctaaaagtgcatttaaggaga

SEQ ID NO: 5880608 - DNA, 19 bp, Homo sapiens
ctaaaagtgtgtgaaacct

SEQ ID NO: 5880609 - DNA, 23 bp, Homo sapiens
ctaaaagttaagtgtcatttctt

SEQ ID NO: 5880610 - DNA, 18 bp, Homo sapiens
ctaaaagttcataacagt

SEQ ID NO: 5880611 - DNA, 18 bp, Homo sapiens
ctaaaagttctcaatgta

SEQ ID NO: 5880612 - DNA, 20 bp, Homo sapiens
ctaaaagttctcaatgtaga

SEQ ID NO: 5880613 - DNA, 17 bp, Homo sapiens
ctaaaagtttagaactt

SEQ ID NO: 5880614 - DNA, 22 bp, Homo sapiens
ctaaaagttttctaatttgcac

SEQ ID NO: 5880615 - DNA, 14 bp, Homo sapiens
ctaaaataaaattt

SEQ ID NO: 5880616 - DNA, 22 bp, Homo sapiens
ctaaaataaagaaatagaacaa

SEQ ID NO: 5880617 - DNA, 18 bp, Homo sapiens
ctaaaataaataccaaag

SEQ ID NO: 5880618 - DNA, 19 bp, Homo sapiens
ctaaaataaataccaaaga

SEQ ID NO: 5880619 - DNA, 12 bp, Homo sapiens
ctaaaataaatg

SEQ ID NO: 5880620 - DNA, 20 bp, Homo sapiens
ctaaaataagctcagtgata

SEQ ID NO: 5880621 - DNA, 22 bp, Homo sapiens
ctaaaataagggcagagtcaca

SEQ ID NO: 5880622 - DNA, 12 bp, Homo sapiens
ctaaaatacaag

SEQ ID NO: 5880623 - DNA, 17 bp, Homo sapiens
ctaaaatacttgagaaa

SEQ ID NO: 5880624 - DNA, 18 bp, Homo sapiens
ctaaaatacttgagaaat

SEQ ID NO: 5880625 - DNA, 14 bp, Homo sapiens
ctaaaatagaatat

SEQ ID NO: 5880626 - DNA, 20 bp, Homo sapiens
ctaaaatagattaaaggaat

SEQ ID NO: 5880627 - DNA, 22 bp, Homo sapiens
ctaaaatagcaataactgaaaa

SEQ ID NO: 5880628 - DNA, 16 bp, Homo sapiens
ctaaaatataatagaa

SEQ ID NO: 5880629 - DNA, 12 bp, Homo sapiens
ctaaaatcaagt

SEQ ID NO: 5880630 - DNA, 15 bp, Homo sapiens
ctaaaatccacccag

SEQ ID NO: 5880631 - DNA, 21 bp, Homo sapiens
ctaaaatccacccagcccact

SEQ ID NO: 5880632 - DNA, 22 bp, Homo sapiens
ctaaaatctgcttgtattccaa

SEQ ID NO: 5880633 - DNA, 19 bp, Homo sapiens
ctaaaatcttatagttcta

SEQ ID NO: 5880634 - DNA, 14 bp, Homo sapiens
ctaaaatcttggaa

SEQ ID NO: 5880635 - DNA, 13 bp, Homo sapiens
ctaaaatgacagc

SEQ ID NO: 5880636 - DNA, 19 bp, Homo sapiens
ctaaaatgattgtgcctct

SEQ ID NO: 5880637 - DNA, 23 bp, Homo sapiens
ctaaaatgattttatctgtgaat

SEQ ID NO: 5880638 - DNA, 22 bp, Homo sapiens
ctaaaatgcctcagtgtatttg

SEQ ID NO: 5880639 - DNA, 20 bp, Homo sapiens
ctaaaatgctgcttttaaaa

SEQ ID NO: 5880640 - DNA, 13 bp, Homo sapiens
ctaaaatgcttca

SEQ ID NO: 5880641 - DNA, 17 bp, Homo sapiens
ctaaaatggacattttc

SEQ ID NO: 5880642 - DNA, 20 bp, Homo sapiens
ctaaaatgtagaaattctaa

SEQ ID NO: 5880643 - DNA, 13 bp, Homo sapiens
ctaaaatgtatct

SEQ ID NO: 5880644 - DNA, 18 bp, Homo sapiens
ctaaaatgtgatgttcta

SEQ ID NO: 5880645 - DNA, 11 bp, Homo sapiens
ctaaaatgtta

SEQ ID NO: 5880646 - DNA, 13 bp, Homo sapiens
ctaaaatgttact

SEQ ID NO: 5880647 - DNA, 13 bp, Homo sapiens
ctaaaatgttcta

SEQ ID NO: 5880648 - DNA, 20 bp, Homo sapiens
ctaaaatgtttaattcatta

SEQ ID NO: 5880649 - DNA, 18 bp, Homo sapiens
ctaaaattagttttaaaa

SEQ ID NO: 5880650 - DNA, 12 bp, Homo sapiens
ctaaaattcaga

SEQ ID NO: 5880651 - DNA, 21 bp, Homo sapiens
ctaaaattctagtctctgatt

SEQ ID NO: 5880652 - DNA, 22 bp, Homo sapiens
ctaaaattctgggcctaatttt

SEQ ID NO: 5880653 - DNA, 13 bp, Homo sapiens
ctaaaatttaaaa

SEQ ID NO: 5880654 - DNA, 14 bp, Homo sapiens
ctaaaatttacaca

SEQ ID NO: 5880655 - DNA, 23 bp, Homo sapiens
ctaaaatttgccctcccatcccg

SEQ ID NO: 5880656 - DNA, 12 bp, Homo sapiens
ctaaaatttgta

SEQ ID NO: 5880657 - DNA, 22 bp, Homo sapiens
ctaaaatttgtaatatttttgt

SEQ ID NO: 5880658 - DNA, 13 bp, Homo sapiens
ctaaaattttaga

SEQ ID NO: 5880659 - DNA, 24 bp, Homo sapiens
ctaaaatttttctagaagatatca

SEQ ID NO: 5880660 - DNA, 21 bp, Homo sapiens
ctaaacaaaagcaaagatgca

SEQ ID NO: 5880661 - DNA, 19 bp, Homo sapiens
ctaaacaagaatcagtcta

SEQ ID NO: 5880662 - DNA, 14 bp, Homo sapiens
ctaaacaagatttt

SEQ ID NO: 5880663 - DNA, 20 bp, Homo sapiens
ctaaacacaacaataacttt

SEQ ID NO: 5880664 - DNA, 18 bp, Homo sapiens
ctaaacacgtgacacaaa

SEQ ID NO: 5880665 - DNA, 19 bp, Homo sapiens
ctaaacactgcgctttatt

SEQ ID NO: 5880666 - DNA, 19 bp, Homo sapiens
ctaaacacttcattcttta

SEQ ID NO: 5880667 - DNA, 16 bp, Homo sapiens
ctaaacagacaggaat

SEQ ID NO: 5880668 - DNA, 16 bp, Homo sapiens
ctaaacagactattta

SEQ ID NO: 5880669 - DNA, 14 bp, Homo sapiens
ctaaacagactcat

SEQ ID NO: 5880670 - DNA, 21 bp, Homo sapiens
ctaaacagagaaaagcttgga

SEQ ID NO: 5880671 - DNA, 13 bp, Homo sapiens
ctaaacagatata

SEQ ID NO: 5880672 - DNA, 18 bp, Homo sapiens
ctaaacagatgtccctga

SEQ ID NO: 5880673 - DNA, 15 bp, Homo sapiens
ctaaacagctgcttt

SEQ ID NO: 5880674 - DNA, 11 bp, Homo sapiens
ctaaacataat

SEQ ID NO: 5880675 - DNA, 23 bp, Homo sapiens
ctaaacatcattcatttttgttg

SEQ ID NO: 5880676 - DNA, 17 bp, Homo sapiens
ctaaacattatttttct

SEQ ID NO: 5880677 - DNA, 16 bp, Homo sapiens
ctaaaccaagttattt

SEQ ID NO: 5880678 - DNA, 16 bp, Homo sapiens
ctaaaccacaaaagtt

SEQ ID NO: 5880679 - DNA, 17 bp, Homo sapiens
ctaaaccacaaaagttg

SEQ ID NO: 5880680 - DNA, 13 bp, Homo sapiens
ctaaaccacaata

SEQ ID NO: 5880681 - DNA, 15 bp, Homo sapiens
ctaaaccacttctct

SEQ ID NO: 5880682 - DNA, 20 bp, Homo sapiens
ctaaaccacttctctgctgc

SEQ ID NO: 5880683 - DNA, 13 bp, Homo sapiens
ctaaaccagaagg

SEQ ID NO: 5880684 - DNA, 15 bp, Homo sapiens
ctaaaccagaaggaa

SEQ ID NO: 5880685 - DNA, 13 bp, Homo sapiens
ctaaaccatgaaa

SEQ ID NO: 5880686 - DNA, 12 bp, Homo sapiens
ctaaaccattca

SEQ ID NO: 5880687 - DNA, 17 bp, Homo sapiens
ctaaaccattgagctag

SEQ ID NO: 5880688 - DNA, 15 bp, Homo sapiens
ctaaaccattgtgca

SEQ ID NO: 5880689 - DNA, 17 bp, Homo sapiens
ctaaacccaaataaatg

SEQ ID NO: 5880690 - DNA, 19 bp, Homo sapiens
ctaaacccaatccaaatgg

SEQ ID NO: 5880691 - DNA, 12 bp, Homo sapiens
ctaaacccaatg

SEQ ID NO: 5880692 - DNA, 14 bp, Homo sapiens
ctaaacccaatgac

SEQ ID NO: 5880693 - DNA, 14 bp, Homo sapiens
ctaaaccccaagct

SEQ ID NO: 5880694 - DNA, 19 bp, Homo sapiens
ctaaaccccagattcttca

SEQ ID NO: 5880695 - DNA, 18 bp, Homo sapiens
ctaaaccccatacctgga

SEQ ID NO: 5880696 - DNA, 20 bp, Homo sapiens
ctaaacccgcaccccagtgc

SEQ ID NO: 5880697 - DNA, 14 bp, Homo sapiens
ctaaaccgtcccct

SEQ ID NO: 5880698 - DNA, 21 bp, Homo sapiens
ctaaaccgtcccctccttccc

SEQ ID NO: 5880699 - DNA, 16 bp, Homo sapiens
ctaaaccgttgagttt

SEQ ID NO: 5880700 - DNA, 20 bp, Homo sapiens
ctaaacctatctgtattggc

SEQ ID NO: 5880701 - DNA, 13 bp, Homo sapiens
ctaaacctcagtt

SEQ ID NO: 5880702 - DNA, 17 bp, Homo sapiens
ctaaacctcagttatta

SEQ ID NO: 5880703 - DNA, 16 bp, Homo sapiens
ctaaacctgtgcctcc

SEQ ID NO: 5880704 - DNA, 19 bp, Homo sapiens
ctaaaccttacatgtgtaa

SEQ ID NO: 5880705 - DNA, 19 bp, Homo sapiens
ctaaaccttagtactgagt

SEQ ID NO: 5880706 - DNA, 22 bp, Homo sapiens
ctaaaccttcatcattttgtga

SEQ ID NO: 5880707 - DNA, 19 bp, Homo sapiens
ctaaacgtaagcactgttt

SEQ ID NO: 5880708 - DNA, 14 bp, Homo sapiens
ctaaacgtgtatgt

SEQ ID NO: 5880709 - DNA, 20 bp, Homo sapiens
ctaaacgtgtatgtttttca

SEQ ID NO: 5880710 - DNA, 19 bp, Homo sapiens
ctaaactaaaatagtttaa

SEQ ID NO: 5880711 - DNA, 15 bp, Homo sapiens
ctaaactaagatgtg

SEQ ID NO: 5880712 - DNA, 15 bp, Homo sapiens
ctaaactacattata

SEQ ID NO: 5880713 - DNA, 13 bp, Homo sapiens
ctaaactaccacc

SEQ ID NO: 5880714 - DNA, 14 bp, Homo sapiens
ctaaactaccacct

SEQ ID NO: 5880715 - DNA, 15 bp, Homo sapiens
ctaaactaggctcct

SEQ ID NO: 5880716 - DNA, 22 bp, Homo sapiens
ctaaactcaagatttgaccaaa

SEQ ID NO: 5880717 - DNA, 16 bp, Homo sapiens
ctaaactccatgatat

SEQ ID NO: 5880718 - DNA, 14 bp, Homo sapiens
ctaaactccttcct

SEQ ID NO: 5880719 - DNA, 15 bp, Homo sapiens
ctaaactccttcctg

SEQ ID NO: 5880720 - DNA, 22 bp, Homo sapiens
ctaaactccttcctggcctgag

SEQ ID NO: 5880721 - DNA, 21 bp, Homo sapiens
ctaaactctcgagacttctct

SEQ ID NO: 5880722 - DNA, 14 bp, Homo sapiens
ctaaactctgaaat

SEQ ID NO: 5880723 - DNA, 13 bp, Homo sapiens
ctaaactctgggg

SEQ ID NO: 5880724 - DNA, 14 bp, Homo sapiens
ctaaactctggggc

SEQ ID NO: 5880725 - DNA, 16 bp, Homo sapiens
ctaaactgaagctgct

SEQ ID NO: 5880726 - DNA, 22 bp, Homo sapiens
ctaaactgaatctatggcttta

SEQ ID NO: 5880727 - DNA, 12 bp, Homo sapiens
ctaaactgcaaa

SEQ ID NO: 5880728 - DNA, 13 bp, Homo sapiens
ctaaactgcagcc

SEQ ID NO: 5880729 - DNA, 21 bp, Homo sapiens
ctaaactgcagcctctctggc

SEQ ID NO: 5880730 - DNA, 11 bp, Homo sapiens
ctaaactgcat

SEQ ID NO: 5880731 - DNA, 13 bp, Homo sapiens
ctaaactggagac

SEQ ID NO: 5880732 - DNA, 14 bp, Homo sapiens
ctaaactggagact

SEQ ID NO: 5880733 - DNA, 15 bp, Homo sapiens
ctaaactggagactg

SEQ ID NO: 5880734 - DNA, 19 bp, Homo sapiens
ctaaactggtgtttttccc

SEQ ID NO: 5880735 - DNA, 17 bp, Homo sapiens
ctaaactgtgaaaaatc

SEQ ID NO: 5880736 - DNA, 14 bp, Homo sapiens
ctaaactgtttact

SEQ ID NO: 5880737 - DNA, 14 bp, Homo sapiens
ctaaactgttttca

SEQ ID NO: 5880738 - DNA, 13 bp, Homo sapiens
ctaaacttagaaa

SEQ ID NO: 5880739 - DNA, 19 bp, Homo sapiens
ctaaacttagaaatatgct

SEQ ID NO: 5880740 - DNA, 12 bp, Homo sapiens
ctaaactttatt

SEQ ID NO: 5880741 - DNA, 15 bp, Homo sapiens
ctaaactttatttgt

SEQ ID NO: 5880742 - DNA, 22 bp, Homo sapiens
ctaaactttatttgtaaaccat

SEQ ID NO: 5880743 - DNA, 23 bp, Homo sapiens
ctaaactttatttgtaaaccatt

SEQ ID NO: 5880744 - DNA, 17 bp, Homo sapiens
ctaaactttggcctttg

SEQ ID NO: 5880745 - DNA, 15 bp, Homo sapiens
ctaaactttttttct

SEQ ID NO: 5880746 - DNA, 17 bp, Homo sapiens
ctaaactttttttctgt

SEQ ID NO: 5880747 - DNA, 21 bp, Homo sapiens
ctaaactttttttctgtacca

SEQ ID NO: 5880748 - DNA, 19 bp, Homo sapiens
ctaaagaaaaagtcatcca

SEQ ID NO: 5880749 - DNA, 21 bp, Homo sapiens
ctaaagaaacagaagattaca

SEQ ID NO: 5880750 - DNA, 16 bp, Homo sapiens
ctaaagaagacacaca

SEQ ID NO: 5880751 - DNA, 11 bp, Homo sapiens
ctaaagaagag

SEQ ID NO: 5880752 - DNA, 19 bp, Homo sapiens
ctaaagaagataaacacaa

SEQ ID NO: 5880753 - DNA, 14 bp, Homo sapiens
ctaaagaagatctg

SEQ ID NO: 5880754 - DNA, 16 bp, Homo sapiens
ctaaagaagatctgta

SEQ ID NO: 5880755 - DNA, 19 bp, Homo sapiens
ctaaagaatagtgcctcag

SEQ ID NO: 5880756 - DNA, 14 bp, Homo sapiens
ctaaagacagaaaa

SEQ ID NO: 5880757 - DNA, 12 bp, Homo sapiens
ctaaagaccaaa

SEQ ID NO: 5880758 - DNA, 15 bp, Homo sapiens
ctaaagaccatttaa

SEQ ID NO: 5880759 - DNA, 21 bp, Homo sapiens
ctaaagaccctaaatctgagg

SEQ ID NO: 5880760 - DNA, 23 bp, Homo sapiens
ctaaagacctgctgtaataaatg

SEQ ID NO: 5880761 - DNA, 18 bp, Homo sapiens
ctaaagactaacttgaaa

SEQ ID NO: 5880762 - DNA, 14 bp, Homo sapiens
ctaaagactgggtt

SEQ ID NO: 5880763 - DNA, 13 bp, Homo sapiens
ctaaagagaacaa

SEQ ID NO: 5880764 - DNA, 20 bp, Homo sapiens
ctaaagagcccttgcctccc

SEQ ID NO: 5880765 - DNA, 22 bp, Homo sapiens
ctaaagagctacttctaattat

SEQ ID NO: 5880766 - DNA, 23 bp, Homo sapiens
ctaacctcccttaagcagcaaca

SEQ ID NO: 5880767 - DNA, 13 bp, Homo sapiens
ctaacctcgccct

SEQ ID NO: 5880768 - DNA, 13 bp, Homo sapiens
ctaacctctctga

SEQ ID NO: 5880769 - DNA, 11 bp, Homo sapiens
ctaacctgacc

SEQ ID NO: 5880770 - DNA, 12 bp, Homo sapiens
ctaacctgccga

SEQ ID NO: 5880771 - DNA, 13 bp, Homo sapiens
ctaacctggagac

SEQ ID NO: 5880772 - DNA, 18 bp, Homo sapiens
ctaacctgggacctgtgg

SEQ ID NO: 5880773 - DNA, 23 bp, Homo sapiens
ctaacctgtagaacacccctgtg

SEQ ID NO: 5880774 - DNA, 12 bp, Homo sapiens
ctaacctgtgac

SEQ ID NO: 5880775 - DNA, 12 bp, Homo sapiens
ctaacctgtgtc

SEQ ID NO: 5880776 - DNA, 14 bp, Homo sapiens
ctaacctgtgtctg

SEQ ID NO: 5880777 - DNA, 20 bp, Homo sapiens
ctaacctgttacactgggct

SEQ ID NO: 5880778 - DNA, 23 bp, Homo sapiens
ctaaccttcatgcttttttccca

SEQ ID NO: 5880779 - DNA, 12 bp, Homo sapiens
ctaaccttgaat

SEQ ID NO: 5880780 - DNA, 19 bp, Homo sapiens
ctaaccttgaatgctgcca

SEQ ID NO: 5880781 - DNA, 20 bp, Homo sapiens
ctaaccttgaatgctgccag

SEQ ID NO: 5880782 - DNA, 13 bp, Homo sapiens
ctaaccttgcctg

SEQ ID NO: 5880783 - DNA, 13 bp, Homo sapiens
ctaacctttacat

SEQ ID NO: 5880784 - DNA, 14 bp, Homo sapiens
ctaaccttttatca

SEQ ID NO: 5880785 - DNA, 20 bp, Homo sapiens
ctaacgaaatatcaaagtca

SEQ ID NO: 5880786 - DNA, 16 bp, Homo sapiens
ctaacgaacgttttaa

SEQ ID NO: 5880787 - DNA, 20 bp, Homo sapiens
ctaacgaacgttttaaagct

SEQ ID NO: 5880788 - DNA, 20 bp, Homo sapiens
ctaacgacttcagggcaggg

SEQ ID NO: 5880789 - DNA, 22 bp, Homo sapiens
ctaacgataaaaggtaataaca

SEQ ID NO: 5880790 - DNA, 14 bp, Homo sapiens
ctaacgccagcaca

SEQ ID NO: 5880791 - DNA, 13 bp, Homo sapiens
ctaacgcctgagc

SEQ ID NO: 5880792 - DNA, 17 bp, Homo sapiens
ctaacgcctgagcccag

SEQ ID NO: 5880793 - DNA, 18 bp, Homo sapiens
ctaacgcctgagcccagg

SEQ ID NO: 5880794 - DNA, 19 bp, Homo sapiens
ctaacgcctgagcccaggg

SEQ ID NO: 5880795 - DNA, 14 bp, Homo sapiens
ctaacgggcgcctt

SEQ ID NO: 5880796 - DNA, 23 bp, Homo sapiens
ctaacgggggtgcggcaggagca

SEQ ID NO: 5880797 - DNA, 22 bp, Homo sapiens
ctaacggtctgttctgtttcaa

SEQ ID NO: 5880798 - DNA, 13 bp, Homo sapiens
ctaactaaaacaa

SEQ ID NO: 5880799 - DNA, 20 bp, Homo sapiens
ctaactaaaacaaagccact

SEQ ID NO: 5880800 - DNA, 12 bp, Homo sapiens
ctaactaaactc

SEQ ID NO: 5880801 - DNA, 15 bp, Homo sapiens
ctaactaaataccat

SEQ ID NO: 5880802 - DNA, 19 bp, Homo sapiens
ctaactaaccacattttag

SEQ ID NO: 5880803 - DNA, 15 bp, Homo sapiens
ctaactaactggcag

SEQ ID NO: 5880804 - DNA, 17 bp, Homo sapiens
ctaactacatgaacaca

SEQ ID NO: 5880805 - DNA, 16 bp, Homo sapiens
ctaactagaattagta

SEQ ID NO: 5880806 - DNA, 15 bp, Homo sapiens
ctaactagacaccaa

SEQ ID NO: 5880807 - DNA, 16 bp, Homo sapiens
ctaactagtaatcttg

SEQ ID NO: 5880808 - DNA, 13 bp, Homo sapiens
ctaactataacca

SEQ ID NO: 5880809 - DNA, 14 bp, Homo sapiens
ctaactatgcaata

SEQ ID NO: 5880810 - DNA, 21 bp, Homo sapiens
ctaactcaccagccccactgc

SEQ ID NO: 5880811 - DNA, 16 bp, Homo sapiens
ctaactcactgcctag

SEQ ID NO: 5880812 - DNA, 19 bp, Homo sapiens
ctaactcagaaacatcagt

SEQ ID NO: 5880813 - DNA, 17 bp, Homo sapiens
ctaactccaaagcctgc

SEQ ID NO: 5880814 - DNA, 15 bp, Homo sapiens
ctaactccaccgcct

SEQ ID NO: 5880815 - DNA, 18 bp, Homo sapiens
ctaactccactggctcca

SEQ ID NO: 5880816 - DNA, 14 bp, Homo sapiens
ctaactccagtgaa

SEQ ID NO: 5880817 - DNA, 13 bp, Homo sapiens
ctaactccctcct

SEQ ID NO: 5880818 - DNA, 15 bp, Homo sapiens
ctaactccctcctca

SEQ ID NO: 5880819 - DNA, 19 bp, Homo sapiens
ctaactccctcctcacact

SEQ ID NO: 5880820 - DNA, 16 bp, Homo sapiens
ctaactccgagagcag

SEQ ID NO: 5880821 - DNA, 14 bp, Homo sapiens
ctaactcctgagaa

SEQ ID NO: 5880822 - DNA, 23 bp, Homo sapiens
ctaactcctgccattcttctggt

SEQ ID NO: 5880823 - DNA, 18 bp, Homo sapiens
ctaactccttaacaactg

SEQ ID NO: 5880824 - DNA, 17 bp, Homo sapiens
ctaactccttatgtttg

SEQ ID NO: 5880825 - DNA, 21 bp, Homo sapiens
ctaactctagtttgcagagga

SEQ ID NO: 5880826 - DNA, 14 bp, Homo sapiens
ctaactctgagagc

SEQ ID NO: 5880827 - DNA, 18 bp, Homo sapiens
ctaactctgagagctgtt

SEQ ID NO: 5880828 - DNA, 16 bp, Homo sapiens
ctaactctgatgtaaa

SEQ ID NO: 5880829 - DNA, 17 bp, Homo sapiens
ctaactctgatgtaaat

SEQ ID NO: 5880830 - DNA, 13 bp, Homo sapiens
ctaactctggcac

SEQ ID NO: 5880831 - DNA, 16 bp, Homo sapiens
ctaactcttagaagtg

SEQ ID NO: 5880832 - DNA, 17 bp, Homo sapiens
ctaactcttctttcatt

SEQ ID NO: 5880833 - DNA, 18 bp, Homo sapiens
ctaactgaaggtgcagtt

SEQ ID NO: 5880834 - DNA, 21 bp, Homo sapiens
ctaactgactctgttattgat

SEQ ID NO: 5880835 - DNA, 14 bp, Homo sapiens
ctaactgagctgcc

SEQ ID NO: 5880836 - DNA, 16 bp, Homo sapiens
ctaactgagctgccag

SEQ ID NO: 5880837 - DNA, 18 bp, Homo sapiens
ctaactgattcagggccc

SEQ ID NO: 5880838 - DNA, 12 bp, Homo sapiens
ctaactgccatg

SEQ ID NO: 5880839 - DNA, 11 bp, Homo sapiens
ctaactgcttc

SEQ ID NO: 5880840 - DNA, 19 bp, Homo sapiens
ctaactgcttcatctcctt

SEQ ID NO: 5880841 - DNA, 21 bp, Homo sapiens
ctaactgcttcatctcctttt

SEQ ID NO: 5880842 - DNA, 14 bp, Homo sapiens
ctaactggacagcc

SEQ ID NO: 5880843 - DNA, 22 bp, Homo sapiens
ctaactggacagcctcttctgt

SEQ ID NO: 5880844 - DNA, 14 bp, Homo sapiens
ctaactgggaagaa

SEQ ID NO: 5880845 - DNA, 16 bp, Homo sapiens
ctaactgggttaaata

SEQ ID NO: 5880846 - DNA, 22 bp, Homo sapiens
ctaactgggttaaatattttgc

SEQ ID NO: 5880847 - DNA, 17 bp, Homo sapiens
ctaactgggttacagtg

SEQ ID NO: 5880848 - DNA, 15 bp, Homo sapiens
ctaactgtaaatcac

SEQ ID NO: 5880849 - DNA, 20 bp, Homo sapiens
ctaactgtaaatcacttgta

SEQ ID NO: 5880850 - DNA, 22 bp, Homo sapiens
ctaactgtaaatcacttgtaaa

SEQ ID NO: 5880851 - DNA, 23 bp, Homo sapiens
ctaactgtaaatcacttgtaaat

SEQ ID NO: 5880852 - DNA, 16 bp, Homo sapiens
ctaactgtatatttgt

SEQ ID NO: 5880853 - DNA, 13 bp, Homo sapiens
ctaactgtgcaaa

SEQ ID NO: 5880854 - DNA, 15 bp, Homo sapiens
ctaactgtggaatat

SEQ ID NO: 5880855 - DNA, 21 bp, Homo sapiens
ctaactgtggaatataaatag

SEQ ID NO: 5880856 - DNA, 23 bp, Homo sapiens
ctaactgttttgtatatgctgca

SEQ ID NO: 5880857 - DNA, 18 bp, Homo sapiens
ctaacttaaaaaactgca

SEQ ID NO: 5880858 - DNA, 23 bp, Homo sapiens
ctaacttattgcctgggcagtgc

SEQ ID NO: 5880859 - DNA, 12 bp, Homo sapiens
ctaacttattta

SEQ ID NO: 5880860 - DNA, 15 bp, Homo sapiens
ctaacttcaccatat

SEQ ID NO: 5880861 - DNA, 14 bp, Homo sapiens
ctaacttcagtagg

SEQ ID NO: 5880862 - DNA, 14 bp, Homo sapiens
ctaacttcctttat

SEQ ID NO: 5880863 - DNA, 12 bp, Homo sapiens
ctaacttctaaa

SEQ ID NO: 5880864 - DNA, 16 bp, Homo sapiens
ctaacttctaaaactg

SEQ ID NO: 5880865 - DNA, 17 bp, Homo sapiens
ctaacttctaaaactgt

SEQ ID NO: 5880866 - DNA, 18 bp, Homo sapiens
ctaacttggggaaggggc

SEQ ID NO: 5880867 - DNA, 13 bp, Homo sapiens
ctaactttattct

SEQ ID NO: 5880868 - DNA, 13 bp, Homo sapiens
ctaactttccttc

SEQ ID NO: 5880869 - DNA, 12 bp, Homo sapiens
ctaactttgtaa

SEQ ID NO: 5880870 - DNA, 21 bp, Homo sapiens
ctaacttttataggttatcaa

SEQ ID NO: 5880871 - DNA, 19 bp, Homo sapiens
ctaacttttcaatgacatt

SEQ ID NO: 5880872 - DNA, 16 bp, Homo sapiens
ctaacttttttttact

SEQ ID NO: 5880873 - DNA, 14 bp, Homo sapiens
ctaagaaaagattt

SEQ ID NO: 5880874 - DNA, 20 bp, Homo sapiens
ctaagaaaagattttaatca

SEQ ID NO: 5880875 - DNA, 21 bp, Homo sapiens
ctaagaaaagattttaatcaa

SEQ ID NO: 5880876 - DNA, 15 bp, Homo sapiens
ctaagaaaatgtagt

SEQ ID NO: 5880877 - DNA, 12 bp, Homo sapiens
ctaagaaacatt

SEQ ID NO: 5880878 - DNA, 19 bp, Homo sapiens
ctaagaaacattggaagca

SEQ ID NO: 5880879 - DNA, 19 bp, Homo sapiens
ctaagaaacatttatattg

SEQ ID NO: 5880880 - DNA, 21 bp, Homo sapiens
ctaagaaacatttatattgat

SEQ ID NO: 5880881 - DNA, 14 bp, Homo sapiens
ctaagaaacttttg

SEQ ID NO: 5880882 - DNA, 17 bp, Homo sapiens
ctaagaaacttttgtaa

SEQ ID NO: 5880883 - DNA, 16 bp, Homo sapiens
ctaagaaagaaaggaa

SEQ ID NO: 5880884 - DNA, 18 bp, Homo sapiens
ctaagaaagaaaggaaag

SEQ ID NO: 5880885 - DNA, 16 bp, Homo sapiens
ctaagaaagacatcac

SEQ ID NO: 5880886 - DNA, 19 bp, Homo sapiens
ctaagaaatagcatcgatg

SEQ ID NO: 5880887 - DNA, 22 bp, Homo sapiens
ctaagaaatatctgtgaaatat

SEQ ID NO: 5880888 - DNA, 15 bp, Homo sapiens
ctaagaaatatgtga

SEQ ID NO: 5880889 - DNA, 21 bp, Homo sapiens
ctaagaaatcaagtaatgaat

SEQ ID NO: 5880890 - DNA, 21 bp, Homo sapiens
ctaagaaatgccagtggtgga

SEQ ID NO: 5880891 - DNA, 20 bp, Homo sapiens
ctaagaaatgggactctgaa

SEQ ID NO: 5880892 - DNA, 16 bp, Homo sapiens
ctaagaaattgaatac

SEQ ID NO: 5880893 - DNA, 13 bp, Homo sapiens
ctaagaacaaaac

SEQ ID NO: 5880894 - DNA, 23 bp, Homo sapiens
ctaagaaccaaaaaaaaaaaagg

SEQ ID NO: 5880895 - DNA, 16 bp, Homo sapiens
ctaagaagaaggccag

SEQ ID NO: 5880896 - DNA, 18 bp, Homo sapiens
ctaagaagacattttgtt

SEQ ID NO: 5880897 - DNA, 19 bp, Homo sapiens
ctaagaagacattttgtta

SEQ ID NO: 5880898 - DNA, 16 bp, Homo sapiens
ctaagaagcttctaat

SEQ ID NO: 5880899 - DNA, 18 bp, Homo sapiens
ctaagaagcttctaataa

SEQ ID NO: 5880900 - DNA, 21 bp, Homo sapiens
ctaagaagcttctaataaatt

SEQ ID NO: 5880901 - DNA, 19 bp, Homo sapiens
ctaagaagtccccaggtca

SEQ ID NO: 5880902 - DNA, 20 bp, Homo sapiens
ctaagaagtccccaggtcat

SEQ ID NO: 5880903 - DNA, 16 bp, Homo sapiens
ctaagaagttactttt

SEQ ID NO: 5880904 - DNA, 20 bp, Homo sapiens
ctaagaagttcaccagccct

SEQ ID NO: 5880905 - DNA, 22 bp, Homo sapiens
ctaagaagttcaccagccctga

SEQ ID NO: 5880906 - DNA, 16 bp, Homo sapiens
ctaagaataaacattt

SEQ ID NO: 5880907 - DNA, 17 bp, Homo sapiens
ctaagaataaacatttg

SEQ ID NO: 5880908 - DNA, 16 bp, Homo sapiens
ctaagaataaataaag

SEQ ID NO: 5880909 - DNA, 21 bp, Homo sapiens
ctaagaataaataaagaagaa

SEQ ID NO: 5880910 - DNA, 22 bp, Homo sapiens
ctaagaataaataaagaagaaa

SEQ ID NO: 5880911 - DNA, 23 bp, Homo sapiens
ctaagaataacaagaagcccagt

SEQ ID NO: 5880912 - DNA, 18 bp, Homo sapiens
ctaagaataataaaatca

SEQ ID NO: 5880913 - DNA, 17 bp, Homo sapiens
ctaagaatacagctttc

SEQ ID NO: 5880914 - DNA, 15 bp, Homo sapiens
ctaagaatgaggaat

SEQ ID NO: 5880915 - DNA, 23 bp, Homo sapiens
ctaagaatgcagacttttcagac

SEQ ID NO: 5880916 - DNA, 14 bp, Homo sapiens
ctaagaatgctttg

SEQ ID NO: 5880917 - DNA, 17 bp, Homo sapiens
ctaagaatgtccttatt

SEQ ID NO: 5880918 - DNA, 17 bp, Homo sapiens
ctaagaattcaaactgg

SEQ ID NO: 5880919 - DNA, 17 bp, Homo sapiens
ctaagaattcagtagca

SEQ ID NO: 5880920 - DNA, 13 bp, Homo sapiens
ctaagaatttaga

SEQ ID NO: 5880921 - DNA, 22 bp, Homo sapiens
ctaagaatttcactgtctttta

SEQ ID NO: 5880922 - DNA, 17 bp, Homo sapiens
ctaagaattttgtttta

SEQ ID NO: 5880923 - DNA, 18 bp, Homo sapiens
ctaagaattttgttttac

SEQ ID NO: 5880924 - DNA, 17 bp, Homo sapiens
ctaagaattttttattt

SEQ ID NO: 5880925 - DNA, 15 bp, Homo sapiens
ctaagacaaatgcag

SEQ ID NO: 5880926 - DNA, 17 bp, Homo sapiens
ctaagacaaatgcagtg

SEQ ID NO: 5880927 - DNA, 22 bp, Homo sapiens
ctaagacaagaacattctctca

SEQ ID NO: 5880928 - DNA, 17 bp, Homo sapiens
ctaagacaatcacgctg

SEQ ID NO: 5880929 - DNA, 13 bp, Homo sapiens
ctaagacagagga

SEQ ID NO: 5880930 - DNA, 17 bp, Homo sapiens
ctaagacatttttcatt

SEQ ID NO: 5880931 - DNA, 17 bp, Homo sapiens
ctaagactaacaaaggc

SEQ ID NO: 5880932 - DNA, 20 bp, Homo sapiens
ctaagactaacaaaggcagc

SEQ ID NO: 5880933 - DNA, 20 bp, Homo sapiens
ctaagactcccgccccgggc

SEQ ID NO: 5880934 - DNA, 22 bp, Homo sapiens
ctaagactctgtgtggctgtgc

SEQ ID NO: 5880935 - DNA, 18 bp, Homo sapiens
ctaagactgccttcagta

SEQ ID NO: 5880936 - DNA, 18 bp, Homo sapiens
ctaagactgctgctgaat

SEQ ID NO: 5880937 - DNA, 15 bp, Homo sapiens
ctaagagaagtagaa

SEQ ID NO: 5880938 - DNA, 17 bp, Homo sapiens
ctaagagaagtagaaat

SEQ ID NO: 5880939 - DNA, 16 bp, Homo sapiens
ctaagagaagttattt

SEQ ID NO: 5880940 - DNA, 21 bp, Homo sapiens
ctaagagaagttgtaaagtat

SEQ ID NO: 5880941 - DNA, 15 bp, Homo sapiens
ctaagagaatgaatt

SEQ ID NO: 5880942 - DNA, 21 bp, Homo sapiens
ctaagagacacatacagagtg

SEQ ID NO: 5880943 - DNA, 19 bp, Homo sapiens
ctaagagacagttctctgt

SEQ ID NO: 5880944 - DNA, 11 bp, Homo sapiens
ctaagagacct

SEQ ID NO: 5880945 - DNA, 16 bp, Homo sapiens
ctaataaacactgttt

SEQ ID NO: 5880946 - DNA, 22 bp, Homo sapiens
ctaataaacagactgttttcta

SEQ ID NO: 5880947 - DNA, 12 bp, Homo sapiens
ctaataaaccag

SEQ ID NO: 5880948 - DNA, 15 bp, Homo sapiens
ctaataaactaataa

SEQ ID NO: 5880949 - DNA, 18 bp, Homo sapiens
ctaataaactaataattg

SEQ ID NO: 5880950 - DNA, 13 bp, Homo sapiens
ctaataaactgta

SEQ ID NO: 5880951 - DNA, 14 bp, Homo sapiens
ctaataaactgtat

SEQ ID NO: 5880952 - DNA, 11 bp, Homo sapiens
ctaataaagag

SEQ ID NO: 5880953 - DNA, 15 bp, Homo sapiens
ctaataaagagactg

SEQ ID NO: 5880954 - DNA, 19 bp, Homo sapiens
ctaataaagccatttctta

SEQ ID NO: 5880955 - DNA, 19 bp, Homo sapiens
ctaataaagctcctctgct

SEQ ID NO: 5880956 - DNA, 22 bp, Homo sapiens
ctaataaagctcctctgctcca

SEQ ID NO: 5880957 - DNA, 23 bp, Homo sapiens
ctaataaagctcctctgctccac

SEQ ID NO: 5880958 - DNA, 14 bp, Homo sapiens
ctaataaagctgtg

SEQ ID NO: 5880959 - DNA, 13 bp, Homo sapiens
ctaataaatacat

SEQ ID NO: 5880960 - DNA, 15 bp, Homo sapiens
ctaataaatataatt

SEQ ID NO: 5880961 - DNA, 16 bp, Homo sapiens
ctaataaatataattt

SEQ ID NO: 5880962 - DNA, 21 bp, Homo sapiens
ctaataaatataatttataag

SEQ ID NO: 5880963 - DNA, 21 bp, Homo sapiens
ctaataaatatactatgaaat

SEQ ID NO: 5880964 - DNA, 14 bp, Homo sapiens
ctaataaatgacca

SEQ ID NO: 5880965 - DNA, 15 bp, Homo sapiens
ctaataaatgaccag

SEQ ID NO: 5880966 - DNA, 18 bp, Homo sapiens
ctaataaatgaccagttt

SEQ ID NO: 5880967 - DNA, 12 bp, Homo sapiens
ctaataaattat

SEQ ID NO: 5880968 - DNA, 22 bp, Homo sapiens
ctaataaattttagtgtgcctt

SEQ ID NO: 5880969 - DNA, 16 bp, Homo sapiens
ctaataactttttcca

SEQ ID NO: 5880970 - DNA, 13 bp, Homo sapiens
ctaataagaagtg

SEQ ID NO: 5880971 - DNA, 22 bp, Homo sapiens
ctaataagaccccactggagtc

SEQ ID NO: 5880972 - DNA, 22 bp, Homo sapiens
ctaataagtttgtgttagaaaa

SEQ ID NO: 5880973 - DNA, 14 bp, Homo sapiens
ctaataataaatag

SEQ ID NO: 5880974 - DNA, 15 bp, Homo sapiens
ctaataataaatagt

SEQ ID NO: 5880975 - DNA, 17 bp, Homo sapiens
ctaataataaatagttc

SEQ ID NO: 5880976 - DNA, 21 bp, Homo sapiens
ctaataataaatgcatagagc

SEQ ID NO: 5880977 - DNA, 22 bp, Homo sapiens
ctaataataaatgcatagagca

SEQ ID NO: 5880978 - DNA, 14 bp, Homo sapiens
ctaataatcataaa

SEQ ID NO: 5880979 - DNA, 21 bp, Homo sapiens
ctaataatcttgtttctgaaa

SEQ ID NO: 5880980 - DNA, 22 bp, Homo sapiens
ctaataatgagctattaaaact

SEQ ID NO: 5880981 - DNA, 15 bp, Homo sapiens
ctaataattgtatct

SEQ ID NO: 5880982 - DNA, 17 bp, Homo sapiens
ctaataattgtatctac

SEQ ID NO: 5880983 - DNA, 16 bp, Homo sapiens
ctaataatttctaatg

SEQ ID NO: 5880984 - DNA, 16 bp, Homo sapiens
ctaatacattaaagca

SEQ ID NO: 5880985 - DNA, 18 bp, Homo sapiens
ctaatacattaaagcagt

SEQ ID NO: 5880986 - DNA, 19 bp, Homo sapiens
ctaatacattaaagcagtc

SEQ ID NO: 5880987 - DNA, 21 bp, Homo sapiens
ctaatacctcttactttgctt

SEQ ID NO: 5880988 - DNA, 19 bp, Homo sapiens
ctaatactggttatcctgt

SEQ ID NO: 5880989 - DNA, 15 bp, Homo sapiens
ctaatagaaaactgt

SEQ ID NO: 5880990 - DNA, 14 bp, Homo sapiens
ctaatagaaaagtc

SEQ ID NO: 5880991 - DNA, 18 bp, Homo sapiens
ctaatagaaaagtctcca

SEQ ID NO: 5880992 - DNA, 19 bp, Homo sapiens
ctaatagaaccaagaattc

SEQ ID NO: 5880993 - DNA, 22 bp, Homo sapiens
ctaatagaagtccatgagttga

SEQ ID NO: 5880994 - DNA, 17 bp, Homo sapiens
ctaatagacaatttatt

SEQ ID NO: 5880995 - DNA, 23 bp, Homo sapiens
ctaatagacaatttattatggca

SEQ ID NO: 5880996 - DNA, 17 bp, Homo sapiens
ctaatagagagattagt

SEQ ID NO: 5880997 - DNA, 23 bp, Homo sapiens
ctaatagcgggttactttcacat

SEQ ID NO: 5880998 - DNA, 21 bp, Homo sapiens
ctaataggctggggtttttgt

SEQ ID NO: 5880999 - DNA, 21 bp, Homo sapiens
ctaataggtactgccatattt

SEQ ID NO: 5881000 - DNA, 23 bp, Homo sapiens
ctaatagttttattaataaacat

SEQ ID NO: 5881001 - DNA, 22 bp, Homo sapiens
ctaatataagtttctttgcttc

SEQ ID NO: 5881002 - DNA, 14 bp, Homo sapiens
ctaatatatacata

SEQ ID NO: 5881003 - DNA, 23 bp, Homo sapiens
ctaatatatacatagaaactttg

SEQ ID NO: 5881004 - DNA, 18 bp, Homo sapiens
ctaatatatatgaataaa

SEQ ID NO: 5881005 - DNA, 17 bp, Homo sapiens
ctaatatatattttaag

SEQ ID NO: 5881006 - DNA, 23 bp, Homo sapiens
ctaatatatattttaaggttgca

SEQ ID NO: 5881007 - DNA, 16 bp, Homo sapiens
ctaatatatctgtaac

SEQ ID NO: 5881008 - DNA, 15 bp, Homo sapiens
ctaatatatggacct

SEQ ID NO: 5881009 - DNA, 16 bp, Homo sapiens
ctaatatatggaccta

SEQ ID NO: 5881010 - DNA, 17 bp, Homo sapiens
ctaatatatttaaaaat

SEQ ID NO: 5881011 - DNA, 12 bp, Homo sapiens
ctaatatatttt

SEQ ID NO: 5881012 - DNA, 15 bp, Homo sapiens
ctaatatatttttat

SEQ ID NO: 5881013 - DNA, 17 bp, Homo sapiens
ctaatatattttttcca

SEQ ID NO: 5881014 - DNA, 15 bp, Homo sapiens
ctaatatcattttat

SEQ ID NO: 5881015 - DNA, 23 bp, Homo sapiens
ctaatatccaacacaactatcaa

SEQ ID NO: 5881016 - DNA, 16 bp, Homo sapiens
ctaatatccacttgtc

SEQ ID NO: 5881017 - DNA, 22 bp, Homo sapiens
ctaatatcttaattctttgttc

SEQ ID NO: 5881018 - DNA, 14 bp, Homo sapiens
ctaatatgattata

SEQ ID NO: 5881019 - DNA, 15 bp, Homo sapiens
ctaatatgattatac

SEQ ID NO: 5881020 - DNA, 12 bp, Homo sapiens
ctaatatgattt

SEQ ID NO: 5881021 - DNA, 18 bp, Homo sapiens
ctaatatgcctaatctgt

SEQ ID NO: 5881022 - DNA, 17 bp, Homo sapiens
ctaatatgtaaaattac

SEQ ID NO: 5881023 - DNA, 18 bp, Homo sapiens
ctaatatgtaacaagcca

SEQ ID NO: 5881024 - DNA, 13 bp, Homo sapiens
ctaatattaaaag

SEQ ID NO: 5881025 - DNA, 18 bp, Homo sapiens
ctaatattagttggcttt

SEQ ID NO: 5881026 - DNA, 15 bp, Homo sapiens
ctaatattcaatgaa

SEQ ID NO: 5881027 - DNA, 20 bp, Homo sapiens
ctaatattcacatgttctaa

SEQ ID NO: 5881028 - DNA, 16 bp, Homo sapiens
ctaatattcagtcctg

SEQ ID NO: 5881029 - DNA, 13 bp, Homo sapiens
ctaatattcatgc

SEQ ID NO: 5881030 - DNA, 17 bp, Homo sapiens
ctaatattcatgctgcc

SEQ ID NO: 5881031 - DNA, 14 bp, Homo sapiens
ctaatattgaaaat

SEQ ID NO: 5881032 - DNA, 21 bp, Homo sapiens
ctaatattgcttcttgtgttt

SEQ ID NO: 5881033 - DNA, 21 bp, Homo sapiens
ctaatatttccagaaggattt

SEQ ID NO: 5881034 - DNA, 18 bp, Homo sapiens
ctaatatttgtctgtgtg

SEQ ID NO: 5881035 - DNA, 19 bp, Homo sapiens
ctaatatttgtctgtgtgc

SEQ ID NO: 5881036 - DNA, 21 bp, Homo sapiens
ctaatatttgtctgtgtgcta

SEQ ID NO: 5881037 - DNA, 12 bp, Homo sapiens
ctaatattttat

SEQ ID NO: 5881038 - DNA, 13 bp, Homo sapiens
ctaatattttatt

SEQ ID NO: 5881039 - DNA, 17 bp, Homo sapiens
ctaatattttcctcctg

SEQ ID NO: 5881040 - DNA, 17 bp, Homo sapiens
ctaatatttttaacaag

SEQ ID NO: 5881041 - DNA, 14 bp, Homo sapiens
ctaatatttttcat

SEQ ID NO: 5881042 - DNA, 20 bp, Homo sapiens
ctaatcaaagccagggtctc

SEQ ID NO: 5881043 - DNA, 21 bp, Homo sapiens
ctaatcaagagtctctccagc

SEQ ID NO: 5881044 - DNA, 19 bp, Homo sapiens
ctaatcaagagtgagtgaa

SEQ ID NO: 5881045 - DNA, 22 bp, Homo sapiens
ctaatcaagagtgagtgaacaa

SEQ ID NO: 5881046 - DNA, 15 bp, Homo sapiens
ctaatcacagtgttg

SEQ ID NO: 5881047 - DNA, 16 bp, Homo sapiens
ctaatcacagtgttgc

SEQ ID NO: 5881048 - DNA, 14 bp, Homo sapiens
ctaatcactctgag

SEQ ID NO: 5881049 - DNA, 17 bp, Homo sapiens
ctaatcagaaattttta

SEQ ID NO: 5881050 - DNA, 23 bp, Homo sapiens
ctaatcagaaatttttatcagtt

SEQ ID NO: 5881051 - DNA, 17 bp, Homo sapiens
ctaatcagcattctcac

SEQ ID NO: 5881052 - DNA, 20 bp, Homo sapiens
ctaatcagcattctcactcc

SEQ ID NO: 5881053 - DNA, 21 bp, Homo sapiens
ctaatcagggaggtcattttg

SEQ ID NO: 5881054 - DNA, 17 bp, Homo sapiens
ctaatcaggttgttaat

SEQ ID NO: 5881055 - DNA, 12 bp, Homo sapiens
ctaatcagtagt

SEQ ID NO: 5881056 - DNA, 13 bp, Homo sapiens
ctaatcagtgatt

SEQ ID NO: 5881057 - DNA, 12 bp, Homo sapiens
ctaatcagtgtc

SEQ ID NO: 5881058 - DNA, 13 bp, Homo sapiens
ctaatcagtgtct

SEQ ID NO: 5881059 - DNA, 20 bp, Homo sapiens
ctaatcagtgtctcacactg

SEQ ID NO: 5881060 - DNA, 16 bp, Homo sapiens
ctaatcatccaatgct

SEQ ID NO: 5881061 - DNA, 15 bp, Homo sapiens
ctaatcatctgcagt

SEQ ID NO: 5881062 - DNA, 15 bp, Homo sapiens
ctaatccaatacctc

SEQ ID NO: 5881063 - DNA, 19 bp, Homo sapiens
ctaatccctgggcattgct

SEQ ID NO: 5881064 - DNA, 20 bp, Homo sapiens
ctaatccctgggcattgctt

SEQ ID NO: 5881065 - DNA, 19 bp, Homo sapiens
ctaatcccttcctctccca

SEQ ID NO: 5881066 - DNA, 21 bp, Homo sapiens
ctaatcctagtttgctgtggc

SEQ ID NO: 5881067 - DNA, 22 bp, Homo sapiens
ctaatcctatctggggagctcc

SEQ ID NO: 5881068 - DNA, 12 bp, Homo sapiens
ctaatccttttc

SEQ ID NO: 5881069 - DNA, 14 bp, Homo sapiens
ctaatctaaactgt

SEQ ID NO: 5881070 - DNA, 19 bp, Homo sapiens
ctaatctagatatcgactt

SEQ ID NO: 5881071 - DNA, 22 bp, Homo sapiens
ctaatctatatgatatgcagcc

SEQ ID NO: 5881072 - DNA, 19 bp, Homo sapiens
ctaatctattgggttcatt

SEQ ID NO: 5881073 - DNA, 20 bp, Homo sapiens
ctaatctattgggttcatta

SEQ ID NO: 5881074 - DNA, 21 bp, Homo sapiens
ctaatctattgggttcattat

SEQ ID NO: 5881075 - DNA, 22 bp, Homo sapiens
ctaatctattgggttcattatt

SEQ ID NO: 5881076 - DNA, 15 bp, Homo sapiens
ctaatctcaatttaa

SEQ ID NO: 5881077 - DNA, 15 bp, Homo sapiens
ctaatctcatacctc

SEQ ID NO: 5881078 - DNA, 18 bp, Homo sapiens
ctaatctcatacctctga

SEQ ID NO: 5881079 - DNA, 20 bp, Homo sapiens
ctaatctccacttttttcat

SEQ ID NO: 5881080 - DNA, 14 bp, Homo sapiens
ctaatctctttatt

SEQ ID NO: 5881081 - DNA, 23 bp, Homo sapiens
ctaatctgaccgttctattgtgt

SEQ ID NO: 5881082 - DNA, 22 bp, Homo sapiens
ctaatctgagctgcagcctggc

SEQ ID NO: 5881083 - DNA, 12 bp, Homo sapiens
ctaatctgcctg

SEQ ID NO: 5881084 - DNA, 13 bp, Homo sapiens
ctaatctgtaggg

SEQ ID NO: 5881085 - DNA, 18 bp, Homo sapiens
ctaatctgtagggctgga

SEQ ID NO: 5881086 - DNA, 21 bp, Homo sapiens
ctaatctgtagggctggacct

SEQ ID NO: 5881087 - DNA, 18 bp, Homo sapiens
ctaatctgtgctgtttca

SEQ ID NO: 5881088 - DNA, 21 bp, Homo sapiens
ctaatctgtgctgtttcaaag

SEQ ID NO: 5881089 - DNA, 21 bp, Homo sapiens
ctaatcttaaatcagaataaa

SEQ ID NO: 5881090 - DNA, 15 bp, Homo sapiens
ctaatcttcagggca

SEQ ID NO: 5881091 - DNA, 22 bp, Homo sapiens
ctaatcttcagggcactgctgc

SEQ ID NO: 5881092 - DNA, 14 bp, Homo sapiens
ctaatcttgtccct

SEQ ID NO: 5881093 - DNA, 19 bp, Homo sapiens
ctaatcttgtgaaaataat

SEQ ID NO: 5881094 - DNA, 13 bp, Homo sapiens
ctaatgaaaaaca

SEQ ID NO: 5881095 - DNA, 15 bp, Homo sapiens
ctaatgaaaaacaaa

SEQ ID NO: 5881096 - DNA, 23 bp, Homo sapiens
ctaatgaaacaaaaaatattcat

SEQ ID NO: 5881097 - DNA, 13 bp, Homo sapiens
ctaatgaaagtga

SEQ ID NO: 5881098 - DNA, 20 bp, Homo sapiens
ctaatgaaagtgatgacata

SEQ ID NO: 5881099 - DNA, 14 bp, Homo sapiens
ctaatgaaattgag

SEQ ID NO: 5881100 - DNA, 16 bp, Homo sapiens
ctaatgaaattgagaa

SEQ ID NO: 5881101 - DNA, 16 bp, Homo sapiens
ctaatgaagacaatga

SEQ ID NO: 5881102 - DNA, 23 bp, Homo sapiens
ctaatgaagggaaaggatatttt

SEQ ID NO: 5881103 - DNA, 21 bp, Homo sapiens
ctaatgaaggttttcatttgc

SEQ ID NO: 5881104 - DNA, 11 bp, Homo sapiens
ctaatgaagta

SEQ ID NO: 5881105 - DNA, 18 bp, Homo sapiens
ctaatgaagtattacatg

SEQ ID NO: 5881106 - DNA, 20 bp, Homo sapiens
ctaatgaatgcaaaaagata

SEQ ID NO: 5881107 - DNA, 19 bp, Homo sapiens
ctaatgaatgcataaaatg

SEQ ID NO: 5881108 - DNA, 21 bp, Homo sapiens
ctaatgaattttaaaagcata

SEQ ID NO: 5881109 - DNA, 23 bp, Homo sapiens
ctaatgacaattttgagaaaagg

SEQ ID NO: 5881110 - DNA, 12 bp, Homo sapiens
ctaatgacccag

SEQ ID NO: 5881111 - DNA, 18 bp, Homo sapiens
ctaatgacgatgccgtgt

SEQ ID NO: 5881112 - DNA, 18 bp, Homo sapiens
ctaatgagatatatcttt

SEQ ID NO: 5881113 - DNA, 19 bp, Homo sapiens
ctaatgagatatatcttta

SEQ ID NO: 5881114 - DNA, 14 bp, Homo sapiens
ctaatgagctagtg

SEQ ID NO: 5881115 - DNA, 16 bp, Homo sapiens
ctaatgagctttgggc

SEQ ID NO: 5881116 - DNA, 17 bp, Homo sapiens
ctaatgaggagagaaaa

SEQ ID NO: 5881117 - DNA, 21 bp, Homo sapiens
ctaatgaggagagaaaatata

SEQ ID NO: 5881118 - DNA, 18 bp, Homo sapiens
ctaatgaggcattacaaa

SEQ ID NO: 5881119 - DNA, 18 bp, Homo sapiens
ctaatgagttgctggaaa

SEQ ID NO: 5881120 - DNA, 19 bp, Homo sapiens
ctaatgatcaaaacatgct

SEQ ID NO: 5881121 - DNA, 13 bp, Homo sapiens
ctaatgatggccc

SEQ ID NO: 5881122 - DNA, 18 bp, Homo sapiens
ctaatgcagaattgctag

SEQ ID NO: 5881123 - DNA, 16 bp, Homo sapiens
ctaatgcattaacttt

SEQ ID NO: 5881124 - DNA, 14 bp, Homo sapiens
ctaatgccaagtta

SEQ ID NO: 5881125 - DNA, 17 bp, Homo sapiens
ctaatgccctatgtgta

SEQ ID NO: 5881126 - DNA, 15 bp, Homo sapiens
ctaatgcgcaggctg

SEQ ID NO: 5881127 - DNA, 20 bp, Homo sapiens
ctaatgcgcaggctggccct

SEQ ID NO: 5881128 - DNA, 22 bp, Homo sapiens
ctaatgcgcaggctggccctgc

SEQ ID NO: 5881129 - DNA, 14 bp, Homo sapiens
ctaatgctaagaaa

SEQ ID NO: 5881130 - DNA, 13 bp, Homo sapiens
ctaatgctcacct

SEQ ID NO: 5881131 - DNA, 12 bp, Homo sapiens
ctaatgctcctt

SEQ ID NO: 5881132 - DNA, 18 bp, Homo sapiens
ctaatgctccttgttcct

SEQ ID NO: 5881133 - DNA, 19 bp, Homo sapiens
ctaatgctcgtatctcctt

SEQ ID NO: 5881134 - DNA, 12 bp, Homo sapiens
ctaatgctggcc

SEQ ID NO: 5881135 - DNA, 13 bp, Homo sapiens
ctaatgctggcct

SEQ ID NO: 5881136 - DNA, 16 bp, Homo sapiens
ctaatgcttgtttatg

SEQ ID NO: 5881137 - DNA, 17 bp, Homo sapiens
ctaatgcttgtttatga

SEQ ID NO: 5881138 - DNA, 14 bp, Homo sapiens
ctaatggagaagac

SEQ ID NO: 5881139 - DNA, 21 bp, Homo sapiens
ctaatggattataatcagaat

SEQ ID NO: 5881140 - DNA, 12 bp, Homo sapiens
ctaatggcatgg

SEQ ID NO: 5881141 - DNA, 22 bp, Homo sapiens
ctaatggccaagtgtacatttg

SEQ ID NO: 5881142 - DNA, 16 bp, Homo sapiens
ctaatgggaatcattc

SEQ ID NO: 5881143 - DNA, 19 bp, Homo sapiens
ctaatgggaatcattccac

SEQ ID NO: 5881144 - DNA, 12 bp, Homo sapiens
ctaatgggacac

SEQ ID NO: 5881145 - DNA, 20 bp, Homo sapiens
ctaatggggaaatgtagcta

SEQ ID NO: 5881146 - DNA, 20 bp, Homo sapiens
ctaatgggggcagtctcccc

SEQ ID NO: 5881147 - DNA, 13 bp, Homo sapiens
ctaatggtaactt

SEQ ID NO: 5881148 - DNA, 14 bp, Homo sapiens
ctaatggtaacttt

SEQ ID NO: 5881149 - DNA, 15 bp, Homo sapiens
ctaatggtaactttt

SEQ ID NO: 5881150 - DNA, 18 bp, Homo sapiens
ctaatggtaacttttgta

SEQ ID NO: 5881151 - DNA, 22 bp, Homo sapiens
ctaatggttgggttgattgtat

SEQ ID NO: 5881152 - DNA, 17 bp, Homo sapiens
ctaatgtaaattttaat

SEQ ID NO: 5881153 - DNA, 17 bp, Homo sapiens
ctaatgtaacttcctct

SEQ ID NO: 5881154 - DNA, 16 bp, Homo sapiens
ctaatgtactgcatat

SEQ ID NO: 5881155 - DNA, 15 bp, Homo sapiens
ctaatgtagctattt

SEQ ID NO: 5881156 - DNA, 16 bp, Homo sapiens
ctaatgtaggactgta

SEQ ID NO: 5881157 - DNA, 18 bp, Homo sapiens
ctaatgtaggactgtata

SEQ ID NO: 5881158 - DNA, 17 bp, Homo sapiens
ctaatgtattttattgt

SEQ ID NO: 5881159 - DNA, 19 bp, Homo sapiens
ctaatgtcacaacatggtg

SEQ ID NO: 5881160 - DNA, 21 bp, Homo sapiens
ctaatgtctcactgttctgca

SEQ ID NO: 5881161 - DNA, 19 bp, Homo sapiens
ctaatgtctcttcctctgt

SEQ ID NO: 5881162 - DNA, 15 bp, Homo sapiens
ctaatgtctgcagct

SEQ ID NO: 5881163 - DNA, 15 bp, Homo sapiens
ctaatgtcttcataa

SEQ ID NO: 5881164 - DNA, 22 bp, Homo sapiens
ctaatgtcttcatttcattgta

SEQ ID NO: 5881165 - DNA, 20 bp, Homo sapiens
ctaatgtgaatgtgagtgaa

SEQ ID NO: 5881166 - DNA, 22 bp, Homo sapiens
ctaatgtgagtgtgaagctttg

SEQ ID NO: 5881167 - DNA, 23 bp, Homo sapiens
ctaatgtggaccttagaatacag

SEQ ID NO: 5881168 - DNA, 13 bp, Homo sapiens
ctaatgtggtagt

SEQ ID NO: 5881169 - DNA, 13 bp, Homo sapiens
ctaatgtgtctgt

SEQ ID NO: 5881170 - DNA, 17 bp, Homo sapiens
ctaatgtgtctgtggac

SEQ ID NO: 5881171 - DNA, 22 bp, Homo sapiens
ctaatgttagaattgatttcca

SEQ ID NO: 5881172 - DNA, 16 bp, Homo sapiens
ctaatgttatttctta

SEQ ID NO: 5881173 - DNA, 19 bp, Homo sapiens
ctaatgttattttccttct

SEQ ID NO: 5881174 - DNA, 22 bp, Homo sapiens
ctaatgttgatcagcaaattta

SEQ ID NO: 5881175 - DNA, 15 bp, Homo sapiens
ctaatgttggacaga

SEQ ID NO: 5881176 - DNA, 22 bp, Homo sapiens
ctaatgttggcagatgcagctc

SEQ ID NO: 5881177 - DNA, 21 bp, Homo sapiens
ctaatgttgtctttttaatgt

SEQ ID NO: 5881178 - DNA, 17 bp, Homo sapiens
ctaatgtttaagcagaa

SEQ ID NO: 5881179 - DNA, 13 bp, Homo sapiens
ctaatgtttacta

SEQ ID NO: 5881180 - DNA, 20 bp, Homo sapiens
ctaatgtttatgagccagac

SEQ ID NO: 5881181 - DNA, 15 bp, Homo sapiens
ctaatgtttgaacaa

SEQ ID NO: 5881182 - DNA, 15 bp, Homo sapiens
ctaatgtttgcatat

SEQ ID NO: 5881183 - DNA, 16 bp, Homo sapiens
ctaatgtttgcatata

SEQ ID NO: 5881184 - DNA, 18 bp, Homo sapiens
ctaatgtttgtattttta

SEQ ID NO: 5881185 - DNA, 16 bp, Homo sapiens
ctaatgttttgcttaa

SEQ ID NO: 5881186 - DNA, 10 bp, Homo sapiens
ctaattaaaa

SEQ ID NO: 5881187 - DNA, 16 bp, Homo sapiens
ctaattaaaaactgtg

SEQ ID NO: 5881188 - DNA, 23 bp, Homo sapiens
ctaattaaaaactgtgattttta

SEQ ID NO: 5881189 - DNA, 16 bp, Homo sapiens
ctaattaaaaagttaa

SEQ ID NO: 5881190 - DNA, 11 bp, Homo sapiens
ctaattaaaat

SEQ ID NO: 5881191 - DNA, 12 bp, Homo sapiens
ctaattaaaatg

SEQ ID NO: 5881192 - DNA, 18 bp, Homo sapiens
ctaattaaaatgtgcagt

SEQ ID NO: 5881193 - DNA, 18 bp, Homo sapiens
ctaattaaaattgtgcat

SEQ ID NO: 5881194 - DNA, 15 bp, Homo sapiens
ctaattaaataatac

SEQ ID NO: 5881195 - DNA, 17 bp, Homo sapiens
ctaattaaccttactaa

SEQ ID NO: 5881196 - DNA, 23 bp, Homo sapiens
ctaattaaggtttgccctgcctg

SEQ ID NO: 5881197 - DNA, 13 bp, Homo sapiens
ctaattaataaag

SEQ ID NO: 5881198 - DNA, 20 bp, Homo sapiens
ctaattaatagtatttcaga

SEQ ID NO: 5881199 - DNA, 21 bp, Homo sapiens
ctaattacacacgtgtgatgt

SEQ ID NO: 5881200 - DNA, 18 bp, Homo sapiens
ctaattagggtacattta

SEQ ID NO: 5881201 - DNA, 23 bp, Homo sapiens
ctaattagtctatcaaatgaaac

SEQ ID NO: 5881202 - DNA, 18 bp, Homo sapiens
ctaattatactactttgt

SEQ ID NO: 5881203 - DNA, 21 bp, Homo sapiens
ctaattatactactttgttag

SEQ ID NO: 5881204 - DNA, 14 bp, Homo sapiens
ctaattatatattt

SEQ ID NO: 5881205 - DNA, 17 bp, Homo sapiens
ctaattatatattttgt

SEQ ID NO: 5881206 - DNA, 22 bp, Homo sapiens
ctaattatatattttgttgttc

SEQ ID NO: 5881207 - DNA, 14 bp, Homo sapiens
ctaattatcaaggg

SEQ ID NO: 5881208 - DNA, 18 bp, Homo sapiens
ctaattatcaatattgag

SEQ ID NO: 5881209 - DNA, 15 bp, Homo sapiens
ctaattatgtagctc

SEQ ID NO: 5881210 - DNA, 13 bp, Homo sapiens
ctaattattttaa

SEQ ID NO: 5881211 - DNA, 15 bp, Homo sapiens
ctaattcaactctgt

SEQ ID NO: 5881212 - DNA, 16 bp, Homo sapiens
ctaattcaaggaattt

SEQ ID NO: 5881213 - DNA, 15 bp, Homo sapiens
ctaattcaattcaaa

SEQ ID NO: 5881214 - DNA, 21 bp, Homo sapiens
ctaattcacacaaagactcct

SEQ ID NO: 5881215 - DNA, 15 bp, Homo sapiens
ctaattcacagtgct

SEQ ID NO: 5881216 - DNA, 16 bp, Homo sapiens
ctaattcacagtgctc

SEQ ID NO: 5881217 - DNA, 22 bp, Homo sapiens
ctaattcagacagagactttaa

SEQ ID NO: 5881218 - DNA, 12 bp, Homo sapiens
ctaattcatctt

SEQ ID NO: 5881219 - DNA, 14 bp, Homo sapiens
ctaattcatctttt

SEQ ID NO: 5881220 - DNA, 16 bp, Homo sapiens
ctaattcatcttttaa

SEQ ID NO: 5881221 - DNA, 19 bp, Homo sapiens
ctaattcatcttttaatca

SEQ ID NO: 5881222 - DNA, 20 bp, Homo sapiens
ctaattcatcttttaatcat

SEQ ID NO: 5881223 - DNA, 13 bp, Homo sapiens
ctaattcatttat

SEQ ID NO: 5881224 - DNA, 14 bp, Homo sapiens
ctaattcatttatt

SEQ ID NO: 5881225 - DNA, 17 bp, Homo sapiens
ctaattccacacctttt

SEQ ID NO: 5881226 - DNA, 14 bp, Homo sapiens
ctaattccacagct

SEQ ID NO: 5881227 - DNA, 15 bp, Homo sapiens
ctaattccacagctg

SEQ ID NO: 5881228 - DNA, 16 bp, Homo sapiens
ctaattccacagctgc

SEQ ID NO: 5881229 - DNA, 19 bp, Homo sapiens
ctaattcccattttgcaaa

SEQ ID NO: 5881230 - DNA, 20 bp, Homo sapiens
ctaattcccattttgcaaaa

SEQ ID NO: 5881231 - DNA, 17 bp, Homo sapiens
ctaattcctgtatgtta

SEQ ID NO: 5881232 - DNA, 20 bp, Homo sapiens
ctaattccttaaatgaacta

SEQ ID NO: 5881233 - DNA, 14 bp, Homo sapiens
ctaattctaatgtg

SEQ ID NO: 5881234 - DNA, 14 bp, Homo sapiens
ctaattctatttct

SEQ ID NO: 5881235 - DNA, 13 bp, Homo sapiens
ctaattctcacat

SEQ ID NO: 5881236 - DNA, 19 bp, Homo sapiens
ctaattctcttacccagaa

SEQ ID NO: 5881237 - DNA, 15 bp, Homo sapiens
ctaattctcttcgct

SEQ ID NO: 5881238 - DNA, 17 bp, Homo sapiens
ctaattctcttcgctgt

SEQ ID NO: 5881239 - DNA, 18 bp, Homo sapiens
ctaattctcttcgctgtg

SEQ ID NO: 5881240 - DNA, 19 bp, Homo sapiens
ctaattctgggaagggaga

SEQ ID NO: 5881241 - DNA, 23 bp, Homo sapiens
ctaattcttatttttaatttttc

SEQ ID NO: 5881242 - DNA, 15 bp, Homo sapiens
ctaattcttcattat

SEQ ID NO: 5881243 - DNA, 18 bp, Homo sapiens
ctaattcttcctttgtaa

SEQ ID NO: 5881244 - DNA, 16 bp, Homo sapiens
ctaattcttctgtcct

SEQ ID NO: 5881245 - DNA, 13 bp, Homo sapiens
ctaattctttaat

SEQ ID NO: 5881246 - DNA, 21 bp, Homo sapiens
ctaattctttgacctgttggg

SEQ ID NO: 5881247 - DNA, 12 bp, Homo sapiens
ctaattctttgc

SEQ ID NO: 5881248 - DNA, 14 bp, Homo sapiens
ctaattctttgcaa

SEQ ID NO: 5881249 - DNA, 18 bp, Homo sapiens
ctaattctttgcaaaaat

SEQ ID NO: 5881250 - DNA, 22 bp, Homo sapiens
ctaattgaaatttaaaaataaa

SEQ ID NO: 5881251 - DNA, 13 bp, Homo sapiens
ctaattgaacatg

SEQ ID NO: 5881252 - DNA, 18 bp, Homo sapiens
ctaattgacttgcaaaga

SEQ ID NO: 5881253 - DNA, 21 bp, Homo sapiens
ctaattgacttgcaaagacct

SEQ ID NO: 5881254 - DNA, 13 bp, Homo sapiens
ctaattgacttta

SEQ ID NO: 5881255 - DNA, 24 bp, Homo sapiens
ctaattgctgttgaaagcaaaaat

SEQ ID NO: 5881256 - DNA, 11 bp, Homo sapiens
ctaattgctta

SEQ ID NO: 5881257 - DNA, 13 bp, Homo sapiens
ctaattgcttatt

SEQ ID NO: 5881258 - DNA, 18 bp, Homo sapiens
ctaattgcttatttattg

SEQ ID NO: 5881259 - DNA, 12 bp, Homo sapiens
ctaattggaaag

SEQ ID NO: 5881260 - DNA, 16 bp, Homo sapiens
ctaattggaaagtgcc

SEQ ID NO: 5881261 - DNA, 22 bp, Homo sapiens
ctaattggaaagtgccagcatt

SEQ ID NO: 5881262 - DNA, 19 bp, Homo sapiens
ctaattggaaggagagggg

SEQ ID NO: 5881263 - DNA, 22 bp, Homo sapiens
ctaattggcatgaaggtgtcat

SEQ ID NO: 5881264 - DNA, 20 bp, Homo sapiens
ctaattgtactaatctgaga

SEQ ID NO: 5881265 - DNA, 17 bp, Homo sapiens
ctaattgtataacaggt

SEQ ID NO: 5881266 - DNA, 15 bp, Homo sapiens
ctaattgtcacatca

SEQ ID NO: 5881267 - DNA, 18 bp, Homo sapiens
ctaattgtgcccctaaag

SEQ ID NO: 5881268 - DNA, 17 bp, Homo sapiens
ctaattgtgtatatgtt

SEQ ID NO: 5881269 - DNA, 19 bp, Homo sapiens
ctaattgttaaatttaaaa

SEQ ID NO: 5881270 - DNA, 12 bp, Homo sapiens
ctaatttaaaaa

SEQ ID NO: 5881271 - DNA, 14 bp, Homo sapiens
ctaatttaaaaaat

SEQ ID NO: 5881272 - DNA, 20 bp, Homo sapiens
ctaatttaaagatgctgtcg

SEQ ID NO: 5881273 - DNA, 13 bp, Homo sapiens
ctaatttaacacc

SEQ ID NO: 5881274 - DNA, 12 bp, Homo sapiens
ctaatttacaag

SEQ ID NO: 5881275 - DNA, 17 bp, Homo sapiens
ctaatttataaaaaggt

SEQ ID NO: 5881276 - DNA, 20 bp, Homo sapiens
ctaatttatacaaaataatt

SEQ ID NO: 5881277 - DNA, 21 bp, Homo sapiens
ctaatttatacaaaataattt

SEQ ID NO: 5881278 - DNA, 19 bp, Homo sapiens
ctaatttatactttaaagt

SEQ ID NO: 5881279 - DNA, 16 bp, Homo sapiens
ctaatttatattatcc

SEQ ID NO: 5881280 - DNA, 21 bp, Homo sapiens
ctaatttatcctgaaatttca

SEQ ID NO: 5881281 - DNA, 21 bp, Homo sapiens
ctaatttatcttgtctctggg

SEQ ID NO: 5881282 - DNA, 18 bp, Homo sapiens
ctaatttatgaagatagt

SEQ ID NO: 5881283 - DNA, 22 bp, Homo sapiens
ctaatttattaatctaaaaaag

SEQ ID NO: 5881284 - DNA, 22 bp, Homo sapiens
ctaatttatttccccaggtgtg

SEQ ID NO: 5881285 - DNA, 15 bp, Homo sapiens
ctaatttatttttag

SEQ ID NO: 5881286 - DNA, 19 bp, Homo sapiens
ctaatttcaaaaatataac

SEQ ID NO: 5881287 - DNA, 21 bp, Homo sapiens
ctaatttcaaaaatataactt

SEQ ID NO: 5881288 - DNA, 18 bp, Homo sapiens
ctaatttcaaaatgcttt

SEQ ID NO: 5881289 - DNA, 22 bp, Homo sapiens
ctaatttcaaaatgctttttat

SEQ ID NO: 5881290 - DNA, 14 bp, Homo sapiens
ctaatttcattcaa

SEQ ID NO: 5881291 - DNA, 15 bp, Homo sapiens
ctaatttcattcaaa

SEQ ID NO: 5881292 - DNA, 15 bp, Homo sapiens
ctaatttcccttctt

SEQ ID NO: 5881293 - DNA, 15 bp, Homo sapiens
ctaatttctcctccc

SEQ ID NO: 5881294 - DNA, 18 bp, Homo sapiens
ctaatttctcctcccttc

SEQ ID NO: 5881295 - DNA, 16 bp, Homo sapiens
ctaatttgaggctcag

SEQ ID NO: 5881296 - DNA, 19 bp, Homo sapiens
ctaatttgcattaaattca

SEQ ID NO: 5881297 - DNA, 14 bp, Homo sapiens
ctaatttgctgctg

SEQ ID NO: 5881298 - DNA, 22 bp, Homo sapiens
ctaatttgtaggaaaaagcaag

SEQ ID NO: 5881299 - DNA, 11 bp, Homo sapiens
ctaatttgtga

SEQ ID NO: 5881300 - DNA, 20 bp, Homo sapiens
ctaatttgtttcttctgtct

SEQ ID NO: 5881301 - DNA, 23 bp, Homo sapiens
ctacattccccagagtgggatcc

SEQ ID NO: 5881302 - DNA, 14 bp, Homo sapiens
ctacattccctggc

SEQ ID NO: 5881303 - DNA, 14 bp, Homo sapiens
ctacattcctcagc

SEQ ID NO: 5881304 - DNA, 16 bp, Homo sapiens
ctacattcctcagctg

SEQ ID NO: 5881305 - DNA, 12 bp, Homo sapiens
ctacattctcta

SEQ ID NO: 5881306 - DNA, 12 bp, Homo sapiens
ctacattctgct

SEQ ID NO: 5881307 - DNA, 15 bp, Homo sapiens
ctacattctgctctg

SEQ ID NO: 5881308 - DNA, 17 bp, Homo sapiens
ctacattctttattctg

SEQ ID NO: 5881309 - DNA, 16 bp, Homo sapiens
ctacattcttttttct

SEQ ID NO: 5881310 - DNA, 17 bp, Homo sapiens
ctacattgacagattga

SEQ ID NO: 5881311 - DNA, 18 bp, Homo sapiens
ctacattgagcatttgaa

SEQ ID NO: 5881312 - DNA, 23 bp, Homo sapiens
ctacatttaaacaagtattttat

SEQ ID NO: 5881313 - DNA, 15 bp, Homo sapiens
ctacatttactttaa

SEQ ID NO: 5881314 - DNA, 11 bp, Homo sapiens
ctacatttgca

SEQ ID NO: 5881315 - DNA, 21 bp, Homo sapiens
ctacatttgcagatgttcaaa

SEQ ID NO: 5881316 - DNA, 20 bp, Homo sapiens
ctacattttgaggttttgta

SEQ ID NO: 5881317 - DNA, 16 bp, Homo sapiens
ctacatttttgtttaa

SEQ ID NO: 5881318 - DNA, 18 bp, Homo sapiens
ctacattttttctaataa

SEQ ID NO: 5881319 - DNA, 19 bp, Homo sapiens
ctacattttttctaataaa

SEQ ID NO: 5881320 - DNA, 16 bp, Homo sapiens
ctaccaaaaattgcca

SEQ ID NO: 5881321 - DNA, 18 bp, Homo sapiens
ctaccaaatataaacttg

SEQ ID NO: 5881322 - DNA, 13 bp, Homo sapiens
ctaccaaatctca

SEQ ID NO: 5881323 - DNA, 22 bp, Homo sapiens
ctaccaaatgttaataaagccc

SEQ ID NO: 5881324 - DNA, 16 bp, Homo sapiens
ctaccaacctgttcaa

SEQ ID NO: 5881325 - DNA, 14 bp, Homo sapiens
ctaccaactggaag

SEQ ID NO: 5881326 - DNA, 16 bp, Homo sapiens
ctaccaactggaagca

SEQ ID NO: 5881327 - DNA, 14 bp, Homo sapiens
ctaccaagctgtca

SEQ ID NO: 5881328 - DNA, 15 bp, Homo sapiens
ctaccaagctgtcac

SEQ ID NO: 5881329 - DNA, 17 bp, Homo sapiens
ctaccaagctgtcacag

SEQ ID NO: 5881330 - DNA, 17 bp, Homo sapiens
ctaccaaggcccagcta

SEQ ID NO: 5881331 - DNA, 20 bp, Homo sapiens
ctaccaaggtcttcttaata

SEQ ID NO: 5881332 - DNA, 13 bp, Homo sapiens
ctaccaagtgacc

SEQ ID NO: 5881333 - DNA, 17 bp, Homo sapiens
ctaccaatacaaaatgt

SEQ ID NO: 5881334 - DNA, 18 bp, Homo sapiens
ctaccaatagattcccca

SEQ ID NO: 5881335 - DNA, 13 bp, Homo sapiens
ctaccaatattta

SEQ ID NO: 5881336 - DNA, 17 bp, Homo sapiens
ctaccaatctctgctct

SEQ ID NO: 5881337 - DNA, 15 bp, Homo sapiens
ctaccaatctgtgag

SEQ ID NO: 5881338 - DNA, 13 bp, Homo sapiens
ctaccaatgcatg

SEQ ID NO: 5881339 - DNA, 14 bp, Homo sapiens
ctaccaatgcatgc

SEQ ID NO: 5881340 - DNA, 19 bp, Homo sapiens
ctaccaatgccaagataat

SEQ ID NO: 5881341 - DNA, 13 bp, Homo sapiens
ctaccacaaggaa

SEQ ID NO: 5881342 - DNA, 15 bp, Homo sapiens
ctaccacaaggaaaa

SEQ ID NO: 5881343 - DNA, 16 bp, Homo sapiens
ctaccacacacagcct

SEQ ID NO: 5881344 - DNA, 13 bp, Homo sapiens
ctaccacagactt

SEQ ID NO: 5881345 - DNA, 15 bp, Homo sapiens
ctaccacagctgcct

SEQ ID NO: 5881346 - DNA, 17 bp, Homo sapiens
ctaccacagctgcctcc

SEQ ID NO: 5881347 - DNA, 18 bp, Homo sapiens
ctaccacatgccaagcac

SEQ ID NO: 5881348 - DNA, 20 bp, Homo sapiens
ctaccaccacaccaaatgac

SEQ ID NO: 5881349 - DNA, 13 bp, Homo sapiens
ctaccaccagctg

SEQ ID NO: 5881350 - DNA, 19 bp, Homo sapiens
ctaccaccagctgtgtcca

SEQ ID NO: 5881351 - DNA, 14 bp, Homo sapiens
ctaccaccccactg

SEQ ID NO: 5881352 - DNA, 18 bp, Homo sapiens
ctaccaccccttcctgtc

SEQ ID NO: 5881353 - DNA, 22 bp, Homo sapiens
ctaccaccccttcctgtcccac

SEQ ID NO: 5881354 - DNA, 18 bp, Homo sapiens
ctaccaccctcgctgcca

SEQ ID NO: 5881355 - DNA, 20 bp, Homo sapiens
ctaccaccctcgctgccacc

SEQ ID NO: 5881356 - DNA, 20 bp, Homo sapiens
ctaccaccgcatcctcactg

SEQ ID NO: 5881357 - DNA, 21 bp, Homo sapiens
ctaccaccgcatcctcactgg

SEQ ID NO: 5881358 - DNA, 17 bp, Homo sapiens
ctaccacctcaggtgac

SEQ ID NO: 5881359 - DNA, 14 bp, Homo sapiens
ctaccacctcccca

SEQ ID NO: 5881360 - DNA, 15 bp, Homo sapiens
ctaccacctccccag

SEQ ID NO: 5881361 - DNA, 18 bp, Homo sapiens
ctaccaccttccctcttt

SEQ ID NO: 5881362 - DNA, 20 bp, Homo sapiens
ctaccaccttccctctttct

SEQ ID NO: 5881363 - DNA, 19 bp, Homo sapiens
ctaccacggcctcctttcc

SEQ ID NO: 5881364 - DNA, 18 bp, Homo sapiens
ctaccacgggtctgccat

SEQ ID NO: 5881365 - DNA, 17 bp, Homo sapiens
ctaccactcctgccaag

SEQ ID NO: 5881366 - DNA, 18 bp, Homo sapiens
ctaccactctaatcaaga

SEQ ID NO: 5881367 - DNA, 20 bp, Homo sapiens
ctaccactggtacttccttt

SEQ ID NO: 5881368 - DNA, 22 bp, Homo sapiens
ctaccactggtgtaaaaaacaa

SEQ ID NO: 5881369 - DNA, 16 bp, Homo sapiens
ctaccacttatttcta

SEQ ID NO: 5881370 - DNA, 21 bp, Homo sapiens
ctaccactttttttaaccatt

SEQ ID NO: 5881371 - DNA, 16 bp, Homo sapiens
ctaccagaagggcttc

SEQ ID NO: 5881372 - DNA, 16 bp, Homo sapiens
ctaccagcaaacagct

SEQ ID NO: 5881373 - DNA, 12 bp, Homo sapiens
ctaccagccagc

SEQ ID NO: 5881374 - DNA, 22 bp, Homo sapiens
ctaccagcgccaaatgttcatc

SEQ ID NO: 5881375 - DNA, 12 bp, Homo sapiens
ctaccagctcct

SEQ ID NO: 5881376 - DNA, 19 bp, Homo sapiens
ctaccagctcctccagccc

SEQ ID NO: 5881377 - DNA, 20 bp, Homo sapiens
ctaccagctcctccagccct

SEQ ID NO: 5881378 - DNA, 21 bp, Homo sapiens
ctaccagctcctccagccctg

SEQ ID NO: 5881379 - DNA, 13 bp, Homo sapiens
ctaccaggaagag

SEQ ID NO: 5881380 - DNA, 12 bp, Homo sapiens
ctaccaggactc

SEQ ID NO: 5881381 - DNA, 17 bp, Homo sapiens
ctaccaggatgctaaag

SEQ ID NO: 5881382 - DNA, 15 bp, Homo sapiens
ctaccaggtgttcta

SEQ ID NO: 5881383 - DNA, 21 bp, Homo sapiens
ctaccagtatctccatcctta

SEQ ID NO: 5881384 - DNA, 20 bp, Homo sapiens
ctaccagtatttagaagcca

SEQ ID NO: 5881385 - DNA, 18 bp, Homo sapiens
ctaccagtcgccctctgt

SEQ ID NO: 5881386 - DNA, 23 bp, Homo sapiens
ctaccagtcgccctctgtgccta

SEQ ID NO: 5881387 - DNA, 19 bp, Homo sapiens
ctaccagtgcaggctggcc

SEQ ID NO: 5881388 - DNA, 17 bp, Homo sapiens
ctaccatcagctctgcc

SEQ ID NO: 5881389 - DNA, 18 bp, Homo sapiens
ctaccatcccctgtagag

SEQ ID NO: 5881390 - DNA, 12 bp, Homo sapiens
ctaccatctgca

SEQ ID NO: 5881391 - DNA, 14 bp, Homo sapiens
ctaccatctgcatg

SEQ ID NO: 5881392 - DNA, 16 bp, Homo sapiens
ctaccatctgcatggg

SEQ ID NO: 5881393 - DNA, 20 bp, Homo sapiens
ctaccatggttctgcctcct

SEQ ID NO: 5881394 - DNA, 22 bp, Homo sapiens
ctaccatggttctgcctcctgg

SEQ ID NO: 5881395 - DNA, 23 bp, Homo sapiens
ctaccatggttctgcctcctggc

SEQ ID NO: 5881396 - DNA, 20 bp, Homo sapiens
ctaccattgaaggaaagcta

SEQ ID NO: 5881397 - DNA, 21 bp, Homo sapiens
ctaccattgctgttctacttt

SEQ ID NO: 5881398 - DNA, 12 bp, Homo sapiens
ctaccatttcag

SEQ ID NO: 5881399 - DNA, 20 bp, Homo sapiens
ctaccattttacatttctat

SEQ ID NO: 5881400 - DNA, 13 bp, Homo sapiens
ctacccaaccctg

SEQ ID NO: 5881401 - DNA, 15 bp, Homo sapiens
ctacccaaccctgcc

SEQ ID NO: 5881402 - DNA, 20 bp, Homo sapiens
ctacccaaccctgccctgcc

SEQ ID NO: 5881403 - DNA, 20 bp, Homo sapiens
ctacccaatgtctcccacac

SEQ ID NO: 5881404 - DNA, 19 bp, Homo sapiens
ctacccacacctctgccag

SEQ ID NO: 5881405 - DNA, 15 bp, Homo sapiens
ctacccacagagcaa

SEQ ID NO: 5881406 - DNA, 15 bp, Homo sapiens
ctacccacagggcct

SEQ ID NO: 5881407 - DNA, 22 bp, Homo sapiens
ctacccacagggcctgactttt

SEQ ID NO: 5881408 - DNA, 13 bp, Homo sapiens
ctacccaccctcc

SEQ ID NO: 5881409 - DNA, 22 bp, Homo sapiens
ctacccaccctcctttcaccac

SEQ ID NO: 5881410 - DNA, 23 bp, Homo sapiens
ctacccaccgatggagcccccag

SEQ ID NO: 5881411 - DNA, 23 bp, Homo sapiens
ctacccacgttctcacacccacc

SEQ ID NO: 5881412 - DNA, 20 bp, Homo sapiens
ctacccactatccttcgtga

SEQ ID NO: 5881413 - DNA, 17 bp, Homo sapiens
ctacccactatgcacag

SEQ ID NO: 5881414 - DNA, 23 bp, Homo sapiens
ctacccactctttgctacaataa

SEQ ID NO: 5881415 - DNA, 16 bp, Homo sapiens
ctacccacttctaaat

SEQ ID NO: 5881416 - DNA, 21 bp, Homo sapiens
ctacccagagattgcttctca

SEQ ID NO: 5881417 - DNA, 18 bp, Homo sapiens
ctacccagagccttctcc

SEQ ID NO: 5881418 - DNA, 22 bp, Homo sapiens
ctacccagagccttctcctgcc

SEQ ID NO: 5881419 - DNA, 12 bp, Homo sapiens
ctacccagccca

SEQ ID NO: 5881420 - DNA, 15 bp, Homo sapiens
ctacccagcccatct

SEQ ID NO: 5881421 - DNA, 18 bp, Homo sapiens
ctacccagcgtggcccag

SEQ ID NO: 5881422 - DNA, 18 bp, Homo sapiens
ctacccagcgtggcctcc

SEQ ID NO: 5881423 - DNA, 13 bp, Homo sapiens
ctacccagctctg

SEQ ID NO: 5881424 - DNA, 13 bp, Homo sapiens
ctacccagctgat

SEQ ID NO: 5881425 - DNA, 20 bp, Homo sapiens
ctacccaggaggctgaggca

SEQ ID NO: 5881426 - DNA, 15 bp, Homo sapiens
ctacccagggcctgc

SEQ ID NO: 5881427 - DNA, 16 bp, Homo sapiens
ctacccagggcctgca

SEQ ID NO: 5881428 - DNA, 18 bp, Homo sapiens
ctacccagtcatgtactg

SEQ ID NO: 5881429 - DNA, 14 bp, Homo sapiens
ctacccatatccct

SEQ ID NO: 5881430 - DNA, 19 bp, Homo sapiens
ctacccatatccctcccgt

SEQ ID NO: 5881431 - DNA, 13 bp, Homo sapiens
ctacccatccccg

SEQ ID NO: 5881432 - DNA, 21 bp, Homo sapiens
ctacccatgcaattaaaaggt

SEQ ID NO: 5881433 - DNA, 20 bp, Homo sapiens
ctacccatgttgggaaaaac

SEQ ID NO: 5881434 - DNA, 15 bp, Homo sapiens
ctaccccaaggccag

SEQ ID NO: 5881435 - DNA, 19 bp, Homo sapiens
ctaccccacaccagccttg

SEQ ID NO: 5881436 - DNA, 17 bp, Homo sapiens
ctaccccacaccaggcc

SEQ ID NO: 5881437 - DNA, 15 bp, Homo sapiens
ctaccccacctgacc

SEQ ID NO: 5881438 - DNA, 20 bp, Homo sapiens
ctaccccagaacgcatgcag

SEQ ID NO: 5881439 - DNA, 13 bp, Homo sapiens
ctaccccagccag

SEQ ID NO: 5881440 - DNA, 12 bp, Homo sapiens
ctaccccagtcc

SEQ ID NO: 5881441 - DNA, 13 bp, Homo sapiens
ctaccccagtccc

SEQ ID NO: 5881442 - DNA, 22 bp, Homo sapiens
ctaccccagttcatctctgctg

SEQ ID NO: 5881443 - DNA, 14 bp, Homo sapiens
ctaccccagttcct

SEQ ID NO: 5881444 - DNA, 15 bp, Homo sapiens
ctaccccagttccta

SEQ ID NO: 5881445 - DNA, 20 bp, Homo sapiens
ctaccccatatacacctgga

SEQ ID NO: 5881446 - DNA, 18 bp, Homo sapiens
ctaccccatgctgtactt

SEQ ID NO: 5881447 - DNA, 15 bp, Homo sapiens
ctacccccaaccctc

SEQ ID NO: 5881448 - DNA, 17 bp, Homo sapiens
ctacccccagctgtgct

SEQ ID NO: 5881449 - DNA, 19 bp, Homo sapiens
ctacccccagctgtgctta

SEQ ID NO: 5881450 - DNA, 13 bp, Homo sapiens
ctaccccccacct

SEQ ID NO: 5881451 - DNA, 18 bp, Homo sapiens
ctaccccccctcctgctg

SEQ ID NO: 5881452 - DNA, 21 bp, Homo sapiens
ctaccccccgtctcctgccgg

SEQ ID NO: 5881453 - DNA, 17 bp, Homo sapiens
ctaccccctcatccccc

SEQ ID NO: 5881454 - DNA, 14 bp, Homo sapiens
ctaccccctgtgcc

SEQ ID NO: 5881455 - DNA, 15 bp, Homo sapiens
ctacccccttttcag

SEQ ID NO: 5881456 - DNA, 18 bp, Homo sapiens
ctacccccttttcagctg

SEQ ID NO: 5881457 - DNA, 23 bp, Homo sapiens
ctacccccttttcagctgagccc

SEQ ID NO: 5881458 - DNA, 22 bp, Homo sapiens
ctaccccgactatccctgcaca

SEQ ID NO: 5881459 - DNA, 22 bp, Homo sapiens
ctacccctcaaactgcacatct

SEQ ID NO: 5881460 - DNA, 17 bp, Homo sapiens
ctacccctcccagctga

SEQ ID NO: 5881461 - DNA, 14 bp, Homo sapiens
ctacccctcctgcg

SEQ ID NO: 5881462 - DNA, 15 bp, Homo sapiens
ctacccctcctgcgc

SEQ ID NO: 5881463 - DNA, 21 bp, Homo sapiens
ctacccctcgactcagcacca

SEQ ID NO: 5881464 - DNA, 14 bp, Homo sapiens
ctacccctgccctg

SEQ ID NO: 5881465 - DNA, 13 bp, Homo sapiens
ctacccctggctg

SEQ ID NO: 5881466 - DNA, 19 bp, Homo sapiens
ctacccctggctgtactgc

SEQ ID NO: 5881467 - DNA, 14 bp, Homo sapiens
ctacccctgtcctg

SEQ ID NO: 5881468 - DNA, 16 bp, Homo sapiens
ctacccctgtcctggg

SEQ ID NO: 5881469 - DNA, 13 bp, Homo sapiens
ctaccccttcctg

SEQ ID NO: 5881470 - DNA, 16 bp, Homo sapiens
ctaccccttgtgggca

SEQ ID NO: 5881471 - DNA, 21 bp, Homo sapiens
ctacccctttctccagccctg

SEQ ID NO: 5881472 - DNA, 17 bp, Homo sapiens
ctacccctttcttctcg

SEQ ID NO: 5881473 - DNA, 15 bp, Homo sapiens
ctacccgagcccagc

SEQ ID NO: 5881474 - DNA, 16 bp, Homo sapiens
ctacccgagcccagct

SEQ ID NO: 5881475 - DNA, 22 bp, Homo sapiens
ctacccgatttgtttatttgca

SEQ ID NO: 5881476 - DNA, 14 bp, Homo sapiens
ctacccgctgtggc

SEQ ID NO: 5881477 - DNA, 15 bp, Homo sapiens
ctacccgctgtggcc

SEQ ID NO: 5881478 - DNA, 16 bp, Homo sapiens
ctacccggctcgttcc

SEQ ID NO: 5881479 - DNA, 14 bp, Homo sapiens
ctacccgggaaggg

SEQ ID NO: 5881480 - DNA, 23 bp, Homo sapiens
ctacctttatatttggggtcctt

SEQ ID NO: 5881481 - DNA, 16 bp, Homo sapiens
ctacctttcaaagctt

SEQ ID NO: 5881482 - DNA, 13 bp, Homo sapiens
ctacctttgtctc

SEQ ID NO: 5881483 - DNA, 15 bp, Homo sapiens
ctacctttgtctcac

SEQ ID NO: 5881484 - DNA, 19 bp, Homo sapiens
ctaccttttaaaattgaat

SEQ ID NO: 5881485 - DNA, 14 bp, Homo sapiens
ctaccttttctctt

SEQ ID NO: 5881486 - DNA, 22 bp, Homo sapiens
ctacctttttataatgcacaac

SEQ ID NO: 5881487 - DNA, 20 bp, Homo sapiens
ctacctttttatatttaaaa

SEQ ID NO: 5881488 - DNA, 20 bp, Homo sapiens
ctacgaaaaataaaaaggaa

SEQ ID NO: 5881489 - DNA, 14 bp, Homo sapiens
ctacgaagccacag

SEQ ID NO: 5881490 - DNA, 18 bp, Homo sapiens
ctacgaagccacaggcct

SEQ ID NO: 5881491 - DNA, 21 bp, Homo sapiens
ctacgaagccacaggcctggc

SEQ ID NO: 5881492 - DNA, 22 bp, Homo sapiens
ctacgaagccacaggcctggcc

SEQ ID NO: 5881493 - DNA, 21 bp, Homo sapiens
ctacgagggaggaacacctga

SEQ ID NO: 5881494 - DNA, 19 bp, Homo sapiens
ctacgatgggatcattatt

SEQ ID NO: 5881495 - DNA, 14 bp, Homo sapiens
ctacgattccactg

SEQ ID NO: 5881496 - DNA, 18 bp, Homo sapiens
ctacgcaccattttgtca

SEQ ID NO: 5881497 - DNA, 22 bp, Homo sapiens
ctacgccaaagtgcagcccttc

SEQ ID NO: 5881498 - DNA, 19 bp, Homo sapiens
ctacgcctcttctgtccct

SEQ ID NO: 5881499 - DNA, 14 bp, Homo sapiens
ctacgcctgcatgt

SEQ ID NO: 5881500 - DNA, 17 bp, Homo sapiens
ctacgctcatctctgga

SEQ ID NO: 5881501 - DNA, 13 bp, Homo sapiens
ctacgctcctgtc

SEQ ID NO: 5881502 - DNA, 14 bp, Homo sapiens
ctacgctcctgtct

SEQ ID NO: 5881503 - DNA, 21 bp, Homo sapiens
ctacgctctcctttctttcta

SEQ ID NO: 5881504 - DNA, 18 bp, Homo sapiens
ctacggggaaaatgcatt

SEQ ID NO: 5881505 - DNA, 20 bp, Homo sapiens
ctacggtagtgatgaaatta

SEQ ID NO: 5881506 - DNA, 14 bp, Homo sapiens
ctacggttatttcc

SEQ ID NO: 5881507 - DNA, 20 bp, Homo sapiens
ctacggttatttcctgcttt

SEQ ID NO: 5881508 - DNA, 19 bp, Homo sapiens
ctacgtataaatatgaaat

SEQ ID NO: 5881509 - DNA, 19 bp, Homo sapiens
ctacgtcatgtattttatg

SEQ ID NO: 5881510 - DNA, 20 bp, Homo sapiens
ctacgtcatgtattttatga

SEQ ID NO: 5881511 - DNA, 13 bp, Homo sapiens
ctacgtgcctccc

SEQ ID NO: 5881512 - DNA, 22 bp, Homo sapiens
ctacgtgtgaaatctgtctttg

SEQ ID NO: 5881513 - DNA, 19 bp, Homo sapiens
ctacgttcctattgtcatt

SEQ ID NO: 5881514 - DNA, 16 bp, Homo sapiens
ctacgttctccagccc

SEQ ID NO: 5881515 - DNA, 22 bp, Homo sapiens
ctacgtttccccaataaagcct

SEQ ID NO: 5881516 - DNA, 22 bp, Homo sapiens
ctacgtttgcaccgcctgccct

SEQ ID NO: 5881517 - DNA, 14 bp, Homo sapiens
ctacgttttggttc

SEQ ID NO: 5881518 - DNA, 15 bp, Homo sapiens
ctactaaaaatacaa

SEQ ID NO: 5881519 - DNA, 19 bp, Homo sapiens
ctactaaaaatacaaaaat

SEQ ID NO: 5881520 - DNA, 18 bp, Homo sapiens
ctactaaaaatatgaaat

SEQ ID NO: 5881521 - DNA, 15 bp, Homo sapiens
ctactaaaaatgcaa

SEQ ID NO: 5881522 - DNA, 15 bp, Homo sapiens
ctactaaaagtttag

SEQ ID NO: 5881523 - DNA, 20 bp, Homo sapiens
ctactaaaattcaaaaacaa

SEQ ID NO: 5881524 - DNA, 14 bp, Homo sapiens
ctactaaagtgcct

SEQ ID NO: 5881525 - DNA, 19 bp, Homo sapiens
ctactaacaaatgtaaaat

SEQ ID NO: 5881526 - DNA, 16 bp, Homo sapiens
ctactaacatcccaat

SEQ ID NO: 5881527 - DNA, 18 bp, Homo sapiens
ctactaacctgacatcac

SEQ ID NO: 5881528 - DNA, 18 bp, Homo sapiens
ctactaacctggagacag

SEQ ID NO: 5881529 - DNA, 16 bp, Homo sapiens
ctactaagaaaataga

SEQ ID NO: 5881530 - DNA, 23 bp, Homo sapiens
ctactaagaaaatagagatgagc

SEQ ID NO: 5881531 - DNA, 17 bp, Homo sapiens
ctactaagaataaataa

SEQ ID NO: 5881532 - DNA, 21 bp, Homo sapiens
ctactaagaataaataaagaa

SEQ ID NO: 5881533 - DNA, 13 bp, Homo sapiens
ctactaaggcctt

SEQ ID NO: 5881534 - DNA, 22 bp, Homo sapiens
ctactaaggccttttatgtaat

SEQ ID NO: 5881535 - DNA, 15 bp, Homo sapiens
ctactaagttatttt

SEQ ID NO: 5881536 - DNA, 19 bp, Homo sapiens
ctactaagtttccttttaa

SEQ ID NO: 5881537 - DNA, 16 bp, Homo sapiens
ctactaataaaccagt

SEQ ID NO: 5881538 - DNA, 17 bp, Homo sapiens
ctactaatagaataaag

SEQ ID NO: 5881539 - DNA, 19 bp, Homo sapiens
ctactaatctcaatttaag

SEQ ID NO: 5881540 - DNA, 13 bp, Homo sapiens
ctactaatgatgt

SEQ ID NO: 5881541 - DNA, 14 bp, Homo sapiens
ctactaatgatgtt

SEQ ID NO: 5881542 - DNA, 15 bp, Homo sapiens
ctactaattccacac

SEQ ID NO: 5881543 - DNA, 19 bp, Homo sapiens
ctactaattgagccattta

SEQ ID NO: 5881544 - DNA, 12 bp, Homo sapiens
ctactaattttt

SEQ ID NO: 5881545 - DNA, 16 bp, Homo sapiens
ctactaattttttaag

SEQ ID NO: 5881546 - DNA, 16 bp, Homo sapiens
ctactacatcgccctc

SEQ ID NO: 5881547 - DNA, 18 bp, Homo sapiens
ctactacatcgccctcca

SEQ ID NO: 5881548 - DNA, 22 bp, Homo sapiens
ctactacatctgtgatgactgg

SEQ ID NO: 5881549 - DNA, 17 bp, Homo sapiens
ctactaccacaaggaaa

SEQ ID NO: 5881550 - DNA, 22 bp, Homo sapiens
ctactacccattgttcccttcc

SEQ ID NO: 5881551 - DNA, 15 bp, Homo sapiens
ctactacccgagccc

SEQ ID NO: 5881552 - DNA, 15 bp, Homo sapiens
ctactactctgccaa

SEQ ID NO: 5881553 - DNA, 16 bp, Homo sapiens
ctactactctgccaat

SEQ ID NO: 5881554 - DNA, 15 bp, Homo sapiens
ctactactttgtgtt

SEQ ID NO: 5881555 - DNA, 12 bp, Homo sapiens
ctactagaaaat

SEQ ID NO: 5881556 - DNA, 15 bp, Homo sapiens
ctactagatcacttg

SEQ ID NO: 5881557 - DNA, 15 bp, Homo sapiens
ctactagattgacta

SEQ ID NO: 5881558 - DNA, 17 bp, Homo sapiens
ctactagcaaaataaaa

SEQ ID NO: 5881559 - DNA, 19 bp, Homo sapiens
ctactagcaaaataaaaca

SEQ ID NO: 5881560 - DNA, 18 bp, Homo sapiens
ctactagctctttgagat

SEQ ID NO: 5881561 - DNA, 18 bp, Homo sapiens
ctactagggacctgggga

SEQ ID NO: 5881562 - DNA, 20 bp, Homo sapiens
ctactagggacctggggaag

SEQ ID NO: 5881563 - DNA, 21 bp, Homo sapiens
ctactagggacctggggaagc

SEQ ID NO: 5881564 - DNA, 15 bp, Homo sapiens
ctactaggtctgctc

SEQ ID NO: 5881565 - DNA, 17 bp, Homo sapiens
ctactaggtctgctcct

SEQ ID NO: 5881566 - DNA, 19 bp, Homo sapiens
ctactagtaataatgtaat

SEQ ID NO: 5881567 - DNA, 15 bp, Homo sapiens
ctactagtgtgactc

SEQ ID NO: 5881568 - DNA, 12 bp, Homo sapiens
ctactataatca

SEQ ID NO: 5881569 - DNA, 13 bp, Homo sapiens
ctactataatcaa

SEQ ID NO: 5881570 - DNA, 16 bp, Homo sapiens
ctactataatcaaatg

SEQ ID NO: 5881571 - DNA, 19 bp, Homo sapiens
ctactatatacatatatat

SEQ ID NO: 5881572 - DNA, 16 bp, Homo sapiens
ctactatggctgttta

SEQ ID NO: 5881573 - DNA, 16 bp, Homo sapiens
ctactatgtgctgggt

SEQ ID NO: 5881574 - DNA, 13 bp, Homo sapiens
ctactattcatgt

SEQ ID NO: 5881575 - DNA, 19 bp, Homo sapiens
ctactatttaaatccttgg

SEQ ID NO: 5881576 - DNA, 20 bp, Homo sapiens
ctactatttgaaaaaagaag

SEQ ID NO: 5881577 - DNA, 12 bp, Homo sapiens
ctactattttct

SEQ ID NO: 5881578 - DNA, 13 bp, Homo sapiens
ctactatttttct

SEQ ID NO: 5881579 - DNA, 17 bp, Homo sapiens
ctactcaagcgggtggc

SEQ ID NO: 5881580 - DNA, 20 bp, Homo sapiens
ctactcaagcgggtggctct

SEQ ID NO: 5881581 - DNA, 18 bp, Homo sapiens
ctactcaagtagcattta

SEQ ID NO: 5881582 - DNA, 20 bp, Homo sapiens
ctactcaagtagcatttact

SEQ ID NO: 5881583 - DNA, 14 bp, Homo sapiens
ctactcacacaggc

SEQ ID NO: 5881584 - DNA, 15 bp, Homo sapiens
ctactcacagtctct

SEQ ID NO: 5881585 - DNA, 23 bp, Homo sapiens
ctactcaccttgaacaccacgct

SEQ ID NO: 5881586 - DNA, 16 bp, Homo sapiens
ctactcactcaagttc

SEQ ID NO: 5881587 - DNA, 21 bp, Homo sapiens
ctactcacttttcccactcca

SEQ ID NO: 5881588 - DNA, 21 bp, Homo sapiens
ctactcagaaatggacaaaga

SEQ ID NO: 5881589 - DNA, 13 bp, Homo sapiens
ctactcagaagcc

SEQ ID NO: 5881590 - DNA, 16 bp, Homo sapiens
ctactcagcagccctc

SEQ ID NO: 5881591 - DNA, 19 bp, Homo sapiens
ctactcagcagccctcctc

SEQ ID NO: 5881592 - DNA, 21 bp, Homo sapiens
ctactcagcagccctcctcac

SEQ ID NO: 5881593 - DNA, 22 bp, Homo sapiens
ctactcagcagccctcctcacc

SEQ ID NO: 5881594 - DNA, 12 bp, Homo sapiens
ctactcagcagt

SEQ ID NO: 5881595 - DNA, 18 bp, Homo sapiens
ctactcagtggggctggc

SEQ ID NO: 5881596 - DNA, 14 bp, Homo sapiens
ctactcagttatta

SEQ ID NO: 5881597 - DNA, 21 bp, Homo sapiens
ctactcataagttggaccaga

SEQ ID NO: 5881598 - DNA, 14 bp, Homo sapiens
ctactcattgtctc

SEQ ID NO: 5881599 - DNA, 12 bp, Homo sapiens
ctactccactga

SEQ ID NO: 5881600 - DNA, 20 bp, Homo sapiens
ctactccactgacctggaag

SEQ ID NO: 5881601 - DNA, 17 bp, Homo sapiens
ctactccagtatgacag

SEQ ID NO: 5881602 - DNA, 20 bp, Homo sapiens
ctactccagtatgacagagg

SEQ ID NO: 5881603 - DNA, 21 bp, Homo sapiens
ctactccagtatgacagagga

SEQ ID NO: 5881604 - DNA, 14 bp, Homo sapiens
ctactcccagcgct

SEQ ID NO: 5881605 - DNA, 13 bp, Homo sapiens
ctactcccctggg

SEQ ID NO: 5881606 - DNA, 23 bp, Homo sapiens
ctactccctccaattccccctta

SEQ ID NO: 5881607 - DNA, 18 bp, Homo sapiens
ctactccctgcagatgcc

SEQ ID NO: 5881608 - DNA, 18 bp, Homo sapiens
ctactccctggaccacga

SEQ ID NO: 5881609 - DNA, 15 bp, Homo sapiens
ctactccgttcctgg

SEQ ID NO: 5881610 - DNA, 17 bp, Homo sapiens
ctactcctacctcagcc

SEQ ID NO: 5881611 - DNA, 17 bp, Homo sapiens
ctactcctacctggtca

SEQ ID NO: 5881612 - DNA, 14 bp, Homo sapiens
ctactcctagaaga

SEQ ID NO: 5881613 - DNA, 16 bp, Homo sapiens
ctactcctagaagaac

SEQ ID NO: 5881614 - DNA, 15 bp, Homo sapiens
ctactcctccccctc

SEQ ID NO: 5881615 - DNA, 21 bp, Homo sapiens
ctactcctccccctcctccat

SEQ ID NO: 5881616 - DNA, 23 bp, Homo sapiens
ctactcctccccctcctccatgc

SEQ ID NO: 5881617 - DNA, 15 bp, Homo sapiens
ctactcctctgcagt

SEQ ID NO: 5881618 - DNA, 11 bp, Homo sapiens
ctactcctgcc

SEQ ID NO: 5881619 - DNA, 14 bp, Homo sapiens
ctactcctgtcttc

SEQ ID NO: 5881620 - DNA, 21 bp, Homo sapiens
ctactcctgtcttctgctttg

SEQ ID NO: 5881621 - DNA, 16 bp, Homo sapiens
ctactcctgtgctctg

SEQ ID NO: 5881622 - DNA, 11 bp, Homo sapiens
ctactcctttg

SEQ ID NO: 5881623 - DNA, 19 bp, Homo sapiens
ctactcgatagcctgaggt

SEQ ID NO: 5881624 - DNA, 14 bp, Homo sapiens
ctactctaccatgg

SEQ ID NO: 5881625 - DNA, 15 bp, Homo sapiens
ctactctagatggca

SEQ ID NO: 5881626 - DNA, 19 bp, Homo sapiens
ctactctaggactgggccc

SEQ ID NO: 5881627 - DNA, 15 bp, Homo sapiens
ctactctagttctgt

SEQ ID NO: 5881628 - DNA, 15 bp, Homo sapiens
ctactctatatactt

SEQ ID NO: 5881629 - DNA, 16 bp, Homo sapiens
ctactctattctgtag

SEQ ID NO: 5881630 - DNA, 21 bp, Homo sapiens
ctactctcacactggttctca

SEQ ID NO: 5881631 - DNA, 23 bp, Homo sapiens
ctactctcacactggttctcaat

SEQ ID NO: 5881632 - DNA, 19 bp, Homo sapiens
ctactctccccacgagggc

SEQ ID NO: 5881633 - DNA, 20 bp, Homo sapiens
ctactctccccacgagggct

SEQ ID NO: 5881634 - DNA, 23 bp, Homo sapiens
ctactctccccacgagggctggc

SEQ ID NO: 5881635 - DNA, 13 bp, Homo sapiens
ctactctcctcat

SEQ ID NO: 5881636 - DNA, 14 bp, Homo sapiens
ctactctcttcctc

SEQ ID NO: 5881637 - DNA, 15 bp, Homo sapiens
ctactctcttcctcc

SEQ ID NO: 5881638 - DNA, 18 bp, Homo sapiens
ctactctcttgccagcat

SEQ ID NO: 5881639 - DNA, 22 bp, Homo sapiens
ctactctgagacaaaagaaaaa

SEQ ID NO: 5881640 - DNA, 11 bp, Homo sapiens
ctactctgatc

SEQ ID NO: 5881641 - DNA, 14 bp, Homo sapiens
ctactctgatccct

SEQ ID NO: 5881642 - DNA, 14 bp, Homo sapiens
ctactctgccaatc

SEQ ID NO: 5881643 - DNA, 21 bp, Homo sapiens
ctactctggaatgtttttccc

SEQ ID NO: 5881644 - DNA, 21 bp, Homo sapiens
ctactctggaccaaggagcat

SEQ ID NO: 5881645 - DNA, 19 bp, Homo sapiens
ctactctgtccaggccact

SEQ ID NO: 5881646 - DNA, 21 bp, Homo sapiens
ctactctgtgccagagcctgg

SEQ ID NO: 5881647 - DNA, 12 bp, Homo sapiens
ctactctgtgtc

SEQ ID NO: 5881648 - DNA, 21 bp, Homo sapiens
ctactctgtgtcaggtggggc

SEQ ID NO: 5881649 - DNA, 15 bp, Homo sapiens
ctactctgttccttc

SEQ ID NO: 5881650 - DNA, 22 bp, Homo sapiens
ctactcttaaatatacaacttt

SEQ ID NO: 5881651 - DNA, 20 bp, Homo sapiens
ctactcttaaatgagaaagg

SEQ ID NO: 5881652 - DNA, 15 bp, Homo sapiens
ctactcttaagccat

SEQ ID NO: 5881653 - DNA, 16 bp, Homo sapiens
ctactcttaagccatc

SEQ ID NO: 5881654 - DNA, 17 bp, Homo sapiens
ctactcttaagccatct

SEQ ID NO: 5881655 - DNA, 22 bp, Homo sapiens
ctactcttaagtttctcagctc

SEQ ID NO: 5881656 - DNA, 20 bp, Homo sapiens
ctactcttacagagccttga

SEQ ID NO: 5881657 - DNA, 21 bp, Homo sapiens
ctactcttccaggactctctg

SEQ ID NO: 5881658 - DNA, 15 bp, Homo sapiens
ctacttcccttcctc

SEQ ID NO: 5881659 - DNA, 14 bp, Homo sapiens
ctacttcctcctcc

SEQ ID NO: 5881660 - DNA, 16 bp, Homo sapiens
ctacttcctcctcctc

SEQ ID NO: 5881661 - DNA, 14 bp, Homo sapiens
ctacttcctgcctg

SEQ ID NO: 5881662 - DNA, 17 bp, Homo sapiens
ctacttcggggctggga

SEQ ID NO: 5881663 - DNA, 16 bp, Homo sapiens
ctacttctctgagtca

SEQ ID NO: 5881664 - DNA, 13 bp, Homo sapiens
ctacttctgactt

SEQ ID NO: 5881665 - DNA, 15 bp, Homo sapiens
ctacttctgggaaaa

SEQ ID NO: 5881666 - DNA, 21 bp, Homo sapiens
ctacttctgtgtctgtcacca

SEQ ID NO: 5881667 - DNA, 13 bp, Homo sapiens
ctacttcttaaaa

SEQ ID NO: 5881668 - DNA, 13 bp, Homo sapiens
ctacttcttggaa

SEQ ID NO: 5881669 - DNA, 19 bp, Homo sapiens
ctacttgaatactctcaca

SEQ ID NO: 5881670 - DNA, 21 bp, Homo sapiens
ctacttgaccattctcaccct

SEQ ID NO: 5881671 - DNA, 21 bp, Homo sapiens
ctacttgagaaaatgcaggag

SEQ ID NO: 5881672 - DNA, 15 bp, Homo sapiens
ctacttgcctcattt

SEQ ID NO: 5881673 - DNA, 13 bp, Homo sapiens
ctacttgctctgg

SEQ ID NO: 5881674 - DNA, 15 bp, Homo sapiens
ctacttgctctggac

SEQ ID NO: 5881675 - DNA, 18 bp, Homo sapiens
ctacttgctctggacctg

SEQ ID NO: 5881676 - DNA, 21 bp, Homo sapiens
ctacttgctctggacctgccc

SEQ ID NO: 5881677 - DNA, 15 bp, Homo sapiens
ctacttgctgaagga

SEQ ID NO: 5881678 - DNA, 16 bp, Homo sapiens
ctacttggcaggctga

SEQ ID NO: 5881679 - DNA, 16 bp, Homo sapiens
ctacttgggaggctga

SEQ ID NO: 5881680 - DNA, 23 bp, Homo sapiens
ctacttgggaggctgaggcagga

SEQ ID NO: 5881681 - DNA, 21 bp, Homo sapiens
ctacttggggacataatttca

SEQ ID NO: 5881682 - DNA, 14 bp, Homo sapiens
ctacttggtttgtg

SEQ ID NO: 5881683 - DNA, 15 bp, Homo sapiens
ctacttggtttgtgt

SEQ ID NO: 5881684 - DNA, 18 bp, Homo sapiens
ctacttgtaaaatgcttt

SEQ ID NO: 5881685 - DNA, 21 bp, Homo sapiens
ctacttgtaaaatgcttttca

SEQ ID NO: 5881686 - DNA, 17 bp, Homo sapiens
ctacttgtgactgaagg

SEQ ID NO: 5881687 - DNA, 19 bp, Homo sapiens
ctacttgttacctttccca

SEQ ID NO: 5881688 - DNA, 19 bp, Homo sapiens
ctacttgtttcaaatgtgt

SEQ ID NO: 5881689 - DNA, 19 bp, Homo sapiens
ctacttgttttatttaact

SEQ ID NO: 5881690 - DNA, 21 bp, Homo sapiens
ctactttaaatcctaccaaag

SEQ ID NO: 5881691 - DNA, 18 bp, Homo sapiens
ctactttaaattgtggat

SEQ ID NO: 5881692 - DNA, 20 bp, Homo sapiens
ctactttaaattgtggatga

SEQ ID NO: 5881693 - DNA, 13 bp, Homo sapiens
ctactttaaattt

SEQ ID NO: 5881694 - DNA, 15 bp, Homo sapiens
ctactttaagtgata

SEQ ID NO: 5881695 - DNA, 21 bp, Homo sapiens
ctactttaataaatggttatt

SEQ ID NO: 5881696 - DNA, 15 bp, Homo sapiens
ctactttagccactg

SEQ ID NO: 5881697 - DNA, 18 bp, Homo sapiens
ctactttataactaacat

SEQ ID NO: 5881698 - DNA, 17 bp, Homo sapiens
ctactttatgtaaatca

SEQ ID NO: 5881699 - DNA, 23 bp, Homo sapiens
ctactttatttgcctaaatactt

SEQ ID NO: 5881700 - DNA, 21 bp, Homo sapiens
ctactttcatcttaaactaat

SEQ ID NO: 5881701 - DNA, 23 bp, Homo sapiens
ctactttcatcttaaactaatac

SEQ ID NO: 5881702 - DNA, 14 bp, Homo sapiens
ctactttccaggct

SEQ ID NO: 5881703 - DNA, 14 bp, Homo sapiens
ctactttccctctg

SEQ ID NO: 5881704 - DNA, 16 bp, Homo sapiens
ctactttccctctggg

SEQ ID NO: 5881705 - DNA, 13 bp, Homo sapiens
ctactttcctgat

SEQ ID NO: 5881706 - DNA, 16 bp, Homo sapiens
ctactttctcctgaaa

SEQ ID NO: 5881707 - DNA, 13 bp, Homo sapiens
ctactttctcttg

SEQ ID NO: 5881708 - DNA, 14 bp, Homo sapiens
ctactttctctttt

SEQ ID NO: 5881709 - DNA, 18 bp, Homo sapiens
ctactttctctttttcgt

SEQ ID NO: 5881710 - DNA, 16 bp, Homo sapiens
ctactttgataaagta

SEQ ID NO: 5881711 - DNA, 17 bp, Homo sapiens
ctactttgatatgactg

SEQ ID NO: 5881712 - DNA, 21 bp, Homo sapiens
ctactttgatatgactgtttt

SEQ ID NO: 5881713 - DNA, 16 bp, Homo sapiens
ctactttgctccgtgg

SEQ ID NO: 5881714 - DNA, 17 bp, Homo sapiens
ctactttgctccgtgga

SEQ ID NO: 5881715 - DNA, 21 bp, Homo sapiens
ctactttggtttctgtctgta

SEQ ID NO: 5881716 - DNA, 21 bp, Homo sapiens
ctactttgtcccctcacctcc

SEQ ID NO: 5881717 - DNA, 18 bp, Homo sapiens
ctactttgtctaaaaata

SEQ ID NO: 5881718 - DNA, 14 bp, Homo sapiens
ctacttttaaataa

SEQ ID NO: 5881719 - DNA, 19 bp, Homo sapiens
ctacttttacttgttcatt

SEQ ID NO: 5881720 - DNA, 21 bp, Homo sapiens
ctacttttagttgactcacag

SEQ ID NO: 5881721 - DNA, 16 bp, Homo sapiens
ctacttttccttccct

SEQ ID NO: 5881722 - DNA, 23 bp, Homo sapiens
ctacttttctttattagctttct

SEQ ID NO: 5881723 - DNA, 17 bp, Homo sapiens
ctacttttgcatgaaaa

SEQ ID NO: 5881724 - DNA, 22 bp, Homo sapiens
ctacttttgttccacattctct

SEQ ID NO: 5881725 - DNA, 14 bp, Homo sapiens
ctactttttatact

SEQ ID NO: 5881726 - DNA, 17 bp, Homo sapiens
ctactttttccttcctg

SEQ ID NO: 5881727 - DNA, 20 bp, Homo sapiens
ctactttttccttcctgccc

SEQ ID NO: 5881728 - DNA, 21 bp, Homo sapiens
ctactttttgaacttttcatt

SEQ ID NO: 5881729 - DNA, 16 bp, Homo sapiens
ctactttttgtattta

SEQ ID NO: 5881730 - DNA, 19 bp, Homo sapiens
ctactttttgtatttagta

SEQ ID NO: 5881731 - DNA, 20 bp, Homo sapiens
ctacttttttatccacctcc

SEQ ID NO: 5881732 - DNA, 18 bp, Homo sapiens
ctacttttttcattttgt

SEQ ID NO: 5881733 - DNA, 18 bp, Homo sapiens
ctagaaaaaaaaaacact

SEQ ID NO: 5881734 - DNA, 21 bp, Homo sapiens
ctagaaaaaagggctgagagg

SEQ ID NO: 5881735 - DNA, 14 bp, Homo sapiens
ctagaaaaacaggc

SEQ ID NO: 5881736 - DNA, 17 bp, Homo sapiens
ctagaaaaataaaatgt

SEQ ID NO: 5881737 - DNA, 15 bp, Homo sapiens
ctagaaaagaagcag

SEQ ID NO: 5881738 - DNA, 18 bp, Homo sapiens
ctagaaaagctgatcata

SEQ ID NO: 5881739 - DNA, 14 bp, Homo sapiens
ctagaaaatgaaaa

SEQ ID NO: 5881740 - DNA, 21 bp, Homo sapiens
ctagaaaatttagccctttaa

SEQ ID NO: 5881741 - DNA, 17 bp, Homo sapiens
ctagaaacaacactgta

SEQ ID NO: 5881742 - DNA, 20 bp, Homo sapiens
ctagaaacaacactgtagta

SEQ ID NO: 5881743 - DNA, 21 bp, Homo sapiens
ctagaaacccaagctcctcct

SEQ ID NO: 5881744 - DNA, 16 bp, Homo sapiens
ctagaaacttccaaat

SEQ ID NO: 5881745 - DNA, 20 bp, Homo sapiens
ctagaaagaagctcgcccca

SEQ ID NO: 5881746 - DNA, 22 bp, Homo sapiens
ctagaaagaagctcgccccacc

SEQ ID NO: 5881747 - DNA, 14 bp, Homo sapiens
ctagaaagagaaaa

SEQ ID NO: 5881748 - DNA, 16 bp, Homo sapiens
ctagaaagatgaaaac

SEQ ID NO: 5881749 - DNA, 18 bp, Homo sapiens
ctagaaagccatattcca

SEQ ID NO: 5881750 - DNA, 20 bp, Homo sapiens
ctagaaagccatattccagc

SEQ ID NO: 5881751 - DNA, 21 bp, Homo sapiens
ctagaaagcccctcacctcag

SEQ ID NO: 5881752 - DNA, 20 bp, Homo sapiens
ctagaaagctctgcatgtgt

SEQ ID NO: 5881753 - DNA, 22 bp, Homo sapiens
ctagaaagctctgcatgtgtgt

SEQ ID NO: 5881754 - DNA, 14 bp, Homo sapiens
ctagaaaggagaga

SEQ ID NO: 5881755 - DNA, 19 bp, Homo sapiens
ctagaaagtacaagaaaag

SEQ ID NO: 5881756 - DNA, 19 bp, Homo sapiens
ctagaaatatatcctgtgt

SEQ ID NO: 5881757 - DNA, 16 bp, Homo sapiens
ctagaaatatctttct

SEQ ID NO: 5881758 - DNA, 13 bp, Homo sapiens
ctagaaatatgat

SEQ ID NO: 5881759 - DNA, 15 bp, Homo sapiens
ctagaaatatgattt

SEQ ID NO: 5881760 - DNA, 17 bp, Homo sapiens
ctagaaatatgatttta

SEQ ID NO: 5881761 - DNA, 18 bp, Homo sapiens
ctagaaatcacaagaaca

SEQ ID NO: 5881762 - DNA, 20 bp, Homo sapiens
ctagaaatcacaagaacaaa

SEQ ID NO: 5881763 - DNA, 17 bp, Homo sapiens
ctagaaatctgtcctgt

SEQ ID NO: 5881764 - DNA, 19 bp, Homo sapiens
ctagaaatctgtcctgtgg

SEQ ID NO: 5881765 - DNA, 15 bp, Homo sapiens
ctagaaattcttaag

SEQ ID NO: 5881766 - DNA, 18 bp, Homo sapiens
ctagaaattgaacaaaaa

SEQ ID NO: 5881767 - DNA, 12 bp, Homo sapiens
ctagaaattttc

SEQ ID NO: 5881768 - DNA, 23 bp, Homo sapiens
ctagaaatttttcagatgcttct

SEQ ID NO: 5881769 - DNA, 15 bp, Homo sapiens
ctagaacaacttgaa

SEQ ID NO: 5881770 - DNA, 20 bp, Homo sapiens
ctagaacaagccagagccgc

SEQ ID NO: 5881771 - DNA, 14 bp, Homo sapiens
ctagaacacccact

SEQ ID NO: 5881772 - DNA, 15 bp, Homo sapiens
ctagaacacccactg

SEQ ID NO: 5881773 - DNA, 18 bp, Homo sapiens
ctagaacacccactggcc

SEQ ID NO: 5881774 - DNA, 22 bp, Homo sapiens
ctagaacactaactcaccagcc

SEQ ID NO: 5881775 - DNA, 18 bp, Homo sapiens
ctagaacatccctgccag

SEQ ID NO: 5881776 - DNA, 18 bp, Homo sapiens
ctagaacatccctgggca

SEQ ID NO: 5881777 - DNA, 19 bp, Homo sapiens
ctagaacatccttaaatgt

SEQ ID NO: 5881778 - DNA, 20 bp, Homo sapiens
ctagaacatccttaaatgtc

SEQ ID NO: 5881779 - DNA, 15 bp, Homo sapiens
ctagaacatgcacat

SEQ ID NO: 5881780 - DNA, 20 bp, Homo sapiens
ctagaacattccatttgctt

SEQ ID NO: 5881781 - DNA, 16 bp, Homo sapiens
ctagaaccaagcttca

SEQ ID NO: 5881782 - DNA, 16 bp, Homo sapiens
ctagaaccacttcctg

SEQ ID NO: 5881783 - DNA, 17 bp, Homo sapiens
ctagaaccacttcctgc

SEQ ID NO: 5881784 - DNA, 18 bp, Homo sapiens
ctagaacctagaagggct

SEQ ID NO: 5881785 - DNA, 14 bp, Homo sapiens
ctagaacctggagg

SEQ ID NO: 5881786 - DNA, 23 bp, Homo sapiens
ctagaacgtgcatccttgtaata

SEQ ID NO: 5881787 - DNA, 17 bp, Homo sapiens
ctagaactatcattttt

SEQ ID NO: 5881788 - DNA, 12 bp, Homo sapiens
ctagaactccct

SEQ ID NO: 5881789 - DNA, 13 bp, Homo sapiens
ctagaactccctt

SEQ ID NO: 5881790 - DNA, 19 bp, Homo sapiens
ctagaactccctttcaaca

SEQ ID NO: 5881791 - DNA, 13 bp, Homo sapiens
ctagaactcctgt

SEQ ID NO: 5881792 - DNA, 16 bp, Homo sapiens
ctagaactcctgtctt

SEQ ID NO: 5881793 - DNA, 18 bp, Homo sapiens
ctagaactctccatctta

SEQ ID NO: 5881794 - DNA, 14 bp, Homo sapiens
ctagaacttcaaaa

SEQ ID NO: 5881795 - DNA, 17 bp, Homo sapiens
ctagaacttcaaaatgt

SEQ ID NO: 5881796 - DNA, 10 bp, Homo sapiens
ctagaacttt

SEQ ID NO: 5881797 - DNA, 16 bp, Homo sapiens
ctagaacttttttaaa

SEQ ID NO: 5881798 - DNA, 17 bp, Homo sapiens
ctagaacttttttaaat

SEQ ID NO: 5881799 - DNA, 18 bp, Homo sapiens
ctagaacttttttaaata

SEQ ID NO: 5881800 - DNA, 22 bp, Homo sapiens
ctagaacttttttaaataaact

SEQ ID NO: 5881801 - DNA, 18 bp, Homo sapiens
ctagaagaaaacccgagg

SEQ ID NO: 5881802 - DNA, 20 bp, Homo sapiens
ctagaagaaaacccgaggga

SEQ ID NO: 5881803 - DNA, 13 bp, Homo sapiens
ctagaagaaaagc

SEQ ID NO: 5881804 - DNA, 20 bp, Homo sapiens
ctagaagaaagggcaagaag

SEQ ID NO: 5881805 - DNA, 17 bp, Homo sapiens
ctagaagaaatgaaatt

SEQ ID NO: 5881806 - DNA, 18 bp, Homo sapiens
ctagaagaaatgaaattt

SEQ ID NO: 5881807 - DNA, 21 bp, Homo sapiens
ctagaagaaatgaaattttac

SEQ ID NO: 5881808 - DNA, 16 bp, Homo sapiens
ctagaagaaccaaata

SEQ ID NO: 5881809 - DNA, 19 bp, Homo sapiens
ctagaagaaccaaatacct

SEQ ID NO: 5881810 - DNA, 20 bp, Homo sapiens
ctagaagaaccaaatacctc

SEQ ID NO: 5881811 - DNA, 12 bp, Homo sapiens
ctagaagaatta

SEQ ID NO: 5881812 - DNA, 15 bp, Homo sapiens
ctagaagagcacaga

SEQ ID NO: 5881813 - DNA, 19 bp, Homo sapiens
ctagaagagcacagagccc

SEQ ID NO: 5881814 - DNA, 22 bp, Homo sapiens
ctagaagagcacagagccctga

SEQ ID NO: 5881815 - DNA, 23 bp, Homo sapiens
ctagaagagcacagagccctgag

SEQ ID NO: 5881816 - DNA, 16 bp, Homo sapiens
ctagaagagtctattg

SEQ ID NO: 5881817 - DNA, 18 bp, Homo sapiens
ctagaagataacattttc

SEQ ID NO: 5881818 - DNA, 21 bp, Homo sapiens
ctagaagatcacagcagggcc

SEQ ID NO: 5881819 - DNA, 20 bp, Homo sapiens
ctagaagatgaatacaaaca

SEQ ID NO: 5881820 - DNA, 15 bp, Homo sapiens
ctagaagatgtgtaa

SEQ ID NO: 5881821 - DNA, 18 bp, Homo sapiens
ctagaagatgtgtaaaca

SEQ ID NO: 5881822 - DNA, 15 bp, Homo sapiens
ctagaagattagaaa

SEQ ID NO: 5881823 - DNA, 11 bp, Homo sapiens
ctagaagcaca

SEQ ID NO: 5881824 - DNA, 12 bp, Homo sapiens
ctagaagcacat

SEQ ID NO: 5881825 - DNA, 13 bp, Homo sapiens
ctagaagcacatg

SEQ ID NO: 5881826 - DNA, 13 bp, Homo sapiens
ctagaagccaagg

SEQ ID NO: 5881827 - DNA, 12 bp, Homo sapiens
ctagaagcccct

SEQ ID NO: 5881828 - DNA, 20 bp, Homo sapiens
ctagaagcccctgtcgccca

SEQ ID NO: 5881829 - DNA, 19 bp, Homo sapiens
ctagaagcctaagaactgt

SEQ ID NO: 5881830 - DNA, 23 bp, Homo sapiens
ctagaagctggtaaaaatgacaa

SEQ ID NO: 5881831 - DNA, 13 bp, Homo sapiens
ctagaaggccaca

SEQ ID NO: 5881832 - DNA, 22 bp, Homo sapiens
ctagaaggcttctctccacagt

SEQ ID NO: 5881833 - DNA, 13 bp, Homo sapiens
ctagaagggaagg

SEQ ID NO: 5881834 - DNA, 21 bp, Homo sapiens
ctagaagggctagaacctgga

SEQ ID NO: 5881835 - DNA, 22 bp, Homo sapiens
ctagaagggctagaacctggag

SEQ ID NO: 5881836 - DNA, 14 bp, Homo sapiens
ctagcaggatctgc

SEQ ID NO: 5881837 - DNA, 16 bp, Homo sapiens
ctagcaggcacaggac

SEQ ID NO: 5881838 - DNA, 13 bp, Homo sapiens
ctagcaggcagga

SEQ ID NO: 5881839 - DNA, 19 bp, Homo sapiens
ctagcaggcaggaagtcct

SEQ ID NO: 5881840 - DNA, 16 bp, Homo sapiens
ctagcaggctgttcca

SEQ ID NO: 5881841 - DNA, 17 bp, Homo sapiens
ctagcaggctgttccat

SEQ ID NO: 5881842 - DNA, 15 bp, Homo sapiens
ctagcagtaaaagat

SEQ ID NO: 5881843 - DNA, 17 bp, Homo sapiens
ctagcagtaaaagataa

SEQ ID NO: 5881844 - DNA, 23 bp, Homo sapiens
ctagcagtaaatacttgcagttg

SEQ ID NO: 5881845 - DNA, 15 bp, Homo sapiens
ctagcagtccccagc

SEQ ID NO: 5881846 - DNA, 17 bp, Homo sapiens
ctagcagtgaactattt

SEQ ID NO: 5881847 - DNA, 14 bp, Homo sapiens
ctagcagtttgcct

SEQ ID NO: 5881848 - DNA, 16 bp, Homo sapiens
ctagcagtttgcctct

SEQ ID NO: 5881849 - DNA, 18 bp, Homo sapiens
ctagcatacgtacacatt

SEQ ID NO: 5881850 - DNA, 21 bp, Homo sapiens
ctagcatacgtacacatttta

SEQ ID NO: 5881851 - DNA, 17 bp, Homo sapiens
ctagcatatctgccttt

SEQ ID NO: 5881852 - DNA, 21 bp, Homo sapiens
ctagcatatgagtttcatagc

SEQ ID NO: 5881853 - DNA, 22 bp, Homo sapiens
ctagcatggggtcagccccaag

SEQ ID NO: 5881854 - DNA, 18 bp, Homo sapiens
ctagcatgggtattttta

SEQ ID NO: 5881855 - DNA, 21 bp, Homo sapiens
ctagcattaccacttccctgc

SEQ ID NO: 5881856 - DNA, 14 bp, Homo sapiens
ctagcattcttaaa

SEQ ID NO: 5881857 - DNA, 19 bp, Homo sapiens
ctagcatttatttctctgg

SEQ ID NO: 5881858 - DNA, 18 bp, Homo sapiens
ctagccaaacctcaccaa

SEQ ID NO: 5881859 - DNA, 21 bp, Homo sapiens
ctagccaaacctcaccaactc

SEQ ID NO: 5881860 - DNA, 17 bp, Homo sapiens
ctagccaactcctcctt

SEQ ID NO: 5881861 - DNA, 23 bp, Homo sapiens
ctagccaaggctagttcctttca

SEQ ID NO: 5881862 - DNA, 22 bp, Homo sapiens
ctagccaatattaaaagagacc

SEQ ID NO: 5881863 - DNA, 22 bp, Homo sapiens
ctagccaccaactcttgcaggt

SEQ ID NO: 5881864 - DNA, 12 bp, Homo sapiens
ctagccaccagt

SEQ ID NO: 5881865 - DNA, 15 bp, Homo sapiens
ctagccaccagtgtc

SEQ ID NO: 5881866 - DNA, 20 bp, Homo sapiens
ctagccaccagtgtcctcca

SEQ ID NO: 5881867 - DNA, 22 bp, Homo sapiens
ctagccaccagtgtcctccaag

SEQ ID NO: 5881868 - DNA, 19 bp, Homo sapiens
ctagccaccgcctcctaca

SEQ ID NO: 5881869 - DNA, 16 bp, Homo sapiens
ctagccacctcctcgt

SEQ ID NO: 5881870 - DNA, 12 bp, Homo sapiens
ctagccactccc

SEQ ID NO: 5881871 - DNA, 15 bp, Homo sapiens
ctagccactcctgcc

SEQ ID NO: 5881872 - DNA, 23 bp, Homo sapiens
ctagccagaattctaccctggaa

SEQ ID NO: 5881873 - DNA, 12 bp, Homo sapiens
ctagccagacaa

SEQ ID NO: 5881874 - DNA, 23 bp, Homo sapiens
ctagccagacactctgctctgcc

SEQ ID NO: 5881875 - DNA, 23 bp, Homo sapiens
ctagccagagcccttcactgcca

SEQ ID NO: 5881876 - DNA, 17 bp, Homo sapiens
ctagccagaggagagag

SEQ ID NO: 5881877 - DNA, 15 bp, Homo sapiens
ctagccagaggctgg

SEQ ID NO: 5881878 - DNA, 12 bp, Homo sapiens
ctagccagccag

SEQ ID NO: 5881879 - DNA, 13 bp, Homo sapiens
ctagccagccagg

SEQ ID NO: 5881880 - DNA, 18 bp, Homo sapiens
ctagccagcccctcttcc

SEQ ID NO: 5881881 - DNA, 15 bp, Homo sapiens
ctagccaggagtctg

SEQ ID NO: 5881882 - DNA, 13 bp, Homo sapiens
ctagccaggcctc

SEQ ID NO: 5881883 - DNA, 15 bp, Homo sapiens
ctagccaggcctccc

SEQ ID NO: 5881884 - DNA, 17 bp, Homo sapiens
ctagccaggcctcccgc

SEQ ID NO: 5881885 - DNA, 18 bp, Homo sapiens
ctagccaggcctcccgca

SEQ ID NO: 5881886 - DNA, 21 bp, Homo sapiens
ctagccatacgctcagctcat

SEQ ID NO: 5881887 - DNA, 17 bp, Homo sapiens
ctagccatatattttct

SEQ ID NO: 5881888 - DNA, 12 bp, Homo sapiens
ctagccatggct

SEQ ID NO: 5881889 - DNA, 21 bp, Homo sapiens
ctagccatgtagtgctctcag

SEQ ID NO: 5881890 - DNA, 17 bp, Homo sapiens
ctagccattcctggtac

SEQ ID NO: 5881891 - DNA, 20 bp, Homo sapiens
ctagccattcctggtaccca

SEQ ID NO: 5881892 - DNA, 16 bp, Homo sapiens
ctagcccaaaggtaag

SEQ ID NO: 5881893 - DNA, 13 bp, Homo sapiens
ctagcccaaccta

SEQ ID NO: 5881894 - DNA, 14 bp, Homo sapiens
ctagcccacccccc

SEQ ID NO: 5881895 - DNA, 14 bp, Homo sapiens
ctagcccaccctgc

SEQ ID NO: 5881896 - DNA, 15 bp, Homo sapiens
ctagcccaccctgct

SEQ ID NO: 5881897 - DNA, 20 bp, Homo sapiens
ctagcccacttgtcatccat

SEQ ID NO: 5881898 - DNA, 13 bp, Homo sapiens
ctagcccaggacc

SEQ ID NO: 5881899 - DNA, 13 bp, Homo sapiens
ctagcccaggaga

SEQ ID NO: 5881900 - DNA, 15 bp, Homo sapiens
ctagcccaggagaga

SEQ ID NO: 5881901 - DNA, 17 bp, Homo sapiens
ctagcccaggagagaga

SEQ ID NO: 5881902 - DNA, 19 bp, Homo sapiens
ctagcccaggagagagaaa

SEQ ID NO: 5881903 - DNA, 13 bp, Homo sapiens
ctagcccagtccc

SEQ ID NO: 5881904 - DNA, 13 bp, Homo sapiens
ctagcccagtgct

SEQ ID NO: 5881905 - DNA, 14 bp, Homo sapiens
ctagcccatggact

SEQ ID NO: 5881906 - DNA, 22 bp, Homo sapiens
ctagcccatggacttcacataa

SEQ ID NO: 5881907 - DNA, 17 bp, Homo sapiens
ctagccccacccagagg

SEQ ID NO: 5881908 - DNA, 19 bp, Homo sapiens
ctagccccacccagaggtg

SEQ ID NO: 5881909 - DNA, 22 bp, Homo sapiens
ctagccccacccagaggtggcc

SEQ ID NO: 5881910 - DNA, 16 bp, Homo sapiens
ctagccccagcgccaa

SEQ ID NO: 5881911 - DNA, 12 bp, Homo sapiens
ctagccccaggg

SEQ ID NO: 5881912 - DNA, 21 bp, Homo sapiens
ctagccccagggtgagcaggg

SEQ ID NO: 5881913 - DNA, 23 bp, Homo sapiens
ctagccccagggtgagcagggcc

SEQ ID NO: 5881914 - DNA, 15 bp, Homo sapiens
ctagccccgagacac

SEQ ID NO: 5881915 - DNA, 19 bp, Homo sapiens
ctagccccgagacaccatc

SEQ ID NO: 5881916 - DNA, 21 bp, Homo sapiens
ctagcccctcacttccagctt

SEQ ID NO: 5881917 - DNA, 22 bp, Homo sapiens
ctagcccctcacttccagcttg

SEQ ID NO: 5881918 - DNA, 14 bp, Homo sapiens
ctagcccctctgga

SEQ ID NO: 5881919 - DNA, 15 bp, Homo sapiens
ctagcccctctggat

SEQ ID NO: 5881920 - DNA, 13 bp, Homo sapiens
ctagcccctgtgg

SEQ ID NO: 5881921 - DNA, 16 bp, Homo sapiens
ctagcccgaatacaaa

SEQ ID NO: 5881922 - DNA, 22 bp, Homo sapiens
ctagccctccccccagctccct

SEQ ID NO: 5881923 - DNA, 14 bp, Homo sapiens
ctagccctccctgg

SEQ ID NO: 5881924 - DNA, 19 bp, Homo sapiens
ctagccctcctttttccaa

SEQ ID NO: 5881925 - DNA, 12 bp, Homo sapiens
ctagccctgagc

SEQ ID NO: 5881926 - DNA, 14 bp, Homo sapiens
ctagccctgagccc

SEQ ID NO: 5881927 - DNA, 13 bp, Homo sapiens
ctagccctgcccg

SEQ ID NO: 5881928 - DNA, 11 bp, Homo sapiens
ctagccctgct

SEQ ID NO: 5881929 - DNA, 18 bp, Homo sapiens
ctagccctgctccaactc

SEQ ID NO: 5881930 - DNA, 11 bp, Homo sapiens
ctagccctggt

SEQ ID NO: 5881931 - DNA, 15 bp, Homo sapiens
ctagcccttccagcc

SEQ ID NO: 5881932 - DNA, 16 bp, Homo sapiens
ctagcccttccagcct

SEQ ID NO: 5881933 - DNA, 20 bp, Homo sapiens
ctagcccttccagcctggga

SEQ ID NO: 5881934 - DNA, 15 bp, Homo sapiens
ctagcccttccctga

SEQ ID NO: 5881935 - DNA, 19 bp, Homo sapiens
ctagcccttgtccctttta

SEQ ID NO: 5881936 - DNA, 13 bp, Homo sapiens
ctagccgacctca

SEQ ID NO: 5881937 - DNA, 15 bp, Homo sapiens
ctagccgacctcagc

SEQ ID NO: 5881938 - DNA, 21 bp, Homo sapiens
ctagccgggccatgctttcct

SEQ ID NO: 5881939 - DNA, 15 bp, Homo sapiens
ctagccggttcctgt

SEQ ID NO: 5881940 - DNA, 15 bp, Homo sapiens
ctagcctatgtctgg

SEQ ID NO: 5881941 - DNA, 19 bp, Homo sapiens
ctagcctatgtctggcaga

SEQ ID NO: 5881942 - DNA, 18 bp, Homo sapiens
ctagcctatttacctgca

SEQ ID NO: 5881943 - DNA, 22 bp, Homo sapiens
ctagcctatttacctgcaggct

SEQ ID NO: 5881944 - DNA, 20 bp, Homo sapiens
ctagcctcacgaaactggaa

SEQ ID NO: 5881945 - DNA, 23 bp, Homo sapiens
ctagcctcacgctcctttctgat

SEQ ID NO: 5881946 - DNA, 20 bp, Homo sapiens
ctagcctcaggggtctgagc

SEQ ID NO: 5881947 - DNA, 13 bp, Homo sapiens
ctagcctccacca

SEQ ID NO: 5881948 - DNA, 15 bp, Homo sapiens
ctagcctccagcttt

SEQ ID NO: 5881949 - DNA, 16 bp, Homo sapiens
ctagcctccagctttg

SEQ ID NO: 5881950 - DNA, 13 bp, Homo sapiens
ctagcctccctct

SEQ ID NO: 5881951 - DNA, 22 bp, Homo sapiens
ctagcctccctctcctctgtcc

SEQ ID NO: 5881952 - DNA, 15 bp, Homo sapiens
ctagcctgaaggatt

SEQ ID NO: 5881953 - DNA, 18 bp, Homo sapiens
ctagcctgaaggattctg

SEQ ID NO: 5881954 - DNA, 15 bp, Homo sapiens
ctagcctgcactttg

SEQ ID NO: 5881955 - DNA, 19 bp, Homo sapiens
ctagcctgcattgagcttg

SEQ ID NO: 5881956 - DNA, 22 bp, Homo sapiens
ctagcctggatggcccctcctt

SEQ ID NO: 5881957 - DNA, 19 bp, Homo sapiens
ctagcctggggcttgaatt

SEQ ID NO: 5881958 - DNA, 21 bp, Homo sapiens
ctagcctggggcttgaatttg

SEQ ID NO: 5881959 - DNA, 21 bp, Homo sapiens
ctagccttagaagtcacacag

SEQ ID NO: 5881960 - DNA, 23 bp, Homo sapiens
ctagccttagaagtcacacagta

SEQ ID NO: 5881961 - DNA, 12 bp, Homo sapiens
ctagccttagtc

SEQ ID NO: 5881962 - DNA, 18 bp, Homo sapiens
ctagccttagtcaataaa

SEQ ID NO: 5881963 - DNA, 19 bp, Homo sapiens
ctagccttatcctctgatc

SEQ ID NO: 5881964 - DNA, 22 bp, Homo sapiens
ctagccttatcctctgatctcc

SEQ ID NO: 5881965 - DNA, 19 bp, Homo sapiens
ctagccttgaggagtgtga

SEQ ID NO: 5881966 - DNA, 14 bp, Homo sapiens
ctagccttgcttgt

SEQ ID NO: 5881967 - DNA, 22 bp, Homo sapiens
ctagccttggcctctttcctca

SEQ ID NO: 5881968 - DNA, 12 bp, Homo sapiens
ctagcctttggg

SEQ ID NO: 5881969 - DNA, 22 bp, Homo sapiens
ctagcgaacgtatttctccaga

SEQ ID NO: 5881970 - DNA, 19 bp, Homo sapiens
ctagcgagccgcctctggt

SEQ ID NO: 5881971 - DNA, 19 bp, Homo sapiens
ctagcgatctctcctggcc

SEQ ID NO: 5881972 - DNA, 20 bp, Homo sapiens
ctagcgatctctcctggcct

SEQ ID NO: 5881973 - DNA, 14 bp, Homo sapiens
ctagcgcctggcct

SEQ ID NO: 5881974 - DNA, 16 bp, Homo sapiens
ctagcggctgctcctt

SEQ ID NO: 5881975 - DNA, 18 bp, Homo sapiens
ctagcggctgctccttca

SEQ ID NO: 5881976 - DNA, 20 bp, Homo sapiens
ctagcgtagtgcagcagggc

SEQ ID NO: 5881977 - DNA, 22 bp, Homo sapiens
ctagcgtagtgcagcagggcag

SEQ ID NO: 5881978 - DNA, 15 bp, Homo sapiens
ctagcgtgtgccagg

SEQ ID NO: 5881979 - DNA, 13 bp, Homo sapiens
ctagctaaataaa

SEQ ID NO: 5881980 - DNA, 16 bp, Homo sapiens
ctagctaataaacctg

SEQ ID NO: 5881981 - DNA, 22 bp, Homo sapiens
ctagctaatggaaaatgatttt

SEQ ID NO: 5881982 - DNA, 22 bp, Homo sapiens
ctagctaatgtaataactgtga

SEQ ID NO: 5881983 - DNA, 13 bp, Homo sapiens
ctagctacactga

SEQ ID NO: 5881984 - DNA, 17 bp, Homo sapiens
ctagctagaaatatgat

SEQ ID NO: 5881985 - DNA, 19 bp, Homo sapiens
ctagctagaagtgggccag

SEQ ID NO: 5881986 - DNA, 14 bp, Homo sapiens
ctagctagccagcc

SEQ ID NO: 5881987 - DNA, 12 bp, Homo sapiens
ctagctagctca

SEQ ID NO: 5881988 - DNA, 21 bp, Homo sapiens
ctagctatgctgtatctgtgc

SEQ ID NO: 5881989 - DNA, 12 bp, Homo sapiens
ctagctcacact

SEQ ID NO: 5881990 - DNA, 14 bp, Homo sapiens
ctagctcaccaggc

SEQ ID NO: 5881991 - DNA, 18 bp, Homo sapiens
ctagctcaccaggcctgg

SEQ ID NO: 5881992 - DNA, 22 bp, Homo sapiens
ctagctccacaccctctcccag

SEQ ID NO: 5881993 - DNA, 10 bp, Homo sapiens
ctagctcccc

SEQ ID NO: 5881994 - DNA, 13 bp, Homo sapiens
ctagctcccctcc

SEQ ID NO: 5881995 - DNA, 21 bp, Homo sapiens
ctagctcccctcctctcccct

SEQ ID NO: 5881996 - DNA, 23 bp, Homo sapiens
ctagctcccctcctctcccctac

SEQ ID NO: 5881997 - DNA, 21 bp, Homo sapiens
ctagctcctgccacatggagc

SEQ ID NO: 5881998 - DNA, 14 bp, Homo sapiens
ctagctctcacaga

SEQ ID NO: 5881999 - DNA, 15 bp, Homo sapiens
ctagctctctaggcc

SEQ ID NO: 5882000 - DNA, 14 bp, Homo sapiens
ctagctctggtggg

SEQ ID NO: 5882001 - DNA, 13 bp, Homo sapiens
ctagctcttgggc

SEQ ID NO: 5882002 - DNA, 14 bp, Homo sapiens
ctagctcttgggcc

SEQ ID NO: 5882003 - DNA, 15 bp, Homo sapiens
ctagctcttgggcct

SEQ ID NO: 5882004 - DNA, 21 bp, Homo sapiens
ctagctcttgggcctgacctc

SEQ ID NO: 5882005 - DNA, 22 bp, Homo sapiens
ctagctcttgggcctgacctcc

SEQ ID NO: 5882006 - DNA, 23 bp, Homo sapiens
ctagctcttgggcctgacctcca

SEQ ID NO: 5882007 - DNA, 21 bp, Homo sapiens
ctagctcttgttgagccgtgg

SEQ ID NO: 5882008 - DNA, 22 bp, Homo sapiens
ctagctctttgggcctctcctg

SEQ ID NO: 5882009 - DNA, 10 bp, Homo sapiens
ctagctgaat

SEQ ID NO: 5882010 - DNA, 19 bp, Homo sapiens
ctagctgaatgtttttcta

SEQ ID NO: 5882011 - DNA, 23 bp, Homo sapiens
ctagctgagaagcaatgggtcac

SEQ ID NO: 5882012 - DNA, 19 bp, Homo sapiens
ctagctgatcagaatttta

SEQ ID NO: 5882013 - DNA, 16 bp, Homo sapiens
ctagctgccactttca

SEQ ID NO: 5882014 - DNA, 15 bp, Homo sapiens
ctaggtggaggcaag

SEQ ID NO: 5882015 - DNA, 20 bp, Homo sapiens
ctaggtgggaagatggtttg

SEQ ID NO: 5882016 - DNA, 17 bp, Homo sapiens
ctaggtgggagccacca

SEQ ID NO: 5882017 - DNA, 21 bp, Homo sapiens
ctaggtgggtcaactccaagg

SEQ ID NO: 5882018 - DNA, 23 bp, Homo sapiens
ctaggtgggtcaactccaaggca

SEQ ID NO: 5882019 - DNA, 14 bp, Homo sapiens
ctaggtgtccccaa

SEQ ID NO: 5882020 - DNA, 14 bp, Homo sapiens
ctaggtgttttgtt

SEQ ID NO: 5882021 - DNA, 17 bp, Homo sapiens
ctaggtgttttgttcac

SEQ ID NO: 5882022 - DNA, 16 bp, Homo sapiens
ctaggttaaagctaaa

SEQ ID NO: 5882023 - DNA, 11 bp, Homo sapiens
ctaggttcaaa

SEQ ID NO: 5882024 - DNA, 13 bp, Homo sapiens
ctaggttccctgt

SEQ ID NO: 5882025 - DNA, 21 bp, Homo sapiens
ctaggttccctgttcttcctc

SEQ ID NO: 5882026 - DNA, 20 bp, Homo sapiens
ctaggttctgtagagccaat

SEQ ID NO: 5882027 - DNA, 22 bp, Homo sapiens
ctaggttctgtagagccaatta

SEQ ID NO: 5882028 - DNA, 18 bp, Homo sapiens
ctaggttggacagccccc

SEQ ID NO: 5882029 - DNA, 20 bp, Homo sapiens
ctaggttggacagccccctt

SEQ ID NO: 5882030 - DNA, 21 bp, Homo sapiens
ctaggttggacagcccccttc

SEQ ID NO: 5882031 - DNA, 16 bp, Homo sapiens
ctaggttgtttttaaa

SEQ ID NO: 5882032 - DNA, 12 bp, Homo sapiens
ctaggtttaact

SEQ ID NO: 5882033 - DNA, 20 bp, Homo sapiens
ctaggtttaactcagatcac

SEQ ID NO: 5882034 - DNA, 16 bp, Homo sapiens
ctaggtttatgacagt

SEQ ID NO: 5882035 - DNA, 23 bp, Homo sapiens
ctaggttttgagatttagagcaa

SEQ ID NO: 5882036 - DNA, 16 bp, Homo sapiens
ctagtaaaaatacaaa

SEQ ID NO: 5882037 - DNA, 18 bp, Homo sapiens
ctagtaaaaccttgttct

SEQ ID NO: 5882038 - DNA, 17 bp, Homo sapiens
ctagtaacaatacatga

SEQ ID NO: 5882039 - DNA, 15 bp, Homo sapiens
ctagtaaccaaggcc

SEQ ID NO: 5882040 - DNA, 15 bp, Homo sapiens
ctagtaactgctgtc

SEQ ID NO: 5882041 - DNA, 13 bp, Homo sapiens
ctagtaagaagac

SEQ ID NO: 5882042 - DNA, 21 bp, Homo sapiens
ctagtaagtaattatgcacta

SEQ ID NO: 5882043 - DNA, 22 bp, Homo sapiens
ctagtaagtaattatgcactaa

SEQ ID NO: 5882044 - DNA, 18 bp, Homo sapiens
ctagtaagtgccttccat

SEQ ID NO: 5882045 - DNA, 20 bp, Homo sapiens
ctagtaatatatttaaaggg

SEQ ID NO: 5882046 - DNA, 14 bp, Homo sapiens
ctagtaattgccta

SEQ ID NO: 5882047 - DNA, 18 bp, Homo sapiens
ctagtaattgggaaaaaa

SEQ ID NO: 5882048 - DNA, 21 bp, Homo sapiens
ctagtacataattgattaaaa

SEQ ID NO: 5882049 - DNA, 16 bp, Homo sapiens
ctagtacctgtgactc

SEQ ID NO: 5882050 - DNA, 15 bp, Homo sapiens
ctagtactagaaact

SEQ ID NO: 5882051 - DNA, 13 bp, Homo sapiens
ctagtactattat

SEQ ID NO: 5882052 - DNA, 16 bp, Homo sapiens
ctagtactatttctta

SEQ ID NO: 5882053 - DNA, 12 bp, Homo sapiens
ctagtactgtat

SEQ ID NO: 5882054 - DNA, 14 bp, Homo sapiens
ctagtactgtgaat

SEQ ID NO: 5882055 - DNA, 15 bp, Homo sapiens
ctagtacttattaca

SEQ ID NO: 5882056 - DNA, 16 bp, Homo sapiens
ctagtacttgaaaaag

SEQ ID NO: 5882057 - DNA, 22 bp, Homo sapiens
ctagtacttgggagacctgtaa

SEQ ID NO: 5882058 - DNA, 16 bp, Homo sapiens
ctagtagaaagaaaat

SEQ ID NO: 5882059 - DNA, 15 bp, Homo sapiens
ctagtagagcaaaga

SEQ ID NO: 5882060 - DNA, 17 bp, Homo sapiens
ctagtagatttctatga

SEQ ID NO: 5882061 - DNA, 23 bp, Homo sapiens
ctagtagctgttttgaataacat

SEQ ID NO: 5882062 - DNA, 18 bp, Homo sapiens
ctagtaggaatgtacatg

SEQ ID NO: 5882063 - DNA, 23 bp, Homo sapiens
ctagtaggcagcaaaagaccaaa

SEQ ID NO: 5882064 - DNA, 20 bp, Homo sapiens
ctagtaggggtaccactgaa

SEQ ID NO: 5882065 - DNA, 16 bp, Homo sapiens
ctagtaggtctgcaca

SEQ ID NO: 5882066 - DNA, 15 bp, Homo sapiens
ctagtagttaaaaca

SEQ ID NO: 5882067 - DNA, 23 bp, Homo sapiens
ctagtagttaaaacagctatttt

SEQ ID NO: 5882068 - DNA, 17 bp, Homo sapiens
ctagtagttcctgctac

SEQ ID NO: 5882069 - DNA, 23 bp, Homo sapiens
ctagtataaacatgaccctgggc

SEQ ID NO: 5882070 - DNA, 18 bp, Homo sapiens
ctagtataagtctgggca

SEQ ID NO: 5882071 - DNA, 14 bp, Homo sapiens
ctagtatacccact

SEQ ID NO: 5882072 - DNA, 16 bp, Homo sapiens
ctagtatacccactgc

SEQ ID NO: 5882073 - DNA, 14 bp, Homo sapiens
ctagtatatgtcag

SEQ ID NO: 5882074 - DNA, 22 bp, Homo sapiens
ctagtatatgtcagacatgaaa

SEQ ID NO: 5882075 - DNA, 15 bp, Homo sapiens
ctagtatcaaaagaa

SEQ ID NO: 5882076 - DNA, 14 bp, Homo sapiens
ctagtatcactgct

SEQ ID NO: 5882077 - DNA, 19 bp, Homo sapiens
ctagtatccaaaatattta

SEQ ID NO: 5882078 - DNA, 16 bp, Homo sapiens
ctagtatctattgtgt

SEQ ID NO: 5882079 - DNA, 15 bp, Homo sapiens
ctagtatctctggcc

SEQ ID NO: 5882080 - DNA, 18 bp, Homo sapiens
ctagtatctggctgggtt

SEQ ID NO: 5882081 - DNA, 21 bp, Homo sapiens
ctagtatcttcaaactttcac

SEQ ID NO: 5882082 - DNA, 23 bp, Homo sapiens
ctagtatcttcaaactttcactt

SEQ ID NO: 5882083 - DNA, 16 bp, Homo sapiens
ctagtatgaaattata

SEQ ID NO: 5882084 - DNA, 23 bp, Homo sapiens
ctagtattccagacctgaagaat

SEQ ID NO: 5882085 - DNA, 12 bp, Homo sapiens
ctagtattcgct

SEQ ID NO: 5882086 - DNA, 15 bp, Homo sapiens
ctagtattgacaaaa

SEQ ID NO: 5882087 - DNA, 20 bp, Homo sapiens
ctagtattgacaaaatgtta

SEQ ID NO: 5882088 - DNA, 14 bp, Homo sapiens
ctagtatttgaatt

SEQ ID NO: 5882089 - DNA, 20 bp, Homo sapiens
ctagtatttgaattaaaact

SEQ ID NO: 5882090 - DNA, 21 bp, Homo sapiens
ctagtatttgaattaaaactt

SEQ ID NO: 5882091 - DNA, 23 bp, Homo sapiens
ctagtatttgaattaaaacttct

SEQ ID NO: 5882092 - DNA, 20 bp, Homo sapiens
ctagtcaaaactatttttgt

SEQ ID NO: 5882093 - DNA, 21 bp, Homo sapiens
ctagtcaacagtaccctggtt

SEQ ID NO: 5882094 - DNA, 18 bp, Homo sapiens
ctagtcaactgctgtttt

SEQ ID NO: 5882095 - DNA, 22 bp, Homo sapiens
ctagtcaactggggaaaaggat

SEQ ID NO: 5882096 - DNA, 16 bp, Homo sapiens
ctagtcaagctcctcc

SEQ ID NO: 5882097 - DNA, 22 bp, Homo sapiens
ctagtcaagctcctcctccctg

SEQ ID NO: 5882098 - DNA, 23 bp, Homo sapiens
ctagtcaagctcctcctccctgc

SEQ ID NO: 5882099 - DNA, 16 bp, Homo sapiens
ctagtcaataaacctg

SEQ ID NO: 5882100 - DNA, 19 bp, Homo sapiens
ctagtcaataactctgatt

SEQ ID NO: 5882101 - DNA, 20 bp, Homo sapiens
ctagtcaatcaagtctgttt

SEQ ID NO: 5882102 - DNA, 20 bp, Homo sapiens
ctagtcaatgacatgaattt

SEQ ID NO: 5882103 - DNA, 22 bp, Homo sapiens
ctagtcacctgggggggttggg

SEQ ID NO: 5882104 - DNA, 21 bp, Homo sapiens
ctagtcacgcatgcagtgttg

SEQ ID NO: 5882105 - DNA, 19 bp, Homo sapiens
ctagtcactggcagcctgc

SEQ ID NO: 5882106 - DNA, 16 bp, Homo sapiens
ctagtcagatggatgt

SEQ ID NO: 5882107 - DNA, 20 bp, Homo sapiens
ctagtcagcactagatcatg

SEQ ID NO: 5882108 - DNA, 16 bp, Homo sapiens
ctagtcagccacatgg

SEQ ID NO: 5882109 - DNA, 22 bp, Homo sapiens
ctagtcagggcacagctgccct

SEQ ID NO: 5882110 - DNA, 13 bp, Homo sapiens
ctagtcataacct

SEQ ID NO: 5882111 - DNA, 22 bp, Homo sapiens
ctagtccaacattttttcccag

SEQ ID NO: 5882112 - DNA, 15 bp, Homo sapiens
ctagtccccaaggcc

SEQ ID NO: 5882113 - DNA, 21 bp, Homo sapiens
ctagtccccctgttttctgtt

SEQ ID NO: 5882114 - DNA, 16 bp, Homo sapiens
ctagtcccctttcctc

SEQ ID NO: 5882115 - DNA, 23 bp, Homo sapiens
ctagtcccttcccctccctggct

SEQ ID NO: 5882116 - DNA, 20 bp, Homo sapiens
ctagtcccttctctctttct

SEQ ID NO: 5882117 - DNA, 15 bp, Homo sapiens
ctagtccgctgaaga

SEQ ID NO: 5882118 - DNA, 15 bp, Homo sapiens
ctagtccggttcttc

SEQ ID NO: 5882119 - DNA, 14 bp, Homo sapiens
ctagtccgtcctgg

SEQ ID NO: 5882120 - DNA, 20 bp, Homo sapiens
ctagtcctcacttctagatc

SEQ ID NO: 5882121 - DNA, 12 bp, Homo sapiens
ctagtccttgtt

SEQ ID NO: 5882122 - DNA, 21 bp, Homo sapiens
ctagtcctttctgtgaagcta

SEQ ID NO: 5882123 - DNA, 15 bp, Homo sapiens
ctagtcgacactaag

SEQ ID NO: 5882124 - DNA, 19 bp, Homo sapiens
ctagtcgcccctcagagca

SEQ ID NO: 5882125 - DNA, 22 bp, Homo sapiens
ctagtcgcccctcagagcatga

SEQ ID NO: 5882126 - DNA, 20 bp, Homo sapiens
ctagtcgtggagatgtcttc

SEQ ID NO: 5882127 - DNA, 21 bp, Homo sapiens
ctagtctaaaaacttcttttt

SEQ ID NO: 5882128 - DNA, 20 bp, Homo sapiens
ctagtctacttcttaaaatt

SEQ ID NO: 5882129 - DNA, 15 bp, Homo sapiens
ctagtctagtttcct

SEQ ID NO: 5882130 - DNA, 19 bp, Homo sapiens
ctagtctatggtcagttga

SEQ ID NO: 5882131 - DNA, 15 bp, Homo sapiens
ctagtctcctttgaa

SEQ ID NO: 5882132 - DNA, 21 bp, Homo sapiens
ctagtctctatcattaaagtt

SEQ ID NO: 5882133 - DNA, 12 bp, Homo sapiens
ctagtctctcct

SEQ ID NO: 5882134 - DNA, 14 bp, Homo sapiens
ctagtctctctggg

SEQ ID NO: 5882135 - DNA, 15 bp, Homo sapiens
ctagtctcttctcag

SEQ ID NO: 5882136 - DNA, 17 bp, Homo sapiens
ctagtctcttctcagag

SEQ ID NO: 5882137 - DNA, 20 bp, Homo sapiens
ctagtctcttctcagagcag

SEQ ID NO: 5882138 - DNA, 21 bp, Homo sapiens
ctagtctggaactgctgctga

SEQ ID NO: 5882139 - DNA, 21 bp, Homo sapiens
ctagtctggtgttctgagtac

SEQ ID NO: 5882140 - DNA, 16 bp, Homo sapiens
ctagtctgtcagggcc

SEQ ID NO: 5882141 - DNA, 15 bp, Homo sapiens
ctagtctgtgcctca

SEQ ID NO: 5882142 - DNA, 23 bp, Homo sapiens
ctagtctgtgtaactttaaacat

SEQ ID NO: 5882143 - DNA, 23 bp, Homo sapiens
ctagtctgtgtggcaaattaaac

SEQ ID NO: 5882144 - DNA, 20 bp, Homo sapiens
ctagtctgtgtgggactgta

SEQ ID NO: 5882145 - DNA, 13 bp, Homo sapiens
ctagtcttaagaa

SEQ ID NO: 5882146 - DNA, 14 bp, Homo sapiens
ctagtcttcacaac

SEQ ID NO: 5882147 - DNA, 18 bp, Homo sapiens
ctagtcttgacctctcca

SEQ ID NO: 5882148 - DNA, 19 bp, Homo sapiens
ctagtcttgacctctccag

SEQ ID NO: 5882149 - DNA, 20 bp, Homo sapiens
ctagtcttgacctctccagc

SEQ ID NO: 5882150 - DNA, 23 bp, Homo sapiens
ctagtcttgctttgctgtctggt

SEQ ID NO: 5882151 - DNA, 14 bp, Homo sapiens
ctagtctttccagt

SEQ ID NO: 5882152 - DNA, 23 bp, Homo sapiens
ctagtctttccagtcaacatcgt

SEQ ID NO: 5882153 - DNA, 15 bp, Homo sapiens
ctagtcttttgcttt

SEQ ID NO: 5882154 - DNA, 18 bp, Homo sapiens
ctagtgaaactgcattat

SEQ ID NO: 5882155 - DNA, 12 bp, Homo sapiens
ctagtgaaactt

SEQ ID NO: 5882156 - DNA, 16 bp, Homo sapiens
ctagtgaaccacaggt

SEQ ID NO: 5882157 - DNA, 19 bp, Homo sapiens
ctagtgaagaccagagcag

SEQ ID NO: 5882158 - DNA, 22 bp, Homo sapiens
ctagtgaagaccagagcagttt

SEQ ID NO: 5882159 - DNA, 13 bp, Homo sapiens
ctagtgaagatgt

SEQ ID NO: 5882160 - DNA, 16 bp, Homo sapiens
ctagtgacacctcagt

SEQ ID NO: 5882161 - DNA, 18 bp, Homo sapiens
ctagtgacccacatgcca

SEQ ID NO: 5882162 - DNA, 19 bp, Homo sapiens
ctagtgaccccttccctgt

SEQ ID NO: 5882163 - DNA, 19 bp, Homo sapiens
ctagtgacttgtgtcccat

SEQ ID NO: 5882164 - DNA, 17 bp, Homo sapiens
ctagtgagcctgggcca

SEQ ID NO: 5882165 - DNA, 18 bp, Homo sapiens
ctagtgagcctgggccag

SEQ ID NO: 5882166 - DNA, 17 bp, Homo sapiens
ctagtgaggaagacaag

SEQ ID NO: 5882167 - DNA, 21 bp, Homo sapiens
ctagtgatacactgtatctaa

SEQ ID NO: 5882168 - DNA, 16 bp, Homo sapiens
ctagtgatacggattt

SEQ ID NO: 5882169 - DNA, 15 bp, Homo sapiens
ctagtgatggtcaga

SEQ ID NO: 5882170 - DNA, 21 bp, Homo sapiens
ctagtgattaaacgaggcaat

SEQ ID NO: 5882171 - DNA, 23 bp, Homo sapiens
ctagtgatttctggggccccacc

SEQ ID NO: 5882172 - DNA, 19 bp, Homo sapiens
ctagtgcaaaaactgtaaa

SEQ ID NO: 5882173 - DNA, 20 bp, Homo sapiens
ctagtgcaaaaactgtaaaa

SEQ ID NO: 5882174 - DNA, 13 bp, Homo sapiens
ctagtgcaaatca

SEQ ID NO: 5882175 - DNA, 16 bp, Homo sapiens
ctagtgcaaatcatag

SEQ ID NO: 5882176 - DNA, 21 bp, Homo sapiens
ctagtgcagaagccccaactg

SEQ ID NO: 5882177 - DNA, 14 bp, Homo sapiens
ctagtgcagctgaa

SEQ ID NO: 5882178 - DNA, 22 bp, Homo sapiens
ctagtgcagctgattttaacaa

SEQ ID NO: 5882179 - DNA, 23 bp, Homo sapiens
ctagtgcatttcaaggaatggaa

SEQ ID NO: 5882180 - DNA, 17 bp, Homo sapiens
ctagtgccaaataattg

SEQ ID NO: 5882181 - DNA, 20 bp, Homo sapiens
ctagtgccaatgatgtgacc

SEQ ID NO: 5882182 - DNA, 17 bp, Homo sapiens
ctagtgccatatatttt

SEQ ID NO: 5882183 - DNA, 13 bp, Homo sapiens
ctagtgccccaga

SEQ ID NO: 5882184 - DNA, 23 bp, Homo sapiens
ctagtgccccagactgagctctc

SEQ ID NO: 5882185 - DNA, 18 bp, Homo sapiens
ctagtgccctccacagcc

SEQ ID NO: 5882186 - DNA, 19 bp, Homo sapiens
ctagtgccctccacagccg

SEQ ID NO: 5882187 - DNA, 23 bp, Homo sapiens
ctagtgccctccacagccgcagc

SEQ ID NO: 5882188 - DNA, 22 bp, Homo sapiens
ctagtgccgaatgactatgtcc

SEQ ID NO: 5882189 - DNA, 19 bp, Homo sapiens
ctataaattcctctttgct

SEQ ID NO: 5882190 - DNA, 20 bp, Homo sapiens
ctataaatttaagaaaacaa

SEQ ID NO: 5882191 - DNA, 15 bp, Homo sapiens
ctataaattttttga

SEQ ID NO: 5882192 - DNA, 13 bp, Homo sapiens
ctataacaaaaaa

SEQ ID NO: 5882193 - DNA, 17 bp, Homo sapiens
ctataacaaaagcaata

SEQ ID NO: 5882194 - DNA, 22 bp, Homo sapiens
ctataacaaaggatacttattt

SEQ ID NO: 5882195 - DNA, 13 bp, Homo sapiens
ctataacagaaag

SEQ ID NO: 5882196 - DNA, 21 bp, Homo sapiens
ctataacagatcctttcaaaa

SEQ ID NO: 5882197 - DNA, 17 bp, Homo sapiens
ctataacattatataac

SEQ ID NO: 5882198 - DNA, 18 bp, Homo sapiens
ctataacattatataaca

SEQ ID NO: 5882199 - DNA, 12 bp, Homo sapiens
ctataacatttg

SEQ ID NO: 5882200 - DNA, 18 bp, Homo sapiens
ctataaccccagctccct

SEQ ID NO: 5882201 - DNA, 16 bp, Homo sapiens
ctataacttcttcctg

SEQ ID NO: 5882202 - DNA, 22 bp, Homo sapiens
ctataacttgatgcatgtggtt

SEQ ID NO: 5882203 - DNA, 17 bp, Homo sapiens
ctataactttttttcaa

SEQ ID NO: 5882204 - DNA, 15 bp, Homo sapiens
ctataagaaaagtga

SEQ ID NO: 5882205 - DNA, 21 bp, Homo sapiens
ctataagaagccttaatttgc

SEQ ID NO: 5882206 - DNA, 21 bp, Homo sapiens
ctataagactataaataaaaa

SEQ ID NO: 5882207 - DNA, 22 bp, Homo sapiens
ctataagagaattatatatttc

SEQ ID NO: 5882208 - DNA, 18 bp, Homo sapiens
ctataagagacaaagttt

SEQ ID NO: 5882209 - DNA, 15 bp, Homo sapiens
ctataagatgaaaca

SEQ ID NO: 5882210 - DNA, 16 bp, Homo sapiens
ctataaggcagccttg

SEQ ID NO: 5882211 - DNA, 23 bp, Homo sapiens
ctataagggagtaggctgtattt

SEQ ID NO: 5882212 - DNA, 13 bp, Homo sapiens
ctataaggtgcct

SEQ ID NO: 5882213 - DNA, 14 bp, Homo sapiens
ctataaggtgcctc

SEQ ID NO: 5882214 - DNA, 21 bp, Homo sapiens
ctataaggtgctctctttctg

SEQ ID NO: 5882215 - DNA, 23 bp, Homo sapiens
ctataaggtgctctctttctgtc

SEQ ID NO: 5882216 - DNA, 22 bp, Homo sapiens
ctataagtagttggtttgtatg

SEQ ID NO: 5882217 - DNA, 18 bp, Homo sapiens
ctataagtatataaatac

SEQ ID NO: 5882218 - DNA, 17 bp, Homo sapiens
ctataagtgttcagtgt

SEQ ID NO: 5882219 - DNA, 22 bp, Homo sapiens
ctataagtgttcagtgttgaca

SEQ ID NO: 5882220 - DNA, 23 bp, Homo sapiens
ctataagtgttcagtgttgacat

SEQ ID NO: 5882221 - DNA, 11 bp, Homo sapiens
ctataagttgt

SEQ ID NO: 5882222 - DNA, 15 bp, Homo sapiens
ctataagttgtacca

SEQ ID NO: 5882223 - DNA, 23 bp, Homo sapiens
ctataagttgtaccaaaacatcc

SEQ ID NO: 5882224 - DNA, 22 bp, Homo sapiens
ctataataaaatggcaccttcc

SEQ ID NO: 5882225 - DNA, 15 bp, Homo sapiens
ctataataaataaac

SEQ ID NO: 5882226 - DNA, 16 bp, Homo sapiens
ctataataagttttga

SEQ ID NO: 5882227 - DNA, 20 bp, Homo sapiens
ctataataagttttgatata

SEQ ID NO: 5882228 - DNA, 22 bp, Homo sapiens
ctataataagttttgatataat

SEQ ID NO: 5882229 - DNA, 16 bp, Homo sapiens
ctataatatttccttt

SEQ ID NO: 5882230 - DNA, 13 bp, Homo sapiens
ctataatcaaatg

SEQ ID NO: 5882231 - DNA, 14 bp, Homo sapiens
ctataatcaaatga

SEQ ID NO: 5882232 - DNA, 17 bp, Homo sapiens
ctataatcaaatgattt

SEQ ID NO: 5882233 - DNA, 19 bp, Homo sapiens
ctataatcaaatgatttca

SEQ ID NO: 5882234 - DNA, 21 bp, Homo sapiens
ctataatcaaatgatttcata

SEQ ID NO: 5882235 - DNA, 22 bp, Homo sapiens
ctataatcaaatgatttcatat

SEQ ID NO: 5882236 - DNA, 23 bp, Homo sapiens
ctataatcaaatgatttcatatt

SEQ ID NO: 5882237 - DNA, 12 bp, Homo sapiens
ctataatcatta

SEQ ID NO: 5882238 - DNA, 14 bp, Homo sapiens
ctataatcccagca

SEQ ID NO: 5882239 - DNA, 19 bp, Homo sapiens
ctataatcccagcactttg

SEQ ID NO: 5882240 - DNA, 13 bp, Homo sapiens
ctataatctgtca

SEQ ID NO: 5882241 - DNA, 18 bp, Homo sapiens
ctataatctgtcaaaaca

SEQ ID NO: 5882242 - DNA, 19 bp, Homo sapiens
ctataatctgtcaaaacac

SEQ ID NO: 5882243 - DNA, 18 bp, Homo sapiens
ctataatcttatacaaca

SEQ ID NO: 5882244 - DNA, 13 bp, Homo sapiens
ctataatggggaa

SEQ ID NO: 5882245 - DNA, 21 bp, Homo sapiens
ctataatgtcagcttatccta

SEQ ID NO: 5882246 - DNA, 17 bp, Homo sapiens
ctataatgtgaaatgta

SEQ ID NO: 5882247 - DNA, 21 bp, Homo sapiens
ctataatgtgaaatgtaactg

SEQ ID NO: 5882248 - DNA, 18 bp, Homo sapiens
ctataattctatactgtt

SEQ ID NO: 5882249 - DNA, 13 bp, Homo sapiens
ctataattgagaa

SEQ ID NO: 5882250 - DNA, 16 bp, Homo sapiens
ctataattgccactga

SEQ ID NO: 5882251 - DNA, 22 bp, Homo sapiens
ctataattgtaaatattttgat

SEQ ID NO: 5882252 - DNA, 22 bp, Homo sapiens
ctataatttacctaagattaca

SEQ ID NO: 5882253 - DNA, 14 bp, Homo sapiens
ctataattttacaa

SEQ ID NO: 5882254 - DNA, 17 bp, Homo sapiens
ctataattttacaaagt

SEQ ID NO: 5882255 - DNA, 14 bp, Homo sapiens
ctataattttgata

SEQ ID NO: 5882256 - DNA, 19 bp, Homo sapiens
ctataattttgcctttaac

SEQ ID NO: 5882257 - DNA, 13 bp, Homo sapiens
ctatacaaatata

SEQ ID NO: 5882258 - DNA, 14 bp, Homo sapiens
ctatacaaatataa

SEQ ID NO: 5882259 - DNA, 12 bp, Homo sapiens
ctatacaacaat

SEQ ID NO: 5882260 - DNA, 17 bp, Homo sapiens
ctatacaacctaactta

SEQ ID NO: 5882261 - DNA, 15 bp, Homo sapiens
ctatacaactggaca

SEQ ID NO: 5882262 - DNA, 15 bp, Homo sapiens
ctatacaatgtatgt

SEQ ID NO: 5882263 - DNA, 17 bp, Homo sapiens
ctatacaatgtatgtaa

SEQ ID NO: 5882264 - DNA, 22 bp, Homo sapiens
ctatacaatgtatgtaatttgt

SEQ ID NO: 5882265 - DNA, 13 bp, Homo sapiens
ctatacacacaca

SEQ ID NO: 5882266 - DNA, 19 bp, Homo sapiens
ctatacactagacaaaact

SEQ ID NO: 5882267 - DNA, 22 bp, Homo sapiens
ctatacagaacagagggccaga

SEQ ID NO: 5882268 - DNA, 12 bp, Homo sapiens
ctatacagccat

SEQ ID NO: 5882269 - DNA, 20 bp, Homo sapiens
ctatacaggacttagaagta

SEQ ID NO: 5882270 - DNA, 17 bp, Homo sapiens
ctatacaggctgggaag

SEQ ID NO: 5882271 - DNA, 12 bp, Homo sapiens
ctatacatgttg

SEQ ID NO: 5882272 - DNA, 21 bp, Homo sapiens
ctatacatgttggaaatgtgt

SEQ ID NO: 5882273 - DNA, 15 bp, Homo sapiens
ctatacattcctgag

SEQ ID NO: 5882274 - DNA, 22 bp, Homo sapiens
ctatacattcctgagattctgg

SEQ ID NO: 5882275 - DNA, 17 bp, Homo sapiens
ctataccaactgggcct

SEQ ID NO: 5882276 - DNA, 16 bp, Homo sapiens
ctataccaataaagtg

SEQ ID NO: 5882277 - DNA, 22 bp, Homo sapiens
ctataccatatgtctgcttctg

SEQ ID NO: 5882278 - DNA, 16 bp, Homo sapiens
ctatacccagcagagg

SEQ ID NO: 5882279 - DNA, 19 bp, Homo sapiens
ctatacccagcagagggat

SEQ ID NO: 5882280 - DNA, 13 bp, Homo sapiens
ctatacccattct

SEQ ID NO: 5882281 - DNA, 22 bp, Homo sapiens
ctataccctaggtctccacccc

SEQ ID NO: 5882282 - DNA, 17 bp, Homo sapiens
ctatacctgcacgttca

SEQ ID NO: 5882283 - DNA, 13 bp, Homo sapiens
ctatacctgcctt

SEQ ID NO: 5882284 - DNA, 14 bp, Homo sapiens
ctatactaccctgg

SEQ ID NO: 5882285 - DNA, 18 bp, Homo sapiens
ctatactaccctgggctc

SEQ ID NO: 5882286 - DNA, 15 bp, Homo sapiens
ctatactgaaagatc

SEQ ID NO: 5882287 - DNA, 12 bp, Homo sapiens
ctatactgcttg

SEQ ID NO: 5882288 - DNA, 16 bp, Homo sapiens
ctatactggttatagt

SEQ ID NO: 5882289 - DNA, 16 bp, Homo sapiens
ctatactgtggcctgc

SEQ ID NO: 5882290 - DNA, 22 bp, Homo sapiens
ctatactgtggcctgcaggagg

SEQ ID NO: 5882291 - DNA, 16 bp, Homo sapiens
ctatactgtttgtaat

SEQ ID NO: 5882292 - DNA, 18 bp, Homo sapiens
ctatacttatcacatttt

SEQ ID NO: 5882293 - DNA, 15 bp, Homo sapiens
ctatacttctccttt

SEQ ID NO: 5882294 - DNA, 15 bp, Homo sapiens
ctatacttgaacaaa

SEQ ID NO: 5882295 - DNA, 20 bp, Homo sapiens
ctatacttgaacaaaagggt

SEQ ID NO: 5882296 - DNA, 13 bp, Homo sapiens
ctatactttgttc

SEQ ID NO: 5882297 - DNA, 19 bp, Homo sapiens
ctatagaaaaagtaaaaga

SEQ ID NO: 5882298 - DNA, 16 bp, Homo sapiens
ctatagaaagtgttct

SEQ ID NO: 5882299 - DNA, 17 bp, Homo sapiens
ctatagaaagtgttctg

SEQ ID NO: 5882300 - DNA, 19 bp, Homo sapiens
ctatagaaagtgttctgtt

SEQ ID NO: 5882301 - DNA, 22 bp, Homo sapiens
ctatagaaagtgttctgttaca

SEQ ID NO: 5882302 - DNA, 20 bp, Homo sapiens
ctatagaaatattgtgctta

SEQ ID NO: 5882303 - DNA, 18 bp, Homo sapiens
ctatagaccaaaaggaga

SEQ ID NO: 5882304 - DNA, 20 bp, Homo sapiens
ctatagactggaaaaaatga

SEQ ID NO: 5882305 - DNA, 12 bp, Homo sapiens
ctatagagaaaa

SEQ ID NO: 5882306 - DNA, 14 bp, Homo sapiens
ctatagagaggggg

SEQ ID NO: 5882307 - DNA, 16 bp, Homo sapiens
ctatagatgtcttttc

SEQ ID NO: 5882308 - DNA, 14 bp, Homo sapiens
ctatagattcttta

SEQ ID NO: 5882309 - DNA, 15 bp, Homo sapiens
ctatagcatcactta

SEQ ID NO: 5882310 - DNA, 14 bp, Homo sapiens
ctatagcatttaaa

SEQ ID NO: 5882311 - DNA, 15 bp, Homo sapiens
ctatagcattttgct

SEQ ID NO: 5882312 - DNA, 14 bp, Homo sapiens
ctatagccatttgc

SEQ ID NO: 5882313 - DNA, 19 bp, Homo sapiens
ctatagcctaggtgacaga

SEQ ID NO: 5882314 - DNA, 20 bp, Homo sapiens
ctatagcctaggtgacagag

SEQ ID NO: 5882315 - DNA, 19 bp, Homo sapiens
ctatagcctggactttcct

SEQ ID NO: 5882316 - DNA, 18 bp, Homo sapiens
ctatagcctggggtgggg

SEQ ID NO: 5882317 - DNA, 21 bp, Homo sapiens
ctatagcctggggtggggtca

SEQ ID NO: 5882318 - DNA, 14 bp, Homo sapiens
ctatagctcaggac

SEQ ID NO: 5882319 - DNA, 18 bp, Homo sapiens
ctatagctcttctattta

SEQ ID NO: 5882320 - DNA, 20 bp, Homo sapiens
ctatagctcttctatttaaa

SEQ ID NO: 5882321 - DNA, 21 bp, Homo sapiens
ctatagctcttctatttaaaa

SEQ ID NO: 5882322 - DNA, 22 bp, Homo sapiens
ctatagctcttctatttaaaaa

SEQ ID NO: 5882323 - DNA, 12 bp, Homo sapiens
ctataggaaagt

SEQ ID NO: 5882324 - DNA, 14 bp, Homo sapiens
ctataggaaagtct

SEQ ID NO: 5882325 - DNA, 20 bp, Homo sapiens
ctataggacttaatttagca

SEQ ID NO: 5882326 - DNA, 15 bp, Homo sapiens
ctataggctggagaa

SEQ ID NO: 5882327 - DNA, 17 bp, Homo sapiens
ctatagggatgaacttt

SEQ ID NO: 5882328 - DNA, 19 bp, Homo sapiens
ctataggtgacttttgcaa

SEQ ID NO: 5882329 - DNA, 21 bp, Homo sapiens
ctataggtgctacaaaaacac

SEQ ID NO: 5882330 - DNA, 13 bp, Homo sapiens
ctatagtaaatgt

SEQ ID NO: 5882331 - DNA, 14 bp, Homo sapiens
ctatagtactttat

SEQ ID NO: 5882332 - DNA, 23 bp, Homo sapiens
ctatagtagtcaattagtacagt

SEQ ID NO: 5882333 - DNA, 12 bp, Homo sapiens
ctatagtatttg

SEQ ID NO: 5882334 - DNA, 18 bp, Homo sapiens
ctatagtatttgattcaa

SEQ ID NO: 5882335 - DNA, 23 bp, Homo sapiens
ctatagtatttgattcaaaatat

SEQ ID NO: 5882336 - DNA, 14 bp, Homo sapiens
ctatagtcccagct

SEQ ID NO: 5882337 - DNA, 15 bp, Homo sapiens
ctatagtcccagcta

SEQ ID NO: 5882338 - DNA, 14 bp, Homo sapiens
ctatagtgaagaat

SEQ ID NO: 5882339 - DNA, 18 bp, Homo sapiens
ctatagtgacatgcagtt

SEQ ID NO: 5882340 - DNA, 21 bp, Homo sapiens
ctatagtggccacactctgcc

SEQ ID NO: 5882341 - DNA, 13 bp, Homo sapiens
ctatagttactgt

SEQ ID NO: 5882342 - DNA, 16 bp, Homo sapiens
ctatagttactgtcct

SEQ ID NO: 5882343 - DNA, 21 bp, Homo sapiens
ctatagttatacatcttcatt

SEQ ID NO: 5882344 - DNA, 22 bp, Homo sapiens
ctatagttatatagataaagag

SEQ ID NO: 5882345 - DNA, 16 bp, Homo sapiens
ctatagttgcagccca

SEQ ID NO: 5882346 - DNA, 18 bp, Homo sapiens
ctatagttgcagcccaag

SEQ ID NO: 5882347 - DNA, 19 bp, Homo sapiens
ctatagttgcagcccaagg

SEQ ID NO: 5882348 - DNA, 20 bp, Homo sapiens
ctatagtttcaccactcctc

SEQ ID NO: 5882349 - DNA, 11 bp, Homo sapiens
ctatagttttt

SEQ ID NO: 5882350 - DNA, 14 bp, Homo sapiens
ctatagtttttcta

SEQ ID NO: 5882351 - DNA, 19 bp, Homo sapiens
ctatataaaaaatatatgt

SEQ ID NO: 5882352 - DNA, 20 bp, Homo sapiens
ctatataaaaaatatatgta

SEQ ID NO: 5882353 - DNA, 17 bp, Homo sapiens
ctatataaaatgtattc

SEQ ID NO: 5882354 - DNA, 16 bp, Homo sapiens
ctatataaataaagca

SEQ ID NO: 5882355 - DNA, 13 bp, Homo sapiens
ctatataaataag

SEQ ID NO: 5882356 - DNA, 11 bp, Homo sapiens
ctatataaatg

SEQ ID NO: 5882357 - DNA, 19 bp, Homo sapiens
ctatataagacaagaactc

SEQ ID NO: 5882358 - DNA, 13 bp, Homo sapiens
ctatataagacat

SEQ ID NO: 5882359 - DNA, 17 bp, Homo sapiens
ctatataaggaggaaaa

SEQ ID NO: 5882360 - DNA, 14 bp, Homo sapiens
ctatataatttatt

SEQ ID NO: 5882361 - DNA, 16 bp, Homo sapiens
ctatataatttttcct

SEQ ID NO: 5882362 - DNA, 22 bp, Homo sapiens
ctatatacagatgcaagcaagg

SEQ ID NO: 5882363 - DNA, 22 bp, Homo sapiens
ctatatacatcacgttaaagta

SEQ ID NO: 5882364 - DNA, 11 bp, Homo sapiens
ctatatacctc

SEQ ID NO: 5882365 - DNA, 17 bp, Homo sapiens
ctatatagaatgctgca

SEQ ID NO: 5882366 - DNA, 14 bp, Homo sapiens
ctatatagacttgg

SEQ ID NO: 5882367 - DNA, 15 bp, Homo sapiens
ctatgaccctgtgcc

SEQ ID NO: 5882368 - DNA, 16 bp, Homo sapiens
ctatgaccctgtgcct

SEQ ID NO: 5882369 - DNA, 18 bp, Homo sapiens
ctatgaccctgtgcctgt

SEQ ID NO: 5882370 - DNA, 21 bp, Homo sapiens
ctatgacctcgccctccacaa

SEQ ID NO: 5882371 - DNA, 15 bp, Homo sapiens
ctatgactgctcccc

SEQ ID NO: 5882372 - DNA, 23 bp, Homo sapiens
ctatgacttgggcacccccagcc

SEQ ID NO: 5882373 - DNA, 16 bp, Homo sapiens
ctatgacttttttaaa

SEQ ID NO: 5882374 - DNA, 11 bp, Homo sapiens
ctatgagaaaa

SEQ ID NO: 5882375 - DNA, 16 bp, Homo sapiens
ctatgagaaaagaggc

SEQ ID NO: 5882376 - DNA, 16 bp, Homo sapiens
ctatgagagatgtgtc

SEQ ID NO: 5882377 - DNA, 18 bp, Homo sapiens
ctatgagcatcctgagcc

SEQ ID NO: 5882378 - DNA, 21 bp, Homo sapiens
ctatgagcatcctgagccccg

SEQ ID NO: 5882379 - DNA, 23 bp, Homo sapiens
ctatgaggaataattatttattt

SEQ ID NO: 5882380 - DNA, 17 bp, Homo sapiens
ctatgagggtgtttcct

SEQ ID NO: 5882381 - DNA, 20 bp, Homo sapiens
ctatgagggtgtttcctcta

SEQ ID NO: 5882382 - DNA, 22 bp, Homo sapiens
ctatgagggtgtttcctctaaa

SEQ ID NO: 5882383 - DNA, 15 bp, Homo sapiens
ctatgagtggaaaaa

SEQ ID NO: 5882384 - DNA, 21 bp, Homo sapiens
ctatgagttcacatgtgccct

SEQ ID NO: 5882385 - DNA, 21 bp, Homo sapiens
ctatgagttgaaatgttctgt

SEQ ID NO: 5882386 - DNA, 18 bp, Homo sapiens
ctatgataaagttgtaaa

SEQ ID NO: 5882387 - DNA, 19 bp, Homo sapiens
ctatgataaagttgtaaat

SEQ ID NO: 5882388 - DNA, 14 bp, Homo sapiens
ctatgataaataac

SEQ ID NO: 5882389 - DNA, 17 bp, Homo sapiens
ctatgataaattatgat

SEQ ID NO: 5882390 - DNA, 13 bp, Homo sapiens
ctatgataagatt

SEQ ID NO: 5882391 - DNA, 17 bp, Homo sapiens
ctatgataagattgaaa

SEQ ID NO: 5882392 - DNA, 18 bp, Homo sapiens
ctatgataattatttaca

SEQ ID NO: 5882393 - DNA, 20 bp, Homo sapiens
ctatgatagataataaacaa

SEQ ID NO: 5882394 - DNA, 20 bp, Homo sapiens
ctatgatatggtaaaagtta

SEQ ID NO: 5882395 - DNA, 23 bp, Homo sapiens
ctatgatattttctgtgcctgaa

SEQ ID NO: 5882396 - DNA, 21 bp, Homo sapiens
ctatgatcagaagaacatgat

SEQ ID NO: 5882397 - DNA, 21 bp, Homo sapiens
ctatgatcccagcactttggg

SEQ ID NO: 5882398 - DNA, 19 bp, Homo sapiens
ctatgatccttttttgtca

SEQ ID NO: 5882399 - DNA, 16 bp, Homo sapiens
ctatgatctcaggagc

SEQ ID NO: 5882400 - DNA, 14 bp, Homo sapiens
ctatgatctcaggt

SEQ ID NO: 5882401 - DNA, 24 bp, Homo sapiens
ctatgatctcatcccaataaaatg

SEQ ID NO: 5882402 - DNA, 20 bp, Homo sapiens
ctatgatgttagttttcctt

SEQ ID NO: 5882403 - DNA, 14 bp, Homo sapiens
ctatgatgtttctt

SEQ ID NO: 5882404 - DNA, 19 bp, Homo sapiens
ctatgattaaactgggaaa

SEQ ID NO: 5882405 - DNA, 22 bp, Homo sapiens
ctatgattaaactgggaaatga

SEQ ID NO: 5882406 - DNA, 22 bp, Homo sapiens
ctatgattccaattactacttt

SEQ ID NO: 5882407 - DNA, 20 bp, Homo sapiens
ctatgatttaatttgaaata

SEQ ID NO: 5882408 - DNA, 19 bp, Homo sapiens
ctatgatttggaaaataaa

SEQ ID NO: 5882409 - DNA, 17 bp, Homo sapiens
ctatgatttgtagctct

SEQ ID NO: 5882410 - DNA, 18 bp, Homo sapiens
ctatgatttttttttcca

SEQ ID NO: 5882411 - DNA, 20 bp, Homo sapiens
ctatgatttttttttccaaa

SEQ ID NO: 5882412 - DNA, 20 bp, Homo sapiens
ctatgcaaaatagacatctt

SEQ ID NO: 5882413 - DNA, 21 bp, Homo sapiens
ctatgcaaaatagacatcttt

SEQ ID NO: 5882414 - DNA, 17 bp, Homo sapiens
ctatgcaaaatgtctgt

SEQ ID NO: 5882415 - DNA, 16 bp, Homo sapiens
ctatgcaaatcagtct

SEQ ID NO: 5882416 - DNA, 22 bp, Homo sapiens
ctatgcaatatatctaaattga

SEQ ID NO: 5882417 - DNA, 17 bp, Homo sapiens
ctatgcaattgtacaaa

SEQ ID NO: 5882418 - DNA, 21 bp, Homo sapiens
ctatgcaatttttaaactagt

SEQ ID NO: 5882419 - DNA, 13 bp, Homo sapiens
ctatgcacaccaa

SEQ ID NO: 5882420 - DNA, 16 bp, Homo sapiens
ctatgcacaccaaatt

SEQ ID NO: 5882421 - DNA, 16 bp, Homo sapiens
ctatgcacagagccca

SEQ ID NO: 5882422 - DNA, 22 bp, Homo sapiens
ctatgcacagagcccaatgcat

SEQ ID NO: 5882423 - DNA, 21 bp, Homo sapiens
ctatgcactgaagagctcttg

SEQ ID NO: 5882424 - DNA, 22 bp, Homo sapiens
ctatgcactgaagagctcttgg

SEQ ID NO: 5882425 - DNA, 23 bp, Homo sapiens
ctatgcactgaagagctcttggc

SEQ ID NO: 5882426 - DNA, 20 bp, Homo sapiens
ctatgcagacatctctggag

SEQ ID NO: 5882427 - DNA, 17 bp, Homo sapiens
ctatgcagaggcctggg

SEQ ID NO: 5882428 - DNA, 12 bp, Homo sapiens
ctatgcagcctg

SEQ ID NO: 5882429 - DNA, 14 bp, Homo sapiens
ctatgcagcctgct

SEQ ID NO: 5882430 - DNA, 15 bp, Homo sapiens
ctatgcagcctgctc

SEQ ID NO: 5882431 - DNA, 16 bp, Homo sapiens
ctatgcagggaggcca

SEQ ID NO: 5882432 - DNA, 24 bp, Homo sapiens
ctatgcagtattgccacaatgcct

SEQ ID NO: 5882433 - DNA, 20 bp, Homo sapiens
ctatgcataaaaaaatgatg

SEQ ID NO: 5882434 - DNA, 16 bp, Homo sapiens
ctatgcatatttatag

SEQ ID NO: 5882435 - DNA, 21 bp, Homo sapiens
ctatgcatctgagaaaggtct

SEQ ID NO: 5882436 - DNA, 22 bp, Homo sapiens
ctatgcatggtgccccaggacc

SEQ ID NO: 5882437 - DNA, 21 bp, Homo sapiens
ctatgcatggtttcagcacta

SEQ ID NO: 5882438 - DNA, 23 bp, Homo sapiens
ctatgcatggtttcagcactagc

SEQ ID NO: 5882439 - DNA, 12 bp, Homo sapiens
ctatgcatttga

SEQ ID NO: 5882440 - DNA, 16 bp, Homo sapiens
ctatgcattttcttca

SEQ ID NO: 5882441 - DNA, 19 bp, Homo sapiens
ctatgcattttcttcacag

SEQ ID NO: 5882442 - DNA, 15 bp, Homo sapiens
ctatgccaaagatca

SEQ ID NO: 5882443 - DNA, 15 bp, Homo sapiens
ctatgccactaagcc

SEQ ID NO: 5882444 - DNA, 21 bp, Homo sapiens
ctatgccactaggccctggtc

SEQ ID NO: 5882445 - DNA, 19 bp, Homo sapiens
ctatgccagctcagtccca

SEQ ID NO: 5882446 - DNA, 20 bp, Homo sapiens
ctatgccagctcagtcccat

SEQ ID NO: 5882447 - DNA, 14 bp, Homo sapiens
ctatgccaggctgt

SEQ ID NO: 5882448 - DNA, 18 bp, Homo sapiens
ctatgccaggctgtgcta

SEQ ID NO: 5882449 - DNA, 19 bp, Homo sapiens
ctatgccatttttagttta

SEQ ID NO: 5882450 - DNA, 13 bp, Homo sapiens
ctatgcccacata

SEQ ID NO: 5882451 - DNA, 19 bp, Homo sapiens
ctatgcccagggaataaga

SEQ ID NO: 5882452 - DNA, 23 bp, Homo sapiens
ctatgcccctagtaactgctgtc

SEQ ID NO: 5882453 - DNA, 13 bp, Homo sapiens
ctatgccctgcag

SEQ ID NO: 5882454 - DNA, 14 bp, Homo sapiens
ctatgccctgcaga

SEQ ID NO: 5882455 - DNA, 19 bp, Homo sapiens
ctatgccctgcccttcctc

SEQ ID NO: 5882456 - DNA, 13 bp, Homo sapiens
ctatgcctgcact

SEQ ID NO: 5882457 - DNA, 14 bp, Homo sapiens
ctatgcctgcactg

SEQ ID NO: 5882458 - DNA, 16 bp, Homo sapiens
ctatgcctgtatttcc

SEQ ID NO: 5882459 - DNA, 12 bp, Homo sapiens
ctatgccttgca

SEQ ID NO: 5882460 - DNA, 23 bp, Homo sapiens
ctatgcgcaaaactgcctgaaag

SEQ ID NO: 5882461 - DNA, 19 bp, Homo sapiens
ctatgcggaggaaagcaag

SEQ ID NO: 5882462 - DNA, 13 bp, Homo sapiens
ctatgcgttttta

SEQ ID NO: 5882463 - DNA, 22 bp, Homo sapiens
ctatgctaatttttggagaaat

SEQ ID NO: 5882464 - DNA, 17 bp, Homo sapiens
ctatgctattgacaata

SEQ ID NO: 5882465 - DNA, 21 bp, Homo sapiens
ctatgctattgacaataaaat

SEQ ID NO: 5882466 - DNA, 13 bp, Homo sapiens
ctatgctatttct

SEQ ID NO: 5882467 - DNA, 17 bp, Homo sapiens
ctatgctatttctggcc

SEQ ID NO: 5882468 - DNA, 19 bp, Homo sapiens
ctatgctctggaaaacctg

SEQ ID NO: 5882469 - DNA, 18 bp, Homo sapiens
ctatgctgagtttgtgct

SEQ ID NO: 5882470 - DNA, 19 bp, Homo sapiens
ctatgctgcctaggctgac

SEQ ID NO: 5882471 - DNA, 14 bp, Homo sapiens
ctatgctgcttcca

SEQ ID NO: 5882472 - DNA, 23 bp, Homo sapiens
ctatgctggagtattttctaata

SEQ ID NO: 5882473 - DNA, 18 bp, Homo sapiens
ctatgctggggtacacag

SEQ ID NO: 5882474 - DNA, 20 bp, Homo sapiens
ctatgctggtagatgctgag

SEQ ID NO: 5882475 - DNA, 15 bp, Homo sapiens
ctatgctgtatctgt

SEQ ID NO: 5882476 - DNA, 17 bp, Homo sapiens
ctatgctgtgtgcagag

SEQ ID NO: 5882477 - DNA, 20 bp, Homo sapiens
ctatgcttaataaaagaaca

SEQ ID NO: 5882478 - DNA, 12 bp, Homo sapiens
ctatgcttcctc

SEQ ID NO: 5882479 - DNA, 17 bp, Homo sapiens
ctatgcttcctcgtgcc

SEQ ID NO: 5882480 - DNA, 13 bp, Homo sapiens
ctatgctttagaa

SEQ ID NO: 5882481 - DNA, 17 bp, Homo sapiens
ctatgctttgaaacaga

SEQ ID NO: 5882482 - DNA, 16 bp, Homo sapiens
ctatggaaaatcagct

SEQ ID NO: 5882483 - DNA, 14 bp, Homo sapiens
ctatggaaacattt

SEQ ID NO: 5882484 - DNA, 20 bp, Homo sapiens
ctatggaaagggtgtggctt

SEQ ID NO: 5882485 - DNA, 12 bp, Homo sapiens
ctatggaaatgt

SEQ ID NO: 5882486 - DNA, 21 bp, Homo sapiens
ctatggaaatgtgagaaatgt

SEQ ID NO: 5882487 - DNA, 22 bp, Homo sapiens
ctatggaacataaagttgtatt

SEQ ID NO: 5882488 - DNA, 13 bp, Homo sapiens
ctatggaagccac

SEQ ID NO: 5882489 - DNA, 14 bp, Homo sapiens
ctatggaagccaca

SEQ ID NO: 5882490 - DNA, 15 bp, Homo sapiens
ctatggaatagatta

SEQ ID NO: 5882491 - DNA, 22 bp, Homo sapiens
ctatggaatttataattcagta

SEQ ID NO: 5882492 - DNA, 17 bp, Homo sapiens
ctatggacaacttattt

SEQ ID NO: 5882493 - DNA, 16 bp, Homo sapiens
ctatggacaatttacc

SEQ ID NO: 5882494 - DNA, 15 bp, Homo sapiens
ctatggacacagggt

SEQ ID NO: 5882495 - DNA, 13 bp, Homo sapiens
ctatggacatttt

SEQ ID NO: 5882496 - DNA, 22 bp, Homo sapiens
ctatggacggtgctccaggcag

SEQ ID NO: 5882497 - DNA, 23 bp, Homo sapiens
ctatggacggtgctccaggcagg

SEQ ID NO: 5882498 - DNA, 13 bp, Homo sapiens
ctatggactgcac

SEQ ID NO: 5882499 - DNA, 17 bp, Homo sapiens
ctatggactgcacaaaa

SEQ ID NO: 5882500 - DNA, 19 bp, Homo sapiens
ctatggagactttgctgtt

SEQ ID NO: 5882501 - DNA, 18 bp, Homo sapiens
ctatggagagaattaaaa

SEQ ID NO: 5882502 - DNA, 21 bp, Homo sapiens
ctatggagagccctgggaccg

SEQ ID NO: 5882503 - DNA, 18 bp, Homo sapiens
ctatggagaggcttccct

SEQ ID NO: 5882504 - DNA, 19 bp, Homo sapiens
ctatggagcctctgcagac

SEQ ID NO: 5882505 - DNA, 17 bp, Homo sapiens
ctatggagtcttgtgaa

SEQ ID NO: 5882506 - DNA, 19 bp, Homo sapiens
ctatggagtgcaccaaaga

SEQ ID NO: 5882507 - DNA, 14 bp, Homo sapiens
ctatggatggcttc

SEQ ID NO: 5882508 - DNA, 20 bp, Homo sapiens
ctatggattttctaaggaag

SEQ ID NO: 5882509 - DNA, 19 bp, Homo sapiens
ctatggcagtccagccagc

SEQ ID NO: 5882510 - DNA, 22 bp, Homo sapiens
ctatggcagtccagccagctcc

SEQ ID NO: 5882511 - DNA, 14 bp, Homo sapiens
ctatggccagtctg

SEQ ID NO: 5882512 - DNA, 20 bp, Homo sapiens
ctatggcccatctgtatgct

SEQ ID NO: 5882513 - DNA, 14 bp, Homo sapiens
ctatggcctgtgcg

SEQ ID NO: 5882514 - DNA, 14 bp, Homo sapiens
ctatggctcatgtc

SEQ ID NO: 5882515 - DNA, 18 bp, Homo sapiens
ctatggctccaacagaaa

SEQ ID NO: 5882516 - DNA, 17 bp, Homo sapiens
ctatggctgcctgcatc

SEQ ID NO: 5882517 - DNA, 19 bp, Homo sapiens
ctatggctgcctgcatcta

SEQ ID NO: 5882518 - DNA, 17 bp, Homo sapiens
ctatggctggccactgc

SEQ ID NO: 5882519 - DNA, 20 bp, Homo sapiens
ctatggctggctgggcaagg

SEQ ID NO: 5882520 - DNA, 16 bp, Homo sapiens
ctatggctgtattttt

SEQ ID NO: 5882521 - DNA, 22 bp, Homo sapiens
ctatggctttaaataaattaag

SEQ ID NO: 5882522 - DNA, 16 bp, Homo sapiens
ctatgggaagctctgt

SEQ ID NO: 5882523 - DNA, 20 bp, Homo sapiens
ctatgggaagctctgtgtgt

SEQ ID NO: 5882524 - DNA, 18 bp, Homo sapiens
ctatgggaatttggcttc

SEQ ID NO: 5882525 - DNA, 21 bp, Homo sapiens
ctatgggagagtgtcaaccag

SEQ ID NO: 5882526 - DNA, 14 bp, Homo sapiens
ctatgggagcccca

SEQ ID NO: 5882527 - DNA, 17 bp, Homo sapiens
ctatgggagccccaggg

SEQ ID NO: 5882528 - DNA, 23 bp, Homo sapiens
ctatgggcctgccgggctgaggg

SEQ ID NO: 5882529 - DNA, 15 bp, Homo sapiens
ctatggggaggccct

SEQ ID NO: 5882530 - DNA, 19 bp, Homo sapiens
ctatggggattcaggggct

SEQ ID NO: 5882531 - DNA, 16 bp, Homo sapiens
ctatggggtggggtgg

SEQ ID NO: 5882532 - DNA, 23 bp, Homo sapiens
ctatgggtatcaaacagctcagg

SEQ ID NO: 5882533 - DNA, 19 bp, Homo sapiens
ctatgggtctaggacacag

SEQ ID NO: 5882534 - DNA, 20 bp, Homo sapiens
ctatgggtgttatcacctag

SEQ ID NO: 5882535 - DNA, 20 bp, Homo sapiens
ctatgggttatttttattaa

SEQ ID NO: 5882536 - DNA, 13 bp, Homo sapiens
ctatggtaaagat

SEQ ID NO: 5882537 - DNA, 18 bp, Homo sapiens
ctatggtatgctggccag

SEQ ID NO: 5882538 - DNA, 20 bp, Homo sapiens
ctatggtatgctggccagca

SEQ ID NO: 5882539 - DNA, 22 bp, Homo sapiens
ctatggtatgctggccagcacc

SEQ ID NO: 5882540 - DNA, 22 bp, Homo sapiens
ctatggtcacagacttctggcc

SEQ ID NO: 5882541 - DNA, 11 bp, Homo sapiens
ctatggtctta

SEQ ID NO: 5882542 - DNA, 21 bp, Homo sapiens
ctatggtgagatgcagctgga

SEQ ID NO: 5882543 - DNA, 16 bp, Homo sapiens
ctatttctcctccatg

SEQ ID NO: 5882544 - DNA, 12 bp, Homo sapiens
ctatttctctat

SEQ ID NO: 5882545 - DNA, 16 bp, Homo sapiens
ctatttctctggatct

SEQ ID NO: 5882546 - DNA, 21 bp, Homo sapiens
ctatttctctgtgtatttata

SEQ ID NO: 5882547 - DNA, 12 bp, Homo sapiens
ctatttctcttt

SEQ ID NO: 5882548 - DNA, 13 bp, Homo sapiens
ctatttctgaaag

SEQ ID NO: 5882549 - DNA, 23 bp, Homo sapiens
ctatttctgaaagaataggatta

SEQ ID NO: 5882550 - DNA, 23 bp, Homo sapiens
ctatttctgagaaggtccttaat

SEQ ID NO: 5882551 - DNA, 14 bp, Homo sapiens
ctatttctggcctc

SEQ ID NO: 5882552 - DNA, 16 bp, Homo sapiens
ctatttctggcctcag

SEQ ID NO: 5882553 - DNA, 21 bp, Homo sapiens
ctatttctgggtcttttgcta

SEQ ID NO: 5882554 - DNA, 21 bp, Homo sapiens
ctatttcttgaagaataaatt

SEQ ID NO: 5882555 - DNA, 16 bp, Homo sapiens
ctatttctttcatcag

SEQ ID NO: 5882556 - DNA, 17 bp, Homo sapiens
ctatttgaaaaaagaag

SEQ ID NO: 5882557 - DNA, 13 bp, Homo sapiens
ctatttgaaatac

SEQ ID NO: 5882558 - DNA, 14 bp, Homo sapiens
ctatttgaaatact

SEQ ID NO: 5882559 - DNA, 10 bp, Homo sapiens
ctatttgaag

SEQ ID NO: 5882560 - DNA, 20 bp, Homo sapiens
ctatttgaagaaaaaaatgt

SEQ ID NO: 5882561 - DNA, 22 bp, Homo sapiens
ctatttgaagcatgctctgtaa

SEQ ID NO: 5882562 - DNA, 17 bp, Homo sapiens
ctatttgagaagttctc

SEQ ID NO: 5882563 - DNA, 16 bp, Homo sapiens
ctatttgagactcctc

SEQ ID NO: 5882564 - DNA, 20 bp, Homo sapiens
ctatttgagagcagatgcca

SEQ ID NO: 5882565 - DNA, 18 bp, Homo sapiens
ctatttgagttggccaag

SEQ ID NO: 5882566 - DNA, 18 bp, Homo sapiens
ctatttgcaattcctgct

SEQ ID NO: 5882567 - DNA, 21 bp, Homo sapiens
ctatttgcaccttaaaagaca

SEQ ID NO: 5882568 - DNA, 19 bp, Homo sapiens
ctatttgccaatgtatatt

SEQ ID NO: 5882569 - DNA, 23 bp, Homo sapiens
ctatttgccaatgtatattgcaa

SEQ ID NO: 5882570 - DNA, 16 bp, Homo sapiens
ctatttggaatttata

SEQ ID NO: 5882571 - DNA, 13 bp, Homo sapiens
ctatttggtgcta

SEQ ID NO: 5882572 - DNA, 14 bp, Homo sapiens
ctatttgtaaatct

SEQ ID NO: 5882573 - DNA, 18 bp, Homo sapiens
ctatttgtaaatctgcca

SEQ ID NO: 5882574 - DNA, 19 bp, Homo sapiens
ctatttgtaaatctgccac

SEQ ID NO: 5882575 - DNA, 15 bp, Homo sapiens
ctatttgtacaaata

SEQ ID NO: 5882576 - DNA, 19 bp, Homo sapiens
ctatttgtacaaataaacc

SEQ ID NO: 5882577 - DNA, 21 bp, Homo sapiens
ctatttgtagattaggattaa

SEQ ID NO: 5882578 - DNA, 18 bp, Homo sapiens
ctatttgtataaaaatta

SEQ ID NO: 5882579 - DNA, 22 bp, Homo sapiens
ctatttgtatatatacataaca

SEQ ID NO: 5882580 - DNA, 23 bp, Homo sapiens
ctatttgtatttctcttgtcctt

SEQ ID NO: 5882581 - DNA, 21 bp, Homo sapiens
ctatttgtcttctccttcaaa

SEQ ID NO: 5882582 - DNA, 15 bp, Homo sapiens
ctatttgttcagaga

SEQ ID NO: 5882583 - DNA, 20 bp, Homo sapiens
ctatttgttcagagaggcct

SEQ ID NO: 5882584 - DNA, 22 bp, Homo sapiens
ctatttgttcttcaagaacttt

SEQ ID NO: 5882585 - DNA, 22 bp, Homo sapiens
ctatttgttgatgcttgtgtca

SEQ ID NO: 5882586 - DNA, 23 bp, Homo sapiens
ctatttgttgtttttaacaacta

SEQ ID NO: 5882587 - DNA, 12 bp, Homo sapiens
ctatttgtttca

SEQ ID NO: 5882588 - DNA, 23 bp, Homo sapiens
ctatttgttttcttctgtatgtt

SEQ ID NO: 5882589 - DNA, 13 bp, Homo sapiens
ctattttaaaacc

SEQ ID NO: 5882590 - DNA, 14 bp, Homo sapiens
ctattttaaaacca

SEQ ID NO: 5882591 - DNA, 20 bp, Homo sapiens
ctattttaaaataaattagt

SEQ ID NO: 5882592 - DNA, 17 bp, Homo sapiens
ctattttaaaattcatg

SEQ ID NO: 5882593 - DNA, 15 bp, Homo sapiens
ctattttaacttgct

SEQ ID NO: 5882594 - DNA, 14 bp, Homo sapiens
ctattttaatcttg

SEQ ID NO: 5882595 - DNA, 21 bp, Homo sapiens
ctattttactgtcttaattaa

SEQ ID NO: 5882596 - DNA, 22 bp, Homo sapiens
ctattttacttttctgccaaaa

SEQ ID NO: 5882597 - DNA, 13 bp, Homo sapiens
ctattttagaaag

SEQ ID NO: 5882598 - DNA, 18 bp, Homo sapiens
ctattttagaaagctaaa

SEQ ID NO: 5882599 - DNA, 21 bp, Homo sapiens
ctattttagaaagctaaatga

SEQ ID NO: 5882600 - DNA, 23 bp, Homo sapiens
ctattttatatgatgggggaaaa

SEQ ID NO: 5882601 - DNA, 16 bp, Homo sapiens
ctattttatttgtatt

SEQ ID NO: 5882602 - DNA, 18 bp, Homo sapiens
ctattttattttattgaa

SEQ ID NO: 5882603 - DNA, 13 bp, Homo sapiens
ctattttcaaaga

SEQ ID NO: 5882604 - DNA, 16 bp, Homo sapiens
ctattttcactagggc

SEQ ID NO: 5882605 - DNA, 17 bp, Homo sapiens
ctattttcactagggct

SEQ ID NO: 5882606 - DNA, 18 bp, Homo sapiens
ctattttcagaatctgaa

SEQ ID NO: 5882607 - DNA, 18 bp, Homo sapiens
ctattttcagatgtgaac

SEQ ID NO: 5882608 - DNA, 12 bp, Homo sapiens
ctattttcataa

SEQ ID NO: 5882609 - DNA, 18 bp, Homo sapiens
ctattttcattgtaaaac

SEQ ID NO: 5882610 - DNA, 21 bp, Homo sapiens
ctattttccaggcttctgctg

SEQ ID NO: 5882611 - DNA, 12 bp, Homo sapiens
ctattttcctct

SEQ ID NO: 5882612 - DNA, 12 bp, Homo sapiens
ctattttctatt

SEQ ID NO: 5882613 - DNA, 16 bp, Homo sapiens
ctattttctgcagaaa

SEQ ID NO: 5882614 - DNA, 21 bp, Homo sapiens
ctattttcttacagtggagtg

SEQ ID NO: 5882615 - DNA, 21 bp, Homo sapiens
ctattttcttgaggaaaatat

SEQ ID NO: 5882616 - DNA, 19 bp, Homo sapiens
ctattttgacagttatttt

SEQ ID NO: 5882617 - DNA, 15 bp, Homo sapiens
ctattttgagcatta

SEQ ID NO: 5882618 - DNA, 17 bp, Homo sapiens
ctattttgagttaattt

SEQ ID NO: 5882619 - DNA, 21 bp, Homo sapiens
ctattttgatgcagcatttga

SEQ ID NO: 5882620 - DNA, 17 bp, Homo sapiens
ctattttgggtattaat

SEQ ID NO: 5882621 - DNA, 22 bp, Homo sapiens
ctattttggtgaccaatactac

SEQ ID NO: 5882622 - DNA, 12 bp, Homo sapiens
ctattttgtaaa

SEQ ID NO: 5882623 - DNA, 16 bp, Homo sapiens
ctattttgtaactgta

SEQ ID NO: 5882624 - DNA, 15 bp, Homo sapiens
ctattttgtaatttt

SEQ ID NO: 5882625 - DNA, 15 bp, Homo sapiens
ctattttgtatattt

SEQ ID NO: 5882626 - DNA, 17 bp, Homo sapiens
ctatttttaaaatcata

SEQ ID NO: 5882627 - DNA, 21 bp, Homo sapiens
ctatttttaaaatcataacat

SEQ ID NO: 5882628 - DNA, 22 bp, Homo sapiens
ctatttttaatttcctgtgagg

SEQ ID NO: 5882629 - DNA, 23 bp, Homo sapiens
ctatttttaatttcctgtgagga

SEQ ID NO: 5882630 - DNA, 12 bp, Homo sapiens
ctatttttactg

SEQ ID NO: 5882631 - DNA, 15 bp, Homo sapiens
ctatttttatcatga

SEQ ID NO: 5882632 - DNA, 17 bp, Homo sapiens
ctatttttatcatgaat

SEQ ID NO: 5882633 - DNA, 17 bp, Homo sapiens
ctatttttatgatgaca

SEQ ID NO: 5882634 - DNA, 19 bp, Homo sapiens
ctatttttatgatgacaat

SEQ ID NO: 5882635 - DNA, 16 bp, Homo sapiens
ctatttttatttatat

SEQ ID NO: 5882636 - DNA, 18 bp, Homo sapiens
ctatttttatttatattt

SEQ ID NO: 5882637 - DNA, 14 bp, Homo sapiens
ctatttttcaaatt

SEQ ID NO: 5882638 - DNA, 15 bp, Homo sapiens
ctatttttcaatcat

SEQ ID NO: 5882639 - DNA, 14 bp, Homo sapiens
ctatttttcagaat

SEQ ID NO: 5882640 - DNA, 11 bp, Homo sapiens
ctatttttcct

SEQ ID NO: 5882641 - DNA, 14 bp, Homo sapiens
ctatttttccttta

SEQ ID NO: 5882642 - DNA, 12 bp, Homo sapiens
ctatttttctaa

SEQ ID NO: 5882643 - DNA, 15 bp, Homo sapiens
ctatttttctaacta

SEQ ID NO: 5882644 - DNA, 14 bp, Homo sapiens
ctatttttctatga

SEQ ID NO: 5882645 - DNA, 14 bp, Homo sapiens
ctatttttctctcc

SEQ ID NO: 5882646 - DNA, 16 bp, Homo sapiens
ctatttttctctcctg

SEQ ID NO: 5882647 - DNA, 15 bp, Homo sapiens
ctatttttcttctaa

SEQ ID NO: 5882648 - DNA, 20 bp, Homo sapiens
ctatttttcttgttgcatct

SEQ ID NO: 5882649 - DNA, 21 bp, Homo sapiens
ctatttttgactgtagccaca

SEQ ID NO: 5882650 - DNA, 17 bp, Homo sapiens
ctatttttgattgtgtt

SEQ ID NO: 5882651 - DNA, 13 bp, Homo sapiens
ctatttttgtaaa

SEQ ID NO: 5882652 - DNA, 12 bp, Homo sapiens
ctatttttgtag

SEQ ID NO: 5882653 - DNA, 15 bp, Homo sapiens
ctatttttgtagatc

SEQ ID NO: 5882654 - DNA, 13 bp, Homo sapiens
ctatttttgtgaa

SEQ ID NO: 5882655 - DNA, 14 bp, Homo sapiens
ctatttttgtgaag

SEQ ID NO: 5882656 - DNA, 15 bp, Homo sapiens
ctatttttgtgaaga

SEQ ID NO: 5882657 - DNA, 20 bp, Homo sapiens
ctatttttgtttttgtcttt

SEQ ID NO: 5882658 - DNA, 21 bp, Homo sapiens
ctatttttgtttttgtctttt

SEQ ID NO: 5882659 - DNA, 22 bp, Homo sapiens
ctatttttgtttttgtcttttt

SEQ ID NO: 5882660 - DNA, 17 bp, Homo sapiens
ctattttttaaaaaaat

SEQ ID NO: 5882661 - DNA, 16 bp, Homo sapiens
ctattttttaaaaatt

SEQ ID NO: 5882662 - DNA, 13 bp, Homo sapiens
ctattttttaata

SEQ ID NO: 5882663 - DNA, 14 bp, Homo sapiens
ctattttttatcat

SEQ ID NO: 5882664 - DNA, 18 bp, Homo sapiens
ctattttttattttactt

SEQ ID NO: 5882665 - DNA, 16 bp, Homo sapiens
ctattttttgacactt

SEQ ID NO: 5882666 - DNA, 20 bp, Homo sapiens
ctattttttgacacttccat

SEQ ID NO: 5882667 - DNA, 23 bp, Homo sapiens
ctattttttgacacttccattgt

SEQ ID NO: 5882668 - DNA, 17 bp, Homo sapiens
ctatttttttaaaatca

SEQ ID NO: 5882669 - DNA, 19 bp, Homo sapiens
ctatttttttaaaatcact

SEQ ID NO: 5882670 - DNA, 23 bp, Homo sapiens
ctatttttttaagctatcagcaa

SEQ ID NO: 5882671 - DNA, 18 bp, Homo sapiens
ctatttttttcaaagact

SEQ ID NO: 5882672 - DNA, 13 bp, Homo sapiens
ctatttttttcct

SEQ ID NO: 5882673 - DNA, 14 bp, Homo sapiens
ctatttttttctct

SEQ ID NO: 5882674 - DNA, 17 bp, Homo sapiens
ctattttttttaaatca

SEQ ID NO: 5882675 - DNA, 18 bp, Homo sapiens
ctattttttttaaatcaa

SEQ ID NO: 5882676 - DNA, 20 bp, Homo sapiens
ctattttttttctgttatat

SEQ ID NO: 5882677 - DNA, 19 bp, Homo sapiens
ctatttttttttcttttta

SEQ ID NO: 5882678 - DNA, 23 bp, Homo sapiens
ctatttttttttctttttaaagt

SEQ ID NO: 5882679 - DNA, 22 bp, Homo sapiens
ctcaaaaaaaaaaaagagagag

SEQ ID NO: 5882680 - DNA, 23 bp, Homo sapiens
ctcaaaaaaaaaaaagagagaga

SEQ ID NO: 5882681 - DNA, 19 bp, Homo sapiens
ctcaaaaaaaaaaagaaaa

SEQ ID NO: 5882682 - DNA, 23 bp, Homo sapiens
ctcaaaaaaaaaatttttttcct

SEQ ID NO: 5882683 - DNA, 22 bp, Homo sapiens
ctcaaaaaaaagaaaatgtctt

SEQ ID NO: 5882684 - DNA, 14 bp, Homo sapiens
ctcaaaaaagagga

SEQ ID NO: 5882685 - DNA, 16 bp, Homo sapiens
ctcaaaaacgccctca

SEQ ID NO: 5882686 - DNA, 17 bp, Homo sapiens
ctcaaaaacgccctcaa

SEQ ID NO: 5882687 - DNA, 23 bp, Homo sapiens
ctcaaaaagcagaaggagagtga

SEQ ID NO: 5882688 - DNA, 20 bp, Homo sapiens
ctcaaaaataagtcatgtgt

SEQ ID NO: 5882689 - DNA, 20 bp, Homo sapiens
ctcaaaaatacaaaataaaa

SEQ ID NO: 5882690 - DNA, 16 bp, Homo sapiens
ctcaaaaatcatcaaa

SEQ ID NO: 5882691 - DNA, 13 bp, Homo sapiens
ctcaaaaatgatt

SEQ ID NO: 5882692 - DNA, 14 bp, Homo sapiens
ctcaaaacaaaggc

SEQ ID NO: 5882693 - DNA, 15 bp, Homo sapiens
ctcaaaaccatctct

SEQ ID NO: 5882694 - DNA, 17 bp, Homo sapiens
ctcaaaaccatctctct

SEQ ID NO: 5882695 - DNA, 21 bp, Homo sapiens
ctcaaaacctgattggccact

SEQ ID NO: 5882696 - DNA, 15 bp, Homo sapiens
ctcaaaacctggaga

SEQ ID NO: 5882697 - DNA, 21 bp, Homo sapiens
ctcaaaactgtactgtcttta

SEQ ID NO: 5882698 - DNA, 20 bp, Homo sapiens
ctcaaaacttaacatattta

SEQ ID NO: 5882699 - DNA, 15 bp, Homo sapiens
ctcaaaagaaaatgt

SEQ ID NO: 5882700 - DNA, 13 bp, Homo sapiens
ctcaaaagcactt

SEQ ID NO: 5882701 - DNA, 13 bp, Homo sapiens
ctcaaaagccaaa

SEQ ID NO: 5882702 - DNA, 15 bp, Homo sapiens
ctcaaaagccaaaaa

SEQ ID NO: 5882703 - DNA, 13 bp, Homo sapiens
ctcaaaaggaaac

SEQ ID NO: 5882704 - DNA, 21 bp, Homo sapiens
ctcaaaaggagaactgtgctc

SEQ ID NO: 5882705 - DNA, 23 bp, Homo sapiens
ctcaaaataaaaccagaaagagg

SEQ ID NO: 5882706 - DNA, 23 bp, Homo sapiens
ctcaaaatattttttttaactgc

SEQ ID NO: 5882707 - DNA, 18 bp, Homo sapiens
ctcaaaatcaactctctt

SEQ ID NO: 5882708 - DNA, 15 bp, Homo sapiens
ctcaaaatgacagtt

SEQ ID NO: 5882709 - DNA, 20 bp, Homo sapiens
ctcaaaatgatgcaaccaaa

SEQ ID NO: 5882710 - DNA, 12 bp, Homo sapiens
ctcaaaatgtgt

SEQ ID NO: 5882711 - DNA, 11 bp, Homo sapiens
ctcaaaattat

SEQ ID NO: 5882712 - DNA, 15 bp, Homo sapiens
ctcaaacaatgacaa

SEQ ID NO: 5882713 - DNA, 13 bp, Homo sapiens
ctcaaacacacaa

SEQ ID NO: 5882714 - DNA, 15 bp, Homo sapiens
ctcaaacacagttac

SEQ ID NO: 5882715 - DNA, 12 bp, Homo sapiens
ctcaaacactgc

SEQ ID NO: 5882716 - DNA, 17 bp, Homo sapiens
ctcaaacacttattgtt

SEQ ID NO: 5882717 - DNA, 22 bp, Homo sapiens
ctcaaaccaaatcactgaactt

SEQ ID NO: 5882718 - DNA, 17 bp, Homo sapiens
ctcaaaccacttgcctg

SEQ ID NO: 5882719 - DNA, 15 bp, Homo sapiens
ctcaaacctggcaga

SEQ ID NO: 5882720 - DNA, 16 bp, Homo sapiens
ctcaaacgacagagga

SEQ ID NO: 5882721 - DNA, 13 bp, Homo sapiens
ctcaattatttgc

SEQ ID NO: 5882722 - DNA, 22 bp, Homo sapiens
ctcaattatttgcatattttga

SEQ ID NO: 5882723 - DNA, 16 bp, Homo sapiens
ctcaattccaacagtt

SEQ ID NO: 5882724 - DNA, 21 bp, Homo sapiens
ctcaattccaacagtttaatg

SEQ ID NO: 5882725 - DNA, 20 bp, Homo sapiens
ctcaattccagggaaccaga

SEQ ID NO: 5882726 - DNA, 18 bp, Homo sapiens
ctcaattccccctggcca

SEQ ID NO: 5882727 - DNA, 19 bp, Homo sapiens
ctcaattccccctggccac

SEQ ID NO: 5882728 - DNA, 18 bp, Homo sapiens
ctcaattctgaaggggaa

SEQ ID NO: 5882729 - DNA, 12 bp, Homo sapiens
ctcaattgtgaa

SEQ ID NO: 5882730 - DNA, 16 bp, Homo sapiens
ctcaattgtgctttgt

SEQ ID NO: 5882731 - DNA, 16 bp, Homo sapiens
ctcaatttactaattt

SEQ ID NO: 5882732 - DNA, 12 bp, Homo sapiens
ctcaatttcagc

SEQ ID NO: 5882733 - DNA, 14 bp, Homo sapiens
ctcaatttctctat

SEQ ID NO: 5882734 - DNA, 15 bp, Homo sapiens
ctcaatttgaaacac

SEQ ID NO: 5882735 - DNA, 20 bp, Homo sapiens
ctcaattttggtttttctca

SEQ ID NO: 5882736 - DNA, 13 bp, Homo sapiens
ctcaattttgtat

SEQ ID NO: 5882737 - DNA, 21 bp, Homo sapiens
ctcaatttttggttgaataaa

SEQ ID NO: 5882738 - DNA, 22 bp, Homo sapiens
ctcacaaaccatgcaaatgcta

SEQ ID NO: 5882739 - DNA, 16 bp, Homo sapiens
ctcacaaagtgctggg

SEQ ID NO: 5882740 - DNA, 16 bp, Homo sapiens
ctcacaaatgctgtgg

SEQ ID NO: 5882741 - DNA, 17 bp, Homo sapiens
ctcacaacagctgcctg

SEQ ID NO: 5882742 - DNA, 17 bp, Homo sapiens
ctcacaacagtcttgtg

SEQ ID NO: 5882743 - DNA, 22 bp, Homo sapiens
ctcacaaccaccattcagtcaa

SEQ ID NO: 5882744 - DNA, 20 bp, Homo sapiens
ctcacaacctgaacctagga

SEQ ID NO: 5882745 - DNA, 19 bp, Homo sapiens
ctcacaactgtttttgaag

SEQ ID NO: 5882746 - DNA, 17 bp, Homo sapiens
ctcacaacttgggttct

SEQ ID NO: 5882747 - DNA, 13 bp, Homo sapiens
ctcacaagccgtg

SEQ ID NO: 5882748 - DNA, 14 bp, Homo sapiens
ctcacaagccgtgt

SEQ ID NO: 5882749 - DNA, 18 bp, Homo sapiens
ctcacaagcctcttctga

SEQ ID NO: 5882750 - DNA, 14 bp, Homo sapiens
ctcacaaggcagca

SEQ ID NO: 5882751 - DNA, 16 bp, Homo sapiens
ctcacaaggcagcaag

SEQ ID NO: 5882752 - DNA, 20 bp, Homo sapiens
ctcacaaggcagcaaggccc

SEQ ID NO: 5882753 - DNA, 14 bp, Homo sapiens
ctcacaaggcccag

SEQ ID NO: 5882754 - DNA, 16 bp, Homo sapiens
ctcacaaggcccagga

SEQ ID NO: 5882755 - DNA, 22 bp, Homo sapiens
ctcacaagggctctcaaagtat

SEQ ID NO: 5882756 - DNA, 23 bp, Homo sapiens
ctcacaagtagggagctcactcc

SEQ ID NO: 5882757 - DNA, 18 bp, Homo sapiens
ctcacaagtgaaaactga

SEQ ID NO: 5882758 - DNA, 20 bp, Homo sapiens
ctcacaagtgggtaccccca

SEQ ID NO: 5882759 - DNA, 21 bp, Homo sapiens
ctcacaagtgggtacccccag

SEQ ID NO: 5882760 - DNA, 21 bp, Homo sapiens
ctcacaataaaaatggctcag

SEQ ID NO: 5882761 - DNA, 22 bp, Homo sapiens
ctcacaataaaaatggctcaga

SEQ ID NO: 5882762 - DNA, 21 bp, Homo sapiens
ctcacaatagccgatatcaga

SEQ ID NO: 5882763 - DNA, 16 bp, Homo sapiens
ctcacaatagcgtgag

SEQ ID NO: 5882764 - DNA, 19 bp, Homo sapiens
ctcacaatcatcttctccc

SEQ ID NO: 5882765 - DNA, 14 bp, Homo sapiens
ctcacaattgtaaa

SEQ ID NO: 5882766 - DNA, 16 bp, Homo sapiens
ctcacaattgtaaagt

SEQ ID NO: 5882767 - DNA, 14 bp, Homo sapiens
ctcacaatttaaaa

SEQ ID NO: 5882768 - DNA, 15 bp, Homo sapiens
ctcacaatttaaaat

SEQ ID NO: 5882769 - DNA, 17 bp, Homo sapiens
ctcacacaatcagacca

SEQ ID NO: 5882770 - DNA, 11 bp, Homo sapiens
ctcacacacac

SEQ ID NO: 5882771 - DNA, 14 bp, Homo sapiens
ctcacacacacaca

SEQ ID NO: 5882772 - DNA, 23 bp, Homo sapiens
ctcacacaccctgtctgccccgc

SEQ ID NO: 5882773 - DNA, 14 bp, Homo sapiens
ctcacacacctctg

SEQ ID NO: 5882774 - DNA, 15 bp, Homo sapiens
ctcacacacctctgc

SEQ ID NO: 5882775 - DNA, 18 bp, Homo sapiens
ctcacacacctctgcccc

SEQ ID NO: 5882776 - DNA, 13 bp, Homo sapiens
ctcacacacggag

SEQ ID NO: 5882777 - DNA, 15 bp, Homo sapiens
ctcacacagccaggt

SEQ ID NO: 5882778 - DNA, 19 bp, Homo sapiens
ctcacacagccaggtgcct

SEQ ID NO: 5882779 - DNA, 20 bp, Homo sapiens
ctcacacagccaggtgcctt

SEQ ID NO: 5882780 - DNA, 22 bp, Homo sapiens
ctcacacagccaggtgccttgg

SEQ ID NO: 5882781 - DNA, 13 bp, Homo sapiens
ctcacacaggacc

SEQ ID NO: 5882782 - DNA, 22 bp, Homo sapiens
ctcacacaggacccccttcccc

SEQ ID NO: 5882783 - DNA, 23 bp, Homo sapiens
ctcacacaggcatttcctgggtg

SEQ ID NO: 5882784 - DNA, 14 bp, Homo sapiens
ctcacacatgagca

SEQ ID NO: 5882785 - DNA, 22 bp, Homo sapiens
ctcacacatgagcatcaggcca

SEQ ID NO: 5882786 - DNA, 21 bp, Homo sapiens
ctcacacattcccccaccagc

SEQ ID NO: 5882787 - DNA, 22 bp, Homo sapiens
ctcacacattcccccaccagct

SEQ ID NO: 5882788 - DNA, 23 bp, Homo sapiens
ctcacacattcccccaccagctg

SEQ ID NO: 5882789 - DNA, 17 bp, Homo sapiens
ctcacacatttctgcca

SEQ ID NO: 5882790 - DNA, 13 bp, Homo sapiens
ctcacaccaaatt

SEQ ID NO: 5882791 - DNA, 21 bp, Homo sapiens
ctcacaccactagcctcaggg

SEQ ID NO: 5882792 - DNA, 17 bp, Homo sapiens
ctcacaccagccctggt

SEQ ID NO: 5882793 - DNA, 18 bp, Homo sapiens
ctcacaccagccctggtg

SEQ ID NO: 5882794 - DNA, 12 bp, Homo sapiens
ctcacacccacc

SEQ ID NO: 5882795 - DNA, 15 bp, Homo sapiens
ctcacacccaccgtc

SEQ ID NO: 5882796 - DNA, 22 bp, Homo sapiens
ctcacacccaccgtccgccctg

SEQ ID NO: 5882797 - DNA, 21 bp, Homo sapiens
ctcacacccacctgctgctgt

SEQ ID NO: 5882798 - DNA, 18 bp, Homo sapiens
ctcacacccctgccccca

SEQ ID NO: 5882799 - DNA, 19 bp, Homo sapiens
ctcacacccctgtcccacc

SEQ ID NO: 5882800 - DNA, 19 bp, Homo sapiens
ctcacaccctaccttcccc

SEQ ID NO: 5882801 - DNA, 21 bp, Homo sapiens
ctcacaccctaccttccccag

SEQ ID NO: 5882802 - DNA, 18 bp, Homo sapiens
ctcacaccgcaccgggct

SEQ ID NO: 5882803 - DNA, 17 bp, Homo sapiens
ctcacaccggcactgtg

SEQ ID NO: 5882804 - DNA, 16 bp, Homo sapiens
ctcacacctccttttc

SEQ ID NO: 5882805 - DNA, 19 bp, Homo sapiens
ctcacacctgcaatcccag

SEQ ID NO: 5882806 - DNA, 22 bp, Homo sapiens
ctcacacctgtaatcccagcac

SEQ ID NO: 5882807 - DNA, 15 bp, Homo sapiens
ctcacacctgtcctt

SEQ ID NO: 5882808 - DNA, 22 bp, Homo sapiens
ctcacacgctgcctcctcagca

SEQ ID NO: 5882809 - DNA, 23 bp, Homo sapiens
ctcacacggacactcaaaagctg

SEQ ID NO: 5882810 - DNA, 21 bp, Homo sapiens
ctcacacggatttagtcccac

SEQ ID NO: 5882811 - DNA, 20 bp, Homo sapiens
ctcacacgtttaatcccagc

SEQ ID NO: 5882812 - DNA, 23 bp, Homo sapiens
ctcacacgtttaatcccagcact

SEQ ID NO: 5882813 - DNA, 23 bp, Homo sapiens
ctcacactactgtatttcattat

SEQ ID NO: 5882814 - DNA, 17 bp, Homo sapiens
ctcacactacttgagaa

SEQ ID NO: 5882815 - DNA, 14 bp, Homo sapiens
ctcacactcatcca

SEQ ID NO: 5882816 - DNA, 13 bp, Homo sapiens
ctcacactccaga

SEQ ID NO: 5882817 - DNA, 16 bp, Homo sapiens
ctcacactcctcctgc

SEQ ID NO: 5882818 - DNA, 18 bp, Homo sapiens
ctcacactcctcctgcca

SEQ ID NO: 5882819 - DNA, 18 bp, Homo sapiens
ctcacactcctgggctct

SEQ ID NO: 5882820 - DNA, 14 bp, Homo sapiens
ctcacactccttta

SEQ ID NO: 5882821 - DNA, 12 bp, Homo sapiens
ctcacactctct

SEQ ID NO: 5882822 - DNA, 17 bp, Homo sapiens
ctcacactctctgcagc

SEQ ID NO: 5882823 - DNA, 20 bp, Homo sapiens
ctcacactctctgcagccca

SEQ ID NO: 5882824 - DNA, 23 bp, Homo sapiens
ctcacactctctgcagcccagcc

SEQ ID NO: 5882825 - DNA, 22 bp, Homo sapiens
ctcacactgatgggctggggca

SEQ ID NO: 5882826 - DNA, 13 bp, Homo sapiens
ctcacactgcaag

SEQ ID NO: 5882827 - DNA, 17 bp, Homo sapiens
ctcacactgctgtcctc

SEQ ID NO: 5882828 - DNA, 19 bp, Homo sapiens
ctcacactgctgtcctctc

SEQ ID NO: 5882829 - DNA, 20 bp, Homo sapiens
ctcacactgctgtcctctcc

SEQ ID NO: 5882830 - DNA, 15 bp, Homo sapiens
ctcacactggccaca

SEQ ID NO: 5882831 - DNA, 23 bp, Homo sapiens
ctcacactggttctcaatgaaaa

SEQ ID NO: 5882832 - DNA, 17 bp, Homo sapiens
ctcacactgtttttcat

SEQ ID NO: 5882833 - DNA, 18 bp, Homo sapiens
ctcacactgtttttcata

SEQ ID NO: 5882834 - DNA, 20 bp, Homo sapiens
ctcacacttactgtaagaca

SEQ ID NO: 5882835 - DNA, 21 bp, Homo sapiens
ctcacacttactgtaagacat

SEQ ID NO: 5882836 - DNA, 20 bp, Homo sapiens
ctcacacttgggcgctctgc

SEQ ID NO: 5882837 - DNA, 21 bp, Homo sapiens
ctcacacttgggcgctctgcc

SEQ ID NO: 5882838 - DNA, 23 bp, Homo sapiens
ctcacacttgggcgctctgccct

SEQ ID NO: 5882839 - DNA, 14 bp, Homo sapiens
ctcacacttgggct

SEQ ID NO: 5882840 - DNA, 16 bp, Homo sapiens
ctcacacttgggctgg

SEQ ID NO: 5882841 - DNA, 17 bp, Homo sapiens
ctcacacttgggctggc

SEQ ID NO: 5882842 - DNA, 19 bp, Homo sapiens
ctcacacttgggctggcac

SEQ ID NO: 5882843 - DNA, 19 bp, Homo sapiens
ctcacagaaatgttaaact

SEQ ID NO: 5882844 - DNA, 15 bp, Homo sapiens
ctcacagaagatgaa

SEQ ID NO: 5882845 - DNA, 13 bp, Homo sapiens
ctcacagacagga

SEQ ID NO: 5882846 - DNA, 15 bp, Homo sapiens
ctcacagacaggacc

SEQ ID NO: 5882847 - DNA, 18 bp, Homo sapiens
ctcacagacctctgcttg

SEQ ID NO: 5882848 - DNA, 12 bp, Homo sapiens
ctcacagagaag

SEQ ID NO: 5882849 - DNA, 13 bp, Homo sapiens
ctcacagagaagc

SEQ ID NO: 5882850 - DNA, 14 bp, Homo sapiens
ctcacagagaagct

SEQ ID NO: 5882851 - DNA, 16 bp, Homo sapiens
ctcacagagaagctcc

SEQ ID NO: 5882852 - DNA, 18 bp, Homo sapiens
ctcacagagaagctcctg

SEQ ID NO: 5882853 - DNA, 23 bp, Homo sapiens
ctcacagagaagctcctgctact

SEQ ID NO: 5882854 - DNA, 13 bp, Homo sapiens
ctcacagagcttt

SEQ ID NO: 5882855 - DNA, 20 bp, Homo sapiens
ctcacagagtcaaggcctgc

SEQ ID NO: 5882856 - DNA, 15 bp, Homo sapiens
ctcacagatgctggc

SEQ ID NO: 5882857 - DNA, 18 bp, Homo sapiens
ctcacagatgctggcctc

SEQ ID NO: 5882858 - DNA, 19 bp, Homo sapiens
ctcacagatgctggcctct

SEQ ID NO: 5882859 - DNA, 21 bp, Homo sapiens
ctcacagatgctggcctcttg

SEQ ID NO: 5882860 - DNA, 20 bp, Homo sapiens
ctcacagatgtgactgtata

SEQ ID NO: 5882861 - DNA, 21 bp, Homo sapiens
ctcacagattgaggtaataat

SEQ ID NO: 5882862 - DNA, 17 bp, Homo sapiens
ctcacagcacactcagc

SEQ ID NO: 5882863 - DNA, 19 bp, Homo sapiens
ctcacagcacatgctggcc

SEQ ID NO: 5882864 - DNA, 16 bp, Homo sapiens
ctcacagcacatttgt

SEQ ID NO: 5882865 - DNA, 20 bp, Homo sapiens
ctcacagcacttgttttcag

SEQ ID NO: 5882866 - DNA, 14 bp, Homo sapiens
ctcacagcatttgc

SEQ ID NO: 5882867 - DNA, 10 bp, Homo sapiens
ctcacagcca

SEQ ID NO: 5882868 - DNA, 13 bp, Homo sapiens
ctcacagccacca

SEQ ID NO: 5882869 - DNA, 17 bp, Homo sapiens
ctcacagccaccacctg

SEQ ID NO: 5882870 - DNA, 12 bp, Homo sapiens
ctcacagcctct

SEQ ID NO: 5882871 - DNA, 17 bp, Homo sapiens
ctcacagcctctccctt

SEQ ID NO: 5882872 - DNA, 15 bp, Homo sapiens
ctcacagcctctgac

SEQ ID NO: 5882873 - DNA, 19 bp, Homo sapiens
ctcacagcctctgacccct

SEQ ID NO: 5882874 - DNA, 22 bp, Homo sapiens
ctcacagctactcagtggggct

SEQ ID NO: 5882875 - DNA, 15 bp, Homo sapiens
ctcacagctatgcaa

SEQ ID NO: 5882876 - DNA, 17 bp, Homo sapiens
ctcacagcttctccaag

SEQ ID NO: 5882877 - DNA, 20 bp, Homo sapiens
ctcacaggagcagacagaga

SEQ ID NO: 5882878 - DNA, 20 bp, Homo sapiens
ctcacaggcagctctgagcc

SEQ ID NO: 5882879 - DNA, 17 bp, Homo sapiens
ctcacaggccctggaga

SEQ ID NO: 5882880 - DNA, 18 bp, Homo sapiens
ctcacaggccctggagaa

SEQ ID NO: 5882881 - DNA, 12 bp, Homo sapiens
ctcacaggcctc

SEQ ID NO: 5882882 - DNA, 15 bp, Homo sapiens
ctcacaggcctctct

SEQ ID NO: 5882883 - DNA, 16 bp, Homo sapiens
ctcacaggcctctctt

SEQ ID NO: 5882884 - DNA, 12 bp, Homo sapiens
ctcacaggctga

SEQ ID NO: 5882885 - DNA, 15 bp, Homo sapiens
ctcacagggatgctg

SEQ ID NO: 5882886 - DNA, 12 bp, Homo sapiens
ctcacagggcag

SEQ ID NO: 5882887 - DNA, 14 bp, Homo sapiens
ctcacagggcaggc

SEQ ID NO: 5882888 - DNA, 23 bp, Homo sapiens
ctcacagggcaggccttgctggg

SEQ ID NO: 5882889 - DNA, 18 bp, Homo sapiens
ctcacaggttggaagaga

SEQ ID NO: 5882890 - DNA, 22 bp, Homo sapiens
ctcacaggttggaagagaatca

SEQ ID NO: 5882891 - DNA, 23 bp, Homo sapiens
ctcacaggttggaagagaatcac

SEQ ID NO: 5882892 - DNA, 20 bp, Homo sapiens
ctcacagtaacccaaacctc

SEQ ID NO: 5882893 - DNA, 13 bp, Homo sapiens
ctcacagtacagc

SEQ ID NO: 5882894 - DNA, 14 bp, Homo sapiens
ctcacagtcccact

SEQ ID NO: 5882895 - DNA, 22 bp, Homo sapiens
ctcacagtccttaccagcagag

SEQ ID NO: 5882896 - DNA, 18 bp, Homo sapiens
ctcacagtgacccttccc

SEQ ID NO: 5882897 - DNA, 15 bp, Homo sapiens
ctcacagtgctttta

SEQ ID NO: 5882898 - DNA, 12 bp, Homo sapiens
ctcacagtgtgg

SEQ ID NO: 5882899 - DNA, 22 bp, Homo sapiens
ctcacagtgtggggcagccgtc

SEQ ID NO: 5882900 - DNA, 17 bp, Homo sapiens
ctcacagttcctcgccc

SEQ ID NO: 5882901 - DNA, 13 bp, Homo sapiens
ctcacataagccc

SEQ ID NO: 5882902 - DNA, 21 bp, Homo sapiens
ctcacatagccaactctccca

SEQ ID NO: 5882903 - DNA, 16 bp, Homo sapiens
ctcacatcagagtgac

SEQ ID NO: 5882904 - DNA, 14 bp, Homo sapiens
ctcacatcatgtaa

SEQ ID NO: 5882905 - DNA, 14 bp, Homo sapiens
ctcacatcctcctg

SEQ ID NO: 5882906 - DNA, 15 bp, Homo sapiens
ctcacatcctcctgc

SEQ ID NO: 5882907 - DNA, 14 bp, Homo sapiens
ctcacatcctctcc

SEQ ID NO: 5882908 - DNA, 17 bp, Homo sapiens
ctcacatctacacgtgg

SEQ ID NO: 5882909 - DNA, 17 bp, Homo sapiens
ctcacatctcccttcca

SEQ ID NO: 5882910 - DNA, 20 bp, Homo sapiens
ctcacatctttcacacttcc

SEQ ID NO: 5882911 - DNA, 18 bp, Homo sapiens
ctcacatgattccagcca

SEQ ID NO: 5882912 - DNA, 14 bp, Homo sapiens
ctcacatgcagagt

SEQ ID NO: 5882913 - DNA, 22 bp, Homo sapiens
ctcacatgcccgctgtcccagg

SEQ ID NO: 5882914 - DNA, 11 bp, Homo sapiens
ctcacatgccg

SEQ ID NO: 5882915 - DNA, 13 bp, Homo sapiens
ctcacatgctgga

SEQ ID NO: 5882916 - DNA, 15 bp, Homo sapiens
ctcacatgctggaca

SEQ ID NO: 5882917 - DNA, 16 bp, Homo sapiens
ctcacatggaatgagg

SEQ ID NO: 5882918 - DNA, 14 bp, Homo sapiens
ctcacatgggactg

SEQ ID NO: 5882919 - DNA, 21 bp, Homo sapiens
ctcacatggtgctacgcctgc

SEQ ID NO: 5882920 - DNA, 14 bp, Homo sapiens
ctcacattcccaag

SEQ ID NO: 5882921 - DNA, 15 bp, Homo sapiens
ctcacattcccaagg

SEQ ID NO: 5882922 - DNA, 23 bp, Homo sapiens
ctcacattcccccggtgcctctc

SEQ ID NO: 5882923 - DNA, 18 bp, Homo sapiens
ctcacattcgacataccc

SEQ ID NO: 5882924 - DNA, 21 bp, Homo sapiens
ctcacattcgacataccccac

SEQ ID NO: 5882925 - DNA, 21 bp, Homo sapiens
ctcacattgagagtaagcacg

SEQ ID NO: 5882926 - DNA, 16 bp, Homo sapiens
ctcacattgctgtatt

SEQ ID NO: 5882927 - DNA, 12 bp, Homo sapiens
ctcacatttatg

SEQ ID NO: 5882928 - DNA, 15 bp, Homo sapiens
ctcacatttttttct

SEQ ID NO: 5882929 - DNA, 20 bp, Homo sapiens
ctcaccaaaaagctttaaaa

SEQ ID NO: 5882930 - DNA, 13 bp, Homo sapiens
ctcaccaaaatat

SEQ ID NO: 5882931 - DNA, 21 bp, Homo sapiens
ctcaccaaaatatagttaatt

SEQ ID NO: 5882932 - DNA, 17 bp, Homo sapiens
ctcaccaacttgccaca

SEQ ID NO: 5882933 - DNA, 15 bp, Homo sapiens
ctcaccaacttttaa

SEQ ID NO: 5882934 - DNA, 22 bp, Homo sapiens
ctcaccaataacttcagagaag

SEQ ID NO: 5882935 - DNA, 14 bp, Homo sapiens
ctcaccacaagctg

SEQ ID NO: 5882936 - DNA, 14 bp, Homo sapiens
ctcaccaccacact

SEQ ID NO: 5882937 - DNA, 15 bp, Homo sapiens
ctcaccaccacacta

SEQ ID NO: 5882938 - DNA, 13 bp, Homo sapiens
ctcaccacctgcc

SEQ ID NO: 5882939 - DNA, 16 bp, Homo sapiens
ctcaccacggaccaaa

SEQ ID NO: 5882940 - DNA, 17 bp, Homo sapiens
ctcaccacgtggggcca

SEQ ID NO: 5882941 - DNA, 20 bp, Homo sapiens
ctcaccagaattgtgcaaat

SEQ ID NO: 5882942 - DNA, 21 bp, Homo sapiens
ctcaccagccccactgccagc

SEQ ID NO: 5882943 - DNA, 14 bp, Homo sapiens
ctcaccagccccag

SEQ ID NO: 5882944 - DNA, 17 bp, Homo sapiens
ctcaccagccccccgcg

SEQ ID NO: 5882945 - DNA, 15 bp, Homo sapiens
ctcaccagccctgca

SEQ ID NO: 5882946 - DNA, 15 bp, Homo sapiens
ctcaccagcctctgc

SEQ ID NO: 5882947 - DNA, 14 bp, Homo sapiens
ctcaccagctgcaa

SEQ ID NO: 5882948 - DNA, 15 bp, Homo sapiens
ctcaccagctgcaaa

SEQ ID NO: 5882949 - DNA, 13 bp, Homo sapiens
ctcaccagctgtg

SEQ ID NO: 5882950 - DNA, 19 bp, Homo sapiens
ctcaccaggcagcctctgg

SEQ ID NO: 5882951 - DNA, 21 bp, Homo sapiens
ctcaccaggcagcctctgggg

SEQ ID NO: 5882952 - DNA, 14 bp, Homo sapiens
ctcaccaggcctgg

SEQ ID NO: 5882953 - DNA, 16 bp, Homo sapiens
ctcaccaggcctggcc

SEQ ID NO: 5882954 - DNA, 17 bp, Homo sapiens
ctcaccaggcctggcct

SEQ ID NO: 5882955 - DNA, 20 bp, Homo sapiens
ctcaccaggcctggcctctg

SEQ ID NO: 5882956 - DNA, 12 bp, Homo sapiens
ctcaccagggtc

SEQ ID NO: 5882957 - DNA, 13 bp, Homo sapiens
ctcaccagggtcc

SEQ ID NO: 5882958 - DNA, 21 bp, Homo sapiens
ctcaccagggtccgcaccagc

SEQ ID NO: 5882959 - DNA, 22 bp, Homo sapiens
ctcaccagggtccgcaccagct

SEQ ID NO: 5882960 - DNA, 12 bp, Homo sapiens
ctcaccagtggc

SEQ ID NO: 5882961 - DNA, 14 bp, Homo sapiens
ctcaccagtggcct

SEQ ID NO: 5882962 - DNA, 17 bp, Homo sapiens
ctcaccatatttgaatt

SEQ ID NO: 5882963 - DNA, 19 bp, Homo sapiens
ctcaccatatttgaattgg

SEQ ID NO: 5882964 - DNA, 13 bp, Homo sapiens
ctcaccatccagt

SEQ ID NO: 5882965 - DNA, 17 bp, Homo sapiens
ctcaccatccagtgggc

SEQ ID NO: 5882966 - DNA, 14 bp, Homo sapiens
ctcaccatgtaaaa

SEQ ID NO: 5882967 - DNA, 17 bp, Homo sapiens
ctcaccattgtgaagca

SEQ ID NO: 5882968 - DNA, 22 bp, Homo sapiens
ctcaccatttaatcatttccag

SEQ ID NO: 5882969 - DNA, 13 bp, Homo sapiens
ctcaccatttcat

SEQ ID NO: 5882970 - DNA, 16 bp, Homo sapiens
ctcaccatttccccag

SEQ ID NO: 5882971 - DNA, 17 bp, Homo sapiens
ctcacccaccagctcca

SEQ ID NO: 5882972 - DNA, 18 bp, Homo sapiens
ctcacccaccagctccac

SEQ ID NO: 5882973 - DNA, 21 bp, Homo sapiens
ctcacccaccatggaccagcc

SEQ ID NO: 5882974 - DNA, 16 bp, Homo sapiens
ctcacccacctctggg

SEQ ID NO: 5882975 - DNA, 20 bp, Homo sapiens
ctcacccactctggtggcca

SEQ ID NO: 5882976 - DNA, 13 bp, Homo sapiens
ctcacccagaagg

SEQ ID NO: 5882977 - DNA, 13 bp, Homo sapiens
ctcacccagcctg

SEQ ID NO: 5882978 - DNA, 12 bp, Homo sapiens
ctcacccaggac

SEQ ID NO: 5882979 - DNA, 18 bp, Homo sapiens
ctcacccaggacctctgg

SEQ ID NO: 5882980 - DNA, 20 bp, Homo sapiens
ctcacccaggacctctgggg

SEQ ID NO: 5882981 - DNA, 12 bp, Homo sapiens
ctcacccagtcc

SEQ ID NO: 5882982 - DNA, 15 bp, Homo sapiens
ctcacccatcctaga

SEQ ID NO: 5882983 - DNA, 16 bp, Homo sapiens
ctcacccatgtgccaa

SEQ ID NO: 5882984 - DNA, 20 bp, Homo sapiens
ctcaccccacaatttcttta

SEQ ID NO: 5882985 - DNA, 13 bp, Homo sapiens
ctcaccccactcc

SEQ ID NO: 5882986 - DNA, 12 bp, Homo sapiens
ctcaccccatcc

SEQ ID NO: 5882987 - DNA, 17 bp, Homo sapiens
ctcacccccaaggggca

SEQ ID NO: 5882988 - DNA, 13 bp, Homo sapiens
ctcacccccaccc

SEQ ID NO: 5882989 - DNA, 18 bp, Homo sapiens
ctcacccccagctttgct

SEQ ID NO: 5882990 - DNA, 14 bp, Homo sapiens
ctcacccccatccc

SEQ ID NO: 5882991 - DNA, 14 bp, Homo sapiens
ctcaccccctccca

SEQ ID NO: 5882992 - DNA, 17 bp, Homo sapiens
ctcaccccctcctggca

SEQ ID NO: 5882993 - DNA, 14 bp, Homo sapiens
ctcaccccctcggg

SEQ ID NO: 5882994 - DNA, 19 bp, Homo sapiens
ctcacccccttctccatcc

SEQ ID NO: 5882995 - DNA, 20 bp, Homo sapiens
ctcacccccttctccatcca

SEQ ID NO: 5882996 - DNA, 15 bp, Homo sapiens
ctcaccccctttgct

SEQ ID NO: 5882997 - DNA, 17 bp, Homo sapiens
ctcaccccgaggccctg

SEQ ID NO: 5882998 - DNA, 18 bp, Homo sapiens
ctcaccccgaggccctgc

SEQ ID NO: 5882999 - DNA, 15 bp, Homo sapiens
ctcaccccgtctggg

SEQ ID NO: 5883000 - DNA, 14 bp, Homo sapiens
ctcacccctcccct

SEQ ID NO: 5883001 - DNA, 16 bp, Homo sapiens
ctcacccctcccctgg

SEQ ID NO: 5883002 - DNA, 19 bp, Homo sapiens
ctcacccctcccctgggac

SEQ ID NO: 5883003 - DNA, 20 bp, Homo sapiens
ctcacccctcccctgggact

SEQ ID NO: 5883004 - DNA, 14 bp, Homo sapiens
ctcacccctcgcca

SEQ ID NO: 5883005 - DNA, 15 bp, Homo sapiens
ctcacccctgcccct

SEQ ID NO: 5883006 - DNA, 20 bp, Homo sapiens
ctcacccctgcccctgtggg

SEQ ID NO: 5883007 - DNA, 21 bp, Homo sapiens
ctcacccctgcccctgtggga

SEQ ID NO: 5883008 - DNA, 17 bp, Homo sapiens
ctcacccctgccctggg

SEQ ID NO: 5883009 - DNA, 12 bp, Homo sapiens
ctcacccctggg

SEQ ID NO: 5883010 - DNA, 13 bp, Homo sapiens
ctcacccctgggc

SEQ ID NO: 5883011 - DNA, 14 bp, Homo sapiens
ctcacccctggttc

SEQ ID NO: 5883012 - DNA, 17 bp, Homo sapiens
ctcacccctggttctca

SEQ ID NO: 5883013 - DNA, 15 bp, Homo sapiens
ctcacccctgtaggg

SEQ ID NO: 5883014 - DNA, 17 bp, Homo sapiens
ctcacccgctgcccagc

SEQ ID NO: 5883015 - DNA, 19 bp, Homo sapiens
ctcacccgctgcccagccc

SEQ ID NO: 5883016 - DNA, 24 bp, Homo sapiens
ctcacccggcaaggggcgcgcgcc

SEQ ID NO: 5883017 - DNA, 17 bp, Homo sapiens
ctcaccctactctggat

SEQ ID NO: 5883018 - DNA, 18 bp, Homo sapiens
ctcaccctactctggatg

SEQ ID NO: 5883019 - DNA, 15 bp, Homo sapiens
ctcaccctcatacca

SEQ ID NO: 5883020 - DNA, 21 bp, Homo sapiens
ctcaccctcataccatctgct

SEQ ID NO: 5883021 - DNA, 23 bp, Homo sapiens
ctcaccctccacaaagcaaaggc

SEQ ID NO: 5883022 - DNA, 13 bp, Homo sapiens
ctcaccctctgtc

SEQ ID NO: 5883023 - DNA, 14 bp, Homo sapiens
ctcaccctctgtcc

SEQ ID NO: 5883024 - DNA, 23 bp, Homo sapiens
ctcaccctctgtccttcccccag

SEQ ID NO: 5883025 - DNA, 20 bp, Homo sapiens
ctcaccctgagccccttcct

SEQ ID NO: 5883026 - DNA, 19 bp, Homo sapiens
ctcaccctgcccgctccca

SEQ ID NO: 5883027 - DNA, 13 bp, Homo sapiens
ctcaccctgcctt

SEQ ID NO: 5883028 - DNA, 14 bp, Homo sapiens
ctcaccctgcctta

SEQ ID NO: 5883029 - DNA, 15 bp, Homo sapiens
ctcaccctgctccta

SEQ ID NO: 5883030 - DNA, 15 bp, Homo sapiens
ctcaccctgcttggg

SEQ ID NO: 5883031 - DNA, 15 bp, Homo sapiens
ctcaccctggaggca

SEQ ID NO: 5883032 - DNA, 21 bp, Homo sapiens
ctcaccctgtgggaccgcctg

SEQ ID NO: 5883033 - DNA, 22 bp, Homo sapiens
ctcaccctgtgggaccgcctgg

SEQ ID NO: 5883034 - DNA, 15 bp, Homo sapiens
ctcacccttcccggc

SEQ ID NO: 5883035 - DNA, 16 bp, Homo sapiens
ctcacccttcctggcc

SEQ ID NO: 5883036 - DNA, 12 bp, Homo sapiens
ctcacccttggc

SEQ ID NO: 5883037 - DNA, 22 bp, Homo sapiens
ctcaccgacccgacactctcac

SEQ ID NO: 5883038 - DNA, 22 bp, Homo sapiens
ctcaccgactcacctgcgcaag

SEQ ID NO: 5883039 - DNA, 21 bp, Homo sapiens
ctcaccgcagtcgtcgcacag

SEQ ID NO: 5883040 - DNA, 16 bp, Homo sapiens
ctcaccgcccatcagg

SEQ ID NO: 5883041 - DNA, 17 bp, Homo sapiens
ctcaccgcccatcaggg

SEQ ID NO: 5883042 - DNA, 13 bp, Homo sapiens
ctcaccgcctgct

SEQ ID NO: 5883043 - DNA, 15 bp, Homo sapiens
ctcaccgcggctgga

SEQ ID NO: 5883044 - DNA, 21 bp, Homo sapiens
ctcaccgctggcccttagaga

SEQ ID NO: 5883045 - DNA, 19 bp, Homo sapiens
ctcaccggcatgctggcct

SEQ ID NO: 5883046 - DNA, 13 bp, Homo sapiens
ctcaccggctctc

SEQ ID NO: 5883047 - DNA, 21 bp, Homo sapiens
ctcaccggctctcacctggcc

SEQ ID NO: 5883048 - DNA, 15 bp, Homo sapiens
ctcaccgtgctgtct

SEQ ID NO: 5883049 - DNA, 17 bp, Homo sapiens
ctcacctaaaccctctg

SEQ ID NO: 5883050 - DNA, 22 bp, Homo sapiens
ctcacctaaaccctctgtgaaa

SEQ ID NO: 5883051 - DNA, 21 bp, Homo sapiens
ctcacctaatggttgtacata

SEQ ID NO: 5883052 - DNA, 20 bp, Homo sapiens
ctcacctaccctcaaagtag

SEQ ID NO: 5883053 - DNA, 17 bp, Homo sapiens
ctcacctagagccagac

SEQ ID NO: 5883054 - DNA, 19 bp, Homo sapiens
ctcacctagagccagacca

SEQ ID NO: 5883055 - DNA, 19 bp, Homo sapiens
ctcacctatccacacaaca

SEQ ID NO: 5883056 - DNA, 13 bp, Homo sapiens
ctcacctccatcc

SEQ ID NO: 5883057 - DNA, 10 bp, Homo sapiens
ctcacctccc

SEQ ID NO: 5883058 - DNA, 17 bp, Homo sapiens
ctcacctcccagggcta

SEQ ID NO: 5883059 - DNA, 14 bp, Homo sapiens
ctcacctcctgctg

SEQ ID NO: 5883060 - DNA, 22 bp, Homo sapiens
ctcacctctaggtccccatact

SEQ ID NO: 5883061 - DNA, 14 bp, Homo sapiens
ctcacctctccctc

SEQ ID NO: 5883062 - DNA, 16 bp, Homo sapiens
ctcacctctcccttgg

SEQ ID NO: 5883063 - DNA, 17 bp, Homo sapiens
ctcacctctcccttgga

SEQ ID NO: 5883064 - DNA, 14 bp, Homo sapiens
ctcacctctctcta

SEQ ID NO: 5883065 - DNA, 14 bp, Homo sapiens
ctcacctctgagga

SEQ ID NO: 5883066 - DNA, 15 bp, Homo sapiens
ctcacctctgaggac

SEQ ID NO: 5883067 - DNA, 16 bp, Homo sapiens
ctcacctctgcctcaa

SEQ ID NO: 5883068 - DNA, 19 bp, Homo sapiens
ctcacctctgcctcaatgt

SEQ ID NO: 5883069 - DNA, 20 bp, Homo sapiens
ctcacctctttgttcttcct

SEQ ID NO: 5883070 - DNA, 17 bp, Homo sapiens
ctcacctgaaaatgtgg

SEQ ID NO: 5883071 - DNA, 17 bp, Homo sapiens
ctcacctgaattcgaga

SEQ ID NO: 5883072 - DNA, 16 bp, Homo sapiens
ctcacctgagacctcc

SEQ ID NO: 5883073 - DNA, 23 bp, Homo sapiens
ctcacctgagacctccactccac

SEQ ID NO: 5883074 - DNA, 17 bp, Homo sapiens
ctcacctgcactaacag

SEQ ID NO: 5883075 - DNA, 20 bp, Homo sapiens
ctcacctgcactaacagagt

SEQ ID NO: 5883076 - DNA, 17 bp, Homo sapiens
ctcacctgcagagaaac

SEQ ID NO: 5883077 - DNA, 16 bp, Homo sapiens
ctcacctgcccctcaa

SEQ ID NO: 5883078 - DNA, 18 bp, Homo sapiens
ctcacctgcccctctgtt

SEQ ID NO: 5883079 - DNA, 22 bp, Homo sapiens
ctcagaattattcatagctgta

SEQ ID NO: 5883080 - DNA, 14 bp, Homo sapiens
ctcagaattatttt

SEQ ID NO: 5883081 - DNA, 23 bp, Homo sapiens
ctcagaatttatctcccttagaa

SEQ ID NO: 5883082 - DNA, 16 bp, Homo sapiens
ctcagacaatccactc

SEQ ID NO: 5883083 - DNA, 23 bp, Homo sapiens
ctcagacacgcaggacccaggta

SEQ ID NO: 5883084 - DNA, 14 bp, Homo sapiens
ctcagacatctcca

SEQ ID NO: 5883085 - DNA, 19 bp, Homo sapiens
ctcagacatctccagtgtg

SEQ ID NO: 5883086 - DNA, 19 bp, Homo sapiens
ctcagacatgttttccgtg

SEQ ID NO: 5883087 - DNA, 20 bp, Homo sapiens
ctcagacatgttttccgtga

SEQ ID NO: 5883088 - DNA, 21 bp, Homo sapiens
ctcagaccaactctctcctgt

SEQ ID NO: 5883089 - DNA, 18 bp, Homo sapiens
ctcagaccacatgcccca

SEQ ID NO: 5883090 - DNA, 17 bp, Homo sapiens
ctcagaccaggtggaat

SEQ ID NO: 5883091 - DNA, 18 bp, Homo sapiens
ctcagaccaggtggaatt

SEQ ID NO: 5883092 - DNA, 12 bp, Homo sapiens
ctcagacccagc

SEQ ID NO: 5883093 - DNA, 17 bp, Homo sapiens
ctcagacccagcggtcc

SEQ ID NO: 5883094 - DNA, 23 bp, Homo sapiens
ctcagacccagcggtccaatgcc

SEQ ID NO: 5883095 - DNA, 13 bp, Homo sapiens
ctcagacccagga

SEQ ID NO: 5883096 - DNA, 22 bp, Homo sapiens
ctcagacccaggagtccagacc

SEQ ID NO: 5883097 - DNA, 18 bp, Homo sapiens
ctcagacccaggggtcca

SEQ ID NO: 5883098 - DNA, 22 bp, Homo sapiens
ctcagacccaggggtccaggcc

SEQ ID NO: 5883099 - DNA, 18 bp, Homo sapiens
ctcagaccccaggtcagc

SEQ ID NO: 5883100 - DNA, 22 bp, Homo sapiens
ctcagacccccactctcattcc

SEQ ID NO: 5883101 - DNA, 19 bp, Homo sapiens
ctcagaccccctcagcctt

SEQ ID NO: 5883102 - DNA, 15 bp, Homo sapiens
ctcagacccctcagc

SEQ ID NO: 5883103 - DNA, 20 bp, Homo sapiens
ctcagaccctgcttaggatg

SEQ ID NO: 5883104 - DNA, 22 bp, Homo sapiens
ctcagacccttgaagatgtagc

SEQ ID NO: 5883105 - DNA, 15 bp, Homo sapiens
ctcagaccgtcttcc

SEQ ID NO: 5883106 - DNA, 12 bp, Homo sapiens
ctcagacctcca

SEQ ID NO: 5883107 - DNA, 17 bp, Homo sapiens
ctcagacctttactgat

SEQ ID NO: 5883108 - DNA, 17 bp, Homo sapiens
ctcagacgactagccca

SEQ ID NO: 5883109 - DNA, 18 bp, Homo sapiens
ctcagacgagacacccta

SEQ ID NO: 5883110 - DNA, 17 bp, Homo sapiens
ctcagacggcggccagg

SEQ ID NO: 5883111 - DNA, 18 bp, Homo sapiens
ctcagacggcggccaggc

SEQ ID NO: 5883112 - DNA, 19 bp, Homo sapiens
ctcagacggcggccaggca

SEQ ID NO: 5883113 - DNA, 22 bp, Homo sapiens
ctcagacggcggccaggcacag

SEQ ID NO: 5883114 - DNA, 23 bp, Homo sapiens
ctcagacggcggccaggcacagg

SEQ ID NO: 5883115 - DNA, 19 bp, Homo sapiens
ctcagacgggctgagagga

SEQ ID NO: 5883116 - DNA, 23 bp, Homo sapiens
ctcagacgtgtgacctccatact

SEQ ID NO: 5883117 - DNA, 15 bp, Homo sapiens
ctcagacgttgcctg

SEQ ID NO: 5883118 - DNA, 17 bp, Homo sapiens
ctcagacgttgcctgag

SEQ ID NO: 5883119 - DNA, 18 bp, Homo sapiens
ctcagacgttgcctgaga

SEQ ID NO: 5883120 - DNA, 22 bp, Homo sapiens
ctcagacgttgcctgagaagaa

SEQ ID NO: 5883121 - DNA, 17 bp, Homo sapiens
ctcagactcagaggtcc

SEQ ID NO: 5883122 - DNA, 18 bp, Homo sapiens
ctcagactcagaggtcca

SEQ ID NO: 5883123 - DNA, 17 bp, Homo sapiens
ctcagactcatacagaa

SEQ ID NO: 5883124 - DNA, 14 bp, Homo sapiens
ctcagactccattt

SEQ ID NO: 5883125 - DNA, 14 bp, Homo sapiens
ctcagactccgccc

SEQ ID NO: 5883126 - DNA, 14 bp, Homo sapiens
ctcagactcctggc

SEQ ID NO: 5883127 - DNA, 16 bp, Homo sapiens
ctcagactgcacccag

SEQ ID NO: 5883128 - DNA, 20 bp, Homo sapiens
ctcagactgcacccaggagg

SEQ ID NO: 5883129 - DNA, 14 bp, Homo sapiens
ctcagactggggca

SEQ ID NO: 5883130 - DNA, 13 bp, Homo sapiens
ctcagactggtct

SEQ ID NO: 5883131 - DNA, 13 bp, Homo sapiens
ctcagactgtata

SEQ ID NO: 5883132 - DNA, 21 bp, Homo sapiens
ctcagacttctattttttaaa

SEQ ID NO: 5883133 - DNA, 22 bp, Homo sapiens
ctcagacttctcttattcttta

SEQ ID NO: 5883134 - DNA, 15 bp, Homo sapiens
ctcagacttgccagg

SEQ ID NO: 5883135 - DNA, 17 bp, Homo sapiens
ctcagactttggaaaat

SEQ ID NO: 5883136 - DNA, 21 bp, Homo sapiens
ctcagagaaaaatgctcccca

SEQ ID NO: 5883137 - DNA, 23 bp, Homo sapiens
ctcagagaaaagagattgagatg

SEQ ID NO: 5883138 - DNA, 12 bp, Homo sapiens
ctcagagacacc

SEQ ID NO: 5883139 - DNA, 16 bp, Homo sapiens
ctcagagacaggtggc

SEQ ID NO: 5883140 - DNA, 22 bp, Homo sapiens
ctcagagacaggtggcctagca

SEQ ID NO: 5883141 - DNA, 17 bp, Homo sapiens
ctcagagacatgcagag

SEQ ID NO: 5883142 - DNA, 19 bp, Homo sapiens
ctcagagacatgcagagat

SEQ ID NO: 5883143 - DNA, 14 bp, Homo sapiens
ctcagagaccagca

SEQ ID NO: 5883144 - DNA, 15 bp, Homo sapiens
ctcagagaccagcac

SEQ ID NO: 5883145 - DNA, 23 bp, Homo sapiens
ctcagagaccagcactcagcctc

SEQ ID NO: 5883146 - DNA, 21 bp, Homo sapiens
ctcagagacctgaagtgtgca

SEQ ID NO: 5883147 - DNA, 15 bp, Homo sapiens
ctcagagagcaccat

SEQ ID NO: 5883148 - DNA, 20 bp, Homo sapiens
ctcagagaggacaaaataaa

SEQ ID NO: 5883149 - DNA, 15 bp, Homo sapiens
ctcagagagggcagg

SEQ ID NO: 5883150 - DNA, 14 bp, Homo sapiens
ctcagagagggtgg

SEQ ID NO: 5883151 - DNA, 12 bp, Homo sapiens
ctcagagagtac

SEQ ID NO: 5883152 - DNA, 18 bp, Homo sapiens
ctcagagagtacactgtg

SEQ ID NO: 5883153 - DNA, 19 bp, Homo sapiens
ctcagagagtacactgtgt

SEQ ID NO: 5883154 - DNA, 23 bp, Homo sapiens
ctcagagattcttgaagaatgaa

SEQ ID NO: 5883155 - DNA, 18 bp, Homo sapiens
ctcagagcaagcctttga

SEQ ID NO: 5883156 - DNA, 22 bp, Homo sapiens
ctcagagcaagcctttgacctg

SEQ ID NO: 5883157 - DNA, 14 bp, Homo sapiens
ctcagagcacagag

SEQ ID NO: 5883158 - DNA, 15 bp, Homo sapiens
ctcagagcacagagg

SEQ ID NO: 5883159 - DNA, 14 bp, Homo sapiens
ctcagagcacagcc

SEQ ID NO: 5883160 - DNA, 12 bp, Homo sapiens
ctcagagcagca

SEQ ID NO: 5883161 - DNA, 23 bp, Homo sapiens
ctcagagcaggctcagactctgg

SEQ ID NO: 5883162 - DNA, 16 bp, Homo sapiens
ctcagagcagggccaa

SEQ ID NO: 5883163 - DNA, 15 bp, Homo sapiens
ctcagagcatgatgg

SEQ ID NO: 5883164 - DNA, 11 bp, Homo sapiens
ctcagagccaa

SEQ ID NO: 5883165 - DNA, 12 bp, Homo sapiens
ctcagagccagt

SEQ ID NO: 5883166 - DNA, 12 bp, Homo sapiens
ctcagagcccat

SEQ ID NO: 5883167 - DNA, 15 bp, Homo sapiens
ctcagagccccgccc

SEQ ID NO: 5883168 - DNA, 19 bp, Homo sapiens
ctcagagcccctccctgct

SEQ ID NO: 5883169 - DNA, 19 bp, Homo sapiens
ctcagagccctgccctgca

SEQ ID NO: 5883170 - DNA, 16 bp, Homo sapiens
ctcagagcctcagctt

SEQ ID NO: 5883171 - DNA, 19 bp, Homo sapiens
ctcagagcctgacctgaga

SEQ ID NO: 5883172 - DNA, 20 bp, Homo sapiens
ctcagagcctgacctgagag

SEQ ID NO: 5883173 - DNA, 15 bp, Homo sapiens
ctcagagccttccat

SEQ ID NO: 5883174 - DNA, 18 bp, Homo sapiens
ctcagagcgccaggaagc

SEQ ID NO: 5883175 - DNA, 19 bp, Homo sapiens
ctcagagcgccaggaagcc

SEQ ID NO: 5883176 - DNA, 22 bp, Homo sapiens
ctcagagcgccaggaagccaga

SEQ ID NO: 5883177 - DNA, 23 bp, Homo sapiens
ctcagagcggatgggcacacaca

SEQ ID NO: 5883178 - DNA, 12 bp, Homo sapiens
ctcagagcttcc

SEQ ID NO: 5883179 - DNA, 19 bp, Homo sapiens
ctcagagcttcctggggac

SEQ ID NO: 5883180 - DNA, 21 bp, Homo sapiens
ctcagagcttcctggggacca

SEQ ID NO: 5883181 - DNA, 11 bp, Homo sapiens
ctcagagcttt

SEQ ID NO: 5883182 - DNA, 22 bp, Homo sapiens
ctcagagctttgtcacttgcca

SEQ ID NO: 5883183 - DNA, 18 bp, Homo sapiens
ctcagaggaccctttcca

SEQ ID NO: 5883184 - DNA, 16 bp, Homo sapiens
ctcagaggcagcttca

SEQ ID NO: 5883185 - DNA, 17 bp, Homo sapiens
ctcagaggcagcttcaa

SEQ ID NO: 5883186 - DNA, 22 bp, Homo sapiens
ctcagaggcagcttcaagtgcc

SEQ ID NO: 5883187 - DNA, 12 bp, Homo sapiens
ctcagaggccca

SEQ ID NO: 5883188 - DNA, 12 bp, Homo sapiens
ctcagaggcccc

SEQ ID NO: 5883189 - DNA, 13 bp, Homo sapiens
ctcagaggccccc

SEQ ID NO: 5883190 - DNA, 22 bp, Homo sapiens
ctcagaggccccttgctgctgg

SEQ ID NO: 5883191 - DNA, 19 bp, Homo sapiens
ctcagaggccgctctgggg

SEQ ID NO: 5883192 - DNA, 13 bp, Homo sapiens
ctcagaggcctgc

SEQ ID NO: 5883193 - DNA, 15 bp, Homo sapiens
ctcagaggcctgctg

SEQ ID NO: 5883194 - DNA, 23 bp, Homo sapiens
ctcagaggccttgctgtggagct

SEQ ID NO: 5883195 - DNA, 17 bp, Homo sapiens
ctcagaggctgacactg

SEQ ID NO: 5883196 - DNA, 23 bp, Homo sapiens
ctcagaggctgagccctgtaccc

SEQ ID NO: 5883197 - DNA, 22 bp, Homo sapiens
ctcagagggaaggctctctggt

SEQ ID NO: 5883198 - DNA, 20 bp, Homo sapiens
ctcagaggggccagctaacc

SEQ ID NO: 5883199 - DNA, 15 bp, Homo sapiens
ctcagaggggccccg

SEQ ID NO: 5883200 - DNA, 19 bp, Homo sapiens
ctcagaggggcctcatctt

SEQ ID NO: 5883201 - DNA, 17 bp, Homo sapiens
ctcagagggggactgct

SEQ ID NO: 5883202 - DNA, 17 bp, Homo sapiens
ctcagagggtccctagg

SEQ ID NO: 5883203 - DNA, 20 bp, Homo sapiens
ctcagaggtccaggccccca

SEQ ID NO: 5883204 - DNA, 15 bp, Homo sapiens
ctcagagtaggtggg

SEQ ID NO: 5883205 - DNA, 16 bp, Homo sapiens
ctcagagtatctttac

SEQ ID NO: 5883206 - DNA, 16 bp, Homo sapiens
ctcagagtatggagct

SEQ ID NO: 5883207 - DNA, 15 bp, Homo sapiens
ctcagagtccaatgt

SEQ ID NO: 5883208 - DNA, 19 bp, Homo sapiens
ctcagagtcccggcgttta

SEQ ID NO: 5883209 - DNA, 14 bp, Homo sapiens
ctcagagtgaagag

SEQ ID NO: 5883210 - DNA, 16 bp, Homo sapiens
ctcagagtgaagagtg

SEQ ID NO: 5883211 - DNA, 19 bp, Homo sapiens
ctcagagtgaagagtgaag

SEQ ID NO: 5883212 - DNA, 14 bp, Homo sapiens
ctcagagtgaccct

SEQ ID NO: 5883213 - DNA, 22 bp, Homo sapiens
ctcagagtgaccctcagctgtc

SEQ ID NO: 5883214 - DNA, 13 bp, Homo sapiens
ctcagagtgcaag

SEQ ID NO: 5883215 - DNA, 21 bp, Homo sapiens
ctcagagtggtgggggaaggc

SEQ ID NO: 5883216 - DNA, 22 bp, Homo sapiens
ctcagatagtctctttctctga

SEQ ID NO: 5883217 - DNA, 16 bp, Homo sapiens
ctcagatataagagaa

SEQ ID NO: 5883218 - DNA, 22 bp, Homo sapiens
ctcagatataagagaagtctca

SEQ ID NO: 5883219 - DNA, 21 bp, Homo sapiens
ctcagatatagatcctgagct

SEQ ID NO: 5883220 - DNA, 22 bp, Homo sapiens
ctcagatatagatcctgagctc

SEQ ID NO: 5883221 - DNA, 21 bp, Homo sapiens
ctcagatcagtgtaccatttg

SEQ ID NO: 5883222 - DNA, 10 bp, Homo sapiens
ctcagatcca

SEQ ID NO: 5883223 - DNA, 14 bp, Homo sapiens
ctcagatccaggga

SEQ ID NO: 5883224 - DNA, 13 bp, Homo sapiens
ctcagatcccagg

SEQ ID NO: 5883225 - DNA, 18 bp, Homo sapiens
ctcagatcccagggtaca

SEQ ID NO: 5883226 - DNA, 22 bp, Homo sapiens
ctcagatccctcggtcagcacc

SEQ ID NO: 5883227 - DNA, 14 bp, Homo sapiens
ctcagatcctcctc

SEQ ID NO: 5883228 - DNA, 16 bp, Homo sapiens
ctcagatcctgggcat

SEQ ID NO: 5883229 - DNA, 19 bp, Homo sapiens
ctcagatccttgtttcaaa

SEQ ID NO: 5883230 - DNA, 15 bp, Homo sapiens
ctcagatctgcactc

SEQ ID NO: 5883231 - DNA, 18 bp, Homo sapiens
ctcagatctgtctgatag

SEQ ID NO: 5883232 - DNA, 15 bp, Homo sapiens
ctcagatcttctgtg

SEQ ID NO: 5883233 - DNA, 16 bp, Homo sapiens
ctcagatcttctgtgg

SEQ ID NO: 5883234 - DNA, 16 bp, Homo sapiens
ctcagatcttgacagt

SEQ ID NO: 5883235 - DNA, 20 bp, Homo sapiens
ctcagatgaaaataaaataa

SEQ ID NO: 5883236 - DNA, 16 bp, Homo sapiens
ctcagatgaggacaga

SEQ ID NO: 5883237 - DNA, 20 bp, Homo sapiens
ctcagatgatctctccacgg

SEQ ID NO: 5883238 - DNA, 19 bp, Homo sapiens
ctcagatgatgccagctgt

SEQ ID NO: 5883239 - DNA, 23 bp, Homo sapiens
ctcagatgatggggtcagcaggc

SEQ ID NO: 5883240 - DNA, 21 bp, Homo sapiens
ctcagatgcacatgagctggc

SEQ ID NO: 5883241 - DNA, 16 bp, Homo sapiens
ctcagatgccggagcc

SEQ ID NO: 5883242 - DNA, 23 bp, Homo sapiens
ctcagatgctggtcatcctgggc

SEQ ID NO: 5883243 - DNA, 22 bp, Homo sapiens
ctcagatggaaccgcaggaagc

SEQ ID NO: 5883244 - DNA, 16 bp, Homo sapiens
ctcagatggactggga

SEQ ID NO: 5883245 - DNA, 18 bp, Homo sapiens
ctcagatggactgggagg

SEQ ID NO: 5883246 - DNA, 22 bp, Homo sapiens
ctcagatggactgggaggaggg

SEQ ID NO: 5883247 - DNA, 14 bp, Homo sapiens
ctcagatggcagct

SEQ ID NO: 5883248 - DNA, 16 bp, Homo sapiens
ctcagatggcagcttt

SEQ ID NO: 5883249 - DNA, 21 bp, Homo sapiens
ctcagatggcagcttttaaaa

SEQ ID NO: 5883250 - DNA, 17 bp, Homo sapiens
ctcagatggggcctggg

SEQ ID NO: 5883251 - DNA, 21 bp, Homo sapiens
ctcagatggggcctgggctgt

SEQ ID NO: 5883252 - DNA, 22 bp, Homo sapiens
ctcagatggtgtgtccagcact

SEQ ID NO: 5883253 - DNA, 23 bp, Homo sapiens
ctcagatgtcccttgatgcacag

SEQ ID NO: 5883254 - DNA, 13 bp, Homo sapiens
ctcagatgttaaa

SEQ ID NO: 5883255 - DNA, 14 bp, Homo sapiens
ctcagatgttaaaa

SEQ ID NO: 5883256 - DNA, 17 bp, Homo sapiens
ctcagatgttaaaataa

SEQ ID NO: 5883257 - DNA, 19 bp, Homo sapiens
ctcagatgttaaaataaat

SEQ ID NO: 5883258 - DNA, 15 bp, Homo sapiens
ctcagattacacttc

SEQ ID NO: 5883259 - DNA, 17 bp, Homo sapiens
ctcagattccttcccat

SEQ ID NO: 5883260 - DNA, 24 bp, Homo sapiens
ctcagattccttcccatggaggga

SEQ ID NO: 5883261 - DNA, 15 bp, Homo sapiens
ctcagattcctttgt

SEQ ID NO: 5883262 - DNA, 12 bp, Homo sapiens
ctcagattcttc

SEQ ID NO: 5883263 - DNA, 23 bp, Homo sapiens
ctcagattcttcattgaggattg

SEQ ID NO: 5883264 - DNA, 14 bp, Homo sapiens
ctcagattgctgaa

SEQ ID NO: 5883265 - DNA, 13 bp, Homo sapiens
ctcagatttaaaa

SEQ ID NO: 5883266 - DNA, 18 bp, Homo sapiens
ctcagatttccacagaga

SEQ ID NO: 5883267 - DNA, 16 bp, Homo sapiens
ctcagatttctgagga

SEQ ID NO: 5883268 - DNA, 13 bp, Homo sapiens
ctcagattttata

SEQ ID NO: 5883269 - DNA, 22 bp, Homo sapiens
ctcagattttattatgtaaatc

SEQ ID NO: 5883270 - DNA, 14 bp, Homo sapiens
ctcagatttttcct

SEQ ID NO: 5883271 - DNA, 21 bp, Homo sapiens
ctcagcaaaagatgcttctca

SEQ ID NO: 5883272 - DNA, 17 bp, Homo sapiens
ctcagcaaacccaaaga

SEQ ID NO: 5883273 - DNA, 16 bp, Homo sapiens
ctcagcaaagctacag

SEQ ID NO: 5883274 - DNA, 20 bp, Homo sapiens
ctcagcaaagctacaggact

SEQ ID NO: 5883275 - DNA, 21 bp, Homo sapiens
ctcagcaaagtagaatctctt

SEQ ID NO: 5883276 - DNA, 16 bp, Homo sapiens
ctcagcaaatcctctt

SEQ ID NO: 5883277 - DNA, 15 bp, Homo sapiens
ctcagcaaattcttg

SEQ ID NO: 5883278 - DNA, 16 bp, Homo sapiens
ctcagcaaattcttga

SEQ ID NO: 5883279 - DNA, 22 bp, Homo sapiens
ctcagcaactgttagctgggaa

SEQ ID NO: 5883280 - DNA, 15 bp, Homo sapiens
ctcagcaactttccc

SEQ ID NO: 5883281 - DNA, 18 bp, Homo sapiens
ctcagcaagctgcccagc

SEQ ID NO: 5883282 - DNA, 20 bp, Homo sapiens
ctcagcaagctgcccagccc

SEQ ID NO: 5883283 - DNA, 21 bp, Homo sapiens
ctcagcaagctgcccagccct

SEQ ID NO: 5883284 - DNA, 22 bp, Homo sapiens
ctcagcaagctgcccagccctg

SEQ ID NO: 5883285 - DNA, 13 bp, Homo sapiens
ctcagcaaggcca

SEQ ID NO: 5883286 - DNA, 18 bp, Homo sapiens
ctcagcaaggccacctct

SEQ ID NO: 5883287 - DNA, 21 bp, Homo sapiens
ctcagcaaggccacctcttcc

SEQ ID NO: 5883288 - DNA, 23 bp, Homo sapiens
ctcagcaaggggctgcttctggg

SEQ ID NO: 5883289 - DNA, 18 bp, Homo sapiens
ctcagcaagtgcccagtg

SEQ ID NO: 5883290 - DNA, 14 bp, Homo sapiens
ctcagcaagtgctg

SEQ ID NO: 5883291 - DNA, 13 bp, Homo sapiens
ctcagcaagtgta

SEQ ID NO: 5883292 - DNA, 14 bp, Homo sapiens
ctcagcaagtgtac

SEQ ID NO: 5883293 - DNA, 20 bp, Homo sapiens
ctcagcacaattatgtgtga

SEQ ID NO: 5883294 - DNA, 21 bp, Homo sapiens
ctcagcacacatgcatcctcc

SEQ ID NO: 5883295 - DNA, 12 bp, Homo sapiens
ctcagcacagcc

SEQ ID NO: 5883296 - DNA, 13 bp, Homo sapiens
ctcagcacagcct

SEQ ID NO: 5883297 - DNA, 21 bp, Homo sapiens
ctcagcacagcctcacccctg

SEQ ID NO: 5883298 - DNA, 17 bp, Homo sapiens
ctcagcaccacattgcc

SEQ ID NO: 5883299 - DNA, 20 bp, Homo sapiens
ctcagcaccacattgcctca

SEQ ID NO: 5883300 - DNA, 14 bp, Homo sapiens
ctcagcaccactca

SEQ ID NO: 5883301 - DNA, 17 bp, Homo sapiens
ctcagcaccccactcct

SEQ ID NO: 5883302 - DNA, 12 bp, Homo sapiens
ctcagcacccct

SEQ ID NO: 5883303 - DNA, 14 bp, Homo sapiens
ctcagcacccctcc

SEQ ID NO: 5883304 - DNA, 13 bp, Homo sapiens
ctcagcacccctt

SEQ ID NO: 5883305 - DNA, 16 bp, Homo sapiens
ctcagcaccccttcca

SEQ ID NO: 5883306 - DNA, 20 bp, Homo sapiens
ctcagcaccccttccatgtg

SEQ ID NO: 5883307 - DNA, 15 bp, Homo sapiens
ctcagcactgcctgc

SEQ ID NO: 5883308 - DNA, 23 bp, Homo sapiens
ctcagcactgtttgaagattgcc

SEQ ID NO: 5883309 - DNA, 13 bp, Homo sapiens
ctcagcacttggc

SEQ ID NO: 5883310 - DNA, 14 bp, Homo sapiens
ctcagcacttggcc

SEQ ID NO: 5883311 - DNA, 16 bp, Homo sapiens
ctcagcacttggccct

SEQ ID NO: 5883312 - DNA, 13 bp, Homo sapiens
ctcagcagaaggc

SEQ ID NO: 5883313 - DNA, 22 bp, Homo sapiens
ctcagcagacatccacacacag

SEQ ID NO: 5883314 - DNA, 16 bp, Homo sapiens
ctcagcagacatttat

SEQ ID NO: 5883315 - DNA, 11 bp, Homo sapiens
ctcagcagagt

SEQ ID NO: 5883316 - DNA, 13 bp, Homo sapiens
ctcagcagagtgc

SEQ ID NO: 5883317 - DNA, 19 bp, Homo sapiens
ctcagcagcagagagccct

SEQ ID NO: 5883318 - DNA, 12 bp, Homo sapiens
ctcagcagccag

SEQ ID NO: 5883319 - DNA, 17 bp, Homo sapiens
ctcagcagccagctcct

SEQ ID NO: 5883320 - DNA, 14 bp, Homo sapiens
ctcagcagccagtc

SEQ ID NO: 5883321 - DNA, 23 bp, Homo sapiens
ctcagcagccagtctcagagacc

SEQ ID NO: 5883322 - DNA, 13 bp, Homo sapiens
ctcagcagcccca

SEQ ID NO: 5883323 - DNA, 13 bp, Homo sapiens
ctcagcagccctc

SEQ ID NO: 5883324 - DNA, 21 bp, Homo sapiens
ctcagcagccctcctcacccc

SEQ ID NO: 5883325 - DNA, 23 bp, Homo sapiens
ctcagcagcctgcgctcggcagg

SEQ ID NO: 5883326 - DNA, 19 bp, Homo sapiens
ctcagcagcgaccacccct

SEQ ID NO: 5883327 - DNA, 20 bp, Homo sapiens
ctcagcagctggtaatcttg

SEQ ID NO: 5883328 - DNA, 14 bp, Homo sapiens
ctcagcaggaacct

SEQ ID NO: 5883329 - DNA, 16 bp, Homo sapiens
ctcagcaggaacctgt

SEQ ID NO: 5883330 - DNA, 12 bp, Homo sapiens
ctcagcagggca

SEQ ID NO: 5883331 - DNA, 17 bp, Homo sapiens
ctcagcagggctggtca

SEQ ID NO: 5883332 - DNA, 23 bp, Homo sapiens
ctcagcagggctggtcacctccc

SEQ ID NO: 5883333 - DNA, 16 bp, Homo sapiens
ctcagcaggggagggt

SEQ ID NO: 5883334 - DNA, 17 bp, Homo sapiens
ctcagcagtaagcaggc

SEQ ID NO: 5883335 - DNA, 17 bp, Homo sapiens
ctcagcagtgagagcag

SEQ ID NO: 5883336 - DNA, 12 bp, Homo sapiens
ctcagcagttca

SEQ ID NO: 5883337 - DNA, 14 bp, Homo sapiens
ctcagcagttcact

SEQ ID NO: 5883338 - DNA, 18 bp, Homo sapiens
ctcagcagttgacatcca

SEQ ID NO: 5883339 - DNA, 16 bp, Homo sapiens
ctcagcataagtaaac

SEQ ID NO: 5883340 - DNA, 14 bp, Homo sapiens
ctcagcatatatat

SEQ ID NO: 5883341 - DNA, 13 bp, Homo sapiens
ctcagcatcctcc

SEQ ID NO: 5883342 - DNA, 13 bp, Homo sapiens
ctcagcatcctgg

SEQ ID NO: 5883343 - DNA, 18 bp, Homo sapiens
ctcagcatcctggaaatt

SEQ ID NO: 5883344 - DNA, 23 bp, Homo sapiens
ctcagcatcctggaaatttgtgt

SEQ ID NO: 5883345 - DNA, 21 bp, Homo sapiens
ctcagcatcctggcacccggc

SEQ ID NO: 5883346 - DNA, 21 bp, Homo sapiens
ctcagcatgcagaagtgcatg

SEQ ID NO: 5883347 - DNA, 17 bp, Homo sapiens
ctcagcatttccttcca

SEQ ID NO: 5883348 - DNA, 19 bp, Homo sapiens
ctcagcatttccttgtccc

SEQ ID NO: 5883349 - DNA, 21 bp, Homo sapiens
ctcagcatttccttgtcccgt

SEQ ID NO: 5883350 - DNA, 14 bp, Homo sapiens
ctcagccaagcttg

SEQ ID NO: 5883351 - DNA, 20 bp, Homo sapiens
ctcagccacaaaactctgtc

SEQ ID NO: 5883352 - DNA, 20 bp, Homo sapiens
ctcagccacaaaccctgcct

SEQ ID NO: 5883353 - DNA, 20 bp, Homo sapiens
ctcagccacaaagcccccca

SEQ ID NO: 5883354 - DNA, 13 bp, Homo sapiens
ctcagccacaccc

SEQ ID NO: 5883355 - DNA, 15 bp, Homo sapiens
ctcagccaccctgag

SEQ ID NO: 5883356 - DNA, 13 bp, Homo sapiens
ctcagccaccctt

SEQ ID NO: 5883357 - DNA, 13 bp, Homo sapiens
ctcagccacgacc

SEQ ID NO: 5883358 - DNA, 16 bp, Homo sapiens
ctcagccacgaccagc

SEQ ID NO: 5883359 - DNA, 18 bp, Homo sapiens
ctcagccacgaccagccc

SEQ ID NO: 5883360 - DNA, 13 bp, Homo sapiens
ctcagccacgcct

SEQ ID NO: 5883361 - DNA, 12 bp, Homo sapiens
ctcagccagaga

SEQ ID NO: 5883362 - DNA, 14 bp, Homo sapiens
ctcagccagagaag

SEQ ID NO: 5883363 - DNA, 11 bp, Homo sapiens
ctcagccagca

SEQ ID NO: 5883364 - DNA, 11 bp, Homo sapiens
ctcagccagcc

SEQ ID NO: 5883365 - DNA, 16 bp, Homo sapiens
ctcagccagccctgga

SEQ ID NO: 5883366 - DNA, 18 bp, Homo sapiens
ctcagccagccctggagg

SEQ ID NO: 5883367 - DNA, 13 bp, Homo sapiens
ctcagccagcctc

SEQ ID NO: 5883368 - DNA, 15 bp, Homo sapiens
ctcagccagcctcct

SEQ ID NO: 5883369 - DNA, 22 bp, Homo sapiens
ctcagccagcctccttgtgaga

SEQ ID NO: 5883370 - DNA, 18 bp, Homo sapiens
ctcagccagctgcccaca

SEQ ID NO: 5883371 - DNA, 11 bp, Homo sapiens
ctcagccaggc

SEQ ID NO: 5883372 - DNA, 13 bp, Homo sapiens
ctcagccaggccc

SEQ ID NO: 5883373 - DNA, 16 bp, Homo sapiens
ctcagccagtggcaca

SEQ ID NO: 5883374 - DNA, 17 bp, Homo sapiens
ctcagccagtggcacag

SEQ ID NO: 5883375 - DNA, 15 bp, Homo sapiens
ctcagccatgaggag

SEQ ID NO: 5883376 - DNA, 21 bp, Homo sapiens
ctcagccatgaggagttgctg

SEQ ID NO: 5883377 - DNA, 23 bp, Homo sapiens
ctcagccattctctacccatcct

SEQ ID NO: 5883378 - DNA, 16 bp, Homo sapiens
ctcagccatttccccc

SEQ ID NO: 5883379 - DNA, 21 bp, Homo sapiens
ctcagcccaacttcttacccg

SEQ ID NO: 5883380 - DNA, 19 bp, Homo sapiens
ctcagcccacatagtgatg

SEQ ID NO: 5883381 - DNA, 19 bp, Homo sapiens
ctcagcccacccccctcat

SEQ ID NO: 5883382 - DNA, 14 bp, Homo sapiens
ctcagcccacctgc

SEQ ID NO: 5883383 - DNA, 18 bp, Homo sapiens
ctcagcccacctgcaccc

SEQ ID NO: 5883384 - DNA, 20 bp, Homo sapiens
ctcagcccacctgcacccag

SEQ ID NO: 5883385 - DNA, 11 bp, Homo sapiens
ctcagcccagc

SEQ ID NO: 5883386 - DNA, 12 bp, Homo sapiens
ctcagcccagct

SEQ ID NO: 5883387 - DNA, 16 bp, Homo sapiens
ctcagcccagctggcc

SEQ ID NO: 5883388 - DNA, 15 bp, Homo sapiens
ctcagcccaggcaca

SEQ ID NO: 5883389 - DNA, 19 bp, Homo sapiens
ctcagcccaggtctcctgg

SEQ ID NO: 5883390 - DNA, 22 bp, Homo sapiens
ctcagccccaaacacccaccca

SEQ ID NO: 5883391 - DNA, 17 bp, Homo sapiens
ctcagccccaactcttt

SEQ ID NO: 5883392 - DNA, 20 bp, Homo sapiens
ctcagccccaactctttatc

SEQ ID NO: 5883393 - DNA, 17 bp, Homo sapiens
ctcagccccagcccaga

SEQ ID NO: 5883394 - DNA, 13 bp, Homo sapiens
ctcagccccagga

SEQ ID NO: 5883395 - DNA, 18 bp, Homo sapiens
ctcagccccaggagaagg

SEQ ID NO: 5883396 - DNA, 22 bp, Homo sapiens
ctcagccccaggagaagggaca

SEQ ID NO: 5883397 - DNA, 14 bp, Homo sapiens
ctcagccccaggcc

SEQ ID NO: 5883398 - DNA, 15 bp, Homo sapiens
ctcagccccaggcca

SEQ ID NO: 5883399 - DNA, 17 bp, Homo sapiens
ctcagccccaggccagc

SEQ ID NO: 5883400 - DNA, 19 bp, Homo sapiens
ctcagccccaggccagctg

SEQ ID NO: 5883401 - DNA, 20 bp, Homo sapiens
ctcagccccaggccagctgc

SEQ ID NO: 5883402 - DNA, 15 bp, Homo sapiens
ctcagccccagggcc

SEQ ID NO: 5883403 - DNA, 16 bp, Homo sapiens
ctcagccccagggccc

SEQ ID NO: 5883404 - DNA, 23 bp, Homo sapiens
ctcagccccagggccctgctcag

SEQ ID NO: 5883405 - DNA, 15 bp, Homo sapiens
ctcagccccatcgcc

SEQ ID NO: 5883406 - DNA, 18 bp, Homo sapiens
ctcagccccctgcttcag

SEQ ID NO: 5883407 - DNA, 19 bp, Homo sapiens
ctcagccccgagctgtccc

SEQ ID NO: 5883408 - DNA, 21 bp, Homo sapiens
ctcagccccgggcctgcctct

SEQ ID NO: 5883409 - DNA, 11 bp, Homo sapiens
ctcagccccta

SEQ ID NO: 5883410 - DNA, 16 bp, Homo sapiens
ctcagcccctacccct

SEQ ID NO: 5883411 - DNA, 17 bp, Homo sapiens
ctcagcccctacccctg

SEQ ID NO: 5883412 - DNA, 12 bp, Homo sapiens
ctcagcccctag

SEQ ID NO: 5883413 - DNA, 23 bp, Homo sapiens
ctcagcccctaggagtatatttc

SEQ ID NO: 5883414 - DNA, 11 bp, Homo sapiens
ctcagcccctc

SEQ ID NO: 5883415 - DNA, 13 bp, Homo sapiens
ctcagcccctctt

SEQ ID NO: 5883416 - DNA, 16 bp, Homo sapiens
ctcagcccctcttgcc

SEQ ID NO: 5883417 - DNA, 14 bp, Homo sapiens
ctcagccccttccc

SEQ ID NO: 5883418 - DNA, 16 bp, Homo sapiens
ctcagcccgctgagtg

SEQ ID NO: 5883419 - DNA, 16 bp, Homo sapiens
ctcagcccgcttggcc

SEQ ID NO: 5883420 - DNA, 17 bp, Homo sapiens
ctcagcccgcttggcca

SEQ ID NO: 5883421 - DNA, 16 bp, Homo sapiens
ctcagcccgggatcct

SEQ ID NO: 5883422 - DNA, 21 bp, Homo sapiens
ctcagccctagaggcgagcca

SEQ ID NO: 5883423 - DNA, 17 bp, Homo sapiens
ctcagccctcacacacc

SEQ ID NO: 5883424 - DNA, 12 bp, Homo sapiens
ctcagccctcag

SEQ ID NO: 5883425 - DNA, 16 bp, Homo sapiens
ctcagccctcagaaca

SEQ ID NO: 5883426 - DNA, 14 bp, Homo sapiens
ctcagccctcagtt

SEQ ID NO: 5883427 - DNA, 16 bp, Homo sapiens
ctcagccctcattaaa

SEQ ID NO: 5883428 - DNA, 20 bp, Homo sapiens
ctcagccctcattaaactaa

SEQ ID NO: 5883429 - DNA, 20 bp, Homo sapiens
ctcagccctccatggcctgg

SEQ ID NO: 5883430 - DNA, 16 bp, Homo sapiens
ctcagccctctcttgc

SEQ ID NO: 5883431 - DNA, 14 bp, Homo sapiens
ctcagccctgaccc

SEQ ID NO: 5883432 - DNA, 14 bp, Homo sapiens
ctcagccctgagct

SEQ ID NO: 5883433 - DNA, 15 bp, Homo sapiens
ctcagccctgagctg

SEQ ID NO: 5883434 - DNA, 17 bp, Homo sapiens
ctcagccctgagctggc

SEQ ID NO: 5883435 - DNA, 20 bp, Homo sapiens
ctcagccctgagctggcctc

SEQ ID NO: 5883436 - DNA, 13 bp, Homo sapiens
ctcaggcctcacc

SEQ ID NO: 5883437 - DNA, 14 bp, Homo sapiens
ctcaggcctcacct

SEQ ID NO: 5883438 - DNA, 20 bp, Homo sapiens
ctcaggcctcacctcccagg

SEQ ID NO: 5883439 - DNA, 22 bp, Homo sapiens
ctcaggcctcacctcccagggc

SEQ ID NO: 5883440 - DNA, 19 bp, Homo sapiens
ctcaggcctcacctggctt

SEQ ID NO: 5883441 - DNA, 13 bp, Homo sapiens
ctcaggcctccca

SEQ ID NO: 5883442 - DNA, 15 bp, Homo sapiens
ctcaggcctctgcag

SEQ ID NO: 5883443 - DNA, 16 bp, Homo sapiens
ctcaggcctctgcaga

SEQ ID NO: 5883444 - DNA, 17 bp, Homo sapiens
ctcaggcctggcccttt

SEQ ID NO: 5883445 - DNA, 18 bp, Homo sapiens
ctcaggcctggccctttc

SEQ ID NO: 5883446 - DNA, 19 bp, Homo sapiens
ctcaggcctggccctttca

SEQ ID NO: 5883447 - DNA, 13 bp, Homo sapiens
ctcaggcctgtgc

SEQ ID NO: 5883448 - DNA, 23 bp, Homo sapiens
ctcaggcctgtgcccactcccta

SEQ ID NO: 5883449 - DNA, 20 bp, Homo sapiens
ctcaggcgatccacctgtct

SEQ ID NO: 5883450 - DNA, 15 bp, Homo sapiens
ctcaggcgcagccct

SEQ ID NO: 5883451 - DNA, 17 bp, Homo sapiens
ctcaggcgcctggcaca

SEQ ID NO: 5883452 - DNA, 22 bp, Homo sapiens
ctcaggcgcctggcacatttca

SEQ ID NO: 5883453 - DNA, 21 bp, Homo sapiens
ctcaggcgggacagtgctgca

SEQ ID NO: 5883454 - DNA, 22 bp, Homo sapiens
ctcaggcggggaggaggagctg

SEQ ID NO: 5883455 - DNA, 15 bp, Homo sapiens
ctcaggctaggccag

SEQ ID NO: 5883456 - DNA, 20 bp, Homo sapiens
ctcaggctaggccagcaggg

SEQ ID NO: 5883457 - DNA, 21 bp, Homo sapiens
ctcaggctaggccagcagggg

SEQ ID NO: 5883458 - DNA, 18 bp, Homo sapiens
ctcaggctcaagttttta

SEQ ID NO: 5883459 - DNA, 14 bp, Homo sapiens
ctcaggctccccag

SEQ ID NO: 5883460 - DNA, 15 bp, Homo sapiens
ctcaggctccccagt

SEQ ID NO: 5883461 - DNA, 22 bp, Homo sapiens
ctcaggctccgggcaccagggg

SEQ ID NO: 5883462 - DNA, 14 bp, Homo sapiens
ctcaggctctgctg

SEQ ID NO: 5883463 - DNA, 20 bp, Homo sapiens
ctcaggctctgctggtggaa

SEQ ID NO: 5883464 - DNA, 14 bp, Homo sapiens
ctcaggctctgtgg

SEQ ID NO: 5883465 - DNA, 12 bp, Homo sapiens
ctcaggctcttg

SEQ ID NO: 5883466 - DNA, 17 bp, Homo sapiens
ctcaggctgaccacttt

SEQ ID NO: 5883467 - DNA, 16 bp, Homo sapiens
ctcaggctgagcccag

SEQ ID NO: 5883468 - DNA, 19 bp, Homo sapiens
ctcaggctgagcccagcca

SEQ ID NO: 5883469 - DNA, 21 bp, Homo sapiens
ctcaggctgagcccagccacc

SEQ ID NO: 5883470 - DNA, 18 bp, Homo sapiens
ctcaggctgcagctggac

SEQ ID NO: 5883471 - DNA, 22 bp, Homo sapiens
ctcaggctgcagctggacagag

SEQ ID NO: 5883472 - DNA, 13 bp, Homo sapiens
ctcaggctgccca

SEQ ID NO: 5883473 - DNA, 21 bp, Homo sapiens
ctcaggctgcctgagtcgtga

SEQ ID NO: 5883474 - DNA, 14 bp, Homo sapiens
ctcaggctgctgct

SEQ ID NO: 5883475 - DNA, 13 bp, Homo sapiens
ctcaggctggagt

SEQ ID NO: 5883476 - DNA, 17 bp, Homo sapiens
ctcaggctggtgggagg

SEQ ID NO: 5883477 - DNA, 22 bp, Homo sapiens
ctcaggctgtgcttacctgtga

SEQ ID NO: 5883478 - DNA, 17 bp, Homo sapiens
ctcaggcttccttggca

SEQ ID NO: 5883479 - DNA, 13 bp, Homo sapiens
ctcaggcttctca

SEQ ID NO: 5883480 - DNA, 15 bp, Homo sapiens
ctcaggcttgaaatg

SEQ ID NO: 5883481 - DNA, 18 bp, Homo sapiens
ctcaggcttgagggaggg

SEQ ID NO: 5883482 - DNA, 22 bp, Homo sapiens
ctcaggctttcactatttcctt

SEQ ID NO: 5883483 - DNA, 13 bp, Homo sapiens
ctcaggctttcta

SEQ ID NO: 5883484 - DNA, 14 bp, Homo sapiens
ctcaggctttctat

SEQ ID NO: 5883485 - DNA, 13 bp, Homo sapiens
ctcagggaaagca

SEQ ID NO: 5883486 - DNA, 17 bp, Homo sapiens
ctcagggaaaggccagt

SEQ ID NO: 5883487 - DNA, 20 bp, Homo sapiens
ctcagggaaatggccttccc

SEQ ID NO: 5883488 - DNA, 21 bp, Homo sapiens
ctcagggaaatggccttcccg

SEQ ID NO: 5883489 - DNA, 16 bp, Homo sapiens
ctcagggaactgaccc

SEQ ID NO: 5883490 - DNA, 19 bp, Homo sapiens
ctcagggaagcccagctcc

SEQ ID NO: 5883491 - DNA, 17 bp, Homo sapiens
ctcagggaccacagcaa

SEQ ID NO: 5883492 - DNA, 17 bp, Homo sapiens
ctcagggaccatggctt

SEQ ID NO: 5883493 - DNA, 21 bp, Homo sapiens
ctcagggagcagggaaggcct

SEQ ID NO: 5883494 - DNA, 23 bp, Homo sapiens
ctcagggagcagggaaggcctga

SEQ ID NO: 5883495 - DNA, 13 bp, Homo sapiens
ctcagggagcgat

SEQ ID NO: 5883496 - DNA, 16 bp, Homo sapiens
ctcagggatcttctcc

SEQ ID NO: 5883497 - DNA, 15 bp, Homo sapiens
ctcagggatggaggg

SEQ ID NO: 5883498 - DNA, 22 bp, Homo sapiens
ctcagggatggagggaagacct

SEQ ID NO: 5883499 - DNA, 22 bp, Homo sapiens
ctcagggatgtgggaatctccc

SEQ ID NO: 5883500 - DNA, 18 bp, Homo sapiens
ctcagggattctgggctt

SEQ ID NO: 5883501 - DNA, 10 bp, Homo sapiens
ctcagggcac

SEQ ID NO: 5883502 - DNA, 14 bp, Homo sapiens
ctcagggcacgcag

SEQ ID NO: 5883503 - DNA, 14 bp, Homo sapiens
ctcagggcagacag

SEQ ID NO: 5883504 - DNA, 14 bp, Homo sapiens
ctcagggcagcctc

SEQ ID NO: 5883505 - DNA, 21 bp, Homo sapiens
ctcagggcagcctcccccggc

SEQ ID NO: 5883506 - DNA, 14 bp, Homo sapiens
ctcagggcagctgc

SEQ ID NO: 5883507 - DNA, 15 bp, Homo sapiens
ctcagggcagctgcc

SEQ ID NO: 5883508 - DNA, 18 bp, Homo sapiens
ctcagggcagctgcctgg

SEQ ID NO: 5883509 - DNA, 17 bp, Homo sapiens
ctcagggcagctgtgct

SEQ ID NO: 5883510 - DNA, 22 bp, Homo sapiens
ctcagggcagtggcttctttcc

SEQ ID NO: 5883511 - DNA, 14 bp, Homo sapiens
ctcagggccaagcc

SEQ ID NO: 5883512 - DNA, 16 bp, Homo sapiens
ctcagggccaagccgg

SEQ ID NO: 5883513 - DNA, 17 bp, Homo sapiens
ctcagggccaagccggc

SEQ ID NO: 5883514 - DNA, 18 bp, Homo sapiens
ctcagggccaagccggcc

SEQ ID NO: 5883515 - DNA, 22 bp, Homo sapiens
ctcagggccaagccggcccaac

SEQ ID NO: 5883516 - DNA, 12 bp, Homo sapiens
ctcagggccagg

SEQ ID NO: 5883517 - DNA, 14 bp, Homo sapiens
ctcagggccaggaa

SEQ ID NO: 5883518 - DNA, 15 bp, Homo sapiens
ctcagggccaggaag

SEQ ID NO: 5883519 - DNA, 19 bp, Homo sapiens
ctcagggccatgctgaggc

SEQ ID NO: 5883520 - DNA, 20 bp, Homo sapiens
ctcagggccatgctgaggcc

SEQ ID NO: 5883521 - DNA, 17 bp, Homo sapiens
ctcagggcccacctcct

SEQ ID NO: 5883522 - DNA, 12 bp, Homo sapiens
ctcagggcccca

SEQ ID NO: 5883523 - DNA, 13 bp, Homo sapiens
ctcagggccccag

SEQ ID NO: 5883524 - DNA, 16 bp, Homo sapiens
ctcagggccctgtgcc

SEQ ID NO: 5883525 - DNA, 13 bp, Homo sapiens
ctcagggcctggc

SEQ ID NO: 5883526 - DNA, 19 bp, Homo sapiens
ctcagggcctggcaggcca

SEQ ID NO: 5883527 - DNA, 14 bp, Homo sapiens
ctcagggcctggtc

SEQ ID NO: 5883528 - DNA, 14 bp, Homo sapiens
ctcagggcgctcag

SEQ ID NO: 5883529 - DNA, 16 bp, Homo sapiens
ctcagggcgctcagac

SEQ ID NO: 5883530 - DNA, 16 bp, Homo sapiens
ctcagggctcccaggg

SEQ ID NO: 5883531 - DNA, 15 bp, Homo sapiens
ctcagggctcctccc

SEQ ID NO: 5883532 - DNA, 16 bp, Homo sapiens
ctcagggctcctccca

SEQ ID NO: 5883533 - DNA, 21 bp, Homo sapiens
ctcagggctcctcccagcttg

SEQ ID NO: 5883534 - DNA, 13 bp, Homo sapiens
ctcagggctcctg

SEQ ID NO: 5883535 - DNA, 22 bp, Homo sapiens
ctcagggctcctgccttctgtc

SEQ ID NO: 5883536 - DNA, 14 bp, Homo sapiens
ctcagggctccttg

SEQ ID NO: 5883537 - DNA, 11 bp, Homo sapiens
ctcagggctgg

SEQ ID NO: 5883538 - DNA, 19 bp, Homo sapiens
ctcagggctggagcctggg

SEQ ID NO: 5883539 - DNA, 23 bp, Homo sapiens
ctcagggctggagcctggggtgt

SEQ ID NO: 5883540 - DNA, 20 bp, Homo sapiens
ctcagggctggattggcagg

SEQ ID NO: 5883541 - DNA, 23 bp, Homo sapiens
ctcagggctggattggcaggtgt

SEQ ID NO: 5883542 - DNA, 13 bp, Homo sapiens
ctcagggctgtcc

SEQ ID NO: 5883543 - DNA, 20 bp, Homo sapiens
ctcagggctgtcccagcccc

SEQ ID NO: 5883544 - DNA, 22 bp, Homo sapiens
ctcagggctgtcccagccccgg

SEQ ID NO: 5883545 - DNA, 13 bp, Homo sapiens
ctcagggcttcct

SEQ ID NO: 5883546 - DNA, 18 bp, Homo sapiens
ctcagggcttctcctctg

SEQ ID NO: 5883547 - DNA, 24 bp, Homo sapiens
ctcagggcttctcctctgctaggc

SEQ ID NO: 5883548 - DNA, 18 bp, Homo sapiens
ctcaggggaaaactgtta

SEQ ID NO: 5883549 - DNA, 15 bp, Homo sapiens
ctcaggggaagctgc

SEQ ID NO: 5883550 - DNA, 22 bp, Homo sapiens
ctcaggggaagctgctagggga

SEQ ID NO: 5883551 - DNA, 21 bp, Homo sapiens
ctcaggggacaatctcccctc

SEQ ID NO: 5883552 - DNA, 21 bp, Homo sapiens
ctcaggggacactggccccac

SEQ ID NO: 5883553 - DNA, 18 bp, Homo sapiens
ctcaggggaccccactcc

SEQ ID NO: 5883554 - DNA, 12 bp, Homo sapiens
ctcaggggagac

SEQ ID NO: 5883555 - DNA, 23 bp, Homo sapiens
ctcaggggagacttaggccagag

SEQ ID NO: 5883556 - DNA, 14 bp, Homo sapiens
ctcaggggatgttt

SEQ ID NO: 5883557 - DNA, 17 bp, Homo sapiens
ctcaggggcacagacct

SEQ ID NO: 5883558 - DNA, 13 bp, Homo sapiens
ctcaggggcagct

SEQ ID NO: 5883559 - DNA, 14 bp, Homo sapiens
ctcaggggcaggtg

SEQ ID NO: 5883560 - DNA, 19 bp, Homo sapiens
ctcaggggcaggtggtgga

SEQ ID NO: 5883561 - DNA, 23 bp, Homo sapiens
ctcaggggcaggtggtggagggg

SEQ ID NO: 5883562 - DNA, 20 bp, Homo sapiens
ctcaggggccagaggaactg

SEQ ID NO: 5883563 - DNA, 15 bp, Homo sapiens
ctcaggggcctctct

SEQ ID NO: 5883564 - DNA, 16 bp, Homo sapiens
ctcaggggcctctctc

SEQ ID NO: 5883565 - DNA, 14 bp, Homo sapiens
ctcaggggcctgga

SEQ ID NO: 5883566 - DNA, 20 bp, Homo sapiens
ctcaggggcctggaggtctg

SEQ ID NO: 5883567 - DNA, 17 bp, Homo sapiens
ctcaggggcgtgtggct

SEQ ID NO: 5883568 - DNA, 15 bp, Homo sapiens
ctcaggggctccatg

SEQ ID NO: 5883569 - DNA, 16 bp, Homo sapiens
ctcaggggctctaggg

SEQ ID NO: 5883570 - DNA, 13 bp, Homo sapiens
ctcagggggccag

SEQ ID NO: 5883571 - DNA, 19 bp, Homo sapiens
ctcagggggccagctgggg

SEQ ID NO: 5883572 - DNA, 22 bp, Homo sapiens
ctcagggggccagctggggaga

SEQ ID NO: 5883573 - DNA, 22 bp, Homo sapiens
ctcagggggtaggagagcactg

SEQ ID NO: 5883574 - DNA, 23 bp, Homo sapiens
ctcagggggtaggagagcactgc

SEQ ID NO: 5883575 - DNA, 14 bp, Homo sapiens
ctcaggggtggaga

SEQ ID NO: 5883576 - DNA, 16 bp, Homo sapiens
ctcaggggtggagaag

SEQ ID NO: 5883577 - DNA, 17 bp, Homo sapiens
ctcagggtcactgtcct

SEQ ID NO: 5883578 - DNA, 12 bp, Homo sapiens
ctcagggtccct

SEQ ID NO: 5883579 - DNA, 18 bp, Homo sapiens
ctcagggtccctggtggc

SEQ ID NO: 5883580 - DNA, 21 bp, Homo sapiens
ctcagggtccctggtggcagc

SEQ ID NO: 5883581 - DNA, 22 bp, Homo sapiens
ctcagggtccctggtggcagct

SEQ ID NO: 5883582 - DNA, 13 bp, Homo sapiens
ctcagggtctctg

SEQ ID NO: 5883583 - DNA, 14 bp, Homo sapiens
ctcagggtctctgc

SEQ ID NO: 5883584 - DNA, 18 bp, Homo sapiens
ctcagggtctctgctgcc

SEQ ID NO: 5883585 - DNA, 21 bp, Homo sapiens
ctcagggtgctccctcctcag

SEQ ID NO: 5883586 - DNA, 17 bp, Homo sapiens
ctcagggtggggggtga

SEQ ID NO: 5883587 - DNA, 18 bp, Homo sapiens
ctcagggtggggggtgac

SEQ ID NO: 5883588 - DNA, 15 bp, Homo sapiens
ctcagggtggtctct

SEQ ID NO: 5883589 - DNA, 17 bp, Homo sapiens
ctcagggtgtcctgagg

SEQ ID NO: 5883590 - DNA, 15 bp, Homo sapiens
ctcagggttcatctg

SEQ ID NO: 5883591 - DNA, 17 bp, Homo sapiens
ctcagggttcatctgtc

SEQ ID NO: 5883592 - DNA, 18 bp, Homo sapiens
ctcagggttcatctgtcc

SEQ ID NO: 5883593 - DNA, 23 bp, Homo sapiens
ctcaggtaaatgaggtctttgca

SEQ ID NO: 5883594 - DNA, 17 bp, Homo sapiens
ctcaggtaatcatttta

SEQ ID NO: 5883595 - DNA, 24 bp, Homo sapiens
ctcaggtaatcgacctgcctcggc

SEQ ID NO: 5883596 - DNA, 18 bp, Homo sapiens
ctcaggtacagagaagga

SEQ ID NO: 5883597 - DNA, 21 bp, Homo sapiens
ctcaggtacagagaaggaatg

SEQ ID NO: 5883598 - DNA, 18 bp, Homo sapiens
ctcaggtacagcgggctg

SEQ ID NO: 5883599 - DNA, 22 bp, Homo sapiens
ctcaggtacagcgggctgtgcc

SEQ ID NO: 5883600 - DNA, 21 bp, Homo sapiens
ctcaggtaggaagcaacagct

SEQ ID NO: 5883601 - DNA, 18 bp, Homo sapiens
ctcaggtattgattgaaa

SEQ ID NO: 5883602 - DNA, 19 bp, Homo sapiens
ctcaggtcacataaaactt

SEQ ID NO: 5883603 - DNA, 21 bp, Homo sapiens
ctcaggtcagctgggagccag

SEQ ID NO: 5883604 - DNA, 22 bp, Homo sapiens
ctcaggtcagctgggagccagt

SEQ ID NO: 5883605 - DNA, 17 bp, Homo sapiens
ctcaggtccctgcaggg

SEQ ID NO: 5883606 - DNA, 17 bp, Homo sapiens
ctcaggtgactggagcc

SEQ ID NO: 5883607 - DNA, 19 bp, Homo sapiens
ctcaggtgatccacccacc

SEQ ID NO: 5883608 - DNA, 22 bp, Homo sapiens
ctcaggtgatccacccacctca

SEQ ID NO: 5883609 - DNA, 23 bp, Homo sapiens
ctcaggtgatccacccacctcag

SEQ ID NO: 5883610 - DNA, 16 bp, Homo sapiens
ctcaggtgatccgccc

SEQ ID NO: 5883611 - DNA, 20 bp, Homo sapiens
ctcaggtgatctacctgcct

SEQ ID NO: 5883612 - DNA, 23 bp, Homo sapiens
ctcaggtgcacacatcaccaggt

SEQ ID NO: 5883613 - DNA, 17 bp, Homo sapiens
ctcaggtgccactccct

SEQ ID NO: 5883614 - DNA, 18 bp, Homo sapiens
ctcaggtgccactccctg

SEQ ID NO: 5883615 - DNA, 22 bp, Homo sapiens
ctcaggtgccactccctgagct

SEQ ID NO: 5883616 - DNA, 23 bp, Homo sapiens
ctcaggtgccactccctgagctt

SEQ ID NO: 5883617 - DNA, 16 bp, Homo sapiens
ctcaggtgctggggcc

SEQ ID NO: 5883618 - DNA, 22 bp, Homo sapiens
ctcaggtgctggggcctggttc

SEQ ID NO: 5883619 - DNA, 14 bp, Homo sapiens
ctcaggtgctgtcc

SEQ ID NO: 5883620 - DNA, 15 bp, Homo sapiens
ctcaggtggccatgc

SEQ ID NO: 5883621 - DNA, 21 bp, Homo sapiens
ctcaggtggccatgcctcagc

SEQ ID NO: 5883622 - DNA, 13 bp, Homo sapiens
ctcaggtggggag

SEQ ID NO: 5883623 - DNA, 20 bp, Homo sapiens
ctcaggtggggtcactctgg

SEQ ID NO: 5883624 - DNA, 23 bp, Homo sapiens
ctcaggtggggtcactctggcag

SEQ ID NO: 5883625 - DNA, 21 bp, Homo sapiens
ctcaggtggtgtccttcttcc

SEQ ID NO: 5883626 - DNA, 22 bp, Homo sapiens
ctcaggtggtgtccttcttcct

SEQ ID NO: 5883627 - DNA, 20 bp, Homo sapiens
ctcaggtgtgcctgttgctt

SEQ ID NO: 5883628 - DNA, 23 bp, Homo sapiens
ctcaggtgtgggtgggaggggcc

SEQ ID NO: 5883629 - DNA, 15 bp, Homo sapiens
ctcaggtgttgccaa

SEQ ID NO: 5883630 - DNA, 13 bp, Homo sapiens
ctcaggttccaga

SEQ ID NO: 5883631 - DNA, 15 bp, Homo sapiens
ctcaggttccagaac

SEQ ID NO: 5883632 - DNA, 14 bp, Homo sapiens
ctcaggttccctgc

SEQ ID NO: 5883633 - DNA, 17 bp, Homo sapiens
ctcaggttccctgccac

SEQ ID NO: 5883634 - DNA, 17 bp, Homo sapiens
ctcaggttcctaagact

SEQ ID NO: 5883635 - DNA, 21 bp, Homo sapiens
ctcaggttctattttcttaaa

SEQ ID NO: 5883636 - DNA, 18 bp, Homo sapiens
ctcaggttcttcagggcc

SEQ ID NO: 5883637 - DNA, 16 bp, Homo sapiens
ctcaggttctttccat

SEQ ID NO: 5883638 - DNA, 21 bp, Homo sapiens
ctcaggttgctggttgctgtg

SEQ ID NO: 5883639 - DNA, 14 bp, Homo sapiens
ctcaggttgtctga

SEQ ID NO: 5883640 - DNA, 22 bp, Homo sapiens
ctcaggttgtctgtagagaatg

SEQ ID NO: 5883641 - DNA, 16 bp, Homo sapiens
ctcaggtttctggaca

SEQ ID NO: 5883642 - DNA, 22 bp, Homo sapiens
ctcaggtttctggacaagaaga

SEQ ID NO: 5883643 - DNA, 20 bp, Homo sapiens
ctcaggtttgcctgagggcg

SEQ ID NO: 5883644 - DNA, 23 bp, Homo sapiens
ctcaggtttgtcctggtcatgca

SEQ ID NO: 5883645 - DNA, 17 bp, Homo sapiens
ctcaggtttttgaggaa

SEQ ID NO: 5883646 - DNA, 18 bp, Homo sapiens
ctcagtaaaagtcttctc

SEQ ID NO: 5883647 - DNA, 19 bp, Homo sapiens
ctcagtaaaagtcttctcc

SEQ ID NO: 5883648 - DNA, 20 bp, Homo sapiens
ctcagtaaaagtcttctccc

SEQ ID NO: 5883649 - DNA, 21 bp, Homo sapiens
ctcagtaaaagtcttctccca

SEQ ID NO: 5883650 - DNA, 22 bp, Homo sapiens
ctcagtaaaagtcttctcccaa

SEQ ID NO: 5883651 - DNA, 14 bp, Homo sapiens
ctcagtaaaatgaa

SEQ ID NO: 5883652 - DNA, 21 bp, Homo sapiens
ctcagtaacataactgcttct

SEQ ID NO: 5883653 - DNA, 16 bp, Homo sapiens
ctcagtaacatttctg

SEQ ID NO: 5883654 - DNA, 19 bp, Homo sapiens
ctcagtaacatttctgttc

SEQ ID NO: 5883655 - DNA, 20 bp, Homo sapiens
ctcagtaacatttctgttct

SEQ ID NO: 5883656 - DNA, 22 bp, Homo sapiens
ctcagtaacatttctgttctca

SEQ ID NO: 5883657 - DNA, 13 bp, Homo sapiens
ctcagtaataaaa

SEQ ID NO: 5883658 - DNA, 18 bp, Homo sapiens
ctcagtaatacagtacag

SEQ ID NO: 5883659 - DNA, 22 bp, Homo sapiens
ctcagtaatttagaaatcattt

SEQ ID NO: 5883660 - DNA, 22 bp, Homo sapiens
ctcagtacagggcaggagctgc

SEQ ID NO: 5883661 - DNA, 12 bp, Homo sapiens
ctcagtactttg

SEQ ID NO: 5883662 - DNA, 19 bp, Homo sapiens
ctcagtactttggaggccc

SEQ ID NO: 5883663 - DNA, 20 bp, Homo sapiens
ctcagtactttggaggcccc

SEQ ID NO: 5883664 - DNA, 21 bp, Homo sapiens
ctcagtactttggaggcccct

SEQ ID NO: 5883665 - DNA, 23 bp, Homo sapiens
ctcagtactttggaggcccctat

SEQ ID NO: 5883666 - DNA, 12 bp, Homo sapiens
ctcagtagaaaa

SEQ ID NO: 5883667 - DNA, 22 bp, Homo sapiens
ctcagtagaaaaggatctaagg

SEQ ID NO: 5883668 - DNA, 13 bp, Homo sapiens
ctcagtagaaagg

SEQ ID NO: 5883669 - DNA, 14 bp, Homo sapiens
ctcagtatcttaaa

SEQ ID NO: 5883670 - DNA, 23 bp, Homo sapiens
ctcagtatgctttccctgaggaa

SEQ ID NO: 5883671 - DNA, 17 bp, Homo sapiens
ctcagtatgtgggggct

SEQ ID NO: 5883672 - DNA, 20 bp, Homo sapiens
ctcagtatgtgggggcttca

SEQ ID NO: 5883673 - DNA, 21 bp, Homo sapiens
ctcagtattactttctgccgc

SEQ ID NO: 5883674 - DNA, 21 bp, Homo sapiens
ctcagtattgagacactgtca

SEQ ID NO: 5883675 - DNA, 18 bp, Homo sapiens
ctcagtatttatgtaatt

SEQ ID NO: 5883676 - DNA, 13 bp, Homo sapiens
ctcagtcaaatgt

SEQ ID NO: 5883677 - DNA, 15 bp, Homo sapiens
ctcagtcacccccac

SEQ ID NO: 5883678 - DNA, 15 bp, Homo sapiens
ctcagtcagcccagt

SEQ ID NO: 5883679 - DNA, 14 bp, Homo sapiens
ctcagtcagtgtca

SEQ ID NO: 5883680 - DNA, 16 bp, Homo sapiens
ctcagtcagtgtcatg

SEQ ID NO: 5883681 - DNA, 20 bp, Homo sapiens
ctcagtcagttcccggagca

SEQ ID NO: 5883682 - DNA, 22 bp, Homo sapiens
ctcagtcagttcccggagcaca

SEQ ID NO: 5883683 - DNA, 13 bp, Homo sapiens
ctcagtcatattt

SEQ ID NO: 5883684 - DNA, 15 bp, Homo sapiens
ctcagtcatcaaagc

SEQ ID NO: 5883685 - DNA, 18 bp, Homo sapiens
ctcagtccacctgagctg

SEQ ID NO: 5883686 - DNA, 15 bp, Homo sapiens
ctcagtccactgttg

SEQ ID NO: 5883687 - DNA, 21 bp, Homo sapiens
ctcagtccagatgccttcctg

SEQ ID NO: 5883688 - DNA, 16 bp, Homo sapiens
ctcagtccatgaagat

SEQ ID NO: 5883689 - DNA, 19 bp, Homo sapiens
ctcagtccatttatatatg

SEQ ID NO: 5883690 - DNA, 23 bp, Homo sapiens
ctcagtccatttatatatgaaaa

SEQ ID NO: 5883691 - DNA, 14 bp, Homo sapiens
ctcagtcccacagc

SEQ ID NO: 5883692 - DNA, 15 bp, Homo sapiens
ctcagtcccacagcc

SEQ ID NO: 5883693 - DNA, 16 bp, Homo sapiens
ctcagtcccacagccc

SEQ ID NO: 5883694 - DNA, 17 bp, Homo sapiens
ctcagtcccccaacaga

SEQ ID NO: 5883695 - DNA, 16 bp, Homo sapiens
ctcagtcccccaccac

SEQ ID NO: 5883696 - DNA, 22 bp, Homo sapiens
ctcagtcccccaccacactgaa

SEQ ID NO: 5883697 - DNA, 20 bp, Homo sapiens
ctcagtccctactgagtact

SEQ ID NO: 5883698 - DNA, 18 bp, Homo sapiens
ctcagtccctccctcctg

SEQ ID NO: 5883699 - DNA, 23 bp, Homo sapiens
ctcagtccctccctcctggctca

SEQ ID NO: 5883700 - DNA, 13 bp, Homo sapiens
ctcagtccctctt

SEQ ID NO: 5883701 - DNA, 12 bp, Homo sapiens
ctcagtcctaat

SEQ ID NO: 5883702 - DNA, 12 bp, Homo sapiens
ctcagtcctcaa

SEQ ID NO: 5883703 - DNA, 12 bp, Homo sapiens
ctcagtcctgga

SEQ ID NO: 5883704 - DNA, 13 bp, Homo sapiens
ctcagtccttcca

SEQ ID NO: 5883705 - DNA, 15 bp, Homo sapiens
ctcagtcgccctgtt

SEQ ID NO: 5883706 - DNA, 17 bp, Homo sapiens
ctcagtcgccctgttct

SEQ ID NO: 5883707 - DNA, 21 bp, Homo sapiens
ctcagtcggggcaggccaggg

SEQ ID NO: 5883708 - DNA, 22 bp, Homo sapiens
ctcagtcggggcaggccagggg

SEQ ID NO: 5883709 - DNA, 18 bp, Homo sapiens
ctcagtctaaggtctcat

SEQ ID NO: 5883710 - DNA, 17 bp, Homo sapiens
ctcagtctcaaataata

SEQ ID NO: 5883711 - DNA, 21 bp, Homo sapiens
ctcagtctcacctgccggctc

SEQ ID NO: 5883712 - DNA, 13 bp, Homo sapiens
ctcagtctcagga

SEQ ID NO: 5883713 - DNA, 14 bp, Homo sapiens
ctcagtctcaggag

SEQ ID NO: 5883714 - DNA, 15 bp, Homo sapiens
ctcagtctcaggagc

SEQ ID NO: 5883715 - DNA, 16 bp, Homo sapiens
ctcagtctcaggagca

SEQ ID NO: 5883716 - DNA, 13 bp, Homo sapiens
ctcagtctccctc

SEQ ID NO: 5883717 - DNA, 15 bp, Homo sapiens
ctcagtctccctccc

SEQ ID NO: 5883718 - DNA, 16 bp, Homo sapiens
ctcagtctccctccct

SEQ ID NO: 5883719 - DNA, 17 bp, Homo sapiens
ctcagtctctcttctct

SEQ ID NO: 5883720 - DNA, 19 bp, Homo sapiens
ctcagtctctcttctctcc

SEQ ID NO: 5883721 - DNA, 24 bp, Homo sapiens
ctcagtctggtgctccagttccag

SEQ ID NO: 5883722 - DNA, 14 bp, Homo sapiens
ctcagtctgtggga

SEQ ID NO: 5883723 - DNA, 12 bp, Homo sapiens
ctcagtctgttc

SEQ ID NO: 5883724 - DNA, 13 bp, Homo sapiens
ctcagtcttccct

SEQ ID NO: 5883725 - DNA, 11 bp, Homo sapiens
ctcagtcttct

SEQ ID NO: 5883726 - DNA, 13 bp, Homo sapiens
ctcagtgaaacag

SEQ ID NO: 5883727 - DNA, 18 bp, Homo sapiens
ctcagtgaagaatacttc

SEQ ID NO: 5883728 - DNA, 14 bp, Homo sapiens
ctcagtgaaggtgg

SEQ ID NO: 5883729 - DNA, 18 bp, Homo sapiens
ctcagtgaagttgctgct

SEQ ID NO: 5883730 - DNA, 19 bp, Homo sapiens
ctcagtgaagttgctgctt

SEQ ID NO: 5883731 - DNA, 22 bp, Homo sapiens
ctcagtgacatcaaagcctggc

SEQ ID NO: 5883732 - DNA, 14 bp, Homo sapiens
ctcagtgactgttg

SEQ ID NO: 5883733 - DNA, 13 bp, Homo sapiens
ctcagtgagcctc

SEQ ID NO: 5883734 - DNA, 22 bp, Homo sapiens
ctcagtgatacgtacagccaaa

SEQ ID NO: 5883735 - DNA, 21 bp, Homo sapiens
ctcagtgcaaaatgtcttgtg

SEQ ID NO: 5883736 - DNA, 22 bp, Homo sapiens
ctcagtgcaaaatgtcttgtgt

SEQ ID NO: 5883737 - DNA, 24 bp, Homo sapiens
ctcagtgcaaaatgtcttgtgtat

SEQ ID NO: 5883738 - DNA, 15 bp, Homo sapiens
ctcagtgcaacctct

SEQ ID NO: 5883739 - DNA, 22 bp, Homo sapiens
ctcagtgcaacctctgcttccc

SEQ ID NO: 5883740 - DNA, 15 bp, Homo sapiens
ctcagtgcagatgga

SEQ ID NO: 5883741 - DNA, 22 bp, Homo sapiens
ctcagtgcatttgtgctagaaa

SEQ ID NO: 5883742 - DNA, 14 bp, Homo sapiens
ctcagtgccaaaga

SEQ ID NO: 5883743 - DNA, 19 bp, Homo sapiens
ctcagtgccaactgtggct

SEQ ID NO: 5883744 - DNA, 21 bp, Homo sapiens
ctcagtgccaactgtggctgg

SEQ ID NO: 5883745 - DNA, 17 bp, Homo sapiens
ctcagtgccacaaagct

SEQ ID NO: 5883746 - DNA, 22 bp, Homo sapiens
ctcagtgccacaaagctcaata

SEQ ID NO: 5883747 - DNA, 14 bp, Homo sapiens
ctcagtgccacacc

SEQ ID NO: 5883748 - DNA, 15 bp, Homo sapiens
ctcagtgccacacct

SEQ ID NO: 5883749 - DNA, 21 bp, Homo sapiens
ctcagtgccacctatgcctgt

SEQ ID NO: 5883750 - DNA, 12 bp, Homo sapiens
ctcagtgccact

SEQ ID NO: 5883751 - DNA, 20 bp, Homo sapiens
ctcagtgccacttgacattc

SEQ ID NO: 5883752 - DNA, 22 bp, Homo sapiens
ctcagtgccacttgacattcct

SEQ ID NO: 5883753 - DNA, 22 bp, Homo sapiens
ctcagtgccccttaaatttctg

SEQ ID NO: 5883754 - DNA, 15 bp, Homo sapiens
ctcagtgccctccag

SEQ ID NO: 5883755 - DNA, 16 bp, Homo sapiens
ctcagtgccctccagc

SEQ ID NO: 5883756 - DNA, 19 bp, Homo sapiens
ctcagtgcctccacatgct

SEQ ID NO: 5883757 - DNA, 22 bp, Homo sapiens
ctcagtgccttctctcagctcc

SEQ ID NO: 5883758 - DNA, 15 bp, Homo sapiens
ctcagtgctcctgga

SEQ ID NO: 5883759 - DNA, 22 bp, Homo sapiens
ctcagtgctcctggaaacttag

SEQ ID NO: 5883760 - DNA, 14 bp, Homo sapiens
ctcagtgctcggca

SEQ ID NO: 5883761 - DNA, 16 bp, Homo sapiens
ctcagtgctcggcagt

SEQ ID NO: 5883762 - DNA, 15 bp, Homo sapiens
ctcagtgctctctcc

SEQ ID NO: 5883763 - DNA, 20 bp, Homo sapiens
ctcagtggactttccacccc

SEQ ID NO: 5883764 - DNA, 16 bp, Homo sapiens
ctcagtggatcttcag

SEQ ID NO: 5883765 - DNA, 23 bp, Homo sapiens
ctcagtggatcttcagaactgcc

SEQ ID NO: 5883766 - DNA, 16 bp, Homo sapiens
ctcagtggcagcatcc

SEQ ID NO: 5883767 - DNA, 21 bp, Homo sapiens
ctcagtggcttcatctgtcaa

SEQ ID NO: 5883768 - DNA, 18 bp, Homo sapiens
ctcagtgggaagaaaaat

SEQ ID NO: 5883769 - DNA, 20 bp, Homo sapiens
ctcagtgggacaaaccagag

SEQ ID NO: 5883770 - DNA, 15 bp, Homo sapiens
ctcagtgggctccct

SEQ ID NO: 5883771 - DNA, 19 bp, Homo sapiens
ctcagtggtcaccttcctc

SEQ ID NO: 5883772 - DNA, 20 bp, Homo sapiens
ctcagtggtgtgtgaagttt

SEQ ID NO: 5883773 - DNA, 16 bp, Homo sapiens
ctcagtgtatttgtat

SEQ ID NO: 5883774 - DNA, 17 bp, Homo sapiens
ctcagtgtatttgtatt

SEQ ID NO: 5883775 - DNA, 20 bp, Homo sapiens
ctcagtgtcagcactcaggt

SEQ ID NO: 5883776 - DNA, 22 bp, Homo sapiens
ctcagtgtcatttatgaaaaga

SEQ ID NO: 5883777 - DNA, 20 bp, Homo sapiens
ctcagtgtccagcttccaaa

SEQ ID NO: 5883778 - DNA, 23 bp, Homo sapiens
ctcagtgtgtgtgtgtggtccat

SEQ ID NO: 5883779 - DNA, 20 bp, Homo sapiens
ctcagtgttaatactgagaa

SEQ ID NO: 5883780 - DNA, 14 bp, Homo sapiens
ctcagtgttagaga

SEQ ID NO: 5883781 - DNA, 17 bp, Homo sapiens
ctcagtgttagagaaat

SEQ ID NO: 5883782 - DNA, 16 bp, Homo sapiens
ctcagttaaaatgtga

SEQ ID NO: 5883783 - DNA, 14 bp, Homo sapiens
ctcagttacacagg

SEQ ID NO: 5883784 - DNA, 17 bp, Homo sapiens
ctcagttatgtagtttc

SEQ ID NO: 5883785 - DNA, 19 bp, Homo sapiens
ctcagttcaaaccatttca

SEQ ID NO: 5883786 - DNA, 23 bp, Homo sapiens
ctcagttcaacctggtggcacca

SEQ ID NO: 5883787 - DNA, 21 bp, Homo sapiens
ctcagttcagaatcacttctg

SEQ ID NO: 5883788 - DNA, 14 bp, Homo sapiens
ctcagttcccagct

SEQ ID NO: 5883789 - DNA, 15 bp, Homo sapiens
ctcatgtctgaaaaa

SEQ ID NO: 5883790 - DNA, 23 bp, Homo sapiens
ctcatgtctgaaaaatgcctgct

SEQ ID NO: 5883791 - DNA, 23 bp, Homo sapiens
ctcatgtctggagtcccctcctc

SEQ ID NO: 5883792 - DNA, 14 bp, Homo sapiens
ctcatgtgatcctt

SEQ ID NO: 5883793 - DNA, 16 bp, Homo sapiens
ctcatgtgatcctttt

SEQ ID NO: 5883794 - DNA, 14 bp, Homo sapiens
ctcatgtgatttac

SEQ ID NO: 5883795 - DNA, 19 bp, Homo sapiens
ctcatgtgcagtcagcttt

SEQ ID NO: 5883796 - DNA, 15 bp, Homo sapiens
ctcatgtggctggaa

SEQ ID NO: 5883797 - DNA, 15 bp, Homo sapiens
ctcatgtgtttgcat

SEQ ID NO: 5883798 - DNA, 15 bp, Homo sapiens
ctcatgttaaatatt

SEQ ID NO: 5883799 - DNA, 17 bp, Homo sapiens
ctcatgttccttttgaa

SEQ ID NO: 5883800 - DNA, 20 bp, Homo sapiens
ctcatgttccttttgaaatt

SEQ ID NO: 5883801 - DNA, 16 bp, Homo sapiens
ctcatgttgctgaatt

SEQ ID NO: 5883802 - DNA, 14 bp, Homo sapiens
ctcatgttgttccc

SEQ ID NO: 5883803 - DNA, 21 bp, Homo sapiens
ctcatgtttatgaaaataaat

SEQ ID NO: 5883804 - DNA, 17 bp, Homo sapiens
ctcatgttttccattgt

SEQ ID NO: 5883805 - DNA, 14 bp, Homo sapiens
ctcatgtttttaac

SEQ ID NO: 5883806 - DNA, 11 bp, Homo sapiens
ctcattaaaat

SEQ ID NO: 5883807 - DNA, 14 bp, Homo sapiens
ctcattaaaatcca

SEQ ID NO: 5883808 - DNA, 21 bp, Homo sapiens
ctcattaaatggtgatttctt

SEQ ID NO: 5883809 - DNA, 11 bp, Homo sapiens
ctcattaaatt

SEQ ID NO: 5883810 - DNA, 15 bp, Homo sapiens
ctcattaatagctgc

SEQ ID NO: 5883811 - DNA, 17 bp, Homo sapiens
ctcattaatagctgcct

SEQ ID NO: 5883812 - DNA, 16 bp, Homo sapiens
ctcattaatgacactt

SEQ ID NO: 5883813 - DNA, 12 bp, Homo sapiens
ctcattaatttc

SEQ ID NO: 5883814 - DNA, 22 bp, Homo sapiens
ctcattacagctcattcgctcc

SEQ ID NO: 5883815 - DNA, 17 bp, Homo sapiens
ctcattacagttctttc

SEQ ID NO: 5883816 - DNA, 22 bp, Homo sapiens
ctcattacagttctttcctctt

SEQ ID NO: 5883817 - DNA, 23 bp, Homo sapiens
ctcattacccacccgacctggct

SEQ ID NO: 5883818 - DNA, 19 bp, Homo sapiens
ctcattacccttttctggg

SEQ ID NO: 5883819 - DNA, 18 bp, Homo sapiens
ctcattactgcttcattt

SEQ ID NO: 5883820 - DNA, 18 bp, Homo sapiens
ctcattactgggccttag

SEQ ID NO: 5883821 - DNA, 13 bp, Homo sapiens
ctcattagaaagg

SEQ ID NO: 5883822 - DNA, 21 bp, Homo sapiens
ctcattagcattttgctaaat

SEQ ID NO: 5883823 - DNA, 17 bp, Homo sapiens
ctcattatgttgatact

SEQ ID NO: 5883824 - DNA, 13 bp, Homo sapiens
ctcattatttcat

SEQ ID NO: 5883825 - DNA, 12 bp, Homo sapiens
ctcattatttct

SEQ ID NO: 5883826 - DNA, 21 bp, Homo sapiens
ctcattcactaagccatgcca

SEQ ID NO: 5883827 - DNA, 19 bp, Homo sapiens
ctcattcagagactgccct

SEQ ID NO: 5883828 - DNA, 20 bp, Homo sapiens
ctcattcagagactgccctt

SEQ ID NO: 5883829 - DNA, 13 bp, Homo sapiens
ctcattcagcaga

SEQ ID NO: 5883830 - DNA, 14 bp, Homo sapiens
ctcattcagtatta

SEQ ID NO: 5883831 - DNA, 17 bp, Homo sapiens
ctcattcagtattaaag

SEQ ID NO: 5883832 - DNA, 19 bp, Homo sapiens
ctcattcagtattaaaggg

SEQ ID NO: 5883833 - DNA, 22 bp, Homo sapiens
ctcattcatcactccaaaaaca

SEQ ID NO: 5883834 - DNA, 17 bp, Homo sapiens
ctcattcattactaaaa

SEQ ID NO: 5883835 - DNA, 21 bp, Homo sapiens
ctcattcattttatattgaaa

SEQ ID NO: 5883836 - DNA, 18 bp, Homo sapiens
ctcattccaacagtgagt

SEQ ID NO: 5883837 - DNA, 18 bp, Homo sapiens
ctcattccacactgttga

SEQ ID NO: 5883838 - DNA, 21 bp, Homo sapiens
ctcattccaccttcccatgcc

SEQ ID NO: 5883839 - DNA, 12 bp, Homo sapiens
ctcattccagat

SEQ ID NO: 5883840 - DNA, 17 bp, Homo sapiens
ctcattccataaatgtc

SEQ ID NO: 5883841 - DNA, 12 bp, Homo sapiens
ctcattcccaac

SEQ ID NO: 5883842 - DNA, 16 bp, Homo sapiens
ctcattcccatgtgga

SEQ ID NO: 5883843 - DNA, 14 bp, Homo sapiens
ctcattccccaggt

SEQ ID NO: 5883844 - DNA, 14 bp, Homo sapiens
ctcattccccgggg

SEQ ID NO: 5883845 - DNA, 12 bp, Homo sapiens
ctcattcccctc

SEQ ID NO: 5883846 - DNA, 18 bp, Homo sapiens
ctcattccctccccagaa

SEQ ID NO: 5883847 - DNA, 21 bp, Homo sapiens
ctcattccggccacatcattc

SEQ ID NO: 5883848 - DNA, 22 bp, Homo sapiens
ctcattccggccacatcattct

SEQ ID NO: 5883849 - DNA, 18 bp, Homo sapiens
ctcattcctccacctgcc

SEQ ID NO: 5883850 - DNA, 12 bp, Homo sapiens
ctcattcctgcc

SEQ ID NO: 5883851 - DNA, 17 bp, Homo sapiens
ctcattcctgcctgtct

SEQ ID NO: 5883852 - DNA, 15 bp, Homo sapiens
ctcattcctgttctt

SEQ ID NO: 5883853 - DNA, 17 bp, Homo sapiens
ctcattccttctggagg

SEQ ID NO: 5883854 - DNA, 14 bp, Homo sapiens
ctcattccttgtct

SEQ ID NO: 5883855 - DNA, 16 bp, Homo sapiens
ctcattcgcctgtggg

SEQ ID NO: 5883856 - DNA, 20 bp, Homo sapiens
ctcattcgtggcatgttttg

SEQ ID NO: 5883857 - DNA, 18 bp, Homo sapiens
ctcattctccttgtgtta

SEQ ID NO: 5883858 - DNA, 22 bp, Homo sapiens
ctcattctccttgtgttactaa

SEQ ID NO: 5883859 - DNA, 17 bp, Homo sapiens
ctcattctcttcttgct

SEQ ID NO: 5883860 - DNA, 23 bp, Homo sapiens
ctcattctctttctttttctgtc

SEQ ID NO: 5883861 - DNA, 19 bp, Homo sapiens
ctcattctgaaggagcccc

SEQ ID NO: 5883862 - DNA, 14 bp, Homo sapiens
ctcattctgcacct

SEQ ID NO: 5883863 - DNA, 18 bp, Homo sapiens
ctcattctgcaccttgcc

SEQ ID NO: 5883864 - DNA, 19 bp, Homo sapiens
ctcattctgcaccttgcca

SEQ ID NO: 5883865 - DNA, 20 bp, Homo sapiens
ctcattctgcattaataata

SEQ ID NO: 5883866 - DNA, 21 bp, Homo sapiens
ctcattctggttccctgctgc

SEQ ID NO: 5883867 - DNA, 15 bp, Homo sapiens
ctcattctgtgccat

SEQ ID NO: 5883868 - DNA, 12 bp, Homo sapiens
ctcattgaaatg

SEQ ID NO: 5883869 - DNA, 23 bp, Homo sapiens
ctcattgaaatgtaatttcagtt

SEQ ID NO: 5883870 - DNA, 21 bp, Homo sapiens
ctcattgacttttataaagca

SEQ ID NO: 5883871 - DNA, 16 bp, Homo sapiens
ctcattgcagcagata

SEQ ID NO: 5883872 - DNA, 20 bp, Homo sapiens
ctcattgcccccacctctgg

SEQ ID NO: 5883873 - DNA, 19 bp, Homo sapiens
ctcattgcctcctgttctg

SEQ ID NO: 5883874 - DNA, 20 bp, Homo sapiens
ctcattgctaccacagactt

SEQ ID NO: 5883875 - DNA, 16 bp, Homo sapiens
ctcattgctgagcctc

SEQ ID NO: 5883876 - DNA, 18 bp, Homo sapiens
ctcattgctgagcctctg

SEQ ID NO: 5883877 - DNA, 13 bp, Homo sapiens
ctcattgcttctg

SEQ ID NO: 5883878 - DNA, 16 bp, Homo sapiens
ctcattggaaatttag

SEQ ID NO: 5883879 - DNA, 18 bp, Homo sapiens
ctcattggaaatttagca

SEQ ID NO: 5883880 - DNA, 17 bp, Homo sapiens
ctcattggacccttcca

SEQ ID NO: 5883881 - DNA, 13 bp, Homo sapiens
ctcattggccagc

SEQ ID NO: 5883882 - DNA, 18 bp, Homo sapiens
ctcattggggttgcaaca

SEQ ID NO: 5883883 - DNA, 12 bp, Homo sapiens
ctcattgtagaa

SEQ ID NO: 5883884 - DNA, 23 bp, Homo sapiens
ctcattgtcttgttatgtacaaa

SEQ ID NO: 5883885 - DNA, 14 bp, Homo sapiens
ctcattgtgccaag

SEQ ID NO: 5883886 - DNA, 15 bp, Homo sapiens
ctcattgtgccaagc

SEQ ID NO: 5883887 - DNA, 16 bp, Homo sapiens
ctcattgtgccaagcc

SEQ ID NO: 5883888 - DNA, 23 bp, Homo sapiens
ctcattgtggccagtttagagtt

SEQ ID NO: 5883889 - DNA, 13 bp, Homo sapiens
ctcattgtgtctc

SEQ ID NO: 5883890 - DNA, 17 bp, Homo sapiens
ctcattgtgtctcccgt

SEQ ID NO: 5883891 - DNA, 22 bp, Homo sapiens
ctcattgtgtctcccgtgcatg

SEQ ID NO: 5883892 - DNA, 17 bp, Homo sapiens
ctcatttaatatttttc

SEQ ID NO: 5883893 - DNA, 18 bp, Homo sapiens
ctcatttaatatttttca

SEQ ID NO: 5883894 - DNA, 17 bp, Homo sapiens
ctcatttaatcccagga

SEQ ID NO: 5883895 - DNA, 19 bp, Homo sapiens
ctcatttaatcctcccttc

SEQ ID NO: 5883896 - DNA, 18 bp, Homo sapiens
ctcatttacaactgaaac

SEQ ID NO: 5883897 - DNA, 19 bp, Homo sapiens
ctcatttacgtaaaaagat

SEQ ID NO: 5883898 - DNA, 19 bp, Homo sapiens
ctcatttagcctgtcctgt

SEQ ID NO: 5883899 - DNA, 18 bp, Homo sapiens
ctcatttatgttatttat

SEQ ID NO: 5883900 - DNA, 14 bp, Homo sapiens
ctcatttcacccct

SEQ ID NO: 5883901 - DNA, 12 bp, Homo sapiens
ctcatttcagga

SEQ ID NO: 5883902 - DNA, 13 bp, Homo sapiens
ctcatttcaggat

SEQ ID NO: 5883903 - DNA, 13 bp, Homo sapiens
ctcatttccaagc

SEQ ID NO: 5883904 - DNA, 21 bp, Homo sapiens
ctcatttccaagcaagtatta

SEQ ID NO: 5883905 - DNA, 15 bp, Homo sapiens
ctcatttccaatcat

SEQ ID NO: 5883906 - DNA, 16 bp, Homo sapiens
ctcatttccagcttct

SEQ ID NO: 5883907 - DNA, 18 bp, Homo sapiens
ctcatttccataccattg

SEQ ID NO: 5883908 - DNA, 14 bp, Homo sapiens
ctcatttctagcag

SEQ ID NO: 5883909 - DNA, 16 bp, Homo sapiens
ctcatttctgccagcg

SEQ ID NO: 5883910 - DNA, 17 bp, Homo sapiens
ctcatttcttcctctgc

SEQ ID NO: 5883911 - DNA, 18 bp, Homo sapiens
ctcatttcttcctctgca

SEQ ID NO: 5883912 - DNA, 18 bp, Homo sapiens
ctcatttctttcaagaca

SEQ ID NO: 5883913 - DNA, 17 bp, Homo sapiens
ctcatttctttgtcttt

SEQ ID NO: 5883914 - DNA, 22 bp, Homo sapiens
ctcatttctttgtctttttcct

SEQ ID NO: 5883915 - DNA, 23 bp, Homo sapiens
ctcatttctttgtctttttccta

SEQ ID NO: 5883916 - DNA, 19 bp, Homo sapiens
ctcatttgagaactgtcag

SEQ ID NO: 5883917 - DNA, 11 bp, Homo sapiens
ctcatttgcat

SEQ ID NO: 5883918 - DNA, 22 bp, Homo sapiens
ctcatttggtctgccagaatac

SEQ ID NO: 5883919 - DNA, 21 bp, Homo sapiens
ctcatttgtattccattgatt

SEQ ID NO: 5883920 - DNA, 21 bp, Homo sapiens
ctcatttgtcatttaccctgg

SEQ ID NO: 5883921 - DNA, 15 bp, Homo sapiens
ctcatttgttctcac

SEQ ID NO: 5883922 - DNA, 22 bp, Homo sapiens
ctcatttgttgttgtttttcct

SEQ ID NO: 5883923 - DNA, 15 bp, Homo sapiens
ctcatttgtttttct

SEQ ID NO: 5883924 - DNA, 20 bp, Homo sapiens
ctcattttaatgattgttta

SEQ ID NO: 5883925 - DNA, 21 bp, Homo sapiens
ctcattttatttacagctgtg

SEQ ID NO: 5883926 - DNA, 18 bp, Homo sapiens
ctcattttcacagcacta

SEQ ID NO: 5883927 - DNA, 13 bp, Homo sapiens
ctcattttcttta

SEQ ID NO: 5883928 - DNA, 15 bp, Homo sapiens
ctcattttgaaatat

SEQ ID NO: 5883929 - DNA, 16 bp, Homo sapiens
ctcattttggtctgtt

SEQ ID NO: 5883930 - DNA, 10 bp, Homo sapiens
ctcattttgt

SEQ ID NO: 5883931 - DNA, 21 bp, Homo sapiens
ctcattttgtatgtatgtgta

SEQ ID NO: 5883932 - DNA, 17 bp, Homo sapiens
ctcattttgtttttgtt

SEQ ID NO: 5883933 - DNA, 22 bp, Homo sapiens
ctcatttttataacctggcaaa

SEQ ID NO: 5883934 - DNA, 23 bp, Homo sapiens
ctcatttttataatgtcccttca

SEQ ID NO: 5883935 - DNA, 12 bp, Homo sapiens
ctcatttttcct

SEQ ID NO: 5883936 - DNA, 20 bp, Homo sapiens
ctcatttttttaatttatta

SEQ ID NO: 5883937 - DNA, 19 bp, Homo sapiens
ctcatttttttccttgcaa

SEQ ID NO: 5883938 - DNA, 23 bp, Homo sapiens
ctcatttttttttttgtttctga

SEQ ID NO: 5883939 - DNA, 21 bp, Homo sapiens
ctccaaaaaaaaaaaaaatac

SEQ ID NO: 5883940 - DNA, 21 bp, Homo sapiens
ctccaaaaacagtaaaaataa

SEQ ID NO: 5883941 - DNA, 19 bp, Homo sapiens
ctccaaaaagacaagtgct

SEQ ID NO: 5883942 - DNA, 16 bp, Homo sapiens
ctccaaaaatctgcct

SEQ ID NO: 5883943 - DNA, 17 bp, Homo sapiens
ctccaaaaatctgcctg

SEQ ID NO: 5883944 - DNA, 16 bp, Homo sapiens
ctccaaaactcctgcc

SEQ ID NO: 5883945 - DNA, 19 bp, Homo sapiens
ctccaaaatattaacattc

SEQ ID NO: 5883946 - DNA, 14 bp, Homo sapiens
ctccaaaatgtgcc

SEQ ID NO: 5883947 - DNA, 16 bp, Homo sapiens
ctccaaaatgtgccta

SEQ ID NO: 5883948 - DNA, 17 bp, Homo sapiens
ctccaaacaattctgat

SEQ ID NO: 5883949 - DNA, 18 bp, Homo sapiens
ctccaaacaattctgatg

SEQ ID NO: 5883950 - DNA, 18 bp, Homo sapiens
ctccaaacaccggcagaa

SEQ ID NO: 5883951 - DNA, 15 bp, Homo sapiens
ctccaaacactgggc

SEQ ID NO: 5883952 - DNA, 13 bp, Homo sapiens
ctccaaaccactt

SEQ ID NO: 5883953 - DNA, 14 bp, Homo sapiens
ctccaaacctccag

SEQ ID NO: 5883954 - DNA, 22 bp, Homo sapiens
ctccaaacctccagcctccctg

SEQ ID NO: 5883955 - DNA, 15 bp, Homo sapiens
ctccaaaccttcaca

SEQ ID NO: 5883956 - DNA, 16 bp, Homo sapiens
ctccaaaccttcacac

SEQ ID NO: 5883957 - DNA, 21 bp, Homo sapiens
ctccaaaccttcacacacaga

SEQ ID NO: 5883958 - DNA, 18 bp, Homo sapiens
ctccaaactgaagcagcc

SEQ ID NO: 5883959 - DNA, 15 bp, Homo sapiens
ctccaaactgattaa

SEQ ID NO: 5883960 - DNA, 22 bp, Homo sapiens
ctccaaagaaatagggcatggc

SEQ ID NO: 5883961 - DNA, 13 bp, Homo sapiens
ctccaaagaaatg

SEQ ID NO: 5883962 - DNA, 13 bp, Homo sapiens
ctccaaagaagat

SEQ ID NO: 5883963 - DNA, 16 bp, Homo sapiens
ctccaaagagaaacct

SEQ ID NO: 5883964 - DNA, 14 bp, Homo sapiens
ctccaaagatgact

SEQ ID NO: 5883965 - DNA, 19 bp, Homo sapiens
ctccaaaggaactctagag

SEQ ID NO: 5883966 - DNA, 15 bp, Homo sapiens
ctccaaaggaagggg

SEQ ID NO: 5883967 - DNA, 15 bp, Homo sapiens
ctccacacctgcggc

SEQ ID NO: 5883968 - DNA, 14 bp, Homo sapiens
ctccacactcagaa

SEQ ID NO: 5883969 - DNA, 15 bp, Homo sapiens
ctccacactccactg

SEQ ID NO: 5883970 - DNA, 16 bp, Homo sapiens
ctccacactccactga

SEQ ID NO: 5883971 - DNA, 14 bp, Homo sapiens
ctccacactgacca

SEQ ID NO: 5883972 - DNA, 20 bp, Homo sapiens
ctccacactgaccaagtgct

SEQ ID NO: 5883973 - DNA, 22 bp, Homo sapiens
ctccacactgaccaagtgctgg

SEQ ID NO: 5883974 - DNA, 15 bp, Homo sapiens
ctccacactgcacaa

SEQ ID NO: 5883975 - DNA, 17 bp, Homo sapiens
ctccacagaaaccctgt

SEQ ID NO: 5883976 - DNA, 20 bp, Homo sapiens
ctccacagaagacacgtgtt

SEQ ID NO: 5883977 - DNA, 20 bp, Homo sapiens
ctccacagagaggaggggac

SEQ ID NO: 5883978 - DNA, 17 bp, Homo sapiens
ctccacagagtgagcca

SEQ ID NO: 5883979 - DNA, 16 bp, Homo sapiens
ctccacagcaacccca

SEQ ID NO: 5883980 - DNA, 19 bp, Homo sapiens
ctccacagcaaccccaggc

SEQ ID NO: 5883981 - DNA, 16 bp, Homo sapiens
ctccacagccatccca

SEQ ID NO: 5883982 - DNA, 14 bp, Homo sapiens
ctccacagccgcag

SEQ ID NO: 5883983 - DNA, 20 bp, Homo sapiens
ctccacagcgagggcagctg

SEQ ID NO: 5883984 - DNA, 21 bp, Homo sapiens
ctccacagcgagggcagctgc

SEQ ID NO: 5883985 - DNA, 22 bp, Homo sapiens
ctccacagcgagggcagctgct

SEQ ID NO: 5883986 - DNA, 21 bp, Homo sapiens
ctccacaggagccgcagaggc

SEQ ID NO: 5883987 - DNA, 11 bp, Homo sapiens
ctccacagggc

SEQ ID NO: 5883988 - DNA, 12 bp, Homo sapiens
ctccacagggct

SEQ ID NO: 5883989 - DNA, 19 bp, Homo sapiens
ctccacagggcttgttttc

SEQ ID NO: 5883990 - DNA, 21 bp, Homo sapiens
ctccacagggcttgttttcca

SEQ ID NO: 5883991 - DNA, 20 bp, Homo sapiens
ctccacagtcccccacccac

SEQ ID NO: 5883992 - DNA, 21 bp, Homo sapiens
ctccacagtcccccacccacc

SEQ ID NO: 5883993 - DNA, 15 bp, Homo sapiens
ctccacagtgctgct

SEQ ID NO: 5883994 - DNA, 12 bp, Homo sapiens
ctccacagtgtt

SEQ ID NO: 5883995 - DNA, 16 bp, Homo sapiens
ctccacagtgttcatt

SEQ ID NO: 5883996 - DNA, 22 bp, Homo sapiens
ctccacagttcgacctgcggct

SEQ ID NO: 5883997 - DNA, 19 bp, Homo sapiens
ctccacatcccagcagccc

SEQ ID NO: 5883998 - DNA, 17 bp, Homo sapiens
ctccacatcctccacgt

SEQ ID NO: 5883999 - DNA, 12 bp, Homo sapiens
ctccacatcctg

SEQ ID NO: 5884000 - DNA, 16 bp, Homo sapiens
ctccacatcctgtgtc

SEQ ID NO: 5884001 - DNA, 17 bp, Homo sapiens
ctccacatcctgtgtca

SEQ ID NO: 5884002 - DNA, 14 bp, Homo sapiens
ctccacatcctttc

SEQ ID NO: 5884003 - DNA, 22 bp, Homo sapiens
ctccacatcctttctaaacaag

SEQ ID NO: 5884004 - DNA, 16 bp, Homo sapiens
ctccacatctgcatca

SEQ ID NO: 5884005 - DNA, 14 bp, Homo sapiens
ctccacatctgcct

SEQ ID NO: 5884006 - DNA, 18 bp, Homo sapiens
ctccacatgctgcctggc

SEQ ID NO: 5884007 - DNA, 20 bp, Homo sapiens
ctccacatgctgcctggcac

SEQ ID NO: 5884008 - DNA, 18 bp, Homo sapiens
ctccacattcttcagttt

SEQ ID NO: 5884009 - DNA, 13 bp, Homo sapiens
ctccacatttgtt

SEQ ID NO: 5884010 - DNA, 22 bp, Homo sapiens
ctccaccaaccccgcggcccag

SEQ ID NO: 5884011 - DNA, 13 bp, Homo sapiens
ctccaccacatcc

SEQ ID NO: 5884012 - DNA, 17 bp, Homo sapiens
ctccaccaccactggcc

SEQ ID NO: 5884013 - DNA, 12 bp, Homo sapiens
ctccaccaccca

SEQ ID NO: 5884014 - DNA, 13 bp, Homo sapiens
ctccaccacccaa

SEQ ID NO: 5884015 - DNA, 12 bp, Homo sapiens
ctccaccaccgc

SEQ ID NO: 5884016 - DNA, 20 bp, Homo sapiens
ctccaccaccgcccgtctgt

SEQ ID NO: 5884017 - DNA, 22 bp, Homo sapiens
ctccaccaccgcccgtctgtgt

SEQ ID NO: 5884018 - DNA, 14 bp, Homo sapiens
ctccaccagcagca

SEQ ID NO: 5884019 - DNA, 16 bp, Homo sapiens
ctccaccagcagcatg

SEQ ID NO: 5884020 - DNA, 16 bp, Homo sapiens
ctccaccagccctact

SEQ ID NO: 5884021 - DNA, 19 bp, Homo sapiens
ctccaccagccctactcct

SEQ ID NO: 5884022 - DNA, 21 bp, Homo sapiens
ctccaccagccctactcctgc

SEQ ID NO: 5884023 - DNA, 15 bp, Homo sapiens
ctccaccagcctgct

SEQ ID NO: 5884024 - DNA, 16 bp, Homo sapiens
ctccaccagcctgctg

SEQ ID NO: 5884025 - DNA, 17 bp, Homo sapiens
ctccaccagcctgctga

SEQ ID NO: 5884026 - DNA, 13 bp, Homo sapiens
ctccaccaggaac

SEQ ID NO: 5884027 - DNA, 14 bp, Homo sapiens
ctccaccaggaacc

SEQ ID NO: 5884028 - DNA, 15 bp, Homo sapiens
ctccaccatcactca

SEQ ID NO: 5884029 - DNA, 16 bp, Homo sapiens
ctccaccatcactcac

SEQ ID NO: 5884030 - DNA, 14 bp, Homo sapiens
ctccacccaccagt

SEQ ID NO: 5884031 - DNA, 14 bp, Homo sapiens
ctccacccactagg

SEQ ID NO: 5884032 - DNA, 14 bp, Homo sapiens
ctccacccactgtc

SEQ ID NO: 5884033 - DNA, 16 bp, Homo sapiens
ctccacccactgtccg

SEQ ID NO: 5884034 - DNA, 17 bp, Homo sapiens
ctccacccagcccctgg

SEQ ID NO: 5884035 - DNA, 21 bp, Homo sapiens
ctccacccataataagagaat

SEQ ID NO: 5884036 - DNA, 23 bp, Homo sapiens
ctccacccatcctatcagcctgt

SEQ ID NO: 5884037 - DNA, 13 bp, Homo sapiens
ctccaccccaggg

SEQ ID NO: 5884038 - DNA, 15 bp, Homo sapiens
ctccacccccaagaa

SEQ ID NO: 5884039 - DNA, 15 bp, Homo sapiens
ctccacccccagagg

SEQ ID NO: 5884040 - DNA, 18 bp, Homo sapiens
ctccacccccagctgctt

SEQ ID NO: 5884041 - DNA, 23 bp, Homo sapiens
ctccacccccatgtggcagccca

SEQ ID NO: 5884042 - DNA, 14 bp, Homo sapiens
ctccaccccccacg

SEQ ID NO: 5884043 - DNA, 21 bp, Homo sapiens
ctccaccccccactcagtgcc

SEQ ID NO: 5884044 - DNA, 16 bp, Homo sapiens
ctccaccccccagaac

SEQ ID NO: 5884045 - DNA, 13 bp, Homo sapiens
ctccacccctcaa

SEQ ID NO: 5884046 - DNA, 21 bp, Homo sapiens
ctccacccgtcctccctcagc

SEQ ID NO: 5884047 - DNA, 23 bp, Homo sapiens
ctccacccgtcctccctcagcct

SEQ ID NO: 5884048 - DNA, 16 bp, Homo sapiens
ctccacccgtcctggg

SEQ ID NO: 5884049 - DNA, 15 bp, Homo sapiens
ctccaccctccacct

SEQ ID NO: 5884050 - DNA, 22 bp, Homo sapiens
ctccaccctcccccagacacag

SEQ ID NO: 5884051 - DNA, 17 bp, Homo sapiens
ctccaccctcctctagc

SEQ ID NO: 5884052 - DNA, 20 bp, Homo sapiens
ctccaccctgagcctgacct

SEQ ID NO: 5884053 - DNA, 13 bp, Homo sapiens
ctccaccctgcat

SEQ ID NO: 5884054 - DNA, 20 bp, Homo sapiens
ctccaccctgcattttcctc

SEQ ID NO: 5884055 - DNA, 14 bp, Homo sapiens
ctccaccctggccg

SEQ ID NO: 5884056 - DNA, 18 bp, Homo sapiens
ctccaccctggctgggat

SEQ ID NO: 5884057 - DNA, 14 bp, Homo sapiens
ctccaccctgtccc

SEQ ID NO: 5884058 - DNA, 18 bp, Homo sapiens
ctccaccctgtcccccag

SEQ ID NO: 5884059 - DNA, 13 bp, Homo sapiens
ctccacccttggc

SEQ ID NO: 5884060 - DNA, 14 bp, Homo sapiens
ctccacccttggcc

SEQ ID NO: 5884061 - DNA, 16 bp, Homo sapiens
ctccaccgaccaactg

SEQ ID NO: 5884062 - DNA, 17 bp, Homo sapiens
ctccaccgaccaactgc

SEQ ID NO: 5884063 - DNA, 18 bp, Homo sapiens
ctccaccgagccagcttg

SEQ ID NO: 5884064 - DNA, 18 bp, Homo sapiens
ctccaccgcagaaggaag

SEQ ID NO: 5884065 - DNA, 17 bp, Homo sapiens
ctccaccggtgcctcct

SEQ ID NO: 5884066 - DNA, 18 bp, Homo sapiens
ctccaccggtgcctcctc

SEQ ID NO: 5884067 - DNA, 20 bp, Homo sapiens
ctccaccgttcaagcgccag

SEQ ID NO: 5884068 - DNA, 22 bp, Homo sapiens
ctccaccgttcaagcgccagaa

SEQ ID NO: 5884069 - DNA, 15 bp, Homo sapiens
ctccacctagactgt

SEQ ID NO: 5884070 - DNA, 20 bp, Homo sapiens
ctccacctagtggctgtcca

SEQ ID NO: 5884071 - DNA, 22 bp, Homo sapiens
ctccacctagtggctgtccagt

SEQ ID NO: 5884072 - DNA, 23 bp, Homo sapiens
ctccacctagtggctgtccagtg

SEQ ID NO: 5884073 - DNA, 11 bp, Homo sapiens
ctccacctcaa

SEQ ID NO: 5884074 - DNA, 13 bp, Homo sapiens
ctccacctcagcc

SEQ ID NO: 5884075 - DNA, 16 bp, Homo sapiens
ctccacctcagccttg

SEQ ID NO: 5884076 - DNA, 12 bp, Homo sapiens
ctccacctcagg

SEQ ID NO: 5884077 - DNA, 14 bp, Homo sapiens
ctccacctccccca

SEQ ID NO: 5884078 - DNA, 12 bp, Homo sapiens
ctccacctcctg

SEQ ID NO: 5884079 - DNA, 12 bp, Homo sapiens
ctccacctctgg

SEQ ID NO: 5884080 - DNA, 13 bp, Homo sapiens
ctccacctctggt

SEQ ID NO: 5884081 - DNA, 19 bp, Homo sapiens
ctccacctctgtgcagggc

SEQ ID NO: 5884082 - DNA, 21 bp, Homo sapiens
ctccacctctgtgcagggcac

SEQ ID NO: 5884083 - DNA, 12 bp, Homo sapiens
ctccacctgcac

SEQ ID NO: 5884084 - DNA, 14 bp, Homo sapiens
ctccacctgcagcc

SEQ ID NO: 5884085 - DNA, 21 bp, Homo sapiens
ctccacctgcagccccaggcc

SEQ ID NO: 5884086 - DNA, 15 bp, Homo sapiens
ctccacctgccaggg

SEQ ID NO: 5884087 - DNA, 20 bp, Homo sapiens
ctccacctgcttgtgttggg

SEQ ID NO: 5884088 - DNA, 18 bp, Homo sapiens
ctccacctgggagatgct

SEQ ID NO: 5884089 - DNA, 21 bp, Homo sapiens
ctccacctgggagatgctggg

SEQ ID NO: 5884090 - DNA, 12 bp, Homo sapiens
ctccacctgtga

SEQ ID NO: 5884091 - DNA, 14 bp, Homo sapiens
ctccaccttcatat

SEQ ID NO: 5884092 - DNA, 14 bp, Homo sapiens
ctccaccttccaaa

SEQ ID NO: 5884093 - DNA, 19 bp, Homo sapiens
ctccaccttgaacctgtca

SEQ ID NO: 5884094 - DNA, 23 bp, Homo sapiens
ctccaccttgagcactattctaa

SEQ ID NO: 5884095 - DNA, 20 bp, Homo sapiens
ctccaccttgatgggtcaac

SEQ ID NO: 5884096 - DNA, 17 bp, Homo sapiens
ctccaccttgcagctct

SEQ ID NO: 5884097 - DNA, 20 bp, Homo sapiens
ctccaccttgttacacatta

SEQ ID NO: 5884098 - DNA, 15 bp, Homo sapiens
ctccacgcaaggctg

SEQ ID NO: 5884099 - DNA, 20 bp, Homo sapiens
ctccacgcaaggctgtgctc

SEQ ID NO: 5884100 - DNA, 13 bp, Homo sapiens
ctccacgcaggcg

SEQ ID NO: 5884101 - DNA, 17 bp, Homo sapiens
ctccacgccactgcctc

SEQ ID NO: 5884102 - DNA, 14 bp, Homo sapiens
ctccacgcctcctg

SEQ ID NO: 5884103 - DNA, 18 bp, Homo sapiens
ctccacgcctcctggcca

SEQ ID NO: 5884104 - DNA, 20 bp, Homo sapiens
ctccacgcctcctggccaga

SEQ ID NO: 5884105 - DNA, 22 bp, Homo sapiens
ctccacgggcaggggtcagagc

SEQ ID NO: 5884106 - DNA, 20 bp, Homo sapiens
ctccacgggggcctagtggc

SEQ ID NO: 5884107 - DNA, 20 bp, Homo sapiens
ctccacggtccgcggcctgc

SEQ ID NO: 5884108 - DNA, 21 bp, Homo sapiens
ctccacggtccgcggcctgca

SEQ ID NO: 5884109 - DNA, 14 bp, Homo sapiens
ctccacgtcagtgc

SEQ ID NO: 5884110 - DNA, 15 bp, Homo sapiens
ctccacgtctttcct

SEQ ID NO: 5884111 - DNA, 22 bp, Homo sapiens
ctccacgtctttcctgctacaa

SEQ ID NO: 5884112 - DNA, 21 bp, Homo sapiens
ctccacgtgatttccagtgag

SEQ ID NO: 5884113 - DNA, 15 bp, Homo sapiens
ctccacgtggttgcc

SEQ ID NO: 5884114 - DNA, 23 bp, Homo sapiens
ctccacgtggttgccgtctctgg

SEQ ID NO: 5884115 - DNA, 22 bp, Homo sapiens
ctccacgtgtttcgggccaggg

SEQ ID NO: 5884116 - DNA, 16 bp, Homo sapiens
ctccacgttcacccct

SEQ ID NO: 5884117 - DNA, 18 bp, Homo sapiens
ctccacgttcacccctcc

SEQ ID NO: 5884118 - DNA, 18 bp, Homo sapiens
ctccacgttctgctcatc

SEQ ID NO: 5884119 - DNA, 18 bp, Homo sapiens
ctccactaaatgagctcc

SEQ ID NO: 5884120 - DNA, 19 bp, Homo sapiens
ctccactaccccacaccag

SEQ ID NO: 5884121 - DNA, 20 bp, Homo sapiens
ctccactaccccacaccagc

SEQ ID NO: 5884122 - DNA, 13 bp, Homo sapiens
ctccactcaaaga

SEQ ID NO: 5884123 - DNA, 22 bp, Homo sapiens
ctccactcaaagagggtgaggg

SEQ ID NO: 5884124 - DNA, 13 bp, Homo sapiens
ctccactcaatgt

SEQ ID NO: 5884125 - DNA, 17 bp, Homo sapiens
ctccactcaccacaagc

SEQ ID NO: 5884126 - DNA, 19 bp, Homo sapiens
ctccactcaccacaagctg

SEQ ID NO: 5884127 - DNA, 23 bp, Homo sapiens
ctccactcaccacaagctgagca

SEQ ID NO: 5884128 - DNA, 17 bp, Homo sapiens
ctccactcactgaagcc

SEQ ID NO: 5884129 - DNA, 13 bp, Homo sapiens
ctccactcactgc

SEQ ID NO: 5884130 - DNA, 14 bp, Homo sapiens
ctccactcactgct

SEQ ID NO: 5884131 - DNA, 13 bp, Homo sapiens
ctccactcagcac

SEQ ID NO: 5884132 - DNA, 15 bp, Homo sapiens
ctccactcagcacaa

SEQ ID NO: 5884133 - DNA, 21 bp, Homo sapiens
ctccactcagcactctggact

SEQ ID NO: 5884134 - DNA, 21 bp, Homo sapiens
ctccactcagctgtcctgcag

SEQ ID NO: 5884135 - DNA, 16 bp, Homo sapiens
ctccactcagggctgg

SEQ ID NO: 5884136 - DNA, 15 bp, Homo sapiens
ctccactcaggtgca

SEQ ID NO: 5884137 - DNA, 13 bp, Homo sapiens
ctccactcccagc

SEQ ID NO: 5884138 - DNA, 13 bp, Homo sapiens
ctccactccccca

SEQ ID NO: 5884139 - DNA, 18 bp, Homo sapiens
ctccactcccccacctga

SEQ ID NO: 5884140 - DNA, 21 bp, Homo sapiens
ctccactcccccacctgacaa

SEQ ID NO: 5884141 - DNA, 14 bp, Homo sapiens
ctccactccctgtc

SEQ ID NO: 5884142 - DNA, 22 bp, Homo sapiens
ctccactcctctcaactgcctc

SEQ ID NO: 5884143 - DNA, 15 bp, Homo sapiens
ctccactccttccca

SEQ ID NO: 5884144 - DNA, 16 bp, Homo sapiens
ctccactccttcccaa

SEQ ID NO: 5884145 - DNA, 14 bp, Homo sapiens
ctccactccttcct

SEQ ID NO: 5884146 - DNA, 18 bp, Homo sapiens
ctccagcattctcagcca

SEQ ID NO: 5884147 - DNA, 20 bp, Homo sapiens
ctccagcattctcagccaca

SEQ ID NO: 5884148 - DNA, 22 bp, Homo sapiens
ctccagccaaacgggagctttt

SEQ ID NO: 5884149 - DNA, 20 bp, Homo sapiens
ctccagccaaagaaatgggc

SEQ ID NO: 5884150 - DNA, 17 bp, Homo sapiens
ctccagccaccaaggct

SEQ ID NO: 5884151 - DNA, 22 bp, Homo sapiens
ctccagccaccaaggctgcctg

SEQ ID NO: 5884152 - DNA, 23 bp, Homo sapiens
ctccagccaccaaggctgcctgc

SEQ ID NO: 5884153 - DNA, 18 bp, Homo sapiens
ctccagccacttatttcc

SEQ ID NO: 5884154 - DNA, 24 bp, Homo sapiens
ctccagccagcaatgatgtccaga

SEQ ID NO: 5884155 - DNA, 20 bp, Homo sapiens
ctccagccagccagctcatt

SEQ ID NO: 5884156 - DNA, 12 bp, Homo sapiens
ctccagccagcg

SEQ ID NO: 5884157 - DNA, 14 bp, Homo sapiens
ctccagccagcgcc

SEQ ID NO: 5884158 - DNA, 21 bp, Homo sapiens
ctccagccagcgcctccctcc

SEQ ID NO: 5884159 - DNA, 22 bp, Homo sapiens
ctccagcccacacccctccaaa

SEQ ID NO: 5884160 - DNA, 23 bp, Homo sapiens
ctccagcccacacccctccaaag

SEQ ID NO: 5884161 - DNA, 17 bp, Homo sapiens
ctccagcccagcccgct

SEQ ID NO: 5884162 - DNA, 23 bp, Homo sapiens
ctccagcccatgctggctggggc

SEQ ID NO: 5884163 - DNA, 12 bp, Homo sapiens
ctccagccccat

SEQ ID NO: 5884164 - DNA, 16 bp, Homo sapiens
ctccagcccctcttgg

SEQ ID NO: 5884165 - DNA, 15 bp, Homo sapiens
ctccagcccctggat

SEQ ID NO: 5884166 - DNA, 15 bp, Homo sapiens
ctccagcccctgtcc

SEQ ID NO: 5884167 - DNA, 22 bp, Homo sapiens
ctccagccccttctcagaatct

SEQ ID NO: 5884168 - DNA, 18 bp, Homo sapiens
ctccagcccctttccaaa

SEQ ID NO: 5884169 - DNA, 19 bp, Homo sapiens
ctccagcccctttccaaaa

SEQ ID NO: 5884170 - DNA, 16 bp, Homo sapiens
ctccagcccctttgcc

SEQ ID NO: 5884171 - DNA, 19 bp, Homo sapiens
ctccagcccctttgcctct

SEQ ID NO: 5884172 - DNA, 23 bp, Homo sapiens
ctccagcccgagtggtctcctct

SEQ ID NO: 5884173 - DNA, 16 bp, Homo sapiens
ctccagcccgcagcac

SEQ ID NO: 5884174 - DNA, 15 bp, Homo sapiens
ctccagcccgggagc

SEQ ID NO: 5884175 - DNA, 12 bp, Homo sapiens
ctccagccctgt

SEQ ID NO: 5884176 - DNA, 15 bp, Homo sapiens
ctccagcccttcaga

SEQ ID NO: 5884177 - DNA, 19 bp, Homo sapiens
ctccagcccttcagacgag

SEQ ID NO: 5884178 - DNA, 13 bp, Homo sapiens
ctccagccgaagc

SEQ ID NO: 5884179 - DNA, 19 bp, Homo sapiens
ctccagccgaagctgcagg

SEQ ID NO: 5884180 - DNA, 14 bp, Homo sapiens
ctccagcctcacag

SEQ ID NO: 5884181 - DNA, 16 bp, Homo sapiens
ctccagcctcagcccc

SEQ ID NO: 5884182 - DNA, 18 bp, Homo sapiens
ctccagcctcagccccct

SEQ ID NO: 5884183 - DNA, 23 bp, Homo sapiens
ctccagcctccccaccccagtgg

SEQ ID NO: 5884184 - DNA, 16 bp, Homo sapiens
ctccagcctcccctcc

SEQ ID NO: 5884185 - DNA, 21 bp, Homo sapiens
ctccagcctcccctcccctgg

SEQ ID NO: 5884186 - DNA, 16 bp, Homo sapiens
ctccagcctccctgtc

SEQ ID NO: 5884187 - DNA, 17 bp, Homo sapiens
ctccagcctccctgtct

SEQ ID NO: 5884188 - DNA, 19 bp, Homo sapiens
ctccagcctccctgtctcc

SEQ ID NO: 5884189 - DNA, 17 bp, Homo sapiens
ctccagcctctcccggc

SEQ ID NO: 5884190 - DNA, 21 bp, Homo sapiens
ctccagcctctcccggctgcc

SEQ ID NO: 5884191 - DNA, 22 bp, Homo sapiens
ctccagcctctcccggctgcct

SEQ ID NO: 5884192 - DNA, 15 bp, Homo sapiens
ctccagcctctgccg

SEQ ID NO: 5884193 - DNA, 20 bp, Homo sapiens
ctccagcctgaacagaagct

SEQ ID NO: 5884194 - DNA, 14 bp, Homo sapiens
ctccagcctgacaa

SEQ ID NO: 5884195 - DNA, 22 bp, Homo sapiens
ctccagcctgacaacagcctga

SEQ ID NO: 5884196 - DNA, 14 bp, Homo sapiens
ctccagcctgagca

SEQ ID NO: 5884197 - DNA, 21 bp, Homo sapiens
ctccagcctgcccaagcccag

SEQ ID NO: 5884198 - DNA, 17 bp, Homo sapiens
ctccagcctgcctggca

SEQ ID NO: 5884199 - DNA, 12 bp, Homo sapiens
ctccagcctgct

SEQ ID NO: 5884200 - DNA, 23 bp, Homo sapiens
ctccagcctggaaacctgtctga

SEQ ID NO: 5884201 - DNA, 13 bp, Homo sapiens
ctccagcctgggc

SEQ ID NO: 5884202 - DNA, 14 bp, Homo sapiens
ctccagcctgggcg

SEQ ID NO: 5884203 - DNA, 21 bp, Homo sapiens
ctccagcctgggcgacagagc

SEQ ID NO: 5884204 - DNA, 22 bp, Homo sapiens
ctccagcctgggcgacagagca

SEQ ID NO: 5884205 - DNA, 18 bp, Homo sapiens
ctccagcctggggacccc

SEQ ID NO: 5884206 - DNA, 21 bp, Homo sapiens
ctccagcctggggaccccact

SEQ ID NO: 5884207 - DNA, 14 bp, Homo sapiens
ctccagcctggggt

SEQ ID NO: 5884208 - DNA, 23 bp, Homo sapiens
ctccagcctggggtgatagaaca

SEQ ID NO: 5884209 - DNA, 15 bp, Homo sapiens
ctccagcctggtggc

SEQ ID NO: 5884210 - DNA, 16 bp, Homo sapiens
ctccagcctggtggcc

SEQ ID NO: 5884211 - DNA, 17 bp, Homo sapiens
ctccagcctggtggccc

SEQ ID NO: 5884212 - DNA, 19 bp, Homo sapiens
ctccagcctggtggcccag

SEQ ID NO: 5884213 - DNA, 14 bp, Homo sapiens
ctccagccttctct

SEQ ID NO: 5884214 - DNA, 20 bp, Homo sapiens
ctccagccttctctctctgg

SEQ ID NO: 5884215 - DNA, 23 bp, Homo sapiens
ctccagcgatggtgctgcccagg

SEQ ID NO: 5884216 - DNA, 13 bp, Homo sapiens
ctccagcggccct

SEQ ID NO: 5884217 - DNA, 15 bp, Homo sapiens
ctccagcggccctgt

SEQ ID NO: 5884218 - DNA, 19 bp, Homo sapiens
ctccagcggccctgtcatc

SEQ ID NO: 5884219 - DNA, 16 bp, Homo sapiens
ctccagcgtcctcagc

SEQ ID NO: 5884220 - DNA, 17 bp, Homo sapiens
ctccagcgtcctcagca

SEQ ID NO: 5884221 - DNA, 19 bp, Homo sapiens
ctccagcgtcctcagcacc

SEQ ID NO: 5884222 - DNA, 20 bp, Homo sapiens
ctccagctaaacaccaaccc

SEQ ID NO: 5884223 - DNA, 23 bp, Homo sapiens
ctccagctaaacaccaacccctg

SEQ ID NO: 5884224 - DNA, 16 bp, Homo sapiens
ctccagctcaccagcc

SEQ ID NO: 5884225 - DNA, 18 bp, Homo sapiens
ctccagctcaccagcccc

SEQ ID NO: 5884226 - DNA, 20 bp, Homo sapiens
ctccagctcaccagccccag

SEQ ID NO: 5884227 - DNA, 19 bp, Homo sapiens
ctccagctcagaacccagg

SEQ ID NO: 5884228 - DNA, 22 bp, Homo sapiens
ctccagctcagaacccagggct

SEQ ID NO: 5884229 - DNA, 23 bp, Homo sapiens
ctccagctcagaacccagggctc

SEQ ID NO: 5884230 - DNA, 24 bp, Homo sapiens
ctccagctcagaacccagggctct

SEQ ID NO: 5884231 - DNA, 14 bp, Homo sapiens
ctccagctcagcag

SEQ ID NO: 5884232 - DNA, 15 bp, Homo sapiens
ctccagctcatatgc

SEQ ID NO: 5884233 - DNA, 12 bp, Homo sapiens
ctccagctccag

SEQ ID NO: 5884234 - DNA, 16 bp, Homo sapiens
ctccagctcccactcc

SEQ ID NO: 5884235 - DNA, 21 bp, Homo sapiens
ctccagctccctgtgccccca

SEQ ID NO: 5884236 - DNA, 11 bp, Homo sapiens
ctccagctcct

SEQ ID NO: 5884237 - DNA, 15 bp, Homo sapiens
ctccagctcctctcc

SEQ ID NO: 5884238 - DNA, 15 bp, Homo sapiens
ctccagctctggcac

SEQ ID NO: 5884239 - DNA, 16 bp, Homo sapiens
ctccagctgacagcca

SEQ ID NO: 5884240 - DNA, 14 bp, Homo sapiens
ctccagctgcctgg

SEQ ID NO: 5884241 - DNA, 15 bp, Homo sapiens
ctccagctgctgctc

SEQ ID NO: 5884242 - DNA, 17 bp, Homo sapiens
ctccagctgctgctctc

SEQ ID NO: 5884243 - DNA, 20 bp, Homo sapiens
ctccagctggaattgctgct

SEQ ID NO: 5884244 - DNA, 13 bp, Homo sapiens
ctccagctggatc

SEQ ID NO: 5884245 - DNA, 21 bp, Homo sapiens
ctccagctgtactagtgccat

SEQ ID NO: 5884246 - DNA, 14 bp, Homo sapiens
ctccagctgtcagc

SEQ ID NO: 5884247 - DNA, 19 bp, Homo sapiens
ctccagctgtcagcctggt

SEQ ID NO: 5884248 - DNA, 13 bp, Homo sapiens
ctccagctgttca

SEQ ID NO: 5884249 - DNA, 16 bp, Homo sapiens
ctccagctgttcttag

SEQ ID NO: 5884250 - DNA, 13 bp, Homo sapiens
ctccagcttcagc

SEQ ID NO: 5884251 - DNA, 12 bp, Homo sapiens
ctccagcttccc

SEQ ID NO: 5884252 - DNA, 14 bp, Homo sapiens
ctccagcttcccct

SEQ ID NO: 5884253 - DNA, 23 bp, Homo sapiens
ctccagcttcccctcgctgtcct

SEQ ID NO: 5884254 - DNA, 22 bp, Homo sapiens
ctccagcttctggtactctcct

SEQ ID NO: 5884255 - DNA, 18 bp, Homo sapiens
ctccagcttgtggagccc

SEQ ID NO: 5884256 - DNA, 19 bp, Homo sapiens
ctccagcttttcctcaggg

SEQ ID NO: 5884257 - DNA, 19 bp, Homo sapiens
ctccagcttttctttttct

SEQ ID NO: 5884258 - DNA, 16 bp, Homo sapiens
ctccaggaaagagcag

SEQ ID NO: 5884259 - DNA, 12 bp, Homo sapiens
ctccaggaacca

SEQ ID NO: 5884260 - DNA, 19 bp, Homo sapiens
ctccaggaagcccagggca

SEQ ID NO: 5884261 - DNA, 19 bp, Homo sapiens
ctccaggaagccttcccct

SEQ ID NO: 5884262 - DNA, 22 bp, Homo sapiens
ctccaggaagggaccccactgg

SEQ ID NO: 5884263 - DNA, 15 bp, Homo sapiens
ctccaggaaggggct

SEQ ID NO: 5884264 - DNA, 22 bp, Homo sapiens
ctccaggaaggtagcccagcac

SEQ ID NO: 5884265 - DNA, 15 bp, Homo sapiens
ctccaggaccagggg

SEQ ID NO: 5884266 - DNA, 20 bp, Homo sapiens
ctccaggactccactggaca

SEQ ID NO: 5884267 - DNA, 23 bp, Homo sapiens
ctccaggactccactggacagac

SEQ ID NO: 5884268 - DNA, 15 bp, Homo sapiens
ctccaggacttgctt

SEQ ID NO: 5884269 - DNA, 23 bp, Homo sapiens
ctccaggacttgcttccaagccc

SEQ ID NO: 5884270 - DNA, 22 bp, Homo sapiens
ctccaggagaaggggcccaagg

SEQ ID NO: 5884271 - DNA, 16 bp, Homo sapiens
ctccaggagagagcca

SEQ ID NO: 5884272 - DNA, 13 bp, Homo sapiens
ctccaggagagga

SEQ ID NO: 5884273 - DNA, 16 bp, Homo sapiens
ctccaggagcagccac

SEQ ID NO: 5884274 - DNA, 23 bp, Homo sapiens
ctccaggagcagccacattcctg

SEQ ID NO: 5884275 - DNA, 16 bp, Homo sapiens
ctccaggagcctaccc

SEQ ID NO: 5884276 - DNA, 20 bp, Homo sapiens
ctccaggagcctcatccagc

SEQ ID NO: 5884277 - DNA, 20 bp, Homo sapiens
ctccaggagggaccaccctc

SEQ ID NO: 5884278 - DNA, 17 bp, Homo sapiens
ctccaggaggggcctgg

SEQ ID NO: 5884279 - DNA, 16 bp, Homo sapiens
ctccaggatcctcctg

SEQ ID NO: 5884280 - DNA, 22 bp, Homo sapiens
ctccaggatcctcctggagcag

SEQ ID NO: 5884281 - DNA, 22 bp, Homo sapiens
ctccaggatctttgactgaaaa

SEQ ID NO: 5884282 - DNA, 17 bp, Homo sapiens
ctccaggatggggaggg

SEQ ID NO: 5884283 - DNA, 17 bp, Homo sapiens
ctccaggattgtccaca

SEQ ID NO: 5884284 - DNA, 18 bp, Homo sapiens
ctccaggattgtccacaa

SEQ ID NO: 5884285 - DNA, 22 bp, Homo sapiens
ctccaggattgtccacaaatgt

SEQ ID NO: 5884286 - DNA, 23 bp, Homo sapiens
ctccaggattttaatttcaggaa

SEQ ID NO: 5884287 - DNA, 17 bp, Homo sapiens
ctccaggcaccatctcc

SEQ ID NO: 5884288 - DNA, 16 bp, Homo sapiens
ctccaggcaccgcctg

SEQ ID NO: 5884289 - DNA, 22 bp, Homo sapiens
ctccaggcaccgcctgccccca

SEQ ID NO: 5884290 - DNA, 13 bp, Homo sapiens
ctccaggcagagg

SEQ ID NO: 5884291 - DNA, 19 bp, Homo sapiens
ctccaggcagcagacacat

SEQ ID NO: 5884292 - DNA, 11 bp, Homo sapiens
ctccaggcagg

SEQ ID NO: 5884293 - DNA, 12 bp, Homo sapiens
ctccaggcagga

SEQ ID NO: 5884294 - DNA, 21 bp, Homo sapiens
ctccaggcaggacgagactcc

SEQ ID NO: 5884295 - DNA, 23 bp, Homo sapiens
ctccaggcaggacgagactcctc

SEQ ID NO: 5884296 - DNA, 17 bp, Homo sapiens
ctccaggcaggccaggc

SEQ ID NO: 5884297 - DNA, 15 bp, Homo sapiens
ctccaggcatcactg

SEQ ID NO: 5884298 - DNA, 15 bp, Homo sapiens
ctccaggcatgctgg

SEQ ID NO: 5884299 - DNA, 17 bp, Homo sapiens
ctccaggcatgctggcc

SEQ ID NO: 5884300 - DNA, 23 bp, Homo sapiens
ctccaggcatgtgtctggcccta

SEQ ID NO: 5884301 - DNA, 22 bp, Homo sapiens
ctccaggcatttagccctcaca

SEQ ID NO: 5884302 - DNA, 12 bp, Homo sapiens
ctccaggccaaa

SEQ ID NO: 5884303 - DNA, 22 bp, Homo sapiens
ctccaggccactctcagagact

SEQ ID NO: 5884304 - DNA, 15 bp, Homo sapiens
ctccaggccaggtgg

SEQ ID NO: 5884305 - DNA, 23 bp, Homo sapiens
ctccaggccaggtgggaacggct

SEQ ID NO: 5884306 - DNA, 19 bp, Homo sapiens
ctccaggcccaaggctccc

SEQ ID NO: 5884307 - DNA, 12 bp, Homo sapiens
ctccaggcccag

SEQ ID NO: 5884308 - DNA, 13 bp, Homo sapiens
ctccaggcccagc

SEQ ID NO: 5884309 - DNA, 15 bp, Homo sapiens
ctccaggcccagcct

SEQ ID NO: 5884310 - DNA, 20 bp, Homo sapiens
ctccaggcccagcctggccc

SEQ ID NO: 5884311 - DNA, 21 bp, Homo sapiens
ctccaggcccagcctggcccc

SEQ ID NO: 5884312 - DNA, 22 bp, Homo sapiens
ctccaggcccagcctggcccca

SEQ ID NO: 5884313 - DNA, 16 bp, Homo sapiens
ctccaggcccatctca

SEQ ID NO: 5884314 - DNA, 15 bp, Homo sapiens
ctccaggcccgtctg

SEQ ID NO: 5884315 - DNA, 17 bp, Homo sapiens
ctccaggcccgtctgtc

SEQ ID NO: 5884316 - DNA, 20 bp, Homo sapiens
ctccaggcccgtctgtccat

SEQ ID NO: 5884317 - DNA, 14 bp, Homo sapiens
ctccaggccctcag

SEQ ID NO: 5884318 - DNA, 18 bp, Homo sapiens
ctccaggccctcctctcc

SEQ ID NO: 5884319 - DNA, 15 bp, Homo sapiens
ctccaggccctgccc

SEQ ID NO: 5884320 - DNA, 10 bp, Homo sapiens
ctccaggcct

SEQ ID NO: 5884321 - DNA, 13 bp, Homo sapiens
ctccaggcctgca

SEQ ID NO: 5884322 - DNA, 18 bp, Homo sapiens
ctccatatcccgggagca

SEQ ID NO: 5884323 - DNA, 22 bp, Homo sapiens
ctccatatgctgtacatgacat

SEQ ID NO: 5884324 - DNA, 13 bp, Homo sapiens
ctccatcacccct

SEQ ID NO: 5884325 - DNA, 17 bp, Homo sapiens
ctccatcacccctggtg

SEQ ID NO: 5884326 - DNA, 19 bp, Homo sapiens
ctccatcacccctggtggc

SEQ ID NO: 5884327 - DNA, 23 bp, Homo sapiens
ctccatcacccctggtggctgca

SEQ ID NO: 5884328 - DNA, 15 bp, Homo sapiens
ctccatcaccctctt

SEQ ID NO: 5884329 - DNA, 22 bp, Homo sapiens
ctccatcaccctcttcctgtga

SEQ ID NO: 5884330 - DNA, 21 bp, Homo sapiens
ctccatcacctgaaacactgg

SEQ ID NO: 5884331 - DNA, 16 bp, Homo sapiens
ctccatcactgagagc

SEQ ID NO: 5884332 - DNA, 18 bp, Homo sapiens
ctccatcagaaaaccaaa

SEQ ID NO: 5884333 - DNA, 13 bp, Homo sapiens
ctccatcagaagg

SEQ ID NO: 5884334 - DNA, 22 bp, Homo sapiens
ctccatcagatgtgttcctcca

SEQ ID NO: 5884335 - DNA, 18 bp, Homo sapiens
ctccatcagttagagctg

SEQ ID NO: 5884336 - DNA, 15 bp, Homo sapiens
ctccatcataggctg

SEQ ID NO: 5884337 - DNA, 20 bp, Homo sapiens
ctccatcatatgcctgaccc

SEQ ID NO: 5884338 - DNA, 13 bp, Homo sapiens
ctccatcattcat

SEQ ID NO: 5884339 - DNA, 12 bp, Homo sapiens
ctccatccaagg

SEQ ID NO: 5884340 - DNA, 20 bp, Homo sapiens
ctccatccacacacagcagc

SEQ ID NO: 5884341 - DNA, 20 bp, Homo sapiens
ctccatccacatgggagccg

SEQ ID NO: 5884342 - DNA, 22 bp, Homo sapiens
ctccatccccatcggccctgtc

SEQ ID NO: 5884343 - DNA, 16 bp, Homo sapiens
ctccatccccctctgt

SEQ ID NO: 5884344 - DNA, 17 bp, Homo sapiens
ctccatccccctctgtc

SEQ ID NO: 5884345 - DNA, 11 bp, Homo sapiens
ctccatcccct

SEQ ID NO: 5884346 - DNA, 14 bp, Homo sapiens
ctccatcccctccc

SEQ ID NO: 5884347 - DNA, 17 bp, Homo sapiens
ctccatcccctccctgc

SEQ ID NO: 5884348 - DNA, 18 bp, Homo sapiens
ctccatcccctccctgcc

SEQ ID NO: 5884349 - DNA, 13 bp, Homo sapiens
ctccatccctcta

SEQ ID NO: 5884350 - DNA, 21 bp, Homo sapiens
ctccatccctctcctctgccc

SEQ ID NO: 5884351 - DNA, 16 bp, Homo sapiens
ctccatccctgaaatt

SEQ ID NO: 5884352 - DNA, 14 bp, Homo sapiens
ctccatcccttccc

SEQ ID NO: 5884353 - DNA, 16 bp, Homo sapiens
ctccatcccttcccca

SEQ ID NO: 5884354 - DNA, 13 bp, Homo sapiens
ctccatccgtgct

SEQ ID NO: 5884355 - DNA, 15 bp, Homo sapiens
ctccatccgtgctgc

SEQ ID NO: 5884356 - DNA, 18 bp, Homo sapiens
ctccatcctaccccctgt

SEQ ID NO: 5884357 - DNA, 20 bp, Homo sapiens
ctccatcctaccccctgtgc

SEQ ID NO: 5884358 - DNA, 22 bp, Homo sapiens
ctccatcctaccccctgtgcct

SEQ ID NO: 5884359 - DNA, 12 bp, Homo sapiens
ctccatcctgag

SEQ ID NO: 5884360 - DNA, 20 bp, Homo sapiens
ctccatcctgaggctccact

SEQ ID NO: 5884361 - DNA, 21 bp, Homo sapiens
ctccatcctgaggctccactt

SEQ ID NO: 5884362 - DNA, 23 bp, Homo sapiens
ctccatcctgaggctccacttgg

SEQ ID NO: 5884363 - DNA, 15 bp, Homo sapiens
ctccatcctgccagg

SEQ ID NO: 5884364 - DNA, 13 bp, Homo sapiens
ctccatcctgctg

SEQ ID NO: 5884365 - DNA, 21 bp, Homo sapiens
ctccatcctgtttgtatgaaa

SEQ ID NO: 5884366 - DNA, 19 bp, Homo sapiens
ctccatcgccatcttcttc

SEQ ID NO: 5884367 - DNA, 20 bp, Homo sapiens
ctccatcgccatcttcttcc

SEQ ID NO: 5884368 - DNA, 16 bp, Homo sapiens
ctccatcggggaatga

SEQ ID NO: 5884369 - DNA, 18 bp, Homo sapiens
ctccatcgtctcatcctc

SEQ ID NO: 5884370 - DNA, 19 bp, Homo sapiens
ctccatctcaaaacaaaac

SEQ ID NO: 5884371 - DNA, 20 bp, Homo sapiens
ctccatctcaaaacaaaaca

SEQ ID NO: 5884372 - DNA, 23 bp, Homo sapiens
ctccatctcatgtatcatctgga

SEQ ID NO: 5884373 - DNA, 22 bp, Homo sapiens
ctccatctccaagaatgctgaa

SEQ ID NO: 5884374 - DNA, 14 bp, Homo sapiens
ctccatctccactc

SEQ ID NO: 5884375 - DNA, 17 bp, Homo sapiens
ctccatctcccaaggct

SEQ ID NO: 5884376 - DNA, 19 bp, Homo sapiens
ctccatctcctgctcacca

SEQ ID NO: 5884377 - DNA, 18 bp, Homo sapiens
ctccatctctctggccct

SEQ ID NO: 5884378 - DNA, 17 bp, Homo sapiens
ctccatcttcagcttct

SEQ ID NO: 5884379 - DNA, 20 bp, Homo sapiens
ctccatcttggtagttctgt

SEQ ID NO: 5884380 - DNA, 16 bp, Homo sapiens
ctccatctttctacag

SEQ ID NO: 5884381 - DNA, 15 bp, Homo sapiens
ctccatctttttctt

SEQ ID NO: 5884382 - DNA, 19 bp, Homo sapiens
ctccatctttttcttgggt

SEQ ID NO: 5884383 - DNA, 17 bp, Homo sapiens
ctccatgaagagcttgt

SEQ ID NO: 5884384 - DNA, 16 bp, Homo sapiens
ctccatgatatttaag

SEQ ID NO: 5884385 - DNA, 18 bp, Homo sapiens
ctccatgattccaagggc

SEQ ID NO: 5884386 - DNA, 19 bp, Homo sapiens
ctccatgattccaagggcc

SEQ ID NO: 5884387 - DNA, 15 bp, Homo sapiens
ctccatgattctctg

SEQ ID NO: 5884388 - DNA, 17 bp, Homo sapiens
ctccatgattctctgag

SEQ ID NO: 5884389 - DNA, 18 bp, Homo sapiens
ctccatgattctctgagt

SEQ ID NO: 5884390 - DNA, 15 bp, Homo sapiens
ctccatgcaagtgct

SEQ ID NO: 5884391 - DNA, 18 bp, Homo sapiens
ctccatgcagatctagcc

SEQ ID NO: 5884392 - DNA, 19 bp, Homo sapiens
ctccatgcagatctagcca

SEQ ID NO: 5884393 - DNA, 15 bp, Homo sapiens
ctccatgcccaacct

SEQ ID NO: 5884394 - DNA, 16 bp, Homo sapiens
ctccatgcccaaccta

SEQ ID NO: 5884395 - DNA, 19 bp, Homo sapiens
ctccatgccccagctctgg

SEQ ID NO: 5884396 - DNA, 12 bp, Homo sapiens
ctccatgccccc

SEQ ID NO: 5884397 - DNA, 15 bp, Homo sapiens
ctccatgcctctgga

SEQ ID NO: 5884398 - DNA, 19 bp, Homo sapiens
ctccatgctcctcactgcc

SEQ ID NO: 5884399 - DNA, 21 bp, Homo sapiens
ctccatgctctttcaccctgc

SEQ ID NO: 5884400 - DNA, 22 bp, Homo sapiens
ctccatgctctttcaccctgcc

SEQ ID NO: 5884401 - DNA, 12 bp, Homo sapiens
ctccatgctgca

SEQ ID NO: 5884402 - DNA, 13 bp, Homo sapiens
ctccatgctgcct

SEQ ID NO: 5884403 - DNA, 17 bp, Homo sapiens
ctccatgctgcctccag

SEQ ID NO: 5884404 - DNA, 24 bp, Homo sapiens
ctccatgctgggtctgaggcccct

SEQ ID NO: 5884405 - DNA, 15 bp, Homo sapiens
ctccatgctggtgtg

SEQ ID NO: 5884406 - DNA, 19 bp, Homo sapiens
ctccatgctgtccctgtgg

SEQ ID NO: 5884407 - DNA, 21 bp, Homo sapiens
ctccatgctttgctctcaagg

SEQ ID NO: 5884408 - DNA, 23 bp, Homo sapiens
ctccatggacgtgtctgcacagg

SEQ ID NO: 5884409 - DNA, 15 bp, Homo sapiens
ctccatggagcctac

SEQ ID NO: 5884410 - DNA, 22 bp, Homo sapiens
ctccatggaggaggtgtcccaa

SEQ ID NO: 5884411 - DNA, 16 bp, Homo sapiens
ctccatggcagcagcc

SEQ ID NO: 5884412 - DNA, 18 bp, Homo sapiens
ctccatggcagcagccag

SEQ ID NO: 5884413 - DNA, 19 bp, Homo sapiens
ctccatggcagcagccagg

SEQ ID NO: 5884414 - DNA, 21 bp, Homo sapiens
ctccatggcagcagccaggga

SEQ ID NO: 5884415 - DNA, 13 bp, Homo sapiens
ctccatggcagga

SEQ ID NO: 5884416 - DNA, 14 bp, Homo sapiens
ctccatggcatctt

SEQ ID NO: 5884417 - DNA, 13 bp, Homo sapiens
ctccatggccacc

SEQ ID NO: 5884418 - DNA, 13 bp, Homo sapiens
ctccatggcccat

SEQ ID NO: 5884419 - DNA, 23 bp, Homo sapiens
ctccatggcccatcactcggctg

SEQ ID NO: 5884420 - DNA, 24 bp, Homo sapiens
ctccatggcccatcactcggctgt

SEQ ID NO: 5884421 - DNA, 14 bp, Homo sapiens
ctccatggcccttc

SEQ ID NO: 5884422 - DNA, 15 bp, Homo sapiens
ctccatggcccttcc

SEQ ID NO: 5884423 - DNA, 16 bp, Homo sapiens
ctccatggcttcctcc

SEQ ID NO: 5884424 - DNA, 21 bp, Homo sapiens
ctccatggcttcctcctccct

SEQ ID NO: 5884425 - DNA, 20 bp, Homo sapiens
ctccatgggccaccgcccag

SEQ ID NO: 5884426 - DNA, 19 bp, Homo sapiens
ctccatgggcgtcctttgg

SEQ ID NO: 5884427 - DNA, 17 bp, Homo sapiens
ctccatgggctagtgtg

SEQ ID NO: 5884428 - DNA, 22 bp, Homo sapiens
ctccatggggaagtgctcccca

SEQ ID NO: 5884429 - DNA, 21 bp, Homo sapiens
ctccatgggggctcagccagg

SEQ ID NO: 5884430 - DNA, 17 bp, Homo sapiens
ctccatggggttcgaga

SEQ ID NO: 5884431 - DNA, 18 bp, Homo sapiens
ctccatggtcctgtctgt

SEQ ID NO: 5884432 - DNA, 21 bp, Homo sapiens
ctccatggtcctgtctgtcct

SEQ ID NO: 5884433 - DNA, 18 bp, Homo sapiens
ctccatggtgaactgaag

SEQ ID NO: 5884434 - DNA, 21 bp, Homo sapiens
ctccatggtgaactgaagcag

SEQ ID NO: 5884435 - DNA, 15 bp, Homo sapiens
ctccatggtgcctct

SEQ ID NO: 5884436 - DNA, 17 bp, Homo sapiens
ctccatggtgcctctgg

SEQ ID NO: 5884437 - DNA, 15 bp, Homo sapiens
ctccatggtgctgca

SEQ ID NO: 5884438 - DNA, 14 bp, Homo sapiens
ctccatggttctca

SEQ ID NO: 5884439 - DNA, 21 bp, Homo sapiens
ctccatgtagaacttgaacta

SEQ ID NO: 5884440 - DNA, 13 bp, Homo sapiens
ctccatgtctctg

SEQ ID NO: 5884441 - DNA, 12 bp, Homo sapiens
ctccatgtctgt

SEQ ID NO: 5884442 - DNA, 19 bp, Homo sapiens
ctccatgtgggtgctaggg

SEQ ID NO: 5884443 - DNA, 14 bp, Homo sapiens
ctccatgtgtgtgc

SEQ ID NO: 5884444 - DNA, 18 bp, Homo sapiens
ctccatgttgcttcactc

SEQ ID NO: 5884445 - DNA, 20 bp, Homo sapiens
ctccatgtttagaaataaat

SEQ ID NO: 5884446 - DNA, 16 bp, Homo sapiens
ctccattaaagtctga

SEQ ID NO: 5884447 - DNA, 20 bp, Homo sapiens
ctccattaaatataaagcaa

SEQ ID NO: 5884448 - DNA, 13 bp, Homo sapiens
ctccattactgtg

SEQ ID NO: 5884449 - DNA, 19 bp, Homo sapiens
ctccattagaaaattttgt

SEQ ID NO: 5884450 - DNA, 22 bp, Homo sapiens
ctccattagaaaattttgtaaa

SEQ ID NO: 5884451 - DNA, 20 bp, Homo sapiens
ctccattatccattcccaag

SEQ ID NO: 5884452 - DNA, 19 bp, Homo sapiens
ctccattattcctctcacc

SEQ ID NO: 5884453 - DNA, 17 bp, Homo sapiens
ctccattcactcccagg

SEQ ID NO: 5884454 - DNA, 20 bp, Homo sapiens
ctccattcatacacaacgta

SEQ ID NO: 5884455 - DNA, 16 bp, Homo sapiens
ctccattcatccttcc

SEQ ID NO: 5884456 - DNA, 21 bp, Homo sapiens
ctccattcatccttccatcca

SEQ ID NO: 5884457 - DNA, 15 bp, Homo sapiens
ctccattccctagca

SEQ ID NO: 5884458 - DNA, 22 bp, Homo sapiens
ctccattcctaggtcacttgaa

SEQ ID NO: 5884459 - DNA, 11 bp, Homo sapiens
ctccattcctg

SEQ ID NO: 5884460 - DNA, 15 bp, Homo sapiens
ctccattcctgagta

SEQ ID NO: 5884461 - DNA, 20 bp, Homo sapiens
ctccattctgaccatttcag

SEQ ID NO: 5884462 - DNA, 17 bp, Homo sapiens
ctccattctgctccttc

SEQ ID NO: 5884463 - DNA, 13 bp, Homo sapiens
ctccattctgtgt

SEQ ID NO: 5884464 - DNA, 17 bp, Homo sapiens
ctccattggtgttgaca

SEQ ID NO: 5884465 - DNA, 20 bp, Homo sapiens
ctccattgtgtgatccagcc

SEQ ID NO: 5884466 - DNA, 21 bp, Homo sapiens
ctccattgtgtgatccagccc

SEQ ID NO: 5884467 - DNA, 23 bp, Homo sapiens
ctccattgtgtgatccagccctg

SEQ ID NO: 5884468 - DNA, 16 bp, Homo sapiens
ctccattgttttgcct

SEQ ID NO: 5884469 - DNA, 14 bp, Homo sapiens
ctccatttaagaca

SEQ ID NO: 5884470 - DNA, 13 bp, Homo sapiens
ctccatttaataa

SEQ ID NO: 5884471 - DNA, 15 bp, Homo sapiens
ctccatttagttctt

SEQ ID NO: 5884472 - DNA, 16 bp, Homo sapiens
ctccatttcaactcca

SEQ ID NO: 5884473 - DNA, 22 bp, Homo sapiens
ctccatttcaattgctttgtga

SEQ ID NO: 5884474 - DNA, 21 bp, Homo sapiens
ctccatttcacacaggtcctg

SEQ ID NO: 5884475 - DNA, 21 bp, Homo sapiens
ctccatttcccaaagtcctct

SEQ ID NO: 5884476 - DNA, 14 bp, Homo sapiens
ctccatttcccact

SEQ ID NO: 5884477 - DNA, 15 bp, Homo sapiens
ctccatttcccactt

SEQ ID NO: 5884478 - DNA, 17 bp, Homo sapiens
ctccatttctctccagg

SEQ ID NO: 5884479 - DNA, 11 bp, Homo sapiens
ctccatttctg

SEQ ID NO: 5884480 - DNA, 14 bp, Homo sapiens
ctccatttctgctc

SEQ ID NO: 5884481 - DNA, 13 bp, Homo sapiens
ctccatttctgtc

SEQ ID NO: 5884482 - DNA, 22 bp, Homo sapiens
ctccatttcttggttttgtatt

SEQ ID NO: 5884483 - DNA, 15 bp, Homo sapiens
ctccatttgctcttc

SEQ ID NO: 5884484 - DNA, 17 bp, Homo sapiens
ctccatttgctcttcag

SEQ ID NO: 5884485 - DNA, 21 bp, Homo sapiens
ctccatttggtcctttctcca

SEQ ID NO: 5884486 - DNA, 19 bp, Homo sapiens
ctccattttcttctctgtg

SEQ ID NO: 5884487 - DNA, 22 bp, Homo sapiens
ctccattttggtgtctttctct

SEQ ID NO: 5884488 - DNA, 18 bp, Homo sapiens
ctccatttttaaccactt

SEQ ID NO: 5884489 - DNA, 21 bp, Homo sapiens
ctccatttttcccaggacagg

SEQ ID NO: 5884490 - DNA, 16 bp, Homo sapiens
ctccatttttctccca

SEQ ID NO: 5884491 - DNA, 13 bp, Homo sapiens
ctccatttttgtt

SEQ ID NO: 5884492 - DNA, 13 bp, Homo sapiens
ctcccaaaaagat

SEQ ID NO: 5884493 - DNA, 12 bp, Homo sapiens
ctcccaaaagac

SEQ ID NO: 5884494 - DNA, 22 bp, Homo sapiens
ctcccaaaagctagaacactgc

SEQ ID NO: 5884495 - DNA, 13 bp, Homo sapiens
ctcccaaaatact

SEQ ID NO: 5884496 - DNA, 18 bp, Homo sapiens
ctcccaaacgccctttcc

SEQ ID NO: 5884497 - DNA, 21 bp, Homo sapiens
ctcccaaagagctgcctaaga

SEQ ID NO: 5884498 - DNA, 21 bp, Homo sapiens
ctcccaaagccatatcaccag

SEQ ID NO: 5884499 - DNA, 19 bp, Homo sapiens
ctcccatgtgtgatgctga

SEQ ID NO: 5884500 - DNA, 15 bp, Homo sapiens
ctcccattcctccct

SEQ ID NO: 5884501 - DNA, 15 bp, Homo sapiens
ctcccattcctgaag

SEQ ID NO: 5884502 - DNA, 16 bp, Homo sapiens
ctcccattctgcacca

SEQ ID NO: 5884503 - DNA, 17 bp, Homo sapiens
ctcccattgtccctctg

SEQ ID NO: 5884504 - DNA, 22 bp, Homo sapiens
ctcccattgtccctctgcccca

SEQ ID NO: 5884505 - DNA, 21 bp, Homo sapiens
ctcccatttcaggaatttaaa

SEQ ID NO: 5884506 - DNA, 17 bp, Homo sapiens
ctcccatttcctgatct

SEQ ID NO: 5884507 - DNA, 22 bp, Homo sapiens
ctcccatttctaaagctgaatg

SEQ ID NO: 5884508 - DNA, 14 bp, Homo sapiens
ctcccatttctact

SEQ ID NO: 5884509 - DNA, 14 bp, Homo sapiens
ctcccatttgcaga

SEQ ID NO: 5884510 - DNA, 22 bp, Homo sapiens
ctccccaaaacctttccccaga

SEQ ID NO: 5884511 - DNA, 13 bp, Homo sapiens
ctccccaaagcca

SEQ ID NO: 5884512 - DNA, 16 bp, Homo sapiens
ctccccaaagggtgtg

SEQ ID NO: 5884513 - DNA, 21 bp, Homo sapiens
ctccccaaatcaatacactag

SEQ ID NO: 5884514 - DNA, 17 bp, Homo sapiens
ctccccaaatggctgct

SEQ ID NO: 5884515 - DNA, 21 bp, Homo sapiens
ctccccaaattgccctgttgc

SEQ ID NO: 5884516 - DNA, 21 bp, Homo sapiens
ctccccaacacctgcctctga

SEQ ID NO: 5884517 - DNA, 12 bp, Homo sapiens
ctccccaaccct

SEQ ID NO: 5884518 - DNA, 23 bp, Homo sapiens
ctccccaaccctaggttccctgt

SEQ ID NO: 5884519 - DNA, 14 bp, Homo sapiens
ctccccaaccctgc

SEQ ID NO: 5884520 - DNA, 17 bp, Homo sapiens
ctccccaaccctgcccc

SEQ ID NO: 5884521 - DNA, 18 bp, Homo sapiens
ctccccaagacacatcct

SEQ ID NO: 5884522 - DNA, 16 bp, Homo sapiens
ctccccaagacttgac

SEQ ID NO: 5884523 - DNA, 18 bp, Homo sapiens
ctccccaaggatgaccac

SEQ ID NO: 5884524 - DNA, 22 bp, Homo sapiens
ctccccaaggatgaccacaccc

SEQ ID NO: 5884525 - DNA, 23 bp, Homo sapiens
ctccccaaggccccctgcctgcc

SEQ ID NO: 5884526 - DNA, 22 bp, Homo sapiens
ctccccaaggtctgtggctcct

SEQ ID NO: 5884527 - DNA, 13 bp, Homo sapiens
ctccccaatcacg

SEQ ID NO: 5884528 - DNA, 15 bp, Homo sapiens
ctccccaatccaacc

SEQ ID NO: 5884529 - DNA, 21 bp, Homo sapiens
ctccccaatccaacccatgca

SEQ ID NO: 5884530 - DNA, 19 bp, Homo sapiens
ctccccaatccatgcttca

SEQ ID NO: 5884531 - DNA, 16 bp, Homo sapiens
ctccccaatccctgac

SEQ ID NO: 5884532 - DNA, 18 bp, Homo sapiens
ctccccaatgagacttgc

SEQ ID NO: 5884533 - DNA, 22 bp, Homo sapiens
ctccccaatgagacttgccttc

SEQ ID NO: 5884534 - DNA, 16 bp, Homo sapiens
ctccccaattctcccc

SEQ ID NO: 5884535 - DNA, 17 bp, Homo sapiens
ctccccaattctcccct

SEQ ID NO: 5884536 - DNA, 21 bp, Homo sapiens
ctccccacacacaggccttct

SEQ ID NO: 5884537 - DNA, 20 bp, Homo sapiens
ctccccacaccctggagtgg

SEQ ID NO: 5884538 - DNA, 21 bp, Homo sapiens
ctccccacaccttccagggcc

SEQ ID NO: 5884539 - DNA, 17 bp, Homo sapiens
ctccccacactccactc

SEQ ID NO: 5884540 - DNA, 20 bp, Homo sapiens
ctccccacactccactctga

SEQ ID NO: 5884541 - DNA, 21 bp, Homo sapiens
ctccccacactccactctgat

SEQ ID NO: 5884542 - DNA, 22 bp, Homo sapiens
ctccccacagcctctggctcca

SEQ ID NO: 5884543 - DNA, 18 bp, Homo sapiens
ctccccacagcgtccctg

SEQ ID NO: 5884544 - DNA, 20 bp, Homo sapiens
ctccccacagcgtccctggc

SEQ ID NO: 5884545 - DNA, 19 bp, Homo sapiens
ctccccacagtcctcacag

SEQ ID NO: 5884546 - DNA, 17 bp, Homo sapiens
ctccccacagtgccacc

SEQ ID NO: 5884547 - DNA, 18 bp, Homo sapiens
ctccccacagtgccaccc

SEQ ID NO: 5884548 - DNA, 17 bp, Homo sapiens
ctccccacatcgcacac

SEQ ID NO: 5884549 - DNA, 19 bp, Homo sapiens
ctccccaccaccccagctg

SEQ ID NO: 5884550 - DNA, 17 bp, Homo sapiens
ctccccaccagagctgc

SEQ ID NO: 5884551 - DNA, 14 bp, Homo sapiens
ctccccacccacca

SEQ ID NO: 5884552 - DNA, 19 bp, Homo sapiens
ctccccacccccgctgggg

SEQ ID NO: 5884553 - DNA, 20 bp, Homo sapiens
ctccccacccccgctggggg

SEQ ID NO: 5884554 - DNA, 15 bp, Homo sapiens
ctccccaccccgaaa

SEQ ID NO: 5884555 - DNA, 12 bp, Homo sapiens
ctccccacccct

SEQ ID NO: 5884556 - DNA, 23 bp, Homo sapiens
ctccccaccctcctggcctcaga

SEQ ID NO: 5884557 - DNA, 12 bp, Homo sapiens
ctccccaccctg

SEQ ID NO: 5884558 - DNA, 14 bp, Homo sapiens
ctccccaccctgtc

SEQ ID NO: 5884559 - DNA, 19 bp, Homo sapiens
ctccccaccctgtcccagg

SEQ ID NO: 5884560 - DNA, 20 bp, Homo sapiens
ctccccaccctgtcccaggc

SEQ ID NO: 5884561 - DNA, 21 bp, Homo sapiens
ctccccaccctgtcccaggca

SEQ ID NO: 5884562 - DNA, 18 bp, Homo sapiens
ctccccacctgctcacca

SEQ ID NO: 5884563 - DNA, 12 bp, Homo sapiens
ctccccacctgg

SEQ ID NO: 5884564 - DNA, 13 bp, Homo sapiens
ctccccacctgta

SEQ ID NO: 5884565 - DNA, 12 bp, Homo sapiens
ctccccaccttc

SEQ ID NO: 5884566 - DNA, 15 bp, Homo sapiens
ctccccaccttcccc

SEQ ID NO: 5884567 - DNA, 16 bp, Homo sapiens
ctccccaccttcccca

SEQ ID NO: 5884568 - DNA, 21 bp, Homo sapiens
ctccccacgatgatatctata

SEQ ID NO: 5884569 - DNA, 12 bp, Homo sapiens
ctccccacgccc

SEQ ID NO: 5884570 - DNA, 15 bp, Homo sapiens
ctccccacgccctcc

SEQ ID NO: 5884571 - DNA, 11 bp, Homo sapiens
ctccccactcc

SEQ ID NO: 5884572 - DNA, 13 bp, Homo sapiens
ctccccactctag

SEQ ID NO: 5884573 - DNA, 16 bp, Homo sapiens
ctccccactctgctct

SEQ ID NO: 5884574 - DNA, 17 bp, Homo sapiens
ctccccactctgctctg

SEQ ID NO: 5884575 - DNA, 21 bp, Homo sapiens
ctccccactctgctctgatgc

SEQ ID NO: 5884576 - DNA, 16 bp, Homo sapiens
ctccccactgcctact

SEQ ID NO: 5884577 - DNA, 19 bp, Homo sapiens
ctccccactgcctactgca

SEQ ID NO: 5884578 - DNA, 21 bp, Homo sapiens
ctccccacttcactttcttca

SEQ ID NO: 5884579 - DNA, 18 bp, Homo sapiens
ctccccagaactggctgg

SEQ ID NO: 5884580 - DNA, 21 bp, Homo sapiens
ctccccagaactggctgggcc

SEQ ID NO: 5884581 - DNA, 16 bp, Homo sapiens
ctccccagacagggct

SEQ ID NO: 5884582 - DNA, 17 bp, Homo sapiens
ctccccagacagggctc

SEQ ID NO: 5884583 - DNA, 12 bp, Homo sapiens
ctccccagagct

SEQ ID NO: 5884584 - DNA, 18 bp, Homo sapiens
ctccccagagctgcctgc

SEQ ID NO: 5884585 - DNA, 15 bp, Homo sapiens
ctccccagagctgtg

SEQ ID NO: 5884586 - DNA, 16 bp, Homo sapiens
ctccccagagctgtgc

SEQ ID NO: 5884587 - DNA, 13 bp, Homo sapiens
ctccccagatctc

SEQ ID NO: 5884588 - DNA, 18 bp, Homo sapiens
ctccccagatctgtcctg

SEQ ID NO: 5884589 - DNA, 20 bp, Homo sapiens
ctccccagcaagtgagagct

SEQ ID NO: 5884590 - DNA, 16 bp, Homo sapiens
ctccccagcaggtggg

SEQ ID NO: 5884591 - DNA, 21 bp, Homo sapiens
ctccccagcattccagcccct

SEQ ID NO: 5884592 - DNA, 15 bp, Homo sapiens
ctccccagccagccc

SEQ ID NO: 5884593 - DNA, 16 bp, Homo sapiens
ctccccagccagccct

SEQ ID NO: 5884594 - DNA, 18 bp, Homo sapiens
ctccccagccagcctggc

SEQ ID NO: 5884595 - DNA, 12 bp, Homo sapiens
ctccccagccca

SEQ ID NO: 5884596 - DNA, 14 bp, Homo sapiens
ctccccagcccacc

SEQ ID NO: 5884597 - DNA, 18 bp, Homo sapiens
ctccccagcccacctgct

SEQ ID NO: 5884598 - DNA, 16 bp, Homo sapiens
ctccccagcccagaga

SEQ ID NO: 5884599 - DNA, 20 bp, Homo sapiens
ctccccagcccagcacccct

SEQ ID NO: 5884600 - DNA, 14 bp, Homo sapiens
ctccccagcccagg

SEQ ID NO: 5884601 - DNA, 15 bp, Homo sapiens
ctccccagcccaggg

SEQ ID NO: 5884602 - DNA, 16 bp, Homo sapiens
ctccccagcccagggt

SEQ ID NO: 5884603 - DNA, 12 bp, Homo sapiens
ctccccagcccc

SEQ ID NO: 5884604 - DNA, 20 bp, Homo sapiens
ctccccagccccatcccaaa

SEQ ID NO: 5884605 - DNA, 18 bp, Homo sapiens
ctccccagccccctccca

SEQ ID NO: 5884606 - DNA, 19 bp, Homo sapiens
ctccccagccccctcccac

SEQ ID NO: 5884607 - DNA, 22 bp, Homo sapiens
ctccccagccccctggcatgtt

SEQ ID NO: 5884608 - DNA, 13 bp, Homo sapiens
ctccccagcccct

SEQ ID NO: 5884609 - DNA, 15 bp, Homo sapiens
ctccccagcccctag

SEQ ID NO: 5884610 - DNA, 16 bp, Homo sapiens
ctccccagccctggct

SEQ ID NO: 5884611 - DNA, 13 bp, Homo sapiens
ctccccagcctgc

SEQ ID NO: 5884612 - DNA, 15 bp, Homo sapiens
ctccccagctcccag

SEQ ID NO: 5884613 - DNA, 16 bp, Homo sapiens
ctccccagctcttctc

SEQ ID NO: 5884614 - DNA, 22 bp, Homo sapiens
ctccccagctcttctcttccta

SEQ ID NO: 5884615 - DNA, 19 bp, Homo sapiens
ctccccaggaagcccactg

SEQ ID NO: 5884616 - DNA, 20 bp, Homo sapiens
ctccccaggaagtggctcag

SEQ ID NO: 5884617 - DNA, 18 bp, Homo sapiens
ctccccaggaatttggga

SEQ ID NO: 5884618 - DNA, 13 bp, Homo sapiens
ctccccaggactc

SEQ ID NO: 5884619 - DNA, 17 bp, Homo sapiens
ctccccaggacttggtc

SEQ ID NO: 5884620 - DNA, 21 bp, Homo sapiens
ctccccaggccgtggctgccc

SEQ ID NO: 5884621 - DNA, 15 bp, Homo sapiens
ctccccaggcctcca

SEQ ID NO: 5884622 - DNA, 16 bp, Homo sapiens
ctccccaggcctccag

SEQ ID NO: 5884623 - DNA, 18 bp, Homo sapiens
ctccccaggcctccagcc

SEQ ID NO: 5884624 - DNA, 18 bp, Homo sapiens
ctccccagggaagcagca

SEQ ID NO: 5884625 - DNA, 20 bp, Homo sapiens
ctccccagggaagcagcagc

SEQ ID NO: 5884626 - DNA, 14 bp, Homo sapiens
ctccccagggagct

SEQ ID NO: 5884627 - DNA, 19 bp, Homo sapiens
ctccccagggagctctggg

SEQ ID NO: 5884628 - DNA, 13 bp, Homo sapiens
ctccccagggcct

SEQ ID NO: 5884629 - DNA, 12 bp, Homo sapiens
ctccccagggct

SEQ ID NO: 5884630 - DNA, 18 bp, Homo sapiens
ctccccagggctccctta

SEQ ID NO: 5884631 - DNA, 16 bp, Homo sapiens
ctccccaggtccagct

SEQ ID NO: 5884632 - DNA, 23 bp, Homo sapiens
ctccccaggtccagctctggagg

SEQ ID NO: 5884633 - DNA, 14 bp, Homo sapiens
ctccccagtgcctg

SEQ ID NO: 5884634 - DNA, 18 bp, Homo sapiens
ctccccagtgcctgccac

SEQ ID NO: 5884635 - DNA, 19 bp, Homo sapiens
ctccccagtgcctgccact

SEQ ID NO: 5884636 - DNA, 20 bp, Homo sapiens
ctccccagtgcctgccactc

SEQ ID NO: 5884637 - DNA, 21 bp, Homo sapiens
ctccccagtgcctgccactct

SEQ ID NO: 5884638 - DNA, 21 bp, Homo sapiens
ctccccagtgctcctggccct

SEQ ID NO: 5884639 - DNA, 16 bp, Homo sapiens
ctccccagtgtatgtc

SEQ ID NO: 5884640 - DNA, 12 bp, Homo sapiens
ctccccagtgtt

SEQ ID NO: 5884641 - DNA, 11 bp, Homo sapiens
ctccccagttc

SEQ ID NO: 5884642 - DNA, 17 bp, Homo sapiens
ctccccagttccacagc

SEQ ID NO: 5884643 - DNA, 19 bp, Homo sapiens
ctccccagttggcccttct

SEQ ID NO: 5884644 - DNA, 12 bp, Homo sapiens
ctccccatacac

SEQ ID NO: 5884645 - DNA, 20 bp, Homo sapiens
ctccccatacttcctgggat

SEQ ID NO: 5884646 - DNA, 17 bp, Homo sapiens
ctccccatatataaatt

SEQ ID NO: 5884647 - DNA, 23 bp, Homo sapiens
ctccccatcgccagctgatgact

SEQ ID NO: 5884648 - DNA, 17 bp, Homo sapiens
ctccccatctgtccagc

SEQ ID NO: 5884649 - DNA, 18 bp, Homo sapiens
ctccccatggtagtttaa

SEQ ID NO: 5884650 - DNA, 20 bp, Homo sapiens
ctccccatgtgcctgcacca

SEQ ID NO: 5884651 - DNA, 18 bp, Homo sapiens
ctccccatgtgtcctggt

SEQ ID NO: 5884652 - DNA, 15 bp, Homo sapiens
ctccccattcacaga

SEQ ID NO: 5884653 - DNA, 16 bp, Homo sapiens
ctccccattcacagag

SEQ ID NO: 5884654 - DNA, 18 bp, Homo sapiens
ctccccattcacagagcc

SEQ ID NO: 5884655 - DNA, 17 bp, Homo sapiens
ctccccattcagacact

SEQ ID NO: 5884656 - DNA, 14 bp, Homo sapiens
ctccccattcctac

SEQ ID NO: 5884657 - DNA, 19 bp, Homo sapiens
ctccccatttcccatctgc

SEQ ID NO: 5884658 - DNA, 20 bp, Homo sapiens
ctccccatttcccatctgca

SEQ ID NO: 5884659 - DNA, 21 bp, Homo sapiens
ctccccatttcccatctgcac

SEQ ID NO: 5884660 - DNA, 22 bp, Homo sapiens
ctccccatttcccatctgcacc

SEQ ID NO: 5884661 - DNA, 17 bp, Homo sapiens
ctcccccaacacctgct

SEQ ID NO: 5884662 - DNA, 19 bp, Homo sapiens
ctcccccaaccaaggaagg

SEQ ID NO: 5884663 - DNA, 22 bp, Homo sapiens
ctcccccaaccaaggaaggagc

SEQ ID NO: 5884664 - DNA, 13 bp, Homo sapiens
ctcccccaaccca

SEQ ID NO: 5884665 - DNA, 21 bp, Homo sapiens
ctcccccaacccacctctggc

SEQ ID NO: 5884666 - DNA, 21 bp, Homo sapiens
ctcccccaacccccaccccac

SEQ ID NO: 5884667 - DNA, 19 bp, Homo sapiens
ctcccccaaccccctgcaa

SEQ ID NO: 5884668 - DNA, 14 bp, Homo sapiens
ctcccccacaaata

SEQ ID NO: 5884669 - DNA, 14 bp, Homo sapiens
ctcccccacaagag

SEQ ID NO: 5884670 - DNA, 17 bp, Homo sapiens
ctcccccaccactcagg

SEQ ID NO: 5884671 - DNA, 16 bp, Homo sapiens
ctcccccacccatggg

SEQ ID NO: 5884672 - DNA, 21 bp, Homo sapiens
ctcccccacccatggggagga

SEQ ID NO: 5884673 - DNA, 14 bp, Homo sapiens
ctcccccaccccct

SEQ ID NO: 5884674 - DNA, 19 bp, Homo sapiens
ctcccccaccccctcccca

SEQ ID NO: 5884675 - DNA, 16 bp, Homo sapiens
ctcccccacccctgct

SEQ ID NO: 5884676 - DNA, 18 bp, Homo sapiens
ctcccccacgcctccatc

SEQ ID NO: 5884677 - DNA, 14 bp, Homo sapiens
ctcccctctgccct

SEQ ID NO: 5884678 - DNA, 14 bp, Homo sapiens
ctcccctctgctgg

SEQ ID NO: 5884679 - DNA, 12 bp, Homo sapiens
ctcccctcttcc

SEQ ID NO: 5884680 - DNA, 13 bp, Homo sapiens
ctcccctcttcct

SEQ ID NO: 5884681 - DNA, 15 bp, Homo sapiens
ctcccctcttctgag

SEQ ID NO: 5884682 - DNA, 16 bp, Homo sapiens
ctcccctcttttgtaa

SEQ ID NO: 5884683 - DNA, 17 bp, Homo sapiens
ctcccctgaatcctcag

SEQ ID NO: 5884684 - DNA, 16 bp, Homo sapiens
ctcccctgacctgtga

SEQ ID NO: 5884685 - DNA, 14 bp, Homo sapiens
ctcccctgagaggt

SEQ ID NO: 5884686 - DNA, 12 bp, Homo sapiens
ctcccctgagga

SEQ ID NO: 5884687 - DNA, 19 bp, Homo sapiens
ctcccctgaggatcccctg

SEQ ID NO: 5884688 - DNA, 22 bp, Homo sapiens
ctcccctgaggctcagggaaag

SEQ ID NO: 5884689 - DNA, 23 bp, Homo sapiens
ctcccctgaggctggcatcctgg

SEQ ID NO: 5884690 - DNA, 21 bp, Homo sapiens
ctcccctgatagaagattgtt

SEQ ID NO: 5884691 - DNA, 15 bp, Homo sapiens
ctcccctgcactgga

SEQ ID NO: 5884692 - DNA, 15 bp, Homo sapiens
ctcccctgcactgta

SEQ ID NO: 5884693 - DNA, 21 bp, Homo sapiens
ctcccctgcactgtaaaatgt

SEQ ID NO: 5884694 - DNA, 15 bp, Homo sapiens
ctcccctgcagccct

SEQ ID NO: 5884695 - DNA, 12 bp, Homo sapiens
ctcccctgccac

SEQ ID NO: 5884696 - DNA, 13 bp, Homo sapiens
ctcccctgccacc

SEQ ID NO: 5884697 - DNA, 23 bp, Homo sapiens
ctcccctgccaccaggccacctc

SEQ ID NO: 5884698 - DNA, 13 bp, Homo sapiens
ctcccctgccagg

SEQ ID NO: 5884699 - DNA, 11 bp, Homo sapiens
ctcccctgccc

SEQ ID NO: 5884700 - DNA, 18 bp, Homo sapiens
ctcccctgcccagcctgc

SEQ ID NO: 5884701 - DNA, 14 bp, Homo sapiens
ctcccctgccccca

SEQ ID NO: 5884702 - DNA, 15 bp, Homo sapiens
ctcccctgcccccag

SEQ ID NO: 5884703 - DNA, 16 bp, Homo sapiens
ctcccctgcccccagg

SEQ ID NO: 5884704 - DNA, 18 bp, Homo sapiens
ctcccctgcccccaggac

SEQ ID NO: 5884705 - DNA, 22 bp, Homo sapiens
ctcccctgcccccaggactggg

SEQ ID NO: 5884706 - DNA, 14 bp, Homo sapiens
ctcccctgccctgg

SEQ ID NO: 5884707 - DNA, 20 bp, Homo sapiens
ctcccctgccgcctcccggg

SEQ ID NO: 5884708 - DNA, 12 bp, Homo sapiens
ctcccctgccgg

SEQ ID NO: 5884709 - DNA, 13 bp, Homo sapiens
ctcccctgccggt

SEQ ID NO: 5884710 - DNA, 13 bp, Homo sapiens
ctcccctgcctcc

SEQ ID NO: 5884711 - DNA, 14 bp, Homo sapiens
ctcccctgcctccg

SEQ ID NO: 5884712 - DNA, 14 bp, Homo sapiens
ctcccctgccttgc

SEQ ID NO: 5884713 - DNA, 15 bp, Homo sapiens
ctcccctgccttgct

SEQ ID NO: 5884714 - DNA, 21 bp, Homo sapiens
ctcccctgcggagctgcatgg

SEQ ID NO: 5884715 - DNA, 23 bp, Homo sapiens
ctcccctgctcagaatctgatac

SEQ ID NO: 5884716 - DNA, 15 bp, Homo sapiens
ctcccctgctcccag

SEQ ID NO: 5884717 - DNA, 15 bp, Homo sapiens
ctcccctgctgcagg

SEQ ID NO: 5884718 - DNA, 22 bp, Homo sapiens
ctcccctggaagcgacccaggg

SEQ ID NO: 5884719 - DNA, 18 bp, Homo sapiens
ctcccctggacagaggcg

SEQ ID NO: 5884720 - DNA, 18 bp, Homo sapiens
ctcccctggagccagcag

SEQ ID NO: 5884721 - DNA, 23 bp, Homo sapiens
ctcccctggagccagcagggctg

SEQ ID NO: 5884722 - DNA, 15 bp, Homo sapiens
ctcccctggctggct

SEQ ID NO: 5884723 - DNA, 20 bp, Homo sapiens
ctcccctggctggctcctag

SEQ ID NO: 5884724 - DNA, 22 bp, Homo sapiens
ctcccctgggactttcccaccc

SEQ ID NO: 5884725 - DNA, 13 bp, Homo sapiens
ctcccctgggggt

SEQ ID NO: 5884726 - DNA, 14 bp, Homo sapiens
ctcccctgtacctt

SEQ ID NO: 5884727 - DNA, 19 bp, Homo sapiens
ctcccctgtgcagtcctgg

SEQ ID NO: 5884728 - DNA, 23 bp, Homo sapiens
ctcccctgtgccagcccagaggc

SEQ ID NO: 5884729 - DNA, 18 bp, Homo sapiens
ctcccctgttcccctctc

SEQ ID NO: 5884730 - DNA, 22 bp, Homo sapiens
ctcccctgttcccctctccctt

SEQ ID NO: 5884731 - DNA, 11 bp, Homo sapiens
ctccccttccc

SEQ ID NO: 5884732 - DNA, 12 bp, Homo sapiens
ctccccttccca

SEQ ID NO: 5884733 - DNA, 13 bp, Homo sapiens
ctccccttcccag

SEQ ID NO: 5884734 - DNA, 15 bp, Homo sapiens
ctccccttcccagac

SEQ ID NO: 5884735 - DNA, 16 bp, Homo sapiens
ctccccttccctgggg

SEQ ID NO: 5884736 - DNA, 17 bp, Homo sapiens
ctccccttccctgggga

SEQ ID NO: 5884737 - DNA, 15 bp, Homo sapiens
ctccccttcctgcac

SEQ ID NO: 5884738 - DNA, 14 bp, Homo sapiens
ctccccttcctgga

SEQ ID NO: 5884739 - DNA, 16 bp, Homo sapiens
ctccccttcctggaca

SEQ ID NO: 5884740 - DNA, 15 bp, Homo sapiens
ctccccttcctggca

SEQ ID NO: 5884741 - DNA, 16 bp, Homo sapiens
ctccccttcctggcac

SEQ ID NO: 5884742 - DNA, 14 bp, Homo sapiens
ctccccttcctgtt

SEQ ID NO: 5884743 - DNA, 23 bp, Homo sapiens
ctccccttcgcgtatttcaggat

SEQ ID NO: 5884744 - DNA, 19 bp, Homo sapiens
ctccccttctctgcctcac

SEQ ID NO: 5884745 - DNA, 22 bp, Homo sapiens
ctccccttgatttaaacacaca

SEQ ID NO: 5884746 - DNA, 15 bp, Homo sapiens
ctccccttgccagct

SEQ ID NO: 5884747 - DNA, 21 bp, Homo sapiens
ctccccttgcccttcctgacc

SEQ ID NO: 5884748 - DNA, 13 bp, Homo sapiens
ctccccttgcctt

SEQ ID NO: 5884749 - DNA, 20 bp, Homo sapiens
ctccccttggacctccaggg

SEQ ID NO: 5884750 - DNA, 22 bp, Homo sapiens
ctccccttggacctccaggggc

SEQ ID NO: 5884751 - DNA, 23 bp, Homo sapiens
ctccccttggacctccaggggct

SEQ ID NO: 5884752 - DNA, 16 bp, Homo sapiens
ctcccctttcccatca

SEQ ID NO: 5884753 - DNA, 12 bp, Homo sapiens
ctcccctttctt

SEQ ID NO: 5884754 - DNA, 15 bp, Homo sapiens
ctcccctttgaccct

SEQ ID NO: 5884755 - DNA, 12 bp, Homo sapiens
ctccccttttcc

SEQ ID NO: 5884756 - DNA, 20 bp, Homo sapiens
ctccccttttttcttctatt

SEQ ID NO: 5884757 - DNA, 18 bp, Homo sapiens
ctcccgaaaaatgtgtgg

SEQ ID NO: 5884758 - DNA, 16 bp, Homo sapiens
ctcccgaagaatgaac

SEQ ID NO: 5884759 - DNA, 14 bp, Homo sapiens
ctcccgaagccacc

SEQ ID NO: 5884760 - DNA, 16 bp, Homo sapiens
ctcccgaatagctggg

SEQ ID NO: 5884761 - DNA, 20 bp, Homo sapiens
ctcccgaatagctgggacta

SEQ ID NO: 5884762 - DNA, 15 bp, Homo sapiens
ctcccgaatcctgag

SEQ ID NO: 5884763 - DNA, 15 bp, Homo sapiens
ctcccgacagcccat

SEQ ID NO: 5884764 - DNA, 20 bp, Homo sapiens
ctcccgacagcccatcacct

SEQ ID NO: 5884765 - DNA, 15 bp, Homo sapiens
ctcccgactgaccac

SEQ ID NO: 5884766 - DNA, 18 bp, Homo sapiens
ctcccgactgaccactgg

SEQ ID NO: 5884767 - DNA, 13 bp, Homo sapiens
ctcccgagaaatt

SEQ ID NO: 5884768 - DNA, 22 bp, Homo sapiens
ctcccgagcaatggcgcctgct

SEQ ID NO: 5884769 - DNA, 19 bp, Homo sapiens
ctcccgagctcctcttcca

SEQ ID NO: 5884770 - DNA, 24 bp, Homo sapiens
ctcccgagctcctcttccatgctg

SEQ ID NO: 5884771 - DNA, 14 bp, Homo sapiens
ctcccgaggaagca

SEQ ID NO: 5884772 - DNA, 18 bp, Homo sapiens
ctcccgagtagctgggat

SEQ ID NO: 5884773 - DNA, 22 bp, Homo sapiens
ctcccgagtagttgggattaca

SEQ ID NO: 5884774 - DNA, 14 bp, Homo sapiens
ctcccgcaccaggc

SEQ ID NO: 5884775 - DNA, 13 bp, Homo sapiens
ctcccgcaccttc

SEQ ID NO: 5884776 - DNA, 14 bp, Homo sapiens
ctcccgcagagact

SEQ ID NO: 5884777 - DNA, 20 bp, Homo sapiens
ctcccgcagagactggggcc

SEQ ID NO: 5884778 - DNA, 18 bp, Homo sapiens
ctcccgcatgctgcctgc

SEQ ID NO: 5884779 - DNA, 19 bp, Homo sapiens
ctcccgcatgctgcctgcc

SEQ ID NO: 5884780 - DNA, 13 bp, Homo sapiens
ctcccgccaccct

SEQ ID NO: 5884781 - DNA, 14 bp, Homo sapiens
ctcccgccaccctg

SEQ ID NO: 5884782 - DNA, 19 bp, Homo sapiens
ctcccgccaccctgtctca

SEQ ID NO: 5884783 - DNA, 15 bp, Homo sapiens
ctcccgccactcgcc

SEQ ID NO: 5884784 - DNA, 23 bp, Homo sapiens
ctcccgcccaaacctttccccca

SEQ ID NO: 5884785 - DNA, 20 bp, Homo sapiens
ctcccgccccagcctcctga

SEQ ID NO: 5884786 - DNA, 22 bp, Homo sapiens
ctcccgccccagcctcctgagt

SEQ ID NO: 5884787 - DNA, 17 bp, Homo sapiens
ctcccgccccagggtct

SEQ ID NO: 5884788 - DNA, 13 bp, Homo sapiens
ctcccgccccgcc

SEQ ID NO: 5884789 - DNA, 14 bp, Homo sapiens
ctcccgccccgccc

SEQ ID NO: 5884790 - DNA, 18 bp, Homo sapiens
ctcccgccccgcccctcc

SEQ ID NO: 5884791 - DNA, 16 bp, Homo sapiens
ctcccgccccgggctg

SEQ ID NO: 5884792 - DNA, 16 bp, Homo sapiens
ctcccgccccttccca

SEQ ID NO: 5884793 - DNA, 19 bp, Homo sapiens
ctcccgcccttccatgtgc

SEQ ID NO: 5884794 - DNA, 13 bp, Homo sapiens
ctcccgcctcagc

SEQ ID NO: 5884795 - DNA, 20 bp, Homo sapiens
ctcccgcctgattggggcct

SEQ ID NO: 5884796 - DNA, 14 bp, Homo sapiens
ctcccgcctttgac

SEQ ID NO: 5884797 - DNA, 13 bp, Homo sapiens
ctcccgctcccag

SEQ ID NO: 5884798 - DNA, 17 bp, Homo sapiens
ctcccgctccgggctcc

SEQ ID NO: 5884799 - DNA, 19 bp, Homo sapiens
ctcccgctgagcccactct

SEQ ID NO: 5884800 - DNA, 13 bp, Homo sapiens
ctcccgctgcaca

SEQ ID NO: 5884801 - DNA, 20 bp, Homo sapiens
ctcccgctgcccaggggagc

SEQ ID NO: 5884802 - DNA, 13 bp, Homo sapiens
ctcccgctgctgc

SEQ ID NO: 5884803 - DNA, 20 bp, Homo sapiens
ctcccgcttcctccggctgg

SEQ ID NO: 5884804 - DNA, 14 bp, Homo sapiens
ctcccgcttcctgg

SEQ ID NO: 5884805 - DNA, 17 bp, Homo sapiens
ctcccgcttcctggcct

SEQ ID NO: 5884806 - DNA, 20 bp, Homo sapiens
ctcccgcttgctctcctgga

SEQ ID NO: 5884807 - DNA, 22 bp, Homo sapiens
ctcccgcttgctctcctggagc

SEQ ID NO: 5884808 - DNA, 13 bp, Homo sapiens
ctcccggacctgg

SEQ ID NO: 5884809 - DNA, 20 bp, Homo sapiens
ctcccggagagggagtcagt

SEQ ID NO: 5884810 - DNA, 22 bp, Homo sapiens
ctcccggaggtgtcaccttcct

SEQ ID NO: 5884811 - DNA, 14 bp, Homo sapiens
ctcccggcatcctg

SEQ ID NO: 5884812 - DNA, 16 bp, Homo sapiens
ctcccggcatcctgaa

SEQ ID NO: 5884813 - DNA, 18 bp, Homo sapiens
ctcccggccctgcctgct

SEQ ID NO: 5884814 - DNA, 22 bp, Homo sapiens
ctcccggcctggcttcactctc

SEQ ID NO: 5884815 - DNA, 18 bp, Homo sapiens
ctcccggcgggtgctctg

SEQ ID NO: 5884816 - DNA, 15 bp, Homo sapiens
ctcccggctgcctgc

SEQ ID NO: 5884817 - DNA, 18 bp, Homo sapiens
ctcccgggaagcatcctc

SEQ ID NO: 5884818 - DNA, 23 bp, Homo sapiens
ctcccgggactcactggcagccc

SEQ ID NO: 5884819 - DNA, 17 bp, Homo sapiens
ctcccgggatgggtgga

SEQ ID NO: 5884820 - DNA, 21 bp, Homo sapiens
ctcccgggccaagacagatgg

SEQ ID NO: 5884821 - DNA, 15 bp, Homo sapiens
ctcccgggccctccc

SEQ ID NO: 5884822 - DNA, 14 bp, Homo sapiens
ctcccgggcctcag

SEQ ID NO: 5884823 - DNA, 15 bp, Homo sapiens
ctcccggggcagggc

SEQ ID NO: 5884824 - DNA, 14 bp, Homo sapiens
ctcccggggcccag

SEQ ID NO: 5884825 - DNA, 12 bp, Homo sapiens
ctcccggggcct

SEQ ID NO: 5884826 - DNA, 15 bp, Homo sapiens
ctcccggggcctgga

SEQ ID NO: 5884827 - DNA, 21 bp, Homo sapiens
ctcccggggcctggacaggcg

SEQ ID NO: 5884828 - DNA, 18 bp, Homo sapiens
ctcccggggccttccttt

SEQ ID NO: 5884829 - DNA, 20 bp, Homo sapiens
ctcccgggggcagggtgggg

SEQ ID NO: 5884830 - DNA, 21 bp, Homo sapiens
ctcccgggggccccacctcgg

SEQ ID NO: 5884831 - DNA, 16 bp, Homo sapiens
ctcccggggtgcccgt

SEQ ID NO: 5884832 - DNA, 19 bp, Homo sapiens
ctcccggggtgcccgtgtg

SEQ ID NO: 5884833 - DNA, 21 bp, Homo sapiens
ctcccggggtgcccgtgtggc

SEQ ID NO: 5884834 - DNA, 23 bp, Homo sapiens
ctcccggggtgcccgtgtggcct

SEQ ID NO: 5884835 - DNA, 20 bp, Homo sapiens
ctcccgggtctcaggcctcc

SEQ ID NO: 5884836 - DNA, 19 bp, Homo sapiens
ctcccgggttcaagtgatt

SEQ ID NO: 5884837 - DNA, 21 bp, Homo sapiens
ctcccggtgcccaagaataga

SEQ ID NO: 5884838 - DNA, 18 bp, Homo sapiens
ctcccggttccctcccca

SEQ ID NO: 5884839 - DNA, 22 bp, Homo sapiens
ctcccgtactgtctgtgtcctt

SEQ ID NO: 5884840 - DNA, 17 bp, Homo sapiens
ctcccgtagtctcctgg

SEQ ID NO: 5884841 - DNA, 16 bp, Homo sapiens
ctcccgtcagggccca

SEQ ID NO: 5884842 - DNA, 21 bp, Homo sapiens
ctcccgtcagggcccaagtcc

SEQ ID NO: 5884843 - DNA, 22 bp, Homo sapiens
ctcccgtccgtccgcccgccca

SEQ ID NO: 5884844 - DNA, 23 bp, Homo sapiens
ctcccgtccgtccgcccgcccac

SEQ ID NO: 5884845 - DNA, 14 bp, Homo sapiens
ctcccgtctcgcct

SEQ ID NO: 5884846 - DNA, 13 bp, Homo sapiens
ctcccgtcttcct

SEQ ID NO: 5884847 - DNA, 21 bp, Homo sapiens
ctcccgtgtatctggacactg

SEQ ID NO: 5884848 - DNA, 20 bp, Homo sapiens
ctcccgttccgtgggatgcc

SEQ ID NO: 5884849 - DNA, 20 bp, Homo sapiens
ctccctaaaataaaaaccag

SEQ ID NO: 5884850 - DNA, 21 bp, Homo sapiens
ctccctaaaataaaaaccaga

SEQ ID NO: 5884851 - DNA, 23 bp, Homo sapiens
ctccctaaaataaaaaccagaat

SEQ ID NO: 5884852 - DNA, 14 bp, Homo sapiens
ctccctaaagccct

SEQ ID NO: 5884853 - DNA, 16 bp, Homo sapiens
ctccctaaagccctct

SEQ ID NO: 5884854 - DNA, 22 bp, Homo sapiens
ctccctaacagtgaaaagagag

SEQ ID NO: 5884855 - DNA, 14 bp, Homo sapiens
ctccctctgcctca

SEQ ID NO: 5884856 - DNA, 15 bp, Homo sapiens
ctccctctgcctcat

SEQ ID NO: 5884857 - DNA, 22 bp, Homo sapiens
ctccctctgccttcaggcttct

SEQ ID NO: 5884858 - DNA, 13 bp, Homo sapiens
ctccctctgctct

SEQ ID NO: 5884859 - DNA, 15 bp, Homo sapiens
ctccctctgctctca

SEQ ID NO: 5884860 - DNA, 14 bp, Homo sapiens
ctccctctggatca

SEQ ID NO: 5884861 - DNA, 16 bp, Homo sapiens
ctccctctggatcaaa

SEQ ID NO: 5884862 - DNA, 14 bp, Homo sapiens
ctccctcttcactg

SEQ ID NO: 5884863 - DNA, 13 bp, Homo sapiens
ctccctcttccca

SEQ ID NO: 5884864 - DNA, 14 bp, Homo sapiens
ctccctcttcccag

SEQ ID NO: 5884865 - DNA, 16 bp, Homo sapiens
ctccctcttcccagca

SEQ ID NO: 5884866 - DNA, 19 bp, Homo sapiens
ctccctcttcctctccata

SEQ ID NO: 5884867 - DNA, 16 bp, Homo sapiens
ctccctcttccttccc

SEQ ID NO: 5884868 - DNA, 15 bp, Homo sapiens
ctccctcttctgccc

SEQ ID NO: 5884869 - DNA, 17 bp, Homo sapiens
ctccctcttgttttgtt

SEQ ID NO: 5884870 - DNA, 12 bp, Homo sapiens
ctccctctttcc

SEQ ID NO: 5884871 - DNA, 19 bp, Homo sapiens
ctccctctttccctccctt

SEQ ID NO: 5884872 - DNA, 15 bp, Homo sapiens
ctccctctttctagc

SEQ ID NO: 5884873 - DNA, 19 bp, Homo sapiens
ctccctctttctagcctgg

SEQ ID NO: 5884874 - DNA, 14 bp, Homo sapiens
ctccctctttctca

SEQ ID NO: 5884875 - DNA, 17 bp, Homo sapiens
ctccctctttttctctg

SEQ ID NO: 5884876 - DNA, 17 bp, Homo sapiens
ctccctgaaacactgct

SEQ ID NO: 5884877 - DNA, 21 bp, Homo sapiens
ctccctgaacctcagtttcct

SEQ ID NO: 5884878 - DNA, 13 bp, Homo sapiens
ctccctgaagcca

SEQ ID NO: 5884879 - DNA, 17 bp, Homo sapiens
ctccctgaagccagcct

SEQ ID NO: 5884880 - DNA, 21 bp, Homo sapiens
ctccctgacatttctaacata

SEQ ID NO: 5884881 - DNA, 16 bp, Homo sapiens
ctccctgaccaccctg

SEQ ID NO: 5884882 - DNA, 14 bp, Homo sapiens
ctccctgaccccct

SEQ ID NO: 5884883 - DNA, 15 bp, Homo sapiens
ctccctgaccccctg

SEQ ID NO: 5884884 - DNA, 18 bp, Homo sapiens
ctccctgaccctgctcct

SEQ ID NO: 5884885 - DNA, 23 bp, Homo sapiens
ctccctgaccctgtatatagccc

SEQ ID NO: 5884886 - DNA, 21 bp, Homo sapiens
ctccctgaccttagcgttctg

SEQ ID NO: 5884887 - DNA, 15 bp, Homo sapiens
ctccctgacgtctgc

SEQ ID NO: 5884888 - DNA, 17 bp, Homo sapiens
ctccctgactccctgtg

SEQ ID NO: 5884889 - DNA, 20 bp, Homo sapiens
ctccctgactccctgtgggg

SEQ ID NO: 5884890 - DNA, 18 bp, Homo sapiens
ctccctgactggcctggg

SEQ ID NO: 5884891 - DNA, 13 bp, Homo sapiens
ctccctgacttct

SEQ ID NO: 5884892 - DNA, 12 bp, Homo sapiens
ctccctgagcct

SEQ ID NO: 5884893 - DNA, 13 bp, Homo sapiens
ctccctgagcctg

SEQ ID NO: 5884894 - DNA, 21 bp, Homo sapiens
ctccctgagcctgcattctgc

SEQ ID NO: 5884895 - DNA, 15 bp, Homo sapiens
ctccctgagcctgcc

SEQ ID NO: 5884896 - DNA, 16 bp, Homo sapiens
ctccctgagctttggg

SEQ ID NO: 5884897 - DNA, 17 bp, Homo sapiens
ctccctgagctttgggg

SEQ ID NO: 5884898 - DNA, 12 bp, Homo sapiens
ctccctgaggca

SEQ ID NO: 5884899 - DNA, 15 bp, Homo sapiens
ctccctgagggcgga

SEQ ID NO: 5884900 - DNA, 22 bp, Homo sapiens
ctccctgagggcggagcgcctc

SEQ ID NO: 5884901 - DNA, 20 bp, Homo sapiens
ctccctgaggtacctttcca

SEQ ID NO: 5884902 - DNA, 17 bp, Homo sapiens
ctccctgagtctggacc

SEQ ID NO: 5884903 - DNA, 20 bp, Homo sapiens
ctccctgatcccaccccctc

SEQ ID NO: 5884904 - DNA, 17 bp, Homo sapiens
ctccctgatcccagacc

SEQ ID NO: 5884905 - DNA, 20 bp, Homo sapiens
ctccctgatcccagacctgt

SEQ ID NO: 5884906 - DNA, 14 bp, Homo sapiens
ctccctgatgacac

SEQ ID NO: 5884907 - DNA, 17 bp, Homo sapiens
ctccctgatgacaccca

SEQ ID NO: 5884908 - DNA, 20 bp, Homo sapiens
ctccctgatgggggacagga

SEQ ID NO: 5884909 - DNA, 15 bp, Homo sapiens
ctccctgatgtacag

SEQ ID NO: 5884910 - DNA, 20 bp, Homo sapiens
ctccctgattaaagtgcctt

SEQ ID NO: 5884911 - DNA, 14 bp, Homo sapiens
ctccctgcaataaa

SEQ ID NO: 5884912 - DNA, 14 bp, Homo sapiens
ctccctgcaccgcc

SEQ ID NO: 5884913 - DNA, 22 bp, Homo sapiens
ctccctgcaccgccgcagaagc

SEQ ID NO: 5884914 - DNA, 17 bp, Homo sapiens
ctccctgcaccgtctca

SEQ ID NO: 5884915 - DNA, 15 bp, Homo sapiens
ctccctgcacttcat

SEQ ID NO: 5884916 - DNA, 14 bp, Homo sapiens
ctccctgcagactc

SEQ ID NO: 5884917 - DNA, 23 bp, Homo sapiens
ctccctgcagatgccaccctagc

SEQ ID NO: 5884918 - DNA, 15 bp, Homo sapiens
ctccctgcagccttt

SEQ ID NO: 5884919 - DNA, 18 bp, Homo sapiens
ctccctgcagccttttct

SEQ ID NO: 5884920 - DNA, 12 bp, Homo sapiens
ctccctgcagct

SEQ ID NO: 5884921 - DNA, 11 bp, Homo sapiens
ctccctgcagg

SEQ ID NO: 5884922 - DNA, 23 bp, Homo sapiens
ctccctgcatctgaccagcagcg

SEQ ID NO: 5884923 - DNA, 14 bp, Homo sapiens
ctccctgcatggca

SEQ ID NO: 5884924 - DNA, 14 bp, Homo sapiens
ctccctgccaactc

SEQ ID NO: 5884925 - DNA, 19 bp, Homo sapiens
ctccctgccaagtctcaga

SEQ ID NO: 5884926 - DNA, 22 bp, Homo sapiens
ctccctgccaagtctcagaaga

SEQ ID NO: 5884927 - DNA, 22 bp, Homo sapiens
ctccctgccaccgtcacacagt

SEQ ID NO: 5884928 - DNA, 14 bp, Homo sapiens
ctccctgccagagg

SEQ ID NO: 5884929 - DNA, 19 bp, Homo sapiens
ctccctgccagaggggaag

SEQ ID NO: 5884930 - DNA, 21 bp, Homo sapiens
ctccctgccatccccctctca

SEQ ID NO: 5884931 - DNA, 17 bp, Homo sapiens
ctccctgcccaaactcc

SEQ ID NO: 5884932 - DNA, 15 bp, Homo sapiens
ctccctgccccaaat

SEQ ID NO: 5884933 - DNA, 23 bp, Homo sapiens
ctccctgccccccaaggttctgg

SEQ ID NO: 5884934 - DNA, 23 bp, Homo sapiens
ctccctgccccccagccctcctt

SEQ ID NO: 5884935 - DNA, 18 bp, Homo sapiens
ctccctgcccctcccttc

SEQ ID NO: 5884936 - DNA, 18 bp, Homo sapiens
ctccctgccccttaaccc

SEQ ID NO: 5884937 - DNA, 19 bp, Homo sapiens
ctccctgccctcgggtctc

SEQ ID NO: 5884938 - DNA, 16 bp, Homo sapiens
ctccctgccgcctcaa

SEQ ID NO: 5884939 - DNA, 18 bp, Homo sapiens
ctccctgccgcctcaatg

SEQ ID NO: 5884940 - DNA, 10 bp, Homo sapiens
ctccctgcct

SEQ ID NO: 5884941 - DNA, 13 bp, Homo sapiens
ctccctgcctcac

SEQ ID NO: 5884942 - DNA, 16 bp, Homo sapiens
ctccctgcctccaccc

SEQ ID NO: 5884943 - DNA, 16 bp, Homo sapiens
ctccctgcctcctgcc

SEQ ID NO: 5884944 - DNA, 14 bp, Homo sapiens
ctccctgcctgagg

SEQ ID NO: 5884945 - DNA, 13 bp, Homo sapiens
ctccctgcctgct

SEQ ID NO: 5884946 - DNA, 15 bp, Homo sapiens
ctccctgcctgctcc

SEQ ID NO: 5884947 - DNA, 14 bp, Homo sapiens
ctccctgcctggat

SEQ ID NO: 5884948 - DNA, 16 bp, Homo sapiens
ctccctgcctggcccc

SEQ ID NO: 5884949 - DNA, 14 bp, Homo sapiens
ctccctgcctgtgg

SEQ ID NO: 5884950 - DNA, 19 bp, Homo sapiens
ctccctgcctgtggcccct

SEQ ID NO: 5884951 - DNA, 16 bp, Homo sapiens
ctccctgcctgtttcc

SEQ ID NO: 5884952 - DNA, 12 bp, Homo sapiens
ctccctgccttt

SEQ ID NO: 5884953 - DNA, 18 bp, Homo sapiens
ctccctgcgcttcctgag

SEQ ID NO: 5884954 - DNA, 15 bp, Homo sapiens
ctccctgctaccaag

SEQ ID NO: 5884955 - DNA, 20 bp, Homo sapiens
ctccctgctagcacagaggc

SEQ ID NO: 5884956 - DNA, 14 bp, Homo sapiens
ctccctgctcagtg

SEQ ID NO: 5884957 - DNA, 15 bp, Homo sapiens
ctccctgctcagtgc

SEQ ID NO: 5884958 - DNA, 14 bp, Homo sapiens
ctccctgctccctg

SEQ ID NO: 5884959 - DNA, 16 bp, Homo sapiens
ctccctgctccctgct

SEQ ID NO: 5884960 - DNA, 19 bp, Homo sapiens
ctccctgctccctgctccc

SEQ ID NO: 5884961 - DNA, 18 bp, Homo sapiens
ctccctgctcctcatggg

SEQ ID NO: 5884962 - DNA, 19 bp, Homo sapiens
ctccctgctcctcatggga

SEQ ID NO: 5884963 - DNA, 19 bp, Homo sapiens
ctccctgctgtcccctctt

SEQ ID NO: 5884964 - DNA, 20 bp, Homo sapiens
ctccctgctgtcccctcttg

SEQ ID NO: 5884965 - DNA, 13 bp, Homo sapiens
ctccctgctgtgc

SEQ ID NO: 5884966 - DNA, 22 bp, Homo sapiens
ctccctgctgtgccatgctggg

SEQ ID NO: 5884967 - DNA, 20 bp, Homo sapiens
ctccctgcttgcacacttcc

SEQ ID NO: 5884968 - DNA, 19 bp, Homo sapiens
ctccctgcttgcaggaggc

SEQ ID NO: 5884969 - DNA, 12 bp, Homo sapiens
ctccctgctttg

SEQ ID NO: 5884970 - DNA, 15 bp, Homo sapiens
ctccctgctttggct

SEQ ID NO: 5884971 - DNA, 19 bp, Homo sapiens
ctccctggaaagcaggcaa

SEQ ID NO: 5884972 - DNA, 21 bp, Homo sapiens
ctccctggaccccattctgag

SEQ ID NO: 5884973 - DNA, 16 bp, Homo sapiens
ctccctggactctgtg

SEQ ID NO: 5884974 - DNA, 18 bp, Homo sapiens
ctccctggactctgtggg

SEQ ID NO: 5884975 - DNA, 11 bp, Homo sapiens
ctccctggagc

SEQ ID NO: 5884976 - DNA, 21 bp, Homo sapiens
ctccctggagccagactctgg

SEQ ID NO: 5884977 - DNA, 14 bp, Homo sapiens
ctccctggagccct

SEQ ID NO: 5884978 - DNA, 15 bp, Homo sapiens
ctccctggagccctg

SEQ ID NO: 5884979 - DNA, 12 bp, Homo sapiens
ctccctggagga

SEQ ID NO: 5884980 - DNA, 12 bp, Homo sapiens
ctccctggaggc

SEQ ID NO: 5884981 - DNA, 22 bp, Homo sapiens
ctccctggaggcacgcaccact

SEQ ID NO: 5884982 - DNA, 22 bp, Homo sapiens
ctccctggagtgcagtttccaa

SEQ ID NO: 5884983 - DNA, 23 bp, Homo sapiens
ctccctggagtgtggctgaggag

SEQ ID NO: 5884984 - DNA, 16 bp, Homo sapiens
ctccctggatcacata

SEQ ID NO: 5884985 - DNA, 21 bp, Homo sapiens
ctccctggatctacctggagg

SEQ ID NO: 5884986 - DNA, 16 bp, Homo sapiens
ctccctggcagacaca

SEQ ID NO: 5884987 - DNA, 13 bp, Homo sapiens
ctccctggcccag

SEQ ID NO: 5884988 - DNA, 18 bp, Homo sapiens
ctccctggcccagccagc

SEQ ID NO: 5884989 - DNA, 12 bp, Homo sapiens
ctccctggccct

SEQ ID NO: 5884990 - DNA, 13 bp, Homo sapiens
ctccctggccctc

SEQ ID NO: 5884991 - DNA, 12 bp, Homo sapiens
ctccctggcctc

SEQ ID NO: 5884992 - DNA, 15 bp, Homo sapiens
ctccctggccttgcc

SEQ ID NO: 5884993 - DNA, 16 bp, Homo sapiens
ctccctggccttgccc

SEQ ID NO: 5884994 - DNA, 11 bp, Homo sapiens
ctccctggctc

SEQ ID NO: 5884995 - DNA, 16 bp, Homo sapiens
ctccctggctcactgg

SEQ ID NO: 5884996 - DNA, 14 bp, Homo sapiens
ctccctggctccct

SEQ ID NO: 5884997 - DNA, 12 bp, Homo sapiens
ctccctggctgc

SEQ ID NO: 5884998 - DNA, 16 bp, Homo sapiens
ctccctggctgcagcc

SEQ ID NO: 5884999 - DNA, 18 bp, Homo sapiens
ctccctggctgcagcctc

SEQ ID NO: 5885000 - DNA, 19 bp, Homo sapiens
ctccctggctgcagcctcc

SEQ ID NO: 5885001 - DNA, 20 bp, Homo sapiens
ctccctggctgcagcctccg

SEQ ID NO: 5885002 - DNA, 13 bp, Homo sapiens
ctccctggctgcc

SEQ ID NO: 5885003 - DNA, 20 bp, Homo sapiens
ctccctggctgccctggccc

SEQ ID NO: 5885004 - DNA, 19 bp, Homo sapiens
ctccctgggacacagaccc

SEQ ID NO: 5885005 - DNA, 13 bp, Homo sapiens
ctccctgggcacc

SEQ ID NO: 5885006 - DNA, 17 bp, Homo sapiens
ctccctgggcaccctgc

SEQ ID NO: 5885007 - DNA, 19 bp, Homo sapiens
ctccctgggccacctccta

SEQ ID NO: 5885008 - DNA, 21 bp, Homo sapiens
ctccctgggcctcttcttcct

SEQ ID NO: 5885009 - DNA, 16 bp, Homo sapiens
ctccctgggcctgtct

SEQ ID NO: 5885010 - DNA, 13 bp, Homo sapiens
ctccctgggctgg

SEQ ID NO: 5885011 - DNA, 18 bp, Homo sapiens
ctccctgggctggcatgg

SEQ ID NO: 5885012 - DNA, 11 bp, Homo sapiens
ctccctgggga

SEQ ID NO: 5885013 - DNA, 18 bp, Homo sapiens
ctccctggggaccaggag

SEQ ID NO: 5885014 - DNA, 22 bp, Homo sapiens
ctccctggggaggacccctgcc

SEQ ID NO: 5885015 - DNA, 22 bp, Homo sapiens
ctccctgggggcggccagccct

SEQ ID NO: 5885016 - DNA, 16 bp, Homo sapiens
ctccctgggggtgggg

SEQ ID NO: 5885017 - DNA, 21 bp, Homo sapiens
ctccctgggggtggggctcct

SEQ ID NO: 5885018 - DNA, 23 bp, Homo sapiens
ctccctgggggtggggctcctac

SEQ ID NO: 5885019 - DNA, 15 bp, Homo sapiens
ctccctgggtctggg

SEQ ID NO: 5885020 - DNA, 19 bp, Homo sapiens
ctccctggtagctgggatt

SEQ ID NO: 5885021 - DNA, 15 bp, Homo sapiens
ctccctggtcccctc

SEQ ID NO: 5885022 - DNA, 16 bp, Homo sapiens
ctccctggtcccctcc

SEQ ID NO: 5885023 - DNA, 16 bp, Homo sapiens
ctccctggtgcctctg

SEQ ID NO: 5885024 - DNA, 20 bp, Homo sapiens
ctccctggtgcctctgtgca

SEQ ID NO: 5885025 - DNA, 13 bp, Homo sapiens
ctccctggtgctt

SEQ ID NO: 5885026 - DNA, 18 bp, Homo sapiens
ctccctggtgcttatgct

SEQ ID NO: 5885027 - DNA, 13 bp, Homo sapiens
ctccctggttgcc

SEQ ID NO: 5885028 - DNA, 15 bp, Homo sapiens
ctccctggttgcctc

SEQ ID NO: 5885029 - DNA, 18 bp, Homo sapiens
ctccctggttgcctctct

SEQ ID NO: 5885030 - DNA, 22 bp, Homo sapiens
ctccctggttgcctctcttgcc

SEQ ID NO: 5885031 - DNA, 23 bp, Homo sapiens
ctccctggttttaccccagctcc

SEQ ID NO: 5885032 - DNA, 13 bp, Homo sapiens
ctccctgtaactt

SEQ ID NO: 5885033 - DNA, 15 bp, Homo sapiens
ctccctgtaacttga

SEQ ID NO: 5885034 - DNA, 19 bp, Homo sapiens
ctccctgtaatgcactcct

SEQ ID NO: 5885035 - DNA, 14 bp, Homo sapiens
ctcctagaagtctt

SEQ ID NO: 5885036 - DNA, 21 bp, Homo sapiens
ctcctagactgaccctgatca

SEQ ID NO: 5885037 - DNA, 18 bp, Homo sapiens
ctcctagagacagaagca

SEQ ID NO: 5885038 - DNA, 17 bp, Homo sapiens
ctcctagagaggagaaa

SEQ ID NO: 5885039 - DNA, 13 bp, Homo sapiens
ctcctagagggag

SEQ ID NO: 5885040 - DNA, 18 bp, Homo sapiens
ctcctagagggaggggcc

SEQ ID NO: 5885041 - DNA, 19 bp, Homo sapiens
ctcctagagggaggggcct

SEQ ID NO: 5885042 - DNA, 13 bp, Homo sapiens
ctcctagaggtgg

SEQ ID NO: 5885043 - DNA, 16 bp, Homo sapiens
ctcctagaggtgggca

SEQ ID NO: 5885044 - DNA, 15 bp, Homo sapiens
ctcctagagtgcagg

SEQ ID NO: 5885045 - DNA, 14 bp, Homo sapiens
ctcctagcaccctg

SEQ ID NO: 5885046 - DNA, 13 bp, Homo sapiens
ctcctagcccctc

SEQ ID NO: 5885047 - DNA, 14 bp, Homo sapiens
ctcctagccccttc

SEQ ID NO: 5885048 - DNA, 12 bp, Homo sapiens
ctcctagccctc

SEQ ID NO: 5885049 - DNA, 17 bp, Homo sapiens
ctcctagcctgctctgc

SEQ ID NO: 5885050 - DNA, 18 bp, Homo sapiens
ctcctagcctgctctgcc

SEQ ID NO: 5885051 - DNA, 20 bp, Homo sapiens
ctcctagcctgctctgccac

SEQ ID NO: 5885052 - DNA, 12 bp, Homo sapiens
ctcctagctctc

SEQ ID NO: 5885053 - DNA, 20 bp, Homo sapiens
ctcctagctggagtgccatg

SEQ ID NO: 5885054 - DNA, 18 bp, Homo sapiens
ctcctaggaaaccagctc

SEQ ID NO: 5885055 - DNA, 13 bp, Homo sapiens
ctcctaggagagc

SEQ ID NO: 5885056 - DNA, 16 bp, Homo sapiens
ctcctaggagagccaa

SEQ ID NO: 5885057 - DNA, 23 bp, Homo sapiens
ctcctaggagagccaacctcggc

SEQ ID NO: 5885058 - DNA, 13 bp, Homo sapiens
ctcctaggccctt

SEQ ID NO: 5885059 - DNA, 16 bp, Homo sapiens
ctcctaggcgctcaga

SEQ ID NO: 5885060 - DNA, 17 bp, Homo sapiens
ctcctaggcgctcagag

SEQ ID NO: 5885061 - DNA, 20 bp, Homo sapiens
ctcctaggcgctcagaggcc

SEQ ID NO: 5885062 - DNA, 22 bp, Homo sapiens
ctcctaggcgctcagaggccgc

SEQ ID NO: 5885063 - DNA, 14 bp, Homo sapiens
ctcctaggctccct

SEQ ID NO: 5885064 - DNA, 16 bp, Homo sapiens
ctcctaggctccctga

SEQ ID NO: 5885065 - DNA, 20 bp, Homo sapiens
ctcctaggctccctgaggta

SEQ ID NO: 5885066 - DNA, 20 bp, Homo sapiens
ctcctagggaaaagttcata

SEQ ID NO: 5885067 - DNA, 21 bp, Homo sapiens
ctcctaggggaacagaccagt

SEQ ID NO: 5885068 - DNA, 13 bp, Homo sapiens
ctcctaggggaag

SEQ ID NO: 5885069 - DNA, 15 bp, Homo sapiens
ctcctaggggaaggg

SEQ ID NO: 5885070 - DNA, 19 bp, Homo sapiens
ctcctaggggcttggtcct

SEQ ID NO: 5885071 - DNA, 16 bp, Homo sapiens
ctcctagggggtgtca

SEQ ID NO: 5885072 - DNA, 22 bp, Homo sapiens
ctcctagggggtgtcagaagct

SEQ ID NO: 5885073 - DNA, 23 bp, Homo sapiens
ctcctagtaggggtaccactgaa

SEQ ID NO: 5885074 - DNA, 17 bp, Homo sapiens
ctcctagttctagaaaa

SEQ ID NO: 5885075 - DNA, 23 bp, Homo sapiens
ctcctagttctagaaaaacaggc

SEQ ID NO: 5885076 - DNA, 23 bp, Homo sapiens
ctcctataaagggcccacacctg

SEQ ID NO: 5885077 - DNA, 19 bp, Homo sapiens
ctcctataaagtgcctcgg

SEQ ID NO: 5885078 - DNA, 20 bp, Homo sapiens
ctcctataatcccaatattt

SEQ ID NO: 5885079 - DNA, 21 bp, Homo sapiens
ctcctataatctgtcaaaaca

SEQ ID NO: 5885080 - DNA, 23 bp, Homo sapiens
ctcctataatctgtcaaaacact

SEQ ID NO: 5885081 - DNA, 17 bp, Homo sapiens
ctcctatatatttctat

SEQ ID NO: 5885082 - DNA, 15 bp, Homo sapiens
ctcctatatcattat

SEQ ID NO: 5885083 - DNA, 17 bp, Homo sapiens
ctcctatatcctccttc

SEQ ID NO: 5885084 - DNA, 19 bp, Homo sapiens
ctcctatatcctccttctc

SEQ ID NO: 5885085 - DNA, 17 bp, Homo sapiens
ctcctatcacctcccct

SEQ ID NO: 5885086 - DNA, 19 bp, Homo sapiens
ctcctatcacctcccctcc

SEQ ID NO: 5885087 - DNA, 18 bp, Homo sapiens
ctcctatcacctgtcttg

SEQ ID NO: 5885088 - DNA, 14 bp, Homo sapiens
ctcctatcctggtt

SEQ ID NO: 5885089 - DNA, 15 bp, Homo sapiens
ctcctatccttggag

SEQ ID NO: 5885090 - DNA, 15 bp, Homo sapiens
ctcctatctgtgttt

SEQ ID NO: 5885091 - DNA, 18 bp, Homo sapiens
ctcctatctgtgttttga

SEQ ID NO: 5885092 - DNA, 14 bp, Homo sapiens
ctcctatcttcata

SEQ ID NO: 5885093 - DNA, 18 bp, Homo sapiens
ctcctatctttcctccct

SEQ ID NO: 5885094 - DNA, 15 bp, Homo sapiens
ctcctatcttttatt

SEQ ID NO: 5885095 - DNA, 16 bp, Homo sapiens
ctcctatgatctgagt

SEQ ID NO: 5885096 - DNA, 22 bp, Homo sapiens
ctcctatgggttgtcaccaagc

SEQ ID NO: 5885097 - DNA, 19 bp, Homo sapiens
ctcctatgtggcagctggg

SEQ ID NO: 5885098 - DNA, 12 bp, Homo sapiens
ctcctatgtgta

SEQ ID NO: 5885099 - DNA, 16 bp, Homo sapiens
ctcctatgtgtgcctc

SEQ ID NO: 5885100 - DNA, 18 bp, Homo sapiens
ctcctatgtttggctgct

SEQ ID NO: 5885101 - DNA, 22 bp, Homo sapiens
ctcctattcagttcccagaatc

SEQ ID NO: 5885102 - DNA, 15 bp, Homo sapiens
ctcctattctataaa

SEQ ID NO: 5885103 - DNA, 22 bp, Homo sapiens
ctcctattctcttaatttttct

SEQ ID NO: 5885104 - DNA, 23 bp, Homo sapiens
ctcctattgaaagaccagatcct

SEQ ID NO: 5885105 - DNA, 15 bp, Homo sapiens
ctcctatttatgaaa

SEQ ID NO: 5885106 - DNA, 19 bp, Homo sapiens
ctcctatttttgtaaactg

SEQ ID NO: 5885107 - DNA, 19 bp, Homo sapiens
ctcctcaaaccacttgcct

SEQ ID NO: 5885108 - DNA, 22 bp, Homo sapiens
ctcctcaaaccacttgcctggg

SEQ ID NO: 5885109 - DNA, 15 bp, Homo sapiens
ctcctcaacccctcc

SEQ ID NO: 5885110 - DNA, 14 bp, Homo sapiens
ctcctcaactcacc

SEQ ID NO: 5885111 - DNA, 13 bp, Homo sapiens
ctcctcaagcctg

SEQ ID NO: 5885112 - DNA, 16 bp, Homo sapiens
ctcctcaagcctgtgg

SEQ ID NO: 5885113 - DNA, 16 bp, Homo sapiens
ctcctcaagggcagag

SEQ ID NO: 5885114 - DNA, 15 bp, Homo sapiens
ctcctcacactccag

SEQ ID NO: 5885115 - DNA, 18 bp, Homo sapiens
ctcctcacagacctctgc

SEQ ID NO: 5885116 - DNA, 20 bp, Homo sapiens
ctcctcacccaccctgtggc

SEQ ID NO: 5885117 - DNA, 23 bp, Homo sapiens
ctcctcaccccagtgcctgtctg

SEQ ID NO: 5885118 - DNA, 22 bp, Homo sapiens
ctcctcacccccacccctgtac

SEQ ID NO: 5885119 - DNA, 15 bp, Homo sapiens
ctcctcacccccagc

SEQ ID NO: 5885120 - DNA, 20 bp, Homo sapiens
ctcctcacccccagctttgc

SEQ ID NO: 5885121 - DNA, 15 bp, Homo sapiens
ctcctcaccccgtct

SEQ ID NO: 5885122 - DNA, 18 bp, Homo sapiens
ctcctcaccccgtctggg

SEQ ID NO: 5885123 - DNA, 17 bp, Homo sapiens
ctcctcacccctgtagg

SEQ ID NO: 5885124 - DNA, 18 bp, Homo sapiens
ctcctcacccctgtaggg

SEQ ID NO: 5885125 - DNA, 16 bp, Homo sapiens
ctcctcacctcatgcc

SEQ ID NO: 5885126 - DNA, 12 bp, Homo sapiens
ctcctcacctgt

SEQ ID NO: 5885127 - DNA, 17 bp, Homo sapiens
ctcctcactcaccttca

SEQ ID NO: 5885128 - DNA, 19 bp, Homo sapiens
ctcctcactccctaggccc

SEQ ID NO: 5885129 - DNA, 16 bp, Homo sapiens
ctcctcactcccttct

SEQ ID NO: 5885130 - DNA, 23 bp, Homo sapiens
ctcctcactctgtccctgtcctt

SEQ ID NO: 5885131 - DNA, 16 bp, Homo sapiens
ctcctcactgcccgca

SEQ ID NO: 5885132 - DNA, 18 bp, Homo sapiens
ctcctcactggccatccc

SEQ ID NO: 5885133 - DNA, 16 bp, Homo sapiens
ctcctcactgtatcca

SEQ ID NO: 5885134 - DNA, 15 bp, Homo sapiens
ctcctcagatggggc

SEQ ID NO: 5885135 - DNA, 11 bp, Homo sapiens
ctcctcagcac

SEQ ID NO: 5885136 - DNA, 16 bp, Homo sapiens
ctcctcagcacccctc

SEQ ID NO: 5885137 - DNA, 15 bp, Homo sapiens
ctcctcagccagcct

SEQ ID NO: 5885138 - DNA, 13 bp, Homo sapiens
ctcctcagccccc

SEQ ID NO: 5885139 - DNA, 18 bp, Homo sapiens
ctcctcagcccccaggcc

SEQ ID NO: 5885140 - DNA, 20 bp, Homo sapiens
ctcctcagcccccaggccag

SEQ ID NO: 5885141 - DNA, 21 bp, Homo sapiens
ctcctcagcccccaggccagg

SEQ ID NO: 5885142 - DNA, 13 bp, Homo sapiens
ctcctcagccctc

SEQ ID NO: 5885143 - DNA, 18 bp, Homo sapiens
ctcctcagccctctcttg

SEQ ID NO: 5885144 - DNA, 15 bp, Homo sapiens
ctcctcagcctccct

SEQ ID NO: 5885145 - DNA, 16 bp, Homo sapiens
ctcctcagcctctgca

SEQ ID NO: 5885146 - DNA, 18 bp, Homo sapiens
ctcctcagcctctgcaac

SEQ ID NO: 5885147 - DNA, 19 bp, Homo sapiens
ctcctcagcctctgcaact

SEQ ID NO: 5885148 - DNA, 14 bp, Homo sapiens
ctcctcagctccct

SEQ ID NO: 5885149 - DNA, 19 bp, Homo sapiens
ctcctcagctgcatggagc

SEQ ID NO: 5885150 - DNA, 23 bp, Homo sapiens
ctcctcagctgcatggagcctgg

SEQ ID NO: 5885151 - DNA, 14 bp, Homo sapiens
ctcctcagcttggg

SEQ ID NO: 5885152 - DNA, 15 bp, Homo sapiens
ctcctcaggagagac

SEQ ID NO: 5885153 - DNA, 19 bp, Homo sapiens
ctcctcaggcacacagcta

SEQ ID NO: 5885154 - DNA, 11 bp, Homo sapiens
ctcctcaggga

SEQ ID NO: 5885155 - DNA, 17 bp, Homo sapiens
ctcctcagggactcagg

SEQ ID NO: 5885156 - DNA, 14 bp, Homo sapiens
ctcctcagggatgg

SEQ ID NO: 5885157 - DNA, 16 bp, Homo sapiens
ctcctcagggggtagg

SEQ ID NO: 5885158 - DNA, 20 bp, Homo sapiens
ctcctcagggggtaggagag

SEQ ID NO: 5885159 - DNA, 23 bp, Homo sapiens
ctcctcagggggtaggagagcac

SEQ ID NO: 5885160 - DNA, 23 bp, Homo sapiens
ctcctcagtaaaagtcttctccc

SEQ ID NO: 5885161 - DNA, 22 bp, Homo sapiens
ctcctcagtatgtgggggcttc

SEQ ID NO: 5885162 - DNA, 21 bp, Homo sapiens
ctcctcagtgaaggtggtggg

SEQ ID NO: 5885163 - DNA, 19 bp, Homo sapiens
ctcctcagtggcttctcca

SEQ ID NO: 5885164 - DNA, 21 bp, Homo sapiens
ctcctcagtggcttctccagg

SEQ ID NO: 5885165 - DNA, 17 bp, Homo sapiens
ctcctcagtttacatct

SEQ ID NO: 5885166 - DNA, 14 bp, Homo sapiens
ctcctcagtttctc

SEQ ID NO: 5885167 - DNA, 16 bp, Homo sapiens
ctcctcatccagggct

SEQ ID NO: 5885168 - DNA, 18 bp, Homo sapiens
ctcctcatccatttcttt

SEQ ID NO: 5885169 - DNA, 21 bp, Homo sapiens
ctcctcatccccacaatctgg

SEQ ID NO: 5885170 - DNA, 15 bp, Homo sapiens
ctcctcatcccgtgt

SEQ ID NO: 5885171 - DNA, 14 bp, Homo sapiens
ctcctcatgggaag

SEQ ID NO: 5885172 - DNA, 16 bp, Homo sapiens
ctcctcattcagacca

SEQ ID NO: 5885173 - DNA, 18 bp, Homo sapiens
ctcctccaaaggaagtct

SEQ ID NO: 5885174 - DNA, 23 bp, Homo sapiens
ctcctccaaaggaagtctaggag

SEQ ID NO: 5885175 - DNA, 12 bp, Homo sapiens
ctcctccaaatg

SEQ ID NO: 5885176 - DNA, 15 bp, Homo sapiens
ctcctccaaatgctg

SEQ ID NO: 5885177 - DNA, 13 bp, Homo sapiens
ctcctccacagtg

SEQ ID NO: 5885178 - DNA, 14 bp, Homo sapiens
ctcctccacagtgc

SEQ ID NO: 5885179 - DNA, 17 bp, Homo sapiens
ctcctccacagtgctgc

SEQ ID NO: 5885180 - DNA, 19 bp, Homo sapiens
ctcctccacagtgctgctt

SEQ ID NO: 5885181 - DNA, 16 bp, Homo sapiens
ctcctccaccaccgcc

SEQ ID NO: 5885182 - DNA, 15 bp, Homo sapiens
ctcctccacccaccc

SEQ ID NO: 5885183 - DNA, 16 bp, Homo sapiens
ctcctccacccacccc

SEQ ID NO: 5885184 - DNA, 14 bp, Homo sapiens
ctcctccactccac

SEQ ID NO: 5885185 - DNA, 15 bp, Homo sapiens
ctcctccactccacc

SEQ ID NO: 5885186 - DNA, 17 bp, Homo sapiens
ctcctccactctccccc

SEQ ID NO: 5885187 - DNA, 13 bp, Homo sapiens
ctcctccagactc

SEQ ID NO: 5885188 - DNA, 21 bp, Homo sapiens
ctcctccagactcgagagggc

SEQ ID NO: 5885189 - DNA, 19 bp, Homo sapiens
ctcctccagagcctgggcg

SEQ ID NO: 5885190 - DNA, 17 bp, Homo sapiens
ctcctccagcaagacct

SEQ ID NO: 5885191 - DNA, 15 bp, Homo sapiens
ctcctccagccaaga

SEQ ID NO: 5885192 - DNA, 13 bp, Homo sapiens
ctcctccagccca

SEQ ID NO: 5885193 - DNA, 16 bp, Homo sapiens
ctcctccagcccctgt

SEQ ID NO: 5885194 - DNA, 17 bp, Homo sapiens
ctcctccagcccctgtc

SEQ ID NO: 5885195 - DNA, 15 bp, Homo sapiens
ctcctccagccctgc

SEQ ID NO: 5885196 - DNA, 16 bp, Homo sapiens
ctcctccagccctggg

SEQ ID NO: 5885197 - DNA, 17 bp, Homo sapiens
ctcctccagccctgggc

SEQ ID NO: 5885198 - DNA, 18 bp, Homo sapiens
ctcctccagccctgggca

SEQ ID NO: 5885199 - DNA, 15 bp, Homo sapiens
ctcctccagccgcca

SEQ ID NO: 5885200 - DNA, 22 bp, Homo sapiens
ctcctccagccgccatgctcct

SEQ ID NO: 5885201 - DNA, 18 bp, Homo sapiens
ctcctccagctcctgccc

SEQ ID NO: 5885202 - DNA, 16 bp, Homo sapiens
ctcctccaggaagcct

SEQ ID NO: 5885203 - DNA, 21 bp, Homo sapiens
ctcctccaggaggactgttct

SEQ ID NO: 5885204 - DNA, 13 bp, Homo sapiens
ctcctccaggcct

SEQ ID NO: 5885205 - DNA, 19 bp, Homo sapiens
ctcctccaggcctgcctcc

SEQ ID NO: 5885206 - DNA, 14 bp, Homo sapiens
ctcctccagggcca

SEQ ID NO: 5885207 - DNA, 13 bp, Homo sapiens
ctcctccagggtg

SEQ ID NO: 5885208 - DNA, 23 bp, Homo sapiens
ctcctccagtacgtcccgctgct

SEQ ID NO: 5885209 - DNA, 18 bp, Homo sapiens
ctcctccatctttctaca

SEQ ID NO: 5885210 - DNA, 15 bp, Homo sapiens
ctcctccatgggaga

SEQ ID NO: 5885211 - DNA, 14 bp, Homo sapiens
ctcctccatggtgc

SEQ ID NO: 5885212 - DNA, 22 bp, Homo sapiens
ctcctcccacccaacttcccct

SEQ ID NO: 5885213 - DNA, 15 bp, Homo sapiens
ctcctcccacccggc

SEQ ID NO: 5885214 - DNA, 21 bp, Homo sapiens
ctcctctcctgacaatactgt

SEQ ID NO: 5885215 - DNA, 13 bp, Homo sapiens
ctcctctcctgga

SEQ ID NO: 5885216 - DNA, 20 bp, Homo sapiens
ctcctctcctggaggattgc

SEQ ID NO: 5885217 - DNA, 17 bp, Homo sapiens
ctcctctccttgggctc

SEQ ID NO: 5885218 - DNA, 21 bp, Homo sapiens
ctcctctccttgggctcctgg

SEQ ID NO: 5885219 - DNA, 13 bp, Homo sapiens
ctcctctctagaa

SEQ ID NO: 5885220 - DNA, 13 bp, Homo sapiens
ctcctctctccct

SEQ ID NO: 5885221 - DNA, 22 bp, Homo sapiens
ctcctctctccctgcctcacat

SEQ ID NO: 5885222 - DNA, 20 bp, Homo sapiens
ctcctctctctccctccact

SEQ ID NO: 5885223 - DNA, 20 bp, Homo sapiens
ctcctctctctctctctctg

SEQ ID NO: 5885224 - DNA, 11 bp, Homo sapiens
ctcctctctga

SEQ ID NO: 5885225 - DNA, 12 bp, Homo sapiens
ctcctctctgaa

SEQ ID NO: 5885226 - DNA, 11 bp, Homo sapiens
ctcctctctgc

SEQ ID NO: 5885227 - DNA, 14 bp, Homo sapiens
ctcctctctgccct

SEQ ID NO: 5885228 - DNA, 13 bp, Homo sapiens
ctcctctctgctg

SEQ ID NO: 5885229 - DNA, 14 bp, Homo sapiens
ctcctctctgggcc

SEQ ID NO: 5885230 - DNA, 22 bp, Homo sapiens
ctcctctctggtggctgggctg

SEQ ID NO: 5885231 - DNA, 14 bp, Homo sapiens
ctcctctcttggac

SEQ ID NO: 5885232 - DNA, 13 bp, Homo sapiens
ctcctctctttgt

SEQ ID NO: 5885233 - DNA, 13 bp, Homo sapiens
ctcctctgaaaca

SEQ ID NO: 5885234 - DNA, 17 bp, Homo sapiens
ctcctctgaaacagctg

SEQ ID NO: 5885235 - DNA, 18 bp, Homo sapiens
ctcctctgaaacagctgc

SEQ ID NO: 5885236 - DNA, 18 bp, Homo sapiens
ctcctctgactcagggct

SEQ ID NO: 5885237 - DNA, 16 bp, Homo sapiens
ctcctctgagcagcct

SEQ ID NO: 5885238 - DNA, 17 bp, Homo sapiens
ctcctctgaggaagcag

SEQ ID NO: 5885239 - DNA, 17 bp, Homo sapiens
ctcctctgattatcagg

SEQ ID NO: 5885240 - DNA, 13 bp, Homo sapiens
ctcctctgcagcc

SEQ ID NO: 5885241 - DNA, 18 bp, Homo sapiens
ctcctctgcagtgccttg

SEQ ID NO: 5885242 - DNA, 16 bp, Homo sapiens
ctcctctgccacctcc

SEQ ID NO: 5885243 - DNA, 13 bp, Homo sapiens
ctcctctgccccc

SEQ ID NO: 5885244 - DNA, 15 bp, Homo sapiens
ctcctctgccccctc

SEQ ID NO: 5885245 - DNA, 22 bp, Homo sapiens
ctcctctgccccctcccccgca

SEQ ID NO: 5885246 - DNA, 18 bp, Homo sapiens
ctcctctgcctacagcca

SEQ ID NO: 5885247 - DNA, 20 bp, Homo sapiens
ctcctctgcctacagccagg

SEQ ID NO: 5885248 - DNA, 22 bp, Homo sapiens
ctcctctgcctacagccaggtt

SEQ ID NO: 5885249 - DNA, 12 bp, Homo sapiens
ctcctctgcctg

SEQ ID NO: 5885250 - DNA, 17 bp, Homo sapiens
ctcctctgcctgtgccc

SEQ ID NO: 5885251 - DNA, 13 bp, Homo sapiens
ctcctctgccttg

SEQ ID NO: 5885252 - DNA, 12 bp, Homo sapiens
ctcctctgctag

SEQ ID NO: 5885253 - DNA, 12 bp, Homo sapiens
ctcctctgctcc

SEQ ID NO: 5885254 - DNA, 22 bp, Homo sapiens
ctcctctgctccaacagacacc

SEQ ID NO: 5885255 - DNA, 11 bp, Homo sapiens
ctcctctgctg

SEQ ID NO: 5885256 - DNA, 14 bp, Homo sapiens
ctcctctgctgacc

SEQ ID NO: 5885257 - DNA, 14 bp, Homo sapiens
ctcctctgctgctc

SEQ ID NO: 5885258 - DNA, 18 bp, Homo sapiens
ctcctctgctgctggctg

SEQ ID NO: 5885259 - DNA, 12 bp, Homo sapiens
ctcctctgctgg

SEQ ID NO: 5885260 - DNA, 13 bp, Homo sapiens
ctcctctgctggg

SEQ ID NO: 5885261 - DNA, 13 bp, Homo sapiens
ctcctctgcttgc

SEQ ID NO: 5885262 - DNA, 22 bp, Homo sapiens
ctcctctgcttgcatcacttgg

SEQ ID NO: 5885263 - DNA, 14 bp, Homo sapiens
ctcctctgcttgcc

SEQ ID NO: 5885264 - DNA, 16 bp, Homo sapiens
ctcctctgcttgccat

SEQ ID NO: 5885265 - DNA, 17 bp, Homo sapiens
ctcctctgcttgccatc

SEQ ID NO: 5885266 - DNA, 20 bp, Homo sapiens
ctcctctgcttgccatccct

SEQ ID NO: 5885267 - DNA, 21 bp, Homo sapiens
ctcctctgcttgccatccctc

SEQ ID NO: 5885268 - DNA, 13 bp, Homo sapiens
ctcctctggcagg

SEQ ID NO: 5885269 - DNA, 17 bp, Homo sapiens
ctcctctggcccagcct

SEQ ID NO: 5885270 - DNA, 22 bp, Homo sapiens
ctcctctggcccagcctaccct

SEQ ID NO: 5885271 - DNA, 12 bp, Homo sapiens
ctcctctggcta

SEQ ID NO: 5885272 - DNA, 14 bp, Homo sapiens
ctcctctggctaga

SEQ ID NO: 5885273 - DNA, 14 bp, Homo sapiens
ctcctctggcttcc

SEQ ID NO: 5885274 - DNA, 13 bp, Homo sapiens
ctcctctgggcag

SEQ ID NO: 5885275 - DNA, 16 bp, Homo sapiens
ctcctctgggccctgt

SEQ ID NO: 5885276 - DNA, 17 bp, Homo sapiens
ctcctctgggccctgtc

SEQ ID NO: 5885277 - DNA, 20 bp, Homo sapiens
ctcctctgggcctggggtgc

SEQ ID NO: 5885278 - DNA, 12 bp, Homo sapiens
ctcctctgtcag

SEQ ID NO: 5885279 - DNA, 15 bp, Homo sapiens
ctcctctgtccaggc

SEQ ID NO: 5885280 - DNA, 17 bp, Homo sapiens
ctcctctgtccagggcc

SEQ ID NO: 5885281 - DNA, 13 bp, Homo sapiens
ctcctctgtctct

SEQ ID NO: 5885282 - DNA, 17 bp, Homo sapiens
ctcctctgtctctgctc

SEQ ID NO: 5885283 - DNA, 16 bp, Homo sapiens
ctcctctgtgctccct

SEQ ID NO: 5885284 - DNA, 23 bp, Homo sapiens
ctcctcttaaaaaataaaaactg

SEQ ID NO: 5885285 - DNA, 14 bp, Homo sapiens
ctcctcttagctca

SEQ ID NO: 5885286 - DNA, 18 bp, Homo sapiens
ctcctcttcaactgacca

SEQ ID NO: 5885287 - DNA, 13 bp, Homo sapiens
ctcctcttcacca

SEQ ID NO: 5885288 - DNA, 15 bp, Homo sapiens
ctcctcttcaccagg

SEQ ID NO: 5885289 - DNA, 18 bp, Homo sapiens
ctcctcttcaccccggca

SEQ ID NO: 5885290 - DNA, 19 bp, Homo sapiens
ctcctcttcaccccggcag

SEQ ID NO: 5885291 - DNA, 16 bp, Homo sapiens
ctcctcttccagagtc

SEQ ID NO: 5885292 - DNA, 17 bp, Homo sapiens
ctcctcttcccagagtc

SEQ ID NO: 5885293 - DNA, 14 bp, Homo sapiens
ctcctcttccccag

SEQ ID NO: 5885294 - DNA, 23 bp, Homo sapiens
ctcctcttcttttttttcattat

SEQ ID NO: 5885295 - DNA, 19 bp, Homo sapiens
ctcctcttgccactgcctc

SEQ ID NO: 5885296 - DNA, 13 bp, Homo sapiens
ctcctcttggaat

SEQ ID NO: 5885297 - DNA, 12 bp, Homo sapiens
ctcctcttgtaa

SEQ ID NO: 5885298 - DNA, 13 bp, Homo sapiens
ctcctcttgtaaa

SEQ ID NO: 5885299 - DNA, 20 bp, Homo sapiens
ctcctcttgtaaataaagcc

SEQ ID NO: 5885300 - DNA, 17 bp, Homo sapiens
ctcctcttgttcctgaa

SEQ ID NO: 5885301 - DNA, 13 bp, Homo sapiens
ctcctctttaaaa

SEQ ID NO: 5885302 - DNA, 18 bp, Homo sapiens
ctcctctttaaaacaaaa

SEQ ID NO: 5885303 - DNA, 17 bp, Homo sapiens
ctcctctttcctctctt

SEQ ID NO: 5885304 - DNA, 15 bp, Homo sapiens
ctcctctttgaacat

SEQ ID NO: 5885305 - DNA, 22 bp, Homo sapiens
ctcctctttgagaccccagtgc

SEQ ID NO: 5885306 - DNA, 13 bp, Homo sapiens
ctcctctttttct

SEQ ID NO: 5885307 - DNA, 23 bp, Homo sapiens
ctcctgaaaaaaaacctgagatt

SEQ ID NO: 5885308 - DNA, 22 bp, Homo sapiens
ctcctgaaaaggtttatgaaaa

SEQ ID NO: 5885309 - DNA, 15 bp, Homo sapiens
ctcctgaaatctaca

SEQ ID NO: 5885310 - DNA, 13 bp, Homo sapiens
ctcctgaaattca

SEQ ID NO: 5885311 - DNA, 17 bp, Homo sapiens
ctcctgaaccagtcctg

SEQ ID NO: 5885312 - DNA, 18 bp, Homo sapiens
ctcctgaaccagtcctgc

SEQ ID NO: 5885313 - DNA, 20 bp, Homo sapiens
ctcctgaaccagtcctgctg

SEQ ID NO: 5885314 - DNA, 19 bp, Homo sapiens
ctcctgaagcctctgccct

SEQ ID NO: 5885315 - DNA, 20 bp, Homo sapiens
ctcctgaagcctctgccctg

SEQ ID NO: 5885316 - DNA, 16 bp, Homo sapiens
ctcctgaaggaggcgg

SEQ ID NO: 5885317 - DNA, 23 bp, Homo sapiens
ctcctgaaggaggcggggctcta

SEQ ID NO: 5885318 - DNA, 17 bp, Homo sapiens
ctcctgaatccctttca

SEQ ID NO: 5885319 - DNA, 21 bp, Homo sapiens
ctcctgaatgaggcggagctc

SEQ ID NO: 5885320 - DNA, 17 bp, Homo sapiens
ctcctgacaacgtctct

SEQ ID NO: 5885321 - DNA, 19 bp, Homo sapiens
ctcctgacaacgtctcttc

SEQ ID NO: 5885322 - DNA, 16 bp, Homo sapiens
ctcctgacaagttatt

SEQ ID NO: 5885323 - DNA, 11 bp, Homo sapiens
ctcctgacaat

SEQ ID NO: 5885324 - DNA, 19 bp, Homo sapiens
ctcctgacacacctgcagc

SEQ ID NO: 5885325 - DNA, 15 bp, Homo sapiens
ctcctgacaccccac

SEQ ID NO: 5885326 - DNA, 18 bp, Homo sapiens
ctcctgacactgctggag

SEQ ID NO: 5885327 - DNA, 18 bp, Homo sapiens
ctcctgacagaaggtgcc

SEQ ID NO: 5885328 - DNA, 22 bp, Homo sapiens
ctcctgacatcaggtgatccac

SEQ ID NO: 5885329 - DNA, 23 bp, Homo sapiens
ctcctgacatcaggtgatccacc

SEQ ID NO: 5885330 - DNA, 11 bp, Homo sapiens
ctcctgaccaa

SEQ ID NO: 5885331 - DNA, 13 bp, Homo sapiens
ctcctgaccaaag

SEQ ID NO: 5885332 - DNA, 14 bp, Homo sapiens
ctcctgaccaaaga

SEQ ID NO: 5885333 - DNA, 14 bp, Homo sapiens
ctcctgaccagggc

SEQ ID NO: 5885334 - DNA, 19 bp, Homo sapiens
ctcctgaccagggcaaggc

SEQ ID NO: 5885335 - DNA, 23 bp, Homo sapiens
ctcctgaccagttgcagtcactc

SEQ ID NO: 5885336 - DNA, 21 bp, Homo sapiens
ctcctgaccataatcctagcc

SEQ ID NO: 5885337 - DNA, 18 bp, Homo sapiens
ctcctgacccattgctgt

SEQ ID NO: 5885338 - DNA, 15 bp, Homo sapiens
ctcctgacccccatg

SEQ ID NO: 5885339 - DNA, 18 bp, Homo sapiens
ctcctgacccccatgtaa

SEQ ID NO: 5885340 - DNA, 20 bp, Homo sapiens
ctcctgacccccatgtaaat

SEQ ID NO: 5885341 - DNA, 18 bp, Homo sapiens
ctcctgacccctccctgc

SEQ ID NO: 5885342 - DNA, 19 bp, Homo sapiens
ctcctgacccctccctgca

SEQ ID NO: 5885343 - DNA, 13 bp, Homo sapiens
ctcctgaccctcc

SEQ ID NO: 5885344 - DNA, 16 bp, Homo sapiens
ctcctgaccctcccac

SEQ ID NO: 5885345 - DNA, 19 bp, Homo sapiens
ctcctgaccctcccactcc

SEQ ID NO: 5885346 - DNA, 20 bp, Homo sapiens
ctcctgaccctcccactccc

SEQ ID NO: 5885347 - DNA, 22 bp, Homo sapiens
ctcctgaccctcccactcccat

SEQ ID NO: 5885348 - DNA, 14 bp, Homo sapiens
ctcctgaccctgtg

SEQ ID NO: 5885349 - DNA, 20 bp, Homo sapiens
ctcctgaccctgtgatgcct

SEQ ID NO: 5885350 - DNA, 19 bp, Homo sapiens
ctcctgacctcaagtgatc

SEQ ID NO: 5885351 - DNA, 19 bp, Homo sapiens
ctcctgacctcaggtgatt

SEQ ID NO: 5885352 - DNA, 15 bp, Homo sapiens
ctcctgacctgaggc

SEQ ID NO: 5885353 - DNA, 16 bp, Homo sapiens
ctcctgacctgtcacc

SEQ ID NO: 5885354 - DNA, 19 bp, Homo sapiens
ctcctgactcatccgcctg

SEQ ID NO: 5885355 - DNA, 19 bp, Homo sapiens
ctcctgactccagtgagct

SEQ ID NO: 5885356 - DNA, 15 bp, Homo sapiens
ctcctgactgtaaca

SEQ ID NO: 5885357 - DNA, 16 bp, Homo sapiens
ctcctgagaaatgtta

SEQ ID NO: 5885358 - DNA, 17 bp, Homo sapiens
ctcctgagaaggcgagg

SEQ ID NO: 5885359 - DNA, 18 bp, Homo sapiens
ctcctgagaaggcgagga

SEQ ID NO: 5885360 - DNA, 14 bp, Homo sapiens
ctcctgagacacat

SEQ ID NO: 5885361 - DNA, 19 bp, Homo sapiens
ctcctgagacacatgggtg

SEQ ID NO: 5885362 - DNA, 18 bp, Homo sapiens
ctcctgagacccctggcc

SEQ ID NO: 5885363 - DNA, 22 bp, Homo sapiens
ctcctgagacccctggcctccg

SEQ ID NO: 5885364 - DNA, 17 bp, Homo sapiens
ctcctgagagctgttcc

SEQ ID NO: 5885365 - DNA, 19 bp, Homo sapiens
ctcctgagaggtgctgcag

SEQ ID NO: 5885366 - DNA, 21 bp, Homo sapiens
ctcctgagcacccgctgacat

SEQ ID NO: 5885367 - DNA, 12 bp, Homo sapiens
ctcctgagcccc

SEQ ID NO: 5885368 - DNA, 14 bp, Homo sapiens
ctcctgagccccca

SEQ ID NO: 5885369 - DNA, 13 bp, Homo sapiens
ctcctgagcctgt

SEQ ID NO: 5885370 - DNA, 18 bp, Homo sapiens
ctcctgagcctgtctctc

SEQ ID NO: 5885371 - DNA, 19 bp, Homo sapiens
ctcctgagcctgtgggtcc

SEQ ID NO: 5885372 - DNA, 21 bp, Homo sapiens
ctcctgaggacagctgtcctc

SEQ ID NO: 5885373 - DNA, 18 bp, Homo sapiens
ctcctgaggagcagccca

SEQ ID NO: 5885374 - DNA, 23 bp, Homo sapiens
ctcctgaggatcagaaagtaatt

SEQ ID NO: 5885375 - DNA, 16 bp, Homo sapiens
ctcctgaggctgtttt

SEQ ID NO: 5885376 - DNA, 21 bp, Homo sapiens
ctcctgaggctgtttttggct

SEQ ID NO: 5885377 - DNA, 20 bp, Homo sapiens
ctcctgagggaggacctggg

SEQ ID NO: 5885378 - DNA, 23 bp, Homo sapiens
ctcctgagggaggacctggggca

SEQ ID NO: 5885379 - DNA, 13 bp, Homo sapiens
ctcctgagggctc

SEQ ID NO: 5885380 - DNA, 19 bp, Homo sapiens
ctcctgaggggcatctgcc

SEQ ID NO: 5885381 - DNA, 17 bp, Homo sapiens
ctcctgagtagatggga

SEQ ID NO: 5885382 - DNA, 14 bp, Homo sapiens
ctcctgagtagctg

SEQ ID NO: 5885383 - DNA, 22 bp, Homo sapiens
ctcctgagtagctgagactaca

SEQ ID NO: 5885384 - DNA, 21 bp, Homo sapiens
ctcctgagtagctggattaca

SEQ ID NO: 5885385 - DNA, 17 bp, Homo sapiens
ctcctgagtagctgggc

SEQ ID NO: 5885386 - DNA, 18 bp, Homo sapiens
ctcctgagtagctgggcc

SEQ ID NO: 5885387 - DNA, 19 bp, Homo sapiens
ctcctgagtagctgggcct

SEQ ID NO: 5885388 - DNA, 16 bp, Homo sapiens
ctcctgagtgatccca

SEQ ID NO: 5885389 - DNA, 18 bp, Homo sapiens
ctcctgagtgccccactt

SEQ ID NO: 5885390 - DNA, 19 bp, Homo sapiens
ctcctgagtgccccacttc

SEQ ID NO: 5885391 - DNA, 20 bp, Homo sapiens
ctcctgagtgccccacttct

SEQ ID NO: 5885392 - DNA, 19 bp, Homo sapiens
ctcctgagttcaagcgatt

SEQ ID NO: 5885393 - DNA, 22 bp, Homo sapiens
ctcctggacccccctttcacag

SEQ ID NO: 5885394 - DNA, 17 bp, Homo sapiens
ctcctggaccttgacag

SEQ ID NO: 5885395 - DNA, 21 bp, Homo sapiens
ctcctggaccttgacagagca

SEQ ID NO: 5885396 - DNA, 13 bp, Homo sapiens
ctcctggactccg

SEQ ID NO: 5885397 - DNA, 23 bp, Homo sapiens
ctcctggactcgcgttcccaaag

SEQ ID NO: 5885398 - DNA, 21 bp, Homo sapiens
ctcctggactggttatcttgt

SEQ ID NO: 5885399 - DNA, 22 bp, Homo sapiens
ctcctggactggttatcttgtt

SEQ ID NO: 5885400 - DNA, 18 bp, Homo sapiens
ctcctggagatagctggg

SEQ ID NO: 5885401 - DNA, 21 bp, Homo sapiens
ctcctggagatagctggggct

SEQ ID NO: 5885402 - DNA, 13 bp, Homo sapiens
ctcctggagcaag

SEQ ID NO: 5885403 - DNA, 15 bp, Homo sapiens
ctcctggagcaagct

SEQ ID NO: 5885404 - DNA, 18 bp, Homo sapiens
ctcctggagcagaaagtg

SEQ ID NO: 5885405 - DNA, 20 bp, Homo sapiens
ctcctggagcagaaagtgcc

SEQ ID NO: 5885406 - DNA, 19 bp, Homo sapiens
ctcctggagcatcccaggc

SEQ ID NO: 5885407 - DNA, 15 bp, Homo sapiens
ctcctggaggaccag

SEQ ID NO: 5885408 - DNA, 20 bp, Homo sapiens
ctcctggagggcgcccagca

SEQ ID NO: 5885409 - DNA, 23 bp, Homo sapiens
ctcctggagggcgcccagcagcc

SEQ ID NO: 5885410 - DNA, 15 bp, Homo sapiens
ctcctggagttgcat

SEQ ID NO: 5885411 - DNA, 16 bp, Homo sapiens
ctcctggatctccctg

SEQ ID NO: 5885412 - DNA, 19 bp, Homo sapiens
ctcctggatctccctgaga

SEQ ID NO: 5885413 - DNA, 10 bp, Homo sapiens
ctcctggcaa

SEQ ID NO: 5885414 - DNA, 21 bp, Homo sapiens
ctcctggcaatcaatacagct

SEQ ID NO: 5885415 - DNA, 11 bp, Homo sapiens
ctcctggcagg

SEQ ID NO: 5885416 - DNA, 18 bp, Homo sapiens
ctcctggcagggccacct

SEQ ID NO: 5885417 - DNA, 21 bp, Homo sapiens
ctcctggcagggccacctgca

SEQ ID NO: 5885418 - DNA, 24 bp, Homo sapiens
ctcctggcagggccacctgcagga

SEQ ID NO: 5885419 - DNA, 11 bp, Homo sapiens
ctcctggccag

SEQ ID NO: 5885420 - DNA, 12 bp, Homo sapiens
ctcctggcccag

SEQ ID NO: 5885421 - DNA, 15 bp, Homo sapiens
ctcctggcccagcct

SEQ ID NO: 5885422 - DNA, 16 bp, Homo sapiens
ctcctggcccagcctt

SEQ ID NO: 5885423 - DNA, 14 bp, Homo sapiens
ctcctggcccaggt

SEQ ID NO: 5885424 - DNA, 15 bp, Homo sapiens
ctcctggcccgccct

SEQ ID NO: 5885425 - DNA, 22 bp, Homo sapiens
ctcctggcccgccctcacctct

SEQ ID NO: 5885426 - DNA, 20 bp, Homo sapiens
ctcctggccggggcccctca

SEQ ID NO: 5885427 - DNA, 14 bp, Homo sapiens
ctcctggcctcaag

SEQ ID NO: 5885428 - DNA, 17 bp, Homo sapiens
ctcctggcctcaagcca

SEQ ID NO: 5885429 - DNA, 23 bp, Homo sapiens
ctcctggcctcaagccatcttcc

SEQ ID NO: 5885430 - DNA, 15 bp, Homo sapiens
ctcctggcctcagac

SEQ ID NO: 5885431 - DNA, 18 bp, Homo sapiens
ctcctggcctcagactgc

SEQ ID NO: 5885432 - DNA, 23 bp, Homo sapiens
ctcctggcctggccatctccctc

SEQ ID NO: 5885433 - DNA, 12 bp, Homo sapiens
ctcctggccttc

SEQ ID NO: 5885434 - DNA, 18 bp, Homo sapiens
ctcctggctaagcctctg

SEQ ID NO: 5885435 - DNA, 15 bp, Homo sapiens
ctcctggctcacagc

SEQ ID NO: 5885436 - DNA, 19 bp, Homo sapiens
ctcctggctcacagccacc

SEQ ID NO: 5885437 - DNA, 20 bp, Homo sapiens
ctcctggctcacagccacca

SEQ ID NO: 5885438 - DNA, 21 bp, Homo sapiens
ctcctggctcacagccaccac

SEQ ID NO: 5885439 - DNA, 15 bp, Homo sapiens
ctcctggctcaggcc

SEQ ID NO: 5885440 - DNA, 16 bp, Homo sapiens
ctcctggctcaggccc

SEQ ID NO: 5885441 - DNA, 16 bp, Homo sapiens
ctcctggctccctccc

SEQ ID NO: 5885442 - DNA, 12 bp, Homo sapiens
ctcctggctgcc

SEQ ID NO: 5885443 - DNA, 14 bp, Homo sapiens
ctcctggctgccag

SEQ ID NO: 5885444 - DNA, 15 bp, Homo sapiens
ctcctggctgccagg

SEQ ID NO: 5885445 - DNA, 18 bp, Homo sapiens
ctcctggctgccaggcgt

SEQ ID NO: 5885446 - DNA, 19 bp, Homo sapiens
ctcctggctgccaggcgtt

SEQ ID NO: 5885447 - DNA, 12 bp, Homo sapiens
ctcctggctggg

SEQ ID NO: 5885448 - DNA, 15 bp, Homo sapiens
ctcctggctgggcca

SEQ ID NO: 5885449 - DNA, 19 bp, Homo sapiens
ctcctggctgggccatcct

SEQ ID NO: 5885450 - DNA, 14 bp, Homo sapiens
ctcctggctgtcct

SEQ ID NO: 5885451 - DNA, 16 bp, Homo sapiens
ctcctggctgtgccca

SEQ ID NO: 5885452 - DNA, 17 bp, Homo sapiens
ctcctggctgtgcccag

SEQ ID NO: 5885453 - DNA, 21 bp, Homo sapiens
ctcctggctgtgcccagcagg

SEQ ID NO: 5885454 - DNA, 21 bp, Homo sapiens
ctcctggcttcccatccccag

SEQ ID NO: 5885455 - DNA, 20 bp, Homo sapiens
ctcctgggaaacctgccttt

SEQ ID NO: 5885456 - DNA, 13 bp, Homo sapiens
ctcctgggaaagg

SEQ ID NO: 5885457 - DNA, 20 bp, Homo sapiens
ctcctgggaagatgaggttc

SEQ ID NO: 5885458 - DNA, 12 bp, Homo sapiens
ctcctgggaagg

SEQ ID NO: 5885459 - DNA, 22 bp, Homo sapiens
ctcctgggaaggagggagctgc

SEQ ID NO: 5885460 - DNA, 18 bp, Homo sapiens
ctcctgggaaggccacct

SEQ ID NO: 5885461 - DNA, 21 bp, Homo sapiens
ctcctgggaaggccacctccc

SEQ ID NO: 5885462 - DNA, 23 bp, Homo sapiens
ctcctgggaaggctactcacctt

SEQ ID NO: 5885463 - DNA, 23 bp, Homo sapiens
ctcctgggaatggggtgggagcc

SEQ ID NO: 5885464 - DNA, 18 bp, Homo sapiens
ctcctgggacccttggct

SEQ ID NO: 5885465 - DNA, 11 bp, Homo sapiens
ctcctgggaga

SEQ ID NO: 5885466 - DNA, 18 bp, Homo sapiens
ctcctgggaggccctggc

SEQ ID NO: 5885467 - DNA, 20 bp, Homo sapiens
ctcctgggaggccctggcag

SEQ ID NO: 5885468 - DNA, 15 bp, Homo sapiens
ctcctgggatctgct

SEQ ID NO: 5885469 - DNA, 16 bp, Homo sapiens
ctcctgggatctgctc

SEQ ID NO: 5885470 - DNA, 15 bp, Homo sapiens
ctcctgggcagccgt

SEQ ID NO: 5885471 - DNA, 16 bp, Homo sapiens
ctcctgggcagctgcc

SEQ ID NO: 5885472 - DNA, 17 bp, Homo sapiens
ctcctgggcagctgcct

SEQ ID NO: 5885473 - DNA, 23 bp, Homo sapiens
ctcctgggcagcttgagagggca

SEQ ID NO: 5885474 - DNA, 14 bp, Homo sapiens
ctcctgggcatctg

SEQ ID NO: 5885475 - DNA, 16 bp, Homo sapiens
ctcctgggcatctggc

SEQ ID NO: 5885476 - DNA, 21 bp, Homo sapiens
ctcctgggcatgtttgtctgt

SEQ ID NO: 5885477 - DNA, 23 bp, Homo sapiens
ctcctgggcatgtttgtctgtgt

SEQ ID NO: 5885478 - DNA, 21 bp, Homo sapiens
ctcctgggcattagcaaggca

SEQ ID NO: 5885479 - DNA, 16 bp, Homo sapiens
ctcctgggccagggtc

SEQ ID NO: 5885480 - DNA, 11 bp, Homo sapiens
ctcctgggccc

SEQ ID NO: 5885481 - DNA, 19 bp, Homo sapiens
ctcctgggcccaagtgatc

SEQ ID NO: 5885482 - DNA, 15 bp, Homo sapiens
ctcctgggcccaggc

SEQ ID NO: 5885483 - DNA, 16 bp, Homo sapiens
ctcctgggcccaggca

SEQ ID NO: 5885484 - DNA, 20 bp, Homo sapiens
ctcctgggcccctccctacc

SEQ ID NO: 5885485 - DNA, 20 bp, Homo sapiens
ctcctgggcccgctttgcct

SEQ ID NO: 5885486 - DNA, 19 bp, Homo sapiens
ctcctgggccctctctgct

SEQ ID NO: 5885487 - DNA, 16 bp, Homo sapiens
ctcctgggccctgggc

SEQ ID NO: 5885488 - DNA, 23 bp, Homo sapiens
ctcctgggccctgggctggcaca

SEQ ID NO: 5885489 - DNA, 22 bp, Homo sapiens
ctcctgggccggctgagtggca

SEQ ID NO: 5885490 - DNA, 15 bp, Homo sapiens
ctcctgggctcaagc

SEQ ID NO: 5885491 - DNA, 19 bp, Homo sapiens
ctcctgggctcaagcaatc

SEQ ID NO: 5885492 - DNA, 19 bp, Homo sapiens
ctcctgggctcaagtgatc

SEQ ID NO: 5885493 - DNA, 14 bp, Homo sapiens
ctcctgggctccag

SEQ ID NO: 5885494 - DNA, 20 bp, Homo sapiens
ctcctgggctctgaacacac

SEQ ID NO: 5885495 - DNA, 9 bp, Homo sapiens
ctcctgggg

SEQ ID NO: 5885496 - DNA, 14 bp, Homo sapiens
ctcctggggagagg

SEQ ID NO: 5885497 - DNA, 13 bp, Homo sapiens
ctcctggggagct

SEQ ID NO: 5885498 - DNA, 16 bp, Homo sapiens
ctcctggggagctcct

SEQ ID NO: 5885499 - DNA, 19 bp, Homo sapiens
ctcctggggagctcctggg

SEQ ID NO: 5885500 - DNA, 21 bp, Homo sapiens
ctcctggggagctcctgggac

SEQ ID NO: 5885501 - DNA, 18 bp, Homo sapiens
ctcctggggatggccagg

SEQ ID NO: 5885502 - DNA, 11 bp, Homo sapiens
ctcctggggca

SEQ ID NO: 5885503 - DNA, 12 bp, Homo sapiens
ctcctggggcag

SEQ ID NO: 5885504 - DNA, 15 bp, Homo sapiens
ctcctggggcagaga

SEQ ID NO: 5885505 - DNA, 16 bp, Homo sapiens
ctcctggggccaggcc

SEQ ID NO: 5885506 - DNA, 15 bp, Homo sapiens
ctcctgggggcccat

SEQ ID NO: 5885507 - DNA, 17 bp, Homo sapiens
ctcctgggggcccattc

SEQ ID NO: 5885508 - DNA, 20 bp, Homo sapiens
ctcctgggggcccattctgc

SEQ ID NO: 5885509 - DNA, 17 bp, Homo sapiens
ctcctgggggctggctc

SEQ ID NO: 5885510 - DNA, 19 bp, Homo sapiens
ctcctgggttcaagcgatt

SEQ ID NO: 5885511 - DNA, 16 bp, Homo sapiens
ctcctgggttgagctg

SEQ ID NO: 5885512 - DNA, 15 bp, Homo sapiens
ctcctgggttggagg

SEQ ID NO: 5885513 - DNA, 21 bp, Homo sapiens
ctcctgggttttgtattctct

SEQ ID NO: 5885514 - DNA, 14 bp, Homo sapiens
ctcctggtagcatg

SEQ ID NO: 5885515 - DNA, 15 bp, Homo sapiens
ctcctggtcctaggc

SEQ ID NO: 5885516 - DNA, 15 bp, Homo sapiens
ctcctggtcctggac

SEQ ID NO: 5885517 - DNA, 17 bp, Homo sapiens
ctcctggtcctggacac

SEQ ID NO: 5885518 - DNA, 21 bp, Homo sapiens
ctcctggtcctggacacctcc

SEQ ID NO: 5885519 - DNA, 21 bp, Homo sapiens
ctcctggtctgtgctgccctg

SEQ ID NO: 5885520 - DNA, 20 bp, Homo sapiens
ctcctggtgaagtgtgactt

SEQ ID NO: 5885521 - DNA, 15 bp, Homo sapiens
ctcctggtgcccctc

SEQ ID NO: 5885522 - DNA, 21 bp, Homo sapiens
ctcctggtgcccctcgccagc

SEQ ID NO: 5885523 - DNA, 22 bp, Homo sapiens
ctcctggtgcccctcgccagct

SEQ ID NO: 5885524 - DNA, 11 bp, Homo sapiens
ctcctggtggc

SEQ ID NO: 5885525 - DNA, 14 bp, Homo sapiens
ctcctggtggggca

SEQ ID NO: 5885526 - DNA, 19 bp, Homo sapiens
ctcctggtgtcaccccaga

SEQ ID NO: 5885527 - DNA, 22 bp, Homo sapiens
ctcctggtgtcaccccagagcc

SEQ ID NO: 5885528 - DNA, 24 bp, Homo sapiens
ctcctggtgtgggtaaagggacag

SEQ ID NO: 5885529 - DNA, 22 bp, Homo sapiens
ctcctggtgtttttctctctgg

SEQ ID NO: 5885530 - DNA, 20 bp, Homo sapiens
ctcctgtaacatactggcct

SEQ ID NO: 5885531 - DNA, 16 bp, Homo sapiens
ctcctgtaattcctac

SEQ ID NO: 5885532 - DNA, 18 bp, Homo sapiens
ctcctgtaattcctacct

SEQ ID NO: 5885533 - DNA, 18 bp, Homo sapiens
ctcctgtaattttgtagt

SEQ ID NO: 5885534 - DNA, 20 bp, Homo sapiens
ctcctgtacatatagccctt

SEQ ID NO: 5885535 - DNA, 18 bp, Homo sapiens
ctcctgtacctcagtgga

SEQ ID NO: 5885536 - DNA, 18 bp, Homo sapiens
ctcctgtacgaacccctc

SEQ ID NO: 5885537 - DNA, 20 bp, Homo sapiens
ctcctgtacttgtcctcagc

SEQ ID NO: 5885538 - DNA, 21 bp, Homo sapiens
ctcctgtacttgtcctcagct

SEQ ID NO: 5885539 - DNA, 14 bp, Homo sapiens
ctcctgtccaacct

SEQ ID NO: 5885540 - DNA, 14 bp, Homo sapiens
ctcctgtcccctgc

SEQ ID NO: 5885541 - DNA, 14 bp, Homo sapiens
ctcctgtccctacc

SEQ ID NO: 5885542 - DNA, 19 bp, Homo sapiens
ctcctgtccctacccactc

SEQ ID NO: 5885543 - DNA, 14 bp, Homo sapiens
ctcctgtccctcca

SEQ ID NO: 5885544 - DNA, 21 bp, Homo sapiens
ctcctgtccctgtagctcagt

SEQ ID NO: 5885545 - DNA, 13 bp, Homo sapiens
ctcctgtcccttt

SEQ ID NO: 5885546 - DNA, 17 bp, Homo sapiens
ctcctgtcccttttccc

SEQ ID NO: 5885547 - DNA, 13 bp, Homo sapiens
ctcctgtccttta

SEQ ID NO: 5885548 - DNA, 17 bp, Homo sapiens
ctcctgtctaactgctg

SEQ ID NO: 5885549 - DNA, 18 bp, Homo sapiens
ctcctgtctcctctgtca

SEQ ID NO: 5885550 - DNA, 16 bp, Homo sapiens
ctcctgtctgccagcc

SEQ ID NO: 5885551 - DNA, 23 bp, Homo sapiens
ctcctgtctgccagccagcagcc

SEQ ID NO: 5885552 - DNA, 13 bp, Homo sapiens
ctcctgtctgccc

SEQ ID NO: 5885553 - DNA, 14 bp, Homo sapiens
ctcctgtctgccct

SEQ ID NO: 5885554 - DNA, 14 bp, Homo sapiens
ctcctgtctggctc

SEQ ID NO: 5885555 - DNA, 19 bp, Homo sapiens
ctcctgtcttatggtccag

SEQ ID NO: 5885556 - DNA, 16 bp, Homo sapiens
ctcctgtcttctgctt

SEQ ID NO: 5885557 - DNA, 23 bp, Homo sapiens
ctcctgtcttctttctccatgga

SEQ ID NO: 5885558 - DNA, 16 bp, Homo sapiens
ctcctgtgaatggagg

SEQ ID NO: 5885559 - DNA, 17 bp, Homo sapiens
ctcctgtgagctcccca

SEQ ID NO: 5885560 - DNA, 16 bp, Homo sapiens
ctcctgtgatcctttg

SEQ ID NO: 5885561 - DNA, 17 bp, Homo sapiens
ctcctgtgcaactttcc

SEQ ID NO: 5885562 - DNA, 11 bp, Homo sapiens
ctcctgtgccc

SEQ ID NO: 5885563 - DNA, 14 bp, Homo sapiens
ctcctgtgcccaca

SEQ ID NO: 5885564 - DNA, 21 bp, Homo sapiens
ctcctgtgcccacatcccagg

SEQ ID NO: 5885565 - DNA, 15 bp, Homo sapiens
ctcctgtgccccagc

SEQ ID NO: 5885566 - DNA, 23 bp, Homo sapiens
ctcctgtgccccagctgccaggc

SEQ ID NO: 5885567 - DNA, 14 bp, Homo sapiens
ctcctgtgcctggc

SEQ ID NO: 5885568 - DNA, 16 bp, Homo sapiens
ctcctgtgcctggccc

SEQ ID NO: 5885569 - DNA, 19 bp, Homo sapiens
ctcctgtgcctggccccag

SEQ ID NO: 5885570 - DNA, 11 bp, Homo sapiens
ctcctgtgcta

SEQ ID NO: 5885571 - DNA, 21 bp, Homo sapiens
ctctcgctgccctgtggacag

SEQ ID NO: 5885572 - DNA, 13 bp, Homo sapiens
ctctcgctgcgtc

SEQ ID NO: 5885573 - DNA, 19 bp, Homo sapiens
ctctcggaaggctggctgg

SEQ ID NO: 5885574 - DNA, 19 bp, Homo sapiens
ctctcggagtatctgggaa

SEQ ID NO: 5885575 - DNA, 20 bp, Homo sapiens
ctctcggagtatctgggaac

SEQ ID NO: 5885576 - DNA, 15 bp, Homo sapiens
ctctcggccaggcat

SEQ ID NO: 5885577 - DNA, 12 bp, Homo sapiens
ctctcggcccct

SEQ ID NO: 5885578 - DNA, 14 bp, Homo sapiens
ctctcggcccctgt

SEQ ID NO: 5885579 - DNA, 17 bp, Homo sapiens
ctctcggctccccatgt

SEQ ID NO: 5885580 - DNA, 19 bp, Homo sapiens
ctctcggctgccaggggct

SEQ ID NO: 5885581 - DNA, 21 bp, Homo sapiens
ctctcggggcccttggggcct

SEQ ID NO: 5885582 - DNA, 23 bp, Homo sapiens
ctctcggggcccttggggcctgg

SEQ ID NO: 5885583 - DNA, 24 bp, Homo sapiens
ctctcggtgacctccgtcctctcc

SEQ ID NO: 5885584 - DNA, 20 bp, Homo sapiens
ctctcggtgctccatctccg

SEQ ID NO: 5885585 - DNA, 21 bp, Homo sapiens
ctctcggttccacgtccccct

SEQ ID NO: 5885586 - DNA, 17 bp, Homo sapiens
ctctcgtaactggtttc

SEQ ID NO: 5885587 - DNA, 19 bp, Homo sapiens
ctctcgtagaacctgcgca

SEQ ID NO: 5885588 - DNA, 16 bp, Homo sapiens
ctctcgtccctctgct

SEQ ID NO: 5885589 - DNA, 16 bp, Homo sapiens
ctctcgtgatatgctg

SEQ ID NO: 5885590 - DNA, 19 bp, Homo sapiens
ctctcgtgatatgctgctt

SEQ ID NO: 5885591 - DNA, 15 bp, Homo sapiens
ctctcgttctccttc

SEQ ID NO: 5885592 - DNA, 21 bp, Homo sapiens
ctctcgttttgggtactttct

SEQ ID NO: 5885593 - DNA, 13 bp, Homo sapiens
ctctctaaaaata

SEQ ID NO: 5885594 - DNA, 16 bp, Homo sapiens
ctctctaaaaataaaa

SEQ ID NO: 5885595 - DNA, 21 bp, Homo sapiens
ctctctaaaaataaaatgatg

SEQ ID NO: 5885596 - DNA, 18 bp, Homo sapiens
ctctctaaaagtgtccac

SEQ ID NO: 5885597 - DNA, 20 bp, Homo sapiens
ctctctaaactggtacaatt

SEQ ID NO: 5885598 - DNA, 18 bp, Homo sapiens
ctctctaagacaaatgca

SEQ ID NO: 5885599 - DNA, 15 bp, Homo sapiens
ctctctaagccacag

SEQ ID NO: 5885600 - DNA, 15 bp, Homo sapiens
ctctctaatagaagt

SEQ ID NO: 5885601 - DNA, 19 bp, Homo sapiens
ctctctacagagaggaaat

SEQ ID NO: 5885602 - DNA, 23 bp, Homo sapiens
ctctctacaggtccgtttcctta

SEQ ID NO: 5885603 - DNA, 18 bp, Homo sapiens
ctctctacagtctcgtct

SEQ ID NO: 5885604 - DNA, 15 bp, Homo sapiens
ctctctacagtgcca

SEQ ID NO: 5885605 - DNA, 16 bp, Homo sapiens
ctctctacccagccca

SEQ ID NO: 5885606 - DNA, 22 bp, Homo sapiens
ctctctacccagcccatcttgc

SEQ ID NO: 5885607 - DNA, 11 bp, Homo sapiens
ctctctagctt

SEQ ID NO: 5885608 - DNA, 14 bp, Homo sapiens
ctctctaggcctct

SEQ ID NO: 5885609 - DNA, 14 bp, Homo sapiens
ctctctagggaccc

SEQ ID NO: 5885610 - DNA, 22 bp, Homo sapiens
ctctctagggtacatggtgctg

SEQ ID NO: 5885611 - DNA, 20 bp, Homo sapiens
ctctctataagtgttcagtg

SEQ ID NO: 5885612 - DNA, 21 bp, Homo sapiens
ctctctataagtgttcagtgt

SEQ ID NO: 5885613 - DNA, 16 bp, Homo sapiens
ctctctatagcaccag

SEQ ID NO: 5885614 - DNA, 21 bp, Homo sapiens
ctctctatccaaaataaagat

SEQ ID NO: 5885615 - DNA, 23 bp, Homo sapiens
ctctctatcggggtcacttgcaa

SEQ ID NO: 5885616 - DNA, 20 bp, Homo sapiens
ctctctatggtaaagatatt

SEQ ID NO: 5885617 - DNA, 23 bp, Homo sapiens
ctctctatggtaaagatattatt

SEQ ID NO: 5885618 - DNA, 20 bp, Homo sapiens
ctctctattaccactgaaga

SEQ ID NO: 5885619 - DNA, 21 bp, Homo sapiens
ctctctattgaccaccagtta

SEQ ID NO: 5885620 - DNA, 21 bp, Homo sapiens
ctctctatttccccctttctt

SEQ ID NO: 5885621 - DNA, 14 bp, Homo sapiens
ctctctcaaaagag

SEQ ID NO: 5885622 - DNA, 15 bp, Homo sapiens
ctctctcaaaattat

SEQ ID NO: 5885623 - DNA, 17 bp, Homo sapiens
ctctctcaccagccttg

SEQ ID NO: 5885624 - DNA, 12 bp, Homo sapiens
ctctctcaccca

SEQ ID NO: 5885625 - DNA, 13 bp, Homo sapiens
ctctctcacccac

SEQ ID NO: 5885626 - DNA, 14 bp, Homo sapiens
ctctctcacccacc

SEQ ID NO: 5885627 - DNA, 15 bp, Homo sapiens
ctctctcacccacca

SEQ ID NO: 5885628 - DNA, 21 bp, Homo sapiens
ctctctcacccaccagctcca

SEQ ID NO: 5885629 - DNA, 14 bp, Homo sapiens
ctctctcacctgct

SEQ ID NO: 5885630 - DNA, 17 bp, Homo sapiens
ctctctcacctgctccc

SEQ ID NO: 5885631 - DNA, 18 bp, Homo sapiens
ctctctcacctgctccca

SEQ ID NO: 5885632 - DNA, 15 bp, Homo sapiens
ctctctcactccttg

SEQ ID NO: 5885633 - DNA, 12 bp, Homo sapiens
ctctctcagacc

SEQ ID NO: 5885634 - DNA, 15 bp, Homo sapiens
ctctctcagagcatc

SEQ ID NO: 5885635 - DNA, 15 bp, Homo sapiens
ctctctcagcacagc

SEQ ID NO: 5885636 - DNA, 17 bp, Homo sapiens
ctctctcagcccaggtc

SEQ ID NO: 5885637 - DNA, 21 bp, Homo sapiens
ctctctcaggccaccacagag

SEQ ID NO: 5885638 - DNA, 12 bp, Homo sapiens
ctctctcatgcc

SEQ ID NO: 5885639 - DNA, 14 bp, Homo sapiens
ctctctccaccccc

SEQ ID NO: 5885640 - DNA, 22 bp, Homo sapiens
ctctctccaccccccacgtctg

SEQ ID NO: 5885641 - DNA, 21 bp, Homo sapiens
ctctctccagaaacagctgct

SEQ ID NO: 5885642 - DNA, 17 bp, Homo sapiens
ctctctccagatgtttc

SEQ ID NO: 5885643 - DNA, 13 bp, Homo sapiens
ctctctccaggag

SEQ ID NO: 5885644 - DNA, 12 bp, Homo sapiens
ctctctccaggt

SEQ ID NO: 5885645 - DNA, 12 bp, Homo sapiens
ctctctccatca

SEQ ID NO: 5885646 - DNA, 14 bp, Homo sapiens
ctctctccatcaga

SEQ ID NO: 5885647 - DNA, 23 bp, Homo sapiens
ctctctccatccctctcctctgc

SEQ ID NO: 5885648 - DNA, 16 bp, Homo sapiens
ctctctccatttatat

SEQ ID NO: 5885649 - DNA, 20 bp, Homo sapiens
ctctctcccaactgctgctt

SEQ ID NO: 5885650 - DNA, 23 bp, Homo sapiens
ctctctcccaccctaagggcagc

SEQ ID NO: 5885651 - DNA, 20 bp, Homo sapiens
ctctctcccatggagcccca

SEQ ID NO: 5885652 - DNA, 14 bp, Homo sapiens
ctctctcccatttc

SEQ ID NO: 5885653 - DNA, 23 bp, Homo sapiens
ctctctcccctactacaagtccc

SEQ ID NO: 5885654 - DNA, 16 bp, Homo sapiens
ctctctccctacctcc

SEQ ID NO: 5885655 - DNA, 19 bp, Homo sapiens
ctctctccctacctccctc

SEQ ID NO: 5885656 - DNA, 20 bp, Homo sapiens
ctctctccctacctccctcc

SEQ ID NO: 5885657 - DNA, 12 bp, Homo sapiens
ctctctccctct

SEQ ID NO: 5885658 - DNA, 20 bp, Homo sapiens
ctctctccctctttctagcc

SEQ ID NO: 5885659 - DNA, 18 bp, Homo sapiens
ctctctccctgcctcaca

SEQ ID NO: 5885660 - DNA, 21 bp, Homo sapiens
ctctctccctgcctcacatct

SEQ ID NO: 5885661 - DNA, 17 bp, Homo sapiens
ctctctccctgccttta

SEQ ID NO: 5885662 - DNA, 15 bp, Homo sapiens
ctctctccctgtcac

SEQ ID NO: 5885663 - DNA, 13 bp, Homo sapiens
ctctctccctttt

SEQ ID NO: 5885664 - DNA, 13 bp, Homo sapiens
ctctctcctggac

SEQ ID NO: 5885665 - DNA, 14 bp, Homo sapiens
ctctctcctggact

SEQ ID NO: 5885666 - DNA, 15 bp, Homo sapiens
ctctctcctggactg

SEQ ID NO: 5885667 - DNA, 15 bp, Homo sapiens
ctctctcctgtactt

SEQ ID NO: 5885668 - DNA, 15 bp, Homo sapiens
ctctctcctgtccaa

SEQ ID NO: 5885669 - DNA, 15 bp, Homo sapiens
ctctctccttctggc

SEQ ID NO: 5885670 - DNA, 15 bp, Homo sapiens
ctctctcctttgctg

SEQ ID NO: 5885671 - DNA, 16 bp, Homo sapiens
ctctctcctttttgct

SEQ ID NO: 5885672 - DNA, 19 bp, Homo sapiens
ctctctcggagccctcaga

SEQ ID NO: 5885673 - DNA, 18 bp, Homo sapiens
ctctctcggcccctgtct

SEQ ID NO: 5885674 - DNA, 23 bp, Homo sapiens
ctctctcggcccctgtctgttcc

SEQ ID NO: 5885675 - DNA, 14 bp, Homo sapiens
ctctctctaagtat

SEQ ID NO: 5885676 - DNA, 13 bp, Homo sapiens
ctctctctcacct

SEQ ID NO: 5885677 - DNA, 15 bp, Homo sapiens
ctctctctcctcagg

SEQ ID NO: 5885678 - DNA, 13 bp, Homo sapiens
ctctctctctcta

SEQ ID NO: 5885679 - DNA, 14 bp, Homo sapiens
ctctctctctctcc

SEQ ID NO: 5885680 - DNA, 15 bp, Homo sapiens
ctctctctctctctg

SEQ ID NO: 5885681 - DNA, 16 bp, Homo sapiens
ctctctctctgttcca

SEQ ID NO: 5885682 - DNA, 15 bp, Homo sapiens
ctctctctcttcctc

SEQ ID NO: 5885683 - DNA, 15 bp, Homo sapiens
ctctctctctttcct

SEQ ID NO: 5885684 - DNA, 13 bp, Homo sapiens
ctctctctgactc

SEQ ID NO: 5885685 - DNA, 13 bp, Homo sapiens
ctctctctgctcc

SEQ ID NO: 5885686 - DNA, 14 bp, Homo sapiens
ctctctctgctcct

SEQ ID NO: 5885687 - DNA, 12 bp, Homo sapiens
ctctctctgggc

SEQ ID NO: 5885688 - DNA, 13 bp, Homo sapiens
ctctctctgttcc

SEQ ID NO: 5885689 - DNA, 11 bp, Homo sapiens
ctctctcttcc

SEQ ID NO: 5885690 - DNA, 16 bp, Homo sapiens
ctctctcttcctaccc

SEQ ID NO: 5885691 - DNA, 21 bp, Homo sapiens
ctctctcttctgctccaccct

SEQ ID NO: 5885692 - DNA, 21 bp, Homo sapiens
ctctctcttcttattacccaa

SEQ ID NO: 5885693 - DNA, 12 bp, Homo sapiens
ctctctctttct

SEQ ID NO: 5885694 - DNA, 18 bp, Homo sapiens
ctctctctttctagaggt

SEQ ID NO: 5885695 - DNA, 13 bp, Homo sapiens
ctctctctttctc

SEQ ID NO: 5885696 - DNA, 11 bp, Homo sapiens
ctctctctttg

SEQ ID NO: 5885697 - DNA, 19 bp, Homo sapiens
ctctctctttgttacataa

SEQ ID NO: 5885698 - DNA, 15 bp, Homo sapiens
ctctctcttttcatt

SEQ ID NO: 5885699 - DNA, 15 bp, Homo sapiens
ctctctcttttttct

SEQ ID NO: 5885700 - DNA, 16 bp, Homo sapiens
ctctctgaacccctcc

SEQ ID NO: 5885701 - DNA, 18 bp, Homo sapiens
ctctctgaactgcaacac

SEQ ID NO: 5885702 - DNA, 20 bp, Homo sapiens
ctctctgaactgcaacactg

SEQ ID NO: 5885703 - DNA, 20 bp, Homo sapiens
ctctctgaagatgatcattt

SEQ ID NO: 5885704 - DNA, 12 bp, Homo sapiens
ctctctgacccg

SEQ ID NO: 5885705 - DNA, 16 bp, Homo sapiens
ctctctgacctttcat

SEQ ID NO: 5885706 - DNA, 18 bp, Homo sapiens
ctctctgacgtcaaccca

SEQ ID NO: 5885707 - DNA, 15 bp, Homo sapiens
ctctctgagactgct

SEQ ID NO: 5885708 - DNA, 21 bp, Homo sapiens
ctctctgagagcacagcgttt

SEQ ID NO: 5885709 - DNA, 18 bp, Homo sapiens
ctctctgagggagaggct

SEQ ID NO: 5885710 - DNA, 20 bp, Homo sapiens
ctctctgagtcaaatccagt

SEQ ID NO: 5885711 - DNA, 18 bp, Homo sapiens
ctctctgagtctggactt

SEQ ID NO: 5885712 - DNA, 15 bp, Homo sapiens
ctctctgatgtccca

SEQ ID NO: 5885713 - DNA, 18 bp, Homo sapiens
ctctctgcaccgtactgt

SEQ ID NO: 5885714 - DNA, 16 bp, Homo sapiens
ctctctgcacctgtct

SEQ ID NO: 5885715 - DNA, 12 bp, Homo sapiens
ctctctgcagcc

SEQ ID NO: 5885716 - DNA, 17 bp, Homo sapiens
ctctctgcagccagccc

SEQ ID NO: 5885717 - DNA, 15 bp, Homo sapiens
ctctctgcagcccag

SEQ ID NO: 5885718 - DNA, 13 bp, Homo sapiens
ctctctgcagctg

SEQ ID NO: 5885719 - DNA, 14 bp, Homo sapiens
ctctctgcagctgc

SEQ ID NO: 5885720 - DNA, 13 bp, Homo sapiens
ctctctgcaggtc

SEQ ID NO: 5885721 - DNA, 16 bp, Homo sapiens
ctctctgcaggtccct

SEQ ID NO: 5885722 - DNA, 19 bp, Homo sapiens
ctctctgcaggtccctaat

SEQ ID NO: 5885723 - DNA, 15 bp, Homo sapiens
ctctctgcagtcctc

SEQ ID NO: 5885724 - DNA, 23 bp, Homo sapiens
ctctctgcagtcctcggcagctc

SEQ ID NO: 5885725 - DNA, 15 bp, Homo sapiens
ctctctgccagccgc

SEQ ID NO: 5885726 - DNA, 21 bp, Homo sapiens
ctctctgccattctgtgcagg

SEQ ID NO: 5885727 - DNA, 20 bp, Homo sapiens
ctctctgcccaagttgctct

SEQ ID NO: 5885728 - DNA, 22 bp, Homo sapiens
ctctctgcccaagttgctctgt

SEQ ID NO: 5885729 - DNA, 11 bp, Homo sapiens
ctctctgccct

SEQ ID NO: 5885730 - DNA, 15 bp, Homo sapiens
ctctctgccctgtgt

SEQ ID NO: 5885731 - DNA, 15 bp, Homo sapiens
ctctctgcctctctt

SEQ ID NO: 5885732 - DNA, 20 bp, Homo sapiens
ctctctgcctctcttcttcc

SEQ ID NO: 5885733 - DNA, 22 bp, Homo sapiens
ctctctgcctctcttcttcccc

SEQ ID NO: 5885734 - DNA, 13 bp, Homo sapiens
ctctctgcctgct

SEQ ID NO: 5885735 - DNA, 20 bp, Homo sapiens
ctctctgcctgctgggctct

SEQ ID NO: 5885736 - DNA, 14 bp, Homo sapiens
ctctctgcctgctt

SEQ ID NO: 5885737 - DNA, 18 bp, Homo sapiens
ctctctgcctgcttcctg

SEQ ID NO: 5885738 - DNA, 15 bp, Homo sapiens
ctctctgcctggtgg

SEQ ID NO: 5885739 - DNA, 16 bp, Homo sapiens
ctctctgcctgtaaat

SEQ ID NO: 5885740 - DNA, 13 bp, Homo sapiens
ctctctgcctgtt

SEQ ID NO: 5885741 - DNA, 15 bp, Homo sapiens
ctctctgcctgttcc

SEQ ID NO: 5885742 - DNA, 12 bp, Homo sapiens
ctctctgctcag

SEQ ID NO: 5885743 - DNA, 13 bp, Homo sapiens
ctctctgctcagt

SEQ ID NO: 5885744 - DNA, 15 bp, Homo sapiens
ctctctgctcagtga

SEQ ID NO: 5885745 - DNA, 15 bp, Homo sapiens
ctctctgctccagag

SEQ ID NO: 5885746 - DNA, 22 bp, Homo sapiens
ctctctgctcctcacccccacc

SEQ ID NO: 5885747 - DNA, 13 bp, Homo sapiens
ctctctgctcctt

SEQ ID NO: 5885748 - DNA, 14 bp, Homo sapiens
ctctctgctctagc

SEQ ID NO: 5885749 - DNA, 18 bp, Homo sapiens
ctctctgctctagccagg

SEQ ID NO: 5885750 - DNA, 14 bp, Homo sapiens
ctctctgctctgac

SEQ ID NO: 5885751 - DNA, 14 bp, Homo sapiens
ctctctgctctgcg

SEQ ID NO: 5885752 - DNA, 21 bp, Homo sapiens
ctctctgctgagcagcccagc

SEQ ID NO: 5885753 - DNA, 17 bp, Homo sapiens
ctctctgctgagctggg

SEQ ID NO: 5885754 - DNA, 17 bp, Homo sapiens
ctctctgcttccgttcc

SEQ ID NO: 5885755 - DNA, 17 bp, Homo sapiens
ctctctggaaagaggct

SEQ ID NO: 5885756 - DNA, 19 bp, Homo sapiens
ctctctggaagagggaggg

SEQ ID NO: 5885757 - DNA, 20 bp, Homo sapiens
ctctctggaagcccctgggc

SEQ ID NO: 5885758 - DNA, 10 bp, Homo sapiens
ctctctggac

SEQ ID NO: 5885759 - DNA, 16 bp, Homo sapiens
ctctctggacctcagt

SEQ ID NO: 5885760 - DNA, 15 bp, Homo sapiens
ctctctggacctgac

SEQ ID NO: 5885761 - DNA, 14 bp, Homo sapiens
ctctctggcctccc

SEQ ID NO: 5885762 - DNA, 16 bp, Homo sapiens
ctctctggcctcccac

SEQ ID NO: 5885763 - DNA, 19 bp, Homo sapiens
ctctctggcctcccacccg

SEQ ID NO: 5885764 - DNA, 12 bp, Homo sapiens
ctctctggcctt

SEQ ID NO: 5885765 - DNA, 17 bp, Homo sapiens
ctctctggccttcggcc

SEQ ID NO: 5885766 - DNA, 19 bp, Homo sapiens
ctctctggccttcggcctc

SEQ ID NO: 5885767 - DNA, 17 bp, Homo sapiens
ctctctggccttttcct

SEQ ID NO: 5885768 - DNA, 13 bp, Homo sapiens
ctctctggctggg

SEQ ID NO: 5885769 - DNA, 15 bp, Homo sapiens
ctctctggctggtct

SEQ ID NO: 5885770 - DNA, 16 bp, Homo sapiens
ctctctggctggtctt

SEQ ID NO: 5885771 - DNA, 13 bp, Homo sapiens
ctctctggctgtc

SEQ ID NO: 5885772 - DNA, 19 bp, Homo sapiens
ctctctggcttccatgctc

SEQ ID NO: 5885773 - DNA, 21 bp, Homo sapiens
ctctctggcttctctcttttc

SEQ ID NO: 5885774 - DNA, 23 bp, Homo sapiens
ctctctggcttctgaagagcctg

SEQ ID NO: 5885775 - DNA, 18 bp, Homo sapiens
ctctctgggactctcctc

SEQ ID NO: 5885776 - DNA, 15 bp, Homo sapiens
ctctctgggcccagg

SEQ ID NO: 5885777 - DNA, 12 bp, Homo sapiens
ctctctgggcct

SEQ ID NO: 5885778 - DNA, 20 bp, Homo sapiens
ctctctgggcctcagaggcc

SEQ ID NO: 5885779 - DNA, 13 bp, Homo sapiens
ctctctgggcctt

SEQ ID NO: 5885780 - DNA, 12 bp, Homo sapiens
ctctctgggctg

SEQ ID NO: 5885781 - DNA, 19 bp, Homo sapiens
ctctctggggccacacaga

SEQ ID NO: 5885782 - DNA, 23 bp, Homo sapiens
ctctctggggccctgggcctcag

SEQ ID NO: 5885783 - DNA, 18 bp, Homo sapiens
ctctctgggggaggcagg

SEQ ID NO: 5885784 - DNA, 17 bp, Homo sapiens
ctctctgtattttttct

SEQ ID NO: 5885785 - DNA, 19 bp, Homo sapiens
ctctctgtcccttgctgta

SEQ ID NO: 5885786 - DNA, 23 bp, Homo sapiens
ctctctgtcccttgctgtatgct

SEQ ID NO: 5885787 - DNA, 16 bp, Homo sapiens
ctctctgtctccaggc

SEQ ID NO: 5885788 - DNA, 16 bp, Homo sapiens
ctctctgtgaatacaa

SEQ ID NO: 5885789 - DNA, 17 bp, Homo sapiens
ctctctgtgaatacaat

SEQ ID NO: 5885790 - DNA, 21 bp, Homo sapiens
ctctctgtgaatacaattaaa

SEQ ID NO: 5885791 - DNA, 15 bp, Homo sapiens
ctctctgtggctcca

SEQ ID NO: 5885792 - DNA, 19 bp, Homo sapiens
ctctctgtgggctggcagt

SEQ ID NO: 5885793 - DNA, 14 bp, Homo sapiens
ctctctgtggtccc

SEQ ID NO: 5885794 - DNA, 15 bp, Homo sapiens
ctctctgttccaagt

SEQ ID NO: 5885795 - DNA, 18 bp, Homo sapiens
ctctctgttccaagtgtg

SEQ ID NO: 5885796 - DNA, 13 bp, Homo sapiens
ctctctgttccct

SEQ ID NO: 5885797 - DNA, 13 bp, Homo sapiens
ctctctgttctct

SEQ ID NO: 5885798 - DNA, 21 bp, Homo sapiens
ctctcttaaatgaagtgccca

SEQ ID NO: 5885799 - DNA, 16 bp, Homo sapiens
ctctcttaccccgtcc

SEQ ID NO: 5885800 - DNA, 15 bp, Homo sapiens
ctctcttacccttct

SEQ ID NO: 5885801 - DNA, 19 bp, Homo sapiens
ctctcttacccttctgtgc

SEQ ID NO: 5885802 - DNA, 19 bp, Homo sapiens
ctctcttagggacagtcaa

SEQ ID NO: 5885803 - DNA, 23 bp, Homo sapiens
ctctcttatagaatatttattac

SEQ ID NO: 5885804 - DNA, 19 bp, Homo sapiens
ctctcttattgttctttca

SEQ ID NO: 5885805 - DNA, 13 bp, Homo sapiens
ctctcttcaataa

SEQ ID NO: 5885806 - DNA, 16 bp, Homo sapiens
ctctcttcaatctctg

SEQ ID NO: 5885807 - DNA, 14 bp, Homo sapiens
ctctcttcactgct

SEQ ID NO: 5885808 - DNA, 24 bp, Homo sapiens
ctctcttcactgctacatgtgctg

SEQ ID NO: 5885809 - DNA, 11 bp, Homo sapiens
ctctcttcagc

SEQ ID NO: 5885810 - DNA, 22 bp, Homo sapiens
ctctcttcagcccctagtgcta

SEQ ID NO: 5885811 - DNA, 15 bp, Homo sapiens
ctctcttccacagtg

SEQ ID NO: 5885812 - DNA, 17 bp, Homo sapiens
ctctcttccacagtggc

SEQ ID NO: 5885813 - DNA, 22 bp, Homo sapiens
ctctcttccagaagatgccctc

SEQ ID NO: 5885814 - DNA, 24 bp, Homo sapiens
ctctcttccagaagatgccctcca

SEQ ID NO: 5885815 - DNA, 19 bp, Homo sapiens
ctctcttccccttccctta

SEQ ID NO: 5885816 - DNA, 12 bp, Homo sapiens
ctctcttccctc

SEQ ID NO: 5885817 - DNA, 14 bp, Homo sapiens
ctctcttccctcag

SEQ ID NO: 5885818 - DNA, 20 bp, Homo sapiens
ctctcttccctttccccagc

SEQ ID NO: 5885819 - DNA, 20 bp, Homo sapiens
ctctcttccgggagctggtg

SEQ ID NO: 5885820 - DNA, 19 bp, Homo sapiens
ctctcttcctatcccatcc

SEQ ID NO: 5885821 - DNA, 17 bp, Homo sapiens
ctctcttcctccacttc

SEQ ID NO: 5885822 - DNA, 12 bp, Homo sapiens
ctctcttcctgc

SEQ ID NO: 5885823 - DNA, 13 bp, Homo sapiens
ctctcttcctgca

SEQ ID NO: 5885824 - DNA, 19 bp, Homo sapiens
ctctcttcctgcccctctt

SEQ ID NO: 5885825 - DNA, 22 bp, Homo sapiens
ctctcttcgtcctgatccctcc

SEQ ID NO: 5885826 - DNA, 17 bp, Homo sapiens
ctctcttctcagagtgg

SEQ ID NO: 5885827 - DNA, 19 bp, Homo sapiens
ctctcttctcagagtggtg

SEQ ID NO: 5885828 - DNA, 13 bp, Homo sapiens
ctctcttctccat

SEQ ID NO: 5885829 - DNA, 15 bp, Homo sapiens
ctctcttctccattc

SEQ ID NO: 5885830 - DNA, 14 bp, Homo sapiens
ctctcttctgctcc

SEQ ID NO: 5885831 - DNA, 20 bp, Homo sapiens
ctctcttgattaagatctca

SEQ ID NO: 5885832 - DNA, 18 bp, Homo sapiens
ctctcttggaactgcacc

SEQ ID NO: 5885833 - DNA, 19 bp, Homo sapiens
ctctcttggaactgcacca

SEQ ID NO: 5885834 - DNA, 13 bp, Homo sapiens
ctctcttggaatt

SEQ ID NO: 5885835 - DNA, 18 bp, Homo sapiens
ctctcttggacccacctg

SEQ ID NO: 5885836 - DNA, 21 bp, Homo sapiens
ctctcttggacccacctgtgg

SEQ ID NO: 5885837 - DNA, 19 bp, Homo sapiens
ctctcttggaccctgggag

SEQ ID NO: 5885838 - DNA, 21 bp, Homo sapiens
ctctcttggaccctgggagtg

SEQ ID NO: 5885839 - DNA, 15 bp, Homo sapiens
ctctcttggctattg

SEQ ID NO: 5885840 - DNA, 22 bp, Homo sapiens
ctctcttgggccaagccagctg

SEQ ID NO: 5885841 - DNA, 19 bp, Homo sapiens
ctctcttggtctctttctt

SEQ ID NO: 5885842 - DNA, 18 bp, Homo sapiens
ctctcttgtcctcttctg

SEQ ID NO: 5885843 - DNA, 21 bp, Homo sapiens
ctctcttgtgagccatagaga

SEQ ID NO: 5885844 - DNA, 18 bp, Homo sapiens
ctctctttatgcttgctt

SEQ ID NO: 5885845 - DNA, 22 bp, Homo sapiens
ctctctttatgcttgcttgggg

SEQ ID NO: 5885846 - DNA, 19 bp, Homo sapiens
ctctctttcctccacccat

SEQ ID NO: 5885847 - DNA, 20 bp, Homo sapiens
ctctctttccttcttgcctt

SEQ ID NO: 5885848 - DNA, 16 bp, Homo sapiens
ctctctttctagaggt

SEQ ID NO: 5885849 - DNA, 16 bp, Homo sapiens
ctctctttcttccact

SEQ ID NO: 5885850 - DNA, 15 bp, Homo sapiens
ctctctttgcccagt

SEQ ID NO: 5885851 - DNA, 23 bp, Homo sapiens
ctctctttgcccagttggagact

SEQ ID NO: 5885852 - DNA, 14 bp, Homo sapiens
ctctctttgttctc

SEQ ID NO: 5885853 - DNA, 15 bp, Homo sapiens
ctctctttgttctca

SEQ ID NO: 5885854 - DNA, 13 bp, Homo sapiens
ctctcttttaaag

SEQ ID NO: 5885855 - DNA, 13 bp, Homo sapiens
ctctcttttcatt

SEQ ID NO: 5885856 - DNA, 18 bp, Homo sapiens
ctctcttttcattgtgta

SEQ ID NO: 5885857 - DNA, 19 bp, Homo sapiens
ctctcttttcattgtgtat

SEQ ID NO: 5885858 - DNA, 21 bp, Homo sapiens
ctctcttttccccgcctgcag

SEQ ID NO: 5885859 - DNA, 17 bp, Homo sapiens
ctctcttttccctcctt

SEQ ID NO: 5885860 - DNA, 18 bp, Homo sapiens
ctctcttttccctccttt

SEQ ID NO: 5885861 - DNA, 20 bp, Homo sapiens
ctctcttttcctcctccacc

SEQ ID NO: 5885862 - DNA, 20 bp, Homo sapiens
ctctcttttctacacactca

SEQ ID NO: 5885863 - DNA, 21 bp, Homo sapiens
ctctcttttgaggtccctgta

SEQ ID NO: 5885864 - DNA, 12 bp, Homo sapiens
ctctcttttgtt

SEQ ID NO: 5885865 - DNA, 14 bp, Homo sapiens
ctctcttttgttta

SEQ ID NO: 5885866 - DNA, 12 bp, Homo sapiens
ctctctttttct

SEQ ID NO: 5885867 - DNA, 17 bp, Homo sapiens
ctctgaaaacggccctc

SEQ ID NO: 5885868 - DNA, 21 bp, Homo sapiens
ctctgaaaagcaaaggatgtg

SEQ ID NO: 5885869 - DNA, 13 bp, Homo sapiens
ctctgaaaaggaa

SEQ ID NO: 5885870 - DNA, 15 bp, Homo sapiens
ctctgaaaatatttt

SEQ ID NO: 5885871 - DNA, 24 bp, Homo sapiens
ctctgaaaatatttttttctagct

SEQ ID NO: 5885872 - DNA, 17 bp, Homo sapiens
ctctgaaaattctggaa

SEQ ID NO: 5885873 - DNA, 9 bp, Homo sapiens
ctctgaaac

SEQ ID NO: 5885874 - DNA, 12 bp, Homo sapiens
ctctgaaacagc

SEQ ID NO: 5885875 - DNA, 14 bp, Homo sapiens
ctctgaaacatatt

SEQ ID NO: 5885876 - DNA, 15 bp, Homo sapiens
ctctgaaaccctgga

SEQ ID NO: 5885877 - DNA, 13 bp, Homo sapiens
ctctgaaagagaa

SEQ ID NO: 5885878 - DNA, 14 bp, Homo sapiens
ctctgaaagagaaa

SEQ ID NO: 5885879 - DNA, 21 bp, Homo sapiens
ctctgaaagagaaacacgtat

SEQ ID NO: 5885880 - DNA, 17 bp, Homo sapiens
ctctgaaagttgtacat

SEQ ID NO: 5885881 - DNA, 19 bp, Homo sapiens
ctctgaaagttgtacatga

SEQ ID NO: 5885882 - DNA, 13 bp, Homo sapiens
ctctgaaataatg

SEQ ID NO: 5885883 - DNA, 17 bp, Homo sapiens
ctctgaaataatgggat

SEQ ID NO: 5885884 - DNA, 19 bp, Homo sapiens
ctctgaaatgcactagacc

SEQ ID NO: 5885885 - DNA, 19 bp, Homo sapiens
ctctgaaattaaagaaatg

SEQ ID NO: 5885886 - DNA, 21 bp, Homo sapiens
ctctgaaattaaagaaatgaa

SEQ ID NO: 5885887 - DNA, 22 bp, Homo sapiens
ctctgaaattaaagaaatgaaa

SEQ ID NO: 5885888 - DNA, 14 bp, Homo sapiens
ctctgaaatttccc

SEQ ID NO: 5885889 - DNA, 17 bp, Homo sapiens
ctctgaacaaacactga

SEQ ID NO: 5885890 - DNA, 21 bp, Homo sapiens
ctctgaacaaacactgaatca

SEQ ID NO: 5885891 - DNA, 20 bp, Homo sapiens
ctctgaacacaggcagcttt

SEQ ID NO: 5885892 - DNA, 13 bp, Homo sapiens
ctctgaacacatt

SEQ ID NO: 5885893 - DNA, 15 bp, Homo sapiens
ctctgaactgcaaca

SEQ ID NO: 5885894 - DNA, 18 bp, Homo sapiens
ctctgaactgcaacactg

SEQ ID NO: 5885895 - DNA, 21 bp, Homo sapiens
ctctgaactgctgctggtcac

SEQ ID NO: 5885896 - DNA, 20 bp, Homo sapiens
ctctgaactggtagaaaaac

SEQ ID NO: 5885897 - DNA, 23 bp, Homo sapiens
ctctgaacttccaagctccaaat

SEQ ID NO: 5885898 - DNA, 21 bp, Homo sapiens
ctctgaagagtgggtttcaca

SEQ ID NO: 5885899 - DNA, 15 bp, Homo sapiens
ctctgaagcaaggcg

SEQ ID NO: 5885900 - DNA, 14 bp, Homo sapiens
ctctgaagcatttg

SEQ ID NO: 5885901 - DNA, 21 bp, Homo sapiens
ctctgaagccacaaagaccca

SEQ ID NO: 5885902 - DNA, 19 bp, Homo sapiens
ctctgaaggacccttcaga

SEQ ID NO: 5885903 - DNA, 14 bp, Homo sapiens
ctctgaaggaggcc

SEQ ID NO: 5885904 - DNA, 17 bp, Homo sapiens
ctctgaaggaggccacc

SEQ ID NO: 5885905 - DNA, 18 bp, Homo sapiens
ctctgaaggaggccacct

SEQ ID NO: 5885906 - DNA, 20 bp, Homo sapiens
ctctgaaggaggccacctcc

SEQ ID NO: 5885907 - DNA, 23 bp, Homo sapiens
ctctgaagtgaaactgcttgttt

SEQ ID NO: 5885908 - DNA, 13 bp, Homo sapiens
ctctgaagttaaa

SEQ ID NO: 5885909 - DNA, 21 bp, Homo sapiens
ctctgaataagcactttttaa

SEQ ID NO: 5885910 - DNA, 18 bp, Homo sapiens
ctctgaatacacagtatt

SEQ ID NO: 5885911 - DNA, 18 bp, Homo sapiens
ctctgaataccaagtgtg

SEQ ID NO: 5885912 - DNA, 15 bp, Homo sapiens
ctctgaatctctcaa

SEQ ID NO: 5885913 - DNA, 16 bp, Homo sapiens
ctctgaatctctcaaa

SEQ ID NO: 5885914 - DNA, 19 bp, Homo sapiens
ctctgaatctctcaaaatg

SEQ ID NO: 5885915 - DNA, 22 bp, Homo sapiens
ctctgaatctctcaaaatgtgc

SEQ ID NO: 5885916 - DNA, 22 bp, Homo sapiens
ctctgaatctgataggaaaaga

SEQ ID NO: 5885917 - DNA, 17 bp, Homo sapiens
ctctgaatctgtacatg

SEQ ID NO: 5885918 - DNA, 17 bp, Homo sapiens
ctctgaatgctatttgt

SEQ ID NO: 5885919 - DNA, 18 bp, Homo sapiens
ctctgaatgctatttgtg

SEQ ID NO: 5885920 - DNA, 16 bp, Homo sapiens
ctctgaatgtcccaga

SEQ ID NO: 5885921 - DNA, 19 bp, Homo sapiens
ctctgaatgtcccagaggc

SEQ ID NO: 5885922 - DNA, 23 bp, Homo sapiens
ctctgaattataataacatagcc

SEQ ID NO: 5885923 - DNA, 16 bp, Homo sapiens
ctctgaattcaggtcc

SEQ ID NO: 5885924 - DNA, 20 bp, Homo sapiens
ctctgaatttacttccttgc

SEQ ID NO: 5885925 - DNA, 15 bp, Homo sapiens
ctctgaatttatctt

SEQ ID NO: 5885926 - DNA, 15 bp, Homo sapiens
ctctgaatttcttct

SEQ ID NO: 5885927 - DNA, 19 bp, Homo sapiens
ctctgaatttgagatacaa

SEQ ID NO: 5885928 - DNA, 20 bp, Homo sapiens
ctctgaatttgtcgggttct

SEQ ID NO: 5885929 - DNA, 22 bp, Homo sapiens
ctctgccccatcctccagcagg

SEQ ID NO: 5885930 - DNA, 24 bp, Homo sapiens
ctctgccccatcctccagcaggga

SEQ ID NO: 5885931 - DNA, 20 bp, Homo sapiens
ctctgcccccgcgggttcta

SEQ ID NO: 5885932 - DNA, 14 bp, Homo sapiens
ctctgccccctccc

SEQ ID NO: 5885933 - DNA, 20 bp, Homo sapiens
ctctgccccctcccccgcag

SEQ ID NO: 5885934 - DNA, 10 bp, Homo sapiens
ctctgcccct

SEQ ID NO: 5885935 - DNA, 21 bp, Homo sapiens
ctctgcccctattgggagagg

SEQ ID NO: 5885936 - DNA, 12 bp, Homo sapiens
ctctgcccctgc

SEQ ID NO: 5885937 - DNA, 14 bp, Homo sapiens
ctctgcccctgcag

SEQ ID NO: 5885938 - DNA, 15 bp, Homo sapiens
ctctgcccctgcagc

SEQ ID NO: 5885939 - DNA, 16 bp, Homo sapiens
ctctgcccctgcagct

SEQ ID NO: 5885940 - DNA, 14 bp, Homo sapiens
ctctgccccttccc

SEQ ID NO: 5885941 - DNA, 15 bp, Homo sapiens
ctctgccccttcccc

SEQ ID NO: 5885942 - DNA, 19 bp, Homo sapiens
ctctgccccttgggcctcc

SEQ ID NO: 5885943 - DNA, 12 bp, Homo sapiens
ctctgcccgggc

SEQ ID NO: 5885944 - DNA, 21 bp, Homo sapiens
ctctgcccgggccccttgctg

SEQ ID NO: 5885945 - DNA, 22 bp, Homo sapiens
ctctgccctaatgcgcaggctg

SEQ ID NO: 5885946 - DNA, 23 bp, Homo sapiens
ctctgccctcattactgggcctt

SEQ ID NO: 5885947 - DNA, 14 bp, Homo sapiens
ctctgccctccctg

SEQ ID NO: 5885948 - DNA, 22 bp, Homo sapiens
ctctgccctcgggtggggctgg

SEQ ID NO: 5885949 - DNA, 17 bp, Homo sapiens
ctctgccctctccctgt

SEQ ID NO: 5885950 - DNA, 15 bp, Homo sapiens
ctctgccctctgctc

SEQ ID NO: 5885951 - DNA, 17 bp, Homo sapiens
ctctgccctgccctagc

SEQ ID NO: 5885952 - DNA, 23 bp, Homo sapiens
ctctgccctgccctagctccaca

SEQ ID NO: 5885953 - DNA, 16 bp, Homo sapiens
ctctgccctgccctgg

SEQ ID NO: 5885954 - DNA, 17 bp, Homo sapiens
ctctgccctgccctggc

SEQ ID NO: 5885955 - DNA, 23 bp, Homo sapiens
ctctgccctgcctccctttctgg

SEQ ID NO: 5885956 - DNA, 11 bp, Homo sapiens
ctctgccctgg

SEQ ID NO: 5885957 - DNA, 14 bp, Homo sapiens
ctctgccctggaaa

SEQ ID NO: 5885958 - DNA, 13 bp, Homo sapiens
ctctgccctggat

SEQ ID NO: 5885959 - DNA, 12 bp, Homo sapiens
ctctgccctggg

SEQ ID NO: 5885960 - DNA, 14 bp, Homo sapiens
ctctgccctgggct

SEQ ID NO: 5885961 - DNA, 16 bp, Homo sapiens
ctctgccctgggctcc

SEQ ID NO: 5885962 - DNA, 20 bp, Homo sapiens
ctctgccctgggctcctctt

SEQ ID NO: 5885963 - DNA, 13 bp, Homo sapiens
ctctgccctgtgt

SEQ ID NO: 5885964 - DNA, 14 bp, Homo sapiens
ctctgcccttcccc

SEQ ID NO: 5885965 - DNA, 15 bp, Homo sapiens
ctctgcccttcccct

SEQ ID NO: 5885966 - DNA, 21 bp, Homo sapiens
ctctgcccttgatcagcccca

SEQ ID NO: 5885967 - DNA, 13 bp, Homo sapiens
ctctgcccttggg

SEQ ID NO: 5885968 - DNA, 19 bp, Homo sapiens
ctctgccgaccgcctgctt

SEQ ID NO: 5885969 - DNA, 22 bp, Homo sapiens
ctctgccgaccgcctgcttcac

SEQ ID NO: 5885970 - DNA, 21 bp, Homo sapiens
ctctgccgatctaattacagc

SEQ ID NO: 5885971 - DNA, 20 bp, Homo sapiens
ctctgccgcaatacaggaac

SEQ ID NO: 5885972 - DNA, 18 bp, Homo sapiens
ctctgccgccgcccgctg

SEQ ID NO: 5885973 - DNA, 15 bp, Homo sapiens
ctctgccgctacctc

SEQ ID NO: 5885974 - DNA, 18 bp, Homo sapiens
ctctgccgctgccatgct

SEQ ID NO: 5885975 - DNA, 17 bp, Homo sapiens
ctctgccgctgtgtagg

SEQ ID NO: 5885976 - DNA, 13 bp, Homo sapiens
ctctgccggctct

SEQ ID NO: 5885977 - DNA, 23 bp, Homo sapiens
ctctgccggctctttccttgctc

SEQ ID NO: 5885978 - DNA, 20 bp, Homo sapiens
ctctgccggtcccccatgcc

SEQ ID NO: 5885979 - DNA, 22 bp, Homo sapiens
ctctgccggtcgggcagccagc

SEQ ID NO: 5885980 - DNA, 19 bp, Homo sapiens
ctctgccgtctctcctgct

SEQ ID NO: 5885981 - DNA, 17 bp, Homo sapiens
ctctgccgtctctggag

SEQ ID NO: 5885982 - DNA, 17 bp, Homo sapiens
ctctgcctaaccatggg

SEQ ID NO: 5885983 - DNA, 20 bp, Homo sapiens
ctctgcctaaccatgggctc

SEQ ID NO: 5885984 - DNA, 21 bp, Homo sapiens
ctctgcctaaccatgggctca

SEQ ID NO: 5885985 - DNA, 15 bp, Homo sapiens
ctctgcctacagaac

SEQ ID NO: 5885986 - DNA, 16 bp, Homo sapiens
ctctgcctagaaacag

SEQ ID NO: 5885987 - DNA, 20 bp, Homo sapiens
ctctgcctagaatctttatt

SEQ ID NO: 5885988 - DNA, 14 bp, Homo sapiens
ctctgcctagtcta

SEQ ID NO: 5885989 - DNA, 21 bp, Homo sapiens
ctctgcctcaaattctgcgtt

SEQ ID NO: 5885990 - DNA, 20 bp, Homo sapiens
ctctgcctcatcctcctcct

SEQ ID NO: 5885991 - DNA, 21 bp, Homo sapiens
ctctgcctcatcctcctcctc

SEQ ID NO: 5885992 - DNA, 15 bp, Homo sapiens
ctctgcctccaggag

SEQ ID NO: 5885993 - DNA, 23 bp, Homo sapiens
ctctgcctccaggagggcatcag

SEQ ID NO: 5885994 - DNA, 13 bp, Homo sapiens
ctctgcctcccag

SEQ ID NO: 5885995 - DNA, 17 bp, Homo sapiens
ctctgcctcccatcacc

SEQ ID NO: 5885996 - DNA, 15 bp, Homo sapiens
ctctgcctccctagc

SEQ ID NO: 5885997 - DNA, 20 bp, Homo sapiens
ctctgcctccctcaccctga

SEQ ID NO: 5885998 - DNA, 21 bp, Homo sapiens
ctctgcctccctcaccctgag

SEQ ID NO: 5885999 - DNA, 15 bp, Homo sapiens
ctctgcctcctcctc

SEQ ID NO: 5886000 - DNA, 23 bp, Homo sapiens
ctctgcctcctgggttcacgtaa

SEQ ID NO: 5886001 - DNA, 19 bp, Homo sapiens
ctctgcctctaactccctc

SEQ ID NO: 5886002 - DNA, 22 bp, Homo sapiens
ctctgcctctaactccctcctc

SEQ ID NO: 5886003 - DNA, 23 bp, Homo sapiens
ctctgcctctaactccctcctca

SEQ ID NO: 5886004 - DNA, 19 bp, Homo sapiens
ctctgcctctaaggccaag

SEQ ID NO: 5886005 - DNA, 20 bp, Homo sapiens
ctctgcctctaaggccaagg

SEQ ID NO: 5886006 - DNA, 22 bp, Homo sapiens
ctctgcctctagtccccaaggc

SEQ ID NO: 5886007 - DNA, 14 bp, Homo sapiens
ctctgcctctccca

SEQ ID NO: 5886008 - DNA, 15 bp, Homo sapiens
ctctgcctctcttct

SEQ ID NO: 5886009 - DNA, 20 bp, Homo sapiens
ctctgcctctgacacacagc

SEQ ID NO: 5886010 - DNA, 17 bp, Homo sapiens
ctctgcctctgcctgca

SEQ ID NO: 5886011 - DNA, 14 bp, Homo sapiens
ctctgcctctgggc

SEQ ID NO: 5886012 - DNA, 17 bp, Homo sapiens
ctctgcctctgggcagc

SEQ ID NO: 5886013 - DNA, 20 bp, Homo sapiens
ctctgcctctgggcagcctg

SEQ ID NO: 5886014 - DNA, 22 bp, Homo sapiens
ctctgcctctgggcagcctgct

SEQ ID NO: 5886015 - DNA, 18 bp, Homo sapiens
ctctgcctgaaccttcca

SEQ ID NO: 5886016 - DNA, 19 bp, Homo sapiens
ctctgcctgacaaggccag

SEQ ID NO: 5886017 - DNA, 21 bp, Homo sapiens
ctctgcctgcactccctggcc

SEQ ID NO: 5886018 - DNA, 20 bp, Homo sapiens
ctctgcctgccccgccccca

SEQ ID NO: 5886019 - DNA, 13 bp, Homo sapiens
ctctgcctgctgg

SEQ ID NO: 5886020 - DNA, 16 bp, Homo sapiens
ctctgcctgctgggct

SEQ ID NO: 5886021 - DNA, 18 bp, Homo sapiens
ctctgcctgctgggctct

SEQ ID NO: 5886022 - DNA, 21 bp, Homo sapiens
ctctgcctgcttcctggaccg

SEQ ID NO: 5886023 - DNA, 13 bp, Homo sapiens
ctctgcctggagc

SEQ ID NO: 5886024 - DNA, 23 bp, Homo sapiens
ctctgcctggaggatccctccat

SEQ ID NO: 5886025 - DNA, 13 bp, Homo sapiens
ctctgcctgggat

SEQ ID NO: 5886026 - DNA, 14 bp, Homo sapiens
ctctgcctgggatg

SEQ ID NO: 5886027 - DNA, 22 bp, Homo sapiens
ctctgcctgggatgcccttccc

SEQ ID NO: 5886028 - DNA, 18 bp, Homo sapiens
ctctgcctgggctctgga

SEQ ID NO: 5886029 - DNA, 14 bp, Homo sapiens
ctctgcctgtgccc

SEQ ID NO: 5886030 - DNA, 22 bp, Homo sapiens
ctctgccttagggtttgcagag

SEQ ID NO: 5886031 - DNA, 13 bp, Homo sapiens
ctctgccttctca

SEQ ID NO: 5886032 - DNA, 14 bp, Homo sapiens
ctctgccttctcag

SEQ ID NO: 5886033 - DNA, 16 bp, Homo sapiens
ctctgccttgcacaaa

SEQ ID NO: 5886034 - DNA, 16 bp, Homo sapiens
ctctgccttgcactgt

SEQ ID NO: 5886035 - DNA, 23 bp, Homo sapiens
ctctgccttgccctcctgggccc

SEQ ID NO: 5886036 - DNA, 15 bp, Homo sapiens
ctctgcctttgacat

SEQ ID NO: 5886037 - DNA, 22 bp, Homo sapiens
ctctgcctttgagcttctcctc

SEQ ID NO: 5886038 - DNA, 21 bp, Homo sapiens
ctctgcctttgagtgtgggac

SEQ ID NO: 5886039 - DNA, 23 bp, Homo sapiens
ctctgcctttgcaccacgggaca

SEQ ID NO: 5886040 - DNA, 13 bp, Homo sapiens
ctctgcctttgct

SEQ ID NO: 5886041 - DNA, 22 bp, Homo sapiens
ctctgcctttgtgatcctgagt

SEQ ID NO: 5886042 - DNA, 18 bp, Homo sapiens
ctctgcgacgatccccat

SEQ ID NO: 5886043 - DNA, 16 bp, Homo sapiens
ctctgcgccaggcaga

SEQ ID NO: 5886044 - DNA, 22 bp, Homo sapiens
ctctgcgccaggcagagctgag

SEQ ID NO: 5886045 - DNA, 16 bp, Homo sapiens
ctctgcgccccagcga

SEQ ID NO: 5886046 - DNA, 19 bp, Homo sapiens
ctctgcgcctctccactgt

SEQ ID NO: 5886047 - DNA, 19 bp, Homo sapiens
ctctgcggaccccagctgt

SEQ ID NO: 5886048 - DNA, 17 bp, Homo sapiens
ctctgcggagcacactg

SEQ ID NO: 5886049 - DNA, 20 bp, Homo sapiens
ctctgcggatagcatttggt

SEQ ID NO: 5886050 - DNA, 16 bp, Homo sapiens
ctctgcggccactgcg

SEQ ID NO: 5886051 - DNA, 14 bp, Homo sapiens
ctctgcggggcagg

SEQ ID NO: 5886052 - DNA, 20 bp, Homo sapiens
ctctgcggggcagggccttc

SEQ ID NO: 5886053 - DNA, 15 bp, Homo sapiens
ctctgcggtggtgcc

SEQ ID NO: 5886054 - DNA, 17 bp, Homo sapiens
ctctgcgtcccactgag

SEQ ID NO: 5886055 - DNA, 15 bp, Homo sapiens
ctctgcgtcccccag

SEQ ID NO: 5886056 - DNA, 18 bp, Homo sapiens
ctctgcgtcccccagccc

SEQ ID NO: 5886057 - DNA, 19 bp, Homo sapiens
ctctgcgtcggtcctggtg

SEQ ID NO: 5886058 - DNA, 21 bp, Homo sapiens
ctctgcgtcggtcctggtgcc

SEQ ID NO: 5886059 - DNA, 21 bp, Homo sapiens
ctctgcgtctatcctgtgtag

SEQ ID NO: 5886060 - DNA, 21 bp, Homo sapiens
ctctgcgttggcttctccctg

SEQ ID NO: 5886061 - DNA, 20 bp, Homo sapiens
ctctgctaaattgatgttga

SEQ ID NO: 5886062 - DNA, 17 bp, Homo sapiens
ctctgctaccttgcccc

SEQ ID NO: 5886063 - DNA, 13 bp, Homo sapiens
ctctgctagactc

SEQ ID NO: 5886064 - DNA, 18 bp, Homo sapiens
ctctgctagactcctcag

SEQ ID NO: 5886065 - DNA, 20 bp, Homo sapiens
ctctgctagactcctcagga

SEQ ID NO: 5886066 - DNA, 23 bp, Homo sapiens
ctctgctagactcctcaggagag

SEQ ID NO: 5886067 - DNA, 14 bp, Homo sapiens
ctctgctagtgaaa

SEQ ID NO: 5886068 - DNA, 23 bp, Homo sapiens
ctctgctcaatgaaaccttcctc

SEQ ID NO: 5886069 - DNA, 15 bp, Homo sapiens
ctctgctcacagaag

SEQ ID NO: 5886070 - DNA, 21 bp, Homo sapiens
ctctgctcaccgcccatcagg

SEQ ID NO: 5886071 - DNA, 13 bp, Homo sapiens
ctctgctcagcca

SEQ ID NO: 5886072 - DNA, 16 bp, Homo sapiens
ctctgctcagccaagc

SEQ ID NO: 5886073 - DNA, 21 bp, Homo sapiens
ctctgctcagctgcgccccct

SEQ ID NO: 5886074 - DNA, 12 bp, Homo sapiens
ctctgctcagtg

SEQ ID NO: 5886075 - DNA, 17 bp, Homo sapiens
ctctgctcatctacaca

SEQ ID NO: 5886076 - DNA, 18 bp, Homo sapiens
ctctgctccaacagacac

SEQ ID NO: 5886077 - DNA, 22 bp, Homo sapiens
ctctgctccaacagacaccctc

SEQ ID NO: 5886078 - DNA, 18 bp, Homo sapiens
ctctgctccacctttcag

SEQ ID NO: 5886079 - DNA, 12 bp, Homo sapiens
ctctgctccaga

SEQ ID NO: 5886080 - DNA, 13 bp, Homo sapiens
ctctgctccagag

SEQ ID NO: 5886081 - DNA, 22 bp, Homo sapiens
ctctgctccagcaactgccctt

SEQ ID NO: 5886082 - DNA, 13 bp, Homo sapiens
ctctgctcccagc

SEQ ID NO: 5886083 - DNA, 13 bp, Homo sapiens
ctctgctccccag

SEQ ID NO: 5886084 - DNA, 18 bp, Homo sapiens
ctctgctccgtgtgtctc

SEQ ID NO: 5886085 - DNA, 14 bp, Homo sapiens
ctctgctcctacat

SEQ ID NO: 5886086 - DNA, 20 bp, Homo sapiens
ctctgctcctacatccagct

SEQ ID NO: 5886087 - DNA, 21 bp, Homo sapiens
ctctgctcctacatccagctc

SEQ ID NO: 5886088 - DNA, 14 bp, Homo sapiens
ctctgctcctcacc

SEQ ID NO: 5886089 - DNA, 15 bp, Homo sapiens
ctctgctcctcaccc

SEQ ID NO: 5886090 - DNA, 13 bp, Homo sapiens
ctctgctcctctc

SEQ ID NO: 5886091 - DNA, 20 bp, Homo sapiens
ctctgctcctctccccagca

SEQ ID NO: 5886092 - DNA, 21 bp, Homo sapiens
ctctgctcctctccccagcaa

SEQ ID NO: 5886093 - DNA, 14 bp, Homo sapiens
ctctgctcctggag

SEQ ID NO: 5886094 - DNA, 17 bp, Homo sapiens
ctctgctcctggagcct

SEQ ID NO: 5886095 - DNA, 17 bp, Homo sapiens
ctctgctcgccctcctt

SEQ ID NO: 5886096 - DNA, 20 bp, Homo sapiens
ctctgctcgccctcctttct

SEQ ID NO: 5886097 - DNA, 13 bp, Homo sapiens
ctctgctcgcctt

SEQ ID NO: 5886098 - DNA, 13 bp, Homo sapiens
ctctgctctagcc

SEQ ID NO: 5886099 - DNA, 16 bp, Homo sapiens
ctctgctctagccagg

SEQ ID NO: 5886100 - DNA, 17 bp, Homo sapiens
ctctgctctatgccagg

SEQ ID NO: 5886101 - DNA, 21 bp, Homo sapiens
ctctgctctatgccaggctgt

SEQ ID NO: 5886102 - DNA, 11 bp, Homo sapiens
ctctgctctga

SEQ ID NO: 5886103 - DNA, 12 bp, Homo sapiens
ctctgctctgat

SEQ ID NO: 5886104 - DNA, 13 bp, Homo sapiens
ctctgctctgcct

SEQ ID NO: 5886105 - DNA, 17 bp, Homo sapiens
ctctgctcttgcctgca

SEQ ID NO: 5886106 - DNA, 16 bp, Homo sapiens
ctctggcagctcagag

SEQ ID NO: 5886107 - DNA, 18 bp, Homo sapiens
ctctggcagctcagagag

SEQ ID NO: 5886108 - DNA, 20 bp, Homo sapiens
ctctggcagctcagagaggg

SEQ ID NO: 5886109 - DNA, 20 bp, Homo sapiens
ctctggcattagaattattt

SEQ ID NO: 5886110 - DNA, 20 bp, Homo sapiens
ctctggccaaatatgcactt

SEQ ID NO: 5886111 - DNA, 21 bp, Homo sapiens
ctctggccaaatatgcacttt

SEQ ID NO: 5886112 - DNA, 15 bp, Homo sapiens
ctctggccaagggcc

SEQ ID NO: 5886113 - DNA, 16 bp, Homo sapiens
ctctggccaagggcca

SEQ ID NO: 5886114 - DNA, 17 bp, Homo sapiens
ctctggccaagggccag

SEQ ID NO: 5886115 - DNA, 20 bp, Homo sapiens
ctctggccaagggccagaca

SEQ ID NO: 5886116 - DNA, 14 bp, Homo sapiens
ctctggccacaaca

SEQ ID NO: 5886117 - DNA, 23 bp, Homo sapiens
ctctggccacaatcctccccacc

SEQ ID NO: 5886118 - DNA, 12 bp, Homo sapiens
ctctggccaccc

SEQ ID NO: 5886119 - DNA, 16 bp, Homo sapiens
ctctggccaccctggc

SEQ ID NO: 5886120 - DNA, 14 bp, Homo sapiens
ctctggccactctg

SEQ ID NO: 5886121 - DNA, 15 bp, Homo sapiens
ctctggccactctgc

SEQ ID NO: 5886122 - DNA, 13 bp, Homo sapiens
ctctggccagacg

SEQ ID NO: 5886123 - DNA, 15 bp, Homo sapiens
ctctggccaggatgg

SEQ ID NO: 5886124 - DNA, 12 bp, Homo sapiens
ctctggcccaga

SEQ ID NO: 5886125 - DNA, 15 bp, Homo sapiens
ctctggcccagaaag

SEQ ID NO: 5886126 - DNA, 13 bp, Homo sapiens
ctctggcccagcc

SEQ ID NO: 5886127 - DNA, 24 bp, Homo sapiens
ctctggccctctacccctgatctg

SEQ ID NO: 5886128 - DNA, 13 bp, Homo sapiens
ctctggccctgcc

SEQ ID NO: 5886129 - DNA, 14 bp, Homo sapiens
ctctggccctgcct

SEQ ID NO: 5886130 - DNA, 18 bp, Homo sapiens
ctctggccctgccttctt

SEQ ID NO: 5886131 - DNA, 20 bp, Homo sapiens
ctctggccctggcccttact

SEQ ID NO: 5886132 - DNA, 21 bp, Homo sapiens
ctctggccctggggtgtgtct

SEQ ID NO: 5886133 - DNA, 11 bp, Homo sapiens
ctctggccctt

SEQ ID NO: 5886134 - DNA, 14 bp, Homo sapiens
ctctggcccttgga

SEQ ID NO: 5886135 - DNA, 17 bp, Homo sapiens
ctctggcccttggaata

SEQ ID NO: 5886136 - DNA, 19 bp, Homo sapiens
ctctggccgccacccccat

SEQ ID NO: 5886137 - DNA, 16 bp, Homo sapiens
ctctggcctcccacca

SEQ ID NO: 5886138 - DNA, 18 bp, Homo sapiens
ctctggcctcctgggggc

SEQ ID NO: 5886139 - DNA, 11 bp, Homo sapiens
ctctggcctct

SEQ ID NO: 5886140 - DNA, 22 bp, Homo sapiens
ctctggcctctcgagttctcct

SEQ ID NO: 5886141 - DNA, 22 bp, Homo sapiens
ctctggccttcggcctccatcc

SEQ ID NO: 5886142 - DNA, 16 bp, Homo sapiens
ctctggccttttccta

SEQ ID NO: 5886143 - DNA, 20 bp, Homo sapiens
ctctggcggcttcctgtcca

SEQ ID NO: 5886144 - DNA, 18 bp, Homo sapiens
ctctggcggtggccacag

SEQ ID NO: 5886145 - DNA, 19 bp, Homo sapiens
ctctggcggtggccacagc

SEQ ID NO: 5886146 - DNA, 14 bp, Homo sapiens
ctctggcgtgtggg

SEQ ID NO: 5886147 - DNA, 17 bp, Homo sapiens
ctctggctactccctgg

SEQ ID NO: 5886148 - DNA, 21 bp, Homo sapiens
ctctggctactccctggacca

SEQ ID NO: 5886149 - DNA, 16 bp, Homo sapiens
ctctggctagagccga

SEQ ID NO: 5886150 - DNA, 18 bp, Homo sapiens
ctctggctagagccgagg

SEQ ID NO: 5886151 - DNA, 19 bp, Homo sapiens
ctctggctagaggccagcc

SEQ ID NO: 5886152 - DNA, 21 bp, Homo sapiens
ctctggctagaggccagcccc

SEQ ID NO: 5886153 - DNA, 22 bp, Homo sapiens
ctctggctcacagactggagac

SEQ ID NO: 5886154 - DNA, 18 bp, Homo sapiens
ctctggctcagcctgtct

SEQ ID NO: 5886155 - DNA, 20 bp, Homo sapiens
ctctggctcagctgtggtcc

SEQ ID NO: 5886156 - DNA, 23 bp, Homo sapiens
ctctggctcagctgtggtcccac

SEQ ID NO: 5886157 - DNA, 14 bp, Homo sapiens
ctctggctccacac

SEQ ID NO: 5886158 - DNA, 12 bp, Homo sapiens
ctctggctccag

SEQ ID NO: 5886159 - DNA, 17 bp, Homo sapiens
ctctggctccagaggac

SEQ ID NO: 5886160 - DNA, 14 bp, Homo sapiens
ctctggctccaggc

SEQ ID NO: 5886161 - DNA, 18 bp, Homo sapiens
ctctggctccaggcagaa

SEQ ID NO: 5886162 - DNA, 14 bp, Homo sapiens
ctctggctccccaa

SEQ ID NO: 5886163 - DNA, 16 bp, Homo sapiens
ctctggctctacgttt

SEQ ID NO: 5886164 - DNA, 14 bp, Homo sapiens
ctctggctctgcct

SEQ ID NO: 5886165 - DNA, 18 bp, Homo sapiens
ctctggctctgcctcagg

SEQ ID NO: 5886166 - DNA, 14 bp, Homo sapiens
ctctggctctgttc

SEQ ID NO: 5886167 - DNA, 16 bp, Homo sapiens
ctctggctgaaccctg

SEQ ID NO: 5886168 - DNA, 19 bp, Homo sapiens
ctctggctgaaccctgtgc

SEQ ID NO: 5886169 - DNA, 14 bp, Homo sapiens
ctctggctgcctgg

SEQ ID NO: 5886170 - DNA, 15 bp, Homo sapiens
ctctggctgcctggc

SEQ ID NO: 5886171 - DNA, 19 bp, Homo sapiens
ctctggctgcctggcccag

SEQ ID NO: 5886172 - DNA, 15 bp, Homo sapiens
ctctggctgcttttt

SEQ ID NO: 5886173 - DNA, 22 bp, Homo sapiens
ctctggctggtttggaatgctt

SEQ ID NO: 5886174 - DNA, 21 bp, Homo sapiens
ctctggctgtaaggctctaga

SEQ ID NO: 5886175 - DNA, 16 bp, Homo sapiens
ctctggcttagaaatt

SEQ ID NO: 5886176 - DNA, 19 bp, Homo sapiens
ctctggcttcaaaaagcca

SEQ ID NO: 5886177 - DNA, 20 bp, Homo sapiens
ctctggcttcaaaaagccac

SEQ ID NO: 5886178 - DNA, 13 bp, Homo sapiens
ctctggcttccag

SEQ ID NO: 5886179 - DNA, 18 bp, Homo sapiens
ctctggcttccaggtatc

SEQ ID NO: 5886180 - DNA, 16 bp, Homo sapiens
ctctggcttccctgcc

SEQ ID NO: 5886181 - DNA, 17 bp, Homo sapiens
ctctggcttccctgccc

SEQ ID NO: 5886182 - DNA, 21 bp, Homo sapiens
ctctggcttccctgcccaatc

SEQ ID NO: 5886183 - DNA, 16 bp, Homo sapiens
ctctggcttctctctt

SEQ ID NO: 5886184 - DNA, 13 bp, Homo sapiens
ctctggcttctga

SEQ ID NO: 5886185 - DNA, 18 bp, Homo sapiens
ctctggcttgccccagga

SEQ ID NO: 5886186 - DNA, 23 bp, Homo sapiens
ctctggcttgccccaggactctg

SEQ ID NO: 5886187 - DNA, 22 bp, Homo sapiens
ctctggcttggccacagccagg

SEQ ID NO: 5886188 - DNA, 10 bp, Homo sapiens
ctctggcttt

SEQ ID NO: 5886189 - DNA, 20 bp, Homo sapiens
ctctggctttattactcccc

SEQ ID NO: 5886190 - DNA, 18 bp, Homo sapiens
ctctggctttgtctctag

SEQ ID NO: 5886191 - DNA, 15 bp, Homo sapiens
ctctggcttttggaa

SEQ ID NO: 5886192 - DNA, 19 bp, Homo sapiens
ctctgggaaataagagaga

SEQ ID NO: 5886193 - DNA, 17 bp, Homo sapiens
ctctgggaacctcccag

SEQ ID NO: 5886194 - DNA, 20 bp, Homo sapiens
ctctgggaacctcccagagg

SEQ ID NO: 5886195 - DNA, 23 bp, Homo sapiens
ctctgggaagcggaaagcagtca

SEQ ID NO: 5886196 - DNA, 13 bp, Homo sapiens
ctctgggaagggg

SEQ ID NO: 5886197 - DNA, 14 bp, Homo sapiens
ctctgggaaggggt

SEQ ID NO: 5886198 - DNA, 17 bp, Homo sapiens
ctctgggaaggggtgcc

SEQ ID NO: 5886199 - DNA, 18 bp, Homo sapiens
ctctgggacccacagaac

SEQ ID NO: 5886200 - DNA, 21 bp, Homo sapiens
ctctgggacccacagaacttg

SEQ ID NO: 5886201 - DNA, 21 bp, Homo sapiens
ctctgggacgtggacatgcct

SEQ ID NO: 5886202 - DNA, 20 bp, Homo sapiens
ctctgggactctcctcctcc

SEQ ID NO: 5886203 - DNA, 18 bp, Homo sapiens
ctctgggagaaaatcatc

SEQ ID NO: 5886204 - DNA, 21 bp, Homo sapiens
ctctgggagaaaatcatcaag

SEQ ID NO: 5886205 - DNA, 18 bp, Homo sapiens
ctctgggagactttccct

SEQ ID NO: 5886206 - DNA, 17 bp, Homo sapiens
ctctgggagaggatttt

SEQ ID NO: 5886207 - DNA, 19 bp, Homo sapiens
ctctgggagcccagaaccc

SEQ ID NO: 5886208 - DNA, 19 bp, Homo sapiens
ctctgggaggggtgctgcc

SEQ ID NO: 5886209 - DNA, 15 bp, Homo sapiens
ctctgggatctgcca

SEQ ID NO: 5886210 - DNA, 20 bp, Homo sapiens
ctctgggatgtgtagccttc

SEQ ID NO: 5886211 - DNA, 18 bp, Homo sapiens
ctctgggatttatgctca

SEQ ID NO: 5886212 - DNA, 17 bp, Homo sapiens
ctctgggcaaagcccct

SEQ ID NO: 5886213 - DNA, 11 bp, Homo sapiens
ctctgggcaca

SEQ ID NO: 5886214 - DNA, 19 bp, Homo sapiens
ctctgggcacaagcagggc

SEQ ID NO: 5886215 - DNA, 19 bp, Homo sapiens
ctctgggcacactctgcca

SEQ ID NO: 5886216 - DNA, 17 bp, Homo sapiens
ctctgggcacagtgctg

SEQ ID NO: 5886217 - DNA, 19 bp, Homo sapiens
ctctgggcacagtgctgcc

SEQ ID NO: 5886218 - DNA, 21 bp, Homo sapiens
ctctgggcacccggtcccctc

SEQ ID NO: 5886219 - DNA, 15 bp, Homo sapiens
ctctgggcagcctgc

SEQ ID NO: 5886220 - DNA, 21 bp, Homo sapiens
ctctgggcagcctgctttggc

SEQ ID NO: 5886221 - DNA, 18 bp, Homo sapiens
ctctgggcagctgtcatg

SEQ ID NO: 5886222 - DNA, 15 bp, Homo sapiens
ctctgggcaggacct

SEQ ID NO: 5886223 - DNA, 14 bp, Homo sapiens
ctctgggcagtgtg

SEQ ID NO: 5886224 - DNA, 17 bp, Homo sapiens
ctctgggccacttggag

SEQ ID NO: 5886225 - DNA, 12 bp, Homo sapiens
ctctgggcccag

SEQ ID NO: 5886226 - DNA, 14 bp, Homo sapiens
ctctgggcccaggg

SEQ ID NO: 5886227 - DNA, 18 bp, Homo sapiens
ctctgggccctgcaggag

SEQ ID NO: 5886228 - DNA, 13 bp, Homo sapiens
ctctgggccctgt

SEQ ID NO: 5886229 - DNA, 16 bp, Homo sapiens
ctctgggcctcagttt

SEQ ID NO: 5886230 - DNA, 14 bp, Homo sapiens
ctctgggcctgagg

SEQ ID NO: 5886231 - DNA, 15 bp, Homo sapiens
ctctgggcctgaggg

SEQ ID NO: 5886232 - DNA, 14 bp, Homo sapiens
ctctgggcctgggg

SEQ ID NO: 5886233 - DNA, 13 bp, Homo sapiens
ctctgggcctgtg

SEQ ID NO: 5886234 - DNA, 17 bp, Homo sapiens
ctctgggcctgtgtgtg

SEQ ID NO: 5886235 - DNA, 14 bp, Homo sapiens
ctctgggcctgttc

SEQ ID NO: 5886236 - DNA, 21 bp, Homo sapiens
ctctgggcctttgtttccttg

SEQ ID NO: 5886237 - DNA, 19 bp, Homo sapiens
ctctgggcggtccagaagg

SEQ ID NO: 5886238 - DNA, 16 bp, Homo sapiens
ctctgggctatggaca

SEQ ID NO: 5886239 - DNA, 14 bp, Homo sapiens
ctctgggctcacac

SEQ ID NO: 5886240 - DNA, 19 bp, Homo sapiens
ctctgggctcacaccagcc

SEQ ID NO: 5886241 - DNA, 12 bp, Homo sapiens
ctctgggctcag

SEQ ID NO: 5886242 - DNA, 15 bp, Homo sapiens
ctctgggctcagggc

SEQ ID NO: 5886243 - DNA, 17 bp, Homo sapiens
ctctgggctcagggctg

SEQ ID NO: 5886244 - DNA, 18 bp, Homo sapiens
ctctgggctcagggctgg

SEQ ID NO: 5886245 - DNA, 19 bp, Homo sapiens
ctctgggctcagggctgga

SEQ ID NO: 5886246 - DNA, 15 bp, Homo sapiens
ctctgggctgagcct

SEQ ID NO: 5886247 - DNA, 23 bp, Homo sapiens
ctctgggctgagcctactgtctc

SEQ ID NO: 5886248 - DNA, 17 bp, Homo sapiens
ctctgggctgccatgtg

SEQ ID NO: 5886249 - DNA, 19 bp, Homo sapiens
ctctgggctggatgagctc

SEQ ID NO: 5886250 - DNA, 14 bp, Homo sapiens
ctctgggctggctg

SEQ ID NO: 5886251 - DNA, 15 bp, Homo sapiens
ctctgggctgtgcct

SEQ ID NO: 5886252 - DNA, 22 bp, Homo sapiens
ctctgggctttgattccatctc

SEQ ID NO: 5886253 - DNA, 22 bp, Homo sapiens
ctctggggaagggaaccagccc

SEQ ID NO: 5886254 - DNA, 18 bp, Homo sapiens
ctctggggacagcttcct

SEQ ID NO: 5886255 - DNA, 20 bp, Homo sapiens
ctctggggaccccaacctca

SEQ ID NO: 5886256 - DNA, 13 bp, Homo sapiens
ctctggggaccct

SEQ ID NO: 5886257 - DNA, 22 bp, Homo sapiens
ctctggggaccctccagaggtg

SEQ ID NO: 5886258 - DNA, 14 bp, Homo sapiens
ctctggggcagccc

SEQ ID NO: 5886259 - DNA, 18 bp, Homo sapiens
ctctggggcaggaccact

SEQ ID NO: 5886260 - DNA, 18 bp, Homo sapiens
ctctggggccctgggcct

SEQ ID NO: 5886261 - DNA, 21 bp, Homo sapiens
ctctggggccctgggcctcag

SEQ ID NO: 5886262 - DNA, 22 bp, Homo sapiens
ctctggggccctgggcctcagt

SEQ ID NO: 5886263 - DNA, 13 bp, Homo sapiens
ctctggggccctt

SEQ ID NO: 5886264 - DNA, 18 bp, Homo sapiens
ctctggggctcaagcagt

SEQ ID NO: 5886265 - DNA, 22 bp, Homo sapiens
ctctggggctcagccctgagct

SEQ ID NO: 5886266 - DNA, 15 bp, Homo sapiens
ctctggggcttgcta

SEQ ID NO: 5886267 - DNA, 16 bp, Homo sapiens
ctctggggcttgtcct

SEQ ID NO: 5886268 - DNA, 24 bp, Homo sapiens
ctctggggcttgtcctgtgcttgc

SEQ ID NO: 5886269 - DNA, 15 bp, Homo sapiens
ctctgggggacccag

SEQ ID NO: 5886270 - DNA, 16 bp, Homo sapiens
ctctgggggacccagg

SEQ ID NO: 5886271 - DNA, 22 bp, Homo sapiens
ctctgggggactccttccttga

SEQ ID NO: 5886272 - DNA, 13 bp, Homo sapiens
ctctgggggaggc

SEQ ID NO: 5886273 - DNA, 20 bp, Homo sapiens
ctctgggggctctggccaag

SEQ ID NO: 5886274 - DNA, 22 bp, Homo sapiens
ctctggggggcagttgggtaga

SEQ ID NO: 5886275 - DNA, 19 bp, Homo sapiens
ctctggggggtggccaggc

SEQ ID NO: 5886276 - DNA, 17 bp, Homo sapiens
ctctgggggtcctctct

SEQ ID NO: 5886277 - DNA, 17 bp, Homo sapiens
ctctgggggtgggaagt

SEQ ID NO: 5886278 - DNA, 18 bp, Homo sapiens
ctctggggtatgtgtgtg

SEQ ID NO: 5886279 - DNA, 19 bp, Homo sapiens
ctctggggtatgtgtgtgt

SEQ ID NO: 5886280 - DNA, 21 bp, Homo sapiens
ctctgggtacctgcaagcaga

SEQ ID NO: 5886281 - DNA, 20 bp, Homo sapiens
ctctgggtcagtggtccaca

SEQ ID NO: 5886282 - DNA, 16 bp, Homo sapiens
ctctgggtccctcctc

SEQ ID NO: 5886283 - DNA, 17 bp, Homo sapiens
ctctgggtccctcggag

SEQ ID NO: 5886284 - DNA, 13 bp, Homo sapiens
ctctgtcttctgg

SEQ ID NO: 5886285 - DNA, 14 bp, Homo sapiens
ctctgtcttctgga

SEQ ID NO: 5886286 - DNA, 16 bp, Homo sapiens
ctctgtctttttcctt

SEQ ID NO: 5886287 - DNA, 20 bp, Homo sapiens
ctctgtctttttccttcctg

SEQ ID NO: 5886288 - DNA, 21 bp, Homo sapiens
ctctgtctttttccttcctga

SEQ ID NO: 5886289 - DNA, 11 bp, Homo sapiens
ctctgtgaaag

SEQ ID NO: 5886290 - DNA, 14 bp, Homo sapiens
ctctgtgaaagctt

SEQ ID NO: 5886291 - DNA, 18 bp, Homo sapiens
ctctgtgaacgatttaga

SEQ ID NO: 5886292 - DNA, 14 bp, Homo sapiens
ctctgtgaatacaa

SEQ ID NO: 5886293 - DNA, 18 bp, Homo sapiens
ctctgtgaatacaattaa

SEQ ID NO: 5886294 - DNA, 21 bp, Homo sapiens
ctctgtgaatacaattaaagg

SEQ ID NO: 5886295 - DNA, 12 bp, Homo sapiens
ctctgtgaatcc

SEQ ID NO: 5886296 - DNA, 21 bp, Homo sapiens
ctctgtgaatccatgggtctg

SEQ ID NO: 5886297 - DNA, 22 bp, Homo sapiens
ctctgtgaatccatgggtctgg

SEQ ID NO: 5886298 - DNA, 15 bp, Homo sapiens
ctctgtgaccaactg

SEQ ID NO: 5886299 - DNA, 16 bp, Homo sapiens
ctctgtgaccaactgt

SEQ ID NO: 5886300 - DNA, 14 bp, Homo sapiens
ctctgtgaccaatg

SEQ ID NO: 5886301 - DNA, 15 bp, Homo sapiens
ctctgtgaccaatgt

SEQ ID NO: 5886302 - DNA, 12 bp, Homo sapiens
ctctgtgaccca

SEQ ID NO: 5886303 - DNA, 23 bp, Homo sapiens
ctctgtgacccacttctcatcac

SEQ ID NO: 5886304 - DNA, 17 bp, Homo sapiens
ctctgtgaccgccctcc

SEQ ID NO: 5886305 - DNA, 14 bp, Homo sapiens
ctctgtgactgatg

SEQ ID NO: 5886306 - DNA, 18 bp, Homo sapiens
ctctgtgagactcgagaa

SEQ ID NO: 5886307 - DNA, 18 bp, Homo sapiens
ctctgtgagccccacagc

SEQ ID NO: 5886308 - DNA, 17 bp, Homo sapiens
ctctgtgagggtgctga

SEQ ID NO: 5886309 - DNA, 18 bp, Homo sapiens
ctctgtgcacagtggctt

SEQ ID NO: 5886310 - DNA, 22 bp, Homo sapiens
ctctgtgcacagtggcttcttt

SEQ ID NO: 5886311 - DNA, 18 bp, Homo sapiens
ctctgtgcactcacgctc

SEQ ID NO: 5886312 - DNA, 20 bp, Homo sapiens
ctctgtgcacttatttatga

SEQ ID NO: 5886313 - DNA, 17 bp, Homo sapiens
ctctgtgcagacagtgt

SEQ ID NO: 5886314 - DNA, 18 bp, Homo sapiens
ctctgtgcaggagccagt

SEQ ID NO: 5886315 - DNA, 14 bp, Homo sapiens
ctctgtgcagggca

SEQ ID NO: 5886316 - DNA, 21 bp, Homo sapiens
ctctgtgcagggcacagaagg

SEQ ID NO: 5886317 - DNA, 13 bp, Homo sapiens
ctctgtgcaggtg

SEQ ID NO: 5886318 - DNA, 15 bp, Homo sapiens
ctctgtgcaggtgct

SEQ ID NO: 5886319 - DNA, 19 bp, Homo sapiens
ctctgtgcaggtgctgcct

SEQ ID NO: 5886320 - DNA, 15 bp, Homo sapiens
ctctgtgccagagcc

SEQ ID NO: 5886321 - DNA, 16 bp, Homo sapiens
ctctgtgccagagcct

SEQ ID NO: 5886322 - DNA, 22 bp, Homo sapiens
ctctgtgcccaccctccactct

SEQ ID NO: 5886323 - DNA, 14 bp, Homo sapiens
ctctgtgcccatgg

SEQ ID NO: 5886324 - DNA, 19 bp, Homo sapiens
ctctgtgcccctgtaaata

SEQ ID NO: 5886325 - DNA, 17 bp, Homo sapiens
ctctgtgcccggtgcca

SEQ ID NO: 5886326 - DNA, 14 bp, Homo sapiens
ctctgtgcctaata

SEQ ID NO: 5886327 - DNA, 17 bp, Homo sapiens
ctctgtgcctgggatca

SEQ ID NO: 5886328 - DNA, 13 bp, Homo sapiens
ctctgtgccttcg

SEQ ID NO: 5886329 - DNA, 15 bp, Homo sapiens
ctctgtgccttcttt

SEQ ID NO: 5886330 - DNA, 16 bp, Homo sapiens
ctctgtgccttctttt

SEQ ID NO: 5886331 - DNA, 23 bp, Homo sapiens
ctctgtgccttgccacattaaat

SEQ ID NO: 5886332 - DNA, 13 bp, Homo sapiens
ctctgtgccttgg

SEQ ID NO: 5886333 - DNA, 19 bp, Homo sapiens
ctctgtgctaagttgtctt

SEQ ID NO: 5886334 - DNA, 18 bp, Homo sapiens
ctctgtgctctcctagag

SEQ ID NO: 5886335 - DNA, 15 bp, Homo sapiens
ctctgtgctgaccct

SEQ ID NO: 5886336 - DNA, 21 bp, Homo sapiens
ctctgtgctgaccctcctgtt

SEQ ID NO: 5886337 - DNA, 19 bp, Homo sapiens
ctctgtgctgagcacagag

SEQ ID NO: 5886338 - DNA, 12 bp, Homo sapiens
ctctgtgctggc

SEQ ID NO: 5886339 - DNA, 19 bp, Homo sapiens
ctctgtgctggccagcgag

SEQ ID NO: 5886340 - DNA, 20 bp, Homo sapiens
ctctgtggaaaagccatctc

SEQ ID NO: 5886341 - DNA, 22 bp, Homo sapiens
ctctgtggaaaagccatctcag

SEQ ID NO: 5886342 - DNA, 18 bp, Homo sapiens
ctctgtggaggggccctc

SEQ ID NO: 5886343 - DNA, 15 bp, Homo sapiens
ctctgtggcaaaaag

SEQ ID NO: 5886344 - DNA, 17 bp, Homo sapiens
ctctgtggccagcctgg

SEQ ID NO: 5886345 - DNA, 21 bp, Homo sapiens
ctctgtggccagcctggcatc

SEQ ID NO: 5886346 - DNA, 15 bp, Homo sapiens
ctctgtggccaggag

SEQ ID NO: 5886347 - DNA, 18 bp, Homo sapiens
ctctgtggccaggagccc

SEQ ID NO: 5886348 - DNA, 13 bp, Homo sapiens
ctctgtggcctcc

SEQ ID NO: 5886349 - DNA, 17 bp, Homo sapiens
ctctgtggcctgtgtcc

SEQ ID NO: 5886350 - DNA, 19 bp, Homo sapiens
ctctgtggccttggccctg

SEQ ID NO: 5886351 - DNA, 20 bp, Homo sapiens
ctctgtggccttggccctga

SEQ ID NO: 5886352 - DNA, 15 bp, Homo sapiens
ctctgtggctccaac

SEQ ID NO: 5886353 - DNA, 18 bp, Homo sapiens
ctctgtgggaaaaaagaa

SEQ ID NO: 5886354 - DNA, 17 bp, Homo sapiens
ctctgtgggccctaccc

SEQ ID NO: 5886355 - DNA, 18 bp, Homo sapiens
ctctgtgggccctaccct

SEQ ID NO: 5886356 - DNA, 15 bp, Homo sapiens
ctctgtggggccaca

SEQ ID NO: 5886357 - DNA, 13 bp, Homo sapiens
ctctgtggggctg

SEQ ID NO: 5886358 - DNA, 16 bp, Homo sapiens
ctctgtgggtctctgg

SEQ ID NO: 5886359 - DNA, 18 bp, Homo sapiens
ctctgtggtcacccatgc

SEQ ID NO: 5886360 - DNA, 21 bp, Homo sapiens
ctctgtggtcacccatgcatc

SEQ ID NO: 5886361 - DNA, 23 bp, Homo sapiens
ctctgtggtggttcattccacag

SEQ ID NO: 5886362 - DNA, 13 bp, Homo sapiens
ctctgtggtgtct

SEQ ID NO: 5886363 - DNA, 21 bp, Homo sapiens
ctctgtgtaaccagctcagtg

SEQ ID NO: 5886364 - DNA, 17 bp, Homo sapiens
ctctgtgtaatagaata

SEQ ID NO: 5886365 - DNA, 23 bp, Homo sapiens
ctctgtgtacatgtgtgcagagc

SEQ ID NO: 5886366 - DNA, 23 bp, Homo sapiens
ctctgtgtatatctcttggaaaa

SEQ ID NO: 5886367 - DNA, 17 bp, Homo sapiens
ctctgtgtatttatata

SEQ ID NO: 5886368 - DNA, 18 bp, Homo sapiens
ctctgtgtatttatataa

SEQ ID NO: 5886369 - DNA, 20 bp, Homo sapiens
ctctgtgtatttatataaaa

SEQ ID NO: 5886370 - DNA, 23 bp, Homo sapiens
ctctgtgtcagcatctttgccct

SEQ ID NO: 5886371 - DNA, 14 bp, Homo sapiens
ctctgtgtctttct

SEQ ID NO: 5886372 - DNA, 20 bp, Homo sapiens
ctctgtgtggcaaacattta

SEQ ID NO: 5886373 - DNA, 16 bp, Homo sapiens
ctctgtgtggctgtgc

SEQ ID NO: 5886374 - DNA, 17 bp, Homo sapiens
ctctgtgtggctgtgca

SEQ ID NO: 5886375 - DNA, 16 bp, Homo sapiens
ctctgtgtgttaaaat

SEQ ID NO: 5886376 - DNA, 18 bp, Homo sapiens
ctctgtgttcccagaggc

SEQ ID NO: 5886377 - DNA, 13 bp, Homo sapiens
ctctgtgtttaaa

SEQ ID NO: 5886378 - DNA, 16 bp, Homo sapiens
ctctgttaaagatcag

SEQ ID NO: 5886379 - DNA, 20 bp, Homo sapiens
ctctgttaaggttgaacttt

SEQ ID NO: 5886380 - DNA, 13 bp, Homo sapiens
ctctgttacaaaa

SEQ ID NO: 5886381 - DNA, 14 bp, Homo sapiens
ctctgttacaaaag

SEQ ID NO: 5886382 - DNA, 22 bp, Homo sapiens
ctctgttacactttttggaagt

SEQ ID NO: 5886383 - DNA, 16 bp, Homo sapiens
ctctgttaggtccatt

SEQ ID NO: 5886384 - DNA, 18 bp, Homo sapiens
ctctgttaggtccatttt

SEQ ID NO: 5886385 - DNA, 20 bp, Homo sapiens
ctctgttatgcaagcacaaa

SEQ ID NO: 5886386 - DNA, 15 bp, Homo sapiens
ctctgttcaaagctg

SEQ ID NO: 5886387 - DNA, 18 bp, Homo sapiens
ctctgttcaaagctgcct

SEQ ID NO: 5886388 - DNA, 11 bp, Homo sapiens
ctctgttcaca

SEQ ID NO: 5886389 - DNA, 19 bp, Homo sapiens
ctctgttcagatgtgcatt

SEQ ID NO: 5886390 - DNA, 15 bp, Homo sapiens
ctctgttcagtcgca

SEQ ID NO: 5886391 - DNA, 15 bp, Homo sapiens
ctctgttcatttcac

SEQ ID NO: 5886392 - DNA, 21 bp, Homo sapiens
ctctgttcatttcacacagtg

SEQ ID NO: 5886393 - DNA, 16 bp, Homo sapiens
ctctgttcatttcctc

SEQ ID NO: 5886394 - DNA, 11 bp, Homo sapiens
ctctgttccaa

SEQ ID NO: 5886395 - DNA, 18 bp, Homo sapiens
ctctgttccaagtgtgtg

SEQ ID NO: 5886396 - DNA, 13 bp, Homo sapiens
ctctgttccatgt

SEQ ID NO: 5886397 - DNA, 15 bp, Homo sapiens
ctctgttccatgtct

SEQ ID NO: 5886398 - DNA, 16 bp, Homo sapiens
ctctgttccatgtctc

SEQ ID NO: 5886399 - DNA, 14 bp, Homo sapiens
ctctgttcccctag

SEQ ID NO: 5886400 - DNA, 23 bp, Homo sapiens
ctctgttcccctagtaagtgcct

SEQ ID NO: 5886401 - DNA, 14 bp, Homo sapiens
ctctgttcccttcc

SEQ ID NO: 5886402 - DNA, 17 bp, Homo sapiens
ctctgttcccttcctca

SEQ ID NO: 5886403 - DNA, 15 bp, Homo sapiens
ctctgttcctcaatg

SEQ ID NO: 5886404 - DNA, 15 bp, Homo sapiens
ctctgttcctggctc

SEQ ID NO: 5886405 - DNA, 15 bp, Homo sapiens
ctctgttccttccct

SEQ ID NO: 5886406 - DNA, 20 bp, Homo sapiens
ctctgttcctttctctgggc

SEQ ID NO: 5886407 - DNA, 21 bp, Homo sapiens
ctctgttcctttctctgggct

SEQ ID NO: 5886408 - DNA, 14 bp, Homo sapiens
ctctgttccttttg

SEQ ID NO: 5886409 - DNA, 15 bp, Homo sapiens
ctctgttctagagtg

SEQ ID NO: 5886410 - DNA, 19 bp, Homo sapiens
ctctgttctagagtgacag

SEQ ID NO: 5886411 - DNA, 17 bp, Homo sapiens
ctctgttctcatgaagg

SEQ ID NO: 5886412 - DNA, 14 bp, Homo sapiens
ctctgttctctccc

SEQ ID NO: 5886413 - DNA, 15 bp, Homo sapiens
ctctgttctcttgct

SEQ ID NO: 5886414 - DNA, 18 bp, Homo sapiens
ctctgttctcttgcttta

SEQ ID NO: 5886415 - DNA, 20 bp, Homo sapiens
ctctgttctgcacacagcac

SEQ ID NO: 5886416 - DNA, 18 bp, Homo sapiens
ctctgttctggtggcccc

SEQ ID NO: 5886417 - DNA, 19 bp, Homo sapiens
ctctgttctggtggcccca

SEQ ID NO: 5886418 - DNA, 20 bp, Homo sapiens
ctctgttcttcctcagccag

SEQ ID NO: 5886419 - DNA, 21 bp, Homo sapiens
ctctgttcttcctcagccagc

SEQ ID NO: 5886420 - DNA, 22 bp, Homo sapiens
ctctgttcttcctcagccagcc

SEQ ID NO: 5886421 - DNA, 14 bp, Homo sapiens
ctctgttgaatatt

SEQ ID NO: 5886422 - DNA, 16 bp, Homo sapiens
ctctgttgaatattta

SEQ ID NO: 5886423 - DNA, 20 bp, Homo sapiens
ctctgttgaccaggctggag

SEQ ID NO: 5886424 - DNA, 19 bp, Homo sapiens
ctctgttgactggctgtgt

SEQ ID NO: 5886425 - DNA, 16 bp, Homo sapiens
ctctgttgatctaccc

SEQ ID NO: 5886426 - DNA, 23 bp, Homo sapiens
ctctgttgatctacccgtgcctg

SEQ ID NO: 5886427 - DNA, 19 bp, Homo sapiens
ctctgttgcaggtgtccgg

SEQ ID NO: 5886428 - DNA, 22 bp, Homo sapiens
ctctgttgccaaggctggagtg

SEQ ID NO: 5886429 - DNA, 14 bp, Homo sapiens
ctctgttgcccagg

SEQ ID NO: 5886430 - DNA, 22 bp, Homo sapiens
ctctgttgcccaggctggagtg

SEQ ID NO: 5886431 - DNA, 11 bp, Homo sapiens
ctctgttgcct

SEQ ID NO: 5886432 - DNA, 14 bp, Homo sapiens
ctctgttgcctcct

SEQ ID NO: 5886433 - DNA, 16 bp, Homo sapiens
ctctgttgcctcctct

SEQ ID NO: 5886434 - DNA, 15 bp, Homo sapiens
ctctgttgccttttt

SEQ ID NO: 5886435 - DNA, 13 bp, Homo sapiens
ctctgttgctgtg

SEQ ID NO: 5886436 - DNA, 16 bp, Homo sapiens
ctctgttggtccactg

SEQ ID NO: 5886437 - DNA, 18 bp, Homo sapiens
ctctgttggtctgccttc

SEQ ID NO: 5886438 - DNA, 20 bp, Homo sapiens
ctctgttgtcctccccttgg

SEQ ID NO: 5886439 - DNA, 21 bp, Homo sapiens
ctctgttgtcgtaaagatttg

SEQ ID NO: 5886440 - DNA, 18 bp, Homo sapiens
ctctgtttaccctccctg

SEQ ID NO: 5886441 - DNA, 19 bp, Homo sapiens
ctctgtttagtaaatacat

SEQ ID NO: 5886442 - DNA, 17 bp, Homo sapiens
ctctgtttcctgaaata

SEQ ID NO: 5886443 - DNA, 16 bp, Homo sapiens
ctctgtttctccttct

SEQ ID NO: 5886444 - DNA, 18 bp, Homo sapiens
ctctgtttgatgctattt

SEQ ID NO: 5886445 - DNA, 13 bp, Homo sapiens
ctctgtttgctca

SEQ ID NO: 5886446 - DNA, 23 bp, Homo sapiens
ctctgtttgctcacccaggacct

SEQ ID NO: 5886447 - DNA, 18 bp, Homo sapiens
ctctgtttgcttttgaac

SEQ ID NO: 5886448 - DNA, 16 bp, Homo sapiens
ctctgtttgtggggtg

SEQ ID NO: 5886449 - DNA, 16 bp, Homo sapiens
ctctgttttacaagtt

SEQ ID NO: 5886450 - DNA, 19 bp, Homo sapiens
ctctgtttttcttctgaaa

SEQ ID NO: 5886451 - DNA, 19 bp, Homo sapiens
ctcttaaaaaataaaaact

SEQ ID NO: 5886452 - DNA, 18 bp, Homo sapiens
ctcttaaaaagacactta

SEQ ID NO: 5886453 - DNA, 12 bp, Homo sapiens
ctcttaaaaatc

SEQ ID NO: 5886454 - DNA, 13 bp, Homo sapiens
ctcttaaaaccca

SEQ ID NO: 5886455 - DNA, 14 bp, Homo sapiens
ctcttaaaatatct

SEQ ID NO: 5886456 - DNA, 17 bp, Homo sapiens
ctcttaaaatatcttcc

SEQ ID NO: 5886457 - DNA, 13 bp, Homo sapiens
ctcttaaactctc

SEQ ID NO: 5886458 - DNA, 22 bp, Homo sapiens
ctcttaaactctcttcttccat

SEQ ID NO: 5886459 - DNA, 22 bp, Homo sapiens
ctcttaaagttggaatttacca

SEQ ID NO: 5886460 - DNA, 15 bp, Homo sapiens
ctcttaaataaaaat

SEQ ID NO: 5886461 - DNA, 21 bp, Homo sapiens
ctcttaaatctcttaaactct

SEQ ID NO: 5886462 - DNA, 17 bp, Homo sapiens
ctcttaacaatttctgt

SEQ ID NO: 5886463 - DNA, 14 bp, Homo sapiens
ctcttccagggcag

SEQ ID NO: 5886464 - DNA, 18 bp, Homo sapiens
ctcttccagggcagcggc

SEQ ID NO: 5886465 - DNA, 22 bp, Homo sapiens
ctcttccagggcagcggctcca

SEQ ID NO: 5886466 - DNA, 19 bp, Homo sapiens
ctcttccagtcttcctgac

SEQ ID NO: 5886467 - DNA, 22 bp, Homo sapiens
ctcttccagtgaacattcccag

SEQ ID NO: 5886468 - DNA, 15 bp, Homo sapiens
ctcttccagtttctg

SEQ ID NO: 5886469 - DNA, 23 bp, Homo sapiens
ctcttccatcagagatgggaaaa

SEQ ID NO: 5886470 - DNA, 14 bp, Homo sapiens
ctcttccatgctgt

SEQ ID NO: 5886471 - DNA, 15 bp, Homo sapiens
ctcttccatgctgtg

SEQ ID NO: 5886472 - DNA, 13 bp, Homo sapiens
ctcttccatttct

SEQ ID NO: 5886473 - DNA, 13 bp, Homo sapiens
ctcttcccaccaa

SEQ ID NO: 5886474 - DNA, 22 bp, Homo sapiens
ctcttcccaccaactctctctg

SEQ ID NO: 5886475 - DNA, 15 bp, Homo sapiens
ctcttcccactccag

SEQ ID NO: 5886476 - DNA, 18 bp, Homo sapiens
ctcttcccactccagctg

SEQ ID NO: 5886477 - DNA, 14 bp, Homo sapiens
ctcttcccactttt

SEQ ID NO: 5886478 - DNA, 21 bp, Homo sapiens
ctcttcccagaaaaccagtct

SEQ ID NO: 5886479 - DNA, 19 bp, Homo sapiens
ctcttcccaggcctttgga

SEQ ID NO: 5886480 - DNA, 18 bp, Homo sapiens
ctcttcccagttcagctt

SEQ ID NO: 5886481 - DNA, 12 bp, Homo sapiens
ctcttcccatga

SEQ ID NO: 5886482 - DNA, 16 bp, Homo sapiens
ctcttcccatgactgc

SEQ ID NO: 5886483 - DNA, 20 bp, Homo sapiens
ctcttcccatgactgcaccc

SEQ ID NO: 5886484 - DNA, 21 bp, Homo sapiens
ctcttccccagaaaggagact

SEQ ID NO: 5886485 - DNA, 22 bp, Homo sapiens
ctcttccccagacgcctggctg

SEQ ID NO: 5886486 - DNA, 19 bp, Homo sapiens
ctcttccccagagaggcac

SEQ ID NO: 5886487 - DNA, 15 bp, Homo sapiens
ctcttcccccaagat

SEQ ID NO: 5886488 - DNA, 15 bp, Homo sapiens
ctcttcccccaccac

SEQ ID NO: 5886489 - DNA, 20 bp, Homo sapiens
ctcttcccccatgtgcctgt

SEQ ID NO: 5886490 - DNA, 13 bp, Homo sapiens
ctcttccccccaa

SEQ ID NO: 5886491 - DNA, 14 bp, Homo sapiens
ctcttccccccaaa

SEQ ID NO: 5886492 - DNA, 16 bp, Homo sapiens
ctcttccccctctccc

SEQ ID NO: 5886493 - DNA, 18 bp, Homo sapiens
ctcttccccctctcccag

SEQ ID NO: 5886494 - DNA, 16 bp, Homo sapiens
ctcttcccctagacct

SEQ ID NO: 5886495 - DNA, 22 bp, Homo sapiens
ctcttcccctccctcccacact

SEQ ID NO: 5886496 - DNA, 16 bp, Homo sapiens
ctcttccccttcctgt

SEQ ID NO: 5886497 - DNA, 15 bp, Homo sapiens
ctcttcccctttcct

SEQ ID NO: 5886498 - DNA, 21 bp, Homo sapiens
ctcttccctccggactctaaa

SEQ ID NO: 5886499 - DNA, 12 bp, Homo sapiens
ctcttccctcct

SEQ ID NO: 5886500 - DNA, 16 bp, Homo sapiens
ctcttccctccttccc

SEQ ID NO: 5886501 - DNA, 12 bp, Homo sapiens
ctcttccctctg

SEQ ID NO: 5886502 - DNA, 17 bp, Homo sapiens
ctcttccctctgggcct

SEQ ID NO: 5886503 - DNA, 15 bp, Homo sapiens
ctcttccctgaacgt

SEQ ID NO: 5886504 - DNA, 12 bp, Homo sapiens
ctcttcccttcc

SEQ ID NO: 5886505 - DNA, 15 bp, Homo sapiens
ctcttcccttcccag

SEQ ID NO: 5886506 - DNA, 16 bp, Homo sapiens
ctcttcccttcccaga

SEQ ID NO: 5886507 - DNA, 18 bp, Homo sapiens
ctcttcccttcccagacc

SEQ ID NO: 5886508 - DNA, 21 bp, Homo sapiens
ctcttcccttcctccattgca

SEQ ID NO: 5886509 - DNA, 17 bp, Homo sapiens
ctcttccctttccccag

SEQ ID NO: 5886510 - DNA, 19 bp, Homo sapiens
ctcttcccttttttttctg

SEQ ID NO: 5886511 - DNA, 20 bp, Homo sapiens
ctcttcccttttttttctgg

SEQ ID NO: 5886512 - DNA, 20 bp, Homo sapiens
ctcttccgaaaaatcctctt

SEQ ID NO: 5886513 - DNA, 23 bp, Homo sapiens
ctcttccgaaaaatcctcttcct

SEQ ID NO: 5886514 - DNA, 13 bp, Homo sapiens
ctcttccgagctg

SEQ ID NO: 5886515 - DNA, 16 bp, Homo sapiens
ctcttccgagctgctt

SEQ ID NO: 5886516 - DNA, 17 bp, Homo sapiens
ctcttccgcagcccctt

SEQ ID NO: 5886517 - DNA, 18 bp, Homo sapiens
ctcttccgggagctggtg

SEQ ID NO: 5886518 - DNA, 23 bp, Homo sapiens
ctcttccgttggaaagaacattt

SEQ ID NO: 5886519 - DNA, 22 bp, Homo sapiens
ctcttcctacccaaccactcaa

SEQ ID NO: 5886520 - DNA, 18 bp, Homo sapiens
ctcttcctactggtctct

SEQ ID NO: 5886521 - DNA, 20 bp, Homo sapiens
ctcttcctactggtctctct

SEQ ID NO: 5886522 - DNA, 18 bp, Homo sapiens
ctcttcctatcccatccc

SEQ ID NO: 5886523 - DNA, 17 bp, Homo sapiens
ctcttcctcatcctgct

SEQ ID NO: 5886524 - DNA, 11 bp, Homo sapiens
ctcttcctcca

SEQ ID NO: 5886525 - DNA, 13 bp, Homo sapiens
ctcttcctccact

SEQ ID NO: 5886526 - DNA, 14 bp, Homo sapiens
ctcttcctcccctc

SEQ ID NO: 5886527 - DNA, 16 bp, Homo sapiens
ctcttcctcctgacac

SEQ ID NO: 5886528 - DNA, 18 bp, Homo sapiens
ctcttcctcctgacaccc

SEQ ID NO: 5886529 - DNA, 23 bp, Homo sapiens
ctcttcctcctgacaccccactt

SEQ ID NO: 5886530 - DNA, 17 bp, Homo sapiens
ctcttcctctgaggctg

SEQ ID NO: 5886531 - DNA, 20 bp, Homo sapiens
ctcttcctctggtttctgtg

SEQ ID NO: 5886532 - DNA, 13 bp, Homo sapiens
ctcttcctctgtt

SEQ ID NO: 5886533 - DNA, 13 bp, Homo sapiens
ctcttcctcttcc

SEQ ID NO: 5886534 - DNA, 16 bp, Homo sapiens
ctcttcctcttgaccc

SEQ ID NO: 5886535 - DNA, 16 bp, Homo sapiens
ctcttcctgcccctct

SEQ ID NO: 5886536 - DNA, 14 bp, Homo sapiens
ctcttcctgccctt

SEQ ID NO: 5886537 - DNA, 20 bp, Homo sapiens
ctcttcctggaatgcattca

SEQ ID NO: 5886538 - DNA, 19 bp, Homo sapiens
ctcttcctggacaggccag

SEQ ID NO: 5886539 - DNA, 17 bp, Homo sapiens
ctcttcctgtgatccac

SEQ ID NO: 5886540 - DNA, 13 bp, Homo sapiens
ctcttccttcccc

SEQ ID NO: 5886541 - DNA, 19 bp, Homo sapiens
ctcttccttccctgctgtg

SEQ ID NO: 5886542 - DNA, 23 bp, Homo sapiens
ctcttccttccgctcctttacct

SEQ ID NO: 5886543 - DNA, 15 bp, Homo sapiens
ctcttccttctctac

SEQ ID NO: 5886544 - DNA, 19 bp, Homo sapiens
ctcttccttctctactcat

SEQ ID NO: 5886545 - DNA, 16 bp, Homo sapiens
ctcttcgaagccttgc

SEQ ID NO: 5886546 - DNA, 14 bp, Homo sapiens
ctcttcgcctttcc

SEQ ID NO: 5886547 - DNA, 18 bp, Homo sapiens
ctcttcggtggccttgag

SEQ ID NO: 5886548 - DNA, 15 bp, Homo sapiens
ctcttcggtttctga

SEQ ID NO: 5886549 - DNA, 16 bp, Homo sapiens
ctcttcgtcctgatcc

SEQ ID NO: 5886550 - DNA, 20 bp, Homo sapiens
ctcttcgtttcagtgtcaaa

SEQ ID NO: 5886551 - DNA, 16 bp, Homo sapiens
ctcttctaaaatagca

SEQ ID NO: 5886552 - DNA, 21 bp, Homo sapiens
ctcttctaaaatagcaataac

SEQ ID NO: 5886553 - DNA, 16 bp, Homo sapiens
ctcttctaacatctta

SEQ ID NO: 5886554 - DNA, 19 bp, Homo sapiens
ctcttctaacatgaaatat

SEQ ID NO: 5886555 - DNA, 15 bp, Homo sapiens
ctcttctaccctttt

SEQ ID NO: 5886556 - DNA, 18 bp, Homo sapiens
ctcttctacccttttcct

SEQ ID NO: 5886557 - DNA, 23 bp, Homo sapiens
ctcttctactacccccacagacc

SEQ ID NO: 5886558 - DNA, 15 bp, Homo sapiens
ctcttctagagccgt

SEQ ID NO: 5886559 - DNA, 21 bp, Homo sapiens
ctcttctagatgattttttga

SEQ ID NO: 5886560 - DNA, 23 bp, Homo sapiens
ctcttctagatggaccccagcat

SEQ ID NO: 5886561 - DNA, 22 bp, Homo sapiens
ctcttctaggcccattgtcctc

SEQ ID NO: 5886562 - DNA, 18 bp, Homo sapiens
ctcttctatttaaaaaat

SEQ ID NO: 5886563 - DNA, 14 bp, Homo sapiens
ctcttctcagccac

SEQ ID NO: 5886564 - DNA, 15 bp, Homo sapiens
ctcttctcagccact

SEQ ID NO: 5886565 - DNA, 16 bp, Homo sapiens
ctcttctcagctccac

SEQ ID NO: 5886566 - DNA, 20 bp, Homo sapiens
ctcttctcagctccactctg

SEQ ID NO: 5886567 - DNA, 21 bp, Homo sapiens
ctcttctcagctcttccatga

SEQ ID NO: 5886568 - DNA, 12 bp, Homo sapiens
ctcttctcattt

SEQ ID NO: 5886569 - DNA, 15 bp, Homo sapiens
ctcttctccactgga

SEQ ID NO: 5886570 - DNA, 17 bp, Homo sapiens
ctcttctccactggatg

SEQ ID NO: 5886571 - DNA, 19 bp, Homo sapiens
ctcttctccactggatgga

SEQ ID NO: 5886572 - DNA, 12 bp, Homo sapiens
ctcttctccagg

SEQ ID NO: 5886573 - DNA, 16 bp, Homo sapiens
ctcttctccaggctgt

SEQ ID NO: 5886574 - DNA, 12 bp, Homo sapiens
ctcttctcccag

SEQ ID NO: 5886575 - DNA, 13 bp, Homo sapiens
ctcttctcccaga

SEQ ID NO: 5886576 - DNA, 16 bp, Homo sapiens
ctcttctcccagaatc

SEQ ID NO: 5886577 - DNA, 21 bp, Homo sapiens
ctcttctcccagaatcccagc

SEQ ID NO: 5886578 - DNA, 21 bp, Homo sapiens
ctcttctccccttccatttct

SEQ ID NO: 5886579 - DNA, 16 bp, Homo sapiens
ctcttctccctttcct

SEQ ID NO: 5886580 - DNA, 16 bp, Homo sapiens
ctcttctcctgcagcc

SEQ ID NO: 5886581 - DNA, 11 bp, Homo sapiens
ctcttctcctt

SEQ ID NO: 5886582 - DNA, 21 bp, Homo sapiens
ctcttctccttgccttgcttc

SEQ ID NO: 5886583 - DNA, 21 bp, Homo sapiens
ctcttctctcaaccttggcct

SEQ ID NO: 5886584 - DNA, 15 bp, Homo sapiens
ctcttctctccagct

SEQ ID NO: 5886585 - DNA, 15 bp, Homo sapiens
ctcttctctccccag

SEQ ID NO: 5886586 - DNA, 16 bp, Homo sapiens
ctcttctctccccagc

SEQ ID NO: 5886587 - DNA, 18 bp, Homo sapiens
ctcttctctccccttttc

SEQ ID NO: 5886588 - DNA, 15 bp, Homo sapiens
ctcttctctcctcag

SEQ ID NO: 5886589 - DNA, 17 bp, Homo sapiens
ctcttctctcctcagtt

SEQ ID NO: 5886590 - DNA, 15 bp, Homo sapiens
ctcttctctctgctc

SEQ ID NO: 5886591 - DNA, 17 bp, Homo sapiens
ctcttctctctgctctg

SEQ ID NO: 5886592 - DNA, 19 bp, Homo sapiens
ctcttctctctgctctgac

SEQ ID NO: 5886593 - DNA, 16 bp, Homo sapiens
ctcttctctgcaatgc

SEQ ID NO: 5886594 - DNA, 15 bp, Homo sapiens
ctcttctctgggccc

SEQ ID NO: 5886595 - DNA, 16 bp, Homo sapiens
ctcttctctgggccca

SEQ ID NO: 5886596 - DNA, 13 bp, Homo sapiens
ctcttctctgtta

SEQ ID NO: 5886597 - DNA, 17 bp, Homo sapiens
ctcttctcttgacagtc

SEQ ID NO: 5886598 - DNA, 22 bp, Homo sapiens
ctcttctcttgacagtctgaag

SEQ ID NO: 5886599 - DNA, 19 bp, Homo sapiens
ctcttctgaagctagaaac

SEQ ID NO: 5886600 - DNA, 20 bp, Homo sapiens
ctcttctgaagctagaaaca

SEQ ID NO: 5886601 - DNA, 16 bp, Homo sapiens
ctcttctgaataaagc

SEQ ID NO: 5886602 - DNA, 20 bp, Homo sapiens
ctcttctgaataaagcaatt

SEQ ID NO: 5886603 - DNA, 20 bp, Homo sapiens
ctcttctgacgtgccttttg

SEQ ID NO: 5886604 - DNA, 22 bp, Homo sapiens
ctcttctgacgtgccttttgca

SEQ ID NO: 5886605 - DNA, 11 bp, Homo sapiens
ctcttctgagc

SEQ ID NO: 5886606 - DNA, 15 bp, Homo sapiens
ctcttctgagctatt

SEQ ID NO: 5886607 - DNA, 18 bp, Homo sapiens
ctcttctgcacagctcct

SEQ ID NO: 5886608 - DNA, 16 bp, Homo sapiens
ctcttctgcatcttgg

SEQ ID NO: 5886609 - DNA, 14 bp, Homo sapiens
ctcttctgctccac

SEQ ID NO: 5886610 - DNA, 15 bp, Homo sapiens
ctcttctgctccacc

SEQ ID NO: 5886611 - DNA, 15 bp, Homo sapiens
ctcttctgctcctta

SEQ ID NO: 5886612 - DNA, 12 bp, Homo sapiens
ctcttctgctct

SEQ ID NO: 5886613 - DNA, 14 bp, Homo sapiens
ctcttctggaatgg

SEQ ID NO: 5886614 - DNA, 20 bp, Homo sapiens
ctcttctggagtttctctaa

SEQ ID NO: 5886615 - DNA, 12 bp, Homo sapiens
ctcttctggcct

SEQ ID NO: 5886616 - DNA, 10 bp, Homo sapiens
ctcttctggg

SEQ ID NO: 5886617 - DNA, 22 bp, Homo sapiens
ctcttctgggagggcagcaggg

SEQ ID NO: 5886618 - DNA, 14 bp, Homo sapiens
ctcttctgggcaga

SEQ ID NO: 5886619 - DNA, 19 bp, Homo sapiens
ctcttctgggcagagcctg

SEQ ID NO: 5886620 - DNA, 21 bp, Homo sapiens
ctcttctgggcagagcctgtc

SEQ ID NO: 5886621 - DNA, 21 bp, Homo sapiens
ctcttctggggcaggctgggc

SEQ ID NO: 5886622 - DNA, 18 bp, Homo sapiens
ctcttctgggttccttcc

SEQ ID NO: 5886623 - DNA, 16 bp, Homo sapiens
ctcttctgtccatcag

SEQ ID NO: 5886624 - DNA, 19 bp, Homo sapiens
ctcttctgtccatcagtgc

SEQ ID NO: 5886625 - DNA, 18 bp, Homo sapiens
ctcttcttaatgtacata

SEQ ID NO: 5886626 - DNA, 23 bp, Homo sapiens
ctcttcttaatgtacatagtgct

SEQ ID NO: 5886627 - DNA, 15 bp, Homo sapiens
ctcttcttactcatt

SEQ ID NO: 5886628 - DNA, 21 bp, Homo sapiens
ctcttcttactgtatttggga

SEQ ID NO: 5886629 - DNA, 13 bp, Homo sapiens
ctcttcttagcct

SEQ ID NO: 5886630 - DNA, 16 bp, Homo sapiens
ctcttcttatcacact

SEQ ID NO: 5886631 - DNA, 16 bp, Homo sapiens
ctcttcttcccagcac

SEQ ID NO: 5886632 - DNA, 15 bp, Homo sapiens
ctcttcttccccttt

SEQ ID NO: 5886633 - DNA, 14 bp, Homo sapiens
ctcttcttctcaag

SEQ ID NO: 5886634 - DNA, 15 bp, Homo sapiens
ctcttcttctgaaga

SEQ ID NO: 5886635 - DNA, 15 bp, Homo sapiens
ctcttcttcttcaga

SEQ ID NO: 5886636 - DNA, 17 bp, Homo sapiens
ctcttcttcttttctat

SEQ ID NO: 5886637 - DNA, 13 bp, Homo sapiens
ctcttcttgaaaa

SEQ ID NO: 5886638 - DNA, 17 bp, Homo sapiens
ctcttcttgagcagacc

SEQ ID NO: 5886639 - DNA, 16 bp, Homo sapiens
ctcttcttggggccca

SEQ ID NO: 5886640 - DNA, 21 bp, Homo sapiens
ctcttcttggggcccagtgca

SEQ ID NO: 5886641 - DNA, 22 bp, Homo sapiens
ctcttcttggggcccagtgcat

SEQ ID NO: 5886642 - DNA, 21 bp, Homo sapiens
ctcttggttcgatacctggag

SEQ ID NO: 5886643 - DNA, 22 bp, Homo sapiens
ctcttggttcgatacctggagc

SEQ ID NO: 5886644 - DNA, 20 bp, Homo sapiens
ctcttggtttccttccttgg

SEQ ID NO: 5886645 - DNA, 15 bp, Homo sapiens
ctcttgtaaagactg

SEQ ID NO: 5886646 - DNA, 16 bp, Homo sapiens
ctcttgtaaagactgg

SEQ ID NO: 5886647 - DNA, 18 bp, Homo sapiens
ctcttgtaaataaagccc

SEQ ID NO: 5886648 - DNA, 20 bp, Homo sapiens
ctcttgtaaataaagccctg

SEQ ID NO: 5886649 - DNA, 23 bp, Homo sapiens
ctcttgtaaataaagccctggga

SEQ ID NO: 5886650 - DNA, 14 bp, Homo sapiens
ctcttgtaagattt

SEQ ID NO: 5886651 - DNA, 18 bp, Homo sapiens
ctcttgtaagattttgaa

SEQ ID NO: 5886652 - DNA, 19 bp, Homo sapiens
ctcttgtaagattttgaaa

SEQ ID NO: 5886653 - DNA, 14 bp, Homo sapiens
ctcttgtacagtta

SEQ ID NO: 5886654 - DNA, 14 bp, Homo sapiens
ctcttgtaccagcc

SEQ ID NO: 5886655 - DNA, 15 bp, Homo sapiens
ctcttgtaccagccc

SEQ ID NO: 5886656 - DNA, 20 bp, Homo sapiens
ctcttgtagcccaggctgga

SEQ ID NO: 5886657 - DNA, 21 bp, Homo sapiens
ctcttgtagtcttggctaagg

SEQ ID NO: 5886658 - DNA, 15 bp, Homo sapiens
ctcttgtattaaact

SEQ ID NO: 5886659 - DNA, 13 bp, Homo sapiens
ctcttgtcacatg

SEQ ID NO: 5886660 - DNA, 15 bp, Homo sapiens
ctcttgtcacccagg

SEQ ID NO: 5886661 - DNA, 20 bp, Homo sapiens
ctcttgtcacccaggctgga

SEQ ID NO: 5886662 - DNA, 14 bp, Homo sapiens
ctcttgtcagtgta

SEQ ID NO: 5886663 - DNA, 19 bp, Homo sapiens
ctcttgtcattctcatcca

SEQ ID NO: 5886664 - DNA, 13 bp, Homo sapiens
ctcttgtcatttt

SEQ ID NO: 5886665 - DNA, 14 bp, Homo sapiens
ctcttgtcccacgt

SEQ ID NO: 5886666 - DNA, 21 bp, Homo sapiens
ctcttgtcccacgtgtcttcc

SEQ ID NO: 5886667 - DNA, 20 bp, Homo sapiens
ctcttgtcctcttctgctct

SEQ ID NO: 5886668 - DNA, 24 bp, Homo sapiens
ctcttgtcctcttctgctcttttc

SEQ ID NO: 5886669 - DNA, 14 bp, Homo sapiens
ctcttgtcctggcc

SEQ ID NO: 5886670 - DNA, 15 bp, Homo sapiens
ctcttgtcctggccc

SEQ ID NO: 5886671 - DNA, 18 bp, Homo sapiens
ctcttgtcctggcccttc

SEQ ID NO: 5886672 - DNA, 14 bp, Homo sapiens
ctcttgtctgaggg

SEQ ID NO: 5886673 - DNA, 20 bp, Homo sapiens
ctcttgtgactcagcagagg

SEQ ID NO: 5886674 - DNA, 20 bp, Homo sapiens
ctcttgtgaggaaagtcatt

SEQ ID NO: 5886675 - DNA, 20 bp, Homo sapiens
ctcttgtgcaaggtggcctt

SEQ ID NO: 5886676 - DNA, 19 bp, Homo sapiens
ctcttgtgctcacgctccc

SEQ ID NO: 5886677 - DNA, 23 bp, Homo sapiens
ctcttgtgctcagtcgccctgtt

SEQ ID NO: 5886678 - DNA, 23 bp, Homo sapiens
ctcttgtgctggatggagcccag

SEQ ID NO: 5886679 - DNA, 16 bp, Homo sapiens
ctcttgtgttcagaag

SEQ ID NO: 5886680 - DNA, 17 bp, Homo sapiens
ctcttgttccgtgccag

SEQ ID NO: 5886681 - DNA, 19 bp, Homo sapiens
ctcttgttccgtgccaggc

SEQ ID NO: 5886682 - DNA, 17 bp, Homo sapiens
ctcttgttcctgaaatg

SEQ ID NO: 5886683 - DNA, 16 bp, Homo sapiens
ctcttgttcttacttt

SEQ ID NO: 5886684 - DNA, 21 bp, Homo sapiens
ctcttgttcttagggcttgga

SEQ ID NO: 5886685 - DNA, 17 bp, Homo sapiens
ctcttgttgagttctgt

SEQ ID NO: 5886686 - DNA, 17 bp, Homo sapiens
ctcttgttgtccaggct

SEQ ID NO: 5886687 - DNA, 18 bp, Homo sapiens
ctcttgtttaaaaaaaga

SEQ ID NO: 5886688 - DNA, 19 bp, Homo sapiens
ctcttgtttaaaaaaagaa

SEQ ID NO: 5886689 - DNA, 18 bp, Homo sapiens
ctcttgtttcactccacc

SEQ ID NO: 5886690 - DNA, 13 bp, Homo sapiens
ctcttgtttctcc

SEQ ID NO: 5886691 - DNA, 17 bp, Homo sapiens
ctcttgtttctgggtcc

SEQ ID NO: 5886692 - DNA, 22 bp, Homo sapiens
ctcttgtttctgggtccctgct

SEQ ID NO: 5886693 - DNA, 15 bp, Homo sapiens
ctcttgtttctgtgc

SEQ ID NO: 5886694 - DNA, 22 bp, Homo sapiens
ctcttgtttggagggatcattt

SEQ ID NO: 5886695 - DNA, 13 bp, Homo sapiens
ctcttgtttgtct

SEQ ID NO: 5886696 - DNA, 15 bp, Homo sapiens
ctcttgttttgtttg

SEQ ID NO: 5886697 - DNA, 17 bp, Homo sapiens
ctcttgttttgtttgtc

SEQ ID NO: 5886698 - DNA, 18 bp, Homo sapiens
ctcttgttttgtttgtct

SEQ ID NO: 5886699 - DNA, 21 bp, Homo sapiens
ctcttgtttttattaatttat

SEQ ID NO: 5886700 - DNA, 13 bp, Homo sapiens
ctctttaaaaaca

SEQ ID NO: 5886701 - DNA, 17 bp, Homo sapiens
ctctttaaaaacatttt

SEQ ID NO: 5886702 - DNA, 12 bp, Homo sapiens
ctctttaaaaca

SEQ ID NO: 5886703 - DNA, 15 bp, Homo sapiens
ctctttaaaacaaaa

SEQ ID NO: 5886704 - DNA, 13 bp, Homo sapiens
ctctttaaaatat

SEQ ID NO: 5886705 - DNA, 17 bp, Homo sapiens
ctctttaaatcaagtcc

SEQ ID NO: 5886706 - DNA, 13 bp, Homo sapiens
ctctttaaattat

SEQ ID NO: 5886707 - DNA, 14 bp, Homo sapiens
ctctttaaattatg

SEQ ID NO: 5886708 - DNA, 21 bp, Homo sapiens
ctctttaacacattctttata

SEQ ID NO: 5886709 - DNA, 17 bp, Homo sapiens
ctctttaacatacaaga

SEQ ID NO: 5886710 - DNA, 21 bp, Homo sapiens
ctctttaactcaggactccag

SEQ ID NO: 5886711 - DNA, 13 bp, Homo sapiens
ctctttaactgtg

SEQ ID NO: 5886712 - DNA, 15 bp, Homo sapiens
ctctttaactgtgtg

SEQ ID NO: 5886713 - DNA, 15 bp, Homo sapiens
ctctttaacttctcg

SEQ ID NO: 5886714 - DNA, 19 bp, Homo sapiens
ctctttaacttgtaataaa

SEQ ID NO: 5886715 - DNA, 21 bp, Homo sapiens
ctctttaagagttagtttctt

SEQ ID NO: 5886716 - DNA, 16 bp, Homo sapiens
ctctttaatcttcagt

SEQ ID NO: 5886717 - DNA, 17 bp, Homo sapiens
ctctttaatgctgtctt

SEQ ID NO: 5886718 - DNA, 19 bp, Homo sapiens
ctctttaatgctgtctttg

SEQ ID NO: 5886719 - DNA, 20 bp, Homo sapiens
ctctttaatgctgtctttgt

SEQ ID NO: 5886720 - DNA, 21 bp, Homo sapiens
ctctttaatgtcacaggcagg

SEQ ID NO: 5886721 - DNA, 16 bp, Homo sapiens
ctctttaatttgttgt

SEQ ID NO: 5886722 - DNA, 15 bp, Homo sapiens
ctctttaattttaac

SEQ ID NO: 5886723 - DNA, 15 bp, Homo sapiens
ctctttacatttctt

SEQ ID NO: 5886724 - DNA, 23 bp, Homo sapiens
ctctttactcccttcctggcctc

SEQ ID NO: 5886725 - DNA, 14 bp, Homo sapiens
ctctttactctggg

SEQ ID NO: 5886726 - DNA, 20 bp, Homo sapiens
ctctttagagcagctttggg

SEQ ID NO: 5886727 - DNA, 18 bp, Homo sapiens
ctctttagagttagactg

SEQ ID NO: 5886728 - DNA, 13 bp, Homo sapiens
ctctttagatatt

SEQ ID NO: 5886729 - DNA, 17 bp, Homo sapiens
ctctttagatgcaagtg

SEQ ID NO: 5886730 - DNA, 18 bp, Homo sapiens
ctctttagccagaatctc

SEQ ID NO: 5886731 - DNA, 13 bp, Homo sapiens
ctctttaggagaa

SEQ ID NO: 5886732 - DNA, 22 bp, Homo sapiens
ctctttaggagaaattatagtt

SEQ ID NO: 5886733 - DNA, 15 bp, Homo sapiens
ctctttagtataatt

SEQ ID NO: 5886734 - DNA, 14 bp, Homo sapiens
ctctttatacagct

SEQ ID NO: 5886735 - DNA, 13 bp, Homo sapiens
ctctttatatatg

SEQ ID NO: 5886736 - DNA, 22 bp, Homo sapiens
ctctttatatggcctcaagatc

SEQ ID NO: 5886737 - DNA, 18 bp, Homo sapiens
ctctttatcaagcaacat

SEQ ID NO: 5886738 - DNA, 22 bp, Homo sapiens
ctctttatcaagcaacattctt

SEQ ID NO: 5886739 - DNA, 17 bp, Homo sapiens
ctctttatgactgtttt

SEQ ID NO: 5886740 - DNA, 17 bp, Homo sapiens
ctctttatgatctggcc

SEQ ID NO: 5886741 - DNA, 21 bp, Homo sapiens
ctctttatgcttgcaaaaact

SEQ ID NO: 5886742 - DNA, 21 bp, Homo sapiens
ctctttattcctagttggtga

SEQ ID NO: 5886743 - DNA, 17 bp, Homo sapiens
ctctttatttttctctt

SEQ ID NO: 5886744 - DNA, 20 bp, Homo sapiens
ctctttatttttctctttct

SEQ ID NO: 5886745 - DNA, 21 bp, Homo sapiens
ctctttatttttctctttctc

SEQ ID NO: 5886746 - DNA, 11 bp, Homo sapiens
ctctttcaaag

SEQ ID NO: 5886747 - DNA, 22 bp, Homo sapiens
ctctttcaaagaaatccaaatt

SEQ ID NO: 5886748 - DNA, 18 bp, Homo sapiens
ctctttcaataaatgtat

SEQ ID NO: 5886749 - DNA, 14 bp, Homo sapiens
ctctttcaatgcag

SEQ ID NO: 5886750 - DNA, 15 bp, Homo sapiens
ctctttcacattgtt

SEQ ID NO: 5886751 - DNA, 16 bp, Homo sapiens
ctctttcaccctgcca

SEQ ID NO: 5886752 - DNA, 12 bp, Homo sapiens
ctctttcagaga

SEQ ID NO: 5886753 - DNA, 15 bp, Homo sapiens
ctctttcagctcctg

SEQ ID NO: 5886754 - DNA, 11 bp, Homo sapiens
ctctttcagtg

SEQ ID NO: 5886755 - DNA, 12 bp, Homo sapiens
ctctttcatcca

SEQ ID NO: 5886756 - DNA, 16 bp, Homo sapiens
ctctttcatgccattt

SEQ ID NO: 5886757 - DNA, 22 bp, Homo sapiens
ctctttccaccataccttagag

SEQ ID NO: 5886758 - DNA, 15 bp, Homo sapiens
ctctttccacttgcc

SEQ ID NO: 5886759 - DNA, 15 bp, Homo sapiens
ctctttcccacccag

SEQ ID NO: 5886760 - DNA, 17 bp, Homo sapiens
ctctttcccacccagcc

SEQ ID NO: 5886761 - DNA, 20 bp, Homo sapiens
ctctttcccacccagcctgg

SEQ ID NO: 5886762 - DNA, 20 bp, Homo sapiens
ctctttcccaccctccacct

SEQ ID NO: 5886763 - DNA, 20 bp, Homo sapiens
ctctttccccacctcttcct

SEQ ID NO: 5886764 - DNA, 15 bp, Homo sapiens
ctctttccccactga

SEQ ID NO: 5886765 - DNA, 12 bp, Homo sapiens
ctctttccccag

SEQ ID NO: 5886766 - DNA, 10 bp, Homo sapiens
ctctttccct

SEQ ID NO: 5886767 - DNA, 16 bp, Homo sapiens
ctctttccctaggaaa

SEQ ID NO: 5886768 - DNA, 13 bp, Homo sapiens
ctctttccctgcg

SEQ ID NO: 5886769 - DNA, 15 bp, Homo sapiens
ctctttccctgcgag

SEQ ID NO: 5886770 - DNA, 13 bp, Homo sapiens
ctctttccctggt

SEQ ID NO: 5886771 - DNA, 14 bp, Homo sapiens
ctctttccctggtc

SEQ ID NO: 5886772 - DNA, 23 bp, Homo sapiens
ctctttcccttccagtttattcc

SEQ ID NO: 5886773 - DNA, 13 bp, Homo sapiens
ctctttcctccac

SEQ ID NO: 5886774 - DNA, 16 bp, Homo sapiens
ctctttcctccttcca

SEQ ID NO: 5886775 - DNA, 19 bp, Homo sapiens
ctctttccttgaaaataaa

SEQ ID NO: 5886776 - DNA, 13 bp, Homo sapiens
ctctttccttgct

SEQ ID NO: 5886777 - DNA, 15 bp, Homo sapiens
ctctttcggaaatga

SEQ ID NO: 5886778 - DNA, 18 bp, Homo sapiens
ctctttcgtcacccttgg

SEQ ID NO: 5886779 - DNA, 21 bp, Homo sapiens
ctctttctacatgactgggcc

SEQ ID NO: 5886780 - DNA, 17 bp, Homo sapiens
ctctttctattgtttct

SEQ ID NO: 5886781 - DNA, 20 bp, Homo sapiens
ctctttctcaaagagggggc

SEQ ID NO: 5886782 - DNA, 17 bp, Homo sapiens
ctctttctcacctttcc

SEQ ID NO: 5886783 - DNA, 11 bp, Homo sapiens
ctctttctccc

SEQ ID NO: 5886784 - DNA, 19 bp, Homo sapiens
ctctttctctattatgtta

SEQ ID NO: 5886785 - DNA, 13 bp, Homo sapiens
ctctttctctccc

SEQ ID NO: 5886786 - DNA, 14 bp, Homo sapiens
ctctttctctcccc

SEQ ID NO: 5886787 - DNA, 12 bp, Homo sapiens
ctctttctctct

SEQ ID NO: 5886788 - DNA, 13 bp, Homo sapiens
ctctttctctctc

SEQ ID NO: 5886789 - DNA, 18 bp, Homo sapiens
ctctttctctctgtgtgg

SEQ ID NO: 5886790 - DNA, 14 bp, Homo sapiens
ctctttctctcttc

SEQ ID NO: 5886791 - DNA, 12 bp, Homo sapiens
ctctttctctga

SEQ ID NO: 5886792 - DNA, 14 bp, Homo sapiens
ctctttctctgaga

SEQ ID NO: 5886793 - DNA, 16 bp, Homo sapiens
ctctttctctgccagt

SEQ ID NO: 5886794 - DNA, 22 bp, Homo sapiens
ctctttctctggtggtcttcct

SEQ ID NO: 5886795 - DNA, 23 bp, Homo sapiens
ctctttctctggtggtcttcctt

SEQ ID NO: 5886796 - DNA, 13 bp, Homo sapiens
ctctttctgctct

SEQ ID NO: 5886797 - DNA, 17 bp, Homo sapiens
ctctttctgctctgcca

SEQ ID NO: 5886798 - DNA, 11 bp, Homo sapiens
ctctttctgta

SEQ ID NO: 5886799 - DNA, 15 bp, Homo sapiens
ctctttctgtatata

SEQ ID NO: 5886800 - DNA, 21 bp, Homo sapiens
ctctttcttattttgtaataa

SEQ ID NO: 5886801 - DNA, 12 bp, Homo sapiens
ctctttcttcat

SEQ ID NO: 5886802 - DNA, 16 bp, Homo sapiens
ctctttcttcctttct

SEQ ID NO: 5886803 - DNA, 13 bp, Homo sapiens
ctctttcttcttt

SEQ ID NO: 5886804 - DNA, 17 bp, Homo sapiens
ctctttcttgtttgtca

SEQ ID NO: 5886805 - DNA, 23 bp, Homo sapiens
ctctttcttgtttgtcagcatct

SEQ ID NO: 5886806 - DNA, 14 bp, Homo sapiens
ctctttctttccaa

SEQ ID NO: 5886807 - DNA, 14 bp, Homo sapiens
ctctttctttctct

SEQ ID NO: 5886808 - DNA, 17 bp, Homo sapiens
ctctttctttctctttc

SEQ ID NO: 5886809 - DNA, 22 bp, Homo sapiens
ctctttctttcttttgtgttgg

SEQ ID NO: 5886810 - DNA, 22 bp, Homo sapiens
ctctttctttttctgtctctct

SEQ ID NO: 5886811 - DNA, 22 bp, Homo sapiens
ctctttgaaatagtctgtgtga

SEQ ID NO: 5886812 - DNA, 23 bp, Homo sapiens
ctctttgaaatgacatgttcctt

SEQ ID NO: 5886813 - DNA, 16 bp, Homo sapiens
ctctttgaagaaaaga

SEQ ID NO: 5886814 - DNA, 14 bp, Homo sapiens
ctctttgaatgaca

SEQ ID NO: 5886815 - DNA, 20 bp, Homo sapiens
ctctttgaattttctgtgtt

SEQ ID NO: 5886816 - DNA, 22 bp, Homo sapiens
ctctttgacgggaggcctcagt

SEQ ID NO: 5886817 - DNA, 10 bp, Homo sapiens
ctctttgaga

SEQ ID NO: 5886818 - DNA, 12 bp, Homo sapiens
ctctttgagaaa

SEQ ID NO: 5886819 - DNA, 20 bp, Homo sapiens
ctctttgagaaaatgtaaaa

SEQ ID NO: 5886820 - DNA, 20 bp, Homo sapiens
ctctttgagaccccagtgcc

SEQ ID NO: 5886821 - DNA, 14 bp, Homo sapiens
ctgaaaatgtcctt

SEQ ID NO: 5886822 - DNA, 16 bp, Homo sapiens
ctgaaaatgtccttgt

SEQ ID NO: 5886823 - DNA, 19 bp, Homo sapiens
ctgaaaatgtccttgtgat

SEQ ID NO: 5886824 - DNA, 21 bp, Homo sapiens
ctgaaaatgtgaataaaatta

SEQ ID NO: 5886825 - DNA, 15 bp, Homo sapiens
ctgaaaatgtgtata

SEQ ID NO: 5886826 - DNA, 13 bp, Homo sapiens
ctgaaaatgttag

SEQ ID NO: 5886827 - DNA, 17 bp, Homo sapiens
ctgaaaattaacactgc

SEQ ID NO: 5886828 - DNA, 14 bp, Homo sapiens
ctgaaaattccaat

SEQ ID NO: 5886829 - DNA, 17 bp, Homo sapiens
ctgaaaattccaatttg

SEQ ID NO: 5886830 - DNA, 22 bp, Homo sapiens
ctgaaaattccagaaaggatat

SEQ ID NO: 5886831 - DNA, 18 bp, Homo sapiens
ctgaaaattcgaaccagg

SEQ ID NO: 5886832 - DNA, 22 bp, Homo sapiens
ctgaaaattgatgggatttggt

SEQ ID NO: 5886833 - DNA, 19 bp, Homo sapiens
ctgaaaattgcctttctgt

SEQ ID NO: 5886834 - DNA, 23 bp, Homo sapiens
ctgaaaattggacagattgcctg

SEQ ID NO: 5886835 - DNA, 16 bp, Homo sapiens
ctgaaaatttaacagt

SEQ ID NO: 5886836 - DNA, 19 bp, Homo sapiens
ctgaaaatttatataactg

SEQ ID NO: 5886837 - DNA, 16 bp, Homo sapiens
ctgaaacaaaatgttt

SEQ ID NO: 5886838 - DNA, 13 bp, Homo sapiens
ctgaaacacacga

SEQ ID NO: 5886839 - DNA, 17 bp, Homo sapiens
ctgaaacacctcccagg

SEQ ID NO: 5886840 - DNA, 18 bp, Homo sapiens
ctgaaacacctcccaggg

SEQ ID NO: 5886841 - DNA, 18 bp, Homo sapiens
ctgaaacacgaaacttgt

SEQ ID NO: 5886842 - DNA, 15 bp, Homo sapiens
ctgaaacactgcttc

SEQ ID NO: 5886843 - DNA, 17 bp, Homo sapiens
ctgaaacactgcttctc

SEQ ID NO: 5886844 - DNA, 14 bp, Homo sapiens
ctgaaacactggac

SEQ ID NO: 5886845 - DNA, 15 bp, Homo sapiens
ctgaaacactggacc

SEQ ID NO: 5886846 - DNA, 22 bp, Homo sapiens
ctgaaacagaaagttggaaagg

SEQ ID NO: 5886847 - DNA, 12 bp, Homo sapiens
ctgaaacagctg

SEQ ID NO: 5886848 - DNA, 16 bp, Homo sapiens
ctgaaacagctgcctt

SEQ ID NO: 5886849 - DNA, 20 bp, Homo sapiens
ctgaaacagctgccttagct

SEQ ID NO: 5886850 - DNA, 13 bp, Homo sapiens
ctgaaacaggaga

SEQ ID NO: 5886851 - DNA, 13 bp, Homo sapiens
ctgaaacatattt

SEQ ID NO: 5886852 - DNA, 12 bp, Homo sapiens
ctgaaacatgaa

SEQ ID NO: 5886853 - DNA, 21 bp, Homo sapiens
ctgaaacatgcacattttgta

SEQ ID NO: 5886854 - DNA, 23 bp, Homo sapiens
ctgaaacatgcacattttgtaca

SEQ ID NO: 5886855 - DNA, 22 bp, Homo sapiens
ctgaaacattccgaagagggaa

SEQ ID NO: 5886856 - DNA, 13 bp, Homo sapiens
ctgaaacatttca

SEQ ID NO: 5886857 - DNA, 13 bp, Homo sapiens
ctgaaaccatttt

SEQ ID NO: 5886858 - DNA, 22 bp, Homo sapiens
ctgaaacccacagatgtctctg

SEQ ID NO: 5886859 - DNA, 19 bp, Homo sapiens
ctgaaacccatttacttag

SEQ ID NO: 5886860 - DNA, 21 bp, Homo sapiens
ctgaaacccgccctcaggggc

SEQ ID NO: 5886861 - DNA, 16 bp, Homo sapiens
ctgaaaccctccttct

SEQ ID NO: 5886862 - DNA, 16 bp, Homo sapiens
ctgaaacctctgttct

SEQ ID NO: 5886863 - DNA, 15 bp, Homo sapiens
ctgaaacgagaagtg

SEQ ID NO: 5886864 - DNA, 19 bp, Homo sapiens
ctgaaacgctcctttgtgt

SEQ ID NO: 5886865 - DNA, 20 bp, Homo sapiens
ctgaaacgtattcagagtta

SEQ ID NO: 5886866 - DNA, 22 bp, Homo sapiens
ctgaaacgtggatacagagcca

SEQ ID NO: 5886867 - DNA, 16 bp, Homo sapiens
ctgaaactaatgaaag

SEQ ID NO: 5886868 - DNA, 17 bp, Homo sapiens
ctgaaactcccttgtgt

SEQ ID NO: 5886869 - DNA, 21 bp, Homo sapiens
ctgaaactcccttgtgttcct

SEQ ID NO: 5886870 - DNA, 23 bp, Homo sapiens
ctgaaacttatttttttctgatt

SEQ ID NO: 5886871 - DNA, 13 bp, Homo sapiens
ctgaaacttccct

SEQ ID NO: 5886872 - DNA, 16 bp, Homo sapiens
ctgaaacttttctaaa

SEQ ID NO: 5886873 - DNA, 17 bp, Homo sapiens
ctgaaacttttctaaag

SEQ ID NO: 5886874 - DNA, 15 bp, Homo sapiens
ctgaaagaaacagtt

SEQ ID NO: 5886875 - DNA, 19 bp, Homo sapiens
ctgaaagaaacagttaact

SEQ ID NO: 5886876 - DNA, 11 bp, Homo sapiens
ctgaaagacaa

SEQ ID NO: 5886877 - DNA, 13 bp, Homo sapiens
ctgaaagacagaa

SEQ ID NO: 5886878 - DNA, 17 bp, Homo sapiens
ctgaaagacagaatgtc

SEQ ID NO: 5886879 - DNA, 14 bp, Homo sapiens
ctgaaagagaaaca

SEQ ID NO: 5886880 - DNA, 14 bp, Homo sapiens
ctgaaagagaggac

SEQ ID NO: 5886881 - DNA, 22 bp, Homo sapiens
ctgaaagaggaggacccctgcc

SEQ ID NO: 5886882 - DNA, 14 bp, Homo sapiens
ctgaaagaggccaa

SEQ ID NO: 5886883 - DNA, 16 bp, Homo sapiens
ctgaaagatctctgtc

SEQ ID NO: 5886884 - DNA, 16 bp, Homo sapiens
ctgaaagcaacagctg

SEQ ID NO: 5886885 - DNA, 16 bp, Homo sapiens
ctgaaagcacatgaat

SEQ ID NO: 5886886 - DNA, 14 bp, Homo sapiens
ctgaaagcagcagc

SEQ ID NO: 5886887 - DNA, 15 bp, Homo sapiens
ctgaaagcagcagct

SEQ ID NO: 5886888 - DNA, 17 bp, Homo sapiens
ctgaaagcagcagctag

SEQ ID NO: 5886889 - DNA, 13 bp, Homo sapiens
ctgaaagccaagg

SEQ ID NO: 5886890 - DNA, 22 bp, Homo sapiens
ctgaaagccaaggcagctcttc

SEQ ID NO: 5886891 - DNA, 12 bp, Homo sapiens
ctgaaagccacg

SEQ ID NO: 5886892 - DNA, 13 bp, Homo sapiens
ctgaaagccagca

SEQ ID NO: 5886893 - DNA, 16 bp, Homo sapiens
ctgaaagccagcaaag

SEQ ID NO: 5886894 - DNA, 20 bp, Homo sapiens
ctgaaagccagcaaagcctc

SEQ ID NO: 5886895 - DNA, 23 bp, Homo sapiens
ctgaaagccagcaaagcctccag

SEQ ID NO: 5886896 - DNA, 16 bp, Homo sapiens
ctgaaagccatggaga

SEQ ID NO: 5886897 - DNA, 18 bp, Homo sapiens
ctgaaagccctgagcttt

SEQ ID NO: 5886898 - DNA, 19 bp, Homo sapiens
ctgaaagccctgagctttc

SEQ ID NO: 5886899 - DNA, 12 bp, Homo sapiens
ctgaaagcctgt

SEQ ID NO: 5886900 - DNA, 16 bp, Homo sapiens
ctgaaagcctgtctct

SEQ ID NO: 5886901 - DNA, 23 bp, Homo sapiens
ctgaaagcctgtctctttccact

SEQ ID NO: 5886902 - DNA, 20 bp, Homo sapiens
ctgaaagccttagggaagct

SEQ ID NO: 5886903 - DNA, 14 bp, Homo sapiens
ctgaaagcggctgc

SEQ ID NO: 5886904 - DNA, 15 bp, Homo sapiens
ctgaaagcggctgcc

SEQ ID NO: 5886905 - DNA, 22 bp, Homo sapiens
ctgaaagcggctgcctccatta

SEQ ID NO: 5886906 - DNA, 17 bp, Homo sapiens
ctgaaagctgcttctgg

SEQ ID NO: 5886907 - DNA, 17 bp, Homo sapiens
ctgaaaggaaaagtctt

SEQ ID NO: 5886908 - DNA, 22 bp, Homo sapiens
ctgaaaggaaaagtctttgcta

SEQ ID NO: 5886909 - DNA, 12 bp, Homo sapiens
ctgaaaggaaat

SEQ ID NO: 5886910 - DNA, 17 bp, Homo sapiens
ctgaaaggaacactggc

SEQ ID NO: 5886911 - DNA, 20 bp, Homo sapiens
ctgaaaggatgtagaaacaa

SEQ ID NO: 5886912 - DNA, 21 bp, Homo sapiens
ctgaaaggccagcagctgatg

SEQ ID NO: 5886913 - DNA, 15 bp, Homo sapiens
ctgaaagggaaggac

SEQ ID NO: 5886914 - DNA, 14 bp, Homo sapiens
ctgaaagtaaagtt

SEQ ID NO: 5886915 - DNA, 16 bp, Homo sapiens
ctgaaagtagggggct

SEQ ID NO: 5886916 - DNA, 12 bp, Homo sapiens
ctgaaagtgatg

SEQ ID NO: 5886917 - DNA, 13 bp, Homo sapiens
ctgaaagtggctc

SEQ ID NO: 5886918 - DNA, 21 bp, Homo sapiens
ctgaaagtgtgtgtagtttta

SEQ ID NO: 5886919 - DNA, 22 bp, Homo sapiens
ctgaaagtgtttccttcatttc

SEQ ID NO: 5886920 - DNA, 17 bp, Homo sapiens
ctgaaagttacccactg

SEQ ID NO: 5886921 - DNA, 12 bp, Homo sapiens
ctgaaagttggc

SEQ ID NO: 5886922 - DNA, 19 bp, Homo sapiens
ctgaaagttggggcccagt

SEQ ID NO: 5886923 - DNA, 14 bp, Homo sapiens
ctgaaagttgtaca

SEQ ID NO: 5886924 - DNA, 20 bp, Homo sapiens
ctgaaagttgtacatgaaat

SEQ ID NO: 5886925 - DNA, 13 bp, Homo sapiens
ctgaaagttttgt

SEQ ID NO: 5886926 - DNA, 20 bp, Homo sapiens
ctgaaagttttgtaaaagaa

SEQ ID NO: 5886927 - DNA, 23 bp, Homo sapiens
ctgaaagttttgtaaaagaaatc

SEQ ID NO: 5886928 - DNA, 16 bp, Homo sapiens
ctgaaataaaagcctc

SEQ ID NO: 5886929 - DNA, 18 bp, Homo sapiens
ctgaaataaaagcctctg

SEQ ID NO: 5886930 - DNA, 19 bp, Homo sapiens
ctgaaataaaagcctctgg

SEQ ID NO: 5886931 - DNA, 23 bp, Homo sapiens
ctgaaataaaagcctctggtgga

SEQ ID NO: 5886932 - DNA, 13 bp, Homo sapiens
ctgaaataaacac

SEQ ID NO: 5886933 - DNA, 22 bp, Homo sapiens
ctgaaataaacactggtgccaa

SEQ ID NO: 5886934 - DNA, 20 bp, Homo sapiens
ctgaaataaacctgcactga

SEQ ID NO: 5886935 - DNA, 20 bp, Homo sapiens
ctgaaataaacgtcttaaat

SEQ ID NO: 5886936 - DNA, 21 bp, Homo sapiens
ctgaaataaacgtcttaaata

SEQ ID NO: 5886937 - DNA, 12 bp, Homo sapiens
ctgaaataaact

SEQ ID NO: 5886938 - DNA, 15 bp, Homo sapiens
ctgaaataaactagg

SEQ ID NO: 5886939 - DNA, 22 bp, Homo sapiens
ctgaaataaatgtttcaaatgc

SEQ ID NO: 5886940 - DNA, 17 bp, Homo sapiens
ctgaaatacctttgcct

SEQ ID NO: 5886941 - DNA, 19 bp, Homo sapiens
ctgaaatacctttgcctgg

SEQ ID NO: 5886942 - DNA, 21 bp, Homo sapiens
ctgaaatataaactgtagcga

SEQ ID NO: 5886943 - DNA, 14 bp, Homo sapiens
ctgaaatataaagt

SEQ ID NO: 5886944 - DNA, 18 bp, Homo sapiens
ctgaaatatacacacagc

SEQ ID NO: 5886945 - DNA, 19 bp, Homo sapiens
ctgaaatatattttaaatg

SEQ ID NO: 5886946 - DNA, 22 bp, Homo sapiens
ctgaaatatccacccagcaggc

SEQ ID NO: 5886947 - DNA, 21 bp, Homo sapiens
ctgaaatatcccgggggtggg

SEQ ID NO: 5886948 - DNA, 22 bp, Homo sapiens
ctgaaatatcccgggggtgggg

SEQ ID NO: 5886949 - DNA, 22 bp, Homo sapiens
ctgaaatcatatagaaaggctg

SEQ ID NO: 5886950 - DNA, 17 bp, Homo sapiens
ctgaaatcatctttgtt

SEQ ID NO: 5886951 - DNA, 15 bp, Homo sapiens
ctgaaatccataaac

SEQ ID NO: 5886952 - DNA, 19 bp, Homo sapiens
ctgaaatctcagaattcct

SEQ ID NO: 5886953 - DNA, 23 bp, Homo sapiens
ctgaaatcttcccatgcattctg

SEQ ID NO: 5886954 - DNA, 17 bp, Homo sapiens
ctgaaatgaaatcttcc

SEQ ID NO: 5886955 - DNA, 16 bp, Homo sapiens
ctgaaatgacatttca

SEQ ID NO: 5886956 - DNA, 18 bp, Homo sapiens
ctgaaatgacatttcact

SEQ ID NO: 5886957 - DNA, 20 bp, Homo sapiens
ctgaaatgagagattttcct

SEQ ID NO: 5886958 - DNA, 21 bp, Homo sapiens
ctgaaatgaggagagaaggac

SEQ ID NO: 5886959 - DNA, 22 bp, Homo sapiens
ctgaaatgaggagagaaggaca

SEQ ID NO: 5886960 - DNA, 16 bp, Homo sapiens
ctgaaatgccaagtgc

SEQ ID NO: 5886961 - DNA, 18 bp, Homo sapiens
ctgaaatgccttactttg

SEQ ID NO: 5886962 - DNA, 19 bp, Homo sapiens
ctgaaatgcgctctttaat

SEQ ID NO: 5886963 - DNA, 14 bp, Homo sapiens
ctgaaatggcttct

SEQ ID NO: 5886964 - DNA, 13 bp, Homo sapiens
ctgaaatgtgtgt

SEQ ID NO: 5886965 - DNA, 16 bp, Homo sapiens
ctgaaatgtgtgtgat

SEQ ID NO: 5886966 - DNA, 17 bp, Homo sapiens
ctgaaatgtgtgtgatg

SEQ ID NO: 5886967 - DNA, 20 bp, Homo sapiens
ctgaaatgtgtgtgatgtga

SEQ ID NO: 5886968 - DNA, 22 bp, Homo sapiens
ctgaaatgtgtgtgatgtgaca

SEQ ID NO: 5886969 - DNA, 18 bp, Homo sapiens
ctgaaatgttacacatta

SEQ ID NO: 5886970 - DNA, 19 bp, Homo sapiens
ctgaaatgtttccaggcat

SEQ ID NO: 5886971 - DNA, 11 bp, Homo sapiens
ctgaaattaaa

SEQ ID NO: 5886972 - DNA, 16 bp, Homo sapiens
ctgaaattaaagaaat

SEQ ID NO: 5886973 - DNA, 17 bp, Homo sapiens
ctgaaattatgtcaaat

SEQ ID NO: 5886974 - DNA, 13 bp, Homo sapiens
ctgaaattatttt

SEQ ID NO: 5886975 - DNA, 16 bp, Homo sapiens
ctgaaattattttctc

SEQ ID NO: 5886976 - DNA, 23 bp, Homo sapiens
ctgaaattcagatttttacaagt

SEQ ID NO: 5886977 - DNA, 16 bp, Homo sapiens
ctgaaattccaaagtc

SEQ ID NO: 5886978 - DNA, 15 bp, Homo sapiens
ctgaaattctaaata

SEQ ID NO: 5886979 - DNA, 17 bp, Homo sapiens
ctgaaattctaaatatt

SEQ ID NO: 5886980 - DNA, 14 bp, Homo sapiens
ctgaaattctcctg

SEQ ID NO: 5886981 - DNA, 17 bp, Homo sapiens
ctgaaattctcctggag

SEQ ID NO: 5886982 - DNA, 14 bp, Homo sapiens
ctgaaattgcctga

SEQ ID NO: 5886983 - DNA, 19 bp, Homo sapiens
ctgaaattgcttatttttg

SEQ ID NO: 5886984 - DNA, 21 bp, Homo sapiens
ctgaaattggtgggaagcaag

SEQ ID NO: 5886985 - DNA, 17 bp, Homo sapiens
ctgaaatttagtacact

SEQ ID NO: 5886986 - DNA, 23 bp, Homo sapiens
ctgaaatttgttatacttcaaaa

SEQ ID NO: 5886987 - DNA, 22 bp, Homo sapiens
ctgaaattttagaaatattcac

SEQ ID NO: 5886988 - DNA, 13 bp, Homo sapiens
ctgaaattttata

SEQ ID NO: 5886989 - DNA, 22 bp, Homo sapiens
ctgaaattttatatgcttactg

SEQ ID NO: 5886990 - DNA, 19 bp, Homo sapiens
ctgaacaaaacctacacac

SEQ ID NO: 5886991 - DNA, 18 bp, Homo sapiens
ctgaacaaaacctacgca

SEQ ID NO: 5886992 - DNA, 12 bp, Homo sapiens
ctgaacaaaagc

SEQ ID NO: 5886993 - DNA, 21 bp, Homo sapiens
ctgaacaaaagcaggttttta

SEQ ID NO: 5886994 - DNA, 18 bp, Homo sapiens
ctgaacaaaccctttaaa

SEQ ID NO: 5886995 - DNA, 20 bp, Homo sapiens
ctgaacaaaccctttaaatg

SEQ ID NO: 5886996 - DNA, 14 bp, Homo sapiens
ctgaacaaagagag

SEQ ID NO: 5886997 - DNA, 20 bp, Homo sapiens
ctgaacaaatcttgggtggg

SEQ ID NO: 5886998 - DNA, 18 bp, Homo sapiens
ctgaacaagaaagagtaa

SEQ ID NO: 5886999 - DNA, 17 bp, Homo sapiens
ctgaagatcaatttctc

SEQ ID NO: 5887000 - DNA, 16 bp, Homo sapiens
ctgaagatcagagctg

SEQ ID NO: 5887001 - DNA, 22 bp, Homo sapiens
ctgaagatcagagctgcagcca

SEQ ID NO: 5887002 - DNA, 22 bp, Homo sapiens
ctgaagatcccaacatggtcct

SEQ ID NO: 5887003 - DNA, 18 bp, Homo sapiens
ctgaagatccccaactgc

SEQ ID NO: 5887004 - DNA, 20 bp, Homo sapiens
ctgaagatccccaactgctc

SEQ ID NO: 5887005 - DNA, 20 bp, Homo sapiens
ctgaagatccccattctttc

SEQ ID NO: 5887006 - DNA, 22 bp, Homo sapiens
ctgaagatgcagcaaaatgtga

SEQ ID NO: 5887007 - DNA, 16 bp, Homo sapiens
ctgaagatgcagctca

SEQ ID NO: 5887008 - DNA, 14 bp, Homo sapiens
ctgaagatggaggg

SEQ ID NO: 5887009 - DNA, 21 bp, Homo sapiens
ctgaagatggagggggctggg

SEQ ID NO: 5887010 - DNA, 23 bp, Homo sapiens
ctgaagatggcatcctgtgaagt

SEQ ID NO: 5887011 - DNA, 13 bp, Homo sapiens
ctgaagatggctt

SEQ ID NO: 5887012 - DNA, 13 bp, Homo sapiens
ctgaagatgtctc

SEQ ID NO: 5887013 - DNA, 15 bp, Homo sapiens
ctgaagatgtctcct

SEQ ID NO: 5887014 - DNA, 17 bp, Homo sapiens
ctgaagatgtctcctca

SEQ ID NO: 5887015 - DNA, 20 bp, Homo sapiens
ctgaagattaggcacacaga

SEQ ID NO: 5887016 - DNA, 14 bp, Homo sapiens
ctgaagattgttta

SEQ ID NO: 5887017 - DNA, 21 bp, Homo sapiens
ctgaagcaaggcggtggactt

SEQ ID NO: 5887018 - DNA, 18 bp, Homo sapiens
ctgaagcacgtgagagac

SEQ ID NO: 5887019 - DNA, 16 bp, Homo sapiens
ctgaagcagagtcaag

SEQ ID NO: 5887020 - DNA, 22 bp, Homo sapiens
ctgaagcagatgcaaagaggca

SEQ ID NO: 5887021 - DNA, 16 bp, Homo sapiens
ctgaagcagcctctcc

SEQ ID NO: 5887022 - DNA, 15 bp, Homo sapiens
ctgaagcataaacat

SEQ ID NO: 5887023 - DNA, 15 bp, Homo sapiens
ctgaagcatgtttca

SEQ ID NO: 5887024 - DNA, 18 bp, Homo sapiens
ctgaagcatgtttcatgt

SEQ ID NO: 5887025 - DNA, 23 bp, Homo sapiens
ctgaagcatgtttcatgttttgt

SEQ ID NO: 5887026 - DNA, 15 bp, Homo sapiens
ctgaagccaaatgaa

SEQ ID NO: 5887027 - DNA, 19 bp, Homo sapiens
ctgaagccacacagcccag

SEQ ID NO: 5887028 - DNA, 17 bp, Homo sapiens
ctgaagccacctctctg

SEQ ID NO: 5887029 - DNA, 13 bp, Homo sapiens
ctgaagccacttg

SEQ ID NO: 5887030 - DNA, 20 bp, Homo sapiens
ctgaagccacttggcccaga

SEQ ID NO: 5887031 - DNA, 15 bp, Homo sapiens
ctgaagccagatcca

SEQ ID NO: 5887032 - DNA, 14 bp, Homo sapiens
ctgaagccagcctt

SEQ ID NO: 5887033 - DNA, 12 bp, Homo sapiens
ctgaagccagct

SEQ ID NO: 5887034 - DNA, 21 bp, Homo sapiens
ctgaagccatgtagccaccca

SEQ ID NO: 5887035 - DNA, 14 bp, Homo sapiens
ctgaagccattgga

SEQ ID NO: 5887036 - DNA, 15 bp, Homo sapiens
ctgaagcccaaagcc

SEQ ID NO: 5887037 - DNA, 22 bp, Homo sapiens
ctgaagcccaaagcctgaggac

SEQ ID NO: 5887038 - DNA, 18 bp, Homo sapiens
ctgaagcccatgctttcc

SEQ ID NO: 5887039 - DNA, 19 bp, Homo sapiens
ctgaagcccatgctttccc

SEQ ID NO: 5887040 - DNA, 13 bp, Homo sapiens
ctgaagcccttgt

SEQ ID NO: 5887041 - DNA, 18 bp, Homo sapiens
ctgaagccgccaggaccg

SEQ ID NO: 5887042 - DNA, 23 bp, Homo sapiens
ctgaagccggacagctgcccaga

SEQ ID NO: 5887043 - DNA, 18 bp, Homo sapiens
ctgaagccgtgcctgtag

SEQ ID NO: 5887044 - DNA, 20 bp, Homo sapiens
ctgaagcctctaacaaatga

SEQ ID NO: 5887045 - DNA, 12 bp, Homo sapiens
ctgaagcctctg

SEQ ID NO: 5887046 - DNA, 21 bp, Homo sapiens
ctgaagcctctgccctgcctc

SEQ ID NO: 5887047 - DNA, 14 bp, Homo sapiens
ctgaagcctctggg

SEQ ID NO: 5887048 - DNA, 13 bp, Homo sapiens
ctgaagcctgcag

SEQ ID NO: 5887049 - DNA, 13 bp, Homo sapiens
ctgaagcctggac

SEQ ID NO: 5887050 - DNA, 22 bp, Homo sapiens
ctgaagcctggattccagcagt

SEQ ID NO: 5887051 - DNA, 13 bp, Homo sapiens
ctgaagccttctt

SEQ ID NO: 5887052 - DNA, 14 bp, Homo sapiens
ctgaagccttcttc

SEQ ID NO: 5887053 - DNA, 21 bp, Homo sapiens
ctgaagccttcttctgccact

SEQ ID NO: 5887054 - DNA, 19 bp, Homo sapiens
ctgaagcctttcttttgga

SEQ ID NO: 5887055 - DNA, 17 bp, Homo sapiens
ctgaagccttttcctga

SEQ ID NO: 5887056 - DNA, 17 bp, Homo sapiens
ctgaagcgaacatcttc

SEQ ID NO: 5887057 - DNA, 19 bp, Homo sapiens
ctgaagcgaacatcttcat

SEQ ID NO: 5887058 - DNA, 21 bp, Homo sapiens
ctgaagcgactctcctgtttg

SEQ ID NO: 5887059 - DNA, 14 bp, Homo sapiens
ctgaagctagaaac

SEQ ID NO: 5887060 - DNA, 22 bp, Homo sapiens
ctgaagctagaggaataaagct

SEQ ID NO: 5887061 - DNA, 22 bp, Homo sapiens
ctgaagctatcgtaaaattaag

SEQ ID NO: 5887062 - DNA, 15 bp, Homo sapiens
ctgaagctattgatg

SEQ ID NO: 5887063 - DNA, 15 bp, Homo sapiens
ctgaagctcccacag

SEQ ID NO: 5887064 - DNA, 22 bp, Homo sapiens
ctgaagctcgcatccagacagt

SEQ ID NO: 5887065 - DNA, 12 bp, Homo sapiens
ctgaagctgagg

SEQ ID NO: 5887066 - DNA, 15 bp, Homo sapiens
ctgaagctgcctgct

SEQ ID NO: 5887067 - DNA, 16 bp, Homo sapiens
ctgaagctgctgcagc

SEQ ID NO: 5887068 - DNA, 20 bp, Homo sapiens
ctgaagctgctgcagccctg

SEQ ID NO: 5887069 - DNA, 23 bp, Homo sapiens
ctgaagctgctgcagccctgcca

SEQ ID NO: 5887070 - DNA, 13 bp, Homo sapiens
ctgaagctgctgt

SEQ ID NO: 5887071 - DNA, 16 bp, Homo sapiens
ctgaagctgctgtgtc

SEQ ID NO: 5887072 - DNA, 12 bp, Homo sapiens
ctgaagctgggg

SEQ ID NO: 5887073 - DNA, 20 bp, Homo sapiens
ctgaagctggggcttgggga

SEQ ID NO: 5887074 - DNA, 19 bp, Homo sapiens
ctgaagcttaaccgaagaa

SEQ ID NO: 5887075 - DNA, 14 bp, Homo sapiens
ctgaagcttattaa

SEQ ID NO: 5887076 - DNA, 17 bp, Homo sapiens
ctgaagcttattaatgc

SEQ ID NO: 5887077 - DNA, 18 bp, Homo sapiens
ctgaagcttattaatgct

SEQ ID NO: 5887078 - DNA, 21 bp, Homo sapiens
ctgaagcttattaatgctaag

SEQ ID NO: 5887079 - DNA, 18 bp, Homo sapiens
ctgaagcttcggccgcgc

SEQ ID NO: 5887080 - DNA, 18 bp, Homo sapiens
ctgaaggaaaaacacaag

SEQ ID NO: 5887081 - DNA, 13 bp, Homo sapiens
ctgaaggaaggct

SEQ ID NO: 5887082 - DNA, 17 bp, Homo sapiens
ctgaaggacacttcctg

SEQ ID NO: 5887083 - DNA, 18 bp, Homo sapiens
ctgaaggacacttcctgc

SEQ ID NO: 5887084 - DNA, 20 bp, Homo sapiens
ctgaaggacacttcctgcct

SEQ ID NO: 5887085 - DNA, 19 bp, Homo sapiens
ctgaaggacattgcggaca

SEQ ID NO: 5887086 - DNA, 21 bp, Homo sapiens
ctgaaggacattgcggacagc

SEQ ID NO: 5887087 - DNA, 21 bp, Homo sapiens
ctgaaggacctccccctgtgt

SEQ ID NO: 5887088 - DNA, 14 bp, Homo sapiens
ctgaaggacctgag

SEQ ID NO: 5887089 - DNA, 16 bp, Homo sapiens
ctgaaggacctgagct

SEQ ID NO: 5887090 - DNA, 12 bp, Homo sapiens
ctgaaggactgg

SEQ ID NO: 5887091 - DNA, 13 bp, Homo sapiens
ctgaaggactgtg

SEQ ID NO: 5887092 - DNA, 14 bp, Homo sapiens
ctgaaggactgtga

SEQ ID NO: 5887093 - DNA, 13 bp, Homo sapiens
ctgaaggagagga

SEQ ID NO: 5887094 - DNA, 14 bp, Homo sapiens
ctgaaggagaggag

SEQ ID NO: 5887095 - DNA, 15 bp, Homo sapiens
ctgaaggagaggagt

SEQ ID NO: 5887096 - DNA, 12 bp, Homo sapiens
ctgaaggagatt

SEQ ID NO: 5887097 - DNA, 16 bp, Homo sapiens
ctgaaggagattttcc

SEQ ID NO: 5887098 - DNA, 18 bp, Homo sapiens
ctgaaggagattttcctt

SEQ ID NO: 5887099 - DNA, 12 bp, Homo sapiens
ctgaaggagccc

SEQ ID NO: 5887100 - DNA, 13 bp, Homo sapiens
ctgaaggagcccc

SEQ ID NO: 5887101 - DNA, 21 bp, Homo sapiens
ctgaaggagccccattcctgg

SEQ ID NO: 5887102 - DNA, 15 bp, Homo sapiens
ctgaaggaggccacc

SEQ ID NO: 5887103 - DNA, 16 bp, Homo sapiens
ctgaaggaggccacct

SEQ ID NO: 5887104 - DNA, 19 bp, Homo sapiens
ctgaaggaggccacctcct

SEQ ID NO: 5887105 - DNA, 21 bp, Homo sapiens
ctgaaggatcctggaaccact

SEQ ID NO: 5887106 - DNA, 23 bp, Homo sapiens
ctgaaggatcctggaaccactga

SEQ ID NO: 5887107 - DNA, 18 bp, Homo sapiens
ctgaaggattaatgaaaa

SEQ ID NO: 5887108 - DNA, 16 bp, Homo sapiens
ctgaaggattctggga

SEQ ID NO: 5887109 - DNA, 20 bp, Homo sapiens
ctgaaggattttaaatgctg

SEQ ID NO: 5887110 - DNA, 21 bp, Homo sapiens
ctgaaggcaaatctcctttgt

SEQ ID NO: 5887111 - DNA, 18 bp, Homo sapiens
ctgaaggcaacctggaag

SEQ ID NO: 5887112 - DNA, 15 bp, Homo sapiens
ctgaaggcagtggca

SEQ ID NO: 5887113 - DNA, 17 bp, Homo sapiens
ctgaaggcagtggcagg

SEQ ID NO: 5887114 - DNA, 21 bp, Homo sapiens
ctgaaggcagtggcaggggag

SEQ ID NO: 5887115 - DNA, 13 bp, Homo sapiens
ctgaaggccccgc

SEQ ID NO: 5887116 - DNA, 18 bp, Homo sapiens
ctgaaggccccgcccagg

SEQ ID NO: 5887117 - DNA, 15 bp, Homo sapiens
ctgaaggcctccatt

SEQ ID NO: 5887118 - DNA, 16 bp, Homo sapiens
ctgaaggcctccattt

SEQ ID NO: 5887119 - DNA, 19 bp, Homo sapiens
ctgaaggcctgaggttact

SEQ ID NO: 5887120 - DNA, 17 bp, Homo sapiens
ctgaaggctgggttctg

SEQ ID NO: 5887121 - DNA, 18 bp, Homo sapiens
ctgaaggcttctgcagct

SEQ ID NO: 5887122 - DNA, 23 bp, Homo sapiens
ctgaaggctttcagggcctccag

SEQ ID NO: 5887123 - DNA, 15 bp, Homo sapiens
ctgaagggaacagcc

SEQ ID NO: 5887124 - DNA, 22 bp, Homo sapiens
ctgaagggaacagcctgagccg

SEQ ID NO: 5887125 - DNA, 20 bp, Homo sapiens
ctgaagggaactagaggtgt

SEQ ID NO: 5887126 - DNA, 20 bp, Homo sapiens
ctgaagggaaggcaaaggca

SEQ ID NO: 5887127 - DNA, 11 bp, Homo sapiens
ctgaagggagg

SEQ ID NO: 5887128 - DNA, 17 bp, Homo sapiens
ctgaagggaggggaaga

SEQ ID NO: 5887129 - DNA, 18 bp, Homo sapiens
ctgaagggcattctttcc

SEQ ID NO: 5887130 - DNA, 20 bp, Homo sapiens
ctgaagggcattctttccca

SEQ ID NO: 5887131 - DNA, 13 bp, Homo sapiens
ctgaagggcctcc

SEQ ID NO: 5887132 - DNA, 14 bp, Homo sapiens
ctgaagggcctccc

SEQ ID NO: 5887133 - DNA, 16 bp, Homo sapiens
ctgaagggcctcccag

SEQ ID NO: 5887134 - DNA, 15 bp, Homo sapiens
ctgaaggggccatga

SEQ ID NO: 5887135 - DNA, 19 bp, Homo sapiens
ctgaaggggccatgatggc

SEQ ID NO: 5887136 - DNA, 16 bp, Homo sapiens
ctgaagggggcggcct

SEQ ID NO: 5887137 - DNA, 18 bp, Homo sapiens
ctgaaggggtgcacccac

SEQ ID NO: 5887138 - DNA, 21 bp, Homo sapiens
ctgaaggggtgcacccacctg

SEQ ID NO: 5887139 - DNA, 22 bp, Homo sapiens
ctgaaggggtgcacccacctgt

SEQ ID NO: 5887140 - DNA, 18 bp, Homo sapiens
ctgaaggggttttcttga

SEQ ID NO: 5887141 - DNA, 20 bp, Homo sapiens
ctgaaggggttttcttgata

SEQ ID NO: 5887142 - DNA, 14 bp, Homo sapiens
ctgaagggtgctca

SEQ ID NO: 5887143 - DNA, 17 bp, Homo sapiens
ctgaagggtggatgtgc

SEQ ID NO: 5887144 - DNA, 21 bp, Homo sapiens
ctgaagggtggatgtgctgga

SEQ ID NO: 5887145 - DNA, 17 bp, Homo sapiens
ctgaaggtcccctggca

SEQ ID NO: 5887146 - DNA, 15 bp, Homo sapiens
ctgaaggtctgggtc

SEQ ID NO: 5887147 - DNA, 15 bp, Homo sapiens
ctgaaggttcctgag

SEQ ID NO: 5887148 - DNA, 13 bp, Homo sapiens
ctgaaggtttttt

SEQ ID NO: 5887149 - DNA, 22 bp, Homo sapiens
ctgaaggttttttttttaagtg

SEQ ID NO: 5887150 - DNA, 14 bp, Homo sapiens
ctgaagtacaaaca

SEQ ID NO: 5887151 - DNA, 15 bp, Homo sapiens
ctgaagtacaaacat

SEQ ID NO: 5887152 - DNA, 16 bp, Homo sapiens
ctgaagtacaaacatg

SEQ ID NO: 5887153 - DNA, 24 bp, Homo sapiens
ctgaagtacagtatattcttgtaa

SEQ ID NO: 5887154 - DNA, 19 bp, Homo sapiens
ctgaagtacagtcccagca

SEQ ID NO: 5887155 - DNA, 22 bp, Homo sapiens
ctgaagtacagtcccagcacat

SEQ ID NO: 5887156 - DNA, 16 bp, Homo sapiens
ctgaagtactgcaccc

SEQ ID NO: 5887157 - DNA, 13 bp, Homo sapiens
ctgaagtatgaag

SEQ ID NO: 5887158 - DNA, 14 bp, Homo sapiens
ctgaagtcacacag

SEQ ID NO: 5887159 - DNA, 13 bp, Homo sapiens
ctgaagtcactgc

SEQ ID NO: 5887160 - DNA, 14 bp, Homo sapiens
ctgaagtcactgca

SEQ ID NO: 5887161 - DNA, 17 bp, Homo sapiens
ctgaagtcactgcacag

SEQ ID NO: 5887162 - DNA, 14 bp, Homo sapiens
ctgaagtcagttct

SEQ ID NO: 5887163 - DNA, 13 bp, Homo sapiens
ctgaagtctcccc

SEQ ID NO: 5887164 - DNA, 21 bp, Homo sapiens
ctgaagtctgagcccatttct

SEQ ID NO: 5887165 - DNA, 18 bp, Homo sapiens
ctgaagtcttgcattgaa

SEQ ID NO: 5887166 - DNA, 17 bp, Homo sapiens
ctgaagtctttgtacag

SEQ ID NO: 5887167 - DNA, 20 bp, Homo sapiens
ctgaagtctttgtacagaca

SEQ ID NO: 5887168 - DNA, 17 bp, Homo sapiens
ctgaagtgaaactgctt

SEQ ID NO: 5887169 - DNA, 14 bp, Homo sapiens
ctgaagtgacccca

SEQ ID NO: 5887170 - DNA, 17 bp, Homo sapiens
ctgaagtgaccccagct

SEQ ID NO: 5887171 - DNA, 18 bp, Homo sapiens
ctgaagtgaccccagctc

SEQ ID NO: 5887172 - DNA, 23 bp, Homo sapiens
ctgaagtgaccccagctccaggc

SEQ ID NO: 5887173 - DNA, 22 bp, Homo sapiens
ctgaagtgacctcactggcctg

SEQ ID NO: 5887174 - DNA, 21 bp, Homo sapiens
ctgaagtgagcacagcctagg

SEQ ID NO: 5887175 - DNA, 14 bp, Homo sapiens
ctgaagtgattgaa

SEQ ID NO: 5887176 - DNA, 20 bp, Homo sapiens
ctgaagtgcagctcaggaga

SEQ ID NO: 5887177 - DNA, 17 bp, Homo sapiens
ctgacagctcttcacag

SEQ ID NO: 5887178 - DNA, 14 bp, Homo sapiens
ctgacagctgctcc

SEQ ID NO: 5887179 - DNA, 19 bp, Homo sapiens
ctgacagctgtccctgccc

SEQ ID NO: 5887180 - DNA, 15 bp, Homo sapiens
ctgacagcttgagaa

SEQ ID NO: 5887181 - DNA, 13 bp, Homo sapiens
ctgacaggaagac

SEQ ID NO: 5887182 - DNA, 16 bp, Homo sapiens
ctgacaggaagactgg

SEQ ID NO: 5887183 - DNA, 19 bp, Homo sapiens
ctgacaggaagactggaga

SEQ ID NO: 5887184 - DNA, 12 bp, Homo sapiens
ctgacaggatgt

SEQ ID NO: 5887185 - DNA, 22 bp, Homo sapiens
ctgacaggatgtggcactgctt

SEQ ID NO: 5887186 - DNA, 19 bp, Homo sapiens
ctgacaggcaatgctggct

SEQ ID NO: 5887187 - DNA, 15 bp, Homo sapiens
ctgacaggcagcctg

SEQ ID NO: 5887188 - DNA, 23 bp, Homo sapiens
ctgacaggcagcctggacataga

SEQ ID NO: 5887189 - DNA, 22 bp, Homo sapiens
ctgacaggccttcctcctctca

SEQ ID NO: 5887190 - DNA, 23 bp, Homo sapiens
ctgacaggccttcctcctctcaa

SEQ ID NO: 5887191 - DNA, 13 bp, Homo sapiens
ctgacagggagca

SEQ ID NO: 5887192 - DNA, 16 bp, Homo sapiens
ctgacagggagcagcc

SEQ ID NO: 5887193 - DNA, 12 bp, Homo sapiens
ctgacagggcca

SEQ ID NO: 5887194 - DNA, 22 bp, Homo sapiens
ctgacagggcccagttaaatat

SEQ ID NO: 5887195 - DNA, 21 bp, Homo sapiens
ctgacaggtgaattggatggt

SEQ ID NO: 5887196 - DNA, 18 bp, Homo sapiens
ctgacaggtgatgctctg

SEQ ID NO: 5887197 - DNA, 20 bp, Homo sapiens
ctgacaggtgatgctctggc

SEQ ID NO: 5887198 - DNA, 19 bp, Homo sapiens
ctgacaggttcccagcagc

SEQ ID NO: 5887199 - DNA, 14 bp, Homo sapiens
ctgacagtagctct

SEQ ID NO: 5887200 - DNA, 15 bp, Homo sapiens
ctgacagtagctctt

SEQ ID NO: 5887201 - DNA, 16 bp, Homo sapiens
ctgacagtcagctgtg

SEQ ID NO: 5887202 - DNA, 17 bp, Homo sapiens
ctgacagtcagctgtgg

SEQ ID NO: 5887203 - DNA, 14 bp, Homo sapiens
ctgacagtccacag

SEQ ID NO: 5887204 - DNA, 18 bp, Homo sapiens
ctgacagtgtgggacagg

SEQ ID NO: 5887205 - DNA, 23 bp, Homo sapiens
ctgacagtgtgggacaggctctt

SEQ ID NO: 5887206 - DNA, 14 bp, Homo sapiens
ctgacagtttttct

SEQ ID NO: 5887207 - DNA, 14 bp, Homo sapiens
ctgacataatgtag

SEQ ID NO: 5887208 - DNA, 20 bp, Homo sapiens
ctgacataatgtagtgagtg

SEQ ID NO: 5887209 - DNA, 17 bp, Homo sapiens
ctgacataccttagact

SEQ ID NO: 5887210 - DNA, 21 bp, Homo sapiens
ctgacatagtggatggacaga

SEQ ID NO: 5887211 - DNA, 17 bp, Homo sapiens
ctgacatatttcataag

SEQ ID NO: 5887212 - DNA, 21 bp, Homo sapiens
ctgacatatttcataagcaca

SEQ ID NO: 5887213 - DNA, 17 bp, Homo sapiens
ctgacatcaaaaaaggc

SEQ ID NO: 5887214 - DNA, 14 bp, Homo sapiens
ctgacatcaagtgt

SEQ ID NO: 5887215 - DNA, 16 bp, Homo sapiens
ctgacatcaagtgtaa

SEQ ID NO: 5887216 - DNA, 20 bp, Homo sapiens
ctgacatcaattttaccctg

SEQ ID NO: 5887217 - DNA, 17 bp, Homo sapiens
ctgacatcacagcagcc

SEQ ID NO: 5887218 - DNA, 13 bp, Homo sapiens
ctgacatcatttg

SEQ ID NO: 5887219 - DNA, 12 bp, Homo sapiens
ctgacatccctt

SEQ ID NO: 5887220 - DNA, 16 bp, Homo sapiens
ctgacatcccttcctg

SEQ ID NO: 5887221 - DNA, 21 bp, Homo sapiens
ctgacatcccttcctggaaac

SEQ ID NO: 5887222 - DNA, 20 bp, Homo sapiens
ctgacatcctgacctcctgg

SEQ ID NO: 5887223 - DNA, 22 bp, Homo sapiens
ctgacatctcctctatcacatt

SEQ ID NO: 5887224 - DNA, 13 bp, Homo sapiens
ctgacatcttgaa

SEQ ID NO: 5887225 - DNA, 15 bp, Homo sapiens
ctgacatcttgaatc

SEQ ID NO: 5887226 - DNA, 22 bp, Homo sapiens
ctgacatcttgaatccttccat

SEQ ID NO: 5887227 - DNA, 16 bp, Homo sapiens
ctgacatgattccttc

SEQ ID NO: 5887228 - DNA, 20 bp, Homo sapiens
ctgacatgattccttcctgt

SEQ ID NO: 5887229 - DNA, 21 bp, Homo sapiens
ctgacatgctaacctctctga

SEQ ID NO: 5887230 - DNA, 17 bp, Homo sapiens
ctgacatggctctggac

SEQ ID NO: 5887231 - DNA, 15 bp, Homo sapiens
ctgacatggtgctgt

SEQ ID NO: 5887232 - DNA, 16 bp, Homo sapiens
ctgacatggtgctgtg

SEQ ID NO: 5887233 - DNA, 22 bp, Homo sapiens
ctgacatgtaccccctttccct

SEQ ID NO: 5887234 - DNA, 13 bp, Homo sapiens
ctgacatgtctca

SEQ ID NO: 5887235 - DNA, 19 bp, Homo sapiens
ctgacatgtggggccaggt

SEQ ID NO: 5887236 - DNA, 18 bp, Homo sapiens
ctgacattaacagttttc

SEQ ID NO: 5887237 - DNA, 17 bp, Homo sapiens
ctgacattcacctgccc

SEQ ID NO: 5887238 - DNA, 15 bp, Homo sapiens
ctgacattcactgag

SEQ ID NO: 5887239 - DNA, 22 bp, Homo sapiens
ctgacattcctaagagtggagg

SEQ ID NO: 5887240 - DNA, 15 bp, Homo sapiens
ctgacattctgattc

SEQ ID NO: 5887241 - DNA, 16 bp, Homo sapiens
ctgacattgccaaaaa

SEQ ID NO: 5887242 - DNA, 19 bp, Homo sapiens
ctgacattgctccaagatg

SEQ ID NO: 5887243 - DNA, 20 bp, Homo sapiens
ctgacattgctccaagatgt

SEQ ID NO: 5887244 - DNA, 12 bp, Homo sapiens
ctgacatttcac

SEQ ID NO: 5887245 - DNA, 12 bp, Homo sapiens
ctgacatttcta

SEQ ID NO: 5887246 - DNA, 14 bp, Homo sapiens
ctgacatttcttct

SEQ ID NO: 5887247 - DNA, 15 bp, Homo sapiens
ctgacattttttcct

SEQ ID NO: 5887248 - DNA, 21 bp, Homo sapiens
ctgaccaaaaccagagggcag

SEQ ID NO: 5887249 - DNA, 15 bp, Homo sapiens
ctgaccaaaatgtgt

SEQ ID NO: 5887250 - DNA, 20 bp, Homo sapiens
ctgaccaaatcacccaatcc

SEQ ID NO: 5887251 - DNA, 23 bp, Homo sapiens
ctgaccaaatggccagttttctg

SEQ ID NO: 5887252 - DNA, 19 bp, Homo sapiens
ctgaccaacagttccttca

SEQ ID NO: 5887253 - DNA, 22 bp, Homo sapiens
ctgaccaagactgagccagctt

SEQ ID NO: 5887254 - DNA, 14 bp, Homo sapiens
ctgaccaagagaga

SEQ ID NO: 5887255 - DNA, 15 bp, Homo sapiens
ctgaccaatattgta

SEQ ID NO: 5887256 - DNA, 19 bp, Homo sapiens
ctgaccaatattgtacagt

SEQ ID NO: 5887257 - DNA, 21 bp, Homo sapiens
ctgaccaatattgtacagttt

SEQ ID NO: 5887258 - DNA, 19 bp, Homo sapiens
ctgaccaattgtgctgcca

SEQ ID NO: 5887259 - DNA, 20 bp, Homo sapiens
ctgaccaattgtgctgccat

SEQ ID NO: 5887260 - DNA, 20 bp, Homo sapiens
ctgaccacaccaaccaggcc

SEQ ID NO: 5887261 - DNA, 16 bp, Homo sapiens
ctgaccacactgtatc

SEQ ID NO: 5887262 - DNA, 16 bp, Homo sapiens
ctgaccacacttcctg

SEQ ID NO: 5887263 - DNA, 15 bp, Homo sapiens
ctgaccacagacact

SEQ ID NO: 5887264 - DNA, 16 bp, Homo sapiens
ctgaccacagacactc

SEQ ID NO: 5887265 - DNA, 12 bp, Homo sapiens
ctgaccacagca

SEQ ID NO: 5887266 - DNA, 13 bp, Homo sapiens
ctgaccaccctcc

SEQ ID NO: 5887267 - DNA, 13 bp, Homo sapiens
ctgaccaccctgc

SEQ ID NO: 5887268 - DNA, 16 bp, Homo sapiens
ctgaccaccctgcctg

SEQ ID NO: 5887269 - DNA, 20 bp, Homo sapiens
ctgaccaccctgcctgtgga

SEQ ID NO: 5887270 - DNA, 23 bp, Homo sapiens
ctgaccacggacgtttccatcag

SEQ ID NO: 5887271 - DNA, 13 bp, Homo sapiens
ctgaccactcaga

SEQ ID NO: 5887272 - DNA, 16 bp, Homo sapiens
ctgaccactcagagac

SEQ ID NO: 5887273 - DNA, 23 bp, Homo sapiens
ctgaccactcagagacatgcaga

SEQ ID NO: 5887274 - DNA, 22 bp, Homo sapiens
ctgaccagaagacaaaggccca

SEQ ID NO: 5887275 - DNA, 18 bp, Homo sapiens
ctgaccagaagtggcagg

SEQ ID NO: 5887276 - DNA, 19 bp, Homo sapiens
ctgaccagaagtggcagga

SEQ ID NO: 5887277 - DNA, 12 bp, Homo sapiens
ctgaccagagaa

SEQ ID NO: 5887278 - DNA, 15 bp, Homo sapiens
ctgaccagagaatgc

SEQ ID NO: 5887279 - DNA, 14 bp, Homo sapiens
ctgaccagcagcgc

SEQ ID NO: 5887280 - DNA, 15 bp, Homo sapiens
ctgaccagcagcgcc

SEQ ID NO: 5887281 - DNA, 16 bp, Homo sapiens
ctgaccagcagcgcct

SEQ ID NO: 5887282 - DNA, 20 bp, Homo sapiens
ctgaccagcagcgcctttcc

SEQ ID NO: 5887283 - DNA, 22 bp, Homo sapiens
ctgaccagcagcgcctttccca

SEQ ID NO: 5887284 - DNA, 21 bp, Homo sapiens
ctgaccagcggctgctcaagc

SEQ ID NO: 5887285 - DNA, 22 bp, Homo sapiens
ctgaccagcggctgctcaagcc

SEQ ID NO: 5887286 - DNA, 12 bp, Homo sapiens
ctgaccagctgg

SEQ ID NO: 5887287 - DNA, 23 bp, Homo sapiens
ctgaccaggatggagcaagctct

SEQ ID NO: 5887288 - DNA, 24 bp, Homo sapiens
ctgaccaggatggagcaagctctt

SEQ ID NO: 5887289 - DNA, 18 bp, Homo sapiens
ctgaccaggcccaaggag

SEQ ID NO: 5887290 - DNA, 17 bp, Homo sapiens
ctgaccaggccctgctc

SEQ ID NO: 5887291 - DNA, 18 bp, Homo sapiens
ctgaccaggccctgctca

SEQ ID NO: 5887292 - DNA, 17 bp, Homo sapiens
ctgaccaggcgcccggg

SEQ ID NO: 5887293 - DNA, 21 bp, Homo sapiens
ctgaccaggcttcttcctaca

SEQ ID NO: 5887294 - DNA, 15 bp, Homo sapiens
ctgaccagggcaagg

SEQ ID NO: 5887295 - DNA, 16 bp, Homo sapiens
ctgaccagggcaaggc

SEQ ID NO: 5887296 - DNA, 21 bp, Homo sapiens
ctgaccagggcaaggcccctt

SEQ ID NO: 5887297 - DNA, 17 bp, Homo sapiens
ctgaccaggggccctac

SEQ ID NO: 5887298 - DNA, 12 bp, Homo sapiens
ctgaccagtcag

SEQ ID NO: 5887299 - DNA, 23 bp, Homo sapiens
ctgaccagtttaacctgatgcag

SEQ ID NO: 5887300 - DNA, 21 bp, Homo sapiens
ctgaccataatcctagccccg

SEQ ID NO: 5887301 - DNA, 15 bp, Homo sapiens
ctgaccatcatgccc

SEQ ID NO: 5887302 - DNA, 16 bp, Homo sapiens
ctgaccatccactcta

SEQ ID NO: 5887303 - DNA, 22 bp, Homo sapiens
ctgaccatccactctaccctcc

SEQ ID NO: 5887304 - DNA, 19 bp, Homo sapiens
ctgaccatcccatgagcag

SEQ ID NO: 5887305 - DNA, 14 bp, Homo sapiens
ctgaccatctgtga

SEQ ID NO: 5887306 - DNA, 16 bp, Homo sapiens
ctgaccatctgtgact

SEQ ID NO: 5887307 - DNA, 18 bp, Homo sapiens
ctgaccatctgtgactat

SEQ ID NO: 5887308 - DNA, 19 bp, Homo sapiens
ctgaccatgcgtcaggggc

SEQ ID NO: 5887309 - DNA, 18 bp, Homo sapiens
ctgacccaactgatcctg

SEQ ID NO: 5887310 - DNA, 21 bp, Homo sapiens
ctgacccaactgatcctgctc

SEQ ID NO: 5887311 - DNA, 23 bp, Homo sapiens
ctgacccaactgatcctgctcca

SEQ ID NO: 5887312 - DNA, 14 bp, Homo sapiens
ctgacccacctgcg

SEQ ID NO: 5887313 - DNA, 15 bp, Homo sapiens
ctgacccactgatct

SEQ ID NO: 5887314 - DNA, 21 bp, Homo sapiens
ctgacccagattcccttccgg

SEQ ID NO: 5887315 - DNA, 18 bp, Homo sapiens
ctgacccaggaccatcct

SEQ ID NO: 5887316 - DNA, 22 bp, Homo sapiens
ctgacccaggaccatcctggag

SEQ ID NO: 5887317 - DNA, 15 bp, Homo sapiens
ctgacccaggccgca

SEQ ID NO: 5887318 - DNA, 17 bp, Homo sapiens
ctgacccaggccgcagc

SEQ ID NO: 5887319 - DNA, 21 bp, Homo sapiens
ctgacccagggactctccaaa

SEQ ID NO: 5887320 - DNA, 12 bp, Homo sapiens
ctgacccagtgc

SEQ ID NO: 5887321 - DNA, 18 bp, Homo sapiens
ctgacccagtgtgtgctc

SEQ ID NO: 5887322 - DNA, 21 bp, Homo sapiens
ctgacccagtgtgtgctcagc

SEQ ID NO: 5887323 - DNA, 14 bp, Homo sapiens
ctgacccatgctgc

SEQ ID NO: 5887324 - DNA, 13 bp, Homo sapiens
ctgacccatgggc

SEQ ID NO: 5887325 - DNA, 17 bp, Homo sapiens
ctgacccatgggcagga

SEQ ID NO: 5887326 - DNA, 18 bp, Homo sapiens
ctgacccattcacatttt

SEQ ID NO: 5887327 - DNA, 21 bp, Homo sapiens
ctgaccccaaacaccttccag

SEQ ID NO: 5887328 - DNA, 23 bp, Homo sapiens
ctgaccccaaagagcctggagaa

SEQ ID NO: 5887329 - DNA, 23 bp, Homo sapiens
ctgaccccaagggggctgctgct

SEQ ID NO: 5887330 - DNA, 15 bp, Homo sapiens
ctgaccccacctaga

SEQ ID NO: 5887331 - DNA, 20 bp, Homo sapiens
ctgaccccacttatgctgct

SEQ ID NO: 5887332 - DNA, 21 bp, Homo sapiens
ctgaccccacttatgctgctg

SEQ ID NO: 5887333 - DNA, 23 bp, Homo sapiens
ctgaccccacttatgctgctgtg

SEQ ID NO: 5887334 - DNA, 15 bp, Homo sapiens
ctgaccccagcccag

SEQ ID NO: 5887335 - DNA, 16 bp, Homo sapiens
ctgaccccagcccaga

SEQ ID NO: 5887336 - DNA, 20 bp, Homo sapiens
ctgaccccagcccagacagc

SEQ ID NO: 5887337 - DNA, 12 bp, Homo sapiens
ctgaccccaggt

SEQ ID NO: 5887338 - DNA, 17 bp, Homo sapiens
ctgaccccaggtcagcc

SEQ ID NO: 5887339 - DNA, 18 bp, Homo sapiens
ctgaccccatcacctact

SEQ ID NO: 5887340 - DNA, 17 bp, Homo sapiens
ctgaccccattcctgat

SEQ ID NO: 5887341 - DNA, 17 bp, Homo sapiens
ctgacccccatgtaaat

SEQ ID NO: 5887342 - DNA, 15 bp, Homo sapiens
ctgacccccctcagg

SEQ ID NO: 5887343 - DNA, 21 bp, Homo sapiens
ctgacccccttcctgtcccca

SEQ ID NO: 5887344 - DNA, 18 bp, Homo sapiens
ctgaccccgagaagtgct

SEQ ID NO: 5887345 - DNA, 22 bp, Homo sapiens
ctgaccccgagaagtgctcttg

SEQ ID NO: 5887346 - DNA, 22 bp, Homo sapiens
ctgaccccggggggctgggaca

SEQ ID NO: 5887347 - DNA, 20 bp, Homo sapiens
ctgacccctcctcactggcc

SEQ ID NO: 5887348 - DNA, 14 bp, Homo sapiens
ctgacccctgcacc

SEQ ID NO: 5887349 - DNA, 19 bp, Homo sapiens
ctgacccctgcctgttggc

SEQ ID NO: 5887350 - DNA, 22 bp, Homo sapiens
ctgacccctgcctgttggcagg

SEQ ID NO: 5887351 - DNA, 23 bp, Homo sapiens
ctgacccgctcggacttactgcc

SEQ ID NO: 5887352 - DNA, 20 bp, Homo sapiens
ctgacccggattggccctgc

SEQ ID NO: 5887353 - DNA, 12 bp, Homo sapiens
ctgactccaaag

SEQ ID NO: 5887354 - DNA, 14 bp, Homo sapiens
ctgactccaaagct

SEQ ID NO: 5887355 - DNA, 20 bp, Homo sapiens
ctgactccaaagctgttcca

SEQ ID NO: 5887356 - DNA, 12 bp, Homo sapiens
ctgactccagag

SEQ ID NO: 5887357 - DNA, 16 bp, Homo sapiens
ctgactccagtgagct

SEQ ID NO: 5887358 - DNA, 20 bp, Homo sapiens
ctgactccagtgagctggaa

SEQ ID NO: 5887359 - DNA, 15 bp, Homo sapiens
ctgactccatgtgtg

SEQ ID NO: 5887360 - DNA, 17 bp, Homo sapiens
ctgactccctccccacc

SEQ ID NO: 5887361 - DNA, 14 bp, Homo sapiens
ctgactccctgtgg

SEQ ID NO: 5887362 - DNA, 21 bp, Homo sapiens
ctgactccctgtgggggtggc

SEQ ID NO: 5887363 - DNA, 22 bp, Homo sapiens
ctgactccgtcaagctggttgt

SEQ ID NO: 5887364 - DNA, 18 bp, Homo sapiens
ctgactcctacctgccct

SEQ ID NO: 5887365 - DNA, 20 bp, Homo sapiens
ctgactcctacctgccctgg

SEQ ID NO: 5887366 - DNA, 21 bp, Homo sapiens
ctgactcctacctgccctgga

SEQ ID NO: 5887367 - DNA, 12 bp, Homo sapiens
ctgactcctgga

SEQ ID NO: 5887368 - DNA, 15 bp, Homo sapiens
ctgactcctggactc

SEQ ID NO: 5887369 - DNA, 15 bp, Homo sapiens
ctgactcctgggtgg

SEQ ID NO: 5887370 - DNA, 14 bp, Homo sapiens
ctgactcctggtcc

SEQ ID NO: 5887371 - DNA, 14 bp, Homo sapiens
ctgactccttctgc

SEQ ID NO: 5887372 - DNA, 22 bp, Homo sapiens
ctgactcggcagtgtgcagtgg

SEQ ID NO: 5887373 - DNA, 17 bp, Homo sapiens
ctgactcggtttctcca

SEQ ID NO: 5887374 - DNA, 21 bp, Homo sapiens
ctgactctaaaatatggaaaa

SEQ ID NO: 5887375 - DNA, 14 bp, Homo sapiens
ctgactctcacctg

SEQ ID NO: 5887376 - DNA, 20 bp, Homo sapiens
ctgactctctgagctgggga

SEQ ID NO: 5887377 - DNA, 14 bp, Homo sapiens
ctgactctgaaatc

SEQ ID NO: 5887378 - DNA, 15 bp, Homo sapiens
ctgactctgactcat

SEQ ID NO: 5887379 - DNA, 14 bp, Homo sapiens
ctgactctgggttc

SEQ ID NO: 5887380 - DNA, 14 bp, Homo sapiens
ctgactctgtgctg

SEQ ID NO: 5887381 - DNA, 12 bp, Homo sapiens
ctgactcttatt

SEQ ID NO: 5887382 - DNA, 13 bp, Homo sapiens
ctgactcttattt

SEQ ID NO: 5887383 - DNA, 22 bp, Homo sapiens
ctgactctttttggactcagcc

SEQ ID NO: 5887384 - DNA, 13 bp, Homo sapiens
ctgactgaaatta

SEQ ID NO: 5887385 - DNA, 22 bp, Homo sapiens
ctgactgaaggaaaagcaagaa

SEQ ID NO: 5887386 - DNA, 14 bp, Homo sapiens
ctgactgacacagg

SEQ ID NO: 5887387 - DNA, 12 bp, Homo sapiens
ctgactgagata

SEQ ID NO: 5887388 - DNA, 17 bp, Homo sapiens
ctgactgaggcagtttg

SEQ ID NO: 5887389 - DNA, 16 bp, Homo sapiens
ctgactgaggcctgct

SEQ ID NO: 5887390 - DNA, 24 bp, Homo sapiens
ctgactgatagcttacactgagga

SEQ ID NO: 5887391 - DNA, 23 bp, Homo sapiens
ctgactgcaccagcgcccccaga

SEQ ID NO: 5887392 - DNA, 14 bp, Homo sapiens
ctgactgcagcccc

SEQ ID NO: 5887393 - DNA, 15 bp, Homo sapiens
ctgactgcagccccc

SEQ ID NO: 5887394 - DNA, 14 bp, Homo sapiens
ctgactgccaagcc

SEQ ID NO: 5887395 - DNA, 16 bp, Homo sapiens
ctgactgccaagccat

SEQ ID NO: 5887396 - DNA, 18 bp, Homo sapiens
ctgactgccaggacccca

SEQ ID NO: 5887397 - DNA, 22 bp, Homo sapiens
ctgactgcccgctcctcgggaa

SEQ ID NO: 5887398 - DNA, 13 bp, Homo sapiens
ctgactgctcaga

SEQ ID NO: 5887399 - DNA, 16 bp, Homo sapiens
ctgactggaggaggcc

SEQ ID NO: 5887400 - DNA, 17 bp, Homo sapiens
ctgactggatgtccaga

SEQ ID NO: 5887401 - DNA, 22 bp, Homo sapiens
ctgactggatgtccagagctgg

SEQ ID NO: 5887402 - DNA, 20 bp, Homo sapiens
ctgactggcaaaggaccagc

SEQ ID NO: 5887403 - DNA, 16 bp, Homo sapiens
ctgactggccaaaccc

SEQ ID NO: 5887404 - DNA, 20 bp, Homo sapiens
ctgactggccccagggactc

SEQ ID NO: 5887405 - DNA, 15 bp, Homo sapiens
ctgactggcctggga

SEQ ID NO: 5887406 - DNA, 14 bp, Homo sapiens
ctgactgggccaca

SEQ ID NO: 5887407 - DNA, 20 bp, Homo sapiens
ctgactgggccacagccccg

SEQ ID NO: 5887408 - DNA, 14 bp, Homo sapiens
ctgactgggccagg

SEQ ID NO: 5887409 - DNA, 16 bp, Homo sapiens
ctgactgggctgggtt

SEQ ID NO: 5887410 - DNA, 18 bp, Homo sapiens
ctgactgggctgggtttg

SEQ ID NO: 5887411 - DNA, 14 bp, Homo sapiens
ctgactgggggcag

SEQ ID NO: 5887412 - DNA, 17 bp, Homo sapiens
ctgactgggggcctctg

SEQ ID NO: 5887413 - DNA, 22 bp, Homo sapiens
ctgactgggggcctctgcctcc

SEQ ID NO: 5887414 - DNA, 16 bp, Homo sapiens
ctgactggtgctgcag

SEQ ID NO: 5887415 - DNA, 17 bp, Homo sapiens
ctgactggtttctcctg

SEQ ID NO: 5887416 - DNA, 18 bp, Homo sapiens
ctgactggtttctcctgg

SEQ ID NO: 5887417 - DNA, 13 bp, Homo sapiens
ctgactgtagctt

SEQ ID NO: 5887418 - DNA, 18 bp, Homo sapiens
ctgactgtcacaactcct

SEQ ID NO: 5887419 - DNA, 14 bp, Homo sapiens
ctgactgtcctctc

SEQ ID NO: 5887420 - DNA, 20 bp, Homo sapiens
ctgactgtctcccgggacta

SEQ ID NO: 5887421 - DNA, 12 bp, Homo sapiens
ctgactgtggcc

SEQ ID NO: 5887422 - DNA, 16 bp, Homo sapiens
ctgactgtggccccct

SEQ ID NO: 5887423 - DNA, 17 bp, Homo sapiens
ctgactgtggccccctc

SEQ ID NO: 5887424 - DNA, 12 bp, Homo sapiens
ctgactgtgggg

SEQ ID NO: 5887425 - DNA, 19 bp, Homo sapiens
ctgactgtgttcagtgcct

SEQ ID NO: 5887426 - DNA, 19 bp, Homo sapiens
ctgactgtgttgtcccagg

SEQ ID NO: 5887427 - DNA, 23 bp, Homo sapiens
ctgactgttctcttactgccgaa

SEQ ID NO: 5887428 - DNA, 14 bp, Homo sapiens
ctgactgttcttgg

SEQ ID NO: 5887429 - DNA, 22 bp, Homo sapiens
ctgactgttcttggtaactgat

SEQ ID NO: 5887430 - DNA, 15 bp, Homo sapiens
ctgactgttgccttt

SEQ ID NO: 5887431 - DNA, 11 bp, Homo sapiens
ctgactgttta

SEQ ID NO: 5887432 - DNA, 12 bp, Homo sapiens
ctgactgtttat

SEQ ID NO: 5887433 - DNA, 13 bp, Homo sapiens
ctgactgtttatt

SEQ ID NO: 5887434 - DNA, 16 bp, Homo sapiens
ctgactgtttatttaa

SEQ ID NO: 5887435 - DNA, 17 bp, Homo sapiens
ctgactgtttatttaag

SEQ ID NO: 5887436 - DNA, 24 bp, Homo sapiens
ctgactgtttatttaaggatggat

SEQ ID NO: 5887437 - DNA, 13 bp, Homo sapiens
ctgactgtttcat

SEQ ID NO: 5887438 - DNA, 16 bp, Homo sapiens
ctgactgttttctctt

SEQ ID NO: 5887439 - DNA, 18 bp, Homo sapiens
ctgactgttttttttgca

SEQ ID NO: 5887440 - DNA, 24 bp, Homo sapiens
ctgacttaagcaaaagaaaaagat

SEQ ID NO: 5887441 - DNA, 22 bp, Homo sapiens
ctgacttagaatccctgtgtta

SEQ ID NO: 5887442 - DNA, 15 bp, Homo sapiens
ctgacttcacatctg

SEQ ID NO: 5887443 - DNA, 21 bp, Homo sapiens
ctgacttcactaggcattgtg

SEQ ID NO: 5887444 - DNA, 14 bp, Homo sapiens
ctgacttcaggggc

SEQ ID NO: 5887445 - DNA, 19 bp, Homo sapiens
ctgacttcaggggctgccc

SEQ ID NO: 5887446 - DNA, 20 bp, Homo sapiens
ctgacttcagtgaatatttt

SEQ ID NO: 5887447 - DNA, 23 bp, Homo sapiens
ctgacttcagtgaatatttttgt

SEQ ID NO: 5887448 - DNA, 23 bp, Homo sapiens
ctgacttcatctcccacctagca

SEQ ID NO: 5887449 - DNA, 17 bp, Homo sapiens
ctgacttcatctggggt

SEQ ID NO: 5887450 - DNA, 14 bp, Homo sapiens
ctgacttcatttgt

SEQ ID NO: 5887451 - DNA, 17 bp, Homo sapiens
ctgacttcatttgtgcc

SEQ ID NO: 5887452 - DNA, 20 bp, Homo sapiens
ctgacttcatttgtgccaca

SEQ ID NO: 5887453 - DNA, 14 bp, Homo sapiens
ctgacttcccaagc

SEQ ID NO: 5887454 - DNA, 22 bp, Homo sapiens
ctgacttcccaagccctggtga

SEQ ID NO: 5887455 - DNA, 14 bp, Homo sapiens
ctgacttcccagct

SEQ ID NO: 5887456 - DNA, 15 bp, Homo sapiens
ctgacttcccagctg

SEQ ID NO: 5887457 - DNA, 17 bp, Homo sapiens
ctgacttcccagctggc

SEQ ID NO: 5887458 - DNA, 22 bp, Homo sapiens
ctgacttcccagctggcagcgc

SEQ ID NO: 5887459 - DNA, 23 bp, Homo sapiens
ctgacttcccagctggcagcgcc

SEQ ID NO: 5887460 - DNA, 23 bp, Homo sapiens
ctgacttccccgcattccaggct

SEQ ID NO: 5887461 - DNA, 15 bp, Homo sapiens
ctgacttccctggag

SEQ ID NO: 5887462 - DNA, 16 bp, Homo sapiens
ctgacttctaagtaaa

SEQ ID NO: 5887463 - DNA, 13 bp, Homo sapiens
ctgacttctccca

SEQ ID NO: 5887464 - DNA, 13 bp, Homo sapiens
ctgacttctctga

SEQ ID NO: 5887465 - DNA, 17 bp, Homo sapiens
ctgacttctctgaatca

SEQ ID NO: 5887466 - DNA, 18 bp, Homo sapiens
ctgacttctctgaatcag

SEQ ID NO: 5887467 - DNA, 11 bp, Homo sapiens
ctgacttctgc

SEQ ID NO: 5887468 - DNA, 18 bp, Homo sapiens
ctgacttctgcctggaga

SEQ ID NO: 5887469 - DNA, 17 bp, Homo sapiens
ctgacttctgctaggta

SEQ ID NO: 5887470 - DNA, 16 bp, Homo sapiens
ctgacttgagccactc

SEQ ID NO: 5887471 - DNA, 22 bp, Homo sapiens
ctgacttgagccactccttcct

SEQ ID NO: 5887472 - DNA, 15 bp, Homo sapiens
ctgacttgagtgttc

SEQ ID NO: 5887473 - DNA, 13 bp, Homo sapiens
ctgacttgcagag

SEQ ID NO: 5887474 - DNA, 23 bp, Homo sapiens
ctgacttggatcccaaagcaagg

SEQ ID NO: 5887475 - DNA, 17 bp, Homo sapiens
ctgacttggcacttaag

SEQ ID NO: 5887476 - DNA, 12 bp, Homo sapiens
ctgacttggctg

SEQ ID NO: 5887477 - DNA, 16 bp, Homo sapiens
ctgacttggctgggga

SEQ ID NO: 5887478 - DNA, 21 bp, Homo sapiens
ctgacttggggagatggagtt

SEQ ID NO: 5887479 - DNA, 22 bp, Homo sapiens
ctgacttggggagatggagttc

SEQ ID NO: 5887480 - DNA, 21 bp, Homo sapiens
ctgacttggttctgaagccat

SEQ ID NO: 5887481 - DNA, 17 bp, Homo sapiens
ctgacttgtttgtcttc

SEQ ID NO: 5887482 - DNA, 12 bp, Homo sapiens
ctgactttactt

SEQ ID NO: 5887483 - DNA, 15 bp, Homo sapiens
ctgactttacttgtg

SEQ ID NO: 5887484 - DNA, 21 bp, Homo sapiens
ctgactttctgattactgtcc

SEQ ID NO: 5887485 - DNA, 15 bp, Homo sapiens
ctgactttgaattta

SEQ ID NO: 5887486 - DNA, 17 bp, Homo sapiens
ctgactttgaatttata

SEQ ID NO: 5887487 - DNA, 20 bp, Homo sapiens
ctgactttgaatttatataa

SEQ ID NO: 5887488 - DNA, 17 bp, Homo sapiens
ctgactttgcttgcttt

SEQ ID NO: 5887489 - DNA, 17 bp, Homo sapiens
ctgacttttacagcttt

SEQ ID NO: 5887490 - DNA, 19 bp, Homo sapiens
ctgacttttacagcttttc

SEQ ID NO: 5887491 - DNA, 22 bp, Homo sapiens
ctgacttttacagcttttctct

SEQ ID NO: 5887492 - DNA, 18 bp, Homo sapiens
ctgacttttccaaataaa

SEQ ID NO: 5887493 - DNA, 13 bp, Homo sapiens
ctgactttttaac

SEQ ID NO: 5887494 - DNA, 18 bp, Homo sapiens
ctgactttttgtttcttt

SEQ ID NO: 5887495 - DNA, 19 bp, Homo sapiens
ctgactttttgtttctttg

SEQ ID NO: 5887496 - DNA, 12 bp, Homo sapiens
ctgagaaaacaa

SEQ ID NO: 5887497 - DNA, 21 bp, Homo sapiens
ctgagaaaacgaaactgctct

SEQ ID NO: 5887498 - DNA, 23 bp, Homo sapiens
ctgagaaaatgagtgactagacg

SEQ ID NO: 5887499 - DNA, 20 bp, Homo sapiens
ctgagaaaatgcgagactct

SEQ ID NO: 5887500 - DNA, 21 bp, Homo sapiens
ctgagaaacactatttgtgac

SEQ ID NO: 5887501 - DNA, 19 bp, Homo sapiens
ctgagaaacccaccagcct

SEQ ID NO: 5887502 - DNA, 12 bp, Homo sapiens
ctgagaaactct

SEQ ID NO: 5887503 - DNA, 13 bp, Homo sapiens
ctgagaaagacta

SEQ ID NO: 5887504 - DNA, 15 bp, Homo sapiens
ctgagaaagactatt

SEQ ID NO: 5887505 - DNA, 15 bp, Homo sapiens
ctgagaaagaggcag

SEQ ID NO: 5887506 - DNA, 22 bp, Homo sapiens
ctgagaaagcccacctgggctg

SEQ ID NO: 5887507 - DNA, 16 bp, Homo sapiens
ctgagaaagccctgtc

SEQ ID NO: 5887508 - DNA, 18 bp, Homo sapiens
ctgagaaagctaaagttt

SEQ ID NO: 5887509 - DNA, 19 bp, Homo sapiens
ctgagaaatagtgcactcc

SEQ ID NO: 5887510 - DNA, 23 bp, Homo sapiens
ctgagaaatagtgcactccaaga

SEQ ID NO: 5887511 - DNA, 22 bp, Homo sapiens
ctgagaaatgaatgctgagacc

SEQ ID NO: 5887512 - DNA, 14 bp, Homo sapiens
ctgagaaatgcaga

SEQ ID NO: 5887513 - DNA, 14 bp, Homo sapiens
ctgagaaattgaat

SEQ ID NO: 5887514 - DNA, 14 bp, Homo sapiens
ctgagaaatttata

SEQ ID NO: 5887515 - DNA, 23 bp, Homo sapiens
ctgagaacagatctccaaagctt

SEQ ID NO: 5887516 - DNA, 15 bp, Homo sapiens
ctgagaacataaaat

SEQ ID NO: 5887517 - DNA, 18 bp, Homo sapiens
ctgagaaccaaaagatgc

SEQ ID NO: 5887518 - DNA, 23 bp, Homo sapiens
ctgagaaccaaaagatgccttga

SEQ ID NO: 5887519 - DNA, 23 bp, Homo sapiens
ctgagaaccacggtgaaagtgct

SEQ ID NO: 5887520 - DNA, 22 bp, Homo sapiens
ctgagaaccataggactgtggc

SEQ ID NO: 5887521 - DNA, 23 bp, Homo sapiens
ctgagaaccctgcgtggggacag

SEQ ID NO: 5887522 - DNA, 22 bp, Homo sapiens
ctgagaaccgtagatgatttca

SEQ ID NO: 5887523 - DNA, 15 bp, Homo sapiens
ctgagaacctggcct

SEQ ID NO: 5887524 - DNA, 19 bp, Homo sapiens
ctgagaacctggccttcag

SEQ ID NO: 5887525 - DNA, 15 bp, Homo sapiens
ctgagaactcctgac

SEQ ID NO: 5887526 - DNA, 15 bp, Homo sapiens
ctgagaactgaattt

SEQ ID NO: 5887527 - DNA, 18 bp, Homo sapiens
ctgagaactgactttctc

SEQ ID NO: 5887528 - DNA, 14 bp, Homo sapiens
ctgagaagaagctg

SEQ ID NO: 5887529 - DNA, 17 bp, Homo sapiens
ctgagaagaagctgagg

SEQ ID NO: 5887530 - DNA, 11 bp, Homo sapiens
ctgagaagaat

SEQ ID NO: 5887531 - DNA, 12 bp, Homo sapiens
ctgagcccctgt

SEQ ID NO: 5887532 - DNA, 17 bp, Homo sapiens
ctgagcccgaatttctc

SEQ ID NO: 5887533 - DNA, 20 bp, Homo sapiens
ctgagcccgcagcccagacc

SEQ ID NO: 5887534 - DNA, 19 bp, Homo sapiens
ctgagcccgggctgcctgg

SEQ ID NO: 5887535 - DNA, 21 bp, Homo sapiens
ctgagcccgggctgcctgggc

SEQ ID NO: 5887536 - DNA, 23 bp, Homo sapiens
ctgagcccgggctgcctgggctg

SEQ ID NO: 5887537 - DNA, 18 bp, Homo sapiens
ctgagccctccctcttcc

SEQ ID NO: 5887538 - DNA, 15 bp, Homo sapiens
ctgagccctcctgag

SEQ ID NO: 5887539 - DNA, 18 bp, Homo sapiens
ctgagccctcctgagggc

SEQ ID NO: 5887540 - DNA, 22 bp, Homo sapiens
ctgagccctccttcttgccctg

SEQ ID NO: 5887541 - DNA, 13 bp, Homo sapiens
ctgagccctctca

SEQ ID NO: 5887542 - DNA, 15 bp, Homo sapiens
ctgagccctctcact

SEQ ID NO: 5887543 - DNA, 11 bp, Homo sapiens
ctgagccctgc

SEQ ID NO: 5887544 - DNA, 15 bp, Homo sapiens
ctgagccctggcagg

SEQ ID NO: 5887545 - DNA, 21 bp, Homo sapiens
ctgagccctggggactgttcc

SEQ ID NO: 5887546 - DNA, 13 bp, Homo sapiens
ctgagccctggtg

SEQ ID NO: 5887547 - DNA, 19 bp, Homo sapiens
ctgagccctgtacccaccc

SEQ ID NO: 5887548 - DNA, 19 bp, Homo sapiens
ctgagcccttgcacaggcc

SEQ ID NO: 5887549 - DNA, 20 bp, Homo sapiens
ctgagcccttgcacaggcca

SEQ ID NO: 5887550 - DNA, 21 bp, Homo sapiens
ctgagcccttgcacaggccac

SEQ ID NO: 5887551 - DNA, 17 bp, Homo sapiens
ctgagccgatctggtct

SEQ ID NO: 5887552 - DNA, 15 bp, Homo sapiens
ctgagccgcagagaa

SEQ ID NO: 5887553 - DNA, 14 bp, Homo sapiens
ctgagccgcagggc

SEQ ID NO: 5887554 - DNA, 16 bp, Homo sapiens
ctgagccggccccagg

SEQ ID NO: 5887555 - DNA, 19 bp, Homo sapiens
ctgagccggccccaggctc

SEQ ID NO: 5887556 - DNA, 18 bp, Homo sapiens
ctgagccgtgcagctggg

SEQ ID NO: 5887557 - DNA, 19 bp, Homo sapiens
ctgagccgtgcagctggga

SEQ ID NO: 5887558 - DNA, 22 bp, Homo sapiens
ctgagccgtgcagctgggattt

SEQ ID NO: 5887559 - DNA, 18 bp, Homo sapiens
ctgagcctacagatgaac

SEQ ID NO: 5887560 - DNA, 16 bp, Homo sapiens
ctgagcctagctacct

SEQ ID NO: 5887561 - DNA, 18 bp, Homo sapiens
ctgagcctcaaccttctg

SEQ ID NO: 5887562 - DNA, 14 bp, Homo sapiens
ctgagcctcacttg

SEQ ID NO: 5887563 - DNA, 21 bp, Homo sapiens
ctgagcctcagtctccctccc

SEQ ID NO: 5887564 - DNA, 18 bp, Homo sapiens
ctgagcctcgtgtccaga

SEQ ID NO: 5887565 - DNA, 21 bp, Homo sapiens
ctgagcctctcacctgtactc

SEQ ID NO: 5887566 - DNA, 18 bp, Homo sapiens
ctgagcctctgctcccca

SEQ ID NO: 5887567 - DNA, 14 bp, Homo sapiens
ctgagcctcttttc

SEQ ID NO: 5887568 - DNA, 16 bp, Homo sapiens
ctgagcctgacctttc

SEQ ID NO: 5887569 - DNA, 19 bp, Homo sapiens
ctgagcctgacctttctga

SEQ ID NO: 5887570 - DNA, 19 bp, Homo sapiens
ctgagcctgaggccttcca

SEQ ID NO: 5887571 - DNA, 14 bp, Homo sapiens
ctgagcctgcaggg

SEQ ID NO: 5887572 - DNA, 21 bp, Homo sapiens
ctgagcctgccaaagtgcctg

SEQ ID NO: 5887573 - DNA, 14 bp, Homo sapiens
ctgagcctgcccag

SEQ ID NO: 5887574 - DNA, 18 bp, Homo sapiens
ctgagcctgccccagctg

SEQ ID NO: 5887575 - DNA, 23 bp, Homo sapiens
ctgagcctgccccagctgggctg

SEQ ID NO: 5887576 - DNA, 15 bp, Homo sapiens
ctgagcctgccgagc

SEQ ID NO: 5887577 - DNA, 13 bp, Homo sapiens
ctgagcctggcag

SEQ ID NO: 5887578 - DNA, 22 bp, Homo sapiens
ctgagcctggcaggtcccctgc

SEQ ID NO: 5887579 - DNA, 17 bp, Homo sapiens
ctgagcctggccagcct

SEQ ID NO: 5887580 - DNA, 19 bp, Homo sapiens
ctgagcctggcccatagaa

SEQ ID NO: 5887581 - DNA, 19 bp, Homo sapiens
ctgagcctgtctctcccta

SEQ ID NO: 5887582 - DNA, 20 bp, Homo sapiens
ctgagcctgtgtcctgaaga

SEQ ID NO: 5887583 - DNA, 22 bp, Homo sapiens
ctgagcctgttcccactcagca

SEQ ID NO: 5887584 - DNA, 19 bp, Homo sapiens
ctgagccttagctcccagc

SEQ ID NO: 5887585 - DNA, 21 bp, Homo sapiens
ctgagccttagctcccagcta

SEQ ID NO: 5887586 - DNA, 21 bp, Homo sapiens
ctgagccttagtttcagctga

SEQ ID NO: 5887587 - DNA, 12 bp, Homo sapiens
ctgagccttcag

SEQ ID NO: 5887588 - DNA, 15 bp, Homo sapiens
ctgagccttctgagc

SEQ ID NO: 5887589 - DNA, 16 bp, Homo sapiens
ctgagcgacagtgaga

SEQ ID NO: 5887590 - DNA, 12 bp, Homo sapiens
ctgagcgaggaa

SEQ ID NO: 5887591 - DNA, 13 bp, Homo sapiens
ctgagcgaggaaa

SEQ ID NO: 5887592 - DNA, 15 bp, Homo sapiens
ctgagcgaggaaaaa

SEQ ID NO: 5887593 - DNA, 16 bp, Homo sapiens
ctgagcgaggaaaaac

SEQ ID NO: 5887594 - DNA, 18 bp, Homo sapiens
ctgagcgagtggagtctg

SEQ ID NO: 5887595 - DNA, 21 bp, Homo sapiens
ctgagcgagtggagtctgcca

SEQ ID NO: 5887596 - DNA, 17 bp, Homo sapiens
ctgagcgattattatct

SEQ ID NO: 5887597 - DNA, 19 bp, Homo sapiens
ctgagcgcaagccacagcc

SEQ ID NO: 5887598 - DNA, 23 bp, Homo sapiens
ctgagcgcagcgcctccaccctg

SEQ ID NO: 5887599 - DNA, 18 bp, Homo sapiens
ctgagcgcccccgagccc

SEQ ID NO: 5887600 - DNA, 21 bp, Homo sapiens
ctgagcgcccccgagccctga

SEQ ID NO: 5887601 - DNA, 22 bp, Homo sapiens
ctgagcgcccccgagccctgac

SEQ ID NO: 5887602 - DNA, 13 bp, Homo sapiens
ctgagcgcctcca

SEQ ID NO: 5887603 - DNA, 22 bp, Homo sapiens
ctgagcgcctgggtccagggga

SEQ ID NO: 5887604 - DNA, 14 bp, Homo sapiens
ctgagcggaggctc

SEQ ID NO: 5887605 - DNA, 22 bp, Homo sapiens
ctgagcggcaccctggtctgtg

SEQ ID NO: 5887606 - DNA, 20 bp, Homo sapiens
ctgagcggccgcagagactg

SEQ ID NO: 5887607 - DNA, 22 bp, Homo sapiens
ctgagcggcgcagagccctcca

SEQ ID NO: 5887608 - DNA, 16 bp, Homo sapiens
ctgagcgggaggcaga

SEQ ID NO: 5887609 - DNA, 22 bp, Homo sapiens
ctgagcggtgggggaggagggt

SEQ ID NO: 5887610 - DNA, 15 bp, Homo sapiens
ctgagcgtggaaggg

SEQ ID NO: 5887611 - DNA, 18 bp, Homo sapiens
ctgagcgtggaaggggga

SEQ ID NO: 5887612 - DNA, 19 bp, Homo sapiens
ctgagctagaagctggagg

SEQ ID NO: 5887613 - DNA, 20 bp, Homo sapiens
ctgagctagcaaatacagga

SEQ ID NO: 5887614 - DNA, 18 bp, Homo sapiens
ctgagctagctagcgcac

SEQ ID NO: 5887615 - DNA, 22 bp, Homo sapiens
ctgagctagttggttgaatttt

SEQ ID NO: 5887616 - DNA, 18 bp, Homo sapiens
ctgagctcacaaggcagc

SEQ ID NO: 5887617 - DNA, 22 bp, Homo sapiens
ctgagctcacatgggactggga

SEQ ID NO: 5887618 - DNA, 15 bp, Homo sapiens
ctgagctcaggctga

SEQ ID NO: 5887619 - DNA, 21 bp, Homo sapiens
ctgagctcaggctgagcccag

SEQ ID NO: 5887620 - DNA, 22 bp, Homo sapiens
ctgagctcaggctgagcccagc

SEQ ID NO: 5887621 - DNA, 20 bp, Homo sapiens
ctgagctcatttggggacca

SEQ ID NO: 5887622 - DNA, 15 bp, Homo sapiens
ctgagctccaccctc

SEQ ID NO: 5887623 - DNA, 20 bp, Homo sapiens
ctgagctccaccctcccctc

SEQ ID NO: 5887624 - DNA, 16 bp, Homo sapiens
ctgagctcccacctcc

SEQ ID NO: 5887625 - DNA, 19 bp, Homo sapiens
ctgagctcccacctccctt

SEQ ID NO: 5887626 - DNA, 23 bp, Homo sapiens
ctgagctcccacctcccttccca

SEQ ID NO: 5887627 - DNA, 19 bp, Homo sapiens
ctgagctccccagatctcc

SEQ ID NO: 5887628 - DNA, 21 bp, Homo sapiens
ctgagctccccagatctccca

SEQ ID NO: 5887629 - DNA, 15 bp, Homo sapiens
ctgagctccccatca

SEQ ID NO: 5887630 - DNA, 14 bp, Homo sapiens
ctgagctcctctgg

SEQ ID NO: 5887631 - DNA, 16 bp, Homo sapiens
ctgagctcctctgggc

SEQ ID NO: 5887632 - DNA, 17 bp, Homo sapiens
ctgagctcctctgggca

SEQ ID NO: 5887633 - DNA, 18 bp, Homo sapiens
ctgagctcctgctgcgga

SEQ ID NO: 5887634 - DNA, 15 bp, Homo sapiens
ctgagctcggggaca

SEQ ID NO: 5887635 - DNA, 16 bp, Homo sapiens
ctgagctcggggacag

SEQ ID NO: 5887636 - DNA, 18 bp, Homo sapiens
ctgagctcggggacaggt

SEQ ID NO: 5887637 - DNA, 23 bp, Homo sapiens
ctgagctcggggacaggtgacag

SEQ ID NO: 5887638 - DNA, 13 bp, Homo sapiens
ctgagctctgaga

SEQ ID NO: 5887639 - DNA, 18 bp, Homo sapiens
ctgagctctgagaggccc

SEQ ID NO: 5887640 - DNA, 15 bp, Homo sapiens
ctgagctctgcctca

SEQ ID NO: 5887641 - DNA, 16 bp, Homo sapiens
ctgagctctgcctcaa

SEQ ID NO: 5887642 - DNA, 18 bp, Homo sapiens
ctgagctctgcctcaact

SEQ ID NO: 5887643 - DNA, 23 bp, Homo sapiens
ctgagctcttgctatctctcaag

SEQ ID NO: 5887644 - DNA, 17 bp, Homo sapiens
ctgagctctttgcacta

SEQ ID NO: 5887645 - DNA, 15 bp, Homo sapiens
ctgagctgaggcagc

SEQ ID NO: 5887646 - DNA, 16 bp, Homo sapiens
ctgagctgagtggcca

SEQ ID NO: 5887647 - DNA, 17 bp, Homo sapiens
ctgagctgagtggccag

SEQ ID NO: 5887648 - DNA, 23 bp, Homo sapiens
ctgagctgagtggccagccagtg

SEQ ID NO: 5887649 - DNA, 16 bp, Homo sapiens
ctgagctgcagcctgg

SEQ ID NO: 5887650 - DNA, 18 bp, Homo sapiens
ctgagctgcagcctggct

SEQ ID NO: 5887651 - DNA, 16 bp, Homo sapiens
ctgagctgccatccag

SEQ ID NO: 5887652 - DNA, 22 bp, Homo sapiens
ctgagctgcccacagcaggcca

SEQ ID NO: 5887653 - DNA, 14 bp, Homo sapiens
ctgagctgcccctg

SEQ ID NO: 5887654 - DNA, 17 bp, Homo sapiens
ctgagctgcccctgctg

SEQ ID NO: 5887655 - DNA, 15 bp, Homo sapiens
ctgagctgctcaccg

SEQ ID NO: 5887656 - DNA, 16 bp, Homo sapiens
ctgagctgcttcacta

SEQ ID NO: 5887657 - DNA, 13 bp, Homo sapiens
ctgagctggaaag

SEQ ID NO: 5887658 - DNA, 23 bp, Homo sapiens
ctgagctggaaaggatgcttctg

SEQ ID NO: 5887659 - DNA, 18 bp, Homo sapiens
ctgagctggccaggccct

SEQ ID NO: 5887660 - DNA, 12 bp, Homo sapiens
ctgagctggccc

SEQ ID NO: 5887661 - DNA, 13 bp, Homo sapiens
ctgagctggccta

SEQ ID NO: 5887662 - DNA, 18 bp, Homo sapiens
ctgagctggcctgtctgc

SEQ ID NO: 5887663 - DNA, 21 bp, Homo sapiens
ctgagctggcgtcacctgtgc

SEQ ID NO: 5887664 - DNA, 21 bp, Homo sapiens
ctgagctggctgactaagccc

SEQ ID NO: 5887665 - DNA, 13 bp, Homo sapiens
ctgagctggcttc

SEQ ID NO: 5887666 - DNA, 22 bp, Homo sapiens
ctgagctgggatgattggaggg

SEQ ID NO: 5887667 - DNA, 20 bp, Homo sapiens
ctgagctgggcaccacaggc

SEQ ID NO: 5887668 - DNA, 18 bp, Homo sapiens
ctgagctgggcagctgga

SEQ ID NO: 5887669 - DNA, 13 bp, Homo sapiens
ctgagctggggaa

SEQ ID NO: 5887670 - DNA, 24 bp, Homo sapiens
ctgagctggggaggtgggaggcca

SEQ ID NO: 5887671 - DNA, 16 bp, Homo sapiens
ctgagctggggcctgg

SEQ ID NO: 5887672 - DNA, 16 bp, Homo sapiens
ctgagctggggggatg

SEQ ID NO: 5887673 - DNA, 12 bp, Homo sapiens
ctgagctggggt

SEQ ID NO: 5887674 - DNA, 23 bp, Homo sapiens
ctgagctggggtgggagctcctc

SEQ ID NO: 5887675 - DNA, 21 bp, Homo sapiens
ctgagctgtaatttcgcctta

SEQ ID NO: 5887676 - DNA, 16 bp, Homo sapiens
ctgagctgtcccaagt

SEQ ID NO: 5887677 - DNA, 16 bp, Homo sapiens
ctgagctgtcccctgg

SEQ ID NO: 5887678 - DNA, 20 bp, Homo sapiens
ctgagctgtgacattgctgg

SEQ ID NO: 5887679 - DNA, 13 bp, Homo sapiens
ctgagctgtgacc

SEQ ID NO: 5887680 - DNA, 12 bp, Homo sapiens
ctgagctgtgat

SEQ ID NO: 5887681 - DNA, 12 bp, Homo sapiens
ctgagctgtgcc

SEQ ID NO: 5887682 - DNA, 18 bp, Homo sapiens
ctgagctgtgccagctgc

SEQ ID NO: 5887683 - DNA, 17 bp, Homo sapiens
ctgagctgttatcttgt

SEQ ID NO: 5887684 - DNA, 21 bp, Homo sapiens
ctgagcttagccttgtgccct

SEQ ID NO: 5887685 - DNA, 20 bp, Homo sapiens
ctgagcttcggttctccaga

SEQ ID NO: 5887686 - DNA, 21 bp, Homo sapiens
ctgagcttcggttctccagaa

SEQ ID NO: 5887687 - DNA, 15 bp, Homo sapiens
ctgagcttctctgtg

SEQ ID NO: 5887688 - DNA, 16 bp, Homo sapiens
ctgagcttctctgtga

SEQ ID NO: 5887689 - DNA, 18 bp, Homo sapiens
ctgagcttgagctcccct

SEQ ID NO: 5887690 - DNA, 21 bp, Homo sapiens
ctgagcttgattctaaagggg

SEQ ID NO: 5887691 - DNA, 23 bp, Homo sapiens
ctgagcttgattctaaaggggac

SEQ ID NO: 5887692 - DNA, 22 bp, Homo sapiens
ctgagcttgcagagatgaggcc

SEQ ID NO: 5887693 - DNA, 21 bp, Homo sapiens
ctgagcttggaagcttctggt

SEQ ID NO: 5887694 - DNA, 15 bp, Homo sapiens
ctgagcttggccaga

SEQ ID NO: 5887695 - DNA, 17 bp, Homo sapiens
ctgagcttggccagaag

SEQ ID NO: 5887696 - DNA, 14 bp, Homo sapiens
ctgagcttggccct

SEQ ID NO: 5887697 - DNA, 22 bp, Homo sapiens
ctgagcttgtcttttctgctga

SEQ ID NO: 5887698 - DNA, 21 bp, Homo sapiens
ctgagctttccgcgtcagcaa

SEQ ID NO: 5887699 - DNA, 17 bp, Homo sapiens
ctgagctttccggggag

SEQ ID NO: 5887700 - DNA, 21 bp, Homo sapiens
ctgagctttccggggaggagc

SEQ ID NO: 5887701 - DNA, 15 bp, Homo sapiens
ctgagctttgcatgt

SEQ ID NO: 5887702 - DNA, 22 bp, Homo sapiens
ctgagctttggacgcacacagc

SEQ ID NO: 5887703 - DNA, 23 bp, Homo sapiens
ctgagcttttaccactagactca

SEQ ID NO: 5887704 - DNA, 22 bp, Homo sapiens
ctgagcttttgatgccaggtgc

SEQ ID NO: 5887705 - DNA, 23 bp, Homo sapiens
ctgagcttttgatgccaggtgca

SEQ ID NO: 5887706 - DNA, 20 bp, Homo sapiens
ctgaggaaaggagggaaagt

SEQ ID NO: 5887707 - DNA, 17 bp, Homo sapiens
ctgagtacccctgcttt

SEQ ID NO: 5887708 - DNA, 15 bp, Homo sapiens
ctgagtaccttctac

SEQ ID NO: 5887709 - DNA, 21 bp, Homo sapiens
ctgagtaccttctacaggccc

SEQ ID NO: 5887710 - DNA, 13 bp, Homo sapiens
ctgagtactccac

SEQ ID NO: 5887711 - DNA, 19 bp, Homo sapiens
ctgagtactccacactgca

SEQ ID NO: 5887712 - DNA, 23 bp, Homo sapiens
ctgagtactccacactgcacaat

SEQ ID NO: 5887713 - DNA, 16 bp, Homo sapiens
ctgagtactggaataa

SEQ ID NO: 5887714 - DNA, 22 bp, Homo sapiens
ctgagtactggaataaacagtg

SEQ ID NO: 5887715 - DNA, 17 bp, Homo sapiens
ctgagtagcagaaaaca

SEQ ID NO: 5887716 - DNA, 19 bp, Homo sapiens
ctgagtagctctcctgact

SEQ ID NO: 5887717 - DNA, 18 bp, Homo sapiens
ctgagtagctctgccttt

SEQ ID NO: 5887718 - DNA, 20 bp, Homo sapiens
ctgagtagctgagactacag

SEQ ID NO: 5887719 - DNA, 19 bp, Homo sapiens
ctgagtagctggattacag

SEQ ID NO: 5887720 - DNA, 20 bp, Homo sapiens
ctgagtagctggattacagg

SEQ ID NO: 5887721 - DNA, 16 bp, Homo sapiens
ctgagtagctgggatt

SEQ ID NO: 5887722 - DNA, 17 bp, Homo sapiens
ctgagtagctgggcctg

SEQ ID NO: 5887723 - DNA, 20 bp, Homo sapiens
ctgagtagctgggcctgtgc

SEQ ID NO: 5887724 - DNA, 21 bp, Homo sapiens
ctgagtagctgggcctgtgca

SEQ ID NO: 5887725 - DNA, 22 bp, Homo sapiens
ctgagtagctgggcctgtgcac

SEQ ID NO: 5887726 - DNA, 13 bp, Homo sapiens
ctgagtagctttc

SEQ ID NO: 5887727 - DNA, 16 bp, Homo sapiens
ctgagtagctttcatt

SEQ ID NO: 5887728 - DNA, 21 bp, Homo sapiens
ctgagtaggtctgggatggac

SEQ ID NO: 5887729 - DNA, 15 bp, Homo sapiens
ctgagtagtggccac

SEQ ID NO: 5887730 - DNA, 17 bp, Homo sapiens
ctgagtagtggccactg

SEQ ID NO: 5887731 - DNA, 18 bp, Homo sapiens
ctgagtatgtggaaggca

SEQ ID NO: 5887732 - DNA, 21 bp, Homo sapiens
ctgagtattaaaatgtatgca

SEQ ID NO: 5887733 - DNA, 21 bp, Homo sapiens
ctgagtattaatatctgagga

SEQ ID NO: 5887734 - DNA, 15 bp, Homo sapiens
ctgagtattttttat

SEQ ID NO: 5887735 - DNA, 20 bp, Homo sapiens
ctgagtcaaatccagtggtg

SEQ ID NO: 5887736 - DNA, 15 bp, Homo sapiens
ctgagtcaagttgtt

SEQ ID NO: 5887737 - DNA, 16 bp, Homo sapiens
ctgagtcacaggtgtg

SEQ ID NO: 5887738 - DNA, 24 bp, Homo sapiens
ctgagtcacaggtgtgggatggag

SEQ ID NO: 5887739 - DNA, 15 bp, Homo sapiens
ctgagtcaccaggaa

SEQ ID NO: 5887740 - DNA, 22 bp, Homo sapiens
ctgagtcacccctctgtccagc

SEQ ID NO: 5887741 - DNA, 23 bp, Homo sapiens
ctgagtcaccctacctgtgcctg

SEQ ID NO: 5887742 - DNA, 17 bp, Homo sapiens
ctgagtcacctcctcca

SEQ ID NO: 5887743 - DNA, 16 bp, Homo sapiens
ctgagtcacgctgggg

SEQ ID NO: 5887744 - DNA, 21 bp, Homo sapiens
ctgagtcagagccatgtcttc

SEQ ID NO: 5887745 - DNA, 15 bp, Homo sapiens
ctgagtcagaggaca

SEQ ID NO: 5887746 - DNA, 19 bp, Homo sapiens
ctgagtcagctgaccccct

SEQ ID NO: 5887747 - DNA, 20 bp, Homo sapiens
ctgagtcagctgaccccctc

SEQ ID NO: 5887748 - DNA, 17 bp, Homo sapiens
ctgagtcagggcccaga

SEQ ID NO: 5887749 - DNA, 19 bp, Homo sapiens
ctgagtcagggcccagagg

SEQ ID NO: 5887750 - DNA, 22 bp, Homo sapiens
ctgagtcagggcccagaggctg

SEQ ID NO: 5887751 - DNA, 23 bp, Homo sapiens
ctgagtcagggcccagaggctga

SEQ ID NO: 5887752 - DNA, 14 bp, Homo sapiens
ctgagtcagtgctc

SEQ ID NO: 5887753 - DNA, 15 bp, Homo sapiens
ctgagtcagtgctct

SEQ ID NO: 5887754 - DNA, 21 bp, Homo sapiens
ctgagtcatctgttagggcct

SEQ ID NO: 5887755 - DNA, 19 bp, Homo sapiens
ctgagtcatgatctccctg

SEQ ID NO: 5887756 - DNA, 20 bp, Homo sapiens
ctgagtcatgatctccctgc

SEQ ID NO: 5887757 - DNA, 21 bp, Homo sapiens
ctgagtcatgatctccctgcc

SEQ ID NO: 5887758 - DNA, 13 bp, Homo sapiens
ctgagtccagctc

SEQ ID NO: 5887759 - DNA, 14 bp, Homo sapiens
ctgagtccagctcc

SEQ ID NO: 5887760 - DNA, 17 bp, Homo sapiens
ctgagtcccaggagctg

SEQ ID NO: 5887761 - DNA, 21 bp, Homo sapiens
ctgagtcccaggagctgccca

SEQ ID NO: 5887762 - DNA, 12 bp, Homo sapiens
ctgagtccccac

SEQ ID NO: 5887763 - DNA, 16 bp, Homo sapiens
ctgagtccgggaggca

SEQ ID NO: 5887764 - DNA, 15 bp, Homo sapiens
ctgagtcctgagcga

SEQ ID NO: 5887765 - DNA, 14 bp, Homo sapiens
ctgagtcctggggt

SEQ ID NO: 5887766 - DNA, 13 bp, Homo sapiens
ctgagtcctggtc

SEQ ID NO: 5887767 - DNA, 19 bp, Homo sapiens
ctgagtcctggtccctctg

SEQ ID NO: 5887768 - DNA, 21 bp, Homo sapiens
ctgagtcctggtttcctggca

SEQ ID NO: 5887769 - DNA, 15 bp, Homo sapiens
ctgagtccttaaaca

SEQ ID NO: 5887770 - DNA, 23 bp, Homo sapiens
ctgagtcctttccaggggccaat

SEQ ID NO: 5887771 - DNA, 15 bp, Homo sapiens
ctgagtcctttgcta

SEQ ID NO: 5887772 - DNA, 22 bp, Homo sapiens
ctgagtcgctctcatgaagccc

SEQ ID NO: 5887773 - DNA, 14 bp, Homo sapiens
ctgagtcggcccca

SEQ ID NO: 5887774 - DNA, 17 bp, Homo sapiens
ctgagtcggctgggcag

SEQ ID NO: 5887775 - DNA, 18 bp, Homo sapiens
ctgagtcggctgggcagg

SEQ ID NO: 5887776 - DNA, 23 bp, Homo sapiens
ctgagtcggctgggcagggccgc

SEQ ID NO: 5887777 - DNA, 21 bp, Homo sapiens
ctgagtcgtgacctgctaggc

SEQ ID NO: 5887778 - DNA, 19 bp, Homo sapiens
ctgagtctatgttcaaaga

SEQ ID NO: 5887779 - DNA, 14 bp, Homo sapiens
ctgagtctcattcc

SEQ ID NO: 5887780 - DNA, 15 bp, Homo sapiens
ctgagtctcctgtgc

SEQ ID NO: 5887781 - DNA, 16 bp, Homo sapiens
ctgagtctcctgtgcc

SEQ ID NO: 5887782 - DNA, 13 bp, Homo sapiens
ctgagtctgaagg

SEQ ID NO: 5887783 - DNA, 15 bp, Homo sapiens
ctgagtctgaaggct

SEQ ID NO: 5887784 - DNA, 18 bp, Homo sapiens
ctgagtctgagtcctgtc

SEQ ID NO: 5887785 - DNA, 17 bp, Homo sapiens
ctgagtctgctatattt

SEQ ID NO: 5887786 - DNA, 22 bp, Homo sapiens
ctgagtctgctatattttcatg

SEQ ID NO: 5887787 - DNA, 16 bp, Homo sapiens
ctgagtctggacctcc

SEQ ID NO: 5887788 - DNA, 17 bp, Homo sapiens
ctgagtctggacctcca

SEQ ID NO: 5887789 - DNA, 14 bp, Homo sapiens
ctgagtctggactt

SEQ ID NO: 5887790 - DNA, 15 bp, Homo sapiens
ctgagtctggcaaac

SEQ ID NO: 5887791 - DNA, 19 bp, Homo sapiens
ctgagtctggcaaacatgt

SEQ ID NO: 5887792 - DNA, 22 bp, Homo sapiens
ctgagtctgggcagctgtccct

SEQ ID NO: 5887793 - DNA, 22 bp, Homo sapiens
ctgagtctgtgaataaagccac

SEQ ID NO: 5887794 - DNA, 14 bp, Homo sapiens
ctgagtctgtggac

SEQ ID NO: 5887795 - DNA, 18 bp, Homo sapiens
ctgagtcttggcctgcct

SEQ ID NO: 5887796 - DNA, 19 bp, Homo sapiens
ctgagtcttggcctgcctc

SEQ ID NO: 5887797 - DNA, 13 bp, Homo sapiens
ctgagtgaaatat

SEQ ID NO: 5887798 - DNA, 15 bp, Homo sapiens
ctgagtgaacctgta

SEQ ID NO: 5887799 - DNA, 12 bp, Homo sapiens
ctgagtgaagca

SEQ ID NO: 5887800 - DNA, 17 bp, Homo sapiens
ctgagtgaattgtacct

SEQ ID NO: 5887801 - DNA, 22 bp, Homo sapiens
ctgagtgacatgggtgtgccag

SEQ ID NO: 5887802 - DNA, 23 bp, Homo sapiens
ctgagtgaccgggggctgctggg

SEQ ID NO: 5887803 - DNA, 18 bp, Homo sapiens
ctgagtgacctccttctg

SEQ ID NO: 5887804 - DNA, 21 bp, Homo sapiens
ctgagtgactgtaggcaggga

SEQ ID NO: 5887805 - DNA, 12 bp, Homo sapiens
ctgagtgagagg

SEQ ID NO: 5887806 - DNA, 15 bp, Homo sapiens
ctgagtgagccacag

SEQ ID NO: 5887807 - DNA, 16 bp, Homo sapiens
ctgagtgagccacaga

SEQ ID NO: 5887808 - DNA, 16 bp, Homo sapiens
ctgagtgagtgtgtgt

SEQ ID NO: 5887809 - DNA, 17 bp, Homo sapiens
ctgagtgcaagttcatg

SEQ ID NO: 5887810 - DNA, 14 bp, Homo sapiens
ctgagtgcagaggc

SEQ ID NO: 5887811 - DNA, 20 bp, Homo sapiens
ctgagtgcagaggctgagca

SEQ ID NO: 5887812 - DNA, 14 bp, Homo sapiens
ctgagtgcagccaa

SEQ ID NO: 5887813 - DNA, 22 bp, Homo sapiens
ctgagtgcagccaaaggggagc

SEQ ID NO: 5887814 - DNA, 23 bp, Homo sapiens
ctgagtgcagccaaaggggagcc

SEQ ID NO: 5887815 - DNA, 21 bp, Homo sapiens
ctgagtgcaggcccaccctgc

SEQ ID NO: 5887816 - DNA, 13 bp, Homo sapiens
ctgagtgccccac

SEQ ID NO: 5887817 - DNA, 23 bp, Homo sapiens
ctgagtgccccacttctggccac

SEQ ID NO: 5887818 - DNA, 13 bp, Homo sapiens
ctgagtgccttct

SEQ ID NO: 5887819 - DNA, 17 bp, Homo sapiens
ctgagtgccttctgtgg

SEQ ID NO: 5887820 - DNA, 15 bp, Homo sapiens
ctgagtgctatgtgt

SEQ ID NO: 5887821 - DNA, 15 bp, Homo sapiens
ctgagtgctgggcac

SEQ ID NO: 5887822 - DNA, 21 bp, Homo sapiens
ctgagtggactggagtggagc

SEQ ID NO: 5887823 - DNA, 11 bp, Homo sapiens
ctgagtggagg

SEQ ID NO: 5887824 - DNA, 13 bp, Homo sapiens
ctgagtggcagca

SEQ ID NO: 5887825 - DNA, 15 bp, Homo sapiens
ctgagtggcagcagc

SEQ ID NO: 5887826 - DNA, 18 bp, Homo sapiens
ctgagtggccagccagtg

SEQ ID NO: 5887827 - DNA, 21 bp, Homo sapiens
ctgagtggctcgtgtttcaca

SEQ ID NO: 5887828 - DNA, 24 bp, Homo sapiens
ctgagtggctcgtgtttcacagtg

SEQ ID NO: 5887829 - DNA, 13 bp, Homo sapiens
ctgagtggcttca

SEQ ID NO: 5887830 - DNA, 16 bp, Homo sapiens
ctgagtggcttcactc

SEQ ID NO: 5887831 - DNA, 19 bp, Homo sapiens
ctgagtggcttcactcctg

SEQ ID NO: 5887832 - DNA, 23 bp, Homo sapiens
ctgagtggcttgtgattctggga

SEQ ID NO: 5887833 - DNA, 15 bp, Homo sapiens
ctgagtgggaagccc

SEQ ID NO: 5887834 - DNA, 22 bp, Homo sapiens
ctgagtggggcttcctgggcag

SEQ ID NO: 5887835 - DNA, 22 bp, Homo sapiens
ctgagtgggggatcacagcctc

SEQ ID NO: 5887836 - DNA, 21 bp, Homo sapiens
ctgagtggtcactggtcaggg

SEQ ID NO: 5887837 - DNA, 17 bp, Homo sapiens
ctgagtggtccacattc

SEQ ID NO: 5887838 - DNA, 18 bp, Homo sapiens
ctgagtggtccacattct

SEQ ID NO: 5887839 - DNA, 22 bp, Homo sapiens
ctgagtggtccacattctgctg

SEQ ID NO: 5887840 - DNA, 23 bp, Homo sapiens
ctgagtggtccacattctgctgc

SEQ ID NO: 5887841 - DNA, 15 bp, Homo sapiens
ctgagtggtgagggg

SEQ ID NO: 5887842 - DNA, 18 bp, Homo sapiens
ctgagtggtggttccttt

SEQ ID NO: 5887843 - DNA, 22 bp, Homo sapiens
ctgagtggtggttcctttgcac

SEQ ID NO: 5887844 - DNA, 13 bp, Homo sapiens
ctgagtgtctctg

SEQ ID NO: 5887845 - DNA, 14 bp, Homo sapiens
ctgagtgtggcggg

SEQ ID NO: 5887846 - DNA, 22 bp, Homo sapiens
ctgagtgttcaaactactgtac

SEQ ID NO: 5887847 - DNA, 20 bp, Homo sapiens
ctgagtgttctcctcttttt

SEQ ID NO: 5887848 - DNA, 17 bp, Homo sapiens
ctgagttacattgtcat

SEQ ID NO: 5887849 - DNA, 20 bp, Homo sapiens
ctgagttacttgtctgaggc

SEQ ID NO: 5887850 - DNA, 21 bp, Homo sapiens
ctgagttacttgtctgaggcc

SEQ ID NO: 5887851 - DNA, 14 bp, Homo sapiens
ctgagttagctgtt

SEQ ID NO: 5887852 - DNA, 18 bp, Homo sapiens
ctgagttagctgtttact

SEQ ID NO: 5887853 - DNA, 19 bp, Homo sapiens
ctgagttaggctttctctt

SEQ ID NO: 5887854 - DNA, 20 bp, Homo sapiens
ctgagttatgaaaagataac

SEQ ID NO: 5887855 - DNA, 15 bp, Homo sapiens
ctgagttatgatgta

SEQ ID NO: 5887856 - DNA, 17 bp, Homo sapiens
ctgagttcaagggctgt

SEQ ID NO: 5887857 - DNA, 21 bp, Homo sapiens
ctgagttcccaaagggagggt

SEQ ID NO: 5887858 - DNA, 22 bp, Homo sapiens
ctgagttcccaaagggagggtg

SEQ ID NO: 5887859 - DNA, 17 bp, Homo sapiens
ctgagttcccgggagct

SEQ ID NO: 5887860 - DNA, 18 bp, Homo sapiens
ctgagttcccgggagctg

SEQ ID NO: 5887861 - DNA, 22 bp, Homo sapiens
ctgagttcccgggagctgggcc

SEQ ID NO: 5887862 - DNA, 19 bp, Homo sapiens
ctgagttccggcaccagta

SEQ ID NO: 5887863 - DNA, 15 bp, Homo sapiens
ctgagttcctagcca

SEQ ID NO: 5887864 - DNA, 16 bp, Homo sapiens
ctgagttcctagccac

SEQ ID NO: 5887865 - DNA, 16 bp, Homo sapiens
ctgagttcctgcatgc

SEQ ID NO: 5887866 - DNA, 21 bp, Homo sapiens
ctgagttccttataagaatta

SEQ ID NO: 5887867 - DNA, 14 bp, Homo sapiens
ctgagttctgacac

SEQ ID NO: 5887868 - DNA, 18 bp, Homo sapiens
ctgagttctgacactgtg

SEQ ID NO: 5887869 - DNA, 19 bp, Homo sapiens
ctgagttctgggtttctag

SEQ ID NO: 5887870 - DNA, 22 bp, Homo sapiens
ctgagttctgggtttctagagg

SEQ ID NO: 5887871 - DNA, 15 bp, Homo sapiens
ctgagttctggtgag

SEQ ID NO: 5887872 - DNA, 21 bp, Homo sapiens
ctgagttctgtgtattttcag

SEQ ID NO: 5887873 - DNA, 14 bp, Homo sapiens
ctgagttgaagagg

SEQ ID NO: 5887874 - DNA, 22 bp, Homo sapiens
ctgagttgaagtcatgctcccc

SEQ ID NO: 5887875 - DNA, 20 bp, Homo sapiens
ctgagttgacttgacagaac

SEQ ID NO: 5887876 - DNA, 16 bp, Homo sapiens
ctgagttgaggggctt

SEQ ID NO: 5887877 - DNA, 14 bp, Homo sapiens
ctgagttgccaaga

SEQ ID NO: 5887878 - DNA, 20 bp, Homo sapiens
ctgagttgccaagacaaatc

SEQ ID NO: 5887879 - DNA, 20 bp, Homo sapiens
ctgagttggagctcattctg

SEQ ID NO: 5887880 - DNA, 21 bp, Homo sapiens
ctgagttggagctcattctgt

SEQ ID NO: 5887881 - DNA, 14 bp, Homo sapiens
ctgagttggcctgg

SEQ ID NO: 5887882 - DNA, 22 bp, Homo sapiens
ctgagttgggggtgtggctctg

SEQ ID NO: 5887883 - DNA, 14 bp, Homo sapiens
ctgagttgtataaa

SEQ ID NO: 5887884 - DNA, 15 bp, Homo sapiens
ctgagttgtataaaa

SEQ ID NO: 5887885 - DNA, 19 bp, Homo sapiens
ctgagttgtataaaagttg

SEQ ID NO: 5887886 - DNA, 16 bp, Homo sapiens
ctgagttgttctaaca

SEQ ID NO: 5887887 - DNA, 18 bp, Homo sapiens
ctgagtttaccatttgta

SEQ ID NO: 5887888 - DNA, 22 bp, Homo sapiens
ctgagtttaccatttgtaataa

SEQ ID NO: 5887889 - DNA, 17 bp, Homo sapiens
ctgagtttacgtggagg

SEQ ID NO: 5887890 - DNA, 18 bp, Homo sapiens
ctgagtttagtttttcac

SEQ ID NO: 5887891 - DNA, 18 bp, Homo sapiens
ctgagtttcattctcctg

SEQ ID NO: 5887892 - DNA, 20 bp, Homo sapiens
ctgagtttcattctcctgcc

SEQ ID NO: 5887893 - DNA, 21 bp, Homo sapiens
ctgagtttcattctcctgcct

SEQ ID NO: 5887894 - DNA, 19 bp, Homo sapiens
ctgagtttcctatgggaac

SEQ ID NO: 5887895 - DNA, 11 bp, Homo sapiens
ctgagtttcta

SEQ ID NO: 5887896 - DNA, 23 bp, Homo sapiens
ctgagtttgggttctctgctgtc

SEQ ID NO: 5887897 - DNA, 22 bp, Homo sapiens
ctgagttttagttggtctttcc

SEQ ID NO: 5887898 - DNA, 18 bp, Homo sapiens
ctgagttttccatggcag

SEQ ID NO: 5887899 - DNA, 21 bp, Homo sapiens
ctgagttttgatgctgtattt

SEQ ID NO: 5887900 - DNA, 14 bp, Homo sapiens
ctgagttttgtgtt

SEQ ID NO: 5887901 - DNA, 21 bp, Homo sapiens
ctgagttttgtgtttgttgta

SEQ ID NO: 5887902 - DNA, 15 bp, Homo sapiens
ctgagttttgttttg

SEQ ID NO: 5887903 - DNA, 22 bp, Homo sapiens
ctgagtttttaaaaatggacaa

SEQ ID NO: 5887904 - DNA, 17 bp, Homo sapiens
ctgagtttttcagatgt

SEQ ID NO: 5887905 - DNA, 19 bp, Homo sapiens
ctgataaaacaacagctcg

SEQ ID NO: 5887906 - DNA, 19 bp, Homo sapiens
ctgataaaaccatgtagaa

SEQ ID NO: 5887907 - DNA, 18 bp, Homo sapiens
ctgataaaagatggccat

SEQ ID NO: 5887908 - DNA, 13 bp, Homo sapiens
ctgataaaattgt

SEQ ID NO: 5887909 - DNA, 19 bp, Homo sapiens
ctgataaaattgtgatgtt

SEQ ID NO: 5887910 - DNA, 19 bp, Homo sapiens
ctgataaacacagaggttt

SEQ ID NO: 5887911 - DNA, 12 bp, Homo sapiens
ctgataaacatt

SEQ ID NO: 5887912 - DNA, 16 bp, Homo sapiens
ctgataaacctaatat

SEQ ID NO: 5887913 - DNA, 22 bp, Homo sapiens
ctgataaacctaatattcaatg

SEQ ID NO: 5887914 - DNA, 18 bp, Homo sapiens
ctgataaagcacagctgt

SEQ ID NO: 5887915 - DNA, 19 bp, Homo sapiens
ctgataaagttgagagaca

SEQ ID NO: 5887916 - DNA, 22 bp, Homo sapiens
ctgataaatattcacacttgaa

SEQ ID NO: 5887917 - DNA, 16 bp, Homo sapiens
ctgataacaacctgga

SEQ ID NO: 5887918 - DNA, 17 bp, Homo sapiens
ctgataacaacctggag

SEQ ID NO: 5887919 - DNA, 22 bp, Homo sapiens
ctgataacaacctggagaccag

SEQ ID NO: 5887920 - DNA, 18 bp, Homo sapiens
ctgataagaacccagggt

SEQ ID NO: 5887921 - DNA, 19 bp, Homo sapiens
ctgataagagaatcaacat

SEQ ID NO: 5887922 - DNA, 17 bp, Homo sapiens
ctgataaggaaacttta

SEQ ID NO: 5887923 - DNA, 13 bp, Homo sapiens
ctgataagggaga

SEQ ID NO: 5887924 - DNA, 14 bp, Homo sapiens
ctgataatcatttt

SEQ ID NO: 5887925 - DNA, 16 bp, Homo sapiens
ctgataatcattttga

SEQ ID NO: 5887926 - DNA, 17 bp, Homo sapiens
ctgataattgtgtattt

SEQ ID NO: 5887927 - DNA, 20 bp, Homo sapiens
ctgataatttattgtcttta

SEQ ID NO: 5887928 - DNA, 18 bp, Homo sapiens
ctgataattttaaattct

SEQ ID NO: 5887929 - DNA, 13 bp, Homo sapiens
ctgatacagcctt

SEQ ID NO: 5887930 - DNA, 16 bp, Homo sapiens
ctgatacataaaaatt

SEQ ID NO: 5887931 - DNA, 17 bp, Homo sapiens
ctgatacataactaaat

SEQ ID NO: 5887932 - DNA, 20 bp, Homo sapiens
ctgatacatctgtcagtgag

SEQ ID NO: 5887933 - DNA, 21 bp, Homo sapiens
ctgatacatctgtcagtgagt

SEQ ID NO: 5887934 - DNA, 18 bp, Homo sapiens
ctgataccaaagagacag

SEQ ID NO: 5887935 - DNA, 23 bp, Homo sapiens
ctgataccaaagagacagggccc

SEQ ID NO: 5887936 - DNA, 15 bp, Homo sapiens
ctgataccactgcac

SEQ ID NO: 5887937 - DNA, 19 bp, Homo sapiens
ctgataccatatgaatgaa

SEQ ID NO: 5887938 - DNA, 20 bp, Homo sapiens
ctgataccatatgaatgaaa

SEQ ID NO: 5887939 - DNA, 23 bp, Homo sapiens
ctgataccatatgaatgaaacat

SEQ ID NO: 5887940 - DNA, 15 bp, Homo sapiens
ctgatacccagagca

SEQ ID NO: 5887941 - DNA, 12 bp, Homo sapiens
ctgatacctgcc

SEQ ID NO: 5887942 - DNA, 13 bp, Homo sapiens
ctgatacgtgtat

SEQ ID NO: 5887943 - DNA, 15 bp, Homo sapiens
ctgatacgtgtatga

SEQ ID NO: 5887944 - DNA, 16 bp, Homo sapiens
ctgatactattcaatg

SEQ ID NO: 5887945 - DNA, 19 bp, Homo sapiens
ctgatactattcaatgcaa

SEQ ID NO: 5887946 - DNA, 20 bp, Homo sapiens
ctgatactattcaatgcaat

SEQ ID NO: 5887947 - DNA, 22 bp, Homo sapiens
ctgatactgggtacaagagcca

SEQ ID NO: 5887948 - DNA, 17 bp, Homo sapiens
ctgatacttagaccaaa

SEQ ID NO: 5887949 - DNA, 18 bp, Homo sapiens
ctgatactttagccatca

SEQ ID NO: 5887950 - DNA, 20 bp, Homo sapiens
ctgatactttgacagtgttt

SEQ ID NO: 5887951 - DNA, 22 bp, Homo sapiens
ctgatagaaatggtttcctctg

SEQ ID NO: 5887952 - DNA, 18 bp, Homo sapiens
ctgatagaattatttcac

SEQ ID NO: 5887953 - DNA, 15 bp, Homo sapiens
ctgatagacaccata

SEQ ID NO: 5887954 - DNA, 17 bp, Homo sapiens
ctgatagactttgtgaa

SEQ ID NO: 5887955 - DNA, 20 bp, Homo sapiens
ctgatagaggaagcctgatt

SEQ ID NO: 5887956 - DNA, 14 bp, Homo sapiens
ctgatagagtgatt

SEQ ID NO: 5887957 - DNA, 18 bp, Homo sapiens
ctgatagatatccttggc

SEQ ID NO: 5887958 - DNA, 23 bp, Homo sapiens
ctgatagcgttggaattaaaaca

SEQ ID NO: 5887959 - DNA, 17 bp, Homo sapiens
ctgatagcttacactga

SEQ ID NO: 5887960 - DNA, 20 bp, Homo sapiens
ctgatagcttacactgagga

SEQ ID NO: 5887961 - DNA, 14 bp, Homo sapiens
ctgataggaaaaga

SEQ ID NO: 5887962 - DNA, 18 bp, Homo sapiens
ctgataggagggggcggc

SEQ ID NO: 5887963 - DNA, 17 bp, Homo sapiens
ctgatagggatacatgc

SEQ ID NO: 5887964 - DNA, 20 bp, Homo sapiens
ctgatagggtttgtgacagg

SEQ ID NO: 5887965 - DNA, 15 bp, Homo sapiens
ctgatagtagtaaaa

SEQ ID NO: 5887966 - DNA, 22 bp, Homo sapiens
ctgatagtcctttttccaatgt

SEQ ID NO: 5887967 - DNA, 17 bp, Homo sapiens
ctgatagttactgttgt

SEQ ID NO: 5887968 - DNA, 19 bp, Homo sapiens
ctgatagttactgttgtga

SEQ ID NO: 5887969 - DNA, 21 bp, Homo sapiens
ctgatagttactgttgtgacc

SEQ ID NO: 5887970 - DNA, 22 bp, Homo sapiens
ctgatagttactgttgtgacct

SEQ ID NO: 5887971 - DNA, 13 bp, Homo sapiens
ctgatataatatc

SEQ ID NO: 5887972 - DNA, 18 bp, Homo sapiens
ctgatataatatcataat

SEQ ID NO: 5887973 - DNA, 15 bp, Homo sapiens
ctgatatatgtgttt

SEQ ID NO: 5887974 - DNA, 22 bp, Homo sapiens
ctgatatatgtgtttttcacat

SEQ ID NO: 5887975 - DNA, 16 bp, Homo sapiens
ctgatatattttccag

SEQ ID NO: 5887976 - DNA, 14 bp, Homo sapiens
ctgatatcaacagc

SEQ ID NO: 5887977 - DNA, 21 bp, Homo sapiens
ctgatatccaacagaaagcat

SEQ ID NO: 5887978 - DNA, 22 bp, Homo sapiens
ctgatatctgtttgcttctaaa

SEQ ID NO: 5887979 - DNA, 21 bp, Homo sapiens
ctgatatctttgagggctgac

SEQ ID NO: 5887980 - DNA, 16 bp, Homo sapiens
ctgatatgatttaaaa

SEQ ID NO: 5887981 - DNA, 19 bp, Homo sapiens
ctgatatgatttaaaacat

SEQ ID NO: 5887982 - DNA, 17 bp, Homo sapiens
ctgatatgctgagaaat

SEQ ID NO: 5887983 - DNA, 19 bp, Homo sapiens
ctgatatgctgagaaatta

SEQ ID NO: 5887984 - DNA, 13 bp, Homo sapiens
ctgatatgggact

SEQ ID NO: 5887985 - DNA, 15 bp, Homo sapiens
ctgatatgggactga

SEQ ID NO: 5887986 - DNA, 16 bp, Homo sapiens
ctgatatgggactgag

SEQ ID NO: 5887987 - DNA, 23 bp, Homo sapiens
ctgatatgtctagggtgtgattt

SEQ ID NO: 5887988 - DNA, 13 bp, Homo sapiens
ctgatatgtttgt

SEQ ID NO: 5887989 - DNA, 16 bp, Homo sapiens
ctgatattaatcaaaa

SEQ ID NO: 5887990 - DNA, 17 bp, Homo sapiens
ctgatattaatcaaaat

SEQ ID NO: 5887991 - DNA, 21 bp, Homo sapiens
ctgatattaatcaaaattgtc

SEQ ID NO: 5887992 - DNA, 16 bp, Homo sapiens
ctgatattatttcttc

SEQ ID NO: 5887993 - DNA, 17 bp, Homo sapiens
ctgatattatttcttct

SEQ ID NO: 5887994 - DNA, 20 bp, Homo sapiens
ctgatattcaaatggacaaa

SEQ ID NO: 5887995 - DNA, 17 bp, Homo sapiens
ctgatattcagaattat

SEQ ID NO: 5887996 - DNA, 18 bp, Homo sapiens
ctgatattccatgaatgt

SEQ ID NO: 5887997 - DNA, 15 bp, Homo sapiens
ctgatatttatagaa

SEQ ID NO: 5887998 - DNA, 22 bp, Homo sapiens
ctgatatttccctcccctgggg

SEQ ID NO: 5887999 - DNA, 17 bp, Homo sapiens
ctgatatttgctggagt

SEQ ID NO: 5888000 - DNA, 14 bp, Homo sapiens
ctgatattttctct

SEQ ID NO: 5888001 - DNA, 16 bp, Homo sapiens
ctgatattttctctag

SEQ ID NO: 5888002 - DNA, 15 bp, Homo sapiens
ctgatcaaagcacct

SEQ ID NO: 5888003 - DNA, 21 bp, Homo sapiens
ctgatcaaattggctacaatc

SEQ ID NO: 5888004 - DNA, 23 bp, Homo sapiens
ctgatcaagagtccggatttcta

SEQ ID NO: 5888005 - DNA, 23 bp, Homo sapiens
ctgatcaagcatggaacaaagca

SEQ ID NO: 5888006 - DNA, 23 bp, Homo sapiens
ctgatcaaggtgctcttctcatt

SEQ ID NO: 5888007 - DNA, 23 bp, Homo sapiens
ctgatcaatctgcagtttgtgaa

SEQ ID NO: 5888008 - DNA, 18 bp, Homo sapiens
ctgatcacaacttttctg

SEQ ID NO: 5888009 - DNA, 22 bp, Homo sapiens
ctgatcactagcctgtcatcct

SEQ ID NO: 5888010 - DNA, 20 bp, Homo sapiens
ctgatcactatgcattttaa

SEQ ID NO: 5888011 - DNA, 15 bp, Homo sapiens
ctgatcactcccagc

SEQ ID NO: 5888012 - DNA, 16 bp, Homo sapiens
ctgatcactcccagca

SEQ ID NO: 5888013 - DNA, 14 bp, Homo sapiens
ctgatcacttcatg

SEQ ID NO: 5888014 - DNA, 18 bp, Homo sapiens
ctgatcagaattttacca

SEQ ID NO: 5888015 - DNA, 17 bp, Homo sapiens
ctgatcagaccacggct

SEQ ID NO: 5888016 - DNA, 12 bp, Homo sapiens
ctgatcagaggc

SEQ ID NO: 5888017 - DNA, 22 bp, Homo sapiens
ctgatcagaggtgtacactaac

SEQ ID NO: 5888018 - DNA, 18 bp, Homo sapiens
ctgatcagcaggagccaa

SEQ ID NO: 5888019 - DNA, 18 bp, Homo sapiens
ctgatcaggacctccaag

SEQ ID NO: 5888020 - DNA, 18 bp, Homo sapiens
ctgatcaggcttcctggt

SEQ ID NO: 5888021 - DNA, 22 bp, Homo sapiens
ctgatcagtgggcctccaagga

SEQ ID NO: 5888022 - DNA, 16 bp, Homo sapiens
ctgatcatccaggcct

SEQ ID NO: 5888023 - DNA, 19 bp, Homo sapiens
ctgatcatccaggcctcag

SEQ ID NO: 5888024 - DNA, 14 bp, Homo sapiens
ctgatcatctgctg

SEQ ID NO: 5888025 - DNA, 16 bp, Homo sapiens
ctgatcatctgctgtg

SEQ ID NO: 5888026 - DNA, 14 bp, Homo sapiens
ctgatcatgcattg

SEQ ID NO: 5888027 - DNA, 17 bp, Homo sapiens
ctgatcattagagaaat

SEQ ID NO: 5888028 - DNA, 19 bp, Homo sapiens
ctgatcattctgttttttc

SEQ ID NO: 5888029 - DNA, 20 bp, Homo sapiens
ctgatcatttgcagctgctg

SEQ ID NO: 5888030 - DNA, 15 bp, Homo sapiens
ctgatccagagcaca

SEQ ID NO: 5888031 - DNA, 14 bp, Homo sapiens
ctgatccagccttt

SEQ ID NO: 5888032 - DNA, 20 bp, Homo sapiens
ctgatccagcctttccaagt

SEQ ID NO: 5888033 - DNA, 20 bp, Homo sapiens
ctgatccagtaacctcggag

SEQ ID NO: 5888034 - DNA, 16 bp, Homo sapiens
ctgatccatccatctc

SEQ ID NO: 5888035 - DNA, 22 bp, Homo sapiens
ctgatccatccatctctctctt

SEQ ID NO: 5888036 - DNA, 18 bp, Homo sapiens
ctgatcccaccccctcct

SEQ ID NO: 5888037 - DNA, 12 bp, Homo sapiens
ctgatcccactc

SEQ ID NO: 5888038 - DNA, 18 bp, Homo sapiens
ctgatcccagacccattc

SEQ ID NO: 5888039 - DNA, 18 bp, Homo sapiens
ctgatcccagtttctgct

SEQ ID NO: 5888040 - DNA, 17 bp, Homo sapiens
ctgatcccataaagaaa

SEQ ID NO: 5888041 - DNA, 17 bp, Homo sapiens
ctgatcccatggccagg

SEQ ID NO: 5888042 - DNA, 23 bp, Homo sapiens
ctgatccccaagacatgtggagg

SEQ ID NO: 5888043 - DNA, 19 bp, Homo sapiens
ctgatccccatgcctagca

SEQ ID NO: 5888044 - DNA, 22 bp, Homo sapiens
ctgatcccctttggttttacta

SEQ ID NO: 5888045 - DNA, 20 bp, Homo sapiens
ctgatcccggccggccctgg

SEQ ID NO: 5888046 - DNA, 23 bp, Homo sapiens
ctgatcccggccggccctggctt

SEQ ID NO: 5888047 - DNA, 12 bp, Homo sapiens
ctgatccctcta

SEQ ID NO: 5888048 - DNA, 11 bp, Homo sapiens
ctgatccctgc

SEQ ID NO: 5888049 - DNA, 15 bp, Homo sapiens
ctgatccctgctctc

SEQ ID NO: 5888050 - DNA, 16 bp, Homo sapiens
ctgatccctggccact

SEQ ID NO: 5888051 - DNA, 21 bp, Homo sapiens
ctgatcccttccacctgctct

SEQ ID NO: 5888052 - DNA, 19 bp, Homo sapiens
ctgatccggctgctcctcc

SEQ ID NO: 5888053 - DNA, 19 bp, Homo sapiens
ctgatccgtccgaggctgc

SEQ ID NO: 5888054 - DNA, 18 bp, Homo sapiens
ctgatcctaaccctgggc

SEQ ID NO: 5888055 - DNA, 21 bp, Homo sapiens
ctgatcctaaccctgggctcc

SEQ ID NO: 5888056 - DNA, 20 bp, Homo sapiens
ctgatcctaagaatttttca

SEQ ID NO: 5888057 - DNA, 20 bp, Homo sapiens
ctgatcctagttccaccatc

SEQ ID NO: 5888058 - DNA, 18 bp, Homo sapiens
ctgatttcaaatgcagtc

SEQ ID NO: 5888059 - DNA, 13 bp, Homo sapiens
ctgatttcacaac

SEQ ID NO: 5888060 - DNA, 15 bp, Homo sapiens
ctgatttcagttttt

SEQ ID NO: 5888061 - DNA, 21 bp, Homo sapiens
ctgatttcagtttttcatttg

SEQ ID NO: 5888062 - DNA, 13 bp, Homo sapiens
ctgatttcataat

SEQ ID NO: 5888063 - DNA, 19 bp, Homo sapiens
ctgatttcataattcagaa

SEQ ID NO: 5888064 - DNA, 23 bp, Homo sapiens
ctgatttcattacatttctgaat

SEQ ID NO: 5888065 - DNA, 18 bp, Homo sapiens
ctgatttccaggcccctg

SEQ ID NO: 5888066 - DNA, 15 bp, Homo sapiens
ctgatttcccctttt

SEQ ID NO: 5888067 - DNA, 12 bp, Homo sapiens
ctgatttccctt

SEQ ID NO: 5888068 - DNA, 13 bp, Homo sapiens
ctgatttcccttt

SEQ ID NO: 5888069 - DNA, 14 bp, Homo sapiens
ctgatttccctttt

SEQ ID NO: 5888070 - DNA, 14 bp, Homo sapiens
ctgatttccttcca

SEQ ID NO: 5888071 - DNA, 19 bp, Homo sapiens
ctgatttctagtgtatact

SEQ ID NO: 5888072 - DNA, 20 bp, Homo sapiens
ctgatttctatggctttcaa

SEQ ID NO: 5888073 - DNA, 22 bp, Homo sapiens
ctgatttctatggctttcaaag

SEQ ID NO: 5888074 - DNA, 13 bp, Homo sapiens
ctgatttcttcag

SEQ ID NO: 5888075 - DNA, 14 bp, Homo sapiens
ctgatttcttgctt

SEQ ID NO: 5888076 - DNA, 13 bp, Homo sapiens
ctgatttgagttt

SEQ ID NO: 5888077 - DNA, 16 bp, Homo sapiens
ctgatttgatatagat

SEQ ID NO: 5888078 - DNA, 11 bp, Homo sapiens
ctgatttgcaa

SEQ ID NO: 5888079 - DNA, 22 bp, Homo sapiens
ctgatttgcaataaaaatgata

SEQ ID NO: 5888080 - DNA, 17 bp, Homo sapiens
ctgatttgccactgata

SEQ ID NO: 5888081 - DNA, 21 bp, Homo sapiens
ctgatttgctgggcagttttt

SEQ ID NO: 5888082 - DNA, 14 bp, Homo sapiens
ctgatttggaaaaa

SEQ ID NO: 5888083 - DNA, 20 bp, Homo sapiens
ctgatttggccgttttgtga

SEQ ID NO: 5888084 - DNA, 20 bp, Homo sapiens
ctgatttgggctgaatgtat

SEQ ID NO: 5888085 - DNA, 14 bp, Homo sapiens
ctgatttggtactt

SEQ ID NO: 5888086 - DNA, 18 bp, Homo sapiens
ctgatttgtaacccactg

SEQ ID NO: 5888087 - DNA, 15 bp, Homo sapiens
ctgattttaaaactt

SEQ ID NO: 5888088 - DNA, 13 bp, Homo sapiens
ctgattttaaaat

SEQ ID NO: 5888089 - DNA, 22 bp, Homo sapiens
ctgattttaatgaaatcaaatg

SEQ ID NO: 5888090 - DNA, 23 bp, Homo sapiens
ctgattttaatggattgttaatt

SEQ ID NO: 5888091 - DNA, 22 bp, Homo sapiens
ctgattttacaaattaatattt

SEQ ID NO: 5888092 - DNA, 15 bp, Homo sapiens
ctgattttattcttg

SEQ ID NO: 5888093 - DNA, 21 bp, Homo sapiens
ctgattttcaaagctttttcc

SEQ ID NO: 5888094 - DNA, 22 bp, Homo sapiens
ctgattttctccacaacactgt

SEQ ID NO: 5888095 - DNA, 16 bp, Homo sapiens
ctgattttgaggttta

SEQ ID NO: 5888096 - DNA, 22 bp, Homo sapiens
ctgattttggtttattccctcc

SEQ ID NO: 5888097 - DNA, 18 bp, Homo sapiens
ctgattttgtagttaatt

SEQ ID NO: 5888098 - DNA, 15 bp, Homo sapiens
ctgattttgtatgta

SEQ ID NO: 5888099 - DNA, 18 bp, Homo sapiens
ctgattttgtcactgtct

SEQ ID NO: 5888100 - DNA, 19 bp, Homo sapiens
ctgattttgtcactgtctt

SEQ ID NO: 5888101 - DNA, 14 bp, Homo sapiens
ctgatttttaagat

SEQ ID NO: 5888102 - DNA, 16 bp, Homo sapiens
ctgatttttcctttcg

SEQ ID NO: 5888103 - DNA, 13 bp, Homo sapiens
ctgatttttctct

SEQ ID NO: 5888104 - DNA, 24 bp, Homo sapiens
ctgattttttactggctgtgtgac

SEQ ID NO: 5888105 - DNA, 20 bp, Homo sapiens
ctgattttttgaggccagta

SEQ ID NO: 5888106 - DNA, 21 bp, Homo sapiens
ctgattttttttgtagctgct

SEQ ID NO: 5888107 - DNA, 18 bp, Homo sapiens
ctgatttttttttccttc

SEQ ID NO: 5888108 - DNA, 19 bp, Homo sapiens
ctgatttttttttccttca

SEQ ID NO: 5888109 - DNA, 21 bp, Homo sapiens
ctgatttttttttccttcagt

SEQ ID NO: 5888110 - DNA, 17 bp, Homo sapiens
ctgcaaaaaaagcctcc

SEQ ID NO: 5888111 - DNA, 22 bp, Homo sapiens
ctgcaaaaaaagcctccaaggg

SEQ ID NO: 5888112 - DNA, 14 bp, Homo sapiens
ctgcaaaaagaaaa

SEQ ID NO: 5888113 - DNA, 19 bp, Homo sapiens
ctgcaaaaagatttaacaa

SEQ ID NO: 5888114 - DNA, 17 bp, Homo sapiens
ctgcaaaaatatttata

SEQ ID NO: 5888115 - DNA, 12 bp, Homo sapiens
ctgcaaaaatga

SEQ ID NO: 5888116 - DNA, 15 bp, Homo sapiens
ctgcaaaactccagg

SEQ ID NO: 5888117 - DNA, 17 bp, Homo sapiens
ctgcaaaactccaggca

SEQ ID NO: 5888118 - DNA, 15 bp, Homo sapiens
ctgcaaaactggaag

SEQ ID NO: 5888119 - DNA, 15 bp, Homo sapiens
ctgcaaaaggcctct

SEQ ID NO: 5888120 - DNA, 15 bp, Homo sapiens
ctgcaaaaggcctgt

SEQ ID NO: 5888121 - DNA, 13 bp, Homo sapiens
ctgcaaaatctgt

SEQ ID NO: 5888122 - DNA, 17 bp, Homo sapiens
ctgcaaaatgaagacac

SEQ ID NO: 5888123 - DNA, 19 bp, Homo sapiens
ctgcaaaatgaggaatgta

SEQ ID NO: 5888124 - DNA, 15 bp, Homo sapiens
ctgcaaaattaaatc

SEQ ID NO: 5888125 - DNA, 15 bp, Homo sapiens
ctgcaaacaataaac

SEQ ID NO: 5888126 - DNA, 16 bp, Homo sapiens
ctgcaaacacaccttg

SEQ ID NO: 5888127 - DNA, 22 bp, Homo sapiens
ctgcaaacacaccttggagaag

SEQ ID NO: 5888128 - DNA, 22 bp, Homo sapiens
ctgcaaacaccaacatgttggg

SEQ ID NO: 5888129 - DNA, 14 bp, Homo sapiens
ctgcaaacagaaat

SEQ ID NO: 5888130 - DNA, 15 bp, Homo sapiens
ctgcaaacagaaatc

SEQ ID NO: 5888131 - DNA, 21 bp, Homo sapiens
ctgcaaacagaacagggtcat

SEQ ID NO: 5888132 - DNA, 22 bp, Homo sapiens
ctgcaaacccatgaagctggcc

SEQ ID NO: 5888133 - DNA, 17 bp, Homo sapiens
ctgcaaaccttcctggg

SEQ ID NO: 5888134 - DNA, 19 bp, Homo sapiens
ctgcaaaccttcctgggag

SEQ ID NO: 5888135 - DNA, 16 bp, Homo sapiens
ctgcaaacgctgcctg

SEQ ID NO: 5888136 - DNA, 17 bp, Homo sapiens
ctgcaaacgctgcctgc

SEQ ID NO: 5888137 - DNA, 19 bp, Homo sapiens
ctgcaaacgctgcctgccg

SEQ ID NO: 5888138 - DNA, 14 bp, Homo sapiens
ctgcaaagacagta

SEQ ID NO: 5888139 - DNA, 22 bp, Homo sapiens
ctgcaaagacagtatttattgg

SEQ ID NO: 5888140 - DNA, 22 bp, Homo sapiens
ctgcaaagatctgtcctcagcc

SEQ ID NO: 5888141 - DNA, 23 bp, Homo sapiens
ctgcaaagatctgtcctcagcct

SEQ ID NO: 5888142 - DNA, 13 bp, Homo sapiens
ctgcaaagcatgt

SEQ ID NO: 5888143 - DNA, 14 bp, Homo sapiens
ctgcaaaggacaga

SEQ ID NO: 5888144 - DNA, 15 bp, Homo sapiens
ctgcaaaggagaagc

SEQ ID NO: 5888145 - DNA, 14 bp, Homo sapiens
ctgcaaaggccctt

SEQ ID NO: 5888146 - DNA, 13 bp, Homo sapiens
ctgcaaaggcctg

SEQ ID NO: 5888147 - DNA, 21 bp, Homo sapiens
ctgcaaaggcctgggctggcc

SEQ ID NO: 5888148 - DNA, 23 bp, Homo sapiens
ctgcaaaggtggcaatgcttaaa

SEQ ID NO: 5888149 - DNA, 23 bp, Homo sapiens
ctgcaaagtacaggtactttgtc

SEQ ID NO: 5888150 - DNA, 13 bp, Homo sapiens
ctgcaaagtggca

SEQ ID NO: 5888151 - DNA, 17 bp, Homo sapiens
ctgcaaagtggcaggga

SEQ ID NO: 5888152 - DNA, 23 bp, Homo sapiens
ctgcaaagtgttttgtaccagtg

SEQ ID NO: 5888153 - DNA, 21 bp, Homo sapiens
ctgcaaataaggacagcagct

SEQ ID NO: 5888154 - DNA, 22 bp, Homo sapiens
ctgcaaataaggacagcagctg

SEQ ID NO: 5888155 - DNA, 23 bp, Homo sapiens
ctgcaaataaggacagcagctgg

SEQ ID NO: 5888156 - DNA, 20 bp, Homo sapiens
ctgcaaatagaaaacaggaa

SEQ ID NO: 5888157 - DNA, 14 bp, Homo sapiens
ctgcaaatagtttc

SEQ ID NO: 5888158 - DNA, 22 bp, Homo sapiens
ctgcaaatattagcaaagaagc

SEQ ID NO: 5888159 - DNA, 15 bp, Homo sapiens
ctgcaaatctagtgc

SEQ ID NO: 5888160 - DNA, 18 bp, Homo sapiens
ctgcaaatggcagtttta

SEQ ID NO: 5888161 - DNA, 21 bp, Homo sapiens
ctgcaaatttagtttgttaaa

SEQ ID NO: 5888162 - DNA, 14 bp, Homo sapiens
ctgcaacaaaaagt

SEQ ID NO: 5888163 - DNA, 21 bp, Homo sapiens
ctgcaacaaaatgtagaatat

SEQ ID NO: 5888164 - DNA, 21 bp, Homo sapiens
ctgcaacacaacatttgtgtc

SEQ ID NO: 5888165 - DNA, 19 bp, Homo sapiens
ctgcaacagagagaaaaag

SEQ ID NO: 5888166 - DNA, 14 bp, Homo sapiens
ctgcaacagcctgt

SEQ ID NO: 5888167 - DNA, 19 bp, Homo sapiens
ctgcaacatacaggtgcct

SEQ ID NO: 5888168 - DNA, 17 bp, Homo sapiens
ctgcaacatttgacaaa

SEQ ID NO: 5888169 - DNA, 21 bp, Homo sapiens
ctgcaaccactctgtggccag

SEQ ID NO: 5888170 - DNA, 15 bp, Homo sapiens
ctgcaacccatgagc

SEQ ID NO: 5888171 - DNA, 20 bp, Homo sapiens
ctgcaacctccacctcctga

SEQ ID NO: 5888172 - DNA, 21 bp, Homo sapiens
ctgcaacctccacctcctgag

SEQ ID NO: 5888173 - DNA, 17 bp, Homo sapiens
ctgcaacctctgcctcc

SEQ ID NO: 5888174 - DNA, 18 bp, Homo sapiens
ctgcaacctctgcctccc

SEQ ID NO: 5888175 - DNA, 20 bp, Homo sapiens
ctgcaacctctgcctcccgg

SEQ ID NO: 5888176 - DNA, 22 bp, Homo sapiens
ctgcaacctctgcctcctgggt

SEQ ID NO: 5888177 - DNA, 18 bp, Homo sapiens
ctgcaacctcttcctcct

SEQ ID NO: 5888178 - DNA, 14 bp, Homo sapiens
ctgcaacctgattg

SEQ ID NO: 5888179 - DNA, 21 bp, Homo sapiens
ctgcaacctgattgtgtctct

SEQ ID NO: 5888180 - DNA, 22 bp, Homo sapiens
ctgcaacctgattgtgtctctt

SEQ ID NO: 5888181 - DNA, 15 bp, Homo sapiens
ctgcaacctgttgat

SEQ ID NO: 5888182 - DNA, 17 bp, Homo sapiens
ctgcaaccttcgccacc

SEQ ID NO: 5888183 - DNA, 21 bp, Homo sapiens
ctgcaactagccaaggctagt

SEQ ID NO: 5888184 - DNA, 15 bp, Homo sapiens
ctgcaactccatcct

SEQ ID NO: 5888185 - DNA, 20 bp, Homo sapiens
ctgcaacttccgcctcctgt

SEQ ID NO: 5888186 - DNA, 16 bp, Homo sapiens
ctgcaacttccgctga

SEQ ID NO: 5888187 - DNA, 17 bp, Homo sapiens
ctgcaacttccgctgag

SEQ ID NO: 5888188 - DNA, 19 bp, Homo sapiens
ctgcaacttccgctgaggg

SEQ ID NO: 5888189 - DNA, 23 bp, Homo sapiens
ctgcaacttccgctgaggggtct

SEQ ID NO: 5888190 - DNA, 21 bp, Homo sapiens
ctgcaagaaaatgatgtgtac

SEQ ID NO: 5888191 - DNA, 19 bp, Homo sapiens
ctgcaagaaaggggaccca

SEQ ID NO: 5888192 - DNA, 18 bp, Homo sapiens
ctgcaagaactgttttta

SEQ ID NO: 5888193 - DNA, 22 bp, Homo sapiens
ctgcaagaagcgccgactccct

SEQ ID NO: 5888194 - DNA, 20 bp, Homo sapiens
ctgcaagaattaaaactgag

SEQ ID NO: 5888195 - DNA, 22 bp, Homo sapiens
ctgcaagacacaggctcagcat

SEQ ID NO: 5888196 - DNA, 13 bp, Homo sapiens
ctgcaagaccacg

SEQ ID NO: 5888197 - DNA, 21 bp, Homo sapiens
ctgcaagaccacggagggagc

SEQ ID NO: 5888198 - DNA, 22 bp, Homo sapiens
ctgcaagaccacggagggagcg

SEQ ID NO: 5888199 - DNA, 21 bp, Homo sapiens
ctgcaagagatggaaaaaaag

SEQ ID NO: 5888200 - DNA, 15 bp, Homo sapiens
ctgcaagagccaagt

SEQ ID NO: 5888201 - DNA, 17 bp, Homo sapiens
ctgcaagagcccagatc

SEQ ID NO: 5888202 - DNA, 17 bp, Homo sapiens
ctgcaagagccttggtg

SEQ ID NO: 5888203 - DNA, 19 bp, Homo sapiens
ctgcaagagccttggtgtc

SEQ ID NO: 5888204 - DNA, 21 bp, Homo sapiens
ctgcaagagccttggtgtcca

SEQ ID NO: 5888205 - DNA, 23 bp, Homo sapiens
ctgcaagagtgggctttccaggg

SEQ ID NO: 5888206 - DNA, 22 bp, Homo sapiens
ctgcaagatggacacgagccac

SEQ ID NO: 5888207 - DNA, 20 bp, Homo sapiens
ctgcaagattctgaaacatt

SEQ ID NO: 5888208 - DNA, 15 bp, Homo sapiens
ctgcaagattctgtg

SEQ ID NO: 5888209 - DNA, 14 bp, Homo sapiens
ctgcaagcagaact

SEQ ID NO: 5888210 - DNA, 19 bp, Homo sapiens
ctgcaagcagggctctgcc

SEQ ID NO: 5888211 - DNA, 14 bp, Homo sapiens
ctgcaagccaggga

SEQ ID NO: 5888212 - DNA, 22 bp, Homo sapiens
ctgcaagcccacctcggccctc

SEQ ID NO: 5888213 - DNA, 14 bp, Homo sapiens
ctgcaagccccagg

SEQ ID NO: 5888214 - DNA, 19 bp, Homo sapiens
ctgcaagccccagggcctg

SEQ ID NO: 5888215 - DNA, 20 bp, Homo sapiens
ctgcaagccccagggcctgg

SEQ ID NO: 5888216 - DNA, 22 bp, Homo sapiens
ctgcaagcccgttaaataattc

SEQ ID NO: 5888217 - DNA, 13 bp, Homo sapiens
ctgcaagcctgcg

SEQ ID NO: 5888218 - DNA, 14 bp, Homo sapiens
ctgcaagcctgcgt

SEQ ID NO: 5888219 - DNA, 22 bp, Homo sapiens
ctgcaagctccgcctcccgggt

SEQ ID NO: 5888220 - DNA, 14 bp, Homo sapiens
ctgcaagctctgcc

SEQ ID NO: 5888221 - DNA, 16 bp, Homo sapiens
ctgcaagctctgcctc

SEQ ID NO: 5888222 - DNA, 19 bp, Homo sapiens
ctgcaagctctgcctcccg

SEQ ID NO: 5888223 - DNA, 22 bp, Homo sapiens
ctgcaagctctgcctcccgggt

SEQ ID NO: 5888224 - DNA, 20 bp, Homo sapiens
ctgcaagctctgcctcccgt

SEQ ID NO: 5888225 - DNA, 19 bp, Homo sapiens
ctgcaaggattttttaaaa

SEQ ID NO: 5888226 - DNA, 13 bp, Homo sapiens
ctgcaaggcccac

SEQ ID NO: 5888227 - DNA, 18 bp, Homo sapiens
ctgcaaggcccacaggag

SEQ ID NO: 5888228 - DNA, 17 bp, Homo sapiens
ctgcaaggcctttctgt

SEQ ID NO: 5888229 - DNA, 20 bp, Homo sapiens
ctgcaaggcctttctgtgtg

SEQ ID NO: 5888230 - DNA, 12 bp, Homo sapiens
ctgcaagggaca

SEQ ID NO: 5888231 - DNA, 16 bp, Homo sapiens
ctgcaagggcccagag

SEQ ID NO: 5888232 - DNA, 17 bp, Homo sapiens
ctgcaagggctccccac

SEQ ID NO: 5888233 - DNA, 17 bp, Homo sapiens
ctgcaaggtactctggt

SEQ ID NO: 5888234 - DNA, 21 bp, Homo sapiens
ctgcaccccttcctgggcaca

SEQ ID NO: 5888235 - DNA, 21 bp, Homo sapiens
ctgcaccccttctctcctccc

SEQ ID NO: 5888236 - DNA, 17 bp, Homo sapiens
ctgcacccgcctcgacc

SEQ ID NO: 5888237 - DNA, 16 bp, Homo sapiens
ctgcacccgtaccccc

SEQ ID NO: 5888238 - DNA, 13 bp, Homo sapiens
ctgcaccctcagg

SEQ ID NO: 5888239 - DNA, 20 bp, Homo sapiens
ctgcaccctccacaggagcc

SEQ ID NO: 5888240 - DNA, 16 bp, Homo sapiens
ctgcaccctccaccct

SEQ ID NO: 5888241 - DNA, 17 bp, Homo sapiens
ctgcaccctccaccctg

SEQ ID NO: 5888242 - DNA, 18 bp, Homo sapiens
ctgcaccctccaccctgt

SEQ ID NO: 5888243 - DNA, 20 bp, Homo sapiens
ctgcaccctccaccctgtcc

SEQ ID NO: 5888244 - DNA, 13 bp, Homo sapiens
ctgcaccctctgc

SEQ ID NO: 5888245 - DNA, 16 bp, Homo sapiens
ctgcaccctctgctat

SEQ ID NO: 5888246 - DNA, 21 bp, Homo sapiens
ctgcaccctcttctcctctgg

SEQ ID NO: 5888247 - DNA, 14 bp, Homo sapiens
ctgcaccctgcgcc

SEQ ID NO: 5888248 - DNA, 17 bp, Homo sapiens
ctgcaccctgcgcctcc

SEQ ID NO: 5888249 - DNA, 20 bp, Homo sapiens
ctgcaccctggatttgcata

SEQ ID NO: 5888250 - DNA, 14 bp, Homo sapiens
ctgcacccttccac

SEQ ID NO: 5888251 - DNA, 14 bp, Homo sapiens
ctgcacccttcctc

SEQ ID NO: 5888252 - DNA, 20 bp, Homo sapiens
ctgcacccttcctcctcctt

SEQ ID NO: 5888253 - DNA, 14 bp, Homo sapiens
ctgcacccttcttt

SEQ ID NO: 5888254 - DNA, 18 bp, Homo sapiens
ctgcacccttcttttctc

SEQ ID NO: 5888255 - DNA, 19 bp, Homo sapiens
ctgcaccgaccccgggccg

SEQ ID NO: 5888256 - DNA, 18 bp, Homo sapiens
ctgcaccgacccgaggcc

SEQ ID NO: 5888257 - DNA, 19 bp, Homo sapiens
ctgcaccgacccgaggccc

SEQ ID NO: 5888258 - DNA, 21 bp, Homo sapiens
ctgcaccgacccgaggcccag

SEQ ID NO: 5888259 - DNA, 22 bp, Homo sapiens
ctgcaccgacgcctgcccccgt

SEQ ID NO: 5888260 - DNA, 19 bp, Homo sapiens
ctgcaccgccgcagaagca

SEQ ID NO: 5888261 - DNA, 21 bp, Homo sapiens
ctgcaccgccgcagaagcagc

SEQ ID NO: 5888262 - DNA, 20 bp, Homo sapiens
ctgcaccgcggcgcctccgc

SEQ ID NO: 5888263 - DNA, 19 bp, Homo sapiens
ctgcaccggctggcctggc

SEQ ID NO: 5888264 - DNA, 12 bp, Homo sapiens
ctgcaccgggcc

SEQ ID NO: 5888265 - DNA, 14 bp, Homo sapiens
ctgcaccgggccac

SEQ ID NO: 5888266 - DNA, 14 bp, Homo sapiens
ctgcaccggggcct

SEQ ID NO: 5888267 - DNA, 16 bp, Homo sapiens
ctgcaccggggcctgg

SEQ ID NO: 5888268 - DNA, 19 bp, Homo sapiens
ctgcaccggggcctgggca

SEQ ID NO: 5888269 - DNA, 17 bp, Homo sapiens
ctgcaccgtactgtgga

SEQ ID NO: 5888270 - DNA, 15 bp, Homo sapiens
ctgcaccgtctcact

SEQ ID NO: 5888271 - DNA, 18 bp, Homo sapiens
ctgcacctagaacctccc

SEQ ID NO: 5888272 - DNA, 21 bp, Homo sapiens
ctgcacctccccccactgcag

SEQ ID NO: 5888273 - DNA, 14 bp, Homo sapiens
ctgcacctccgctt

SEQ ID NO: 5888274 - DNA, 16 bp, Homo sapiens
ctgcacctcctaccct

SEQ ID NO: 5888275 - DNA, 13 bp, Homo sapiens
ctgcacctctcca

SEQ ID NO: 5888276 - DNA, 15 bp, Homo sapiens
ctgcacctctggcta

SEQ ID NO: 5888277 - DNA, 22 bp, Homo sapiens
ctgcacctctggctagagccga

SEQ ID NO: 5888278 - DNA, 24 bp, Homo sapiens
ctgcacctctggctagagccgagg

SEQ ID NO: 5888279 - DNA, 13 bp, Homo sapiens
ctgcacctgaggc

SEQ ID NO: 5888280 - DNA, 17 bp, Homo sapiens
ctgcacctgaggcccag

SEQ ID NO: 5888281 - DNA, 18 bp, Homo sapiens
ctgcacctgaggcccagc

SEQ ID NO: 5888282 - DNA, 11 bp, Homo sapiens
ctgcacctgca

SEQ ID NO: 5888283 - DNA, 13 bp, Homo sapiens
ctgcacctgcagg

SEQ ID NO: 5888284 - DNA, 14 bp, Homo sapiens
ctgcacctgcaggg

SEQ ID NO: 5888285 - DNA, 17 bp, Homo sapiens
ctgcacctgcagggagc

SEQ ID NO: 5888286 - DNA, 23 bp, Homo sapiens
ctgcacctgcagggagcagcacg

SEQ ID NO: 5888287 - DNA, 13 bp, Homo sapiens
ctgcacctgccag

SEQ ID NO: 5888288 - DNA, 17 bp, Homo sapiens
ctgcacctgccagcctg

SEQ ID NO: 5888289 - DNA, 16 bp, Homo sapiens
ctgcacctgcccagct

SEQ ID NO: 5888290 - DNA, 14 bp, Homo sapiens
ctgcacctgcctcc

SEQ ID NO: 5888291 - DNA, 16 bp, Homo sapiens
ctgcacctgcctccag

SEQ ID NO: 5888292 - DNA, 15 bp, Homo sapiens
ctgcacctgcctgcc

SEQ ID NO: 5888293 - DNA, 18 bp, Homo sapiens
ctgcacctgcctgccgct

SEQ ID NO: 5888294 - DNA, 14 bp, Homo sapiens
ctgcacctgctgcg

SEQ ID NO: 5888295 - DNA, 21 bp, Homo sapiens
ctgcacctgctgcgtccccac

SEQ ID NO: 5888296 - DNA, 12 bp, Homo sapiens
ctgcacctggcc

SEQ ID NO: 5888297 - DNA, 18 bp, Homo sapiens
ctgcacctgggcagctcc

SEQ ID NO: 5888298 - DNA, 19 bp, Homo sapiens
ctgcacctgggcagctcct

SEQ ID NO: 5888299 - DNA, 23 bp, Homo sapiens
ctgcacctggtgggtggtgtcct

SEQ ID NO: 5888300 - DNA, 21 bp, Homo sapiens
ctgcacctgtctcatagcctc

SEQ ID NO: 5888301 - DNA, 23 bp, Homo sapiens
ctgcacctgtctcatagcctcga

SEQ ID NO: 5888302 - DNA, 13 bp, Homo sapiens
ctgcaccttagaa

SEQ ID NO: 5888303 - DNA, 18 bp, Homo sapiens
ctgcaccttagaaaaaaa

SEQ ID NO: 5888304 - DNA, 21 bp, Homo sapiens
ctgcaccttctgacgcagcct

SEQ ID NO: 5888305 - DNA, 23 bp, Homo sapiens
ctgcaccttctgacgcagcctga

SEQ ID NO: 5888306 - DNA, 14 bp, Homo sapiens
ctgcaccttgggca

SEQ ID NO: 5888307 - DNA, 13 bp, Homo sapiens
ctgcacctttcgg

SEQ ID NO: 5888308 - DNA, 15 bp, Homo sapiens
ctgcacgacccctga

SEQ ID NO: 5888309 - DNA, 14 bp, Homo sapiens
ctgcacgcccagga

SEQ ID NO: 5888310 - DNA, 18 bp, Homo sapiens
ctgcacgccgtggagcat

SEQ ID NO: 5888311 - DNA, 20 bp, Homo sapiens
ctgcacgctcaatgcccagt

SEQ ID NO: 5888312 - DNA, 13 bp, Homo sapiens
ctgcacgctcccc

SEQ ID NO: 5888313 - DNA, 17 bp, Homo sapiens
ctgcacgctcccctcca

SEQ ID NO: 5888314 - DNA, 15 bp, Homo sapiens
ctgcacgctgcccag

SEQ ID NO: 5888315 - DNA, 14 bp, Homo sapiens
ctgcacgggatgcg

SEQ ID NO: 5888316 - DNA, 14 bp, Homo sapiens
ctgcacggtgaatg

SEQ ID NO: 5888317 - DNA, 15 bp, Homo sapiens
ctgcacggtgaatgg

SEQ ID NO: 5888318 - DNA, 18 bp, Homo sapiens
ctgcacgtatacacccag

SEQ ID NO: 5888319 - DNA, 18 bp, Homo sapiens
ctgcacgtcaccctcctg

SEQ ID NO: 5888320 - DNA, 23 bp, Homo sapiens
ctgcacgtcaccctcctgagcct

SEQ ID NO: 5888321 - DNA, 15 bp, Homo sapiens
ctgcacgtgcacaca

SEQ ID NO: 5888322 - DNA, 16 bp, Homo sapiens
ctgcacgtgcacacac

SEQ ID NO: 5888323 - DNA, 17 bp, Homo sapiens
ctgcacgtgcacacacc

SEQ ID NO: 5888324 - DNA, 23 bp, Homo sapiens
ctgcacgtgcacacacctgcaca

SEQ ID NO: 5888325 - DNA, 16 bp, Homo sapiens
ctgcacgttcataacc

SEQ ID NO: 5888326 - DNA, 22 bp, Homo sapiens
ctgcactaaagccagcctgacc

SEQ ID NO: 5888327 - DNA, 22 bp, Homo sapiens
ctgcactaagagaaaattgcac

SEQ ID NO: 5888328 - DNA, 23 bp, Homo sapiens
ctgcactaagagaaaattgcact

SEQ ID NO: 5888329 - DNA, 16 bp, Homo sapiens
ctgcactaggcaggta

SEQ ID NO: 5888330 - DNA, 17 bp, Homo sapiens
ctgcactatagccattt

SEQ ID NO: 5888331 - DNA, 17 bp, Homo sapiens
ctgcactatagcctagg

SEQ ID NO: 5888332 - DNA, 20 bp, Homo sapiens
ctgcactatagcctaggtga

SEQ ID NO: 5888333 - DNA, 22 bp, Homo sapiens
ctgcactatagcctaggtgaca

SEQ ID NO: 5888334 - DNA, 14 bp, Homo sapiens
ctgcactatatgca

SEQ ID NO: 5888335 - DNA, 14 bp, Homo sapiens
ctgcactcagaaaa

SEQ ID NO: 5888336 - DNA, 16 bp, Homo sapiens
ctgcactccagatatg

SEQ ID NO: 5888337 - DNA, 21 bp, Homo sapiens
ctgcactccagatatgtgcca

SEQ ID NO: 5888338 - DNA, 15 bp, Homo sapiens
ctgcactccagcctg

SEQ ID NO: 5888339 - DNA, 17 bp, Homo sapiens
ctgcactccagcctgag

SEQ ID NO: 5888340 - DNA, 23 bp, Homo sapiens
ctgcactccagcctgagtgacag

SEQ ID NO: 5888341 - DNA, 17 bp, Homo sapiens
ctgcactccagcctggg

SEQ ID NO: 5888342 - DNA, 21 bp, Homo sapiens
ctgcactccagcctgggtcac

SEQ ID NO: 5888343 - DNA, 20 bp, Homo sapiens
ctgcactccaggctgggtga

SEQ ID NO: 5888344 - DNA, 17 bp, Homo sapiens
ctgcactccatggccac

SEQ ID NO: 5888345 - DNA, 18 bp, Homo sapiens
ctgcactccatggccacc

SEQ ID NO: 5888346 - DNA, 16 bp, Homo sapiens
ctgcactcccacctga

SEQ ID NO: 5888347 - DNA, 22 bp, Homo sapiens
ctgcactcccacctgacacacc

SEQ ID NO: 5888348 - DNA, 18 bp, Homo sapiens
ctgcactcccccagttcc

SEQ ID NO: 5888349 - DNA, 13 bp, Homo sapiens
ctgcactcccctg

SEQ ID NO: 5888350 - DNA, 20 bp, Homo sapiens
ctgcactcccctgctgggtg

SEQ ID NO: 5888351 - DNA, 12 bp, Homo sapiens
ctgcactcccga

SEQ ID NO: 5888352 - DNA, 13 bp, Homo sapiens
ctgcactccctgg

SEQ ID NO: 5888353 - DNA, 18 bp, Homo sapiens
ctgcactccctggccttg

SEQ ID NO: 5888354 - DNA, 16 bp, Homo sapiens
ctgcactcctgtctct

SEQ ID NO: 5888355 - DNA, 21 bp, Homo sapiens
ctgcactcctgtctcttggga

SEQ ID NO: 5888356 - DNA, 18 bp, Homo sapiens
ctgcactcctttatctgt

SEQ ID NO: 5888357 - DNA, 18 bp, Homo sapiens
ctgcactctaaactgcaa

SEQ ID NO: 5888358 - DNA, 18 bp, Homo sapiens
ctgcactctgtgcccatg

SEQ ID NO: 5888359 - DNA, 19 bp, Homo sapiens
ctgcactcttaagcttccg

SEQ ID NO: 5888360 - DNA, 14 bp, Homo sapiens
ctgcactcttgtac

SEQ ID NO: 5888361 - DNA, 20 bp, Homo sapiens
ctgcactgaatggctgacct

SEQ ID NO: 5888362 - DNA, 21 bp, Homo sapiens
ctgcactgagagggcaaggaa

SEQ ID NO: 5888363 - DNA, 14 bp, Homo sapiens
ctgcactgagcaga

SEQ ID NO: 5888364 - DNA, 18 bp, Homo sapiens
ctgcactgagcagagtct

SEQ ID NO: 5888365 - DNA, 13 bp, Homo sapiens
ctgcactgaggat

SEQ ID NO: 5888366 - DNA, 21 bp, Homo sapiens
ctgcactgaggatttcttttt

SEQ ID NO: 5888367 - DNA, 16 bp, Homo sapiens
ctgcactgcagccaca

SEQ ID NO: 5888368 - DNA, 13 bp, Homo sapiens
ctgcactgcagtg

SEQ ID NO: 5888369 - DNA, 12 bp, Homo sapiens
ctgcactgccct

SEQ ID NO: 5888370 - DNA, 16 bp, Homo sapiens
ctgcactggagccaca

SEQ ID NO: 5888371 - DNA, 20 bp, Homo sapiens
ctgcactggagccacaggca

SEQ ID NO: 5888372 - DNA, 19 bp, Homo sapiens
ctgcactgggaaggaaaca

SEQ ID NO: 5888373 - DNA, 22 bp, Homo sapiens
ctgcactgggaatttatttatg

SEQ ID NO: 5888374 - DNA, 20 bp, Homo sapiens
ctgcactggggcgtttccta

SEQ ID NO: 5888375 - DNA, 11 bp, Homo sapiens
ctgcactgtaa

SEQ ID NO: 5888376 - DNA, 13 bp, Homo sapiens
ctgcactgtaaaa

SEQ ID NO: 5888377 - DNA, 14 bp, Homo sapiens
ctgcactgtaaaat

SEQ ID NO: 5888378 - DNA, 15 bp, Homo sapiens
ctgcactgtaaaatg

SEQ ID NO: 5888379 - DNA, 16 bp, Homo sapiens
ctgcactgtaaaatgt

SEQ ID NO: 5888380 - DNA, 16 bp, Homo sapiens
ctgcactgtcctgctc

SEQ ID NO: 5888381 - DNA, 21 bp, Homo sapiens
ctgcactgtcctgctccacag

SEQ ID NO: 5888382 - DNA, 23 bp, Homo sapiens
ctgcactgtcctgctccacagtg

SEQ ID NO: 5888383 - DNA, 11 bp, Homo sapiens
ctgcactgtga

SEQ ID NO: 5888384 - DNA, 12 bp, Homo sapiens
ctgcactgtgaa

SEQ ID NO: 5888385 - DNA, 20 bp, Homo sapiens
ctgcactgtgaacctgggca

SEQ ID NO: 5888386 - DNA, 15 bp, Homo sapiens
ctgcactgtgccccg

SEQ ID NO: 5888387 - DNA, 23 bp, Homo sapiens
ctgcactgtgccccgcgggcttt

SEQ ID NO: 5888388 - DNA, 21 bp, Homo sapiens
ctgcactgtgtcatcttttca

SEQ ID NO: 5888389 - DNA, 13 bp, Homo sapiens
ctgcacttacaat

SEQ ID NO: 5888390 - DNA, 15 bp, Homo sapiens
ctgcacttcagacac

SEQ ID NO: 5888391 - DNA, 18 bp, Homo sapiens
ctgcacttcatatctaga

SEQ ID NO: 5888392 - DNA, 14 bp, Homo sapiens
ctgcacttcatccc

SEQ ID NO: 5888393 - DNA, 22 bp, Homo sapiens
ctgcacttcatcccggagcgca

SEQ ID NO: 5888394 - DNA, 22 bp, Homo sapiens
ctgcacttgcggttccggcatg

SEQ ID NO: 5888395 - DNA, 16 bp, Homo sapiens
ctgcacttggcctcag

SEQ ID NO: 5888396 - DNA, 17 bp, Homo sapiens
ctgcacttggcctcagc

SEQ ID NO: 5888397 - DNA, 21 bp, Homo sapiens
ctgcacttggcctcagctggc

SEQ ID NO: 5888398 - DNA, 23 bp, Homo sapiens
ctgcacttggcctcagctggctg

SEQ ID NO: 5888399 - DNA, 15 bp, Homo sapiens
ctgcacttggcctct

SEQ ID NO: 5888400 - DNA, 16 bp, Homo sapiens
ctgcacttggcctctt

SEQ ID NO: 5888401 - DNA, 19 bp, Homo sapiens
ctgcacttgggggctcagc

SEQ ID NO: 5888402 - DNA, 21 bp, Homo sapiens
ctgcacttgggggctcagcaa

SEQ ID NO: 5888403 - DNA, 18 bp, Homo sapiens
ctgcacttggtgctgctt

SEQ ID NO: 5888404 - DNA, 22 bp, Homo sapiens
ctgcacttggtgctgctttggc

SEQ ID NO: 5888405 - DNA, 13 bp, Homo sapiens
ctgcactttcccc

SEQ ID NO: 5888406 - DNA, 20 bp, Homo sapiens
ctgcactttcccccttcccg

SEQ ID NO: 5888407 - DNA, 14 bp, Homo sapiens
ctgcactttgatgt

SEQ ID NO: 5888408 - DNA, 20 bp, Homo sapiens
ctgcactttgatgtcatgtg

SEQ ID NO: 5888409 - DNA, 22 bp, Homo sapiens
ctgcactttgatgtcatgtgtt

SEQ ID NO: 5888410 - DNA, 23 bp, Homo sapiens
ctgcactttgatgtcatgtgttc

SEQ ID NO: 5888411 - DNA, 17 bp, Homo sapiens
ctgcacttttagccaga

SEQ ID NO: 5888412 - DNA, 17 bp, Homo sapiens
ctgcagcctctctggct

SEQ ID NO: 5888413 - DNA, 19 bp, Homo sapiens
ctgcagcctctctggctgg

SEQ ID NO: 5888414 - DNA, 14 bp, Homo sapiens
ctgcagcctgagct

SEQ ID NO: 5888415 - DNA, 16 bp, Homo sapiens
ctgcagcctgagctcc

SEQ ID NO: 5888416 - DNA, 17 bp, Homo sapiens
ctgcagcctgagctcca

SEQ ID NO: 5888417 - DNA, 21 bp, Homo sapiens
ctgcagcctgagctccaccct

SEQ ID NO: 5888418 - DNA, 22 bp, Homo sapiens
ctgcagcctgagctccaccctc

SEQ ID NO: 5888419 - DNA, 23 bp, Homo sapiens
ctgcagcctgagctccaccctcc

SEQ ID NO: 5888420 - DNA, 13 bp, Homo sapiens
ctgcagcctgctg

SEQ ID NO: 5888421 - DNA, 16 bp, Homo sapiens
ctgcagcctgctgggg

SEQ ID NO: 5888422 - DNA, 17 bp, Homo sapiens
ctgcagcctgctggggc

SEQ ID NO: 5888423 - DNA, 18 bp, Homo sapiens
ctgcagcctgctggggct

SEQ ID NO: 5888424 - DNA, 11 bp, Homo sapiens
ctgcagcctgg

SEQ ID NO: 5888425 - DNA, 14 bp, Homo sapiens
ctgcagcctggagg

SEQ ID NO: 5888426 - DNA, 15 bp, Homo sapiens
ctgcagcctggaggc

SEQ ID NO: 5888427 - DNA, 20 bp, Homo sapiens
ctgcagcctggctggtcctc

SEQ ID NO: 5888428 - DNA, 18 bp, Homo sapiens
ctgcagcctgggtctgga

SEQ ID NO: 5888429 - DNA, 20 bp, Homo sapiens
ctgcagccttcatcagaact

SEQ ID NO: 5888430 - DNA, 23 bp, Homo sapiens
ctgcagccttcatcagaactctt

SEQ ID NO: 5888431 - DNA, 20 bp, Homo sapiens
ctgcagccttgaactcctgg

SEQ ID NO: 5888432 - DNA, 22 bp, Homo sapiens
ctgcagccttgaactctgggct

SEQ ID NO: 5888433 - DNA, 16 bp, Homo sapiens
ctgcagcgcctcctgg

SEQ ID NO: 5888434 - DNA, 19 bp, Homo sapiens
ctgcagcgcctcctggaca

SEQ ID NO: 5888435 - DNA, 20 bp, Homo sapiens
ctgcagcgcctcctggacac

SEQ ID NO: 5888436 - DNA, 14 bp, Homo sapiens
ctgcagcggcagag

SEQ ID NO: 5888437 - DNA, 18 bp, Homo sapiens
ctgcagcggcaggaccgc

SEQ ID NO: 5888438 - DNA, 21 bp, Homo sapiens
ctgcagcggcaggaccgccat

SEQ ID NO: 5888439 - DNA, 20 bp, Homo sapiens
ctgcagcggccacactgtac

SEQ ID NO: 5888440 - DNA, 15 bp, Homo sapiens
ctgcagctaatttgt

SEQ ID NO: 5888441 - DNA, 18 bp, Homo sapiens
ctgcagctaatttgtgaa

SEQ ID NO: 5888442 - DNA, 20 bp, Homo sapiens
ctgcagctaatttgtgaaag

SEQ ID NO: 5888443 - DNA, 21 bp, Homo sapiens
ctgcagctatgcgcaatgtgg

SEQ ID NO: 5888444 - DNA, 20 bp, Homo sapiens
ctgcagctattcacacacac

SEQ ID NO: 5888445 - DNA, 20 bp, Homo sapiens
ctgcagctcaagggctggca

SEQ ID NO: 5888446 - DNA, 14 bp, Homo sapiens
ctgcagctccctca

SEQ ID NO: 5888447 - DNA, 16 bp, Homo sapiens
ctgcagctccctggct

SEQ ID NO: 5888448 - DNA, 14 bp, Homo sapiens
ctgcagctcctgga

SEQ ID NO: 5888449 - DNA, 15 bp, Homo sapiens
ctgcagctcctggaa

SEQ ID NO: 5888450 - DNA, 13 bp, Homo sapiens
ctgcagctgacct

SEQ ID NO: 5888451 - DNA, 14 bp, Homo sapiens
ctgcagctgacctc

SEQ ID NO: 5888452 - DNA, 15 bp, Homo sapiens
ctgcagctgagcctg

SEQ ID NO: 5888453 - DNA, 16 bp, Homo sapiens
ctgcagctgagcctga

SEQ ID NO: 5888454 - DNA, 17 bp, Homo sapiens
ctgcagctgatccatag

SEQ ID NO: 5888455 - DNA, 11 bp, Homo sapiens
ctgcagctgcc

SEQ ID NO: 5888456 - DNA, 22 bp, Homo sapiens
ctgcagctgctgaagttctgag

SEQ ID NO: 5888457 - DNA, 22 bp, Homo sapiens
ctgcagctggaatgtgccacag

SEQ ID NO: 5888458 - DNA, 24 bp, Homo sapiens
ctgcagctggaatgtgccacagag

SEQ ID NO: 5888459 - DNA, 14 bp, Homo sapiens
ctgcagctggacag

SEQ ID NO: 5888460 - DNA, 15 bp, Homo sapiens
ctgcagctggacaga

SEQ ID NO: 5888461 - DNA, 17 bp, Homo sapiens
ctgcagctggacagagg

SEQ ID NO: 5888462 - DNA, 17 bp, Homo sapiens
ctgcagctgggaagagg

SEQ ID NO: 5888463 - DNA, 19 bp, Homo sapiens
ctgcagctgggaagaggag

SEQ ID NO: 5888464 - DNA, 13 bp, Homo sapiens
ctgcagctgggca

SEQ ID NO: 5888465 - DNA, 15 bp, Homo sapiens
ctgcagctgggcccc

SEQ ID NO: 5888466 - DNA, 21 bp, Homo sapiens
ctgcagctgggccccatgctc

SEQ ID NO: 5888467 - DNA, 22 bp, Homo sapiens
ctgcagctgggccccatgctct

SEQ ID NO: 5888468 - DNA, 24 bp, Homo sapiens
ctgcagctgggccccatgctctgc

SEQ ID NO: 5888469 - DNA, 11 bp, Homo sapiens
ctgcagctgtg

SEQ ID NO: 5888470 - DNA, 14 bp, Homo sapiens
ctgcagctgtttca

SEQ ID NO: 5888471 - DNA, 17 bp, Homo sapiens
ctgcagctgttttagtt

SEQ ID NO: 5888472 - DNA, 23 bp, Homo sapiens
ctgcagctgttttagttaaattt

SEQ ID NO: 5888473 - DNA, 13 bp, Homo sapiens
ctgcagcttggga

SEQ ID NO: 5888474 - DNA, 22 bp, Homo sapiens
ctgcagcttgggagagcccctg

SEQ ID NO: 5888475 - DNA, 14 bp, Homo sapiens
ctgcagctttacat

SEQ ID NO: 5888476 - DNA, 21 bp, Homo sapiens
ctgcagctttacatgcaattt

SEQ ID NO: 5888477 - DNA, 17 bp, Homo sapiens
ctgcagctttgaggctg

SEQ ID NO: 5888478 - DNA, 19 bp, Homo sapiens
ctgcagctttgaggctggc

SEQ ID NO: 5888479 - DNA, 20 bp, Homo sapiens
ctgcagctttggctgcacgt

SEQ ID NO: 5888480 - DNA, 12 bp, Homo sapiens
ctgcagctttgt

SEQ ID NO: 5888481 - DNA, 14 bp, Homo sapiens
ctgcaggaaaagca

SEQ ID NO: 5888482 - DNA, 22 bp, Homo sapiens
ctgcaggaaacatttctgacac

SEQ ID NO: 5888483 - DNA, 22 bp, Homo sapiens
ctgcaggaaatcagagctggca

SEQ ID NO: 5888484 - DNA, 17 bp, Homo sapiens
ctgcaggaaatggctgt

SEQ ID NO: 5888485 - DNA, 22 bp, Homo sapiens
ctgcaggaacgagcactggcca

SEQ ID NO: 5888486 - DNA, 14 bp, Homo sapiens
ctgcaggaaggagc

SEQ ID NO: 5888487 - DNA, 21 bp, Homo sapiens
ctgcaggaaggagctgcctgg

SEQ ID NO: 5888488 - DNA, 23 bp, Homo sapiens
ctgcaggaaggagctgcctggac

SEQ ID NO: 5888489 - DNA, 22 bp, Homo sapiens
ctgcaggaatcaaaaattgaag

SEQ ID NO: 5888490 - DNA, 21 bp, Homo sapiens
ctgcaggacagagggaagcca

SEQ ID NO: 5888491 - DNA, 14 bp, Homo sapiens
ctgcaggacctgcc

SEQ ID NO: 5888492 - DNA, 22 bp, Homo sapiens
ctgcaggacctgcctgtagccc

SEQ ID NO: 5888493 - DNA, 22 bp, Homo sapiens
ctgcaggacttctgcctgaacc

SEQ ID NO: 5888494 - DNA, 23 bp, Homo sapiens
ctgcaggacttgagaagacctca

SEQ ID NO: 5888495 - DNA, 18 bp, Homo sapiens
ctgcaggagagagcagca

SEQ ID NO: 5888496 - DNA, 22 bp, Homo sapiens
ctgcaggagagagcagcactcc

SEQ ID NO: 5888497 - DNA, 16 bp, Homo sapiens
ctgcaggagcagtttg

SEQ ID NO: 5888498 - DNA, 17 bp, Homo sapiens
ctgcaggaggcctggga

SEQ ID NO: 5888499 - DNA, 16 bp, Homo sapiens
ctgcaggagggcactg

SEQ ID NO: 5888500 - DNA, 14 bp, Homo sapiens
ctgcaggatggact

SEQ ID NO: 5888501 - DNA, 22 bp, Homo sapiens
ctgcaggatgggtgaaaccaca

SEQ ID NO: 5888502 - DNA, 19 bp, Homo sapiens
ctgcaggattctcaccagc

SEQ ID NO: 5888503 - DNA, 20 bp, Homo sapiens
ctgcaggattgattatgcag

SEQ ID NO: 5888504 - DNA, 21 bp, Homo sapiens
ctgcaggattgattatgcaga

SEQ ID NO: 5888505 - DNA, 17 bp, Homo sapiens
ctgcaggcaaagtgaga

SEQ ID NO: 5888506 - DNA, 14 bp, Homo sapiens
ctgcaggcacacac

SEQ ID NO: 5888507 - DNA, 23 bp, Homo sapiens
ctgcaggcacacacgccttcatg

SEQ ID NO: 5888508 - DNA, 17 bp, Homo sapiens
ctgcaggcacagaggag

SEQ ID NO: 5888509 - DNA, 17 bp, Homo sapiens
ctgcaggcagacacgga

SEQ ID NO: 5888510 - DNA, 14 bp, Homo sapiens
ctgcaggcagagct

SEQ ID NO: 5888511 - DNA, 18 bp, Homo sapiens
ctgcaggcagccaggcca

SEQ ID NO: 5888512 - DNA, 14 bp, Homo sapiens
ctgcaggcagcctt

SEQ ID NO: 5888513 - DNA, 19 bp, Homo sapiens
ctgcaggcaggtgggggct

SEQ ID NO: 5888514 - DNA, 15 bp, Homo sapiens
ctgcaggcatgctga

SEQ ID NO: 5888515 - DNA, 16 bp, Homo sapiens
ctgcaggcatggaact

SEQ ID NO: 5888516 - DNA, 19 bp, Homo sapiens
ctgcaggccaagagcagag

SEQ ID NO: 5888517 - DNA, 21 bp, Homo sapiens
ctgcaggccaagagcagaggc

SEQ ID NO: 5888518 - DNA, 22 bp, Homo sapiens
ctgcaggccaagagcagaggca

SEQ ID NO: 5888519 - DNA, 11 bp, Homo sapiens
ctgcaggccac

SEQ ID NO: 5888520 - DNA, 12 bp, Homo sapiens
ctgcaggccacc

SEQ ID NO: 5888521 - DNA, 15 bp, Homo sapiens
ctgcaggccaccagc

SEQ ID NO: 5888522 - DNA, 14 bp, Homo sapiens
ctgcaggccaggcc

SEQ ID NO: 5888523 - DNA, 16 bp, Homo sapiens
ctgcaggccaggccag

SEQ ID NO: 5888524 - DNA, 22 bp, Homo sapiens
ctgcaggccaggccagcttccc

SEQ ID NO: 5888525 - DNA, 21 bp, Homo sapiens
ctgcaggccagtcccacggct

SEQ ID NO: 5888526 - DNA, 11 bp, Homo sapiens
ctgcaggcccc

SEQ ID NO: 5888527 - DNA, 15 bp, Homo sapiens
ctgcaggccccagcc

SEQ ID NO: 5888528 - DNA, 17 bp, Homo sapiens
ctgcaggccctccctct

SEQ ID NO: 5888529 - DNA, 20 bp, Homo sapiens
ctgcaggccctccctctact

SEQ ID NO: 5888530 - DNA, 13 bp, Homo sapiens
ctgcaggccctgg

SEQ ID NO: 5888531 - DNA, 17 bp, Homo sapiens
ctgcaggccctggcctc

SEQ ID NO: 5888532 - DNA, 21 bp, Homo sapiens
ctgcaggccctggcctcccct

SEQ ID NO: 5888533 - DNA, 20 bp, Homo sapiens
ctgcaggcctgactactgcc

SEQ ID NO: 5888534 - DNA, 16 bp, Homo sapiens
ctgcaggcggggctcc

SEQ ID NO: 5888535 - DNA, 19 bp, Homo sapiens
ctgcaggcggtatccagag

SEQ ID NO: 5888536 - DNA, 21 bp, Homo sapiens
ctgcaggcggtatccagaggt

SEQ ID NO: 5888537 - DNA, 16 bp, Homo sapiens
ctgcaggctccatgca

SEQ ID NO: 5888538 - DNA, 18 bp, Homo sapiens
ctgcaggctccatgcacc

SEQ ID NO: 5888539 - DNA, 19 bp, Homo sapiens
ctgcaggctccatgcacct

SEQ ID NO: 5888540 - DNA, 23 bp, Homo sapiens
ctgcaggctgcacctctggctag

SEQ ID NO: 5888541 - DNA, 13 bp, Homo sapiens
ctgcaggctgcag

SEQ ID NO: 5888542 - DNA, 18 bp, Homo sapiens
ctgcaggctgcaggaggg

SEQ ID NO: 5888543 - DNA, 18 bp, Homo sapiens
ctgcaggctggagactgg

SEQ ID NO: 5888544 - DNA, 14 bp, Homo sapiens
ctgcaggctggctg

SEQ ID NO: 5888545 - DNA, 19 bp, Homo sapiens
ctgcaggctggggaggtgc

SEQ ID NO: 5888546 - DNA, 21 bp, Homo sapiens
ctgcaggcttaggtcctcact

SEQ ID NO: 5888547 - DNA, 12 bp, Homo sapiens
ctgcagggaaaa

SEQ ID NO: 5888548 - DNA, 23 bp, Homo sapiens
ctgcagggaaaattatttgcata

SEQ ID NO: 5888549 - DNA, 20 bp, Homo sapiens
ctgcagggacagttgggtgt

SEQ ID NO: 5888550 - DNA, 17 bp, Homo sapiens
ctgcagggagcagcacg

SEQ ID NO: 5888551 - DNA, 19 bp, Homo sapiens
ctgcagggcacggggacct

SEQ ID NO: 5888552 - DNA, 21 bp, Homo sapiens
ctgcagggcacggggacctgg

SEQ ID NO: 5888553 - DNA, 18 bp, Homo sapiens
ctgcagggcagcctgtgg

SEQ ID NO: 5888554 - DNA, 20 bp, Homo sapiens
ctgcagggcagcctgtggga

SEQ ID NO: 5888555 - DNA, 13 bp, Homo sapiens
ctgcagggccagg

SEQ ID NO: 5888556 - DNA, 14 bp, Homo sapiens
ctgcagggccagga

SEQ ID NO: 5888557 - DNA, 15 bp, Homo sapiens
ctgcagggccaggac

SEQ ID NO: 5888558 - DNA, 15 bp, Homo sapiens
ctgcagggccatctg

SEQ ID NO: 5888559 - DNA, 17 bp, Homo sapiens
ctgcagggcccttatgg

SEQ ID NO: 5888560 - DNA, 13 bp, Homo sapiens
ctgcagggccggg

SEQ ID NO: 5888561 - DNA, 17 bp, Homo sapiens
ctgcagggccgggcagg

SEQ ID NO: 5888562 - DNA, 14 bp, Homo sapiens
ctgcagggctgctg

SEQ ID NO: 5888563 - DNA, 15 bp, Homo sapiens
ctgcagggctgctgt

SEQ ID NO: 5888564 - DNA, 22 bp, Homo sapiens
ctgcagggctgctgtggcccag

SEQ ID NO: 5888565 - DNA, 12 bp, Homo sapiens
ctgcagggctgg

SEQ ID NO: 5888566 - DNA, 12 bp, Homo sapiens
ctgcaggggagc

SEQ ID NO: 5888567 - DNA, 21 bp, Homo sapiens
ctgcaggggcaggagaggctg

SEQ ID NO: 5888568 - DNA, 20 bp, Homo sapiens
ctgcaggggccactccaaac

SEQ ID NO: 5888569 - DNA, 12 bp, Homo sapiens
ctgcaggggcct

SEQ ID NO: 5888570 - DNA, 11 bp, Homo sapiens
ctgcaggggct

SEQ ID NO: 5888571 - DNA, 16 bp, Homo sapiens
ctgcaggggctctgga

SEQ ID NO: 5888572 - DNA, 19 bp, Homo sapiens
ctgcaggggctctggagag

SEQ ID NO: 5888573 - DNA, 21 bp, Homo sapiens
ctgcaggggctctggagagaa

SEQ ID NO: 5888574 - DNA, 22 bp, Homo sapiens
ctgcaggggctctggagagaaa

SEQ ID NO: 5888575 - DNA, 18 bp, Homo sapiens
ctgcagggggaggaggac

SEQ ID NO: 5888576 - DNA, 17 bp, Homo sapiens
ctgcagggggtgtgtct

SEQ ID NO: 5888577 - DNA, 21 bp, Homo sapiens
ctgcaggggtctgggagtcag

SEQ ID NO: 5888578 - DNA, 22 bp, Homo sapiens
ctgcaggggtctgggagtcagg

SEQ ID NO: 5888579 - DNA, 23 bp, Homo sapiens
ctgcaggggttatgtggaagtgt

SEQ ID NO: 5888580 - DNA, 23 bp, Homo sapiens
ctgcaggggttgagagctttctg

SEQ ID NO: 5888581 - DNA, 16 bp, Homo sapiens
ctgcagggtagggggc

SEQ ID NO: 5888582 - DNA, 23 bp, Homo sapiens
ctgcagggtgaagcaccagggag

SEQ ID NO: 5888583 - DNA, 18 bp, Homo sapiens
ctgcagggtgacgcctga

SEQ ID NO: 5888584 - DNA, 19 bp, Homo sapiens
ctgcagggtgacgcctgag

SEQ ID NO: 5888585 - DNA, 23 bp, Homo sapiens
ctgcagggtgacgcctgagacag

SEQ ID NO: 5888586 - DNA, 20 bp, Homo sapiens
ctgcagggtggtgctgggac

SEQ ID NO: 5888587 - DNA, 22 bp, Homo sapiens
ctgcagggtggtgctgggactg

SEQ ID NO: 5888588 - DNA, 14 bp, Homo sapiens
ctgccaagccccat

SEQ ID NO: 5888589 - DNA, 15 bp, Homo sapiens
ctgccaagcctggag

SEQ ID NO: 5888590 - DNA, 16 bp, Homo sapiens
ctgccaagcctggagc

SEQ ID NO: 5888591 - DNA, 17 bp, Homo sapiens
ctgccaagcctggagcc

SEQ ID NO: 5888592 - DNA, 21 bp, Homo sapiens
ctgccaagcctggagcccctg

SEQ ID NO: 5888593 - DNA, 21 bp, Homo sapiens
ctgccaagcgagaatgcaggc

SEQ ID NO: 5888594 - DNA, 16 bp, Homo sapiens
ctgccaagcttcctgt

SEQ ID NO: 5888595 - DNA, 19 bp, Homo sapiens
ctgccaagcttcctgtgcc

SEQ ID NO: 5888596 - DNA, 21 bp, Homo sapiens
ctgccaagcttcctgtgccct

SEQ ID NO: 5888597 - DNA, 17 bp, Homo sapiens
ctgccaaggagcatcct

SEQ ID NO: 5888598 - DNA, 20 bp, Homo sapiens
ctgccaaggagcatccttgg

SEQ ID NO: 5888599 - DNA, 23 bp, Homo sapiens
ctgccaaggagcatccttggcag

SEQ ID NO: 5888600 - DNA, 21 bp, Homo sapiens
ctgccaaggccagagtggcct

SEQ ID NO: 5888601 - DNA, 21 bp, Homo sapiens
ctgccaaggccggagacccac

SEQ ID NO: 5888602 - DNA, 22 bp, Homo sapiens
ctgccaaggccggagacccaca

SEQ ID NO: 5888603 - DNA, 23 bp, Homo sapiens
ctgccaaggccggagacccacag

SEQ ID NO: 5888604 - DNA, 21 bp, Homo sapiens
ctgccaaggtggagggaagga

SEQ ID NO: 5888605 - DNA, 17 bp, Homo sapiens
ctgccaaggtgtggcct

SEQ ID NO: 5888606 - DNA, 17 bp, Homo sapiens
ctgccaagtcctgcctt

SEQ ID NO: 5888607 - DNA, 16 bp, Homo sapiens
ctgccaagtgctcttt

SEQ ID NO: 5888608 - DNA, 22 bp, Homo sapiens
ctgccaagtggggatggggcct

SEQ ID NO: 5888609 - DNA, 15 bp, Homo sapiens
ctgccaataaattct

SEQ ID NO: 5888610 - DNA, 22 bp, Homo sapiens
ctgccaataaattctaaattac

SEQ ID NO: 5888611 - DNA, 13 bp, Homo sapiens
ctgccaatatcct

SEQ ID NO: 5888612 - DNA, 16 bp, Homo sapiens
ctgccaatatcctaat

SEQ ID NO: 5888613 - DNA, 17 bp, Homo sapiens
ctgccaatatcctaata

SEQ ID NO: 5888614 - DNA, 18 bp, Homo sapiens
ctgccaatatcctaataa

SEQ ID NO: 5888615 - DNA, 19 bp, Homo sapiens
ctgccaatctgtacaaaat

SEQ ID NO: 5888616 - DNA, 21 bp, Homo sapiens
ctgccaatctgtacaaaatgg

SEQ ID NO: 5888617 - DNA, 18 bp, Homo sapiens
ctgccaatgccacagcca

SEQ ID NO: 5888618 - DNA, 20 bp, Homo sapiens
ctgccaatgccacagccaag

SEQ ID NO: 5888619 - DNA, 21 bp, Homo sapiens
ctgccaatgccacagccaagc

SEQ ID NO: 5888620 - DNA, 17 bp, Homo sapiens
ctgccaatgggagctca

SEQ ID NO: 5888621 - DNA, 17 bp, Homo sapiens
ctgccacaacaccagcc

SEQ ID NO: 5888622 - DNA, 20 bp, Homo sapiens
ctgccacaaccagccaggca

SEQ ID NO: 5888623 - DNA, 14 bp, Homo sapiens
ctgccacaagcaca

SEQ ID NO: 5888624 - DNA, 16 bp, Homo sapiens
ctgccacaagcacaat

SEQ ID NO: 5888625 - DNA, 18 bp, Homo sapiens
ctgccacaaggaagaaat

SEQ ID NO: 5888626 - DNA, 15 bp, Homo sapiens
ctgccacaatgtgat

SEQ ID NO: 5888627 - DNA, 22 bp, Homo sapiens
ctgccacacaaacgtatgtaaa

SEQ ID NO: 5888628 - DNA, 21 bp, Homo sapiens
ctgccacaccagtcacatgac

SEQ ID NO: 5888629 - DNA, 15 bp, Homo sapiens
ctgccacacctgagc

SEQ ID NO: 5888630 - DNA, 18 bp, Homo sapiens
ctgccacactcagtcccc

SEQ ID NO: 5888631 - DNA, 15 bp, Homo sapiens
ctgccacactctgac

SEQ ID NO: 5888632 - DNA, 17 bp, Homo sapiens
ctgccacacttcaggct

SEQ ID NO: 5888633 - DNA, 13 bp, Homo sapiens
ctgccacagagaa

SEQ ID NO: 5888634 - DNA, 12 bp, Homo sapiens
ctgccacagcca

SEQ ID NO: 5888635 - DNA, 14 bp, Homo sapiens
ctgccacagccaga

SEQ ID NO: 5888636 - DNA, 15 bp, Homo sapiens
ctgccacagccagag

SEQ ID NO: 5888637 - DNA, 16 bp, Homo sapiens
ctgccacagccagagg

SEQ ID NO: 5888638 - DNA, 14 bp, Homo sapiens
ctgccacatccagc

SEQ ID NO: 5888639 - DNA, 14 bp, Homo sapiens
ctgccacatggagc

SEQ ID NO: 5888640 - DNA, 16 bp, Homo sapiens
ctgccacatggagccc

SEQ ID NO: 5888641 - DNA, 18 bp, Homo sapiens
ctgccacattagaacttc

SEQ ID NO: 5888642 - DNA, 12 bp, Homo sapiens
ctgccacattga

SEQ ID NO: 5888643 - DNA, 22 bp, Homo sapiens
ctgccacattgatttttctata

SEQ ID NO: 5888644 - DNA, 15 bp, Homo sapiens
ctgccaccaaaggcc

SEQ ID NO: 5888645 - DNA, 17 bp, Homo sapiens
ctgccaccaaatctgtc

SEQ ID NO: 5888646 - DNA, 19 bp, Homo sapiens
ctgccaccaaatctgtcta

SEQ ID NO: 5888647 - DNA, 15 bp, Homo sapiens
ctgccaccacacaca

SEQ ID NO: 5888648 - DNA, 13 bp, Homo sapiens
ctgccaccaccct

SEQ ID NO: 5888649 - DNA, 15 bp, Homo sapiens
ctgccaccaccctgt

SEQ ID NO: 5888650 - DNA, 20 bp, Homo sapiens
ctgccaccaccctgtcttcc

SEQ ID NO: 5888651 - DNA, 19 bp, Homo sapiens
ctgccaccacgcccggcta

SEQ ID NO: 5888652 - DNA, 14 bp, Homo sapiens
ctgccaccacgtct

SEQ ID NO: 5888653 - DNA, 22 bp, Homo sapiens
ctgccaccacgtctgccaggcc

SEQ ID NO: 5888654 - DNA, 23 bp, Homo sapiens
ctgccaccacgtctgccaggccc

SEQ ID NO: 5888655 - DNA, 14 bp, Homo sapiens
ctgccaccagagac

SEQ ID NO: 5888656 - DNA, 12 bp, Homo sapiens
ctgccaccagca

SEQ ID NO: 5888657 - DNA, 15 bp, Homo sapiens
ctgccaccagccccc

SEQ ID NO: 5888658 - DNA, 23 bp, Homo sapiens
ctgccaccaggccacctccccag

SEQ ID NO: 5888659 - DNA, 14 bp, Homo sapiens
ctgccaccagtcac

SEQ ID NO: 5888660 - DNA, 17 bp, Homo sapiens
ctgccaccagtcactgt

SEQ ID NO: 5888661 - DNA, 17 bp, Homo sapiens
ctgccaccatcctgctg

SEQ ID NO: 5888662 - DNA, 12 bp, Homo sapiens
ctgccacccacc

SEQ ID NO: 5888663 - DNA, 16 bp, Homo sapiens
ctgccacccaccccaa

SEQ ID NO: 5888664 - DNA, 17 bp, Homo sapiens
ctgccacccaccccaag

SEQ ID NO: 5888665 - DNA, 22 bp, Homo sapiens
ctgccacccaccccaagctgct

SEQ ID NO: 5888666 - DNA, 19 bp, Homo sapiens
ctgccacccacctccctgc

SEQ ID NO: 5888667 - DNA, 20 bp, Homo sapiens
ctgccacccacctccctgcc

SEQ ID NO: 5888668 - DNA, 22 bp, Homo sapiens
ctgccacccacctccctgcctc

SEQ ID NO: 5888669 - DNA, 16 bp, Homo sapiens
ctgccacccactcagg

SEQ ID NO: 5888670 - DNA, 17 bp, Homo sapiens
ctgccacccactcagga

SEQ ID NO: 5888671 - DNA, 18 bp, Homo sapiens
ctgccacccactcaggat

SEQ ID NO: 5888672 - DNA, 18 bp, Homo sapiens
ctgccacccagccccagc

SEQ ID NO: 5888673 - DNA, 20 bp, Homo sapiens
ctgccacccagccccagcca

SEQ ID NO: 5888674 - DNA, 14 bp, Homo sapiens
ctgccacccaggat

SEQ ID NO: 5888675 - DNA, 21 bp, Homo sapiens
ctgccacccccaggtcttcct

SEQ ID NO: 5888676 - DNA, 20 bp, Homo sapiens
ctgccacccccttccctggg

SEQ ID NO: 5888677 - DNA, 17 bp, Homo sapiens
ctgccacccctcttctg

SEQ ID NO: 5888678 - DNA, 17 bp, Homo sapiens
ctgccaccccttcctcc

SEQ ID NO: 5888679 - DNA, 20 bp, Homo sapiens
ctgccaccctctgctgcaca

SEQ ID NO: 5888680 - DNA, 17 bp, Homo sapiens
ctgccaccctgggcctg

SEQ ID NO: 5888681 - DNA, 21 bp, Homo sapiens
ctgccaccctggggagaaagt

SEQ ID NO: 5888682 - DNA, 15 bp, Homo sapiens
ctgccaccctgtagc

SEQ ID NO: 5888683 - DNA, 14 bp, Homo sapiens
ctgccacccttgac

SEQ ID NO: 5888684 - DNA, 16 bp, Homo sapiens
ctgccaccgactgccc

SEQ ID NO: 5888685 - DNA, 18 bp, Homo sapiens
ctgccaccgactgcccag

SEQ ID NO: 5888686 - DNA, 19 bp, Homo sapiens
ctgccaccgccagaggaca

SEQ ID NO: 5888687 - DNA, 23 bp, Homo sapiens
ctgccaccgccagaggacaagga

SEQ ID NO: 5888688 - DNA, 18 bp, Homo sapiens
ctgccaccgtcacacagt

SEQ ID NO: 5888689 - DNA, 21 bp, Homo sapiens
ctgccaccgtgggggaactga

SEQ ID NO: 5888690 - DNA, 17 bp, Homo sapiens
ctgccacctccccttgc

SEQ ID NO: 5888691 - DNA, 18 bp, Homo sapiens
ctgccacctccccttgcc

SEQ ID NO: 5888692 - DNA, 19 bp, Homo sapiens
ctgccacctccccttgcca

SEQ ID NO: 5888693 - DNA, 20 bp, Homo sapiens
ctgccacctccccttgccag

SEQ ID NO: 5888694 - DNA, 13 bp, Homo sapiens
ctgccacctccct

SEQ ID NO: 5888695 - DNA, 17 bp, Homo sapiens
ctgccacctccctgacc

SEQ ID NO: 5888696 - DNA, 16 bp, Homo sapiens
ctgccacctctccatc

SEQ ID NO: 5888697 - DNA, 17 bp, Homo sapiens
ctgccacctctcccagc

SEQ ID NO: 5888698 - DNA, 23 bp, Homo sapiens
ctgccacctctcccagccctcag

SEQ ID NO: 5888699 - DNA, 12 bp, Homo sapiens
ctgccacctgga

SEQ ID NO: 5888700 - DNA, 14 bp, Homo sapiens
ctgccacctggacc

SEQ ID NO: 5888701 - DNA, 14 bp, Homo sapiens
ctgccacctgtctg

SEQ ID NO: 5888702 - DNA, 12 bp, Homo sapiens
ctgccaccttca

SEQ ID NO: 5888703 - DNA, 16 bp, Homo sapiens
ctgccacgtcccgctg

SEQ ID NO: 5888704 - DNA, 21 bp, Homo sapiens
ctgccacgtcccgctgcctcc

SEQ ID NO: 5888705 - DNA, 22 bp, Homo sapiens
ctgccacgtcccgctgcctcct

SEQ ID NO: 5888706 - DNA, 19 bp, Homo sapiens
ctgccactaacctgtagaa

SEQ ID NO: 5888707 - DNA, 15 bp, Homo sapiens
ctgccactcacacag

SEQ ID NO: 5888708 - DNA, 20 bp, Homo sapiens
ctgccactcacacagccagg

SEQ ID NO: 5888709 - DNA, 13 bp, Homo sapiens
ctgccactcaccc

SEQ ID NO: 5888710 - DNA, 22 bp, Homo sapiens
ctgccactcaggcagcctgtgg

SEQ ID NO: 5888711 - DNA, 18 bp, Homo sapiens
ctgccactccagtcctgc

SEQ ID NO: 5888712 - DNA, 20 bp, Homo sapiens
ctgccactccagtcctgcca

SEQ ID NO: 5888713 - DNA, 18 bp, Homo sapiens
ctgccactctcctgagga

SEQ ID NO: 5888714 - DNA, 22 bp, Homo sapiens
ctgccactctcctgaggagcag

SEQ ID NO: 5888715 - DNA, 17 bp, Homo sapiens
ctgccactctctgggac

SEQ ID NO: 5888716 - DNA, 21 bp, Homo sapiens
ctgccactctctgggactctc

SEQ ID NO: 5888717 - DNA, 13 bp, Homo sapiens
ctgccactctgct

SEQ ID NO: 5888718 - DNA, 13 bp, Homo sapiens
ctgccactgacct

SEQ ID NO: 5888719 - DNA, 14 bp, Homo sapiens
ctgccactgaggag

SEQ ID NO: 5888720 - DNA, 15 bp, Homo sapiens
ctgccactgaggaga

SEQ ID NO: 5888721 - DNA, 17 bp, Homo sapiens
ctgccactgaggagaca

SEQ ID NO: 5888722 - DNA, 20 bp, Homo sapiens
ctgccactgaggagacagaa

SEQ ID NO: 5888723 - DNA, 14 bp, Homo sapiens
ctgccactgagggg

SEQ ID NO: 5888724 - DNA, 11 bp, Homo sapiens
ctgccactggg

SEQ ID NO: 5888725 - DNA, 12 bp, Homo sapiens
ctgccactgggc

SEQ ID NO: 5888726 - DNA, 18 bp, Homo sapiens
ctgccactgggctctgga

SEQ ID NO: 5888727 - DNA, 20 bp, Homo sapiens
ctgccactgggctctggacc

SEQ ID NO: 5888728 - DNA, 23 bp, Homo sapiens
ctgccactgtgaaccggctccca

SEQ ID NO: 5888729 - DNA, 23 bp, Homo sapiens
ctgccacttccaggagcccagag

SEQ ID NO: 5888730 - DNA, 17 bp, Homo sapiens
ctgccacttctgcgggc

SEQ ID NO: 5888731 - DNA, 16 bp, Homo sapiens
ctgccacttgcactgt

SEQ ID NO: 5888732 - DNA, 19 bp, Homo sapiens
ctgccacttgcactgtgct

SEQ ID NO: 5888733 - DNA, 20 bp, Homo sapiens
ctgccactttgcacattttg

SEQ ID NO: 5888734 - DNA, 22 bp, Homo sapiens
ctgccactttgcacattttgat

SEQ ID NO: 5888735 - DNA, 19 bp, Homo sapiens
ctgccactttggtacatgg

SEQ ID NO: 5888736 - DNA, 16 bp, Homo sapiens
ctgccagaatctagag

SEQ ID NO: 5888737 - DNA, 17 bp, Homo sapiens
ctgccagaccccctgga

SEQ ID NO: 5888738 - DNA, 19 bp, Homo sapiens
ctgccagaccccctggaga

SEQ ID NO: 5888739 - DNA, 12 bp, Homo sapiens
ctgccagacctg

SEQ ID NO: 5888740 - DNA, 14 bp, Homo sapiens
ctgccagacctgca

SEQ ID NO: 5888741 - DNA, 16 bp, Homo sapiens
ctgccagacctgcatg

SEQ ID NO: 5888742 - DNA, 14 bp, Homo sapiens
ctgccagagaaagt

SEQ ID NO: 5888743 - DNA, 16 bp, Homo sapiens
ctgccagagaagtctg

SEQ ID NO: 5888744 - DNA, 16 bp, Homo sapiens
ctgccagagcaggggg

SEQ ID NO: 5888745 - DNA, 18 bp, Homo sapiens
ctgccagagcccaagtgc

SEQ ID NO: 5888746 - DNA, 23 bp, Homo sapiens
ctgccagagcccaagtgccatcc

SEQ ID NO: 5888747 - DNA, 19 bp, Homo sapiens
ctgccagaggatgctcttt

SEQ ID NO: 5888748 - DNA, 14 bp, Homo sapiens
ctgccagaggcctg

SEQ ID NO: 5888749 - DNA, 17 bp, Homo sapiens
ctgccagaggcctggtg

SEQ ID NO: 5888750 - DNA, 24 bp, Homo sapiens
ctgccagaggcctggtgccctggc

SEQ ID NO: 5888751 - DNA, 16 bp, Homo sapiens
ctgccagatgctgatg

SEQ ID NO: 5888752 - DNA, 12 bp, Homo sapiens
ctgccagcacag

SEQ ID NO: 5888753 - DNA, 15 bp, Homo sapiens
ctgccagcacagagc

SEQ ID NO: 5888754 - DNA, 13 bp, Homo sapiens
ctgccagcacagt

SEQ ID NO: 5888755 - DNA, 17 bp, Homo sapiens
ctgccagcacgcctggc

SEQ ID NO: 5888756 - DNA, 19 bp, Homo sapiens
ctgccagcagcagcaggtg

SEQ ID NO: 5888757 - DNA, 21 bp, Homo sapiens
ctgccagcagcagcaggtgat

SEQ ID NO: 5888758 - DNA, 14 bp, Homo sapiens
ctgccagcagcccc

SEQ ID NO: 5888759 - DNA, 15 bp, Homo sapiens
ctgccagcagccccg

SEQ ID NO: 5888760 - DNA, 19 bp, Homo sapiens
ctgccagcaggaataaaga

SEQ ID NO: 5888761 - DNA, 13 bp, Homo sapiens
ctgccagcagggg

SEQ ID NO: 5888762 - DNA, 23 bp, Homo sapiens
ctgccagccagcagccagctctc

SEQ ID NO: 5888763 - DNA, 21 bp, Homo sapiens
ctgccagccatcacaagggga

SEQ ID NO: 5888764 - DNA, 17 bp, Homo sapiens
ctgccagcccaccccct

SEQ ID NO: 5888765 - DNA, 23 bp, Homo sapiens
ctgccatgggccagcctagccct

SEQ ID NO: 5888766 - DNA, 20 bp, Homo sapiens
ctgccatgtacctcccctgc

SEQ ID NO: 5888767 - DNA, 14 bp, Homo sapiens
ctgccatgtaggct

SEQ ID NO: 5888768 - DNA, 13 bp, Homo sapiens
ctgccatgtccat

SEQ ID NO: 5888769 - DNA, 13 bp, Homo sapiens
ctgccatgtgtga

SEQ ID NO: 5888770 - DNA, 19 bp, Homo sapiens
ctgccatgtgtgagtcact

SEQ ID NO: 5888771 - DNA, 22 bp, Homo sapiens
ctgccatgtttagtgaatgact

SEQ ID NO: 5888772 - DNA, 15 bp, Homo sapiens
ctgccattacccagt

SEQ ID NO: 5888773 - DNA, 17 bp, Homo sapiens
ctgccattcacttcata

SEQ ID NO: 5888774 - DNA, 17 bp, Homo sapiens
ctgccattctgtgcagg

SEQ ID NO: 5888775 - DNA, 17 bp, Homo sapiens
ctgccattcttctggtg

SEQ ID NO: 5888776 - DNA, 14 bp, Homo sapiens
ctgccattggcctc

SEQ ID NO: 5888777 - DNA, 19 bp, Homo sapiens
ctgccattggcctcttgtc

SEQ ID NO: 5888778 - DNA, 14 bp, Homo sapiens
ctgccattgggacc

SEQ ID NO: 5888779 - DNA, 15 bp, Homo sapiens
ctgccatttccctga

SEQ ID NO: 5888780 - DNA, 15 bp, Homo sapiens
ctgccatttcccttc

SEQ ID NO: 5888781 - DNA, 16 bp, Homo sapiens
ctgccatttctgagat

SEQ ID NO: 5888782 - DNA, 17 bp, Homo sapiens
ctgcccaaaaatatggt

SEQ ID NO: 5888783 - DNA, 13 bp, Homo sapiens
ctgcccaaaatgt

SEQ ID NO: 5888784 - DNA, 21 bp, Homo sapiens
ctgcccaaacagctgtattta

SEQ ID NO: 5888785 - DNA, 17 bp, Homo sapiens
ctgcccaaactcccctt

SEQ ID NO: 5888786 - DNA, 18 bp, Homo sapiens
ctgcccaaactccccttc

SEQ ID NO: 5888787 - DNA, 18 bp, Homo sapiens
ctgcccaaattatgtgaa

SEQ ID NO: 5888788 - DNA, 20 bp, Homo sapiens
ctgcccaacccttccctcac

SEQ ID NO: 5888789 - DNA, 17 bp, Homo sapiens
ctgcccaacctctgtgg

SEQ ID NO: 5888790 - DNA, 14 bp, Homo sapiens
ctgcccaagcagcc

SEQ ID NO: 5888791 - DNA, 17 bp, Homo sapiens
ctgcccaagggcctccc

SEQ ID NO: 5888792 - DNA, 17 bp, Homo sapiens
ctgcccaagtgaccagg

SEQ ID NO: 5888793 - DNA, 19 bp, Homo sapiens
ctgcccaagtgaccaggga

SEQ ID NO: 5888794 - DNA, 14 bp, Homo sapiens
ctgcccaagtggct

SEQ ID NO: 5888795 - DNA, 19 bp, Homo sapiens
ctgcccaagtggctcttgg

SEQ ID NO: 5888796 - DNA, 20 bp, Homo sapiens
ctgcccaagtggctcttggg

SEQ ID NO: 5888797 - DNA, 23 bp, Homo sapiens
ctgcccaatcctccctggagaag

SEQ ID NO: 5888798 - DNA, 16 bp, Homo sapiens
ctgcccaatctgagca

SEQ ID NO: 5888799 - DNA, 16 bp, Homo sapiens
ctgcccaatgctttgg

SEQ ID NO: 5888800 - DNA, 21 bp, Homo sapiens
ctgcccaatgctttgggaggc

SEQ ID NO: 5888801 - DNA, 22 bp, Homo sapiens
ctgcccaatgctttgggaggcc

SEQ ID NO: 5888802 - DNA, 24 bp, Homo sapiens
ctgcccacaacgtcccctcaagcc

SEQ ID NO: 5888803 - DNA, 20 bp, Homo sapiens
ctgcccacaactcccttgca

SEQ ID NO: 5888804 - DNA, 23 bp, Homo sapiens
ctgcccacaactcccttgcacgt

SEQ ID NO: 5888805 - DNA, 15 bp, Homo sapiens
ctgcccacaagccat

SEQ ID NO: 5888806 - DNA, 17 bp, Homo sapiens
ctgcccacaccaccgcc

SEQ ID NO: 5888807 - DNA, 17 bp, Homo sapiens
ctgcccacacctcctgg

SEQ ID NO: 5888808 - DNA, 22 bp, Homo sapiens
ctgcccacagaaagccaggagc

SEQ ID NO: 5888809 - DNA, 15 bp, Homo sapiens
ctgcccacagcaggc

SEQ ID NO: 5888810 - DNA, 17 bp, Homo sapiens
ctgcccacattggaccc

SEQ ID NO: 5888811 - DNA, 21 bp, Homo sapiens
ctgcccacatttgggctcagg

SEQ ID NO: 5888812 - DNA, 13 bp, Homo sapiens
ctgcccaccaaag

SEQ ID NO: 5888813 - DNA, 21 bp, Homo sapiens
ctgcccaccaaaggtcaatgt

SEQ ID NO: 5888814 - DNA, 15 bp, Homo sapiens
ctgcccaccattccc

SEQ ID NO: 5888815 - DNA, 19 bp, Homo sapiens
ctgcccaccccatccctgg

SEQ ID NO: 5888816 - DNA, 20 bp, Homo sapiens
ctgcccaccccatccctggc

SEQ ID NO: 5888817 - DNA, 16 bp, Homo sapiens
ctgcccacccccggga

SEQ ID NO: 5888818 - DNA, 19 bp, Homo sapiens
ctgcccaccccctgctggt

SEQ ID NO: 5888819 - DNA, 12 bp, Homo sapiens
ctgcccacccgt

SEQ ID NO: 5888820 - DNA, 21 bp, Homo sapiens
ctgcccaccctaccagctcct

SEQ ID NO: 5888821 - DNA, 19 bp, Homo sapiens
ctgcccaccctcctgtacc

SEQ ID NO: 5888822 - DNA, 12 bp, Homo sapiens
ctgcccaccctg

SEQ ID NO: 5888823 - DNA, 16 bp, Homo sapiens
ctgcccaccctgggcc

SEQ ID NO: 5888824 - DNA, 20 bp, Homo sapiens
ctgcccaccctgggcctccc

SEQ ID NO: 5888825 - DNA, 16 bp, Homo sapiens
ctgcccaccgaccccc

SEQ ID NO: 5888826 - DNA, 23 bp, Homo sapiens
ctgcccaccgaccccctttctaa

SEQ ID NO: 5888827 - DNA, 13 bp, Homo sapiens
ctgcccacctctc

SEQ ID NO: 5888828 - DNA, 15 bp, Homo sapiens
ctgcccacctctccc

SEQ ID NO: 5888829 - DNA, 16 bp, Homo sapiens
ctgcccacctctccct

SEQ ID NO: 5888830 - DNA, 11 bp, Homo sapiens
ctgcccacctg

SEQ ID NO: 5888831 - DNA, 12 bp, Homo sapiens
ctgcccacctgc

SEQ ID NO: 5888832 - DNA, 13 bp, Homo sapiens
ctgcccacctgcc

SEQ ID NO: 5888833 - DNA, 16 bp, Homo sapiens
ctgcccacctgccagg

SEQ ID NO: 5888834 - DNA, 15 bp, Homo sapiens
ctgcccacctgcctg

SEQ ID NO: 5888835 - DNA, 19 bp, Homo sapiens
ctgcccacctgcctggccg

SEQ ID NO: 5888836 - DNA, 15 bp, Homo sapiens
ctgcccacctggcct

SEQ ID NO: 5888837 - DNA, 17 bp, Homo sapiens
ctgcccacctggcctct

SEQ ID NO: 5888838 - DNA, 20 bp, Homo sapiens
ctgcccacctggcctctgca

SEQ ID NO: 5888839 - DNA, 17 bp, Homo sapiens
ctgcccacctggctgcc

SEQ ID NO: 5888840 - DNA, 13 bp, Homo sapiens
ctgcccacctggg

SEQ ID NO: 5888841 - DNA, 15 bp, Homo sapiens
ctgcccacctggggt

SEQ ID NO: 5888842 - DNA, 19 bp, Homo sapiens
ctgcccacctggggtctct

SEQ ID NO: 5888843 - DNA, 23 bp, Homo sapiens
ctgcccacctggggtctctctcc

SEQ ID NO: 5888844 - DNA, 20 bp, Homo sapiens
ctgcccacgatcccctcccc

SEQ ID NO: 5888845 - DNA, 17 bp, Homo sapiens
ctgcccacgcagacctg

SEQ ID NO: 5888846 - DNA, 17 bp, Homo sapiens
ctgcccacgcagaggac

SEQ ID NO: 5888847 - DNA, 16 bp, Homo sapiens
ctgcccacgcccttgg

SEQ ID NO: 5888848 - DNA, 19 bp, Homo sapiens
ctgcccacgcccttggagc

SEQ ID NO: 5888849 - DNA, 12 bp, Homo sapiens
ctgcccacggcc

SEQ ID NO: 5888850 - DNA, 13 bp, Homo sapiens
ctgcccacggcca

SEQ ID NO: 5888851 - DNA, 15 bp, Homo sapiens
ctgcccacgggagga

SEQ ID NO: 5888852 - DNA, 22 bp, Homo sapiens
ctgcccacgtcccgggcactgt

SEQ ID NO: 5888853 - DNA, 23 bp, Homo sapiens
ctgcccacgtcccgggcactgtc

SEQ ID NO: 5888854 - DNA, 13 bp, Homo sapiens
ctgcccactctgg

SEQ ID NO: 5888855 - DNA, 16 bp, Homo sapiens
ctgcccactgctgcag

SEQ ID NO: 5888856 - DNA, 23 bp, Homo sapiens
ctgcccacttagccgtccatggc

SEQ ID NO: 5888857 - DNA, 13 bp, Homo sapiens
ctgcccacttcag

SEQ ID NO: 5888858 - DNA, 17 bp, Homo sapiens
ctgcccacttcagccca

SEQ ID NO: 5888859 - DNA, 15 bp, Homo sapiens
ctgcccacttcccct

SEQ ID NO: 5888860 - DNA, 21 bp, Homo sapiens
ctgcccagaaagtgggggtgg

SEQ ID NO: 5888861 - DNA, 14 bp, Homo sapiens
ctgcccagacacat

SEQ ID NO: 5888862 - DNA, 18 bp, Homo sapiens
ctgcccagacccctctgg

SEQ ID NO: 5888863 - DNA, 22 bp, Homo sapiens
ctgcccagacccctctggccag

SEQ ID NO: 5888864 - DNA, 23 bp, Homo sapiens
ctgcccagacccctctggccagg

SEQ ID NO: 5888865 - DNA, 22 bp, Homo sapiens
ctgcccagactgatgagcacat

SEQ ID NO: 5888866 - DNA, 21 bp, Homo sapiens
ctgcccagagctgctggtctc

SEQ ID NO: 5888867 - DNA, 17 bp, Homo sapiens
ctgcccagagctgggtg

SEQ ID NO: 5888868 - DNA, 19 bp, Homo sapiens
ctgcccagagtatgggcac

SEQ ID NO: 5888869 - DNA, 21 bp, Homo sapiens
ctgcccagatcagccagaagc

SEQ ID NO: 5888870 - DNA, 19 bp, Homo sapiens
ctgcccagatgccctttgg

SEQ ID NO: 5888871 - DNA, 22 bp, Homo sapiens
ctgcccagatgttttagagata

SEQ ID NO: 5888872 - DNA, 13 bp, Homo sapiens
ctgcccagcacct

SEQ ID NO: 5888873 - DNA, 21 bp, Homo sapiens
ctgcccagcacctcctccgtg

SEQ ID NO: 5888874 - DNA, 19 bp, Homo sapiens
ctgcccagcagcccctgag

SEQ ID NO: 5888875 - DNA, 18 bp, Homo sapiens
ctgcccagccacccctca

SEQ ID NO: 5888876 - DNA, 13 bp, Homo sapiens
ctgcccagccact

SEQ ID NO: 5888877 - DNA, 23 bp, Homo sapiens
ctgcccagcccatttgggctctg

SEQ ID NO: 5888878 - DNA, 12 bp, Homo sapiens
ctgcccagcccc

SEQ ID NO: 5888879 - DNA, 22 bp, Homo sapiens
ctgcccagccccttttctctgc

SEQ ID NO: 5888880 - DNA, 13 bp, Homo sapiens
ctgcccagccctc

SEQ ID NO: 5888881 - DNA, 21 bp, Homo sapiens
ctgcccagccctcccagctgg

SEQ ID NO: 5888882 - DNA, 13 bp, Homo sapiens
ctgcccagccctg

SEQ ID NO: 5888883 - DNA, 16 bp, Homo sapiens
ctgcccagccctggcc

SEQ ID NO: 5888884 - DNA, 17 bp, Homo sapiens
ctgcccagccctggccc

SEQ ID NO: 5888885 - DNA, 16 bp, Homo sapiens
ctgcccagcctcaatg

SEQ ID NO: 5888886 - DNA, 21 bp, Homo sapiens
ctgcccagcctcaatgtcact

SEQ ID NO: 5888887 - DNA, 15 bp, Homo sapiens
ctgcccagcctgccc

SEQ ID NO: 5888888 - DNA, 14 bp, Homo sapiens
ctgcccagcctgct

SEQ ID NO: 5888889 - DNA, 23 bp, Homo sapiens
ctgcccagcctggggcaaaccta

SEQ ID NO: 5888890 - DNA, 19 bp, Homo sapiens
ctgcccagctccccaactc

SEQ ID NO: 5888891 - DNA, 14 bp, Homo sapiens
ctgcccagctcctc

SEQ ID NO: 5888892 - DNA, 13 bp, Homo sapiens
ctgcccagctctg

SEQ ID NO: 5888893 - DNA, 15 bp, Homo sapiens
ctgcccagctgctcc

SEQ ID NO: 5888894 - DNA, 16 bp, Homo sapiens
ctgcccagcttgggcc

SEQ ID NO: 5888895 - DNA, 19 bp, Homo sapiens
ctgcccagcttgggcccag

SEQ ID NO: 5888896 - DNA, 20 bp, Homo sapiens
ctgcccagcttgggcccagc

SEQ ID NO: 5888897 - DNA, 23 bp, Homo sapiens
ctgcccagcttgggcccagctgg

SEQ ID NO: 5888898 - DNA, 17 bp, Homo sapiens
ctgcccaggagagccag

SEQ ID NO: 5888899 - DNA, 21 bp, Homo sapiens
ctgcccaggagagccagccct

SEQ ID NO: 5888900 - DNA, 22 bp, Homo sapiens
ctgcccaggagagccagccctc

SEQ ID NO: 5888901 - DNA, 16 bp, Homo sapiens
ctgcccaggagcagct

SEQ ID NO: 5888902 - DNA, 14 bp, Homo sapiens
ctgcccaggcaagg

SEQ ID NO: 5888903 - DNA, 16 bp, Homo sapiens
ctgcccaggcaaggaa

SEQ ID NO: 5888904 - DNA, 20 bp, Homo sapiens
ctgcccaggcactgctaggc

SEQ ID NO: 5888905 - DNA, 20 bp, Homo sapiens
ctgcccaggcagtctttgct

SEQ ID NO: 5888906 - DNA, 11 bp, Homo sapiens
ctgcccaggcc

SEQ ID NO: 5888907 - DNA, 12 bp, Homo sapiens
ctgcccaggcca

SEQ ID NO: 5888908 - DNA, 23 bp, Homo sapiens
ctgcccaggccacagagaacctg

SEQ ID NO: 5888909 - DNA, 16 bp, Homo sapiens
ctgcccaggccacagc

SEQ ID NO: 5888910 - DNA, 17 bp, Homo sapiens
ctgcccaggccacagcc

SEQ ID NO: 5888911 - DNA, 15 bp, Homo sapiens
ctgcccaggcccctg

SEQ ID NO: 5888912 - DNA, 16 bp, Homo sapiens
ctgcccaggcccctgc

SEQ ID NO: 5888913 - DNA, 19 bp, Homo sapiens
ctgcccaggcccctgccac

SEQ ID NO: 5888914 - DNA, 18 bp, Homo sapiens
ctgcccaggccggccagc

SEQ ID NO: 5888915 - DNA, 21 bp, Homo sapiens
ctgcccaggcctctcggtgct

SEQ ID NO: 5888916 - DNA, 14 bp, Homo sapiens
ctgcccaggctctg

SEQ ID NO: 5888917 - DNA, 17 bp, Homo sapiens
ctgcccaggctctgctg

SEQ ID NO: 5888918 - DNA, 19 bp, Homo sapiens
ctgcccaggctctgctgac

SEQ ID NO: 5888919 - DNA, 19 bp, Homo sapiens
ctgcccagggaagccctcg

SEQ ID NO: 5888920 - DNA, 17 bp, Homo sapiens
ctgcccagggagtcctt

SEQ ID NO: 5888921 - DNA, 14 bp, Homo sapiens
ctgcccaggggtgc

SEQ ID NO: 5888922 - DNA, 19 bp, Homo sapiens
ctgcccaggggtgccccct

SEQ ID NO: 5888923 - DNA, 20 bp, Homo sapiens
ctgcccaggggtgccccctc

SEQ ID NO: 5888924 - DNA, 22 bp, Homo sapiens
ctgcccaggggtgccccctcct

SEQ ID NO: 5888925 - DNA, 22 bp, Homo sapiens
ctgcccagggtcagtgtatcta

SEQ ID NO: 5888926 - DNA, 12 bp, Homo sapiens
ctgcccaggtgg

SEQ ID NO: 5888927 - DNA, 22 bp, Homo sapiens
ctgcccaggtggcctcctggcc

SEQ ID NO: 5888928 - DNA, 13 bp, Homo sapiens
ctgcccaggtggg

SEQ ID NO: 5888929 - DNA, 13 bp, Homo sapiens
ctgcccagtcccc

SEQ ID NO: 5888930 - DNA, 17 bp, Homo sapiens
ctgcccagtcgacccca

SEQ ID NO: 5888931 - DNA, 12 bp, Homo sapiens
ctgcccagtgca

SEQ ID NO: 5888932 - DNA, 20 bp, Homo sapiens
ctgcccagtgcaaaccactt

SEQ ID NO: 5888933 - DNA, 19 bp, Homo sapiens
ctgcccagtgcacttgctg

SEQ ID NO: 5888934 - DNA, 12 bp, Homo sapiens
ctgcccagtgtt

SEQ ID NO: 5888935 - DNA, 13 bp, Homo sapiens
ctgcccagttgca

SEQ ID NO: 5888936 - DNA, 15 bp, Homo sapiens
ctgcccatacccctg

SEQ ID NO: 5888937 - DNA, 21 bp, Homo sapiens
ctgcccatacccctgcctggg

SEQ ID NO: 5888938 - DNA, 19 bp, Homo sapiens
ctgcccatactgagcctgc

SEQ ID NO: 5888939 - DNA, 15 bp, Homo sapiens
ctgcccatcacaggg

SEQ ID NO: 5888940 - DNA, 18 bp, Homo sapiens
ctgcccatcatgtggccc

SEQ ID NO: 5888941 - DNA, 14 bp, Homo sapiens
ctgcccatcccacc

SEQ ID NO: 5888942 - DNA, 12 bp, Homo sapiens
ctgcccatgcct

SEQ ID NO: 5888943 - DNA, 17 bp, Homo sapiens
ctgccccggcctcctcg

SEQ ID NO: 5888944 - DNA, 19 bp, Homo sapiens
ctgccccgggtccccagct

SEQ ID NO: 5888945 - DNA, 21 bp, Homo sapiens
ctgccccgggtgcctcagagc

SEQ ID NO: 5888946 - DNA, 19 bp, Homo sapiens
ctgccccgtagagaatgtg

SEQ ID NO: 5888947 - DNA, 20 bp, Homo sapiens
ctgccccgtaggaggagact

SEQ ID NO: 5888948 - DNA, 24 bp, Homo sapiens
ctgccccgtccccctagagactca

SEQ ID NO: 5888949 - DNA, 14 bp, Homo sapiens
ctgccccgtcccct

SEQ ID NO: 5888950 - DNA, 16 bp, Homo sapiens
ctgccccgtcccctgg

SEQ ID NO: 5888951 - DNA, 19 bp, Homo sapiens
ctgccccgtgcagactgga

SEQ ID NO: 5888952 - DNA, 19 bp, Homo sapiens
ctgccccgtgtgaatgtag

SEQ ID NO: 5888953 - DNA, 17 bp, Homo sapiens
ctgccccgtgtgtgtgg

SEQ ID NO: 5888954 - DNA, 15 bp, Homo sapiens
ctgccccgttccctg

SEQ ID NO: 5888955 - DNA, 19 bp, Homo sapiens
ctgccccgttccctgtcag

SEQ ID NO: 5888956 - DNA, 16 bp, Homo sapiens
ctgcccctaactcctg

SEQ ID NO: 5888957 - DNA, 17 bp, Homo sapiens
ctgcccctaggatgctg

SEQ ID NO: 5888958 - DNA, 14 bp, Homo sapiens
ctgcccctcaactc

SEQ ID NO: 5888959 - DNA, 17 bp, Homo sapiens
ctgcccctcaccttggg

SEQ ID NO: 5888960 - DNA, 23 bp, Homo sapiens
ctgcccctcaccttgggctgggg

SEQ ID NO: 5888961 - DNA, 15 bp, Homo sapiens
ctgcccctcagagac

SEQ ID NO: 5888962 - DNA, 16 bp, Homo sapiens
ctgcccctcagggggc

SEQ ID NO: 5888963 - DNA, 18 bp, Homo sapiens
ctgcccctcagggggcca

SEQ ID NO: 5888964 - DNA, 20 bp, Homo sapiens
ctgcccctcagggggccagc

SEQ ID NO: 5888965 - DNA, 22 bp, Homo sapiens
ctgcccctcagggggccagctg

SEQ ID NO: 5888966 - DNA, 15 bp, Homo sapiens
ctgcccctcatgcca

SEQ ID NO: 5888967 - DNA, 19 bp, Homo sapiens
ctgcccctcccaacccagc

SEQ ID NO: 5888968 - DNA, 14 bp, Homo sapiens
ctgcccctcccaga

SEQ ID NO: 5888969 - DNA, 19 bp, Homo sapiens
ctgcccctccccaaaagaa

SEQ ID NO: 5888970 - DNA, 15 bp, Homo sapiens
ctgcccctcccccac

SEQ ID NO: 5888971 - DNA, 18 bp, Homo sapiens
ctgcccctccccctaccg

SEQ ID NO: 5888972 - DNA, 14 bp, Homo sapiens
ctgcccctccccgt

SEQ ID NO: 5888973 - DNA, 19 bp, Homo sapiens
ctgcccctccccgtccctg

SEQ ID NO: 5888974 - DNA, 23 bp, Homo sapiens
ctgcccctccccgtccctgtccc

SEQ ID NO: 5888975 - DNA, 13 bp, Homo sapiens
ctgcccctcccta

SEQ ID NO: 5888976 - DNA, 22 bp, Homo sapiens
ctgcccctccctagatccaggc

SEQ ID NO: 5888977 - DNA, 18 bp, Homo sapiens
ctgcccctccctcaggga

SEQ ID NO: 5888978 - DNA, 16 bp, Homo sapiens
ctgcccctccctgcca

SEQ ID NO: 5888979 - DNA, 19 bp, Homo sapiens
ctgcccctccctgcctcca

SEQ ID NO: 5888980 - DNA, 12 bp, Homo sapiens
ctgcccctcctg

SEQ ID NO: 5888981 - DNA, 18 bp, Homo sapiens
ctgcccctcgcacacagg

SEQ ID NO: 5888982 - DNA, 15 bp, Homo sapiens
ctgcccctctctggg

SEQ ID NO: 5888983 - DNA, 16 bp, Homo sapiens
ctgcccctctgttctc

SEQ ID NO: 5888984 - DNA, 17 bp, Homo sapiens
ctgcccctcttccctgg

SEQ ID NO: 5888985 - DNA, 14 bp, Homo sapiens
ctgcccctctttct

SEQ ID NO: 5888986 - DNA, 16 bp, Homo sapiens
ctgcccctctttctct

SEQ ID NO: 5888987 - DNA, 17 bp, Homo sapiens
ctgcccctctttctctt

SEQ ID NO: 5888988 - DNA, 22 bp, Homo sapiens
ctgcccctgagttctgacactg

SEQ ID NO: 5888989 - DNA, 19 bp, Homo sapiens
ctgcccctgatcactccca

SEQ ID NO: 5888990 - DNA, 22 bp, Homo sapiens
ctgcccctgatcactcccagca

SEQ ID NO: 5888991 - DNA, 12 bp, Homo sapiens
ctgcccctgcaa

SEQ ID NO: 5888992 - DNA, 15 bp, Homo sapiens
ctgcccctgcacagc

SEQ ID NO: 5888993 - DNA, 16 bp, Homo sapiens
ctgcccctgcagctgg

SEQ ID NO: 5888994 - DNA, 17 bp, Homo sapiens
ctgcccctgcagctgga

SEQ ID NO: 5888995 - DNA, 16 bp, Homo sapiens
ctgcccctgcagttgg

SEQ ID NO: 5888996 - DNA, 11 bp, Homo sapiens
ctgcccctgcc

SEQ ID NO: 5888997 - DNA, 14 bp, Homo sapiens
ctgcccctgcccga

SEQ ID NO: 5888998 - DNA, 16 bp, Homo sapiens
ctgcccctgccctgag

SEQ ID NO: 5888999 - DNA, 17 bp, Homo sapiens
ctgcccctgccctgagg

SEQ ID NO: 5889000 - DNA, 19 bp, Homo sapiens
ctgcccctgccctgaggag

SEQ ID NO: 5889001 - DNA, 18 bp, Homo sapiens
ctgcccctgccgcctgtg

SEQ ID NO: 5889002 - DNA, 21 bp, Homo sapiens
ctgcccctgccgcctgtgccc

SEQ ID NO: 5889003 - DNA, 13 bp, Homo sapiens
ctgcccctgcctg

SEQ ID NO: 5889004 - DNA, 22 bp, Homo sapiens
ctgcccctgcgtggcctgagtc

SEQ ID NO: 5889005 - DNA, 23 bp, Homo sapiens
ctgcccctgctactgccaacctc

SEQ ID NO: 5889006 - DNA, 13 bp, Homo sapiens
ctgcccctgctgc

SEQ ID NO: 5889007 - DNA, 12 bp, Homo sapiens
ctgcccctggca

SEQ ID NO: 5889008 - DNA, 15 bp, Homo sapiens
ctgcccctggcagcc

SEQ ID NO: 5889009 - DNA, 17 bp, Homo sapiens
ctgcccctggcagcccc

SEQ ID NO: 5889010 - DNA, 15 bp, Homo sapiens
ctgcccctgtaaggt

SEQ ID NO: 5889011 - DNA, 23 bp, Homo sapiens
ctgcccctgtaaggtttcaatgc

SEQ ID NO: 5889012 - DNA, 17 bp, Homo sapiens
ctgcccctgtaggttgc

SEQ ID NO: 5889013 - DNA, 19 bp, Homo sapiens
ctgcccctgtgcctctgtc

SEQ ID NO: 5889014 - DNA, 16 bp, Homo sapiens
ctgcccctgtgggact

SEQ ID NO: 5889015 - DNA, 17 bp, Homo sapiens
ctgcccctgtgggactc

SEQ ID NO: 5889016 - DNA, 16 bp, Homo sapiens
ctgccccttaacccca

SEQ ID NO: 5889017 - DNA, 21 bp, Homo sapiens
ctgccccttaaccccaaggac

SEQ ID NO: 5889018 - DNA, 13 bp, Homo sapiens
ctgccccttcccc

SEQ ID NO: 5889019 - DNA, 19 bp, Homo sapiens
ctgccccttctacactctc

SEQ ID NO: 5889020 - DNA, 22 bp, Homo sapiens
ctgccccttctacactctcctg

SEQ ID NO: 5889021 - DNA, 17 bp, Homo sapiens
ctgccccttgaccccac

SEQ ID NO: 5889022 - DNA, 22 bp, Homo sapiens
ctgccccttgaccccacacgcc

SEQ ID NO: 5889023 - DNA, 12 bp, Homo sapiens
ctgccccttgca

SEQ ID NO: 5889024 - DNA, 13 bp, Homo sapiens
ctgccccttgcaa

SEQ ID NO: 5889025 - DNA, 14 bp, Homo sapiens
ctgccccttgcaag

SEQ ID NO: 5889026 - DNA, 17 bp, Homo sapiens
ctgccccttgcaagcca

SEQ ID NO: 5889027 - DNA, 13 bp, Homo sapiens
ctgccccttgggc

SEQ ID NO: 5889028 - DNA, 18 bp, Homo sapiens
ctgccccttgggcatcca

SEQ ID NO: 5889029 - DNA, 16 bp, Homo sapiens
ctgccccttgggcctc

SEQ ID NO: 5889030 - DNA, 18 bp, Homo sapiens
ctgcccctttcaggccta

SEQ ID NO: 5889031 - DNA, 21 bp, Homo sapiens
ctgcccctttcaggcctacag

SEQ ID NO: 5889032 - DNA, 18 bp, Homo sapiens
ctgcccctttcttcccca

SEQ ID NO: 5889033 - DNA, 17 bp, Homo sapiens
ctgcccgactcaggtcc

SEQ ID NO: 5889034 - DNA, 20 bp, Homo sapiens
ctgcccgagagagaccccac

SEQ ID NO: 5889035 - DNA, 16 bp, Homo sapiens
ctgcccgagagctctt

SEQ ID NO: 5889036 - DNA, 17 bp, Homo sapiens
ctgcccgagctggtgca

SEQ ID NO: 5889037 - DNA, 19 bp, Homo sapiens
ctgcccgaggtcgctgcag

SEQ ID NO: 5889038 - DNA, 14 bp, Homo sapiens
ctgcccgatccaga

SEQ ID NO: 5889039 - DNA, 23 bp, Homo sapiens
ctgcccgatccagattcccaggc

SEQ ID NO: 5889040 - DNA, 15 bp, Homo sapiens
ctgcccgcacagcag

SEQ ID NO: 5889041 - DNA, 22 bp, Homo sapiens
ctgcccgcaccctggcctggtc

SEQ ID NO: 5889042 - DNA, 20 bp, Homo sapiens
ctgcccgcagacctctggat

SEQ ID NO: 5889043 - DNA, 13 bp, Homo sapiens
ctgcccgcagagc

SEQ ID NO: 5889044 - DNA, 15 bp, Homo sapiens
ctgcccgcagagccc

SEQ ID NO: 5889045 - DNA, 21 bp, Homo sapiens
ctgcccgcccagcacccccag

SEQ ID NO: 5889046 - DNA, 18 bp, Homo sapiens
ctgcccgcctcggcctcc

SEQ ID NO: 5889047 - DNA, 15 bp, Homo sapiens
ctgcccgcctgccca

SEQ ID NO: 5889048 - DNA, 22 bp, Homo sapiens
ctgcccgcctgcccacctgcct

SEQ ID NO: 5889049 - DNA, 19 bp, Homo sapiens
ctgcccgcgggagacagct

SEQ ID NO: 5889050 - DNA, 22 bp, Homo sapiens
ctgcccgcgggtggctggagcc

SEQ ID NO: 5889051 - DNA, 13 bp, Homo sapiens
ctgcccgctccca

SEQ ID NO: 5889052 - DNA, 15 bp, Homo sapiens
ctgcccgctcccagt

SEQ ID NO: 5889053 - DNA, 19 bp, Homo sapiens
ctgcccgctcccagtgtct

SEQ ID NO: 5889054 - DNA, 21 bp, Homo sapiens
ctgcccgctgcaatgcctaga

SEQ ID NO: 5889055 - DNA, 21 bp, Homo sapiens
ctgcccggagggttcactgag

SEQ ID NO: 5889056 - DNA, 20 bp, Homo sapiens
ctgcccggcccaggagcgca

SEQ ID NO: 5889057 - DNA, 15 bp, Homo sapiens
ctgcccggcgccctc

SEQ ID NO: 5889058 - DNA, 16 bp, Homo sapiens
ctgcccggcgccctct

SEQ ID NO: 5889059 - DNA, 21 bp, Homo sapiens
ctgcccggcgccctctgtcct

SEQ ID NO: 5889060 - DNA, 22 bp, Homo sapiens
ctgcccggcgccctctgtcctg

SEQ ID NO: 5889061 - DNA, 17 bp, Homo sapiens
ctgcccggcgcctgccc

SEQ ID NO: 5889062 - DNA, 11 bp, Homo sapiens
ctgcccggctg

SEQ ID NO: 5889063 - DNA, 21 bp, Homo sapiens
ctgcccgggaaggtcaccagc

SEQ ID NO: 5889064 - DNA, 13 bp, Homo sapiens
ctgcccgggcccc

SEQ ID NO: 5889065 - DNA, 13 bp, Homo sapiens
ctgcccggggagc

SEQ ID NO: 5889066 - DNA, 14 bp, Homo sapiens
ctgcccggggagct

SEQ ID NO: 5889067 - DNA, 17 bp, Homo sapiens
ctgcccggggagctgca

SEQ ID NO: 5889068 - DNA, 21 bp, Homo sapiens
ctgcccggggagctgcagagc

SEQ ID NO: 5889069 - DNA, 23 bp, Homo sapiens
ctgcccggggcagctgccagaga

SEQ ID NO: 5889070 - DNA, 13 bp, Homo sapiens
ctgcccggggtgg

SEQ ID NO: 5889071 - DNA, 23 bp, Homo sapiens
ctgcccggtggtttgccatgtcg

SEQ ID NO: 5889072 - DNA, 18 bp, Homo sapiens
ctgcccgtaaacacgcct

SEQ ID NO: 5889073 - DNA, 21 bp, Homo sapiens
ctgcccgtctctctcccatgg

SEQ ID NO: 5889074 - DNA, 22 bp, Homo sapiens
ctgcccgtctctctcccatgga

SEQ ID NO: 5889075 - DNA, 24 bp, Homo sapiens
ctgcccgtctctctcccatggagc

SEQ ID NO: 5889076 - DNA, 16 bp, Homo sapiens
ctgcccgtcttcagcc

SEQ ID NO: 5889077 - DNA, 21 bp, Homo sapiens
ctgcccgtcttcagcctagcc

SEQ ID NO: 5889078 - DNA, 20 bp, Homo sapiens
ctgcccgtgaggagggggag

SEQ ID NO: 5889079 - DNA, 15 bp, Homo sapiens
ctgcccgtgccctgg

SEQ ID NO: 5889080 - DNA, 18 bp, Homo sapiens
ctgcccgtgccctggtga

SEQ ID NO: 5889081 - DNA, 14 bp, Homo sapiens
ctgcccgtgtacat

SEQ ID NO: 5889082 - DNA, 17 bp, Homo sapiens
ctgcccgttgccgggcc

SEQ ID NO: 5889083 - DNA, 20 bp, Homo sapiens
ctgcccgttgccgggcctgg

SEQ ID NO: 5889084 - DNA, 22 bp, Homo sapiens
ctgcccgttgccgggcctggac

SEQ ID NO: 5889085 - DNA, 22 bp, Homo sapiens
ctgccctaactctgcccaccct

SEQ ID NO: 5889086 - DNA, 18 bp, Homo sapiens
ctgccctaagcccccagg

SEQ ID NO: 5889087 - DNA, 22 bp, Homo sapiens
ctgccctaagcccccagggcct

SEQ ID NO: 5889088 - DNA, 22 bp, Homo sapiens
ctgccctaatgcgcaggctggc

SEQ ID NO: 5889089 - DNA, 21 bp, Homo sapiens
ctgccctagcagtttgcctct

SEQ ID NO: 5889090 - DNA, 16 bp, Homo sapiens
ctgccctatgggcctg

SEQ ID NO: 5889091 - DNA, 21 bp, Homo sapiens
ctgccctatgggcctgccggg

SEQ ID NO: 5889092 - DNA, 19 bp, Homo sapiens
ctgccctcactccctctgc

SEQ ID NO: 5889093 - DNA, 20 bp, Homo sapiens
ctgccctcaggctccccagt

SEQ ID NO: 5889094 - DNA, 22 bp, Homo sapiens
ctgccctcaggctccccagtgc

SEQ ID NO: 5889095 - DNA, 12 bp, Homo sapiens
ctgccctcaggg

SEQ ID NO: 5889096 - DNA, 13 bp, Homo sapiens
ctgccctcaggga

SEQ ID NO: 5889097 - DNA, 20 bp, Homo sapiens
ctgccctcattactgggcct

SEQ ID NO: 5889098 - DNA, 22 bp, Homo sapiens
ctgccctccacacccgcgcccc

SEQ ID NO: 5889099 - DNA, 22 bp, Homo sapiens
ctgccctccacccacacctgcc

SEQ ID NO: 5889100 - DNA, 12 bp, Homo sapiens
ctgccctccagg

SEQ ID NO: 5889101 - DNA, 13 bp, Homo sapiens
ctgccctccaggg

SEQ ID NO: 5889102 - DNA, 15 bp, Homo sapiens
ctgccctccagggcc

SEQ ID NO: 5889103 - DNA, 18 bp, Homo sapiens
ctgccctccagggccagg

SEQ ID NO: 5889104 - DNA, 20 bp, Homo sapiens
ctgccctccagggccaggat

SEQ ID NO: 5889105 - DNA, 16 bp, Homo sapiens
ctgccctcccaagtcc

SEQ ID NO: 5889106 - DNA, 20 bp, Homo sapiens
ctgccctcccaagtcccacc

SEQ ID NO: 5889107 - DNA, 16 bp, Homo sapiens
ctgccctcccacagcc

SEQ ID NO: 5889108 - DNA, 23 bp, Homo sapiens
ctgccctcccaccccctccccgg

SEQ ID NO: 5889109 - DNA, 15 bp, Homo sapiens
ctgccctcccccacg

SEQ ID NO: 5889110 - DNA, 19 bp, Homo sapiens
ctgccctcccctgctccca

SEQ ID NO: 5889111 - DNA, 16 bp, Homo sapiens
ctgccctcccgcacct

SEQ ID NO: 5889112 - DNA, 14 bp, Homo sapiens
ctgccctccctcag

SEQ ID NO: 5889113 - DNA, 17 bp, Homo sapiens
ctgccctccctccttcc

SEQ ID NO: 5889114 - DNA, 14 bp, Homo sapiens
ctgccctccctcgg

SEQ ID NO: 5889115 - DNA, 16 bp, Homo sapiens
ctgccctccctggagc

SEQ ID NO: 5889116 - DNA, 14 bp, Homo sapiens
ctgccctccctggc

SEQ ID NO: 5889117 - DNA, 23 bp, Homo sapiens
ctgccctccgccccgtcccccca

SEQ ID NO: 5889118 - DNA, 15 bp, Homo sapiens
ctgccctccggagga

SEQ ID NO: 5889119 - DNA, 11 bp, Homo sapiens
ctgccctcctc

SEQ ID NO: 5889120 - DNA, 13 bp, Homo sapiens
ctgccgcagagct

SEQ ID NO: 5889121 - DNA, 19 bp, Homo sapiens
ctgccgcagccctgcagag

SEQ ID NO: 5889122 - DNA, 20 bp, Homo sapiens
ctgccgcagccctgcagagg

SEQ ID NO: 5889123 - DNA, 18 bp, Homo sapiens
ctgccgcatcatgggagt

SEQ ID NO: 5889124 - DNA, 16 bp, Homo sapiens
ctgccgcatctgcctg

SEQ ID NO: 5889125 - DNA, 22 bp, Homo sapiens
ctgccgcatctgcctggagcct

SEQ ID NO: 5889126 - DNA, 11 bp, Homo sapiens
ctgccgccacc

SEQ ID NO: 5889127 - DNA, 14 bp, Homo sapiens
ctgccgccaccacg

SEQ ID NO: 5889128 - DNA, 13 bp, Homo sapiens
ctgccgcccacct

SEQ ID NO: 5889129 - DNA, 22 bp, Homo sapiens
ctgccgcccacctcgctcccct

SEQ ID NO: 5889130 - DNA, 18 bp, Homo sapiens
ctgccgccccctcctgaa

SEQ ID NO: 5889131 - DNA, 14 bp, Homo sapiens
ctgccgccctgtgg

SEQ ID NO: 5889132 - DNA, 23 bp, Homo sapiens
ctgccgccctgtgggagccgcag

SEQ ID NO: 5889133 - DNA, 16 bp, Homo sapiens
ctgccgcccttcctgg

SEQ ID NO: 5889134 - DNA, 20 bp, Homo sapiens
ctgccgccgcccgctgggga

SEQ ID NO: 5889135 - DNA, 17 bp, Homo sapiens
ctgccgccgcctcccgg

SEQ ID NO: 5889136 - DNA, 17 bp, Homo sapiens
ctgccgcctcaccttcc

SEQ ID NO: 5889137 - DNA, 16 bp, Homo sapiens
ctgccgcctcccagcc

SEQ ID NO: 5889138 - DNA, 18 bp, Homo sapiens
ctgccgcctcccagcctg

SEQ ID NO: 5889139 - DNA, 22 bp, Homo sapiens
ctgccgcctgcgtttggaggcc

SEQ ID NO: 5889140 - DNA, 15 bp, Homo sapiens
ctgccgcctggggct

SEQ ID NO: 5889141 - DNA, 21 bp, Homo sapiens
ctgccgcctgtgcccttgctg

SEQ ID NO: 5889142 - DNA, 13 bp, Homo sapiens
ctgccgctacctc

SEQ ID NO: 5889143 - DNA, 14 bp, Homo sapiens
ctgccgctgcacct

SEQ ID NO: 5889144 - DNA, 16 bp, Homo sapiens
ctgccgctgccatgct

SEQ ID NO: 5889145 - DNA, 19 bp, Homo sapiens
ctgccgctgccatgctttg

SEQ ID NO: 5889146 - DNA, 12 bp, Homo sapiens
ctgccgctgccc

SEQ ID NO: 5889147 - DNA, 15 bp, Homo sapiens
ctgccgctgccccca

SEQ ID NO: 5889148 - DNA, 18 bp, Homo sapiens
ctgccgctgcccccaccc

SEQ ID NO: 5889149 - DNA, 21 bp, Homo sapiens
ctgccgctgcccccaccctgc

SEQ ID NO: 5889150 - DNA, 13 bp, Homo sapiens
ctgccgctgcttg

SEQ ID NO: 5889151 - DNA, 15 bp, Homo sapiens
ctgccgctgcttgag

SEQ ID NO: 5889152 - DNA, 16 bp, Homo sapiens
ctgccggagaggaaga

SEQ ID NO: 5889153 - DNA, 15 bp, Homo sapiens
ctgccggcacagctg

SEQ ID NO: 5889154 - DNA, 17 bp, Homo sapiens
ctgccggcacagctggg

SEQ ID NO: 5889155 - DNA, 21 bp, Homo sapiens
ctgccggcaggatgcagcgcc

SEQ ID NO: 5889156 - DNA, 15 bp, Homo sapiens
ctgccggcagtgctg

SEQ ID NO: 5889157 - DNA, 17 bp, Homo sapiens
ctgccggcagtgctggt

SEQ ID NO: 5889158 - DNA, 16 bp, Homo sapiens
ctgccggcccccagga

SEQ ID NO: 5889159 - DNA, 16 bp, Homo sapiens
ctgccggccccccaag

SEQ ID NO: 5889160 - DNA, 23 bp, Homo sapiens
ctgccggccccccaaggatgggg

SEQ ID NO: 5889161 - DNA, 16 bp, Homo sapiens
ctgccggccctggggc

SEQ ID NO: 5889162 - DNA, 20 bp, Homo sapiens
ctgccggccgcccagacacc

SEQ ID NO: 5889163 - DNA, 16 bp, Homo sapiens
ctgccggctccttggt

SEQ ID NO: 5889164 - DNA, 17 bp, Homo sapiens
ctgccggctctggctct

SEQ ID NO: 5889165 - DNA, 22 bp, Homo sapiens
ctgccggctctgggcctgaggg

SEQ ID NO: 5889166 - DNA, 18 bp, Homo sapiens
ctgccggctctgggctgg

SEQ ID NO: 5889167 - DNA, 14 bp, Homo sapiens
ctgccggctctttc

SEQ ID NO: 5889168 - DNA, 22 bp, Homo sapiens
ctgccggctctttccttgctca

SEQ ID NO: 5889169 - DNA, 13 bp, Homo sapiens
ctgccggggcagc

SEQ ID NO: 5889170 - DNA, 17 bp, Homo sapiens
ctgccggggcagccccc

SEQ ID NO: 5889171 - DNA, 15 bp, Homo sapiens
ctgccgggtgggggg

SEQ ID NO: 5889172 - DNA, 14 bp, Homo sapiens
ctgccgggttctag

SEQ ID NO: 5889173 - DNA, 18 bp, Homo sapiens
ctgccggtcacccaggct

SEQ ID NO: 5889174 - DNA, 15 bp, Homo sapiens
ctgccggtcccccat

SEQ ID NO: 5889175 - DNA, 20 bp, Homo sapiens
ctgccggtcgggcagccagc

SEQ ID NO: 5889176 - DNA, 22 bp, Homo sapiens
ctgccggtcgggcagccagcag

SEQ ID NO: 5889177 - DNA, 18 bp, Homo sapiens
ctgccggtgggaccctgt

SEQ ID NO: 5889178 - DNA, 21 bp, Homo sapiens
ctgccggtgggaccctgtccg

SEQ ID NO: 5889179 - DNA, 22 bp, Homo sapiens
ctgccggtgggaccctgtccgg

SEQ ID NO: 5889180 - DNA, 16 bp, Homo sapiens
ctgccggtggggccag

SEQ ID NO: 5889181 - DNA, 20 bp, Homo sapiens
ctgccggtggggccagcgct

SEQ ID NO: 5889182 - DNA, 16 bp, Homo sapiens
ctgccgtcaccaccac

SEQ ID NO: 5889183 - DNA, 18 bp, Homo sapiens
ctgccgtcaccaccaccc

SEQ ID NO: 5889184 - DNA, 20 bp, Homo sapiens
ctgccgtcaccaccacccct

SEQ ID NO: 5889185 - DNA, 22 bp, Homo sapiens
ctgccgtcaccaccacccctac

SEQ ID NO: 5889186 - DNA, 20 bp, Homo sapiens
ctgccgtcacccactctgca

SEQ ID NO: 5889187 - DNA, 13 bp, Homo sapiens
ctgccgtcagtgc

SEQ ID NO: 5889188 - DNA, 22 bp, Homo sapiens
ctgccgtcccctagagtcccag

SEQ ID NO: 5889189 - DNA, 15 bp, Homo sapiens
ctgccgtctctcctg

SEQ ID NO: 5889190 - DNA, 17 bp, Homo sapiens
ctgccgtctctcctgct

SEQ ID NO: 5889191 - DNA, 23 bp, Homo sapiens
ctgccgtctctcctgctctcata

SEQ ID NO: 5889192 - DNA, 23 bp, Homo sapiens
ctgccgtgagagcccaatcactg

SEQ ID NO: 5889193 - DNA, 19 bp, Homo sapiens
ctgccgtgcacggggccag

SEQ ID NO: 5889194 - DNA, 20 bp, Homo sapiens
ctgccgtgcatggctcctgt

SEQ ID NO: 5889195 - DNA, 21 bp, Homo sapiens
ctgccgtgcatggctcctgtc

SEQ ID NO: 5889196 - DNA, 15 bp, Homo sapiens
ctgccgtgccgcctg

SEQ ID NO: 5889197 - DNA, 22 bp, Homo sapiens
ctgccgtgggcctgtcgtgcca

SEQ ID NO: 5889198 - DNA, 13 bp, Homo sapiens
ctgccgttttctg

SEQ ID NO: 5889199 - DNA, 18 bp, Homo sapiens
ctgccgttttctgggctg

SEQ ID NO: 5889200 - DNA, 20 bp, Homo sapiens
ctgcctaaatccactctgca

SEQ ID NO: 5889201 - DNA, 20 bp, Homo sapiens
ctgcctaaattaaattgggc

SEQ ID NO: 5889202 - DNA, 20 bp, Homo sapiens
ctgcctaaccaggcccagcc

SEQ ID NO: 5889203 - DNA, 21 bp, Homo sapiens
ctgcctaaccaggcccagcca

SEQ ID NO: 5889204 - DNA, 21 bp, Homo sapiens
ctgcctaaccatgggctcagg

SEQ ID NO: 5889205 - DNA, 15 bp, Homo sapiens
ctgcctaaggacttc

SEQ ID NO: 5889206 - DNA, 20 bp, Homo sapiens
ctgcctaaggacttctttaa

SEQ ID NO: 5889207 - DNA, 22 bp, Homo sapiens
ctgcctaaggacttctttaatt

SEQ ID NO: 5889208 - DNA, 18 bp, Homo sapiens
ctgcctaagtggctgctg

SEQ ID NO: 5889209 - DNA, 12 bp, Homo sapiens
ctgcctaataaa

SEQ ID NO: 5889210 - DNA, 14 bp, Homo sapiens
ctgcctaataaaga

SEQ ID NO: 5889211 - DNA, 23 bp, Homo sapiens
ctgcctaattttgccaaaatcct

SEQ ID NO: 5889212 - DNA, 15 bp, Homo sapiens
ctgcctacagccagg

SEQ ID NO: 5889213 - DNA, 15 bp, Homo sapiens
ctgcctacattccct

SEQ ID NO: 5889214 - DNA, 23 bp, Homo sapiens
ctgcctacattccctggcctggc

SEQ ID NO: 5889215 - DNA, 22 bp, Homo sapiens
ctgcctaccagtcgccctctgt

SEQ ID NO: 5889216 - DNA, 18 bp, Homo sapiens
ctgcctacgttctcttta

SEQ ID NO: 5889217 - DNA, 22 bp, Homo sapiens
ctgcctactgcccctgccctga

SEQ ID NO: 5889218 - DNA, 12 bp, Homo sapiens
ctgcctagaaaa

SEQ ID NO: 5889219 - DNA, 15 bp, Homo sapiens
ctgcctagaaacaac

SEQ ID NO: 5889220 - DNA, 15 bp, Homo sapiens
ctgcctagaaacagt

SEQ ID NO: 5889221 - DNA, 14 bp, Homo sapiens
ctgcctagagtgta

SEQ ID NO: 5889222 - DNA, 20 bp, Homo sapiens
ctgcctagatccacgtgtgg

SEQ ID NO: 5889223 - DNA, 17 bp, Homo sapiens
ctgcctagcaagctggc

SEQ ID NO: 5889224 - DNA, 18 bp, Homo sapiens
ctgcctagcaagctggcc

SEQ ID NO: 5889225 - DNA, 20 bp, Homo sapiens
ctgcctagcaagctggcctc

SEQ ID NO: 5889226 - DNA, 17 bp, Homo sapiens
ctgcctagcactcacat

SEQ ID NO: 5889227 - DNA, 19 bp, Homo sapiens
ctgcctagcatggggtcag

SEQ ID NO: 5889228 - DNA, 17 bp, Homo sapiens
ctgcctagctgcctagc

SEQ ID NO: 5889229 - DNA, 21 bp, Homo sapiens
ctgcctagctgcctagcaagc

SEQ ID NO: 5889230 - DNA, 14 bp, Homo sapiens
ctgcctaggagctg

SEQ ID NO: 5889231 - DNA, 15 bp, Homo sapiens
ctgcctaggagctgg

SEQ ID NO: 5889232 - DNA, 16 bp, Homo sapiens
ctgcctaggagctggc

SEQ ID NO: 5889233 - DNA, 18 bp, Homo sapiens
ctgcctaggagctggctg

SEQ ID NO: 5889234 - DNA, 20 bp, Homo sapiens
ctgcctaggagctggctggc

SEQ ID NO: 5889235 - DNA, 23 bp, Homo sapiens
ctgcctaggagctggctggcagg

SEQ ID NO: 5889236 - DNA, 17 bp, Homo sapiens
ctgcctagggttgcttg

SEQ ID NO: 5889237 - DNA, 17 bp, Homo sapiens
ctgcctaggttctgtta

SEQ ID NO: 5889238 - DNA, 17 bp, Homo sapiens
ctgcctaggtttttcct

SEQ ID NO: 5889239 - DNA, 20 bp, Homo sapiens
ctgcctataatcttatacaa

SEQ ID NO: 5889240 - DNA, 16 bp, Homo sapiens
ctgcctatccatcctg

SEQ ID NO: 5889241 - DNA, 18 bp, Homo sapiens
ctgcctatccatcctgcg

SEQ ID NO: 5889242 - DNA, 21 bp, Homo sapiens
ctgcctatcctctgtatatag

SEQ ID NO: 5889243 - DNA, 20 bp, Homo sapiens
ctgcctatgacacagaagcc

SEQ ID NO: 5889244 - DNA, 14 bp, Homo sapiens
ctgcctatgcactg

SEQ ID NO: 5889245 - DNA, 22 bp, Homo sapiens
ctgcctatgcactgaagagctc

SEQ ID NO: 5889246 - DNA, 15 bp, Homo sapiens
ctgcctatgttgggg

SEQ ID NO: 5889247 - DNA, 17 bp, Homo sapiens
ctgcctattatctgtca

SEQ ID NO: 5889248 - DNA, 22 bp, Homo sapiens
ctgcctattgcagctgggagaa

SEQ ID NO: 5889249 - DNA, 14 bp, Homo sapiens
ctgcctattgctga

SEQ ID NO: 5889250 - DNA, 16 bp, Homo sapiens
ctgcctatttattggg

SEQ ID NO: 5889251 - DNA, 18 bp, Homo sapiens
ctgcctatttattggggt

SEQ ID NO: 5889252 - DNA, 15 bp, Homo sapiens
ctgcctcaactccac

SEQ ID NO: 5889253 - DNA, 21 bp, Homo sapiens
ctgcctcaatgtgaatcagac

SEQ ID NO: 5889254 - DNA, 24 bp, Homo sapiens
ctgcctcacatctcccttccacct

SEQ ID NO: 5889255 - DNA, 14 bp, Homo sapiens
ctgcctcacccaca

SEQ ID NO: 5889256 - DNA, 16 bp, Homo sapiens
ctgcctcacccacacc

SEQ ID NO: 5889257 - DNA, 16 bp, Homo sapiens
ctgcctcaccgcttcc

SEQ ID NO: 5889258 - DNA, 21 bp, Homo sapiens
ctgcctcactcctccgtgagc

SEQ ID NO: 5889259 - DNA, 13 bp, Homo sapiens
ctgcctcactgtg

SEQ ID NO: 5889260 - DNA, 18 bp, Homo sapiens
ctgcctcactgtgacctg

SEQ ID NO: 5889261 - DNA, 22 bp, Homo sapiens
ctgcctcactgtgacctgctcc

SEQ ID NO: 5889262 - DNA, 23 bp, Homo sapiens
ctgcctcacttcctacaagagca

SEQ ID NO: 5889263 - DNA, 15 bp, Homo sapiens
ctgcctcagccagtg

SEQ ID NO: 5889264 - DNA, 20 bp, Homo sapiens
ctgcctcagccagtggcaca

SEQ ID NO: 5889265 - DNA, 15 bp, Homo sapiens
ctgcctcagcctccc

SEQ ID NO: 5889266 - DNA, 17 bp, Homo sapiens
ctgcctcagcctcccga

SEQ ID NO: 5889267 - DNA, 20 bp, Homo sapiens
ctgcctcagcctccctggta

SEQ ID NO: 5889268 - DNA, 20 bp, Homo sapiens
ctgcctcagcctcctgaaca

SEQ ID NO: 5889269 - DNA, 18 bp, Homo sapiens
ctgcctcagcctcctgag

SEQ ID NO: 5889270 - DNA, 14 bp, Homo sapiens
ctgcctcagccttc

SEQ ID NO: 5889271 - DNA, 17 bp, Homo sapiens
ctgcctcagccttccaa

SEQ ID NO: 5889272 - DNA, 22 bp, Homo sapiens
ctgcctcagccttctgagtagc

SEQ ID NO: 5889273 - DNA, 17 bp, Homo sapiens
ctgcctcagctgacccg

SEQ ID NO: 5889274 - DNA, 13 bp, Homo sapiens
ctgcctcaggacc

SEQ ID NO: 5889275 - DNA, 21 bp, Homo sapiens
ctgcctcaggacccatccctg

SEQ ID NO: 5889276 - DNA, 14 bp, Homo sapiens
ctgcctcaggactg

SEQ ID NO: 5889277 - DNA, 22 bp, Homo sapiens
ctgcctcaggaggtcacctgcc

SEQ ID NO: 5889278 - DNA, 15 bp, Homo sapiens
ctgcctcaggcactc

SEQ ID NO: 5889279 - DNA, 12 bp, Homo sapiens
ctgcctcaggtt

SEQ ID NO: 5889280 - DNA, 12 bp, Homo sapiens
ctgcctcagtgg

SEQ ID NO: 5889281 - DNA, 13 bp, Homo sapiens
ctgcctcagtggc

SEQ ID NO: 5889282 - DNA, 14 bp, Homo sapiens
ctgcctcagtggca

SEQ ID NO: 5889283 - DNA, 17 bp, Homo sapiens
ctgcctcagtggcagca

SEQ ID NO: 5889284 - DNA, 22 bp, Homo sapiens
ctgcctcagtggctctgggtac

SEQ ID NO: 5889285 - DNA, 21 bp, Homo sapiens
ctgcctcatcctcctcctcat

SEQ ID NO: 5889286 - DNA, 21 bp, Homo sapiens
ctgcctcatcgtggctgggaa

SEQ ID NO: 5889287 - DNA, 22 bp, Homo sapiens
ctgcctcatgaccctcctgtcc

SEQ ID NO: 5889288 - DNA, 22 bp, Homo sapiens
ctgcctccaagatttaacctgc

SEQ ID NO: 5889289 - DNA, 16 bp, Homo sapiens
ctgcctccaagtcatg

SEQ ID NO: 5889290 - DNA, 20 bp, Homo sapiens
ctgcctccaagtcatgggag

SEQ ID NO: 5889291 - DNA, 21 bp, Homo sapiens
ctgcctccaagtcatgggaga

SEQ ID NO: 5889292 - DNA, 17 bp, Homo sapiens
ctgcctccaccagcaag

SEQ ID NO: 5889293 - DNA, 15 bp, Homo sapiens
ctgcctccacccaca

SEQ ID NO: 5889294 - DNA, 17 bp, Homo sapiens
ctgcctccacccacagt

SEQ ID NO: 5889295 - DNA, 21 bp, Homo sapiens
ctgcctccacccgtcctccct

SEQ ID NO: 5889296 - DNA, 18 bp, Homo sapiens
ctgcctgtagttaggaaa

SEQ ID NO: 5889297 - DNA, 22 bp, Homo sapiens
ctgcctgtagttaggaaataaa

SEQ ID NO: 5889298 - DNA, 18 bp, Homo sapiens
ctgcctgtcacctgggag

SEQ ID NO: 5889299 - DNA, 21 bp, Homo sapiens
ctgcctgtccccaaacaggac

SEQ ID NO: 5889300 - DNA, 15 bp, Homo sapiens
ctgcctgtccccatg

SEQ ID NO: 5889301 - DNA, 24 bp, Homo sapiens
ctgcctgtccctaccccatggtgc

SEQ ID NO: 5889302 - DNA, 18 bp, Homo sapiens
ctgcctgtccctctcagg

SEQ ID NO: 5889303 - DNA, 12 bp, Homo sapiens
ctgcctgtctcc

SEQ ID NO: 5889304 - DNA, 15 bp, Homo sapiens
ctgcctgtctgcccc

SEQ ID NO: 5889305 - DNA, 18 bp, Homo sapiens
ctgcctgtctgccccagc

SEQ ID NO: 5889306 - DNA, 16 bp, Homo sapiens
ctgcctgtctgcttgc

SEQ ID NO: 5889307 - DNA, 16 bp, Homo sapiens
ctgcctgtgagtgaca

SEQ ID NO: 5889308 - DNA, 19 bp, Homo sapiens
ctgcctgtgcatgacctga

SEQ ID NO: 5889309 - DNA, 16 bp, Homo sapiens
ctgcctgtgccatgcc

SEQ ID NO: 5889310 - DNA, 19 bp, Homo sapiens
ctgcctgtgccatgcccaa

SEQ ID NO: 5889311 - DNA, 21 bp, Homo sapiens
ctgcctgtgccatgcccaagg

SEQ ID NO: 5889312 - DNA, 12 bp, Homo sapiens
ctgcctgtgccc

SEQ ID NO: 5889313 - DNA, 13 bp, Homo sapiens
ctgcctgtgcccg

SEQ ID NO: 5889314 - DNA, 20 bp, Homo sapiens
ctgcctgtgcccgctgcgct

SEQ ID NO: 5889315 - DNA, 18 bp, Homo sapiens
ctgcctgtgcctgccatg

SEQ ID NO: 5889316 - DNA, 19 bp, Homo sapiens
ctgcctgtgcctgccatgg

SEQ ID NO: 5889317 - DNA, 23 bp, Homo sapiens
ctgcctgtgcctgccatgggcca

SEQ ID NO: 5889318 - DNA, 14 bp, Homo sapiens
ctgcctgtgctgtg

SEQ ID NO: 5889319 - DNA, 16 bp, Homo sapiens
ctgcctgtggagacag

SEQ ID NO: 5889320 - DNA, 18 bp, Homo sapiens
ctgcctgtggagacagcc

SEQ ID NO: 5889321 - DNA, 13 bp, Homo sapiens
ctgcctgtggagg

SEQ ID NO: 5889322 - DNA, 19 bp, Homo sapiens
ctgcctgtggaggtgacct

SEQ ID NO: 5889323 - DNA, 12 bp, Homo sapiens
ctgcctgtggca

SEQ ID NO: 5889324 - DNA, 21 bp, Homo sapiens
ctgcctgtggccatgaccctg

SEQ ID NO: 5889325 - DNA, 23 bp, Homo sapiens
ctgcctgtggccatgaccctgcc

SEQ ID NO: 5889326 - DNA, 19 bp, Homo sapiens
ctgcctgtggtgaggtcct

SEQ ID NO: 5889327 - DNA, 22 bp, Homo sapiens
ctgcctgtggtgaggtcctgtc

SEQ ID NO: 5889328 - DNA, 18 bp, Homo sapiens
ctgcctgttaagtctgag

SEQ ID NO: 5889329 - DNA, 21 bp, Homo sapiens
ctgcctgttataactctgcac

SEQ ID NO: 5889330 - DNA, 23 bp, Homo sapiens
ctgcctgttcagctccagctcac

SEQ ID NO: 5889331 - DNA, 15 bp, Homo sapiens
ctgcctgttcccatt

SEQ ID NO: 5889332 - DNA, 14 bp, Homo sapiens
ctgcctgttcctcc

SEQ ID NO: 5889333 - DNA, 19 bp, Homo sapiens
ctgcctgttcctcccaaga

SEQ ID NO: 5889334 - DNA, 14 bp, Homo sapiens
ctgcctgttctcca

SEQ ID NO: 5889335 - DNA, 18 bp, Homo sapiens
ctgcctgttctgaggatt

SEQ ID NO: 5889336 - DNA, 14 bp, Homo sapiens
ctgcctgttgggcc

SEQ ID NO: 5889337 - DNA, 18 bp, Homo sapiens
ctgcctgttgggccagga

SEQ ID NO: 5889338 - DNA, 21 bp, Homo sapiens
ctgcctgttgggccaggagcc

SEQ ID NO: 5889339 - DNA, 15 bp, Homo sapiens
ctgcctgtttcccgt

SEQ ID NO: 5889340 - DNA, 23 bp, Homo sapiens
ctgcctgtttcccgtaaggctgt

SEQ ID NO: 5889341 - DNA, 17 bp, Homo sapiens
ctgcctgtttggggagg

SEQ ID NO: 5889342 - DNA, 20 bp, Homo sapiens
ctgccttaaagtcagtaact

SEQ ID NO: 5889343 - DNA, 18 bp, Homo sapiens
ctgccttaacctgggacc

SEQ ID NO: 5889344 - DNA, 20 bp, Homo sapiens
ctgccttaacctgggaccaa

SEQ ID NO: 5889345 - DNA, 21 bp, Homo sapiens
ctgccttaaccttctggggga

SEQ ID NO: 5889346 - DNA, 13 bp, Homo sapiens
ctgccttaagtga

SEQ ID NO: 5889347 - DNA, 15 bp, Homo sapiens
ctgccttacaaaata

SEQ ID NO: 5889348 - DNA, 16 bp, Homo sapiens
ctgccttactggtttc

SEQ ID NO: 5889349 - DNA, 23 bp, Homo sapiens
ctgccttactggtttccccaggg

SEQ ID NO: 5889350 - DNA, 15 bp, Homo sapiens
ctgccttagagccag

SEQ ID NO: 5889351 - DNA, 18 bp, Homo sapiens
ctgccttagcctaccatg

SEQ ID NO: 5889352 - DNA, 15 bp, Homo sapiens
ctgccttagcctctt

SEQ ID NO: 5889353 - DNA, 14 bp, Homo sapiens
ctgccttagcttca

SEQ ID NO: 5889354 - DNA, 17 bp, Homo sapiens
ctgccttagcttcagga

SEQ ID NO: 5889355 - DNA, 18 bp, Homo sapiens
ctgccttagcttcaggaa

SEQ ID NO: 5889356 - DNA, 21 bp, Homo sapiens
ctgccttaggctgctgggaga

SEQ ID NO: 5889357 - DNA, 16 bp, Homo sapiens
ctgccttagtctcagt

SEQ ID NO: 5889358 - DNA, 20 bp, Homo sapiens
ctgccttagtctcagtttgt

SEQ ID NO: 5889359 - DNA, 16 bp, Homo sapiens
ctgccttatattattt

SEQ ID NO: 5889360 - DNA, 15 bp, Homo sapiens
ctgccttatcttgca

SEQ ID NO: 5889361 - DNA, 23 bp, Homo sapiens
ctgccttattacataactgatct

SEQ ID NO: 5889362 - DNA, 20 bp, Homo sapiens
ctgccttattcagggaagga

SEQ ID NO: 5889363 - DNA, 21 bp, Homo sapiens
ctgccttcaaggactgtttca

SEQ ID NO: 5889364 - DNA, 16 bp, Homo sapiens
ctgccttcacaaatgt

SEQ ID NO: 5889365 - DNA, 14 bp, Homo sapiens
ctgccttcaccctg

SEQ ID NO: 5889366 - DNA, 16 bp, Homo sapiens
ctgccttcaccctgaa

SEQ ID NO: 5889367 - DNA, 15 bp, Homo sapiens
ctgccttcaccttca

SEQ ID NO: 5889368 - DNA, 12 bp, Homo sapiens
ctgccttccagg

SEQ ID NO: 5889369 - DNA, 13 bp, Homo sapiens
ctgccttccaggc

SEQ ID NO: 5889370 - DNA, 23 bp, Homo sapiens
ctgccttccaggcgtagggccag

SEQ ID NO: 5889371 - DNA, 22 bp, Homo sapiens
ctgccttcctctgaggacaggc

SEQ ID NO: 5889372 - DNA, 16 bp, Homo sapiens
ctgccttcctggggct

SEQ ID NO: 5889373 - DNA, 18 bp, Homo sapiens
ctgccttccttagcagct

SEQ ID NO: 5889374 - DNA, 20 bp, Homo sapiens
ctgccttcgaggtcagagga

SEQ ID NO: 5889375 - DNA, 21 bp, Homo sapiens
ctgccttcgcaccttgctgtg

SEQ ID NO: 5889376 - DNA, 14 bp, Homo sapiens
ctgccttcgcttct

SEQ ID NO: 5889377 - DNA, 20 bp, Homo sapiens
ctgccttcgcttcttgcctc

SEQ ID NO: 5889378 - DNA, 23 bp, Homo sapiens
ctgccttcgcttcttgcctctgt

SEQ ID NO: 5889379 - DNA, 21 bp, Homo sapiens
ctgccttcggagggaaattgt

SEQ ID NO: 5889380 - DNA, 18 bp, Homo sapiens
ctgccttcggtacccacc

SEQ ID NO: 5889381 - DNA, 18 bp, Homo sapiens
ctgccttcgtttatattt

SEQ ID NO: 5889382 - DNA, 20 bp, Homo sapiens
ctgccttctcctctctgggc

SEQ ID NO: 5889383 - DNA, 12 bp, Homo sapiens
ctgccttctctt

SEQ ID NO: 5889384 - DNA, 16 bp, Homo sapiens
ctgccttctcttctat

SEQ ID NO: 5889385 - DNA, 20 bp, Homo sapiens
ctgccttctgacggccctgc

SEQ ID NO: 5889386 - DNA, 21 bp, Homo sapiens
ctgccttctgacggccctgca

SEQ ID NO: 5889387 - DNA, 23 bp, Homo sapiens
ctgccttctgacggccctgcaat

SEQ ID NO: 5889388 - DNA, 13 bp, Homo sapiens
ctgccttctgcgg

SEQ ID NO: 5889389 - DNA, 15 bp, Homo sapiens
ctgccttctgcggag

SEQ ID NO: 5889390 - DNA, 12 bp, Homo sapiens
ctgccttctgct

SEQ ID NO: 5889391 - DNA, 16 bp, Homo sapiens
ctgccttctgtctctt

SEQ ID NO: 5889392 - DNA, 19 bp, Homo sapiens
ctgccttctgtctcttgca

SEQ ID NO: 5889393 - DNA, 14 bp, Homo sapiens
ctgccttctttcca

SEQ ID NO: 5889394 - DNA, 17 bp, Homo sapiens
ctgccttgaaaaagaca

SEQ ID NO: 5889395 - DNA, 14 bp, Homo sapiens
ctgccttgaaaaat

SEQ ID NO: 5889396 - DNA, 23 bp, Homo sapiens
ctgccttgaaatacctgtttctt

SEQ ID NO: 5889397 - DNA, 17 bp, Homo sapiens
ctgccttgaacaaccca

SEQ ID NO: 5889398 - DNA, 17 bp, Homo sapiens
ctgccttgaacctgtga

SEQ ID NO: 5889399 - DNA, 19 bp, Homo sapiens
ctgccttgaacctgtgagt

SEQ ID NO: 5889400 - DNA, 22 bp, Homo sapiens
ctgccttgaagccactgaagct

SEQ ID NO: 5889401 - DNA, 14 bp, Homo sapiens
ctgccttgagctaa

SEQ ID NO: 5889402 - DNA, 21 bp, Homo sapiens
ctgccttgagctaaccccaag

SEQ ID NO: 5889403 - DNA, 17 bp, Homo sapiens
ctgccttgatgaagccc

SEQ ID NO: 5889404 - DNA, 19 bp, Homo sapiens
ctgccttgatgaagcctgt

SEQ ID NO: 5889405 - DNA, 21 bp, Homo sapiens
ctgccttgatggagaaggaaa

SEQ ID NO: 5889406 - DNA, 13 bp, Homo sapiens
ctgccttgccatg

SEQ ID NO: 5889407 - DNA, 16 bp, Homo sapiens
ctgccttgccctcctg

SEQ ID NO: 5889408 - DNA, 22 bp, Homo sapiens
ctgccttgccctcctgggccct

SEQ ID NO: 5889409 - DNA, 15 bp, Homo sapiens
ctgccttgccgctcc

SEQ ID NO: 5889410 - DNA, 23 bp, Homo sapiens
ctgccttgccgctccccttggac

SEQ ID NO: 5889411 - DNA, 19 bp, Homo sapiens
ctgccttgcctcctcagta

SEQ ID NO: 5889412 - DNA, 14 bp, Homo sapiens
ctgccttgccttta

SEQ ID NO: 5889413 - DNA, 18 bp, Homo sapiens
ctgccttgctgccttcac

SEQ ID NO: 5889414 - DNA, 18 bp, Homo sapiens
ctgccttggattcctaga

SEQ ID NO: 5889415 - DNA, 15 bp, Homo sapiens
ctgccttggcctccc

SEQ ID NO: 5889416 - DNA, 18 bp, Homo sapiens
ctgccttggctcagacat

SEQ ID NO: 5889417 - DNA, 17 bp, Homo sapiens
ctgccttgggccttgct

SEQ ID NO: 5889418 - DNA, 24 bp, Homo sapiens
ctgccttgggccttgctgctgctg

SEQ ID NO: 5889419 - DNA, 20 bp, Homo sapiens
ctgccttggggtcaggttga

SEQ ID NO: 5889420 - DNA, 22 bp, Homo sapiens
ctgccttggggtcaggttgaca

SEQ ID NO: 5889421 - DNA, 15 bp, Homo sapiens
ctgccttgtccctct

SEQ ID NO: 5889422 - DNA, 23 bp, Homo sapiens
ctgccttgtccctctcactcccc

SEQ ID NO: 5889423 - DNA, 14 bp, Homo sapiens
ctgccttgtgtaca

SEQ ID NO: 5889424 - DNA, 20 bp, Homo sapiens
ctgccttgtttaatgttaat

SEQ ID NO: 5889425 - DNA, 15 bp, Homo sapiens
ctgcctttaagccaa

SEQ ID NO: 5889426 - DNA, 16 bp, Homo sapiens
ctgcctttaagccaaa

SEQ ID NO: 5889427 - DNA, 19 bp, Homo sapiens
ctgcctttaagccaaagaa

SEQ ID NO: 5889428 - DNA, 17 bp, Homo sapiens
ctgcctttagaaaatat

SEQ ID NO: 5889429 - DNA, 23 bp, Homo sapiens
ctgcctttagcctggaccaaagg

SEQ ID NO: 5889430 - DNA, 20 bp, Homo sapiens
ctgcctttagtcgctgagga

SEQ ID NO: 5889431 - DNA, 20 bp, Homo sapiens
ctgcctttatgatgctaagc

SEQ ID NO: 5889432 - DNA, 24 bp, Homo sapiens
ctgcctttattgtgtttgtcatta

SEQ ID NO: 5889433 - DNA, 23 bp, Homo sapiens
ctgcctttcaaagtgcacacaca

SEQ ID NO: 5889434 - DNA, 21 bp, Homo sapiens
ctgcctttccatccatggcca

SEQ ID NO: 5889435 - DNA, 18 bp, Homo sapiens
ctgcctttcccccctcac

SEQ ID NO: 5889436 - DNA, 17 bp, Homo sapiens
ctgcctttcgtgatctt

SEQ ID NO: 5889437 - DNA, 23 bp, Homo sapiens
ctgcctttctcccccgacactgc

SEQ ID NO: 5889438 - DNA, 15 bp, Homo sapiens
ctgcctttcttccat

SEQ ID NO: 5889439 - DNA, 21 bp, Homo sapiens
ctgcctttgaaattcccccac

SEQ ID NO: 5889440 - DNA, 17 bp, Homo sapiens
ctgcctttgacatttaa

SEQ ID NO: 5889441 - DNA, 22 bp, Homo sapiens
ctgcctttgagcttctcctctg

SEQ ID NO: 5889442 - DNA, 14 bp, Homo sapiens
ctgcctttgcacca

SEQ ID NO: 5889443 - DNA, 19 bp, Homo sapiens
ctgcctttgcagaaacaga

SEQ ID NO: 5889444 - DNA, 20 bp, Homo sapiens
ctgcctttgcagttggactc

SEQ ID NO: 5889445 - DNA, 23 bp, Homo sapiens
ctgcctttgcagttggactctca

SEQ ID NO: 5889446 - DNA, 21 bp, Homo sapiens
ctgcctttgctcctcccatgt

SEQ ID NO: 5889447 - DNA, 14 bp, Homo sapiens
ctgcctttgctgcc

SEQ ID NO: 5889448 - DNA, 17 bp, Homo sapiens
ctgcctttggaagaaac

SEQ ID NO: 5889449 - DNA, 14 bp, Homo sapiens
ctgcctttgtatgt

SEQ ID NO: 5889450 - DNA, 17 bp, Homo sapiens
ctgcctttgtccccaca

SEQ ID NO: 5889451 - DNA, 18 bp, Homo sapiens
ctgcctttgtccccacac

SEQ ID NO: 5889452 - DNA, 18 bp, Homo sapiens
ctgcctttgtgctctgtt

SEQ ID NO: 5889453 - DNA, 19 bp, Homo sapiens
ctgcctttgttcactgtga

SEQ ID NO: 5889454 - DNA, 21 bp, Homo sapiens
ctgccttttagttcctgtgca

SEQ ID NO: 5889455 - DNA, 23 bp, Homo sapiens
ctgccttttagttcctgtgcaca

SEQ ID NO: 5889456 - DNA, 13 bp, Homo sapiens
ctgccttttctgg

SEQ ID NO: 5889457 - DNA, 14 bp, Homo sapiens
ctgccttttctgga

SEQ ID NO: 5889458 - DNA, 15 bp, Homo sapiens
ctgccttttctggag

SEQ ID NO: 5889459 - DNA, 16 bp, Homo sapiens
ctgccttttgctgctg

SEQ ID NO: 5889460 - DNA, 23 bp, Homo sapiens
ctgccttttttttttttttaaga

SEQ ID NO: 5889461 - DNA, 19 bp, Homo sapiens
ctgcgaaaacgttgacccc

SEQ ID NO: 5889462 - DNA, 21 bp, Homo sapiens
ctgcgaaaacgttgacccctt

SEQ ID NO: 5889463 - DNA, 13 bp, Homo sapiens
ctgcgaacactga

SEQ ID NO: 5889464 - DNA, 16 bp, Homo sapiens
ctgcgaactctcagga

SEQ ID NO: 5889465 - DNA, 12 bp, Homo sapiens
ctgcgaagtcct

SEQ ID NO: 5889466 - DNA, 14 bp, Homo sapiens
ctgcgaagtcctat

SEQ ID NO: 5889467 - DNA, 20 bp, Homo sapiens
ctgcgaatctagaggagggg

SEQ ID NO: 5889468 - DNA, 16 bp, Homo sapiens
ctgcgacaccaccaac

SEQ ID NO: 5889469 - DNA, 15 bp, Homo sapiens
ctgcgacagcttgtg

SEQ ID NO: 5889470 - DNA, 13 bp, Homo sapiens
ctgcgaccctggg

SEQ ID NO: 5889471 - DNA, 15 bp, Homo sapiens
ctgcgaccctggggg

SEQ ID NO: 5889472 - DNA, 16 bp, Homo sapiens
ctgcgtgtgtctgtgt

SEQ ID NO: 5889473 - DNA, 17 bp, Homo sapiens
ctgcgtgtgtctgtgtt

SEQ ID NO: 5889474 - DNA, 17 bp, Homo sapiens
ctgcgtgttctcagagg

SEQ ID NO: 5889475 - DNA, 13 bp, Homo sapiens
ctgcgttctgata

SEQ ID NO: 5889476 - DNA, 13 bp, Homo sapiens
ctgcgttctgcaa

SEQ ID NO: 5889477 - DNA, 14 bp, Homo sapiens
ctgcgttggagcca

SEQ ID NO: 5889478 - DNA, 22 bp, Homo sapiens
ctgcgttggagccactcctgtc

SEQ ID NO: 5889479 - DNA, 23 bp, Homo sapiens
ctgcgttggcttctccctgggga

SEQ ID NO: 5889480 - DNA, 16 bp, Homo sapiens
ctgcgttggtccagag

SEQ ID NO: 5889481 - DNA, 19 bp, Homo sapiens
ctgcgttggtccagagcgg

SEQ ID NO: 5889482 - DNA, 19 bp, Homo sapiens
ctgcgtttattaatgcctc

SEQ ID NO: 5889483 - DNA, 22 bp, Homo sapiens
ctgcgttttctccgggtcctcc

SEQ ID NO: 5889484 - DNA, 15 bp, Homo sapiens
ctgcgtttttttata

SEQ ID NO: 5889485 - DNA, 17 bp, Homo sapiens
ctgcgtttttttatagt

SEQ ID NO: 5889486 - DNA, 17 bp, Homo sapiens
ctgctaaatactgtaca

SEQ ID NO: 5889487 - DNA, 19 bp, Homo sapiens
ctgctaaatactgtacata

SEQ ID NO: 5889488 - DNA, 21 bp, Homo sapiens
ctgctaaatactgtacataga

SEQ ID NO: 5889489 - DNA, 20 bp, Homo sapiens
ctgctaaatctcctattttt

SEQ ID NO: 5889490 - DNA, 14 bp, Homo sapiens
ctgctaacaagtca

SEQ ID NO: 5889491 - DNA, 17 bp, Homo sapiens
ctgctaaccatttatat

SEQ ID NO: 5889492 - DNA, 18 bp, Homo sapiens
ctgctaactctgttattc

SEQ ID NO: 5889493 - DNA, 20 bp, Homo sapiens
ctgctaagctaaagaaactg

SEQ ID NO: 5889494 - DNA, 13 bp, Homo sapiens
ctgctaaggctgc

SEQ ID NO: 5889495 - DNA, 18 bp, Homo sapiens
ctgctaaggctgctggct

SEQ ID NO: 5889496 - DNA, 22 bp, Homo sapiens
ctgctaagtaatttagaagata

SEQ ID NO: 5889497 - DNA, 19 bp, Homo sapiens
ctgctaagtatttcccagc

SEQ ID NO: 5889498 - DNA, 21 bp, Homo sapiens
ctgctaagtatttcccagcac

SEQ ID NO: 5889499 - DNA, 20 bp, Homo sapiens
ctgctaagtcattggcaaag

SEQ ID NO: 5889500 - DNA, 21 bp, Homo sapiens
ctgctaagtggaagacagaga

SEQ ID NO: 5889501 - DNA, 16 bp, Homo sapiens
ctgctaagttctccca

SEQ ID NO: 5889502 - DNA, 18 bp, Homo sapiens
ctgctaataaatgaccag

SEQ ID NO: 5889503 - DNA, 21 bp, Homo sapiens
ctgctaataaatgaccagttt

SEQ ID NO: 5889504 - DNA, 19 bp, Homo sapiens
ctgctaataatttgccatt

SEQ ID NO: 5889505 - DNA, 23 bp, Homo sapiens
ctgctaatattttcctcctgagt

SEQ ID NO: 5889506 - DNA, 24 bp, Homo sapiens
ctgctaatattttcctcctgagtg

SEQ ID NO: 5889507 - DNA, 18 bp, Homo sapiens
ctgctacaaagaagacat

SEQ ID NO: 5889508 - DNA, 22 bp, Homo sapiens
ctgctacaagaatgcaaaaaat

SEQ ID NO: 5889509 - DNA, 15 bp, Homo sapiens
ctgctacacaggcag

SEQ ID NO: 5889510 - DNA, 17 bp, Homo sapiens
ctgctacacaggcagga

SEQ ID NO: 5889511 - DNA, 18 bp, Homo sapiens
ctgctacacaggcaggaa

SEQ ID NO: 5889512 - DNA, 20 bp, Homo sapiens
ctgctacacctattatccca

SEQ ID NO: 5889513 - DNA, 23 bp, Homo sapiens
ctgctacacctattatcccagct

SEQ ID NO: 5889514 - DNA, 15 bp, Homo sapiens
ctgctacagagcaga

SEQ ID NO: 5889515 - DNA, 20 bp, Homo sapiens
ctgctacagcaatttctaat

SEQ ID NO: 5889516 - DNA, 14 bp, Homo sapiens
ctgctacaggaggg

SEQ ID NO: 5889517 - DNA, 17 bp, Homo sapiens
ctgctacatcagactct

SEQ ID NO: 5889518 - DNA, 21 bp, Homo sapiens
ctgctacattataatgtacag

SEQ ID NO: 5889519 - DNA, 17 bp, Homo sapiens
ctgctaccaaggcccag

SEQ ID NO: 5889520 - DNA, 17 bp, Homo sapiens
ctgctacccagaaatca

SEQ ID NO: 5889521 - DNA, 16 bp, Homo sapiens
ctgctaccctccctgc

SEQ ID NO: 5889522 - DNA, 18 bp, Homo sapiens
ctgctaccctccctgctg

SEQ ID NO: 5889523 - DNA, 19 bp, Homo sapiens
ctgctaccctccctgctgt

SEQ ID NO: 5889524 - DNA, 20 bp, Homo sapiens
ctgctaccctccctgctgtc

SEQ ID NO: 5889525 - DNA, 21 bp, Homo sapiens
ctgctaccgccctgggctgga

SEQ ID NO: 5889526 - DNA, 15 bp, Homo sapiens
ctgctacctctgaga

SEQ ID NO: 5889527 - DNA, 16 bp, Homo sapiens
ctgctacctctgagaa

SEQ ID NO: 5889528 - DNA, 18 bp, Homo sapiens
ctgctacctctgagaaga

SEQ ID NO: 5889529 - DNA, 16 bp, Homo sapiens
ctgctacctggttttc

SEQ ID NO: 5889530 - DNA, 22 bp, Homo sapiens
ctgctacctggttttcattatt

SEQ ID NO: 5889531 - DNA, 15 bp, Homo sapiens
ctgctacctttgtct

SEQ ID NO: 5889532 - DNA, 16 bp, Homo sapiens
ctgctactacccgagc

SEQ ID NO: 5889533 - DNA, 23 bp, Homo sapiens
ctgctactccactgacctggaag

SEQ ID NO: 5889534 - DNA, 15 bp, Homo sapiens
ctgctactcctgtgc

SEQ ID NO: 5889535 - DNA, 19 bp, Homo sapiens
ctgctactcctgtgctctg

SEQ ID NO: 5889536 - DNA, 22 bp, Homo sapiens
ctgctactctgttccttcacat

SEQ ID NO: 5889537 - DNA, 17 bp, Homo sapiens
ctgctactgacccagag

SEQ ID NO: 5889538 - DNA, 15 bp, Homo sapiens
ctgctactgaggcag

SEQ ID NO: 5889539 - DNA, 15 bp, Homo sapiens
ctgctactgcccctc

SEQ ID NO: 5889540 - DNA, 16 bp, Homo sapiens
ctgctactgtcttact

SEQ ID NO: 5889541 - DNA, 16 bp, Homo sapiens
ctgctacttgctctgc

SEQ ID NO: 5889542 - DNA, 13 bp, Homo sapiens
ctgctagaaagtt

SEQ ID NO: 5889543 - DNA, 13 bp, Homo sapiens
ctgctagaaatgg

SEQ ID NO: 5889544 - DNA, 15 bp, Homo sapiens
ctgctagaacatggt

SEQ ID NO: 5889545 - DNA, 20 bp, Homo sapiens
ctgctagaacttttttaaat

SEQ ID NO: 5889546 - DNA, 16 bp, Homo sapiens
ctgctagactcctcag

SEQ ID NO: 5889547 - DNA, 15 bp, Homo sapiens
ctgctagagaagggg

SEQ ID NO: 5889548 - DNA, 16 bp, Homo sapiens
ctgctagagacgctga

SEQ ID NO: 5889549 - DNA, 15 bp, Homo sapiens
ctgctagagcaaccc

SEQ ID NO: 5889550 - DNA, 23 bp, Homo sapiens
ctgctagagcaacccctgtaccc

SEQ ID NO: 5889551 - DNA, 17 bp, Homo sapiens
ctgctagagcagacagg

SEQ ID NO: 5889552 - DNA, 12 bp, Homo sapiens
ctgctagatctt

SEQ ID NO: 5889553 - DNA, 23 bp, Homo sapiens
ctgctagatctttattatggaaa

SEQ ID NO: 5889554 - DNA, 15 bp, Homo sapiens
ctgctagatttctac

SEQ ID NO: 5889555 - DNA, 14 bp, Homo sapiens
ctgctagattttaa

SEQ ID NO: 5889556 - DNA, 20 bp, Homo sapiens
ctgctagattttaatttatt

SEQ ID NO: 5889557 - DNA, 21 bp, Homo sapiens
ctgctagattttaatttattt

SEQ ID NO: 5889558 - DNA, 22 bp, Homo sapiens
ctgctagattttaatttatttg

SEQ ID NO: 5889559 - DNA, 16 bp, Homo sapiens
ctgctagcaaatggca

SEQ ID NO: 5889560 - DNA, 20 bp, Homo sapiens
ctgctagcacagaggcctga

SEQ ID NO: 5889561 - DNA, 19 bp, Homo sapiens
ctgctagcacctccccaga

SEQ ID NO: 5889562 - DNA, 21 bp, Homo sapiens
ctgctagcacttggagccaag

SEQ ID NO: 5889563 - DNA, 22 bp, Homo sapiens
ctgctagcacttggagccaagg

SEQ ID NO: 5889564 - DNA, 18 bp, Homo sapiens
ctgctagctagctcaact

SEQ ID NO: 5889565 - DNA, 15 bp, Homo sapiens
ctgctagctgtagaa

SEQ ID NO: 5889566 - DNA, 16 bp, Homo sapiens
ctgctagctgtagaaa

SEQ ID NO: 5889567 - DNA, 15 bp, Homo sapiens
ctgctaggccagagc

SEQ ID NO: 5889568 - DNA, 16 bp, Homo sapiens
ctgctaggccagagcc

SEQ ID NO: 5889569 - DNA, 20 bp, Homo sapiens
ctgctaggcgagtgccagga

SEQ ID NO: 5889570 - DNA, 23 bp, Homo sapiens
ctgctaggggaaggactggccgt

SEQ ID NO: 5889571 - DNA, 15 bp, Homo sapiens
ctgctaggtgggcca

SEQ ID NO: 5889572 - DNA, 21 bp, Homo sapiens
ctgctaggtgggccagcccct

SEQ ID NO: 5889573 - DNA, 14 bp, Homo sapiens
ctgctagtacctgt

SEQ ID NO: 5889574 - DNA, 15 bp, Homo sapiens
ctgctagtacctgta

SEQ ID NO: 5889575 - DNA, 17 bp, Homo sapiens
ctgctagtcgcccctca

SEQ ID NO: 5889576 - DNA, 22 bp, Homo sapiens
ctgctagtcgcccctcagagca

SEQ ID NO: 5889577 - DNA, 18 bp, Homo sapiens
ctgctagtgaaatggctg

SEQ ID NO: 5889578 - DNA, 21 bp, Homo sapiens
ctgctagtgaaatggctgggg

SEQ ID NO: 5889579 - DNA, 17 bp, Homo sapiens
ctgctagtgctgtaata

SEQ ID NO: 5889580 - DNA, 21 bp, Homo sapiens
ctgctagtgtagcttctgaaa

SEQ ID NO: 5889581 - DNA, 17 bp, Homo sapiens
ctgctatattttcatga

SEQ ID NO: 5889582 - DNA, 21 bp, Homo sapiens
ctgctatccaatgatatagga

SEQ ID NO: 5889583 - DNA, 13 bp, Homo sapiens
ctgctatccagcc

SEQ ID NO: 5889584 - DNA, 13 bp, Homo sapiens
ctgctatgaaaat

SEQ ID NO: 5889585 - DNA, 21 bp, Homo sapiens
ctgctatgaaaatgagcatca

SEQ ID NO: 5889586 - DNA, 17 bp, Homo sapiens
ctgctatgacagctggc

SEQ ID NO: 5889587 - DNA, 19 bp, Homo sapiens
ctgctatgcattttcttca

SEQ ID NO: 5889588 - DNA, 18 bp, Homo sapiens
ctgctatggacgacctcc

SEQ ID NO: 5889589 - DNA, 20 bp, Homo sapiens
ctgctatgtatttgcaaggc

SEQ ID NO: 5889590 - DNA, 14 bp, Homo sapiens
ctgctattaaatta

SEQ ID NO: 5889591 - DNA, 16 bp, Homo sapiens
ctgctattatgtaaca

SEQ ID NO: 5889592 - DNA, 17 bp, Homo sapiens
ctgctattatgtaacat

SEQ ID NO: 5889593 - DNA, 19 bp, Homo sapiens
ctgctattctagagctttt

SEQ ID NO: 5889594 - DNA, 23 bp, Homo sapiens
ctgctattctagagcttttattt

SEQ ID NO: 5889595 - DNA, 14 bp, Homo sapiens
ctgctattgctgtc

SEQ ID NO: 5889596 - DNA, 16 bp, Homo sapiens
ctgctattgctgtctg

SEQ ID NO: 5889597 - DNA, 19 bp, Homo sapiens
ctgctattgctgtctggtg

SEQ ID NO: 5889598 - DNA, 21 bp, Homo sapiens
ctgctattgctgtctggtgag

SEQ ID NO: 5889599 - DNA, 17 bp, Homo sapiens
ctgctatttattttcct

SEQ ID NO: 5889600 - DNA, 15 bp, Homo sapiens
ctgctatttcaggcc

SEQ ID NO: 5889601 - DNA, 17 bp, Homo sapiens
ctgctatttcaggccct

SEQ ID NO: 5889602 - DNA, 13 bp, Homo sapiens
ctgctatttccca

SEQ ID NO: 5889603 - DNA, 17 bp, Homo sapiens
ctgctatttcccaagct

SEQ ID NO: 5889604 - DNA, 18 bp, Homo sapiens
ctgctatttcccaagctg

SEQ ID NO: 5889605 - DNA, 21 bp, Homo sapiens
ctgctatttcccaagctggag

SEQ ID NO: 5889606 - DNA, 23 bp, Homo sapiens
ctgctatttcccaagctggagtg

SEQ ID NO: 5889607 - DNA, 22 bp, Homo sapiens
ctgctatttccctccttgggct

SEQ ID NO: 5889608 - DNA, 17 bp, Homo sapiens
ctgctattttactgtct

SEQ ID NO: 5889609 - DNA, 23 bp, Homo sapiens
ctgctatttttaatttcctgtga

SEQ ID NO: 5889610 - DNA, 17 bp, Homo sapiens
ctgctatttttcatcct

SEQ ID NO: 5889611 - DNA, 18 bp, Homo sapiens
ctgctattttttttaaat

SEQ ID NO: 5889612 - DNA, 20 bp, Homo sapiens
ctgctattttttttaaatca

SEQ ID NO: 5889613 - DNA, 21 bp, Homo sapiens
ctgctattttttttaaatcaa

SEQ ID NO: 5889614 - DNA, 23 bp, Homo sapiens
ctgctattttttttaaatcaaaa

SEQ ID NO: 5889615 - DNA, 22 bp, Homo sapiens
ctgctcaactctacccctgctc

SEQ ID NO: 5889616 - DNA, 20 bp, Homo sapiens
ctgctcaagaagacatggag

SEQ ID NO: 5889617 - DNA, 22 bp, Homo sapiens
ctgctcaagccgcaagctctca

SEQ ID NO: 5889618 - DNA, 20 bp, Homo sapiens
ctgctcaatgaaaccttcct

SEQ ID NO: 5889619 - DNA, 19 bp, Homo sapiens
ctgctcacagggatgctgg

SEQ ID NO: 5889620 - DNA, 14 bp, Homo sapiens
ctgctcacatatct

SEQ ID NO: 5889621 - DNA, 19 bp, Homo sapiens
ctgctcacatatctgtcat

SEQ ID NO: 5889622 - DNA, 16 bp, Homo sapiens
ctgctcacattccctc

SEQ ID NO: 5889623 - DNA, 17 bp, Homo sapiens
ctgctcacattccctct

SEQ ID NO: 5889624 - DNA, 16 bp, Homo sapiens
ctgctcaccacctgcc

SEQ ID NO: 5889625 - DNA, 19 bp, Homo sapiens
ctgctcaccacctgcctct

SEQ ID NO: 5889626 - DNA, 21 bp, Homo sapiens
ctgctcaccacctgcctctaa

SEQ ID NO: 5889627 - DNA, 18 bp, Homo sapiens
ctgctcacccacctcttg

SEQ ID NO: 5889628 - DNA, 22 bp, Homo sapiens
ctgctcaccctcctagcctgct

SEQ ID NO: 5889629 - DNA, 16 bp, Homo sapiens
ctgctcaccggagtca

SEQ ID NO: 5889630 - DNA, 23 bp, Homo sapiens
ctgctcacctgtgtgcccagcac

SEQ ID NO: 5889631 - DNA, 16 bp, Homo sapiens
ctgctcacgtctctgc

SEQ ID NO: 5889632 - DNA, 20 bp, Homo sapiens
ctgctcactacctcctcagg

SEQ ID NO: 5889633 - DNA, 21 bp, Homo sapiens
ctgctcactacctcctcaggg

SEQ ID NO: 5889634 - DNA, 12 bp, Homo sapiens
ctgctcactgca

SEQ ID NO: 5889635 - DNA, 15 bp, Homo sapiens
ctgctcactgggccc

SEQ ID NO: 5889636 - DNA, 16 bp, Homo sapiens
ctgctcactgggcccg

SEQ ID NO: 5889637 - DNA, 13 bp, Homo sapiens
ctgctcacttaaa

SEQ ID NO: 5889638 - DNA, 15 bp, Homo sapiens
ctgctcactttccac

SEQ ID NO: 5889639 - DNA, 17 bp, Homo sapiens
ctgctcagaacttgctg

SEQ ID NO: 5889640 - DNA, 14 bp, Homo sapiens
ctgctcagagcttt

SEQ ID NO: 5889641 - DNA, 23 bp, Homo sapiens
ctgctcagagctttaaaagtatc

SEQ ID NO: 5889642 - DNA, 21 bp, Homo sapiens
ctgctcagaggggccccggtc

SEQ ID NO: 5889643 - DNA, 16 bp, Homo sapiens
ctgctcagatgctggt

SEQ ID NO: 5889644 - DNA, 18 bp, Homo sapiens
ctgctcagcaacctttca

SEQ ID NO: 5889645 - DNA, 18 bp, Homo sapiens
ctgctcagcagccagtct

SEQ ID NO: 5889646 - DNA, 21 bp, Homo sapiens
ctgctcagcagccagtctcag

SEQ ID NO: 5889647 - DNA, 22 bp, Homo sapiens
ctgctcctcgctcgcacctgcc

SEQ ID NO: 5889648 - DNA, 19 bp, Homo sapiens
ctgctcctcggccagagct

SEQ ID NO: 5889649 - DNA, 20 bp, Homo sapiens
ctgctcctcggccagagctc

SEQ ID NO: 5889650 - DNA, 22 bp, Homo sapiens
ctgctcctcggccagagctccc

SEQ ID NO: 5889651 - DNA, 17 bp, Homo sapiens
ctgctcctctccccagc

SEQ ID NO: 5889652 - DNA, 19 bp, Homo sapiens
ctgctcctctccccagcaa

SEQ ID NO: 5889653 - DNA, 15 bp, Homo sapiens
ctgctcctctttccc

SEQ ID NO: 5889654 - DNA, 18 bp, Homo sapiens
ctgctcctctttcccctc

SEQ ID NO: 5889655 - DNA, 16 bp, Homo sapiens
ctgctcctgcagcatg

SEQ ID NO: 5889656 - DNA, 13 bp, Homo sapiens
ctgctcctgccca

SEQ ID NO: 5889657 - DNA, 13 bp, Homo sapiens
ctgctcctggagc

SEQ ID NO: 5889658 - DNA, 13 bp, Homo sapiens
ctgctcctgggca

SEQ ID NO: 5889659 - DNA, 15 bp, Homo sapiens
ctgctcctgtacttg

SEQ ID NO: 5889660 - DNA, 15 bp, Homo sapiens
ctgctcctgtggcgg

SEQ ID NO: 5889661 - DNA, 17 bp, Homo sapiens
ctgctcctgtggcggtg

SEQ ID NO: 5889662 - DNA, 20 bp, Homo sapiens
ctgctcctgtggcggtgcag

SEQ ID NO: 5889663 - DNA, 12 bp, Homo sapiens
ctgctccttcac

SEQ ID NO: 5889664 - DNA, 16 bp, Homo sapiens
ctgctccttcaggcga

SEQ ID NO: 5889665 - DNA, 15 bp, Homo sapiens
ctgctccttccccat

SEQ ID NO: 5889666 - DNA, 12 bp, Homo sapiens
ctgctccttcct

SEQ ID NO: 5889667 - DNA, 14 bp, Homo sapiens
ctgctccttcctgt

SEQ ID NO: 5889668 - DNA, 18 bp, Homo sapiens
ctgctccttccttcacct

SEQ ID NO: 5889669 - DNA, 12 bp, Homo sapiens
ctgctccttggc

SEQ ID NO: 5889670 - DNA, 22 bp, Homo sapiens
ctgctccttggcacccccatgc

SEQ ID NO: 5889671 - DNA, 23 bp, Homo sapiens
ctgctccttggcacccccatgct

SEQ ID NO: 5889672 - DNA, 13 bp, Homo sapiens
ctgctccttggct

SEQ ID NO: 5889673 - DNA, 20 bp, Homo sapiens
ctgctccttggcttacctga

SEQ ID NO: 5889674 - DNA, 22 bp, Homo sapiens
ctgctcctttctgcccagcctg

SEQ ID NO: 5889675 - DNA, 14 bp, Homo sapiens
ctgctcgcccagga

SEQ ID NO: 5889676 - DNA, 15 bp, Homo sapiens
ctgctcgccctcctt

SEQ ID NO: 5889677 - DNA, 17 bp, Homo sapiens
ctgctcgccctcctttc

SEQ ID NO: 5889678 - DNA, 14 bp, Homo sapiens
ctgctcgccctgtg

SEQ ID NO: 5889679 - DNA, 15 bp, Homo sapiens
ctgctcgccctgtgc

SEQ ID NO: 5889680 - DNA, 17 bp, Homo sapiens
ctgctcgccctgtgccc

SEQ ID NO: 5889681 - DNA, 14 bp, Homo sapiens
ctgctcgccttatt

SEQ ID NO: 5889682 - DNA, 19 bp, Homo sapiens
ctgctcgcgaaggtcccac

SEQ ID NO: 5889683 - DNA, 14 bp, Homo sapiens
ctgctcgctccctg

SEQ ID NO: 5889684 - DNA, 21 bp, Homo sapiens
ctgctcggcaccgccagccgc

SEQ ID NO: 5889685 - DNA, 16 bp, Homo sapiens
ctgctcggctactggt

SEQ ID NO: 5889686 - DNA, 22 bp, Homo sapiens
ctgctcggctactggttacctg

SEQ ID NO: 5889687 - DNA, 18 bp, Homo sapiens
ctgctcggcttcttggac

SEQ ID NO: 5889688 - DNA, 14 bp, Homo sapiens
ctgctcgggaaggc

SEQ ID NO: 5889689 - DNA, 20 bp, Homo sapiens
ctgctcgggaaggcctgagg

SEQ ID NO: 5889690 - DNA, 14 bp, Homo sapiens
ctgctcgggcccag

SEQ ID NO: 5889691 - DNA, 13 bp, Homo sapiens
ctgctcggggtgc

SEQ ID NO: 5889692 - DNA, 17 bp, Homo sapiens
ctgctcggggtgcacag

SEQ ID NO: 5889693 - DNA, 18 bp, Homo sapiens
ctgctcggggtgcacagg

SEQ ID NO: 5889694 - DNA, 19 bp, Homo sapiens
ctgctcggggtgcacagga

SEQ ID NO: 5889695 - DNA, 20 bp, Homo sapiens
ctgctcggggtgcacaggag

SEQ ID NO: 5889696 - DNA, 22 bp, Homo sapiens
ctgctcggggtgcacaggaggg

SEQ ID NO: 5889697 - DNA, 22 bp, Homo sapiens
ctgctcggtcaggagggtgcag

SEQ ID NO: 5889698 - DNA, 22 bp, Homo sapiens
ctgctcgtccccaagtgaccta

SEQ ID NO: 5889699 - DNA, 21 bp, Homo sapiens
ctgctcgtttacactgcacat

SEQ ID NO: 5889700 - DNA, 17 bp, Homo sapiens
ctgctctaacagccctc

SEQ ID NO: 5889701 - DNA, 23 bp, Homo sapiens
ctgctctaagaagctgcaataaa

SEQ ID NO: 5889702 - DNA, 16 bp, Homo sapiens
ctgctctaagcccagg

SEQ ID NO: 5889703 - DNA, 17 bp, Homo sapiens
ctgctctaagcccagga

SEQ ID NO: 5889704 - DNA, 19 bp, Homo sapiens
ctgctctaagcccaggatc

SEQ ID NO: 5889705 - DNA, 19 bp, Homo sapiens
ctgctctacccatgagcct

SEQ ID NO: 5889706 - DNA, 21 bp, Homo sapiens
ctgctctagattcataaatac

SEQ ID NO: 5889707 - DNA, 15 bp, Homo sapiens
ctgctctagccagga

SEQ ID NO: 5889708 - DNA, 16 bp, Homo sapiens
ctgctctagctggcag

SEQ ID NO: 5889709 - DNA, 17 bp, Homo sapiens
ctgctctagtgggacag

SEQ ID NO: 5889710 - DNA, 16 bp, Homo sapiens
ctgctctatactgtgg

SEQ ID NO: 5889711 - DNA, 21 bp, Homo sapiens
ctgctctatactgtggcctgc

SEQ ID NO: 5889712 - DNA, 22 bp, Homo sapiens
ctgctctatactgtggcctgca

SEQ ID NO: 5889713 - DNA, 19 bp, Homo sapiens
ctgctctatgccaggctgt

SEQ ID NO: 5889714 - DNA, 23 bp, Homo sapiens
ctgctctatgccaggctgtgcta

SEQ ID NO: 5889715 - DNA, 15 bp, Homo sapiens
ctgctctattgtagc

SEQ ID NO: 5889716 - DNA, 15 bp, Homo sapiens
ctgctctcaaaatgt

SEQ ID NO: 5889717 - DNA, 23 bp, Homo sapiens
ctgctctcaaacccctgacctca

SEQ ID NO: 5889718 - DNA, 22 bp, Homo sapiens
ctgctctcaccttggttcctgg

SEQ ID NO: 5889719 - DNA, 13 bp, Homo sapiens
ctgctctcagctc

SEQ ID NO: 5889720 - DNA, 14 bp, Homo sapiens
ctgctctcatgcct

SEQ ID NO: 5889721 - DNA, 15 bp, Homo sapiens
ctgctctcatgcctg

SEQ ID NO: 5889722 - DNA, 11 bp, Homo sapiens
ctgctctccat

SEQ ID NO: 5889723 - DNA, 11 bp, Homo sapiens
ctgctctccca

SEQ ID NO: 5889724 - DNA, 12 bp, Homo sapiens
ctgctctcccaa

SEQ ID NO: 5889725 - DNA, 14 bp, Homo sapiens
ctgctctcccaagg

SEQ ID NO: 5889726 - DNA, 14 bp, Homo sapiens
ctgctctcccactg

SEQ ID NO: 5889727 - DNA, 19 bp, Homo sapiens
ctgctctcccctcccagtc

SEQ ID NO: 5889728 - DNA, 15 bp, Homo sapiens
ctgctctccgaccag

SEQ ID NO: 5889729 - DNA, 14 bp, Homo sapiens
ctgctctcctcggg

SEQ ID NO: 5889730 - DNA, 17 bp, Homo sapiens
ctgctctcctcgggccc

SEQ ID NO: 5889731 - DNA, 23 bp, Homo sapiens
ctgctctcctcgggccctgtggt

SEQ ID NO: 5889732 - DNA, 13 bp, Homo sapiens
ctgctctcctctt

SEQ ID NO: 5889733 - DNA, 13 bp, Homo sapiens
ctgctctcctgac

SEQ ID NO: 5889734 - DNA, 15 bp, Homo sapiens
ctgctctcctgacag

SEQ ID NO: 5889735 - DNA, 21 bp, Homo sapiens
ctgctctccttcactctgaca

SEQ ID NO: 5889736 - DNA, 13 bp, Homo sapiens
ctgctctccttcc

SEQ ID NO: 5889737 - DNA, 16 bp, Homo sapiens
ctgctctccttcctgg

SEQ ID NO: 5889738 - DNA, 19 bp, Homo sapiens
ctgctctccttcctggagc

SEQ ID NO: 5889739 - DNA, 20 bp, Homo sapiens
ctgctctccttcctggagcc

SEQ ID NO: 5889740 - DNA, 17 bp, Homo sapiens
ctgctctctacccagcc

SEQ ID NO: 5889741 - DNA, 20 bp, Homo sapiens
ctgctctctacccagcccat

SEQ ID NO: 5889742 - DNA, 15 bp, Homo sapiens
ctgctctctgaggga

SEQ ID NO: 5889743 - DNA, 16 bp, Homo sapiens
ctgctctctgagggag

SEQ ID NO: 5889744 - DNA, 13 bp, Homo sapiens
ctgctctctgctc

SEQ ID NO: 5889745 - DNA, 12 bp, Homo sapiens
ctgctctgagaa

SEQ ID NO: 5889746 - DNA, 13 bp, Homo sapiens
ctgctctgaggct

SEQ ID NO: 5889747 - DNA, 18 bp, Homo sapiens
ctgctctgaggcttccag

SEQ ID NO: 5889748 - DNA, 13 bp, Homo sapiens
ctgctctgatgca

SEQ ID NO: 5889749 - DNA, 22 bp, Homo sapiens
ctgctctgcagcccacagagga

SEQ ID NO: 5889750 - DNA, 23 bp, Homo sapiens
ctgctctgcagcccacagaggac

SEQ ID NO: 5889751 - DNA, 12 bp, Homo sapiens
ctgctctgccca

SEQ ID NO: 5889752 - DNA, 15 bp, Homo sapiens
ctgctctgcccagag

SEQ ID NO: 5889753 - DNA, 18 bp, Homo sapiens
ctgctctgcccagagctg

SEQ ID NO: 5889754 - DNA, 13 bp, Homo sapiens
ctgctctgcccca

SEQ ID NO: 5889755 - DNA, 22 bp, Homo sapiens
ctgctctgccccagcttgggca

SEQ ID NO: 5889756 - DNA, 14 bp, Homo sapiens
ctgctctgcctgga

SEQ ID NO: 5889757 - DNA, 11 bp, Homo sapiens
ctgctctgctc

SEQ ID NO: 5889758 - DNA, 13 bp, Homo sapiens
ctgctctgctcag

SEQ ID NO: 5889759 - DNA, 12 bp, Homo sapiens
ctgctctgctcg

SEQ ID NO: 5889760 - DNA, 15 bp, Homo sapiens
ctgctctgctcgcct

SEQ ID NO: 5889761 - DNA, 14 bp, Homo sapiens
ctgctctgctgtga

SEQ ID NO: 5889762 - DNA, 19 bp, Homo sapiens
ctgctctgcttcctcaggg

SEQ ID NO: 5889763 - DNA, 23 bp, Homo sapiens
ctgctctggaataaagttgcaga

SEQ ID NO: 5889764 - DNA, 13 bp, Homo sapiens
ctgctctgggaag

SEQ ID NO: 5889765 - DNA, 19 bp, Homo sapiens
ctgctctgggaaggggctt

SEQ ID NO: 5889766 - DNA, 15 bp, Homo sapiens
ctgctctgggacgtg

SEQ ID NO: 5889767 - DNA, 18 bp, Homo sapiens
ctgctctgggacgtggac

SEQ ID NO: 5889768 - DNA, 23 bp, Homo sapiens
ctgctctggtgcacgcctgagcg

SEQ ID NO: 5889769 - DNA, 13 bp, Homo sapiens
ctgctctggtggc

SEQ ID NO: 5889770 - DNA, 21 bp, Homo sapiens
ctgctctggtggcttaagtga

SEQ ID NO: 5889771 - DNA, 21 bp, Homo sapiens
ctgctctgtagccacctcctt

SEQ ID NO: 5889772 - DNA, 22 bp, Homo sapiens
ctgctctgtagccacctccttg

SEQ ID NO: 5889773 - DNA, 24 bp, Homo sapiens
ctgctctgtagccacctccttggc

SEQ ID NO: 5889774 - DNA, 20 bp, Homo sapiens
ctgctctgtccaattccaga

SEQ ID NO: 5889775 - DNA, 15 bp, Homo sapiens
ctgctctgtgcccac

SEQ ID NO: 5889776 - DNA, 17 bp, Homo sapiens
ctgctctgtgcctggga

SEQ ID NO: 5889777 - DNA, 16 bp, Homo sapiens
ctgctcttacttcccc

SEQ ID NO: 5889778 - DNA, 19 bp, Homo sapiens
ctgctcttacttcccccac

SEQ ID NO: 5889779 - DNA, 15 bp, Homo sapiens
ctgctcttagtgccc

SEQ ID NO: 5889780 - DNA, 18 bp, Homo sapiens
ctgctcttcaagaaacag

SEQ ID NO: 5889781 - DNA, 21 bp, Homo sapiens
ctgctcttcatcccattccag

SEQ ID NO: 5889782 - DNA, 20 bp, Homo sapiens
ctgctcttctctccccagcc

SEQ ID NO: 5889783 - DNA, 23 bp, Homo sapiens
ctgctcttctctccccagccccc

SEQ ID NO: 5889784 - DNA, 19 bp, Homo sapiens
ctgctcttctgtgcccagg

SEQ ID NO: 5889785 - DNA, 18 bp, Homo sapiens
ctgctcttgaactcctga

SEQ ID NO: 5889786 - DNA, 17 bp, Homo sapiens
ctgctcttgcctgcacc

SEQ ID NO: 5889787 - DNA, 15 bp, Homo sapiens
ctgctcttggctgga

SEQ ID NO: 5889788 - DNA, 22 bp, Homo sapiens
ctgctcttggctggacccagcc

SEQ ID NO: 5889789 - DNA, 21 bp, Homo sapiens
ctgctcttgtttcactccacc

SEQ ID NO: 5889790 - DNA, 22 bp, Homo sapiens
ctgctcttgtttcactccacca

SEQ ID NO: 5889791 - DNA, 19 bp, Homo sapiens
ctgctctttacatttcttt

SEQ ID NO: 5889792 - DNA, 16 bp, Homo sapiens
ctgctctttattgcag

SEQ ID NO: 5889793 - DNA, 14 bp, Homo sapiens
ctgctctttccact

SEQ ID NO: 5889794 - DNA, 21 bp, Homo sapiens
ctgctctttccacttgccctg

SEQ ID NO: 5889795 - DNA, 21 bp, Homo sapiens
ctgctctttctacatgactgg

SEQ ID NO: 5889796 - DNA, 14 bp, Homo sapiens
ctgctctttctctg

SEQ ID NO: 5889797 - DNA, 16 bp, Homo sapiens
ctgctctttctctgag

SEQ ID NO: 5889798 - DNA, 17 bp, Homo sapiens
ctgctctttctctgaga

SEQ ID NO: 5889799 - DNA, 17 bp, Homo sapiens
ctgctctttctctgcca

SEQ ID NO: 5889800 - DNA, 14 bp, Homo sapiens
ctgctctttggcct

SEQ ID NO: 5889801 - DNA, 18 bp, Homo sapiens
ctgctcttttactaagac

SEQ ID NO: 5889802 - DNA, 14 bp, Homo sapiens
ctgctcttttcctg

SEQ ID NO: 5889803 - DNA, 22 bp, Homo sapiens
ctgctcttttgtgatgaacata

SEQ ID NO: 5889804 - DNA, 18 bp, Homo sapiens
ctgctgaaacaacaaata

SEQ ID NO: 5889805 - DNA, 20 bp, Homo sapiens
ctgctgaaacacctcccagg

SEQ ID NO: 5889806 - DNA, 16 bp, Homo sapiens
ctgctgaaatttggaa

SEQ ID NO: 5889807 - DNA, 12 bp, Homo sapiens
ctgctgaacaaa

SEQ ID NO: 5889808 - DNA, 14 bp, Homo sapiens
ctgctgaacacagt

SEQ ID NO: 5889809 - DNA, 20 bp, Homo sapiens
ctgctgaacacagtgtctgt

SEQ ID NO: 5889810 - DNA, 18 bp, Homo sapiens
ctgctgaagacttgcccc

SEQ ID NO: 5889811 - DNA, 22 bp, Homo sapiens
ctgctgaagaggcaagagacag

SEQ ID NO: 5889812 - DNA, 22 bp, Homo sapiens
ctgctgaagattcagtttaaga

SEQ ID NO: 5889813 - DNA, 16 bp, Homo sapiens
ctgctgaagctgcctg

SEQ ID NO: 5889814 - DNA, 20 bp, Homo sapiens
ctgctgaagctgcctgcttt

SEQ ID NO: 5889815 - DNA, 14 bp, Homo sapiens
ctgctgaagctgct

SEQ ID NO: 5889816 - DNA, 15 bp, Homo sapiens
ctgctgaagctgctg

SEQ ID NO: 5889817 - DNA, 17 bp, Homo sapiens
ctgctgaaggaataaat

SEQ ID NO: 5889818 - DNA, 18 bp, Homo sapiens
ctgctgaaggacagaaca

SEQ ID NO: 5889819 - DNA, 14 bp, Homo sapiens
ctgctgaaggctcg

SEQ ID NO: 5889820 - DNA, 15 bp, Homo sapiens
ctgctgaaggctcga

SEQ ID NO: 5889821 - DNA, 24 bp, Homo sapiens
ctgctgaaggctcgagcatgcctg

SEQ ID NO: 5889822 - DNA, 12 bp, Homo sapiens
ctgctgaaggga

SEQ ID NO: 5889823 - DNA, 16 bp, Homo sapiens
ctgctgaataataaac

SEQ ID NO: 5889824 - DNA, 19 bp, Homo sapiens
ctgctgaatgcagggaatg

SEQ ID NO: 5889825 - DNA, 19 bp, Homo sapiens
ctgctgaattaatgtgatt

SEQ ID NO: 5889826 - DNA, 21 bp, Homo sapiens
ctgctgtaactgctgagccac

SEQ ID NO: 5889827 - DNA, 23 bp, Homo sapiens
ctgctgtaactgctgagccactc

SEQ ID NO: 5889828 - DNA, 20 bp, Homo sapiens
ctgctgtaataaatgtatta

SEQ ID NO: 5889829 - DNA, 20 bp, Homo sapiens
ctgctgtaataatattttag

SEQ ID NO: 5889830 - DNA, 16 bp, Homo sapiens
ctgctgtacaacttct

SEQ ID NO: 5889831 - DNA, 14 bp, Homo sapiens
ctgctgtacccaga

SEQ ID NO: 5889832 - DNA, 15 bp, Homo sapiens
ctgctgtacccagat

SEQ ID NO: 5889833 - DNA, 19 bp, Homo sapiens
ctgctgtacccagatgcct

SEQ ID NO: 5889834 - DNA, 17 bp, Homo sapiens
ctgctgtagtcctttct

SEQ ID NO: 5889835 - DNA, 18 bp, Homo sapiens
ctgctgtagtcctttctg

SEQ ID NO: 5889836 - DNA, 17 bp, Homo sapiens
ctgctgtatcttccaga

SEQ ID NO: 5889837 - DNA, 21 bp, Homo sapiens
ctgctgtatcttccagaacct

SEQ ID NO: 5889838 - DNA, 22 bp, Homo sapiens
ctgctgtatttcctgcttccct

SEQ ID NO: 5889839 - DNA, 14 bp, Homo sapiens
ctgctgtatttgag

SEQ ID NO: 5889840 - DNA, 11 bp, Homo sapiens
ctgctgtcaat

SEQ ID NO: 5889841 - DNA, 16 bp, Homo sapiens
ctgctgtcaataaatg

SEQ ID NO: 5889842 - DNA, 22 bp, Homo sapiens
ctgctgtcacctcgctgggctc

SEQ ID NO: 5889843 - DNA, 23 bp, Homo sapiens
ctgctgtcacctcgctgggctct

SEQ ID NO: 5889844 - DNA, 15 bp, Homo sapiens
ctgctgtcacctctc

SEQ ID NO: 5889845 - DNA, 18 bp, Homo sapiens
ctgctgtcacctctccca

SEQ ID NO: 5889846 - DNA, 20 bp, Homo sapiens
ctgctgtcacctctcccacg

SEQ ID NO: 5889847 - DNA, 16 bp, Homo sapiens
ctgctgtcagtctgct

SEQ ID NO: 5889848 - DNA, 18 bp, Homo sapiens
ctgctgtcattgcttctt

SEQ ID NO: 5889849 - DNA, 21 bp, Homo sapiens
ctgctgtcattgtccatgcct

SEQ ID NO: 5889850 - DNA, 14 bp, Homo sapiens
ctgctgtcatttta

SEQ ID NO: 5889851 - DNA, 15 bp, Homo sapiens
ctgctgtcattttat

SEQ ID NO: 5889852 - DNA, 14 bp, Homo sapiens
ctgctgtccagaca

SEQ ID NO: 5889853 - DNA, 15 bp, Homo sapiens
ctgctgtccagacag

SEQ ID NO: 5889854 - DNA, 17 bp, Homo sapiens
ctgctgtccagtgccta

SEQ ID NO: 5889855 - DNA, 18 bp, Homo sapiens
ctgctgtccagtgcctac

SEQ ID NO: 5889856 - DNA, 14 bp, Homo sapiens
ctgctgtcccctct

SEQ ID NO: 5889857 - DNA, 18 bp, Homo sapiens
ctgctgtcccctcttgcc

SEQ ID NO: 5889858 - DNA, 18 bp, Homo sapiens
ctgctgtccccttggcag

SEQ ID NO: 5889859 - DNA, 17 bp, Homo sapiens
ctgctgtccctccccct

SEQ ID NO: 5889860 - DNA, 16 bp, Homo sapiens
ctgctgtccctcctga

SEQ ID NO: 5889861 - DNA, 17 bp, Homo sapiens
ctgctgtccctcctgag

SEQ ID NO: 5889862 - DNA, 15 bp, Homo sapiens
ctgctgtccctgtca

SEQ ID NO: 5889863 - DNA, 21 bp, Homo sapiens
ctgctgtcctctcccccttca

SEQ ID NO: 5889864 - DNA, 20 bp, Homo sapiens
ctgctgtcctggtggctggg

SEQ ID NO: 5889865 - DNA, 15 bp, Homo sapiens
ctgctgtctcagcct

SEQ ID NO: 5889866 - DNA, 16 bp, Homo sapiens
ctgctgtctctctggg

SEQ ID NO: 5889867 - DNA, 12 bp, Homo sapiens
ctgctgtctctt

SEQ ID NO: 5889868 - DNA, 16 bp, Homo sapiens
ctgctgtctgggactc

SEQ ID NO: 5889869 - DNA, 16 bp, Homo sapiens
ctgctgtctgggtgct

SEQ ID NO: 5889870 - DNA, 23 bp, Homo sapiens
ctgctgtcttactaataggtctg

SEQ ID NO: 5889871 - DNA, 19 bp, Homo sapiens
ctgctgtgaaaactctggt

SEQ ID NO: 5889872 - DNA, 15 bp, Homo sapiens
ctgctgtgaaagaag

SEQ ID NO: 5889873 - DNA, 17 bp, Homo sapiens
ctgctgtgaacatgcct

SEQ ID NO: 5889874 - DNA, 22 bp, Homo sapiens
ctgctgtgaacatgcctcctcc

SEQ ID NO: 5889875 - DNA, 15 bp, Homo sapiens
ctgctgtgaaccctg

SEQ ID NO: 5889876 - DNA, 17 bp, Homo sapiens
ctgctgtgaaccctggg

SEQ ID NO: 5889877 - DNA, 23 bp, Homo sapiens
ctgctgtgaaccctggggcctga

SEQ ID NO: 5889878 - DNA, 17 bp, Homo sapiens
ctgctgtgaatctgaaa

SEQ ID NO: 5889879 - DNA, 21 bp, Homo sapiens
ctgctgtgatgccgtcctgct

SEQ ID NO: 5889880 - DNA, 11 bp, Homo sapiens
ctgctgtgcaa

SEQ ID NO: 5889881 - DNA, 16 bp, Homo sapiens
ctgctgtgcagcatgg

SEQ ID NO: 5889882 - DNA, 21 bp, Homo sapiens
ctgctgtgccatgctgggcca

SEQ ID NO: 5889883 - DNA, 23 bp, Homo sapiens
ctgctgtgccatgctgggccact

SEQ ID NO: 5889884 - DNA, 14 bp, Homo sapiens
ctgctgtgcccagc

SEQ ID NO: 5889885 - DNA, 19 bp, Homo sapiens
ctgctgtgccccaccacgt

SEQ ID NO: 5889886 - DNA, 19 bp, Homo sapiens
ctgctgtgcgtggaaaaag

SEQ ID NO: 5889887 - DNA, 17 bp, Homo sapiens
ctgctgtgctctgggga

SEQ ID NO: 5889888 - DNA, 14 bp, Homo sapiens
ctgctgtgctggga

SEQ ID NO: 5889889 - DNA, 23 bp, Homo sapiens
ctgctgtggcatcaggaaaggaa

SEQ ID NO: 5889890 - DNA, 13 bp, Homo sapiens
ctgctgtggcccc

SEQ ID NO: 5889891 - DNA, 13 bp, Homo sapiens
ctgctgtggcctc

SEQ ID NO: 5889892 - DNA, 19 bp, Homo sapiens
ctgctgtgtagctctgtcc

SEQ ID NO: 5889893 - DNA, 20 bp, Homo sapiens
ctgctgtgtccttcctccac

SEQ ID NO: 5889894 - DNA, 22 bp, Homo sapiens
ctgctgtgtgctttttttgtgt

SEQ ID NO: 5889895 - DNA, 16 bp, Homo sapiens
ctgctgtgtgtgagca

SEQ ID NO: 5889896 - DNA, 23 bp, Homo sapiens
ctgctgttaattgattaaaatct

SEQ ID NO: 5889897 - DNA, 23 bp, Homo sapiens
ctgctgttatcaccatagttttg

SEQ ID NO: 5889898 - DNA, 22 bp, Homo sapiens
ctgctgttccaacagacagggc

SEQ ID NO: 5889899 - DNA, 20 bp, Homo sapiens
ctgctgttctcaggacagca

SEQ ID NO: 5889900 - DNA, 15 bp, Homo sapiens
ctgctgttctgtgta

SEQ ID NO: 5889901 - DNA, 15 bp, Homo sapiens
ctgctgttcttcact

SEQ ID NO: 5889902 - DNA, 17 bp, Homo sapiens
ctgctgttcttcagtcc

SEQ ID NO: 5889903 - DNA, 12 bp, Homo sapiens
ctgctgttgaac

SEQ ID NO: 5889904 - DNA, 15 bp, Homo sapiens
ctgctgttgattcca

SEQ ID NO: 5889905 - DNA, 20 bp, Homo sapiens
ctgctgttgccatagcccca

SEQ ID NO: 5889906 - DNA, 14 bp, Homo sapiens
ctgctgttgtggga

SEQ ID NO: 5889907 - DNA, 16 bp, Homo sapiens
ctgctgttgtgggacc

SEQ ID NO: 5889908 - DNA, 14 bp, Homo sapiens
ctgctgtttcctag

SEQ ID NO: 5889909 - DNA, 18 bp, Homo sapiens
ctgctgtttggtttggag

SEQ ID NO: 5889910 - DNA, 22 bp, Homo sapiens
ctgcttaaaagaaaatgttcac

SEQ ID NO: 5889911 - DNA, 15 bp, Homo sapiens
ctgcttaaaatgcaa

SEQ ID NO: 5889912 - DNA, 16 bp, Homo sapiens
ctgcttaaaatgcaag

SEQ ID NO: 5889913 - DNA, 19 bp, Homo sapiens
ctgcttaaaatgcaaggac

SEQ ID NO: 5889914 - DNA, 14 bp, Homo sapiens
ctgcttaaacaaag

SEQ ID NO: 5889915 - DNA, 15 bp, Homo sapiens
ctgcttaaagcttcc

SEQ ID NO: 5889916 - DNA, 13 bp, Homo sapiens
ctgcttaacttca

SEQ ID NO: 5889917 - DNA, 20 bp, Homo sapiens
ctgcttaacttcacatattg

SEQ ID NO: 5889918 - DNA, 18 bp, Homo sapiens
ctgcttaagtgcatgcat

SEQ ID NO: 5889919 - DNA, 16 bp, Homo sapiens
ctgcttaatcctaccc

SEQ ID NO: 5889920 - DNA, 14 bp, Homo sapiens
ctgcttaatgaaaa

SEQ ID NO: 5889921 - DNA, 20 bp, Homo sapiens
ctgcttacaattccctgctg

SEQ ID NO: 5889922 - DNA, 14 bp, Homo sapiens
ctgcttacccttca

SEQ ID NO: 5889923 - DNA, 12 bp, Homo sapiens
ctgcttacctga

SEQ ID NO: 5889924 - DNA, 23 bp, Homo sapiens
ctgcttactcatgtccctattta

SEQ ID NO: 5889925 - DNA, 12 bp, Homo sapiens
ctgcttactttt

SEQ ID NO: 5889926 - DNA, 16 bp, Homo sapiens
ctgcttagaacccttc

SEQ ID NO: 5889927 - DNA, 23 bp, Homo sapiens
ctgcttagaacccttctgctttc

SEQ ID NO: 5889928 - DNA, 12 bp, Homo sapiens
ctgcttagcttg

SEQ ID NO: 5889929 - DNA, 19 bp, Homo sapiens
ctgcttagcttgcaccttg

SEQ ID NO: 5889930 - DNA, 18 bp, Homo sapiens
ctgcttaggagagaccga

SEQ ID NO: 5889931 - DNA, 23 bp, Homo sapiens
ctgcttagtatctcatcaacaaa

SEQ ID NO: 5889932 - DNA, 12 bp, Homo sapiens
ctgcttagtgtc

SEQ ID NO: 5889933 - DNA, 17 bp, Homo sapiens
ctgcttagtgtccctta

SEQ ID NO: 5889934 - DNA, 23 bp, Homo sapiens
ctgcttatcaataaacctgtttg

SEQ ID NO: 5889935 - DNA, 16 bp, Homo sapiens
ctgcttatctgaaact

SEQ ID NO: 5889936 - DNA, 20 bp, Homo sapiens
ctgcttatgatgggctcccc

SEQ ID NO: 5889937 - DNA, 22 bp, Homo sapiens
ctgcttatgatgggctccccag

SEQ ID NO: 5889938 - DNA, 13 bp, Homo sapiens
ctgcttcaaggat

SEQ ID NO: 5889939 - DNA, 14 bp, Homo sapiens
ctgcttcaaggatc

SEQ ID NO: 5889940 - DNA, 16 bp, Homo sapiens
ctgcttcaaggatcct

SEQ ID NO: 5889941 - DNA, 19 bp, Homo sapiens
ctgcttcaaggatcctgag

SEQ ID NO: 5889942 - DNA, 20 bp, Homo sapiens
ctgcttcaaggatcctgagc

SEQ ID NO: 5889943 - DNA, 17 bp, Homo sapiens
ctgcttcaccagacttt

SEQ ID NO: 5889944 - DNA, 19 bp, Homo sapiens
ctgcttcacggactctttg

SEQ ID NO: 5889945 - DNA, 16 bp, Homo sapiens
ctgcttcactagggaa

SEQ ID NO: 5889946 - DNA, 13 bp, Homo sapiens
ctgcttcacttcc

SEQ ID NO: 5889947 - DNA, 20 bp, Homo sapiens
ctgcttcagatgtggagcca

SEQ ID NO: 5889948 - DNA, 14 bp, Homo sapiens
ctgcttcagcctcc

SEQ ID NO: 5889949 - DNA, 16 bp, Homo sapiens
ctgcttcagcctcccg

SEQ ID NO: 5889950 - DNA, 21 bp, Homo sapiens
ctgcttcagtcccttccccat

SEQ ID NO: 5889951 - DNA, 19 bp, Homo sapiens
ctgcttcagtgtatggaaa

SEQ ID NO: 5889952 - DNA, 18 bp, Homo sapiens
ctgcttcatatctctccc

SEQ ID NO: 5889953 - DNA, 17 bp, Homo sapiens
ctgcttcatcctgctcc

SEQ ID NO: 5889954 - DNA, 15 bp, Homo sapiens
ctgcttcattttgga

SEQ ID NO: 5889955 - DNA, 16 bp, Homo sapiens
ctgcttcattttggag

SEQ ID NO: 5889956 - DNA, 19 bp, Homo sapiens
ctgcttcatttttgtaata

SEQ ID NO: 5889957 - DNA, 22 bp, Homo sapiens
ctgcttcatttttgtaataaca

SEQ ID NO: 5889958 - DNA, 17 bp, Homo sapiens
ctgcttccacctcaccc

SEQ ID NO: 5889959 - DNA, 17 bp, Homo sapiens
ctgcttccaggctgggc

SEQ ID NO: 5889960 - DNA, 12 bp, Homo sapiens
ctgcttccaggt

SEQ ID NO: 5889961 - DNA, 20 bp, Homo sapiens
ctgcttccagtgaggctctg

SEQ ID NO: 5889962 - DNA, 14 bp, Homo sapiens
ctgcttccagtgta

SEQ ID NO: 5889963 - DNA, 15 bp, Homo sapiens
ctgcttccagttgga

SEQ ID NO: 5889964 - DNA, 14 bp, Homo sapiens
ctgcttccatggct

SEQ ID NO: 5889965 - DNA, 19 bp, Homo sapiens
ctgcttccatggcttcctg

SEQ ID NO: 5889966 - DNA, 21 bp, Homo sapiens
ctgcttccatggcttcctgag

SEQ ID NO: 5889967 - DNA, 22 bp, Homo sapiens
ctgcttccatggcttcctgaga

SEQ ID NO: 5889968 - DNA, 19 bp, Homo sapiens
ctgcttcccaaactcccag

SEQ ID NO: 5889969 - DNA, 21 bp, Homo sapiens
ctgcttcccacctccctgccc

SEQ ID NO: 5889970 - DNA, 13 bp, Homo sapiens
ctgcttcccactg

SEQ ID NO: 5889971 - DNA, 15 bp, Homo sapiens
ctgcttcccactggg

SEQ ID NO: 5889972 - DNA, 12 bp, Homo sapiens
ctgcttcccaga

SEQ ID NO: 5889973 - DNA, 13 bp, Homo sapiens
ctgcttcccaggt

SEQ ID NO: 5889974 - DNA, 23 bp, Homo sapiens
ctgcttcccaggttcaagcgatt

SEQ ID NO: 5889975 - DNA, 11 bp, Homo sapiens
ctgcttcccat

SEQ ID NO: 5889976 - DNA, 15 bp, Homo sapiens
ctgcttcccatccta

SEQ ID NO: 5889977 - DNA, 18 bp, Homo sapiens
ctgcttcccatcctaccc

SEQ ID NO: 5889978 - DNA, 14 bp, Homo sapiens
ctgcttcccccact

SEQ ID NO: 5889979 - DNA, 12 bp, Homo sapiens
ctgcttcccctc

SEQ ID NO: 5889980 - DNA, 15 bp, Homo sapiens
ctgcttccccttcct

SEQ ID NO: 5889981 - DNA, 17 bp, Homo sapiens
ctgcttccccttcctaa

SEQ ID NO: 5889982 - DNA, 18 bp, Homo sapiens
ctgcttccccttcctaag

SEQ ID NO: 5889983 - DNA, 14 bp, Homo sapiens
ctgcttccctctgc

SEQ ID NO: 5889984 - DNA, 20 bp, Homo sapiens
ctgcttcccttactttgctg

SEQ ID NO: 5889985 - DNA, 13 bp, Homo sapiens
ctgcttcctaact

SEQ ID NO: 5889986 - DNA, 13 bp, Homo sapiens
ctgcttcctagta

SEQ ID NO: 5889987 - DNA, 13 bp, Homo sapiens
ctgcttcctcagg

SEQ ID NO: 5889988 - DNA, 15 bp, Homo sapiens
ctgcttcctcctgga

SEQ ID NO: 5889989 - DNA, 13 bp, Homo sapiens
ctgcttcctgagc

SEQ ID NO: 5889990 - DNA, 12 bp, Homo sapiens
ctgcttcctgga

SEQ ID NO: 5889991 - DNA, 13 bp, Homo sapiens
ctgcttcctggac

SEQ ID NO: 5889992 - DNA, 19 bp, Homo sapiens
ctgcttcctggtctggcag

SEQ ID NO: 5889993 - DNA, 19 bp, Homo sapiens
ctgcttcctgtctttggga

SEQ ID NO: 5889994 - DNA, 12 bp, Homo sapiens
ctgcttccttca

SEQ ID NO: 5889995 - DNA, 14 bp, Homo sapiens
ctgcttccttcagt

SEQ ID NO: 5889996 - DNA, 15 bp, Homo sapiens
ctgcttccttcagtt

SEQ ID NO: 5889997 - DNA, 18 bp, Homo sapiens
ctgcttctaccaactgga

SEQ ID NO: 5889998 - DNA, 19 bp, Homo sapiens
ctgcttctaccaactggaa

SEQ ID NO: 5889999 - DNA, 20 bp, Homo sapiens
ctgcttctaggagaactttt

SEQ ID NO: 5890000 - DNA, 15 bp, Homo sapiens
ctgcttctagtattt

SEQ ID NO: 5890001 - DNA, 14 bp, Homo sapiens
ctgcttctcagccc

SEQ ID NO: 5890002 - DNA, 16 bp, Homo sapiens
ctgcttctccaaggaa

SEQ ID NO: 5890003 - DNA, 14 bp, Homo sapiens
ctgcttctccacct

SEQ ID NO: 5890004 - DNA, 11 bp, Homo sapiens
ctgcttctccc

SEQ ID NO: 5890005 - DNA, 15 bp, Homo sapiens
ctggaagccagcttt

SEQ ID NO: 5890006 - DNA, 22 bp, Homo sapiens
ctggaagccatcctgcccttct

SEQ ID NO: 5890007 - DNA, 21 bp, Homo sapiens
ctggaagccggccggctggga

SEQ ID NO: 5890008 - DNA, 13 bp, Homo sapiens
ctggaagcctgcc

SEQ ID NO: 5890009 - DNA, 22 bp, Homo sapiens
ctggaagctaatttgcattaaa

SEQ ID NO: 5890010 - DNA, 18 bp, Homo sapiens
ctggaagctctccgagct

SEQ ID NO: 5890011 - DNA, 14 bp, Homo sapiens
ctggaagctgagca

SEQ ID NO: 5890012 - DNA, 16 bp, Homo sapiens
ctggaagctgagcagg

SEQ ID NO: 5890013 - DNA, 18 bp, Homo sapiens
ctggaagctgagcaggcc

SEQ ID NO: 5890014 - DNA, 15 bp, Homo sapiens
ctggaagctgggagg

SEQ ID NO: 5890015 - DNA, 20 bp, Homo sapiens
ctggaagctgggaggtcagg

SEQ ID NO: 5890016 - DNA, 16 bp, Homo sapiens
ctggaagctgtcaggc

SEQ ID NO: 5890017 - DNA, 21 bp, Homo sapiens
ctggaagctttgtcccctgct

SEQ ID NO: 5890018 - DNA, 14 bp, Homo sapiens
ctggaaggaaagca

SEQ ID NO: 5890019 - DNA, 13 bp, Homo sapiens
ctggaaggacaca

SEQ ID NO: 5890020 - DNA, 14 bp, Homo sapiens
ctggaaggacacag

SEQ ID NO: 5890021 - DNA, 15 bp, Homo sapiens
ctggaaggacacagt

SEQ ID NO: 5890022 - DNA, 17 bp, Homo sapiens
ctggaaggacacagtga

SEQ ID NO: 5890023 - DNA, 15 bp, Homo sapiens
ctggaaggagcacat

SEQ ID NO: 5890024 - DNA, 14 bp, Homo sapiens
ctggaaggaggaag

SEQ ID NO: 5890025 - DNA, 12 bp, Homo sapiens
ctggaaggcagg

SEQ ID NO: 5890026 - DNA, 15 bp, Homo sapiens
ctggaaggcagggca

SEQ ID NO: 5890027 - DNA, 19 bp, Homo sapiens
ctggaaggcagggcagagg

SEQ ID NO: 5890028 - DNA, 21 bp, Homo sapiens
ctggaaggcagggcagaggga

SEQ ID NO: 5890029 - DNA, 17 bp, Homo sapiens
ctggaaggccccttccc

SEQ ID NO: 5890030 - DNA, 18 bp, Homo sapiens
ctggaaggccccttccct

SEQ ID NO: 5890031 - DNA, 14 bp, Homo sapiens
ctggaaggctggct

SEQ ID NO: 5890032 - DNA, 16 bp, Homo sapiens
ctggaaggctggctga

SEQ ID NO: 5890033 - DNA, 19 bp, Homo sapiens
ctggaaggctggctgagtg

SEQ ID NO: 5890034 - DNA, 16 bp, Homo sapiens
ctggaaggctttattc

SEQ ID NO: 5890035 - DNA, 22 bp, Homo sapiens
ctggaagggaagtgagaaacca

SEQ ID NO: 5890036 - DNA, 23 bp, Homo sapiens
ctggaagggaagtgagaaaccag

SEQ ID NO: 5890037 - DNA, 19 bp, Homo sapiens
ctggaaggtactgaaggct

SEQ ID NO: 5890038 - DNA, 16 bp, Homo sapiens
ctggaaggtcacgctg

SEQ ID NO: 5890039 - DNA, 18 bp, Homo sapiens
ctggaaggtcacgctgaa

SEQ ID NO: 5890040 - DNA, 15 bp, Homo sapiens
ctggaaggtctgatc

SEQ ID NO: 5890041 - DNA, 18 bp, Homo sapiens
ctggaaggttcaggggcc

SEQ ID NO: 5890042 - DNA, 15 bp, Homo sapiens
ctggaagtacttggc

SEQ ID NO: 5890043 - DNA, 19 bp, Homo sapiens
ctggaagtacttggccccc

SEQ ID NO: 5890044 - DNA, 17 bp, Homo sapiens
ctggaagtattttcctc

SEQ ID NO: 5890045 - DNA, 22 bp, Homo sapiens
ctggaagtcaaataaatgtttc

SEQ ID NO: 5890046 - DNA, 23 bp, Homo sapiens
ctggaagtcatctcattccactg

SEQ ID NO: 5890047 - DNA, 16 bp, Homo sapiens
ctggaagtccaatgtg

SEQ ID NO: 5890048 - DNA, 15 bp, Homo sapiens
ctggaagtcctggcc

SEQ ID NO: 5890049 - DNA, 19 bp, Homo sapiens
ctggaagtctacctgctgg

SEQ ID NO: 5890050 - DNA, 18 bp, Homo sapiens
ctggaagtgactttggct

SEQ ID NO: 5890051 - DNA, 20 bp, Homo sapiens
ctggaagtgctaattttgaa

SEQ ID NO: 5890052 - DNA, 23 bp, Homo sapiens
ctggaagtgtgtgtttcttgctt

SEQ ID NO: 5890053 - DNA, 18 bp, Homo sapiens
ctggaagttaaagtgagg

SEQ ID NO: 5890054 - DNA, 23 bp, Homo sapiens
ctggaagttatttattttttaat

SEQ ID NO: 5890055 - DNA, 15 bp, Homo sapiens
ctggaagttgtggat

SEQ ID NO: 5890056 - DNA, 16 bp, Homo sapiens
ctggaagttgtggata

SEQ ID NO: 5890057 - DNA, 21 bp, Homo sapiens
ctggaataaaatataaaactg

SEQ ID NO: 5890058 - DNA, 15 bp, Homo sapiens
ctggaataaacatct

SEQ ID NO: 5890059 - DNA, 21 bp, Homo sapiens
ctggaataaacatctgtgtct

SEQ ID NO: 5890060 - DNA, 13 bp, Homo sapiens
ctggaataagaag

SEQ ID NO: 5890061 - DNA, 14 bp, Homo sapiens
ctggaataagttca

SEQ ID NO: 5890062 - DNA, 15 bp, Homo sapiens
ctggaataatattgg

SEQ ID NO: 5890063 - DNA, 16 bp, Homo sapiens
ctggaatcaaggaatc

SEQ ID NO: 5890064 - DNA, 16 bp, Homo sapiens
ctggaatcaatttccc

SEQ ID NO: 5890065 - DNA, 20 bp, Homo sapiens
ctggaatcaatttcccagaa

SEQ ID NO: 5890066 - DNA, 19 bp, Homo sapiens
ctggaatcagtatttcctt

SEQ ID NO: 5890067 - DNA, 16 bp, Homo sapiens
ctggaatccagaagga

SEQ ID NO: 5890068 - DNA, 18 bp, Homo sapiens
ctggaatccagaaggaag

SEQ ID NO: 5890069 - DNA, 17 bp, Homo sapiens
ctggaatcccagctccg

SEQ ID NO: 5890070 - DNA, 17 bp, Homo sapiens
ctggaatcgatctgtac

SEQ ID NO: 5890071 - DNA, 19 bp, Homo sapiens
ctggaatcgatctgtactg

SEQ ID NO: 5890072 - DNA, 18 bp, Homo sapiens
ctggaatctacaagccaa

SEQ ID NO: 5890073 - DNA, 17 bp, Homo sapiens
ctggaatctggagacca

SEQ ID NO: 5890074 - DNA, 18 bp, Homo sapiens
ctggaatctggagaccag

SEQ ID NO: 5890075 - DNA, 19 bp, Homo sapiens
ctggaatctggagaccagg

SEQ ID NO: 5890076 - DNA, 13 bp, Homo sapiens
ctggaatgaagca

SEQ ID NO: 5890077 - DNA, 16 bp, Homo sapiens
ctggaatgaagcatgt

SEQ ID NO: 5890078 - DNA, 20 bp, Homo sapiens
ctggaatgaagcatgtagct

SEQ ID NO: 5890079 - DNA, 14 bp, Homo sapiens
ctggaatgagggag

SEQ ID NO: 5890080 - DNA, 14 bp, Homo sapiens
ctggaatgcactga

SEQ ID NO: 5890081 - DNA, 14 bp, Homo sapiens
ctggaatgcagtgg

SEQ ID NO: 5890082 - DNA, 15 bp, Homo sapiens
ctggaatgcagtggt

SEQ ID NO: 5890083 - DNA, 13 bp, Homo sapiens
ctggaatgcttct

SEQ ID NO: 5890084 - DNA, 15 bp, Homo sapiens
ctggaatgcttctgc

SEQ ID NO: 5890085 - DNA, 18 bp, Homo sapiens
ctggaatgcttctgcatc

SEQ ID NO: 5890086 - DNA, 15 bp, Homo sapiens
ctggaatggaaaagg

SEQ ID NO: 5890087 - DNA, 15 bp, Homo sapiens
ctggaatggagctgt

SEQ ID NO: 5890088 - DNA, 22 bp, Homo sapiens
ctggaatggcacgttgctgcca

SEQ ID NO: 5890089 - DNA, 18 bp, Homo sapiens
ctggaatgggagacctgt

SEQ ID NO: 5890090 - DNA, 19 bp, Homo sapiens
ctggaatggggacctgggg

SEQ ID NO: 5890091 - DNA, 18 bp, Homo sapiens
ctggaatgggggccaggc

SEQ ID NO: 5890092 - DNA, 19 bp, Homo sapiens
ctggaatgggggccaggct

SEQ ID NO: 5890093 - DNA, 22 bp, Homo sapiens
ctggaatggtgttttgtcagac

SEQ ID NO: 5890094 - DNA, 20 bp, Homo sapiens
ctggaatgtaatcaatgttt

SEQ ID NO: 5890095 - DNA, 21 bp, Homo sapiens
ctggaatgtaatcaatgtttc

SEQ ID NO: 5890096 - DNA, 20 bp, Homo sapiens
ctggaatgtgccacagaggc

SEQ ID NO: 5890097 - DNA, 23 bp, Homo sapiens
ctggaatgtgccacagaggcccc

SEQ ID NO: 5890098 - DNA, 23 bp, Homo sapiens
ctggaatgtttttccctccccag

SEQ ID NO: 5890099 - DNA, 16 bp, Homo sapiens
ctggaattaaaacaaa

SEQ ID NO: 5890100 - DNA, 22 bp, Homo sapiens
ctggaattagcttggggccagg

SEQ ID NO: 5890101 - DNA, 18 bp, Homo sapiens
ctggaattcagcaccctg

SEQ ID NO: 5890102 - DNA, 19 bp, Homo sapiens
ctggaattccacagggacc

SEQ ID NO: 5890103 - DNA, 21 bp, Homo sapiens
ctggaattctaaatgctggtc

SEQ ID NO: 5890104 - DNA, 15 bp, Homo sapiens
ctggaattgatgttt

SEQ ID NO: 5890105 - DNA, 21 bp, Homo sapiens
ctggaattgccacataattca

SEQ ID NO: 5890106 - DNA, 17 bp, Homo sapiens
ctggaattgccagctga

SEQ ID NO: 5890107 - DNA, 15 bp, Homo sapiens
ctggaattgctgctc

SEQ ID NO: 5890108 - DNA, 17 bp, Homo sapiens
ctggaattgctgctctc

SEQ ID NO: 5890109 - DNA, 19 bp, Homo sapiens
ctggaattgctgctctctg

SEQ ID NO: 5890110 - DNA, 23 bp, Homo sapiens
ctggaattggagtcgtgttgtca

SEQ ID NO: 5890111 - DNA, 17 bp, Homo sapiens
ctggaattgggctccgt

SEQ ID NO: 5890112 - DNA, 18 bp, Homo sapiens
ctggaattgggctccgtg

SEQ ID NO: 5890113 - DNA, 22 bp, Homo sapiens
ctggaattgtggctatcctgat

SEQ ID NO: 5890114 - DNA, 19 bp, Homo sapiens
ctggaattgttgaatgtat

SEQ ID NO: 5890115 - DNA, 19 bp, Homo sapiens
ctggaatttaattcaaagt

SEQ ID NO: 5890116 - DNA, 21 bp, Homo sapiens
ctggaatttgcaagtcatggc

SEQ ID NO: 5890117 - DNA, 23 bp, Homo sapiens
ctggaatttgcaagtcatggctg

SEQ ID NO: 5890118 - DNA, 15 bp, Homo sapiens
ctggaattttttatt

SEQ ID NO: 5890119 - DNA, 17 bp, Homo sapiens
ctggaattttttattct

SEQ ID NO: 5890120 - DNA, 14 bp, Homo sapiens
ctggacaaagaatt

SEQ ID NO: 5890121 - DNA, 15 bp, Homo sapiens
ctggacaaagaattc

SEQ ID NO: 5890122 - DNA, 12 bp, Homo sapiens
ctggacaaccca

SEQ ID NO: 5890123 - DNA, 14 bp, Homo sapiens
ctggacaacccaga

SEQ ID NO: 5890124 - DNA, 18 bp, Homo sapiens
ctggacaagaagagtcct

SEQ ID NO: 5890125 - DNA, 17 bp, Homo sapiens
ctggacaagaagctgct

SEQ ID NO: 5890126 - DNA, 18 bp, Homo sapiens
ctggacaagaagctgcta

SEQ ID NO: 5890127 - DNA, 22 bp, Homo sapiens
ctggacacaataggtctttctc

SEQ ID NO: 5890128 - DNA, 23 bp, Homo sapiens
ctggacacacactcaccagtggc

SEQ ID NO: 5890129 - DNA, 22 bp, Homo sapiens
ctggacacactaaactctgggg

SEQ ID NO: 5890130 - DNA, 12 bp, Homo sapiens
ctggacacactc

SEQ ID NO: 5890131 - DNA, 19 bp, Homo sapiens
ctggacacagcccaccctc

SEQ ID NO: 5890132 - DNA, 13 bp, Homo sapiens
ctggacacaggcc

SEQ ID NO: 5890133 - DNA, 14 bp, Homo sapiens
ctggacacaggcct

SEQ ID NO: 5890134 - DNA, 15 bp, Homo sapiens
ctggacacaggcctg

SEQ ID NO: 5890135 - DNA, 15 bp, Homo sapiens
ctggacaccacccag

SEQ ID NO: 5890136 - DNA, 18 bp, Homo sapiens
ctggacaccacccagagc

SEQ ID NO: 5890137 - DNA, 18 bp, Homo sapiens
ctggacaccccacgggag

SEQ ID NO: 5890138 - DNA, 15 bp, Homo sapiens
ctggacacccctgct

SEQ ID NO: 5890139 - DNA, 23 bp, Homo sapiens
ctggacaccctcaccacccaaca

SEQ ID NO: 5890140 - DNA, 22 bp, Homo sapiens
ctggacaccgggccagtatcta

SEQ ID NO: 5890141 - DNA, 17 bp, Homo sapiens
ctggacacctacagcag

SEQ ID NO: 5890142 - DNA, 18 bp, Homo sapiens
ctggacacctacagcagc

SEQ ID NO: 5890143 - DNA, 22 bp, Homo sapiens
ctggacactagggtcaggcggg

SEQ ID NO: 5890144 - DNA, 15 bp, Homo sapiens
ctggacactcagacc

SEQ ID NO: 5890145 - DNA, 22 bp, Homo sapiens
ctggacacttcacgcccttggc

SEQ ID NO: 5890146 - DNA, 13 bp, Homo sapiens
ctggacacttctt

SEQ ID NO: 5890147 - DNA, 17 bp, Homo sapiens
ctggacacttctttata

SEQ ID NO: 5890148 - DNA, 14 bp, Homo sapiens
ctggacagacccag

SEQ ID NO: 5890149 - DNA, 17 bp, Homo sapiens
ctggacagacccaggtc

SEQ ID NO: 5890150 - DNA, 17 bp, Homo sapiens
ctggacagagactcagc

SEQ ID NO: 5890151 - DNA, 22 bp, Homo sapiens
ctggacagagactcagcgctcc

SEQ ID NO: 5890152 - DNA, 15 bp, Homo sapiens
ctggacagaggcggg

SEQ ID NO: 5890153 - DNA, 21 bp, Homo sapiens
ctggacagaggggactctggg

SEQ ID NO: 5890154 - DNA, 10 bp, Homo sapiens
ctggacagat

SEQ ID NO: 5890155 - DNA, 12 bp, Homo sapiens
ctggacagatgg

SEQ ID NO: 5890156 - DNA, 17 bp, Homo sapiens
ctggacagatggacgca

SEQ ID NO: 5890157 - DNA, 19 bp, Homo sapiens
ctggacagatggacgcagg

SEQ ID NO: 5890158 - DNA, 19 bp, Homo sapiens
ctggacagatggcccaagg

SEQ ID NO: 5890159 - DNA, 17 bp, Homo sapiens
ctggacagcagaagcct

SEQ ID NO: 5890160 - DNA, 20 bp, Homo sapiens
ctggacagcagaagcctcca

SEQ ID NO: 5890161 - DNA, 14 bp, Homo sapiens
ctggacagccaggg

SEQ ID NO: 5890162 - DNA, 16 bp, Homo sapiens
ctggacagccagggca

SEQ ID NO: 5890163 - DNA, 18 bp, Homo sapiens
ctggacagccagggcagg

SEQ ID NO: 5890164 - DNA, 13 bp, Homo sapiens
ctggacagccagt

SEQ ID NO: 5890165 - DNA, 15 bp, Homo sapiens
ctggacagccagtga

SEQ ID NO: 5890166 - DNA, 14 bp, Homo sapiens
ctggacagccccac

SEQ ID NO: 5890167 - DNA, 13 bp, Homo sapiens
ctggacagcctcc

SEQ ID NO: 5890168 - DNA, 18 bp, Homo sapiens
ctggacagcggttgtaaa

SEQ ID NO: 5890169 - DNA, 13 bp, Homo sapiens
ctggacagctgtg

SEQ ID NO: 5890170 - DNA, 15 bp, Homo sapiens
ctggacagctgtgcc

SEQ ID NO: 5890171 - DNA, 12 bp, Homo sapiens
ctggacagcttg

SEQ ID NO: 5890172 - DNA, 21 bp, Homo sapiens
ctggacagctttgctccgctc

SEQ ID NO: 5890173 - DNA, 17 bp, Homo sapiens
ctggacaggcatgttct

SEQ ID NO: 5890174 - DNA, 23 bp, Homo sapiens
ctggacaggcgggctcggaggct

SEQ ID NO: 5890175 - DNA, 13 bp, Homo sapiens
ctggacaggctct

SEQ ID NO: 5890176 - DNA, 20 bp, Homo sapiens
ctggacaggctctgcttctc

SEQ ID NO: 5890177 - DNA, 14 bp, Homo sapiens
ctggacaggtctgg

SEQ ID NO: 5890178 - DNA, 18 bp, Homo sapiens
ctggacaggtctgggaga

SEQ ID NO: 5890179 - DNA, 18 bp, Homo sapiens
ctggacagtgagagcagg

SEQ ID NO: 5890180 - DNA, 22 bp, Homo sapiens
ctggacagtgagagcagggctg

SEQ ID NO: 5890181 - DNA, 17 bp, Homo sapiens
ctggacataacattttc

SEQ ID NO: 5890182 - DNA, 18 bp, Homo sapiens
ctggacatactgctggag

SEQ ID NO: 5890183 - DNA, 24 bp, Homo sapiens
ctggagcctgtgtaacagctcctt

SEQ ID NO: 5890184 - DNA, 18 bp, Homo sapiens
ctggagcgaagccttctg

SEQ ID NO: 5890185 - DNA, 18 bp, Homo sapiens
ctggagcgccacacactg

SEQ ID NO: 5890186 - DNA, 20 bp, Homo sapiens
ctggagcgcttcagttcagc

SEQ ID NO: 5890187 - DNA, 19 bp, Homo sapiens
ctggagcggagaggaagcc

SEQ ID NO: 5890188 - DNA, 21 bp, Homo sapiens
ctggagcggagaggaagccag

SEQ ID NO: 5890189 - DNA, 22 bp, Homo sapiens
ctggagcggagatgaggggcca

SEQ ID NO: 5890190 - DNA, 22 bp, Homo sapiens
ctggagcggctctcctgagagg

SEQ ID NO: 5890191 - DNA, 15 bp, Homo sapiens
ctggagcggctgctc

SEQ ID NO: 5890192 - DNA, 19 bp, Homo sapiens
ctggagcgtttgctgtgcc

SEQ ID NO: 5890193 - DNA, 20 bp, Homo sapiens
ctggagcgtttgctgtgcca

SEQ ID NO: 5890194 - DNA, 21 bp, Homo sapiens
ctggagcgtttgctgtgccag

SEQ ID NO: 5890195 - DNA, 17 bp, Homo sapiens
ctggagctagaatttga

SEQ ID NO: 5890196 - DNA, 22 bp, Homo sapiens
ctggagctagaatttgatatgt

SEQ ID NO: 5890197 - DNA, 23 bp, Homo sapiens
ctggagctcaagccgtggccggg

SEQ ID NO: 5890198 - DNA, 12 bp, Homo sapiens
ctggagctcctc

SEQ ID NO: 5890199 - DNA, 15 bp, Homo sapiens
ctggagctcctccct

SEQ ID NO: 5890200 - DNA, 16 bp, Homo sapiens
ctggagctcctccctc

SEQ ID NO: 5890201 - DNA, 20 bp, Homo sapiens
ctggagctcctccctccagc

SEQ ID NO: 5890202 - DNA, 16 bp, Homo sapiens
ctggagctctgtgggt

SEQ ID NO: 5890203 - DNA, 16 bp, Homo sapiens
ctggagctcttggaag

SEQ ID NO: 5890204 - DNA, 14 bp, Homo sapiens
ctggagctgaggaa

SEQ ID NO: 5890205 - DNA, 16 bp, Homo sapiens
ctggagctgctgttcc

SEQ ID NO: 5890206 - DNA, 11 bp, Homo sapiens
ctggagctggc

SEQ ID NO: 5890207 - DNA, 16 bp, Homo sapiens
ctggagctggcactgt

SEQ ID NO: 5890208 - DNA, 23 bp, Homo sapiens
ctggagctgtccttcattccgtt

SEQ ID NO: 5890209 - DNA, 14 bp, Homo sapiens
ctggagcttcagcc

SEQ ID NO: 5890210 - DNA, 21 bp, Homo sapiens
ctggagcttcagccaggtctg

SEQ ID NO: 5890211 - DNA, 22 bp, Homo sapiens
ctggagcttcagccaggtctga

SEQ ID NO: 5890212 - DNA, 20 bp, Homo sapiens
ctggagcttttaaaaatgtt

SEQ ID NO: 5890213 - DNA, 21 bp, Homo sapiens
ctggagcttttaaaaatgttt

SEQ ID NO: 5890214 - DNA, 21 bp, Homo sapiens
ctggaggaaaaggttaatgaa

SEQ ID NO: 5890215 - DNA, 22 bp, Homo sapiens
ctggaggaaggggggttgcagt

SEQ ID NO: 5890216 - DNA, 22 bp, Homo sapiens
ctggaggaattcagctcagctt

SEQ ID NO: 5890217 - DNA, 12 bp, Homo sapiens
ctggaggacctg

SEQ ID NO: 5890218 - DNA, 17 bp, Homo sapiens
ctggaggacctgagcct

SEQ ID NO: 5890219 - DNA, 18 bp, Homo sapiens
ctggaggacctgagcctg

SEQ ID NO: 5890220 - DNA, 22 bp, Homo sapiens
ctggaggacctgagcctgccga

SEQ ID NO: 5890221 - DNA, 21 bp, Homo sapiens
ctggaggactagaacctggag

SEQ ID NO: 5890222 - DNA, 20 bp, Homo sapiens
ctggaggactctagaagctc

SEQ ID NO: 5890223 - DNA, 12 bp, Homo sapiens
ctggaggagaag

SEQ ID NO: 5890224 - DNA, 14 bp, Homo sapiens
ctggaggagaagta

SEQ ID NO: 5890225 - DNA, 13 bp, Homo sapiens
ctggaggagagaa

SEQ ID NO: 5890226 - DNA, 14 bp, Homo sapiens
ctggaggagagaag

SEQ ID NO: 5890227 - DNA, 16 bp, Homo sapiens
ctggaggagcagcagc

SEQ ID NO: 5890228 - DNA, 19 bp, Homo sapiens
ctggaggagcccaggccag

SEQ ID NO: 5890229 - DNA, 16 bp, Homo sapiens
ctggaggagctggcct

SEQ ID NO: 5890230 - DNA, 20 bp, Homo sapiens
ctggaggagctggcctgtgg

SEQ ID NO: 5890231 - DNA, 22 bp, Homo sapiens
ctggaggagctggcctgtggca

SEQ ID NO: 5890232 - DNA, 12 bp, Homo sapiens
ctggaggaggag

SEQ ID NO: 5890233 - DNA, 14 bp, Homo sapiens
ctggaggaggagca

SEQ ID NO: 5890234 - DNA, 17 bp, Homo sapiens
ctggaggaggggaagct

SEQ ID NO: 5890235 - DNA, 17 bp, Homo sapiens
ctggaggatccctccat

SEQ ID NO: 5890236 - DNA, 15 bp, Homo sapiens
ctggaggatgaccag

SEQ ID NO: 5890237 - DNA, 19 bp, Homo sapiens
ctggaggatgtgggcagct

SEQ ID NO: 5890238 - DNA, 16 bp, Homo sapiens
ctggaggcaagaggga

SEQ ID NO: 5890239 - DNA, 18 bp, Homo sapiens
ctggaggcaagagggagg

SEQ ID NO: 5890240 - DNA, 19 bp, Homo sapiens
ctggaggcaagagggaggg

SEQ ID NO: 5890241 - DNA, 16 bp, Homo sapiens
ctggaggcacctggtg

SEQ ID NO: 5890242 - DNA, 16 bp, Homo sapiens
ctggaggcacgcacca

SEQ ID NO: 5890243 - DNA, 10 bp, Homo sapiens
ctggaggcag

SEQ ID NO: 5890244 - DNA, 15 bp, Homo sapiens
ctggaggcagggaac

SEQ ID NO: 5890245 - DNA, 13 bp, Homo sapiens
ctggaggcagggc

SEQ ID NO: 5890246 - DNA, 19 bp, Homo sapiens
ctggaggcagggccttgcc

SEQ ID NO: 5890247 - DNA, 20 bp, Homo sapiens
ctggaggcagggccttgccc

SEQ ID NO: 5890248 - DNA, 18 bp, Homo sapiens
ctggaggcaggggctgct

SEQ ID NO: 5890249 - DNA, 22 bp, Homo sapiens
ctggaggcaggggcttcctggt

SEQ ID NO: 5890250 - DNA, 21 bp, Homo sapiens
ctggaggcagggggtgagggg

SEQ ID NO: 5890251 - DNA, 12 bp, Homo sapiens
ctggaggcccag

SEQ ID NO: 5890252 - DNA, 17 bp, Homo sapiens
ctggaggcccaggctgg

SEQ ID NO: 5890253 - DNA, 18 bp, Homo sapiens
ctggaggcccaggctggg

SEQ ID NO: 5890254 - DNA, 14 bp, Homo sapiens
ctggaggcccctgg

SEQ ID NO: 5890255 - DNA, 17 bp, Homo sapiens
ctggaggcccctggagc

SEQ ID NO: 5890256 - DNA, 15 bp, Homo sapiens
ctggaggccgaggac

SEQ ID NO: 5890257 - DNA, 17 bp, Homo sapiens
ctggaggccgaggacca

SEQ ID NO: 5890258 - DNA, 22 bp, Homo sapiens
ctggaggccgaggaccaccagc

SEQ ID NO: 5890259 - DNA, 15 bp, Homo sapiens
ctggaggcctcaggt

SEQ ID NO: 5890260 - DNA, 18 bp, Homo sapiens
ctggaggcctcaggtgct

SEQ ID NO: 5890261 - DNA, 19 bp, Homo sapiens
ctggaggcctcaggtgctg

SEQ ID NO: 5890262 - DNA, 14 bp, Homo sapiens
ctggaggcctcgcc

SEQ ID NO: 5890263 - DNA, 15 bp, Homo sapiens
ctggaggcctctgca

SEQ ID NO: 5890264 - DNA, 18 bp, Homo sapiens
ctggaggcctctggccct

SEQ ID NO: 5890265 - DNA, 19 bp, Homo sapiens
ctggaggccttccagctgc

SEQ ID NO: 5890266 - DNA, 20 bp, Homo sapiens
ctggaggccttccagctgct

SEQ ID NO: 5890267 - DNA, 16 bp, Homo sapiens
ctggaggcggtgcggc

SEQ ID NO: 5890268 - DNA, 19 bp, Homo sapiens
ctggaggctcagcccaccc

SEQ ID NO: 5890269 - DNA, 13 bp, Homo sapiens
ctggaggctccca

SEQ ID NO: 5890270 - DNA, 17 bp, Homo sapiens
ctggaggctcctctagg

SEQ ID NO: 5890271 - DNA, 18 bp, Homo sapiens
ctggaggctgcctcccaa

SEQ ID NO: 5890272 - DNA, 21 bp, Homo sapiens
ctggaggctgcctcccaacag

SEQ ID NO: 5890273 - DNA, 17 bp, Homo sapiens
ctggaggctgcgtcctg

SEQ ID NO: 5890274 - DNA, 14 bp, Homo sapiens
ctggaggctggacc

SEQ ID NO: 5890275 - DNA, 15 bp, Homo sapiens
ctggaggctggatgg

SEQ ID NO: 5890276 - DNA, 15 bp, Homo sapiens
ctggaggctgggtgg

SEQ ID NO: 5890277 - DNA, 21 bp, Homo sapiens
ctggagggaagagtggaggtg

SEQ ID NO: 5890278 - DNA, 22 bp, Homo sapiens
ctggagggaagagtggaggtgg

SEQ ID NO: 5890279 - DNA, 23 bp, Homo sapiens
ctggagggaagagtggaggtgga

SEQ ID NO: 5890280 - DNA, 21 bp, Homo sapiens
ctggagggaaggacagtccct

SEQ ID NO: 5890281 - DNA, 16 bp, Homo sapiens
ctggagggacttttaa

SEQ ID NO: 5890282 - DNA, 12 bp, Homo sapiens
ctggagggagat

SEQ ID NO: 5890283 - DNA, 16 bp, Homo sapiens
ctggagggcaagccct

SEQ ID NO: 5890284 - DNA, 23 bp, Homo sapiens
ctggagggcacttcctccacagt

SEQ ID NO: 5890285 - DNA, 20 bp, Homo sapiens
ctggagggcgcccagcagcc

SEQ ID NO: 5890286 - DNA, 22 bp, Homo sapiens
ctggagggcgcccagcagcctg

SEQ ID NO: 5890287 - DNA, 21 bp, Homo sapiens
ctggagggctagaacctggag

SEQ ID NO: 5890288 - DNA, 22 bp, Homo sapiens
ctggagggctagaacctggaga

SEQ ID NO: 5890289 - DNA, 19 bp, Homo sapiens
ctggagggctagaatctgg

SEQ ID NO: 5890290 - DNA, 20 bp, Homo sapiens
ctggagggctagaatctgga

SEQ ID NO: 5890291 - DNA, 20 bp, Homo sapiens
ctggagggctggaatctgga

SEQ ID NO: 5890292 - DNA, 14 bp, Homo sapiens
ctggagggctgggc

SEQ ID NO: 5890293 - DNA, 21 bp, Homo sapiens
ctggagggctgggcagggccc

SEQ ID NO: 5890294 - DNA, 15 bp, Homo sapiens
ctggaggggacgctg

SEQ ID NO: 5890295 - DNA, 22 bp, Homo sapiens
ctggaggggagagctttgtgct

SEQ ID NO: 5890296 - DNA, 23 bp, Homo sapiens
ctggaggggagagctttgtgctt

SEQ ID NO: 5890297 - DNA, 22 bp, Homo sapiens
ctggaggggagaggtcagcctt

SEQ ID NO: 5890298 - DNA, 23 bp, Homo sapiens
ctggaggggagaggtcagccttg

SEQ ID NO: 5890299 - DNA, 12 bp, Homo sapiens
ctggaggggcag

SEQ ID NO: 5890300 - DNA, 20 bp, Homo sapiens
ctggaggggcagtggagatc

SEQ ID NO: 5890301 - DNA, 22 bp, Homo sapiens
ctggaggggcatggccagcagc

SEQ ID NO: 5890302 - DNA, 23 bp, Homo sapiens
ctggaggggcatggccagcagct

SEQ ID NO: 5890303 - DNA, 18 bp, Homo sapiens
ctggaggggcccacccac

SEQ ID NO: 5890304 - DNA, 19 bp, Homo sapiens
ctggaggggcccacccaca

SEQ ID NO: 5890305 - DNA, 13 bp, Homo sapiens
ctggaggggctgt

SEQ ID NO: 5890306 - DNA, 19 bp, Homo sapiens
ctggaggggctgtcctcct

SEQ ID NO: 5890307 - DNA, 20 bp, Homo sapiens
ctggaggggctgtcctcctt

SEQ ID NO: 5890308 - DNA, 21 bp, Homo sapiens
ctggaggggctgtcctccttc

SEQ ID NO: 5890309 - DNA, 15 bp, Homo sapiens
ctggagggggaatgg

SEQ ID NO: 5890310 - DNA, 19 bp, Homo sapiens
ctggagggggaatggcagc

SEQ ID NO: 5890311 - DNA, 20 bp, Homo sapiens
ctggagggggaatggcagca

SEQ ID NO: 5890312 - DNA, 23 bp, Homo sapiens
ctggagggggagcaccagcggtc

SEQ ID NO: 5890313 - DNA, 14 bp, Homo sapiens
ctggagggggcaga

SEQ ID NO: 5890314 - DNA, 22 bp, Homo sapiens
ctggagggggcagagtggcctg

SEQ ID NO: 5890315 - DNA, 12 bp, Homo sapiens
ctggaggggtgg

SEQ ID NO: 5890316 - DNA, 18 bp, Homo sapiens
ctggaggggtggcccaga

SEQ ID NO: 5890317 - DNA, 22 bp, Homo sapiens
ctggaggggtggcccagagcca

SEQ ID NO: 5890318 - DNA, 16 bp, Homo sapiens
ctggaggggtgtggct

SEQ ID NO: 5890319 - DNA, 23 bp, Homo sapiens
ctggagggtaactggggggccac

SEQ ID NO: 5890320 - DNA, 23 bp, Homo sapiens
ctggagggtgctaggcccctgtg

SEQ ID NO: 5890321 - DNA, 16 bp, Homo sapiens
ctggaggtagagaggt

SEQ ID NO: 5890322 - DNA, 13 bp, Homo sapiens
ctggaggtcccag

SEQ ID NO: 5890323 - DNA, 15 bp, Homo sapiens
ctggaggtcccagac

SEQ ID NO: 5890324 - DNA, 24 bp, Homo sapiens
ctggaggtctccaggggcctgcag

SEQ ID NO: 5890325 - DNA, 18 bp, Homo sapiens
ctggaggtctggctgagc

SEQ ID NO: 5890326 - DNA, 20 bp, Homo sapiens
ctggaggtctggctgagccc

SEQ ID NO: 5890327 - DNA, 24 bp, Homo sapiens
ctggaggtctggctgagcccctgg

SEQ ID NO: 5890328 - DNA, 17 bp, Homo sapiens
ctggaggtgctgctcta

SEQ ID NO: 5890329 - DNA, 20 bp, Homo sapiens
ctggaggtgctggtagctga

SEQ ID NO: 5890330 - DNA, 20 bp, Homo sapiens
ctggaggtggctgagcccct

SEQ ID NO: 5890331 - DNA, 18 bp, Homo sapiens
ctggaggtgggagcagga

SEQ ID NO: 5890332 - DNA, 13 bp, Homo sapiens
ctggaggtgggca

SEQ ID NO: 5890333 - DNA, 23 bp, Homo sapiens
ctggaggtgggcatgccaccctc

SEQ ID NO: 5890334 - DNA, 24 bp, Homo sapiens
ctggaggtgggcatgccaccctca

SEQ ID NO: 5890335 - DNA, 20 bp, Homo sapiens
ctggaggtggggagggcctc

SEQ ID NO: 5890336 - DNA, 22 bp, Homo sapiens
ctggaggtggggagggcctctg

SEQ ID NO: 5890337 - DNA, 20 bp, Homo sapiens
ctggaggtggggttgggatt

SEQ ID NO: 5890338 - DNA, 22 bp, Homo sapiens
ctggaggtggggttgggattgg

SEQ ID NO: 5890339 - DNA, 14 bp, Homo sapiens
ctggaggtgtggga

SEQ ID NO: 5890340 - DNA, 20 bp, Homo sapiens
ctggaggtgttgtggggatg

SEQ ID NO: 5890341 - DNA, 17 bp, Homo sapiens
ctggaggttgaagccaa

SEQ ID NO: 5890342 - DNA, 19 bp, Homo sapiens
ctggaggttgataactttg

SEQ ID NO: 5890343 - DNA, 21 bp, Homo sapiens
ctggaggttgataactttgct

SEQ ID NO: 5890344 - DNA, 22 bp, Homo sapiens
ctggaggttgataactttgctt

SEQ ID NO: 5890345 - DNA, 14 bp, Homo sapiens
ctggagtacccagc

SEQ ID NO: 5890346 - DNA, 18 bp, Homo sapiens
ctggagtacccagcctat

SEQ ID NO: 5890347 - DNA, 14 bp, Homo sapiens
ctggagtaggcctg

SEQ ID NO: 5890348 - DNA, 16 bp, Homo sapiens
ctggagtaggcctggg

SEQ ID NO: 5890349 - DNA, 21 bp, Homo sapiens
ctggagtcacatcagtgagga

SEQ ID NO: 5890350 - DNA, 19 bp, Homo sapiens
ctggagtcactgcagaggg

SEQ ID NO: 5890351 - DNA, 14 bp, Homo sapiens
ctggagtcagatga

SEQ ID NO: 5890352 - DNA, 16 bp, Homo sapiens
ctggagtcagatgagc

SEQ ID NO: 5890353 - DNA, 15 bp, Homo sapiens
ctggagtcagggtga

SEQ ID NO: 5890354 - DNA, 19 bp, Homo sapiens
ctggagtcagtagccagag

SEQ ID NO: 5890355 - DNA, 20 bp, Homo sapiens
ctggagtcatgccaagcatt

SEQ ID NO: 5890356 - DNA, 22 bp, Homo sapiens
ctggagtcatgtgcctctgtcc

SEQ ID NO: 5890357 - DNA, 15 bp, Homo sapiens
ctggagtccagtctc

SEQ ID NO: 5890358 - DNA, 16 bp, Homo sapiens
ctggagtccagtctct

SEQ ID NO: 5890359 - DNA, 13 bp, Homo sapiens
ctggagtcccacc

SEQ ID NO: 5890360 - DNA, 14 bp, Homo sapiens
ctggagtcccaccc

SEQ ID NO: 5890361 - DNA, 16 bp, Homo sapiens
ctggagtcccctcctc

SEQ ID NO: 5890362 - DNA, 14 bp, Homo sapiens
ctggagtccctgtg

SEQ ID NO: 5890363 - DNA, 13 bp, Homo sapiens
ctggagtcctctc

SEQ ID NO: 5890364 - DNA, 15 bp, Homo sapiens
ctggagtcctctcca

SEQ ID NO: 5890365 - DNA, 17 bp, Homo sapiens
ctggagtcctctccaga

SEQ ID NO: 5890366 - DNA, 16 bp, Homo sapiens
ctggagtcctgttctc

SEQ ID NO: 5890367 - DNA, 17 bp, Homo sapiens
ctggagtcctgttctca

SEQ ID NO: 5890368 - DNA, 23 bp, Homo sapiens
ctggagtcctgttctcagagctc

SEQ ID NO: 5890369 - DNA, 19 bp, Homo sapiens
ctggagtcgtgggaaggag

SEQ ID NO: 5890370 - DNA, 18 bp, Homo sapiens
ctggagtctcactgtctg

SEQ ID NO: 5890371 - DNA, 13 bp, Homo sapiens
ctggagtctcctg

SEQ ID NO: 5890372 - DNA, 19 bp, Homo sapiens
ctggagtctgaaggagagg

SEQ ID NO: 5890373 - DNA, 13 bp, Homo sapiens
ctggagtctggag

SEQ ID NO: 5890374 - DNA, 18 bp, Homo sapiens
ctggagtctggagtgggc

SEQ ID NO: 5890375 - DNA, 14 bp, Homo sapiens
ctggagtctgggct

SEQ ID NO: 5890376 - DNA, 17 bp, Homo sapiens
ctggagtcttgtacact

SEQ ID NO: 5890377 - DNA, 23 bp, Homo sapiens
ctggagtgaagtggtgtgatccc

SEQ ID NO: 5890378 - DNA, 20 bp, Homo sapiens
ctggagtgaggcttccaggc

SEQ ID NO: 5890379 - DNA, 16 bp, Homo sapiens
ctggagtgagggcctc

SEQ ID NO: 5890380 - DNA, 20 bp, Homo sapiens
ctggagtgagggcctcagag

SEQ ID NO: 5890381 - DNA, 23 bp, Homo sapiens
ctggagtgagggcctcagagcct

SEQ ID NO: 5890382 - DNA, 17 bp, Homo sapiens
ctggagtgattctagag

SEQ ID NO: 5890383 - DNA, 14 bp, Homo sapiens
ctggagtgcagtga

SEQ ID NO: 5890384 - DNA, 17 bp, Homo sapiens
ctggagtgcagtgagcc

SEQ ID NO: 5890385 - DNA, 16 bp, Homo sapiens
ctggagtgcagtggct

SEQ ID NO: 5890386 - DNA, 18 bp, Homo sapiens
ctggagtgccatggctgg

SEQ ID NO: 5890387 - DNA, 19 bp, Homo sapiens
ctggagtgccatggctggg

SEQ ID NO: 5890388 - DNA, 14 bp, Homo sapiens
ctggagtgccctgc

SEQ ID NO: 5890389 - DNA, 19 bp, Homo sapiens
ctggagtgccctgcaggca

SEQ ID NO: 5890390 - DNA, 20 bp, Homo sapiens
ctggagtgccctgcaggcac

SEQ ID NO: 5890391 - DNA, 17 bp, Homo sapiens
ctggagtgcgctcttgg

SEQ ID NO: 5890392 - DNA, 24 bp, Homo sapiens
ctggagtgcgctcttggtccctgg

SEQ ID NO: 5890393 - DNA, 14 bp, Homo sapiens
ctggagtgctggct

SEQ ID NO: 5890394 - DNA, 15 bp, Homo sapiens
ctggagtgctggctc

SEQ ID NO: 5890395 - DNA, 16 bp, Homo sapiens
ctggagtgctggctcc

SEQ ID NO: 5890396 - DNA, 22 bp, Homo sapiens
ctggagtgctggctccacgccc

SEQ ID NO: 5890397 - DNA, 15 bp, Homo sapiens
ctggagtgctgtgct

SEQ ID NO: 5890398 - DNA, 20 bp, Homo sapiens
ctggagtgctgtgctgtgtt

SEQ ID NO: 5890399 - DNA, 20 bp, Homo sapiens
ctggagtggaaggtctattg

SEQ ID NO: 5890400 - DNA, 14 bp, Homo sapiens
ctggagtggccact

SEQ ID NO: 5890401 - DNA, 21 bp, Homo sapiens
ctggagtggctcgccaggcca

SEQ ID NO: 5890402 - DNA, 18 bp, Homo sapiens
ctggagtggtaacagctc

SEQ ID NO: 5890403 - DNA, 19 bp, Homo sapiens
ctggagtggtaacagctct

SEQ ID NO: 5890404 - DNA, 19 bp, Homo sapiens
ctggagtggtgttcagcca

SEQ ID NO: 5890405 - DNA, 23 bp, Homo sapiens
ctggagtgtcggatcctgtgagt

SEQ ID NO: 5890406 - DNA, 15 bp, Homo sapiens
ctggagtgtgtcaga

SEQ ID NO: 5890407 - DNA, 22 bp, Homo sapiens
ctggagttcccacccaagccct

SEQ ID NO: 5890408 - DNA, 15 bp, Homo sapiens
ctggagttctggttc

SEQ ID NO: 5890409 - DNA, 17 bp, Homo sapiens
ctggagttgactgactg

SEQ ID NO: 5890410 - DNA, 18 bp, Homo sapiens
ctggagttgatctggaac

SEQ ID NO: 5890411 - DNA, 16 bp, Homo sapiens
ctggagttggggcaga

SEQ ID NO: 5890412 - DNA, 14 bp, Homo sapiens
ctggagttgggggc

SEQ ID NO: 5890413 - DNA, 14 bp, Homo sapiens
ctggagtttcatgt

SEQ ID NO: 5890414 - DNA, 18 bp, Homo sapiens
ctggagtttctctaaagt

SEQ ID NO: 5890415 - DNA, 22 bp, Homo sapiens
ctggagtttctctaaagtcact

SEQ ID NO: 5890416 - DNA, 12 bp, Homo sapiens
ctggataaaaaa

SEQ ID NO: 5890417 - DNA, 16 bp, Homo sapiens
ctggataaaaaagaaa

SEQ ID NO: 5890418 - DNA, 13 bp, Homo sapiens
ctggataaaccac

SEQ ID NO: 5890419 - DNA, 16 bp, Homo sapiens
ctggataaagccactg

SEQ ID NO: 5890420 - DNA, 19 bp, Homo sapiens
ctggataaatttaaaacac

SEQ ID NO: 5890421 - DNA, 20 bp, Homo sapiens
ctggataaatttaaaacaca

SEQ ID NO: 5890422 - DNA, 15 bp, Homo sapiens
ctggataacttaggt

SEQ ID NO: 5890423 - DNA, 17 bp, Homo sapiens
ctggataacttccacag

SEQ ID NO: 5890424 - DNA, 20 bp, Homo sapiens
ctggataagtgaccacagaa

SEQ ID NO: 5890425 - DNA, 15 bp, Homo sapiens
ctggataatttgtat

SEQ ID NO: 5890426 - DNA, 21 bp, Homo sapiens
ctggataattttgcataaaat

SEQ ID NO: 5890427 - DNA, 18 bp, Homo sapiens
ctggatacagaatgaatc

SEQ ID NO: 5890428 - DNA, 14 bp, Homo sapiens
ctggatactggaca

SEQ ID NO: 5890429 - DNA, 16 bp, Homo sapiens
ctggatactggacaca

SEQ ID NO: 5890430 - DNA, 22 bp, Homo sapiens
ctggatagacttgggatgggga

SEQ ID NO: 5890431 - DNA, 19 bp, Homo sapiens
ctggatagccttgaaaaca

SEQ ID NO: 5890432 - DNA, 15 bp, Homo sapiens
ctggataggagcctg

SEQ ID NO: 5890433 - DNA, 18 bp, Homo sapiens
ctggatatagctaggtga

SEQ ID NO: 5890434 - DNA, 20 bp, Homo sapiens
ctggatatccatgagctgca

SEQ ID NO: 5890435 - DNA, 20 bp, Homo sapiens
ctggatatgttgttaaacac

SEQ ID NO: 5890436 - DNA, 16 bp, Homo sapiens
ctggatattcatgaaa

SEQ ID NO: 5890437 - DNA, 18 bp, Homo sapiens
ctggatatttcaatcttt

SEQ ID NO: 5890438 - DNA, 22 bp, Homo sapiens
ctggatatttcaatcttttaaa

SEQ ID NO: 5890439 - DNA, 19 bp, Homo sapiens
ctggatatttgcacttatg

SEQ ID NO: 5890440 - DNA, 16 bp, Homo sapiens
ctggatattttcaaat

SEQ ID NO: 5890441 - DNA, 22 bp, Homo sapiens
ctggatattttttgatggaaaa

SEQ ID NO: 5890442 - DNA, 16 bp, Homo sapiens
ctggatcaagttcagc

SEQ ID NO: 5890443 - DNA, 14 bp, Homo sapiens
ctggatcacagctg

SEQ ID NO: 5890444 - DNA, 22 bp, Homo sapiens
ctggatcacagctgctttctgt

SEQ ID NO: 5890445 - DNA, 20 bp, Homo sapiens
ctggatcacgacgctgcaga

SEQ ID NO: 5890446 - DNA, 21 bp, Homo sapiens
ctggatcacgacgctgcagag

SEQ ID NO: 5890447 - DNA, 15 bp, Homo sapiens
ctggatcagaacagg

SEQ ID NO: 5890448 - DNA, 17 bp, Homo sapiens
ctggatcagcgtggcct

SEQ ID NO: 5890449 - DNA, 18 bp, Homo sapiens
ctggatcagcgtggcctt

SEQ ID NO: 5890450 - DNA, 19 bp, Homo sapiens
ctggatcagcgtggccttg

SEQ ID NO: 5890451 - DNA, 23 bp, Homo sapiens
ctggatcagtaaaattatactgt

SEQ ID NO: 5890452 - DNA, 17 bp, Homo sapiens
ctggatcagtcctttga

SEQ ID NO: 5890453 - DNA, 16 bp, Homo sapiens
ctggatccagcactgg

SEQ ID NO: 5890454 - DNA, 14 bp, Homo sapiens
ctggatccagctct

SEQ ID NO: 5890455 - DNA, 17 bp, Homo sapiens
ctggatccatcaggcca

SEQ ID NO: 5890456 - DNA, 19 bp, Homo sapiens
ctggatccatcaggccact

SEQ ID NO: 5890457 - DNA, 21 bp, Homo sapiens
ctggatccatccgtccagcca

SEQ ID NO: 5890458 - DNA, 22 bp, Homo sapiens
ctggatccatccgtccagccaa

SEQ ID NO: 5890459 - DNA, 15 bp, Homo sapiens
ctggatccatcctgc

SEQ ID NO: 5890460 - DNA, 17 bp, Homo sapiens
ctggatccatgggggga

SEQ ID NO: 5890461 - DNA, 23 bp, Homo sapiens
ctggatcccgttcagaaaaccac

SEQ ID NO: 5890462 - DNA, 23 bp, Homo sapiens
ctggatcctagccttatcctctg

SEQ ID NO: 5890463 - DNA, 15 bp, Homo sapiens
ctggatcctcacact

SEQ ID NO: 5890464 - DNA, 16 bp, Homo sapiens
ctggatcctcacacta

SEQ ID NO: 5890465 - DNA, 15 bp, Homo sapiens
ctggatcctgaaata

SEQ ID NO: 5890466 - DNA, 14 bp, Homo sapiens
ctggatcctgcact

SEQ ID NO: 5890467 - DNA, 18 bp, Homo sapiens
ctggatcctgctgctttg

SEQ ID NO: 5890468 - DNA, 21 bp, Homo sapiens
ctggatcctgctgctttgggc

SEQ ID NO: 5890469 - DNA, 17 bp, Homo sapiens
ctggatcgctgcacatg

SEQ ID NO: 5890470 - DNA, 23 bp, Homo sapiens
ctggatcgctgcacatggcctga

SEQ ID NO: 5890471 - DNA, 18 bp, Homo sapiens
ctggatctacctggaggg

SEQ ID NO: 5890472 - DNA, 19 bp, Homo sapiens
ctggatctagaagggacca

SEQ ID NO: 5890473 - DNA, 16 bp, Homo sapiens
ctggatctatccctgc

SEQ ID NO: 5890474 - DNA, 23 bp, Homo sapiens
ctggatctatccctgcggcctcc

SEQ ID NO: 5890475 - DNA, 17 bp, Homo sapiens
ctggatctcccagggct

SEQ ID NO: 5890476 - DNA, 18 bp, Homo sapiens
ctggatctcccagggcta

SEQ ID NO: 5890477 - DNA, 19 bp, Homo sapiens
ctggatctcccagggctac

SEQ ID NO: 5890478 - DNA, 15 bp, Homo sapiens
ctggatctccccact

SEQ ID NO: 5890479 - DNA, 12 bp, Homo sapiens
ctggatctcctg

SEQ ID NO: 5890480 - DNA, 13 bp, Homo sapiens
ctggatctcctgc

SEQ ID NO: 5890481 - DNA, 16 bp, Homo sapiens
ctggatctcctgctgc

SEQ ID NO: 5890482 - DNA, 18 bp, Homo sapiens
ctggatctcctgctgcct

SEQ ID NO: 5890483 - DNA, 20 bp, Homo sapiens
ctggatctcttaagacagca

SEQ ID NO: 5890484 - DNA, 21 bp, Homo sapiens
ctggatctgaccctcccagtc

SEQ ID NO: 5890485 - DNA, 22 bp, Homo sapiens
ctggatcttcagaaggctagag

SEQ ID NO: 5890486 - DNA, 21 bp, Homo sapiens
ctggatcttctatcattccaa

SEQ ID NO: 5890487 - DNA, 22 bp, Homo sapiens
ctggatctttcggactgaggcc

SEQ ID NO: 5890488 - DNA, 13 bp, Homo sapiens
ctggatgaaaatg

SEQ ID NO: 5890489 - DNA, 23 bp, Homo sapiens
ctggatgaacaggatgtataata

SEQ ID NO: 5890490 - DNA, 23 bp, Homo sapiens
ctggatgaagttatctggcttca

SEQ ID NO: 5890491 - DNA, 16 bp, Homo sapiens
ctggatgaccccatgc

SEQ ID NO: 5890492 - DNA, 20 bp, Homo sapiens
ctggatgagaaacagctcag

SEQ ID NO: 5890493 - DNA, 23 bp, Homo sapiens
ctggatgatactaataaactaat

SEQ ID NO: 5890494 - DNA, 14 bp, Homo sapiens
ctggatgatatttt

SEQ ID NO: 5890495 - DNA, 16 bp, Homo sapiens
ctggatgatggattcc

SEQ ID NO: 5890496 - DNA, 22 bp, Homo sapiens
ctggatgatttcatcttctgga

SEQ ID NO: 5890497 - DNA, 23 bp, Homo sapiens
ctggatgatttcatcttctggaa

SEQ ID NO: 5890498 - DNA, 21 bp, Homo sapiens
ctggatgcacagatgccatgg

SEQ ID NO: 5890499 - DNA, 15 bp, Homo sapiens
ctggatgcacagtgc

SEQ ID NO: 5890500 - DNA, 16 bp, Homo sapiens
ctggatgcacagtgcc

SEQ ID NO: 5890501 - DNA, 19 bp, Homo sapiens
ctggatgcacagtgcctga

SEQ ID NO: 5890502 - DNA, 24 bp, Homo sapiens
ctggatgcacagtgcctgatggga

SEQ ID NO: 5890503 - DNA, 18 bp, Homo sapiens
ctggatgcagcctcacag

SEQ ID NO: 5890504 - DNA, 23 bp, Homo sapiens
ctggatgcagtggctcatgcctg

SEQ ID NO: 5890505 - DNA, 20 bp, Homo sapiens
ctggatgccaaggagcccct

SEQ ID NO: 5890506 - DNA, 14 bp, Homo sapiens
ctggatgccagctg

SEQ ID NO: 5890507 - DNA, 17 bp, Homo sapiens
ctggatgccagctgtgt

SEQ ID NO: 5890508 - DNA, 18 bp, Homo sapiens
ctggatgccagctgtgtc

SEQ ID NO: 5890509 - DNA, 20 bp, Homo sapiens
ctggatgccagctgtgtcct

SEQ ID NO: 5890510 - DNA, 13 bp, Homo sapiens
ctggatgcccagg

SEQ ID NO: 5890511 - DNA, 16 bp, Homo sapiens
ctggatgcccaggaat

SEQ ID NO: 5890512 - DNA, 23 bp, Homo sapiens
ctggatgcccatccactgggtgt

SEQ ID NO: 5890513 - DNA, 19 bp, Homo sapiens
ctggatgccccctgtggat

SEQ ID NO: 5890514 - DNA, 13 bp, Homo sapiens
ctggatgctcgcc

SEQ ID NO: 5890515 - DNA, 23 bp, Homo sapiens
ctggatgctgggttctggggctg

SEQ ID NO: 5890516 - DNA, 21 bp, Homo sapiens
ctggatgctgttgagggccaa

SEQ ID NO: 5890517 - DNA, 13 bp, Homo sapiens
ctggatggaaact

SEQ ID NO: 5890518 - DNA, 20 bp, Homo sapiens
ctggatggaaagacaaactg

SEQ ID NO: 5890519 - DNA, 21 bp, Homo sapiens
ctggatggaacgggcatgggc

SEQ ID NO: 5890520 - DNA, 11 bp, Homo sapiens
ctggatggagc

SEQ ID NO: 5890521 - DNA, 16 bp, Homo sapiens
ctggatggagcccagg

SEQ ID NO: 5890522 - DNA, 17 bp, Homo sapiens
ctggatggagcccaggc

SEQ ID NO: 5890523 - DNA, 16 bp, Homo sapiens
ctggatggagctggag

SEQ ID NO: 5890524 - DNA, 18 bp, Homo sapiens
ctggatggatctgctcca

SEQ ID NO: 5890525 - DNA, 21 bp, Homo sapiens
ctggatggatttgaagcaaag

SEQ ID NO: 5890526 - DNA, 19 bp, Homo sapiens
ctggatggcccctccttgc

SEQ ID NO: 5890527 - DNA, 20 bp, Homo sapiens
ctggatggccgggctgctgc

SEQ ID NO: 5890528 - DNA, 16 bp, Homo sapiens
ctggatggcctctggg

SEQ ID NO: 5890529 - DNA, 17 bp, Homo sapiens
ctggatggcctctgggg

SEQ ID NO: 5890530 - DNA, 13 bp, Homo sapiens
ctggatgggactc

SEQ ID NO: 5890531 - DNA, 20 bp, Homo sapiens
ctggatgggaggagagccac

SEQ ID NO: 5890532 - DNA, 24 bp, Homo sapiens
ctggatgggaggagagccactggg

SEQ ID NO: 5890533 - DNA, 22 bp, Homo sapiens
ctggccagccgctctcctgcca

SEQ ID NO: 5890534 - DNA, 23 bp, Homo sapiens
ctggccagccgctctcctgccac

SEQ ID NO: 5890535 - DNA, 24 bp, Homo sapiens
ctggccagcctggggcctggcagg

SEQ ID NO: 5890536 - DNA, 23 bp, Homo sapiens
ctggccagcgagcgcccagctcc

SEQ ID NO: 5890537 - DNA, 20 bp, Homo sapiens
ctggccagcgggcccagcaa

SEQ ID NO: 5890538 - DNA, 16 bp, Homo sapiens
ctggccagctctgagg

SEQ ID NO: 5890539 - DNA, 22 bp, Homo sapiens
ctggccagctctgaggggaggc

SEQ ID NO: 5890540 - DNA, 12 bp, Homo sapiens
ctggccagctgt

SEQ ID NO: 5890541 - DNA, 15 bp, Homo sapiens
ctggccagctgtgcg

SEQ ID NO: 5890542 - DNA, 12 bp, Homo sapiens
ctggccaggagc

SEQ ID NO: 5890543 - DNA, 20 bp, Homo sapiens
ctggccaggagctcttcagg

SEQ ID NO: 5890544 - DNA, 23 bp, Homo sapiens
ctggccaggatggaggggtggtc

SEQ ID NO: 5890545 - DNA, 17 bp, Homo sapiens
ctggccaggcagggaga

SEQ ID NO: 5890546 - DNA, 14 bp, Homo sapiens
ctggccaggcatgg

SEQ ID NO: 5890547 - DNA, 13 bp, Homo sapiens
ctggccagggagg

SEQ ID NO: 5890548 - DNA, 13 bp, Homo sapiens
ctggccagggcag

SEQ ID NO: 5890549 - DNA, 15 bp, Homo sapiens
ctggccagggcaggg

SEQ ID NO: 5890550 - DNA, 21 bp, Homo sapiens
ctggccagggcagggccaccc

SEQ ID NO: 5890551 - DNA, 14 bp, Homo sapiens
ctggccagggccac

SEQ ID NO: 5890552 - DNA, 18 bp, Homo sapiens
ctggccagggccacgctc

SEQ ID NO: 5890553 - DNA, 13 bp, Homo sapiens
ctggccagggcct

SEQ ID NO: 5890554 - DNA, 18 bp, Homo sapiens
ctggccagggcctctgtg

SEQ ID NO: 5890555 - DNA, 23 bp, Homo sapiens
ctggccagggcctggaagacaga

SEQ ID NO: 5890556 - DNA, 20 bp, Homo sapiens
ctggccaggggcttctcccc

SEQ ID NO: 5890557 - DNA, 17 bp, Homo sapiens
ctggccagtccaggctg

SEQ ID NO: 5890558 - DNA, 16 bp, Homo sapiens
ctggccagtcctagag

SEQ ID NO: 5890559 - DNA, 21 bp, Homo sapiens
ctggccagtcctagagctcct

SEQ ID NO: 5890560 - DNA, 13 bp, Homo sapiens
ctggccagtcctg

SEQ ID NO: 5890561 - DNA, 21 bp, Homo sapiens
ctggccagtgccctgatccca

SEQ ID NO: 5890562 - DNA, 22 bp, Homo sapiens
ctggccagtgccctgatcccag

SEQ ID NO: 5890563 - DNA, 20 bp, Homo sapiens
ctggccagtgctgcccatga

SEQ ID NO: 5890564 - DNA, 17 bp, Homo sapiens
ctggccagttgcccaga

SEQ ID NO: 5890565 - DNA, 18 bp, Homo sapiens
ctggccagttgcccagag

SEQ ID NO: 5890566 - DNA, 23 bp, Homo sapiens
ctggccatccctcgtggtcccca

SEQ ID NO: 5890567 - DNA, 20 bp, Homo sapiens
ctggccatctccctccccag

SEQ ID NO: 5890568 - DNA, 22 bp, Homo sapiens
ctggccatgaatctctgcctct

SEQ ID NO: 5890569 - DNA, 13 bp, Homo sapiens
ctggccatgctgt

SEQ ID NO: 5890570 - DNA, 22 bp, Homo sapiens
ctggccatgctgtccctgcact

SEQ ID NO: 5890571 - DNA, 17 bp, Homo sapiens
ctggccatggagaaagc

SEQ ID NO: 5890572 - DNA, 23 bp, Homo sapiens
ctggccatggagaaagctgactt

SEQ ID NO: 5890573 - DNA, 14 bp, Homo sapiens
ctggccatggcctg

SEQ ID NO: 5890574 - DNA, 22 bp, Homo sapiens
ctggccatggcctgcaaactgg

SEQ ID NO: 5890575 - DNA, 15 bp, Homo sapiens
ctggccatggctgct

SEQ ID NO: 5890576 - DNA, 18 bp, Homo sapiens
ctggccatggggccctcc

SEQ ID NO: 5890577 - DNA, 19 bp, Homo sapiens
ctggccatgtcacctggct

SEQ ID NO: 5890578 - DNA, 23 bp, Homo sapiens
ctggccattcttatgttccagat

SEQ ID NO: 5890579 - DNA, 22 bp, Homo sapiens
ctggccattggctagaatcagg

SEQ ID NO: 5890580 - DNA, 19 bp, Homo sapiens
ctggccatttggccccagg

SEQ ID NO: 5890581 - DNA, 21 bp, Homo sapiens
ctggccattttcttgcctgag

SEQ ID NO: 5890582 - DNA, 22 bp, Homo sapiens
ctggccattttcttgcctgagg

SEQ ID NO: 5890583 - DNA, 16 bp, Homo sapiens
ctggccatttttctgg

SEQ ID NO: 5890584 - DNA, 18 bp, Homo sapiens
ctggccatttttctgggg

SEQ ID NO: 5890585 - DNA, 14 bp, Homo sapiens
ctggcccaaagcag

SEQ ID NO: 5890586 - DNA, 17 bp, Homo sapiens
ctggcccaagccctcca

SEQ ID NO: 5890587 - DNA, 15 bp, Homo sapiens
ctggcccaagctggg

SEQ ID NO: 5890588 - DNA, 16 bp, Homo sapiens
ctggcccaagctgggc

SEQ ID NO: 5890589 - DNA, 15 bp, Homo sapiens
ctggcccacagctct

SEQ ID NO: 5890590 - DNA, 17 bp, Homo sapiens
ctggcccacagctctgc

SEQ ID NO: 5890591 - DNA, 21 bp, Homo sapiens
ctggcccacagctctgctgga

SEQ ID NO: 5890592 - DNA, 22 bp, Homo sapiens
ctggcccaccccccagcctcca

SEQ ID NO: 5890593 - DNA, 15 bp, Homo sapiens
ctggcccacccctct

SEQ ID NO: 5890594 - DNA, 17 bp, Homo sapiens
ctggcccacgccctccc

SEQ ID NO: 5890595 - DNA, 12 bp, Homo sapiens
ctggcccactgc

SEQ ID NO: 5890596 - DNA, 16 bp, Homo sapiens
ctggcccactgctggc

SEQ ID NO: 5890597 - DNA, 17 bp, Homo sapiens
ctggcccactgctggct

SEQ ID NO: 5890598 - DNA, 12 bp, Homo sapiens
ctggcccagaaa

SEQ ID NO: 5890599 - DNA, 15 bp, Homo sapiens
ctggcccagcatgga

SEQ ID NO: 5890600 - DNA, 20 bp, Homo sapiens
ctggcccagccaactgcccc

SEQ ID NO: 5890601 - DNA, 17 bp, Homo sapiens
ctggcccagccagcagg

SEQ ID NO: 5890602 - DNA, 19 bp, Homo sapiens
ctggcccagccagccagga

SEQ ID NO: 5890603 - DNA, 19 bp, Homo sapiens
ctggcccagccctgctggc

SEQ ID NO: 5890604 - DNA, 20 bp, Homo sapiens
ctggcccagccctgctggcc

SEQ ID NO: 5890605 - DNA, 22 bp, Homo sapiens
ctggcccagccctgctggccgc

SEQ ID NO: 5890606 - DNA, 15 bp, Homo sapiens
ctggcccagccggcc

SEQ ID NO: 5890607 - DNA, 20 bp, Homo sapiens
ctggcccagccggcctctct

SEQ ID NO: 5890608 - DNA, 13 bp, Homo sapiens
ctggcccagcctg

SEQ ID NO: 5890609 - DNA, 21 bp, Homo sapiens
ctggcccagcctttgttcccc

SEQ ID NO: 5890610 - DNA, 12 bp, Homo sapiens
ctggcccagctc

SEQ ID NO: 5890611 - DNA, 22 bp, Homo sapiens
ctggcccagctcccccgggagg

SEQ ID NO: 5890612 - DNA, 13 bp, Homo sapiens
ctggcccaggaga

SEQ ID NO: 5890613 - DNA, 12 bp, Homo sapiens
ctggcccaggcc

SEQ ID NO: 5890614 - DNA, 18 bp, Homo sapiens
ctggcccaggccttgctg

SEQ ID NO: 5890615 - DNA, 15 bp, Homo sapiens
ctggcccaggctggc

SEQ ID NO: 5890616 - DNA, 17 bp, Homo sapiens
ctggcccaggctggccc

SEQ ID NO: 5890617 - DNA, 11 bp, Homo sapiens
ctggcccaggg

SEQ ID NO: 5890618 - DNA, 13 bp, Homo sapiens
ctggcccagggcc

SEQ ID NO: 5890619 - DNA, 15 bp, Homo sapiens
ctggcccagggccca

SEQ ID NO: 5890620 - DNA, 20 bp, Homo sapiens
ctggcccagggcccagagcc

SEQ ID NO: 5890621 - DNA, 21 bp, Homo sapiens
ctggcccagggcccagagccc

SEQ ID NO: 5890622 - DNA, 22 bp, Homo sapiens
ctggcccagggcccagagccca

SEQ ID NO: 5890623 - DNA, 15 bp, Homo sapiens
ctggcccagggggcc

SEQ ID NO: 5890624 - DNA, 17 bp, Homo sapiens
ctggcccagggggcctg

SEQ ID NO: 5890625 - DNA, 13 bp, Homo sapiens
ctggcccagggtg

SEQ ID NO: 5890626 - DNA, 23 bp, Homo sapiens
ctggcccagggtgtttgcagctg

SEQ ID NO: 5890627 - DNA, 21 bp, Homo sapiens
ctggcccaggtaacatgttta

SEQ ID NO: 5890628 - DNA, 20 bp, Homo sapiens
ctggcccagtgccagcaagt

SEQ ID NO: 5890629 - DNA, 16 bp, Homo sapiens
ctggcccatagaaaca

SEQ ID NO: 5890630 - DNA, 17 bp, Homo sapiens
ctggcccatagaaacat

SEQ ID NO: 5890631 - DNA, 13 bp, Homo sapiens
ctggcccatcagg

SEQ ID NO: 5890632 - DNA, 16 bp, Homo sapiens
ctggcccatctcagcc

SEQ ID NO: 5890633 - DNA, 22 bp, Homo sapiens
ctggcccatctcagcctcctga

SEQ ID NO: 5890634 - DNA, 12 bp, Homo sapiens
ctggccccacac

SEQ ID NO: 5890635 - DNA, 15 bp, Homo sapiens
ctggccccagagatg

SEQ ID NO: 5890636 - DNA, 21 bp, Homo sapiens
ctggccccagccctactctgt

SEQ ID NO: 5890637 - DNA, 22 bp, Homo sapiens
ctggccccagctcctcttcctg

SEQ ID NO: 5890638 - DNA, 23 bp, Homo sapiens
ctggccccagctcctcttcctgc

SEQ ID NO: 5890639 - DNA, 16 bp, Homo sapiens
ctggccccaggacctg

SEQ ID NO: 5890640 - DNA, 12 bp, Homo sapiens
ctggccccaggc

SEQ ID NO: 5890641 - DNA, 17 bp, Homo sapiens
ctggccccaggccccag

SEQ ID NO: 5890642 - DNA, 13 bp, Homo sapiens
ctggccccaggcg

SEQ ID NO: 5890643 - DNA, 14 bp, Homo sapiens
ctggccccaggcgg

SEQ ID NO: 5890644 - DNA, 15 bp, Homo sapiens
ctggccccaggcgga

SEQ ID NO: 5890645 - DNA, 15 bp, Homo sapiens
ctggccccaggctgt

SEQ ID NO: 5890646 - DNA, 20 bp, Homo sapiens
ctggccccaggtagaaactt

SEQ ID NO: 5890647 - DNA, 17 bp, Homo sapiens
ctggccccatcctggcc

SEQ ID NO: 5890648 - DNA, 17 bp, Homo sapiens
ctggccccatggtcagc

SEQ ID NO: 5890649 - DNA, 13 bp, Homo sapiens
ctggcccccacat

SEQ ID NO: 5890650 - DNA, 14 bp, Homo sapiens
ctggcccccacatg

SEQ ID NO: 5890651 - DNA, 14 bp, Homo sapiens
ctggcccccaccca

SEQ ID NO: 5890652 - DNA, 18 bp, Homo sapiens
ctggcccccacccacctt

SEQ ID NO: 5890653 - DNA, 14 bp, Homo sapiens
ctggcccccactgg

SEQ ID NO: 5890654 - DNA, 23 bp, Homo sapiens
ctggcccccaggattcccccagc

SEQ ID NO: 5890655 - DNA, 16 bp, Homo sapiens
ctggcccccccagccc

SEQ ID NO: 5890656 - DNA, 13 bp, Homo sapiens
ctggcccccctcc

SEQ ID NO: 5890657 - DNA, 17 bp, Homo sapiens
ctggcccccctccaggc

SEQ ID NO: 5890658 - DNA, 22 bp, Homo sapiens
ctggcccccctggtcccctcct

SEQ ID NO: 5890659 - DNA, 16 bp, Homo sapiens
ctggcccccgacccag

SEQ ID NO: 5890660 - DNA, 20 bp, Homo sapiens
ctggcccccgacccagctct

SEQ ID NO: 5890661 - DNA, 21 bp, Homo sapiens
ctggcccccgacccagctcta

SEQ ID NO: 5890662 - DNA, 17 bp, Homo sapiens
ctggccccctccctgga

SEQ ID NO: 5890663 - DNA, 19 bp, Homo sapiens
ctggccccctccctggatg

SEQ ID NO: 5890664 - DNA, 19 bp, Homo sapiens
ctggccccctcgcgcccct

SEQ ID NO: 5890665 - DNA, 21 bp, Homo sapiens
ctggccccctcgcgcccctgt

SEQ ID NO: 5890666 - DNA, 24 bp, Homo sapiens
ctggccccgcccgtggcctcgtgc

SEQ ID NO: 5890667 - DNA, 16 bp, Homo sapiens
ctggccccgccgcctg

SEQ ID NO: 5890668 - DNA, 23 bp, Homo sapiens
ctggccccgccgcctggtactca

SEQ ID NO: 5890669 - DNA, 14 bp, Homo sapiens
ctggccccgcctgc

SEQ ID NO: 5890670 - DNA, 15 bp, Homo sapiens
ctggccccgcctgcc

SEQ ID NO: 5890671 - DNA, 16 bp, Homo sapiens
ctggccccgcctgcct

SEQ ID NO: 5890672 - DNA, 18 bp, Homo sapiens
ctggccccgcctgcctgc

SEQ ID NO: 5890673 - DNA, 20 bp, Homo sapiens
ctggccccgcctgcctgcca

SEQ ID NO: 5890674 - DNA, 21 bp, Homo sapiens
ctggccccgcctgcctgccac

SEQ ID NO: 5890675 - DNA, 18 bp, Homo sapiens
ctggccccggatcagagc

SEQ ID NO: 5890676 - DNA, 21 bp, Homo sapiens
ctggccccgggctctggccac

SEQ ID NO: 5890677 - DNA, 18 bp, Homo sapiens
ctggcccctagaatcagc

SEQ ID NO: 5890678 - DNA, 20 bp, Homo sapiens
ctggcccctagaatcagcct

SEQ ID NO: 5890679 - DNA, 13 bp, Homo sapiens
ctggcccctcagg

SEQ ID NO: 5890680 - DNA, 20 bp, Homo sapiens
ctggcccctcagggtccctg

SEQ ID NO: 5890681 - DNA, 21 bp, Homo sapiens
ctggcccctccagaccctgcc

SEQ ID NO: 5890682 - DNA, 23 bp, Homo sapiens
ctggcccctccagaccctgcctg

SEQ ID NO: 5890683 - DNA, 17 bp, Homo sapiens
ctggcccctccgcgagg

SEQ ID NO: 5890684 - DNA, 15 bp, Homo sapiens
ctggcccctcgcctg

SEQ ID NO: 5890685 - DNA, 13 bp, Homo sapiens
ctggcccctctcc

SEQ ID NO: 5890686 - DNA, 24 bp, Homo sapiens
ctggcccctctcccttgggctctg

SEQ ID NO: 5890687 - DNA, 18 bp, Homo sapiens
ctggcccctgacccaggg

SEQ ID NO: 5890688 - DNA, 19 bp, Homo sapiens
ctggcccctgacccaggga

SEQ ID NO: 5890689 - DNA, 18 bp, Homo sapiens
ctggcccctgagatctct

SEQ ID NO: 5890690 - DNA, 18 bp, Homo sapiens
ctggccccttctccagca

SEQ ID NO: 5890691 - DNA, 21 bp, Homo sapiens
ctggcccctttgggccctgca

SEQ ID NO: 5890692 - DNA, 20 bp, Homo sapiens
ctggcccgcaagagggacag

SEQ ID NO: 5890693 - DNA, 23 bp, Homo sapiens
ctggcccgcaagagggacagagc

SEQ ID NO: 5890694 - DNA, 18 bp, Homo sapiens
ctggcccgtgacagactc

SEQ ID NO: 5890695 - DNA, 19 bp, Homo sapiens
ctggcccgtgacagactcc

SEQ ID NO: 5890696 - DNA, 14 bp, Homo sapiens
ctggccctacagta

SEQ ID NO: 5890697 - DNA, 14 bp, Homo sapiens
ctggccctatttag

SEQ ID NO: 5890698 - DNA, 16 bp, Homo sapiens
ctggccctcaaggcct

SEQ ID NO: 5890699 - DNA, 21 bp, Homo sapiens
ctggccctcaaggcctcccac

SEQ ID NO: 5890700 - DNA, 22 bp, Homo sapiens
ctggccctcaaggcctcccaca

SEQ ID NO: 5890701 - DNA, 23 bp, Homo sapiens
ctggccctcaaggcctcccacag

SEQ ID NO: 5890702 - DNA, 21 bp, Homo sapiens
ctggccctcacccctgccctg

SEQ ID NO: 5890703 - DNA, 23 bp, Homo sapiens
ctggccctcactcaagaccaggc

SEQ ID NO: 5890704 - DNA, 13 bp, Homo sapiens
ctggccctcagct

SEQ ID NO: 5890705 - DNA, 14 bp, Homo sapiens
ctggccctcagctc

SEQ ID NO: 5890706 - DNA, 17 bp, Homo sapiens
ctggccctcagctccct

SEQ ID NO: 5890707 - DNA, 16 bp, Homo sapiens
ctggccctcagtttcc

SEQ ID NO: 5890708 - DNA, 16 bp, Homo sapiens
ctggccctccactcct

SEQ ID NO: 5890709 - DNA, 14 bp, Homo sapiens
ctggcctcttggca

SEQ ID NO: 5890710 - DNA, 16 bp, Homo sapiens
ctggcctcttggcacc

SEQ ID NO: 5890711 - DNA, 19 bp, Homo sapiens
ctggcctcttggcacctgc

SEQ ID NO: 5890712 - DNA, 24 bp, Homo sapiens
ctggcctcttggcacctgcctagc

SEQ ID NO: 5890713 - DNA, 21 bp, Homo sapiens
ctggcctgaactgaggagatg

SEQ ID NO: 5890714 - DNA, 15 bp, Homo sapiens
ctggcctgactccca

SEQ ID NO: 5890715 - DNA, 19 bp, Homo sapiens
ctggcctgagagtcagctc

SEQ ID NO: 5890716 - DNA, 13 bp, Homo sapiens
ctggcctgagcaa

SEQ ID NO: 5890717 - DNA, 15 bp, Homo sapiens
ctggcctgagcgcag

SEQ ID NO: 5890718 - DNA, 14 bp, Homo sapiens
ctggcctgagctgg

SEQ ID NO: 5890719 - DNA, 19 bp, Homo sapiens
ctggcctgagctggggcca

SEQ ID NO: 5890720 - DNA, 12 bp, Homo sapiens
ctggcctgagga

SEQ ID NO: 5890721 - DNA, 13 bp, Homo sapiens
ctggcctgaggag

SEQ ID NO: 5890722 - DNA, 16 bp, Homo sapiens
ctggcctgaggagcag

SEQ ID NO: 5890723 - DNA, 11 bp, Homo sapiens
ctggcctgcca

SEQ ID NO: 5890724 - DNA, 12 bp, Homo sapiens
ctggcctgccag

SEQ ID NO: 5890725 - DNA, 13 bp, Homo sapiens
ctggcctgccagg

SEQ ID NO: 5890726 - DNA, 15 bp, Homo sapiens
ctggcctgccatgcc

SEQ ID NO: 5890727 - DNA, 22 bp, Homo sapiens
ctggcctgccatgccagtaact

SEQ ID NO: 5890728 - DNA, 19 bp, Homo sapiens
ctggcctgcccgtgccctg

SEQ ID NO: 5890729 - DNA, 22 bp, Homo sapiens
ctggcctgcccgtgccctggtg

SEQ ID NO: 5890730 - DNA, 20 bp, Homo sapiens
ctggcctgcggtggagggat

SEQ ID NO: 5890731 - DNA, 22 bp, Homo sapiens
ctggcctgctcttacttccccc

SEQ ID NO: 5890732 - DNA, 14 bp, Homo sapiens
ctggcctgctggga

SEQ ID NO: 5890733 - DNA, 15 bp, Homo sapiens
ctggcctgctgggaa

SEQ ID NO: 5890734 - DNA, 19 bp, Homo sapiens
ctggcctgctgggctctcc

SEQ ID NO: 5890735 - DNA, 20 bp, Homo sapiens
ctggcctgctgggctctcca

SEQ ID NO: 5890736 - DNA, 21 bp, Homo sapiens
ctggcctggatctccccactc

SEQ ID NO: 5890737 - DNA, 22 bp, Homo sapiens
ctggcctggatctccccactct

SEQ ID NO: 5890738 - DNA, 13 bp, Homo sapiens
ctggcctggcaca

SEQ ID NO: 5890739 - DNA, 17 bp, Homo sapiens
ctggcctggccagtgcc

SEQ ID NO: 5890740 - DNA, 19 bp, Homo sapiens
ctggcctggccagtgccct

SEQ ID NO: 5890741 - DNA, 14 bp, Homo sapiens
ctggcctggcccct

SEQ ID NO: 5890742 - DNA, 24 bp, Homo sapiens
ctggcctggcccctcagggtccct

SEQ ID NO: 5890743 - DNA, 16 bp, Homo sapiens
ctggcctggccctgcc

SEQ ID NO: 5890744 - DNA, 14 bp, Homo sapiens
ctggcctggccctt

SEQ ID NO: 5890745 - DNA, 14 bp, Homo sapiens
ctggcctggccggc

SEQ ID NO: 5890746 - DNA, 15 bp, Homo sapiens
ctggcctggccggca

SEQ ID NO: 5890747 - DNA, 16 bp, Homo sapiens
ctggcctggcctggcc

SEQ ID NO: 5890748 - DNA, 14 bp, Homo sapiens
ctggcctggctccc

SEQ ID NO: 5890749 - DNA, 17 bp, Homo sapiens
ctggcctggctccccac

SEQ ID NO: 5890750 - DNA, 17 bp, Homo sapiens
ctggcctggctctcctg

SEQ ID NO: 5890751 - DNA, 13 bp, Homo sapiens
ctggcctggctgg

SEQ ID NO: 5890752 - DNA, 13 bp, Homo sapiens
ctggcctggcttc

SEQ ID NO: 5890753 - DNA, 17 bp, Homo sapiens
ctggcctggcttctcct

SEQ ID NO: 5890754 - DNA, 20 bp, Homo sapiens
ctggcctgggaaaagggcag

SEQ ID NO: 5890755 - DNA, 21 bp, Homo sapiens
ctggcctgggaaaagggcagg

SEQ ID NO: 5890756 - DNA, 17 bp, Homo sapiens
ctggcctgggccacacc

SEQ ID NO: 5890757 - DNA, 18 bp, Homo sapiens
ctggcctgggccacacct

SEQ ID NO: 5890758 - DNA, 14 bp, Homo sapiens
ctggcctgggggct

SEQ ID NO: 5890759 - DNA, 18 bp, Homo sapiens
ctggcctggggtcaggcc

SEQ ID NO: 5890760 - DNA, 20 bp, Homo sapiens
ctggcctggggtccctctga

SEQ ID NO: 5890761 - DNA, 20 bp, Homo sapiens
ctggcctggtccctggtcct

SEQ ID NO: 5890762 - DNA, 20 bp, Homo sapiens
ctggcctggtttcctcgaga

SEQ ID NO: 5890763 - DNA, 18 bp, Homo sapiens
ctggcctgtaatctacca

SEQ ID NO: 5890764 - DNA, 18 bp, Homo sapiens
ctggcctgtctgtgaaga

SEQ ID NO: 5890765 - DNA, 23 bp, Homo sapiens
ctggcctgtggcacagccctgag

SEQ ID NO: 5890766 - DNA, 12 bp, Homo sapiens
ctggcctgttat

SEQ ID NO: 5890767 - DNA, 12 bp, Homo sapiens
ctggcctgttct

SEQ ID NO: 5890768 - DNA, 22 bp, Homo sapiens
ctggccttaaaaggggcccaag

SEQ ID NO: 5890769 - DNA, 16 bp, Homo sapiens
ctggccttcctgccct

SEQ ID NO: 5890770 - DNA, 21 bp, Homo sapiens
ctggccttcggcctccatcct

SEQ ID NO: 5890771 - DNA, 15 bp, Homo sapiens
ctggccttctaggaa

SEQ ID NO: 5890772 - DNA, 22 bp, Homo sapiens
ctggccttctaggaatggagga

SEQ ID NO: 5890773 - DNA, 15 bp, Homo sapiens
ctggccttctcctac

SEQ ID NO: 5890774 - DNA, 18 bp, Homo sapiens
ctggccttgccacactct

SEQ ID NO: 5890775 - DNA, 13 bp, Homo sapiens
ctggccttgcccg

SEQ ID NO: 5890776 - DNA, 16 bp, Homo sapiens
ctggccttgcctccag

SEQ ID NO: 5890777 - DNA, 18 bp, Homo sapiens
ctggccttgcctccagga

SEQ ID NO: 5890778 - DNA, 20 bp, Homo sapiens
ctggccttgggatccaggcc

SEQ ID NO: 5890779 - DNA, 22 bp, Homo sapiens
ctggccttgggatccaggcccc

SEQ ID NO: 5890780 - DNA, 20 bp, Homo sapiens
ctggccttgggccctctggt

SEQ ID NO: 5890781 - DNA, 19 bp, Homo sapiens
ctggccttggtatgtgcca

SEQ ID NO: 5890782 - DNA, 22 bp, Homo sapiens
ctggccttggtatgtgccaggc

SEQ ID NO: 5890783 - DNA, 23 bp, Homo sapiens
ctggccttggtatgtgccaggct

SEQ ID NO: 5890784 - DNA, 19 bp, Homo sapiens
ctggccttggttcctccag

SEQ ID NO: 5890785 - DNA, 21 bp, Homo sapiens
ctggccttggttcctccagca

SEQ ID NO: 5890786 - DNA, 15 bp, Homo sapiens
ctggccttgtacttg

SEQ ID NO: 5890787 - DNA, 17 bp, Homo sapiens
ctggccttgtcaggacc

SEQ ID NO: 5890788 - DNA, 21 bp, Homo sapiens
ctggccttgtcaggacccagg

SEQ ID NO: 5890789 - DNA, 23 bp, Homo sapiens
ctggccttgtcaggacccaggcc

SEQ ID NO: 5890790 - DNA, 15 bp, Homo sapiens
ctggccttgtggtcc

SEQ ID NO: 5890791 - DNA, 14 bp, Homo sapiens
ctggcctttcatgg

SEQ ID NO: 5890792 - DNA, 16 bp, Homo sapiens
ctggccttttccattc

SEQ ID NO: 5890793 - DNA, 17 bp, Homo sapiens
ctggcctttttcattta

SEQ ID NO: 5890794 - DNA, 19 bp, Homo sapiens
ctggcgaagatggtctcca

SEQ ID NO: 5890795 - DNA, 18 bp, Homo sapiens
ctggcgaagcctgagcag

SEQ ID NO: 5890796 - DNA, 21 bp, Homo sapiens
ctggcgaagcctgagcaggca

SEQ ID NO: 5890797 - DNA, 14 bp, Homo sapiens
ctggcgacacactc

SEQ ID NO: 5890798 - DNA, 23 bp, Homo sapiens
ctggcgagagtctggccctagac

SEQ ID NO: 5890799 - DNA, 15 bp, Homo sapiens
ctggcgatctcccag

SEQ ID NO: 5890800 - DNA, 17 bp, Homo sapiens
ctggcgatctcccaggg

SEQ ID NO: 5890801 - DNA, 22 bp, Homo sapiens
ctggcgatctcccagggctctc

SEQ ID NO: 5890802 - DNA, 13 bp, Homo sapiens
ctggcgcagccaa

SEQ ID NO: 5890803 - DNA, 16 bp, Homo sapiens
ctggcgcagccaaggc

SEQ ID NO: 5890804 - DNA, 19 bp, Homo sapiens
ctggcgcagccaaggccga

SEQ ID NO: 5890805 - DNA, 19 bp, Homo sapiens
ctggcgccaggggcaggca

SEQ ID NO: 5890806 - DNA, 19 bp, Homo sapiens
ctggcgccatcgccgggac

SEQ ID NO: 5890807 - DNA, 16 bp, Homo sapiens
ctggcgcccagtggag

SEQ ID NO: 5890808 - DNA, 17 bp, Homo sapiens
ctggcgcccctgcctgt

SEQ ID NO: 5890809 - DNA, 16 bp, Homo sapiens
ctggcgctcagcagcc

SEQ ID NO: 5890810 - DNA, 20 bp, Homo sapiens
ctggcgcttggatctggggt

SEQ ID NO: 5890811 - DNA, 16 bp, Homo sapiens
ctggcggaacctggct

SEQ ID NO: 5890812 - DNA, 19 bp, Homo sapiens
ctggcggaggtctctggga

SEQ ID NO: 5890813 - DNA, 21 bp, Homo sapiens
ctggcggaggtctctgggagc

SEQ ID NO: 5890814 - DNA, 15 bp, Homo sapiens
ctggcggcgcagagg

SEQ ID NO: 5890815 - DNA, 18 bp, Homo sapiens
ctggcggctactcagcag

SEQ ID NO: 5890816 - DNA, 19 bp, Homo sapiens
ctggcggctggggtcccag

SEQ ID NO: 5890817 - DNA, 22 bp, Homo sapiens
ctggcggctggggtcccagcag

SEQ ID NO: 5890818 - DNA, 13 bp, Homo sapiens
ctggcggcttcct

SEQ ID NO: 5890819 - DNA, 15 bp, Homo sapiens
ctggcggcttcctgt

SEQ ID NO: 5890820 - DNA, 17 bp, Homo sapiens
ctggcggcttcctgtcc

SEQ ID NO: 5890821 - DNA, 18 bp, Homo sapiens
ctggcggcttcctgtcca

SEQ ID NO: 5890822 - DNA, 13 bp, Homo sapiens
ctggcgggatggg

SEQ ID NO: 5890823 - DNA, 16 bp, Homo sapiens
ctggcgggatgggcca

SEQ ID NO: 5890824 - DNA, 21 bp, Homo sapiens
ctggcgggcagcccctgctgg

SEQ ID NO: 5890825 - DNA, 21 bp, Homo sapiens
ctggcgggccctggagctcaa

SEQ ID NO: 5890826 - DNA, 21 bp, Homo sapiens
ctggcgggcctttttcctgcg

SEQ ID NO: 5890827 - DNA, 16 bp, Homo sapiens
ctggcggggggcccat

SEQ ID NO: 5890828 - DNA, 16 bp, Homo sapiens
ctggcggggtcccccc

SEQ ID NO: 5890829 - DNA, 17 bp, Homo sapiens
ctggcggggtcccccct

SEQ ID NO: 5890830 - DNA, 13 bp, Homo sapiens
ctggcgggtggct

SEQ ID NO: 5890831 - DNA, 16 bp, Homo sapiens
ctggcgggtggctgca

SEQ ID NO: 5890832 - DNA, 17 bp, Homo sapiens
ctggcgggtggctgcaa

SEQ ID NO: 5890833 - DNA, 21 bp, Homo sapiens
ctggcgtagaagtttttgtac

SEQ ID NO: 5890834 - DNA, 22 bp, Homo sapiens
ctggcgtagaagtttttgtact

SEQ ID NO: 5890835 - DNA, 18 bp, Homo sapiens
ctggcgtcatgcaaagtc

SEQ ID NO: 5890836 - DNA, 23 bp, Homo sapiens
ctggcgtcctctccctcctggcc

SEQ ID NO: 5890837 - DNA, 23 bp, Homo sapiens
ctggcgtctgtcttcaagggctt

SEQ ID NO: 5890838 - DNA, 22 bp, Homo sapiens
ctggcgtgaacccaggaggcgg

SEQ ID NO: 5890839 - DNA, 13 bp, Homo sapiens
ctggcgtgctcag

SEQ ID NO: 5890840 - DNA, 18 bp, Homo sapiens
ctggcgtggattaaactt

SEQ ID NO: 5890841 - DNA, 19 bp, Homo sapiens
ctggcgtggggggagctct

SEQ ID NO: 5890842 - DNA, 20 bp, Homo sapiens
ctggcgtggggggagctctg

SEQ ID NO: 5890843 - DNA, 22 bp, Homo sapiens
ctggcgttcacctccctgctca

SEQ ID NO: 5890844 - DNA, 16 bp, Homo sapiens
ctggcgttctcaagaa

SEQ ID NO: 5890845 - DNA, 20 bp, Homo sapiens
ctggcgttctcaagaatcta

SEQ ID NO: 5890846 - DNA, 21 bp, Homo sapiens
ctggctaacagtctagtgcaa

SEQ ID NO: 5890847 - DNA, 20 bp, Homo sapiens
ctggctaattttctgtattt

SEQ ID NO: 5890848 - DNA, 15 bp, Homo sapiens
ctggctacctgtttg

SEQ ID NO: 5890849 - DNA, 20 bp, Homo sapiens
ctggctacgacttgggacgg

SEQ ID NO: 5890850 - DNA, 13 bp, Homo sapiens
ctggctactccct

SEQ ID NO: 5890851 - DNA, 17 bp, Homo sapiens
ctggctactccctggac

SEQ ID NO: 5890852 - DNA, 20 bp, Homo sapiens
ctggctactccctggaccac

SEQ ID NO: 5890853 - DNA, 22 bp, Homo sapiens
ctggctactgggaaattactta

SEQ ID NO: 5890854 - DNA, 14 bp, Homo sapiens
ctggctactgtcta

SEQ ID NO: 5890855 - DNA, 14 bp, Homo sapiens
ctggctacttccct

SEQ ID NO: 5890856 - DNA, 18 bp, Homo sapiens
ctggctacttcccttcct

SEQ ID NO: 5890857 - DNA, 21 bp, Homo sapiens
ctggctagaaaacaagcgttt

SEQ ID NO: 5890858 - DNA, 19 bp, Homo sapiens
ctggctagagccgagggga

SEQ ID NO: 5890859 - DNA, 23 bp, Homo sapiens
ctggctagaggccagccccaccc

SEQ ID NO: 5890860 - DNA, 16 bp, Homo sapiens
ctggctagagggccca

SEQ ID NO: 5890861 - DNA, 20 bp, Homo sapiens
ctggctagagggcccaaagc

SEQ ID NO: 5890862 - DNA, 22 bp, Homo sapiens
ctggctagagggcccaaagctt

SEQ ID NO: 5890863 - DNA, 19 bp, Homo sapiens
ctggctagagtcctcactc

SEQ ID NO: 5890864 - DNA, 21 bp, Homo sapiens
ctggctagagtcctcactccc

SEQ ID NO: 5890865 - DNA, 14 bp, Homo sapiens
ctggctatgcattt

SEQ ID NO: 5890866 - DNA, 16 bp, Homo sapiens
ctggctatgcatttga

SEQ ID NO: 5890867 - DNA, 22 bp, Homo sapiens
ctggctatttaaaaagctcttt

SEQ ID NO: 5890868 - DNA, 21 bp, Homo sapiens
ctggctcaagaattagggccc

SEQ ID NO: 5890869 - DNA, 15 bp, Homo sapiens
ctggctcacacatcc

SEQ ID NO: 5890870 - DNA, 15 bp, Homo sapiens
ctggctcacagccac

SEQ ID NO: 5890871 - DNA, 22 bp, Homo sapiens
ctggctcacagtacagcatgtg

SEQ ID NO: 5890872 - DNA, 24 bp, Homo sapiens
ctggctcacagtacagcatgtgcc

SEQ ID NO: 5890873 - DNA, 17 bp, Homo sapiens
ctggctcacccagtcct

SEQ ID NO: 5890874 - DNA, 16 bp, Homo sapiens
ctggctcacccctctc

SEQ ID NO: 5890875 - DNA, 22 bp, Homo sapiens
ctggctcacccctctcccccgc

SEQ ID NO: 5890876 - DNA, 21 bp, Homo sapiens
ctggctcacgccccgctgtgt

SEQ ID NO: 5890877 - DNA, 21 bp, Homo sapiens
ctggctcacgcgttctgggag

SEQ ID NO: 5890878 - DNA, 21 bp, Homo sapiens
ctggctcagcccgggatcctg

SEQ ID NO: 5890879 - DNA, 21 bp, Homo sapiens
ctggctcagcctcaaatgcag

SEQ ID NO: 5890880 - DNA, 20 bp, Homo sapiens
ctggctcagctgtggtccca

SEQ ID NO: 5890881 - DNA, 13 bp, Homo sapiens
ctggctcaggccc

SEQ ID NO: 5890882 - DNA, 15 bp, Homo sapiens
ctggctcaggcccag

SEQ ID NO: 5890883 - DNA, 12 bp, Homo sapiens
ctggctcaggga

SEQ ID NO: 5890884 - DNA, 20 bp, Homo sapiens
ctggctcagggtcaaagaca

SEQ ID NO: 5890885 - DNA, 14 bp, Homo sapiens
ctgggaaaccctct

SEQ ID NO: 5890886 - DNA, 19 bp, Homo sapiens
ctgggaaagccatgacctt

SEQ ID NO: 5890887 - DNA, 15 bp, Homo sapiens
ctgggaaaggaaaac

SEQ ID NO: 5890888 - DNA, 20 bp, Homo sapiens
ctgggaaaggaaaaccaggg

SEQ ID NO: 5890889 - DNA, 23 bp, Homo sapiens
ctgggaaaggaaaaccagggata

SEQ ID NO: 5890890 - DNA, 21 bp, Homo sapiens
ctgggaaaggacccacccatc

SEQ ID NO: 5890891 - DNA, 14 bp, Homo sapiens
ctgggaaagggaga

SEQ ID NO: 5890892 - DNA, 15 bp, Homo sapiens
ctgggaaaggtgctc

SEQ ID NO: 5890893 - DNA, 21 bp, Homo sapiens
ctgggaaaggtgctcaaagat

SEQ ID NO: 5890894 - DNA, 16 bp, Homo sapiens
ctgggaaataagagag

SEQ ID NO: 5890895 - DNA, 21 bp, Homo sapiens
ctgggaaatgagaaggcagcc

SEQ ID NO: 5890896 - DNA, 16 bp, Homo sapiens
ctgggaaatgaggttt

SEQ ID NO: 5890897 - DNA, 16 bp, Homo sapiens
ctgggaaatgttttaa

SEQ ID NO: 5890898 - DNA, 21 bp, Homo sapiens
ctgggaaattgaagtgtcttc

SEQ ID NO: 5890899 - DNA, 16 bp, Homo sapiens
ctgggaaattgctcca

SEQ ID NO: 5890900 - DNA, 21 bp, Homo sapiens
ctgggaacacagtgccccagt

SEQ ID NO: 5890901 - DNA, 15 bp, Homo sapiens
ctgggaacacatctg

SEQ ID NO: 5890902 - DNA, 18 bp, Homo sapiens
ctgggaacacttgcattt

SEQ ID NO: 5890903 - DNA, 15 bp, Homo sapiens
ctgggaacagaactc

SEQ ID NO: 5890904 - DNA, 15 bp, Homo sapiens
ctgggaacaggcccc

SEQ ID NO: 5890905 - DNA, 21 bp, Homo sapiens
ctgggaacaggccccacgccc

SEQ ID NO: 5890906 - DNA, 21 bp, Homo sapiens
ctgggaacagtgtgcaaggca

SEQ ID NO: 5890907 - DNA, 23 bp, Homo sapiens
ctgggaacatcacattcctctgc

SEQ ID NO: 5890908 - DNA, 17 bp, Homo sapiens
ctgggaaccatgaagct

SEQ ID NO: 5890909 - DNA, 20 bp, Homo sapiens
ctgggaaccatgaagctgga

SEQ ID NO: 5890910 - DNA, 18 bp, Homo sapiens
ctgggaacctagcacacc

SEQ ID NO: 5890911 - DNA, 13 bp, Homo sapiens
ctgggaacctccc

SEQ ID NO: 5890912 - DNA, 16 bp, Homo sapiens
ctgggaacctccttac

SEQ ID NO: 5890913 - DNA, 15 bp, Homo sapiens
ctgggaacggggtgg

SEQ ID NO: 5890914 - DNA, 19 bp, Homo sapiens
ctgggaactcccaagaaca

SEQ ID NO: 5890915 - DNA, 21 bp, Homo sapiens
ctgggaactcccaagaacagc

SEQ ID NO: 5890916 - DNA, 18 bp, Homo sapiens
ctgggaactgcagacctg

SEQ ID NO: 5890917 - DNA, 23 bp, Homo sapiens
ctgggaactgcagacctgtcctc

SEQ ID NO: 5890918 - DNA, 23 bp, Homo sapiens
ctgggaactggttcaagagacac

SEQ ID NO: 5890919 - DNA, 13 bp, Homo sapiens
ctgggaagaacaa

SEQ ID NO: 5890920 - DNA, 19 bp, Homo sapiens
ctgggaagaagcaagggca

SEQ ID NO: 5890921 - DNA, 21 bp, Homo sapiens
ctgggaagaagcaagggcaag

SEQ ID NO: 5890922 - DNA, 22 bp, Homo sapiens
ctgggaagagaagagggcccag

SEQ ID NO: 5890923 - DNA, 17 bp, Homo sapiens
ctgggaagataggctct

SEQ ID NO: 5890924 - DNA, 20 bp, Homo sapiens
ctgggaagatgctggcccca

SEQ ID NO: 5890925 - DNA, 20 bp, Homo sapiens
ctgggaagatttgaaaacaa

SEQ ID NO: 5890926 - DNA, 17 bp, Homo sapiens
ctgggaagcccacccag

SEQ ID NO: 5890927 - DNA, 14 bp, Homo sapiens
ctgggaagcccttt

SEQ ID NO: 5890928 - DNA, 20 bp, Homo sapiens
ctgggaagctgagggcaaat

SEQ ID NO: 5890929 - DNA, 13 bp, Homo sapiens
ctgggaagctgga

SEQ ID NO: 5890930 - DNA, 14 bp, Homo sapiens
ctgggaagctggag

SEQ ID NO: 5890931 - DNA, 21 bp, Homo sapiens
ctgggaagctgtactcagagc

SEQ ID NO: 5890932 - DNA, 19 bp, Homo sapiens
ctgggaaggaaacaaatgt

SEQ ID NO: 5890933 - DNA, 22 bp, Homo sapiens
ctgggaaggaaacaaatgtgta

SEQ ID NO: 5890934 - DNA, 20 bp, Homo sapiens
ctgggaaggacataaaaggt

SEQ ID NO: 5890935 - DNA, 17 bp, Homo sapiens
ctgggaaggagggagct

SEQ ID NO: 5890936 - DNA, 15 bp, Homo sapiens
ctgggaaggccacct

SEQ ID NO: 5890937 - DNA, 20 bp, Homo sapiens
ctgggaaggccgcaagaggc

SEQ ID NO: 5890938 - DNA, 19 bp, Homo sapiens
ctgggaaggctactcacct

SEQ ID NO: 5890939 - DNA, 16 bp, Homo sapiens
ctgggaagggagaggg

SEQ ID NO: 5890940 - DNA, 12 bp, Homo sapiens
ctgggaaggggt

SEQ ID NO: 5890941 - DNA, 14 bp, Homo sapiens
ctgggaaggttcca

SEQ ID NO: 5890942 - DNA, 23 bp, Homo sapiens
ctgggaagtcgtccttactcctg

SEQ ID NO: 5890943 - DNA, 19 bp, Homo sapiens
ctgggaatacatctgtgga

SEQ ID NO: 5890944 - DNA, 21 bp, Homo sapiens
ctgggaatcaggattccttct

SEQ ID NO: 5890945 - DNA, 14 bp, Homo sapiens
ctgggaatcctgga

SEQ ID NO: 5890946 - DNA, 15 bp, Homo sapiens
ctgggaatggaataa

SEQ ID NO: 5890947 - DNA, 17 bp, Homo sapiens
ctgggaatggaataact

SEQ ID NO: 5890948 - DNA, 23 bp, Homo sapiens
ctgggaatggggacacggtgtcc

SEQ ID NO: 5890949 - DNA, 18 bp, Homo sapiens
ctgggaatgggggagaga

SEQ ID NO: 5890950 - DNA, 23 bp, Homo sapiens
ctgggaatggggtgggagccaca

SEQ ID NO: 5890951 - DNA, 24 bp, Homo sapiens
ctgggaatggggtgggagccacag

SEQ ID NO: 5890952 - DNA, 13 bp, Homo sapiens
ctgggaatgtatt

SEQ ID NO: 5890953 - DNA, 22 bp, Homo sapiens
ctgggaatgtcctgtagagaga

SEQ ID NO: 5890954 - DNA, 16 bp, Homo sapiens
ctgggacacaaaactc

SEQ ID NO: 5890955 - DNA, 21 bp, Homo sapiens
ctgggacacaaaactccgccc

SEQ ID NO: 5890956 - DNA, 12 bp, Homo sapiens
ctgggacacagt

SEQ ID NO: 5890957 - DNA, 23 bp, Homo sapiens
ctgggacacttaacagatgcaat

SEQ ID NO: 5890958 - DNA, 14 bp, Homo sapiens
ctgggacagctggc

SEQ ID NO: 5890959 - DNA, 16 bp, Homo sapiens
ctgggacagctggctg

SEQ ID NO: 5890960 - DNA, 22 bp, Homo sapiens
ctgggacagctggctgggcctt

SEQ ID NO: 5890961 - DNA, 19 bp, Homo sapiens
ctgggacaggcaccatgct

SEQ ID NO: 5890962 - DNA, 22 bp, Homo sapiens
ctgggacagtttatcatgaagc

SEQ ID NO: 5890963 - DNA, 20 bp, Homo sapiens
ctgggacatcaggagactgg

SEQ ID NO: 5890964 - DNA, 22 bp, Homo sapiens
ctgggacatgggaaaggggaag

SEQ ID NO: 5890965 - DNA, 20 bp, Homo sapiens
ctgggaccacaggcatgcac

SEQ ID NO: 5890966 - DNA, 21 bp, Homo sapiens
ctgggaccacaggtgcccgcc

SEQ ID NO: 5890967 - DNA, 14 bp, Homo sapiens
ctgggaccacgtga

SEQ ID NO: 5890968 - DNA, 13 bp, Homo sapiens
ctgggaccagagc

SEQ ID NO: 5890969 - DNA, 16 bp, Homo sapiens
ctgggaccaggctcca

SEQ ID NO: 5890970 - DNA, 16 bp, Homo sapiens
ctgggaccagggcata

SEQ ID NO: 5890971 - DNA, 19 bp, Homo sapiens
ctgggaccatggacacatt

SEQ ID NO: 5890972 - DNA, 15 bp, Homo sapiens
ctgggacccacctcc

SEQ ID NO: 5890973 - DNA, 19 bp, Homo sapiens
ctgggacccacctccccct

SEQ ID NO: 5890974 - DNA, 21 bp, Homo sapiens
ctgggacccacctccccctcc

SEQ ID NO: 5890975 - DNA, 16 bp, Homo sapiens
ctgggacccactccga

SEQ ID NO: 5890976 - DNA, 17 bp, Homo sapiens
ctgggacccagctactc

SEQ ID NO: 5890977 - DNA, 22 bp, Homo sapiens
ctgggaccccagctagggctgg

SEQ ID NO: 5890978 - DNA, 23 bp, Homo sapiens
ctgggaccccagctagggctgga

SEQ ID NO: 5890979 - DNA, 17 bp, Homo sapiens
ctgggaccccagctgct

SEQ ID NO: 5890980 - DNA, 18 bp, Homo sapiens
ctgggaccccagctgctc

SEQ ID NO: 5890981 - DNA, 19 bp, Homo sapiens
ctgggaccccagctgctct

SEQ ID NO: 5890982 - DNA, 14 bp, Homo sapiens
ctgggaccccctcg

SEQ ID NO: 5890983 - DNA, 23 bp, Homo sapiens
ctgggaccccctcgccagcttgg

SEQ ID NO: 5890984 - DNA, 16 bp, Homo sapiens
ctgggaccctcggggc

SEQ ID NO: 5890985 - DNA, 19 bp, Homo sapiens
ctgggaccctcggggcagg

SEQ ID NO: 5890986 - DNA, 18 bp, Homo sapiens
ctgggacccttaggatgg

SEQ ID NO: 5890987 - DNA, 13 bp, Homo sapiens
ctgggacccttgg

SEQ ID NO: 5890988 - DNA, 15 bp, Homo sapiens
ctgggaccctttcct

SEQ ID NO: 5890989 - DNA, 20 bp, Homo sapiens
ctgggaccctttccttcctt

SEQ ID NO: 5890990 - DNA, 23 bp, Homo sapiens
ctgggaccgctacaccactctgg

SEQ ID NO: 5890991 - DNA, 18 bp, Homo sapiens
ctgggacctaatgctggc

SEQ ID NO: 5890992 - DNA, 13 bp, Homo sapiens
ctgggacctaggg

SEQ ID NO: 5890993 - DNA, 18 bp, Homo sapiens
ctgggacctccccagccc

SEQ ID NO: 5890994 - DNA, 15 bp, Homo sapiens
ctgggacctcccctg

SEQ ID NO: 5890995 - DNA, 23 bp, Homo sapiens
ctgggacctgatttattgaaatt

SEQ ID NO: 5890996 - DNA, 17 bp, Homo sapiens
ctgggacctgccaggca

SEQ ID NO: 5890997 - DNA, 20 bp, Homo sapiens
ctgggacctgccaggcaggg

SEQ ID NO: 5890998 - DNA, 15 bp, Homo sapiens
ctgggacctgtgttc

SEQ ID NO: 5890999 - DNA, 13 bp, Homo sapiens
ctgggacctttag

SEQ ID NO: 5891000 - DNA, 15 bp, Homo sapiens
ctgggacgctctgct

SEQ ID NO: 5891001 - DNA, 19 bp, Homo sapiens
ctgggacgtggacatgcct

SEQ ID NO: 5891002 - DNA, 22 bp, Homo sapiens
ctgggacgtggacatgcctcaa

SEQ ID NO: 5891003 - DNA, 18 bp, Homo sapiens
ctgggactaaagccagga

SEQ ID NO: 5891004 - DNA, 19 bp, Homo sapiens
ctgggactaaagccaggaa

SEQ ID NO: 5891005 - DNA, 15 bp, Homo sapiens
ctgggactacaggca

SEQ ID NO: 5891006 - DNA, 17 bp, Homo sapiens
ctgggactacaggcacc

SEQ ID NO: 5891007 - DNA, 21 bp, Homo sapiens
ctgggactacaggcacccacc

SEQ ID NO: 5891008 - DNA, 17 bp, Homo sapiens
ctgggactacaggcgcc

SEQ ID NO: 5891009 - DNA, 18 bp, Homo sapiens
ctgggactacaggtgcaa

SEQ ID NO: 5891010 - DNA, 14 bp, Homo sapiens
ctgggactcagcct

SEQ ID NO: 5891011 - DNA, 18 bp, Homo sapiens
ctgggactcagccttcag

SEQ ID NO: 5891012 - DNA, 22 bp, Homo sapiens
ctgggactcagttcttggcctg

SEQ ID NO: 5891013 - DNA, 15 bp, Homo sapiens
ctgggactcattcac

SEQ ID NO: 5891014 - DNA, 13 bp, Homo sapiens
ctgggactcccag

SEQ ID NO: 5891015 - DNA, 21 bp, Homo sapiens
ctgggactcccagcagagccc

SEQ ID NO: 5891016 - DNA, 22 bp, Homo sapiens
ctgggactcccagcagagccca

SEQ ID NO: 5891017 - DNA, 15 bp, Homo sapiens
ctgggactcctggtg

SEQ ID NO: 5891018 - DNA, 17 bp, Homo sapiens
ctgggactcctggtgcc

SEQ ID NO: 5891019 - DNA, 14 bp, Homo sapiens
ctgggactcctgtc

SEQ ID NO: 5891020 - DNA, 23 bp, Homo sapiens
ctgggactcggagactatggcct

SEQ ID NO: 5891021 - DNA, 18 bp, Homo sapiens
ctgggactctcctcctcc

SEQ ID NO: 5891022 - DNA, 19 bp, Homo sapiens
ctgggactgagaaggctca

SEQ ID NO: 5891023 - DNA, 20 bp, Homo sapiens
ctgggactgagccagtccca

SEQ ID NO: 5891024 - DNA, 16 bp, Homo sapiens
ctgggactgtgcctgg

SEQ ID NO: 5891025 - DNA, 23 bp, Homo sapiens
ctgggactgtgcctggctccctg

SEQ ID NO: 5891026 - DNA, 18 bp, Homo sapiens
ctgggacttccttgctct

SEQ ID NO: 5891027 - DNA, 14 bp, Homo sapiens
ctgggacttctggg

SEQ ID NO: 5891028 - DNA, 12 bp, Homo sapiens
ctgggacttgaa

SEQ ID NO: 5891029 - DNA, 17 bp, Homo sapiens
ctgggacttgaacaaag

SEQ ID NO: 5891030 - DNA, 23 bp, Homo sapiens
ctgggacttgaacaaagacattt

SEQ ID NO: 5891031 - DNA, 18 bp, Homo sapiens
ctgggacttgcaaaaagg

SEQ ID NO: 5891032 - DNA, 21 bp, Homo sapiens
ctgggactttcccacccagga

SEQ ID NO: 5891033 - DNA, 21 bp, Homo sapiens
ctgggagaaaagccagatgac

SEQ ID NO: 5891034 - DNA, 16 bp, Homo sapiens
ctgggagaaaatcatc

SEQ ID NO: 5891035 - DNA, 18 bp, Homo sapiens
ctgggagaaaatcatcaa

SEQ ID NO: 5891036 - DNA, 13 bp, Homo sapiens
ctgggagaaatct

SEQ ID NO: 5891037 - DNA, 16 bp, Homo sapiens
ctgggagaaatgaaaa

SEQ ID NO: 5891038 - DNA, 17 bp, Homo sapiens
ctgggagaacctcaggc

SEQ ID NO: 5891039 - DNA, 13 bp, Homo sapiens
ctgggagacaaag

SEQ ID NO: 5891040 - DNA, 23 bp, Homo sapiens
ctgggagagaaggagatcagggc

SEQ ID NO: 5891041 - DNA, 21 bp, Homo sapiens
ctgggagagacttggatgagg

SEQ ID NO: 5891042 - DNA, 22 bp, Homo sapiens
ctgggagagacttggatgagga

SEQ ID NO: 5891043 - DNA, 16 bp, Homo sapiens
ctgggagagccaaggc

SEQ ID NO: 5891044 - DNA, 23 bp, Homo sapiens
ctgggagagccaaggcctatgcc

SEQ ID NO: 5891045 - DNA, 13 bp, Homo sapiens
ctgggagagccag

SEQ ID NO: 5891046 - DNA, 14 bp, Homo sapiens
ctgggagagccagc

SEQ ID NO: 5891047 - DNA, 18 bp, Homo sapiens
ctgggagagcctggcaag

SEQ ID NO: 5891048 - DNA, 20 bp, Homo sapiens
ctgggagagcctggcaaggc

SEQ ID NO: 5891049 - DNA, 19 bp, Homo sapiens
ctgggagagccttccaggg

SEQ ID NO: 5891050 - DNA, 21 bp, Homo sapiens
ctgggagaggacagggacttc

SEQ ID NO: 5891051 - DNA, 23 bp, Homo sapiens
ctgggagaggcagagtgccccac

SEQ ID NO: 5891052 - DNA, 23 bp, Homo sapiens
ctgggagaggcagcccaggaagt

SEQ ID NO: 5891053 - DNA, 12 bp, Homo sapiens
ctgggagaggtt

SEQ ID NO: 5891054 - DNA, 17 bp, Homo sapiens
ctgggagagtccttagc

SEQ ID NO: 5891055 - DNA, 19 bp, Homo sapiens
ctgggagagtccttagcct

SEQ ID NO: 5891056 - DNA, 17 bp, Homo sapiens
ctgggagagtgaggtca

SEQ ID NO: 5891057 - DNA, 15 bp, Homo sapiens
ctgggagatgcagct

SEQ ID NO: 5891058 - DNA, 16 bp, Homo sapiens
ctgggagatgcagctg

SEQ ID NO: 5891059 - DNA, 11 bp, Homo sapiens
ctgggagcaga

SEQ ID NO: 5891060 - DNA, 18 bp, Homo sapiens
ctgggcacctgcgcacag

SEQ ID NO: 5891061 - DNA, 16 bp, Homo sapiens
ctgggcacctggggag

SEQ ID NO: 5891062 - DNA, 19 bp, Homo sapiens
ctgggcacggctccgaggg

SEQ ID NO: 5891063 - DNA, 20 bp, Homo sapiens
ctgggcacggctccgagggc

SEQ ID NO: 5891064 - DNA, 16 bp, Homo sapiens
ctgggcactgctccaa

SEQ ID NO: 5891065 - DNA, 23 bp, Homo sapiens
ctgggcactgctccaagggacag

SEQ ID NO: 5891066 - DNA, 17 bp, Homo sapiens
ctgggcactgggcacta

SEQ ID NO: 5891067 - DNA, 15 bp, Homo sapiens
ctgggcactgggccg

SEQ ID NO: 5891068 - DNA, 18 bp, Homo sapiens
ctgggcactggggcctca

SEQ ID NO: 5891069 - DNA, 13 bp, Homo sapiens
ctgggcacttccc

SEQ ID NO: 5891070 - DNA, 12 bp, Homo sapiens
ctgggcagaagg

SEQ ID NO: 5891071 - DNA, 17 bp, Homo sapiens
ctgggcagaaggaagac

SEQ ID NO: 5891072 - DNA, 16 bp, Homo sapiens
ctgggcagaaggccaa

SEQ ID NO: 5891073 - DNA, 18 bp, Homo sapiens
ctgggcagaagtgagccc

SEQ ID NO: 5891074 - DNA, 14 bp, Homo sapiens
ctgggcagacaggt

SEQ ID NO: 5891075 - DNA, 18 bp, Homo sapiens
ctgggcagacaggtggga

SEQ ID NO: 5891076 - DNA, 18 bp, Homo sapiens
ctgggcagacattatgta

SEQ ID NO: 5891077 - DNA, 16 bp, Homo sapiens
ctgggcagagcctgtc

SEQ ID NO: 5891078 - DNA, 20 bp, Homo sapiens
ctgggcagaggaaagcaaag

SEQ ID NO: 5891079 - DNA, 21 bp, Homo sapiens
ctgggcagaggggagaggaag

SEQ ID NO: 5891080 - DNA, 13 bp, Homo sapiens
ctgggcagatgtc

SEQ ID NO: 5891081 - DNA, 23 bp, Homo sapiens
ctgggcagatgtcccccactgct

SEQ ID NO: 5891082 - DNA, 22 bp, Homo sapiens
ctgggcagcaaggctgctgccg

SEQ ID NO: 5891083 - DNA, 21 bp, Homo sapiens
ctgggcagcacaaggccttgc

SEQ ID NO: 5891084 - DNA, 19 bp, Homo sapiens
ctgggcagcacctccggga

SEQ ID NO: 5891085 - DNA, 17 bp, Homo sapiens
ctgggcagcatagcaag

SEQ ID NO: 5891086 - DNA, 18 bp, Homo sapiens
ctgggcagcatagcaaga

SEQ ID NO: 5891087 - DNA, 14 bp, Homo sapiens
ctgggcagcccaga

SEQ ID NO: 5891088 - DNA, 17 bp, Homo sapiens
ctgggcagcccagagag

SEQ ID NO: 5891089 - DNA, 18 bp, Homo sapiens
ctgggcagcccagagaga

SEQ ID NO: 5891090 - DNA, 14 bp, Homo sapiens
ctgggcagccccac

SEQ ID NO: 5891091 - DNA, 19 bp, Homo sapiens
ctgggcagccccagagaga

SEQ ID NO: 5891092 - DNA, 12 bp, Homo sapiens
ctgggcagcccg

SEQ ID NO: 5891093 - DNA, 20 bp, Homo sapiens
ctgggcagcccgctaggctc

SEQ ID NO: 5891094 - DNA, 16 bp, Homo sapiens
ctgggcagcctgcttt

SEQ ID NO: 5891095 - DNA, 12 bp, Homo sapiens
ctgggcagcctt

SEQ ID NO: 5891096 - DNA, 15 bp, Homo sapiens
ctgggcagccttggg

SEQ ID NO: 5891097 - DNA, 13 bp, Homo sapiens
ctgggcagctcct

SEQ ID NO: 5891098 - DNA, 17 bp, Homo sapiens
ctgggcagctcctccct

SEQ ID NO: 5891099 - DNA, 19 bp, Homo sapiens
ctgggcagctcctccctgt

SEQ ID NO: 5891100 - DNA, 15 bp, Homo sapiens
ctgggcagctgcctc

SEQ ID NO: 5891101 - DNA, 22 bp, Homo sapiens
ctgggcaggaaaccccagcggc

SEQ ID NO: 5891102 - DNA, 12 bp, Homo sapiens
ctgggcaggacc

SEQ ID NO: 5891103 - DNA, 20 bp, Homo sapiens
ctgggcaggaccctgctgac

SEQ ID NO: 5891104 - DNA, 13 bp, Homo sapiens
ctgggcaggaggg

SEQ ID NO: 5891105 - DNA, 20 bp, Homo sapiens
ctgggcaggcggtccccatc

SEQ ID NO: 5891106 - DNA, 20 bp, Homo sapiens
ctgggcagggatgatggcag

SEQ ID NO: 5891107 - DNA, 11 bp, Homo sapiens
ctgggcagggc

SEQ ID NO: 5891108 - DNA, 23 bp, Homo sapiens
ctgggcagggcagggcagcctgt

SEQ ID NO: 5891109 - DNA, 12 bp, Homo sapiens
ctgggcagggcc

SEQ ID NO: 5891110 - DNA, 13 bp, Homo sapiens
ctgggcagggccc

SEQ ID NO: 5891111 - DNA, 12 bp, Homo sapiens
ctgggcagggtg

SEQ ID NO: 5891112 - DNA, 19 bp, Homo sapiens
ctgggcaggtcctggggag

SEQ ID NO: 5891113 - DNA, 23 bp, Homo sapiens
ctgggcaggtctcctctgggagg

SEQ ID NO: 5891114 - DNA, 12 bp, Homo sapiens
ctgggcaggtgg

SEQ ID NO: 5891115 - DNA, 13 bp, Homo sapiens
ctgggcaggtggg

SEQ ID NO: 5891116 - DNA, 15 bp, Homo sapiens
ctgggcaggtgggag

SEQ ID NO: 5891117 - DNA, 19 bp, Homo sapiens
ctgggcaggtgggagctga

SEQ ID NO: 5891118 - DNA, 13 bp, Homo sapiens
ctgggcaggttcc

SEQ ID NO: 5891119 - DNA, 16 bp, Homo sapiens
ctgggcaggttcctgg

SEQ ID NO: 5891120 - DNA, 18 bp, Homo sapiens
ctgggcagtgccacagcc

SEQ ID NO: 5891121 - DNA, 19 bp, Homo sapiens
ctgggcagtgccacagcct

SEQ ID NO: 5891122 - DNA, 23 bp, Homo sapiens
ctgggcagtgccacagcctgctg

SEQ ID NO: 5891123 - DNA, 19 bp, Homo sapiens
ctgggcagtgtggcctctt

SEQ ID NO: 5891124 - DNA, 23 bp, Homo sapiens
ctgggcatagatgcaggtgagcc

SEQ ID NO: 5891125 - DNA, 16 bp, Homo sapiens
ctgggcatccccagcc

SEQ ID NO: 5891126 - DNA, 16 bp, Homo sapiens
ctgggcatcttctggc

SEQ ID NO: 5891127 - DNA, 16 bp, Homo sapiens
ctgggcatgacatcct

SEQ ID NO: 5891128 - DNA, 18 bp, Homo sapiens
ctgggcatggcagggcca

SEQ ID NO: 5891129 - DNA, 23 bp, Homo sapiens
ctgggcatggcagggccaggcct

SEQ ID NO: 5891130 - DNA, 18 bp, Homo sapiens
ctgggcatgggtccaggg

SEQ ID NO: 5891131 - DNA, 11 bp, Homo sapiens
ctgggcatggt

SEQ ID NO: 5891132 - DNA, 21 bp, Homo sapiens
ctgggcatggtaccagccctg

SEQ ID NO: 5891133 - DNA, 16 bp, Homo sapiens
ctgggcattagcaagg

SEQ ID NO: 5891134 - DNA, 19 bp, Homo sapiens
ctgggcattagcaaggcag

SEQ ID NO: 5891135 - DNA, 13 bp, Homo sapiens
ctgggcattgctt

SEQ ID NO: 5891136 - DNA, 17 bp, Homo sapiens
ctgggcattgctttcca

SEQ ID NO: 5891137 - DNA, 14 bp, Homo sapiens
ctgggcatttcaat

SEQ ID NO: 5891138 - DNA, 22 bp, Homo sapiens
ctgggcatttcacgaactgttc

SEQ ID NO: 5891139 - DNA, 19 bp, Homo sapiens
ctgggcattttcctcctct

SEQ ID NO: 5891140 - DNA, 20 bp, Homo sapiens
ctgggcattttcctcctctg

SEQ ID NO: 5891141 - DNA, 17 bp, Homo sapiens
ctgggccaaaagggcag

SEQ ID NO: 5891142 - DNA, 15 bp, Homo sapiens
ctgggccaagttcct

SEQ ID NO: 5891143 - DNA, 20 bp, Homo sapiens
ctgggccaagttcctctagt

SEQ ID NO: 5891144 - DNA, 21 bp, Homo sapiens
ctgggccaagttcctctagtg

SEQ ID NO: 5891145 - DNA, 21 bp, Homo sapiens
ctgggccacacctgagcgctg

SEQ ID NO: 5891146 - DNA, 17 bp, Homo sapiens
ctgggccaccagggatc

SEQ ID NO: 5891147 - DNA, 12 bp, Homo sapiens
ctgggccaccct

SEQ ID NO: 5891148 - DNA, 13 bp, Homo sapiens
ctgggccaccctt

SEQ ID NO: 5891149 - DNA, 14 bp, Homo sapiens
ctgggccacccttc

SEQ ID NO: 5891150 - DNA, 13 bp, Homo sapiens
ctgggccacctcc

SEQ ID NO: 5891151 - DNA, 14 bp, Homo sapiens
ctgggccacctcct

SEQ ID NO: 5891152 - DNA, 17 bp, Homo sapiens
ctgggccacctcctacc

SEQ ID NO: 5891153 - DNA, 22 bp, Homo sapiens
ctgggccacggaggagggatgc

SEQ ID NO: 5891154 - DNA, 19 bp, Homo sapiens
ctgggccactcctcttcac

SEQ ID NO: 5891155 - DNA, 12 bp, Homo sapiens
ctgggccactgg

SEQ ID NO: 5891156 - DNA, 18 bp, Homo sapiens
ctgggccactggcatctc

SEQ ID NO: 5891157 - DNA, 17 bp, Homo sapiens
ctgggccactggggact

SEQ ID NO: 5891158 - DNA, 14 bp, Homo sapiens
ctgggccagaattt

SEQ ID NO: 5891159 - DNA, 13 bp, Homo sapiens
ctgggccagagta

SEQ ID NO: 5891160 - DNA, 14 bp, Homo sapiens
ctgggccagatgct

SEQ ID NO: 5891161 - DNA, 14 bp, Homo sapiens
ctgggccagcagag

SEQ ID NO: 5891162 - DNA, 15 bp, Homo sapiens
ctgggccagcagagc

SEQ ID NO: 5891163 - DNA, 16 bp, Homo sapiens
ctgggccagcagagca

SEQ ID NO: 5891164 - DNA, 14 bp, Homo sapiens
ctgggccagccctg

SEQ ID NO: 5891165 - DNA, 18 bp, Homo sapiens
ctgggccagccctgcagc

SEQ ID NO: 5891166 - DNA, 19 bp, Homo sapiens
ctgggccagccctgcagcc

SEQ ID NO: 5891167 - DNA, 13 bp, Homo sapiens
ctgggccagcctc

SEQ ID NO: 5891168 - DNA, 17 bp, Homo sapiens
ctgggccagcctcagct

SEQ ID NO: 5891169 - DNA, 22 bp, Homo sapiens
ctgggccagcctcagctcagcc

SEQ ID NO: 5891170 - DNA, 23 bp, Homo sapiens
ctgggccagcctcagctcagcct

SEQ ID NO: 5891171 - DNA, 21 bp, Homo sapiens
ctgggccaggaggtagtttct

SEQ ID NO: 5891172 - DNA, 13 bp, Homo sapiens
ctgggccagggcg

SEQ ID NO: 5891173 - DNA, 13 bp, Homo sapiens
ctgggccagggtc

SEQ ID NO: 5891174 - DNA, 14 bp, Homo sapiens
ctgggccagggtct

SEQ ID NO: 5891175 - DNA, 21 bp, Homo sapiens
ctgggccagggtctcgtcagg

SEQ ID NO: 5891176 - DNA, 17 bp, Homo sapiens
ctgggccagggtctgtg

SEQ ID NO: 5891177 - DNA, 11 bp, Homo sapiens
ctgggccaggt

SEQ ID NO: 5891178 - DNA, 15 bp, Homo sapiens
ctgggccaggtctcc

SEQ ID NO: 5891179 - DNA, 18 bp, Homo sapiens
ctgggccagtggacccgc

SEQ ID NO: 5891180 - DNA, 23 bp, Homo sapiens
ctgggccatagtcattctgcctg

SEQ ID NO: 5891181 - DNA, 19 bp, Homo sapiens
ctgggccatgttgtgcctc

SEQ ID NO: 5891182 - DNA, 20 bp, Homo sapiens
ctgggccattctccacagca

SEQ ID NO: 5891183 - DNA, 21 bp, Homo sapiens
ctgggccattctccacagcaa

SEQ ID NO: 5891184 - DNA, 23 bp, Homo sapiens
ctgggcccaaaggcccagggagg

SEQ ID NO: 5891185 - DNA, 24 bp, Homo sapiens
ctgggcccaaaggcccagggaggc

SEQ ID NO: 5891186 - DNA, 19 bp, Homo sapiens
ctgggcccaaccctgtctg

SEQ ID NO: 5891187 - DNA, 17 bp, Homo sapiens
ctgggcccacaaaggca

SEQ ID NO: 5891188 - DNA, 18 bp, Homo sapiens
ctgggcccacagagatgc

SEQ ID NO: 5891189 - DNA, 20 bp, Homo sapiens
ctgggcccacagagatgcat

SEQ ID NO: 5891190 - DNA, 15 bp, Homo sapiens
ctgggcccacagagc

SEQ ID NO: 5891191 - DNA, 17 bp, Homo sapiens
ctgggcccacagagcct

SEQ ID NO: 5891192 - DNA, 21 bp, Homo sapiens
ctgggcccacagagcctggct

SEQ ID NO: 5891193 - DNA, 12 bp, Homo sapiens
ctgggcccagag

SEQ ID NO: 5891194 - DNA, 13 bp, Homo sapiens
ctgggcccagagg

SEQ ID NO: 5891195 - DNA, 14 bp, Homo sapiens
ctgggcccagagga

SEQ ID NO: 5891196 - DNA, 19 bp, Homo sapiens
ctgggcccagaggagagga

SEQ ID NO: 5891197 - DNA, 19 bp, Homo sapiens
ctgggcccagaggcacagc

SEQ ID NO: 5891198 - DNA, 21 bp, Homo sapiens
ctgggcccagaggcacagccg

SEQ ID NO: 5891199 - DNA, 12 bp, Homo sapiens
ctgggcccagcc

SEQ ID NO: 5891200 - DNA, 13 bp, Homo sapiens
ctgggcccagccg

SEQ ID NO: 5891201 - DNA, 12 bp, Homo sapiens
ctgggcccaggc

SEQ ID NO: 5891202 - DNA, 14 bp, Homo sapiens
ctgggcccaggcag

SEQ ID NO: 5891203 - DNA, 16 bp, Homo sapiens
ctgggcccaggcaggt

SEQ ID NO: 5891204 - DNA, 21 bp, Homo sapiens
ctgggcccaggctctgggaag

SEQ ID NO: 5891205 - DNA, 14 bp, Homo sapiens
ctgggcccatctcc

SEQ ID NO: 5891206 - DNA, 17 bp, Homo sapiens
ctgggcccatctccctg

SEQ ID NO: 5891207 - DNA, 18 bp, Homo sapiens
ctgggcccatctccctgc

SEQ ID NO: 5891208 - DNA, 13 bp, Homo sapiens
ctgggccccacca

SEQ ID NO: 5891209 - DNA, 14 bp, Homo sapiens
ctgggccccaccta

SEQ ID NO: 5891210 - DNA, 15 bp, Homo sapiens
ctgggccccacctac

SEQ ID NO: 5891211 - DNA, 16 bp, Homo sapiens
ctgggccccacctact

SEQ ID NO: 5891212 - DNA, 12 bp, Homo sapiens
ctgggccccact

SEQ ID NO: 5891213 - DNA, 14 bp, Homo sapiens
ctgggccccactgg

SEQ ID NO: 5891214 - DNA, 15 bp, Homo sapiens
ctgggccccactgga

SEQ ID NO: 5891215 - DNA, 12 bp, Homo sapiens
ctgggccccagc

SEQ ID NO: 5891216 - DNA, 16 bp, Homo sapiens
ctgggccccagcccac

SEQ ID NO: 5891217 - DNA, 19 bp, Homo sapiens
ctgggccccagcccaccct

SEQ ID NO: 5891218 - DNA, 14 bp, Homo sapiens
ctgggccccatgct

SEQ ID NO: 5891219 - DNA, 22 bp, Homo sapiens
ctgggccccatgctctgcccca

SEQ ID NO: 5891220 - DNA, 19 bp, Homo sapiens
ctgggccccattctccctc

SEQ ID NO: 5891221 - DNA, 22 bp, Homo sapiens
ctgggcccccactttcaccagt

SEQ ID NO: 5891222 - DNA, 14 bp, Homo sapiens
ctgggcccccagag

SEQ ID NO: 5891223 - DNA, 15 bp, Homo sapiens
ctgggcccccagaga

SEQ ID NO: 5891224 - DNA, 23 bp, Homo sapiens
ctgggccccgacgtttgcggcag

SEQ ID NO: 5891225 - DNA, 17 bp, Homo sapiens
ctgggccccgcctcaag

SEQ ID NO: 5891226 - DNA, 22 bp, Homo sapiens
ctgggcccctcaggggaagctg

SEQ ID NO: 5891227 - DNA, 14 bp, Homo sapiens
ctgggcccctccac

SEQ ID NO: 5891228 - DNA, 17 bp, Homo sapiens
ctgggcccctccacgcc

SEQ ID NO: 5891229 - DNA, 20 bp, Homo sapiens
ctgggcccctccacgcctcc

SEQ ID NO: 5891230 - DNA, 21 bp, Homo sapiens
ctgggcccctccacgcctcct

SEQ ID NO: 5891231 - DNA, 17 bp, Homo sapiens
ctgggcccctccaggag

SEQ ID NO: 5891232 - DNA, 15 bp, Homo sapiens
ctgggcccctcccct

SEQ ID NO: 5891233 - DNA, 18 bp, Homo sapiens
ctgggcccctcccctcag

SEQ ID NO: 5891234 - DNA, 19 bp, Homo sapiens
ctgggcccctccctacctc

SEQ ID NO: 5891235 - DNA, 20 bp, Homo sapiens
ctgggcccctccctacctca

SEQ ID NO: 5891236 - DNA, 12 bp, Homo sapiens
ctgggcccctgc

SEQ ID NO: 5891237 - DNA, 16 bp, Homo sapiens
ctgggcccctgcacag

SEQ ID NO: 5891238 - DNA, 17 bp, Homo sapiens
ctgggcccctgggatgg

SEQ ID NO: 5891239 - DNA, 15 bp, Homo sapiens
ctgggcccctgggga

SEQ ID NO: 5891240 - DNA, 16 bp, Homo sapiens
ctgggctccccccagt

SEQ ID NO: 5891241 - DNA, 15 bp, Homo sapiens
ctgggctccctgatg

SEQ ID NO: 5891242 - DNA, 21 bp, Homo sapiens
ctgggctccctggaggactct

SEQ ID NO: 5891243 - DNA, 21 bp, Homo sapiens
ctgggctcccttcccacctct

SEQ ID NO: 5891244 - DNA, 21 bp, Homo sapiens
ctgggctccctttaagccaag

SEQ ID NO: 5891245 - DNA, 14 bp, Homo sapiens
ctgggctcctccag

SEQ ID NO: 5891246 - DNA, 15 bp, Homo sapiens
ctgggctcctccagg

SEQ ID NO: 5891247 - DNA, 16 bp, Homo sapiens
ctgggctcctctgcat

SEQ ID NO: 5891248 - DNA, 15 bp, Homo sapiens
ctgggctcctcttag

SEQ ID NO: 5891249 - DNA, 15 bp, Homo sapiens
ctgggctcctggacc

SEQ ID NO: 5891250 - DNA, 13 bp, Homo sapiens
ctgggctcggagg

SEQ ID NO: 5891251 - DNA, 15 bp, Homo sapiens
ctgggctcggaggct

SEQ ID NO: 5891252 - DNA, 17 bp, Homo sapiens
ctgggctcggaggctgc

SEQ ID NO: 5891253 - DNA, 18 bp, Homo sapiens
ctgggctcggaggctgcc

SEQ ID NO: 5891254 - DNA, 15 bp, Homo sapiens
ctgggctctcaccca

SEQ ID NO: 5891255 - DNA, 12 bp, Homo sapiens
ctgggctctcca

SEQ ID NO: 5891256 - DNA, 17 bp, Homo sapiens
ctgggctctccacctca

SEQ ID NO: 5891257 - DNA, 18 bp, Homo sapiens
ctgggctctccacctcag

SEQ ID NO: 5891258 - DNA, 20 bp, Homo sapiens
ctgggctctccacctcagcc

SEQ ID NO: 5891259 - DNA, 23 bp, Homo sapiens
ctgggctctccctgcacgcattt

SEQ ID NO: 5891260 - DNA, 19 bp, Homo sapiens
ctgggctctcgcggcctct

SEQ ID NO: 5891261 - DNA, 13 bp, Homo sapiens
ctgggctctgagt

SEQ ID NO: 5891262 - DNA, 13 bp, Homo sapiens
ctgggctctgcca

SEQ ID NO: 5891263 - DNA, 14 bp, Homo sapiens
ctgggctctgccac

SEQ ID NO: 5891264 - DNA, 17 bp, Homo sapiens
ctgggctctgccaccct

SEQ ID NO: 5891265 - DNA, 13 bp, Homo sapiens
ctgggctctggaa

SEQ ID NO: 5891266 - DNA, 14 bp, Homo sapiens
ctgggctctggact

SEQ ID NO: 5891267 - DNA, 15 bp, Homo sapiens
ctgggctctggactc

SEQ ID NO: 5891268 - DNA, 18 bp, Homo sapiens
ctgggctctggactccac

SEQ ID NO: 5891269 - DNA, 15 bp, Homo sapiens
ctgggctctggtggg

SEQ ID NO: 5891270 - DNA, 18 bp, Homo sapiens
ctgggctctggtgggggc

SEQ ID NO: 5891271 - DNA, 14 bp, Homo sapiens
ctgggctctggttt

SEQ ID NO: 5891272 - DNA, 13 bp, Homo sapiens
ctgggctctgtgg

SEQ ID NO: 5891273 - DNA, 14 bp, Homo sapiens
ctgggctgagcccc

SEQ ID NO: 5891274 - DNA, 20 bp, Homo sapiens
ctgggctgagcctactgtct

SEQ ID NO: 5891275 - DNA, 22 bp, Homo sapiens
ctgggctgagcctactgtctcc

SEQ ID NO: 5891276 - DNA, 18 bp, Homo sapiens
ctgggctgagggagcctg

SEQ ID NO: 5891277 - DNA, 20 bp, Homo sapiens
ctgggctgcccacctggctg

SEQ ID NO: 5891278 - DNA, 16 bp, Homo sapiens
ctgggctgctcctgaa

SEQ ID NO: 5891279 - DNA, 17 bp, Homo sapiens
ctgggctgctggggcag

SEQ ID NO: 5891280 - DNA, 17 bp, Homo sapiens
ctgggctggaacgtgaa

SEQ ID NO: 5891281 - DNA, 13 bp, Homo sapiens
ctgggctggactg

SEQ ID NO: 5891282 - DNA, 17 bp, Homo sapiens
ctgggctggactggcca

SEQ ID NO: 5891283 - DNA, 20 bp, Homo sapiens
ctgggctggatgagctccca

SEQ ID NO: 5891284 - DNA, 12 bp, Homo sapiens
ctgggctggcac

SEQ ID NO: 5891285 - DNA, 19 bp, Homo sapiens
ctgggctggcacagcccct

SEQ ID NO: 5891286 - DNA, 18 bp, Homo sapiens
ctgggctggcatggggag

SEQ ID NO: 5891287 - DNA, 13 bp, Homo sapiens
ctgggctggctgc

SEQ ID NO: 5891288 - DNA, 12 bp, Homo sapiens
ctgggctgggca

SEQ ID NO: 5891289 - DNA, 13 bp, Homo sapiens
ctgggctgggcac

SEQ ID NO: 5891290 - DNA, 14 bp, Homo sapiens
ctgggctgggcagc

SEQ ID NO: 5891291 - DNA, 17 bp, Homo sapiens
ctgggctgggcagcctt

SEQ ID NO: 5891292 - DNA, 21 bp, Homo sapiens
ctgggctgggccctctttccc

SEQ ID NO: 5891293 - DNA, 20 bp, Homo sapiens
ctgggctgggcccttcctgg

SEQ ID NO: 5891294 - DNA, 12 bp, Homo sapiens
ctgggctgggct

SEQ ID NO: 5891295 - DNA, 15 bp, Homo sapiens
ctgggctgggctgag

SEQ ID NO: 5891296 - DNA, 14 bp, Homo sapiens
ctgggctgggctgg

SEQ ID NO: 5891297 - DNA, 18 bp, Homo sapiens
ctgggctgggctgggctg

SEQ ID NO: 5891298 - DNA, 19 bp, Homo sapiens
ctgggctgggctgggctga

SEQ ID NO: 5891299 - DNA, 12 bp, Homo sapiens
ctgggctggggc

SEQ ID NO: 5891300 - DNA, 17 bp, Homo sapiens
ctgggctggggccacct

SEQ ID NO: 5891301 - DNA, 18 bp, Homo sapiens
ctgggctggggcctcaga

SEQ ID NO: 5891302 - DNA, 19 bp, Homo sapiens
ctgggctgggtgctgggaa

SEQ ID NO: 5891303 - DNA, 13 bp, Homo sapiens
ctgggctgggttt

SEQ ID NO: 5891304 - DNA, 19 bp, Homo sapiens
ctgggctgggtttgctgtc

SEQ ID NO: 5891305 - DNA, 22 bp, Homo sapiens
ctgggctgtaacgtggcactgg

SEQ ID NO: 5891306 - DNA, 16 bp, Homo sapiens
ctgggctgtccagcct

SEQ ID NO: 5891307 - DNA, 14 bp, Homo sapiens
ctgggctgtctctc

SEQ ID NO: 5891308 - DNA, 13 bp, Homo sapiens
ctgggctgtgagg

SEQ ID NO: 5891309 - DNA, 15 bp, Homo sapiens
ctgggctgtgcctga

SEQ ID NO: 5891310 - DNA, 13 bp, Homo sapiens
ctgggctgtgctg

SEQ ID NO: 5891311 - DNA, 13 bp, Homo sapiens
ctgggctgtgggg

SEQ ID NO: 5891312 - DNA, 14 bp, Homo sapiens
ctgggctgttggca

SEQ ID NO: 5891313 - DNA, 15 bp, Homo sapiens
ctgggctgttggctg

SEQ ID NO: 5891314 - DNA, 21 bp, Homo sapiens
ctgggctgttgtgtctggagc

SEQ ID NO: 5891315 - DNA, 13 bp, Homo sapiens
ctgggcttaagtt

SEQ ID NO: 5891316 - DNA, 17 bp, Homo sapiens
ctgggcttagggtcctg

SEQ ID NO: 5891317 - DNA, 18 bp, Homo sapiens
ctgggcttcagtggcagc

SEQ ID NO: 5891318 - DNA, 21 bp, Homo sapiens
ctgggcttcagtggcagctgc

SEQ ID NO: 5891319 - DNA, 22 bp, Homo sapiens
ctgggcttcagtggcagctgct

SEQ ID NO: 5891320 - DNA, 23 bp, Homo sapiens
ctgggcttcagtggcagctgctt

SEQ ID NO: 5891321 - DNA, 21 bp, Homo sapiens
ctgggcttcattccggactgg

SEQ ID NO: 5891322 - DNA, 15 bp, Homo sapiens
ctgggcttccacagt

SEQ ID NO: 5891323 - DNA, 22 bp, Homo sapiens
ctgggcttcctggagcagaagc

SEQ ID NO: 5891324 - DNA, 19 bp, Homo sapiens
ctgggcttggcctggagag

SEQ ID NO: 5891325 - DNA, 22 bp, Homo sapiens
ctgggcttggctcggcgccccc

SEQ ID NO: 5891326 - DNA, 15 bp, Homo sapiens
ctgggcttggctctt

SEQ ID NO: 5891327 - DNA, 21 bp, Homo sapiens
ctgggcttggctcttggcttc

SEQ ID NO: 5891328 - DNA, 17 bp, Homo sapiens
ctgggcttggggaccag

SEQ ID NO: 5891329 - DNA, 19 bp, Homo sapiens
ctgggcttggggcttccta

SEQ ID NO: 5891330 - DNA, 19 bp, Homo sapiens
ctgggcttggtaagtgaat

SEQ ID NO: 5891331 - DNA, 12 bp, Homo sapiens
ctgggctttctc

SEQ ID NO: 5891332 - DNA, 17 bp, Homo sapiens
ctgggctttctcctgga

SEQ ID NO: 5891333 - DNA, 21 bp, Homo sapiens
ctgggctttgattccatctcc

SEQ ID NO: 5891334 - DNA, 14 bp, Homo sapiens
ctgggctttgggaa

SEQ ID NO: 5891335 - DNA, 17 bp, Homo sapiens
ctgggctttggggctgg

SEQ ID NO: 5891336 - DNA, 23 bp, Homo sapiens
ctgggctttttttttctctttct

SEQ ID NO: 5891337 - DNA, 20 bp, Homo sapiens
ctggggaaacaacatttata

SEQ ID NO: 5891338 - DNA, 19 bp, Homo sapiens
ctggggaaactggccatgg

SEQ ID NO: 5891339 - DNA, 23 bp, Homo sapiens
ctggggaaaggggacaaggaagg

SEQ ID NO: 5891340 - DNA, 19 bp, Homo sapiens
ctggggaaataacagctgt

SEQ ID NO: 5891341 - DNA, 22 bp, Homo sapiens
ctggggaacagagcgggcctct

SEQ ID NO: 5891342 - DNA, 15 bp, Homo sapiens
ctggggaacctgacc

SEQ ID NO: 5891343 - DNA, 16 bp, Homo sapiens
ctggggaacctgaccc

SEQ ID NO: 5891344 - DNA, 17 bp, Homo sapiens
ctggggaacctgacccc

SEQ ID NO: 5891345 - DNA, 15 bp, Homo sapiens
ctggggaagaacagc

SEQ ID NO: 5891346 - DNA, 17 bp, Homo sapiens
ctggggaagaacagccc

SEQ ID NO: 5891347 - DNA, 18 bp, Homo sapiens
ctggggaagacagtggcc

SEQ ID NO: 5891348 - DNA, 13 bp, Homo sapiens
ctggggaaggaag

SEQ ID NO: 5891349 - DNA, 14 bp, Homo sapiens
ctggggaaggacca

SEQ ID NO: 5891350 - DNA, 15 bp, Homo sapiens
ctggggaaggaccaa

SEQ ID NO: 5891351 - DNA, 12 bp, Homo sapiens
ctggggaaggag

SEQ ID NO: 5891352 - DNA, 17 bp, Homo sapiens
ctggggaaggagccagt

SEQ ID NO: 5891353 - DNA, 23 bp, Homo sapiens
ctggggacacacattctgccttg

SEQ ID NO: 5891354 - DNA, 23 bp, Homo sapiens
ctggggacacaggatcctggcct

SEQ ID NO: 5891355 - DNA, 13 bp, Homo sapiens
ctggggacagagc

SEQ ID NO: 5891356 - DNA, 14 bp, Homo sapiens
ctggggacagagcc

SEQ ID NO: 5891357 - DNA, 18 bp, Homo sapiens
ctggggacagagccaccc

SEQ ID NO: 5891358 - DNA, 14 bp, Homo sapiens
ctggggacagaggg

SEQ ID NO: 5891359 - DNA, 14 bp, Homo sapiens
ctggggacagcttc

SEQ ID NO: 5891360 - DNA, 16 bp, Homo sapiens
ctggggacagcttcct

SEQ ID NO: 5891361 - DNA, 12 bp, Homo sapiens
ctggggacaggt

SEQ ID NO: 5891362 - DNA, 16 bp, Homo sapiens
ctggggaccaggagct

SEQ ID NO: 5891363 - DNA, 11 bp, Homo sapiens
ctggggaccat

SEQ ID NO: 5891364 - DNA, 17 bp, Homo sapiens
ctggggaccatgtgatt

SEQ ID NO: 5891365 - DNA, 13 bp, Homo sapiens
ctggggacccaga

SEQ ID NO: 5891366 - DNA, 20 bp, Homo sapiens
ctggggaccccaacctcaga

SEQ ID NO: 5891367 - DNA, 22 bp, Homo sapiens
ctggggacccgctgggggctgg

SEQ ID NO: 5891368 - DNA, 20 bp, Homo sapiens
ctggggacctggtaccctcc

SEQ ID NO: 5891369 - DNA, 19 bp, Homo sapiens
ctggggacgccaaggaggt

SEQ ID NO: 5891370 - DNA, 19 bp, Homo sapiens
ctggggacgctccgctgcc

SEQ ID NO: 5891371 - DNA, 15 bp, Homo sapiens
ctggggacggagcac

SEQ ID NO: 5891372 - DNA, 17 bp, Homo sapiens
ctggggacggagcactg

SEQ ID NO: 5891373 - DNA, 19 bp, Homo sapiens
ctggggacgttgctgagcc

SEQ ID NO: 5891374 - DNA, 24 bp, Homo sapiens
ctggggacgttgctgagccagctg

SEQ ID NO: 5891375 - DNA, 17 bp, Homo sapiens
ctggggactcagggacc

SEQ ID NO: 5891376 - DNA, 19 bp, Homo sapiens
ctggggactctgcttggct

SEQ ID NO: 5891377 - DNA, 13 bp, Homo sapiens
ctggggactctgg

SEQ ID NO: 5891378 - DNA, 17 bp, Homo sapiens
ctggggactctggcaca

SEQ ID NO: 5891379 - DNA, 17 bp, Homo sapiens
ctggggactgcattgga

SEQ ID NO: 5891380 - DNA, 20 bp, Homo sapiens
ctggggactgctacctctga

SEQ ID NO: 5891381 - DNA, 21 bp, Homo sapiens
ctggggacttcaactgcccag

SEQ ID NO: 5891382 - DNA, 18 bp, Homo sapiens
ctggggacttggcctctc

SEQ ID NO: 5891383 - DNA, 19 bp, Homo sapiens
ctggggacttggcctctct

SEQ ID NO: 5891384 - DNA, 17 bp, Homo sapiens
ctggggacttgtgtctg

SEQ ID NO: 5891385 - DNA, 20 bp, Homo sapiens
ctggggagaaataattgttg

SEQ ID NO: 5891386 - DNA, 19 bp, Homo sapiens
ctggggagaacccttcctg

SEQ ID NO: 5891387 - DNA, 23 bp, Homo sapiens
ctggggagaatggggctgggccc

SEQ ID NO: 5891388 - DNA, 19 bp, Homo sapiens
ctggggagagcggctggag

SEQ ID NO: 5891389 - DNA, 22 bp, Homo sapiens
ctggggagataaaaagattaag

SEQ ID NO: 5891390 - DNA, 20 bp, Homo sapiens
ctggggagatgggggcttct

SEQ ID NO: 5891391 - DNA, 23 bp, Homo sapiens
ctggggagcacaggtgtctgcct

SEQ ID NO: 5891392 - DNA, 15 bp, Homo sapiens
ctggggagcaggcag

SEQ ID NO: 5891393 - DNA, 17 bp, Homo sapiens
ctggggagcaggcagcc

SEQ ID NO: 5891394 - DNA, 15 bp, Homo sapiens
ctggggagcccactg

SEQ ID NO: 5891395 - DNA, 23 bp, Homo sapiens
ctggggagcccactgaggggcca

SEQ ID NO: 5891396 - DNA, 15 bp, Homo sapiens
ctggggagcccgtct

SEQ ID NO: 5891397 - DNA, 21 bp, Homo sapiens
ctggggagccctattgctgct

SEQ ID NO: 5891398 - DNA, 14 bp, Homo sapiens
ctggggagccctca

SEQ ID NO: 5891399 - DNA, 14 bp, Homo sapiens
ctggggagcgggtc

SEQ ID NO: 5891400 - DNA, 12 bp, Homo sapiens
ctggggagctcc

SEQ ID NO: 5891401 - DNA, 14 bp, Homo sapiens
ctggggagctcctg

SEQ ID NO: 5891402 - DNA, 15 bp, Homo sapiens
ctggggagctcctgg

SEQ ID NO: 5891403 - DNA, 16 bp, Homo sapiens
ctggggagctcctggg

SEQ ID NO: 5891404 - DNA, 15 bp, Homo sapiens
ctggggaggaagggc

SEQ ID NO: 5891405 - DNA, 17 bp, Homo sapiens
ctggggaggaagggcca

SEQ ID NO: 5891406 - DNA, 19 bp, Homo sapiens
ctggggaggaagggccagg

SEQ ID NO: 5891407 - DNA, 20 bp, Homo sapiens
ctggggaggaagggccagga

SEQ ID NO: 5891408 - DNA, 22 bp, Homo sapiens
ctggggaggaagggccaggaga

SEQ ID NO: 5891409 - DNA, 16 bp, Homo sapiens
ctggggaggaccaggg

SEQ ID NO: 5891410 - DNA, 14 bp, Homo sapiens
ctggggaggacccc

SEQ ID NO: 5891411 - DNA, 17 bp, Homo sapiens
ctggggaggacccctgc

SEQ ID NO: 5891412 - DNA, 19 bp, Homo sapiens
ctggggaggacccctgccc

SEQ ID NO: 5891413 - DNA, 16 bp, Homo sapiens
ctggggaggaggagag

SEQ ID NO: 5891414 - DNA, 20 bp, Homo sapiens
ctggggaggaggagagagtc

SEQ ID NO: 5891415 - DNA, 12 bp, Homo sapiens
ctggggaggcag

SEQ ID NO: 5891416 - DNA, 22 bp, Homo sapiens
ctggggaggctgagactgcaga

SEQ ID NO: 5891417 - DNA, 19 bp, Homo sapiens
ctggggaggctgaggcagg

SEQ ID NO: 5891418 - DNA, 19 bp, Homo sapiens
ctggggagggacacagagg

SEQ ID NO: 5891419 - DNA, 20 bp, Homo sapiens
ctgggggaggcttccagctc

SEQ ID NO: 5891420 - DNA, 22 bp, Homo sapiens
ctgggggaggcttccagctcag

SEQ ID NO: 5891421 - DNA, 15 bp, Homo sapiens
ctgggggagggactg

SEQ ID NO: 5891422 - DNA, 16 bp, Homo sapiens
ctgggggataccagct

SEQ ID NO: 5891423 - DNA, 16 bp, Homo sapiens
ctgggggatgggcctg

SEQ ID NO: 5891424 - DNA, 23 bp, Homo sapiens
ctgggggattcctgagctggcct

SEQ ID NO: 5891425 - DNA, 16 bp, Homo sapiens
ctgggggattgaggtg

SEQ ID NO: 5891426 - DNA, 15 bp, Homo sapiens
ctgggggcacagctg

SEQ ID NO: 5891427 - DNA, 13 bp, Homo sapiens
ctgggggcacagg

SEQ ID NO: 5891428 - DNA, 21 bp, Homo sapiens
ctgggggcagaactcctacct

SEQ ID NO: 5891429 - DNA, 12 bp, Homo sapiens
ctgggggcagct

SEQ ID NO: 5891430 - DNA, 15 bp, Homo sapiens
ctgggggcagctgtc

SEQ ID NO: 5891431 - DNA, 20 bp, Homo sapiens
ctgggggcagtgactggcag

SEQ ID NO: 5891432 - DNA, 23 bp, Homo sapiens
ctgggggcatgggggaggctctg

SEQ ID NO: 5891433 - DNA, 23 bp, Homo sapiens
ctgggggccagctggtgctgcaa

SEQ ID NO: 5891434 - DNA, 19 bp, Homo sapiens
ctgggggccagggctggat

SEQ ID NO: 5891435 - DNA, 14 bp, Homo sapiens
ctgggggccatgag

SEQ ID NO: 5891436 - DNA, 21 bp, Homo sapiens
ctgggggcccgacaggtgggc

SEQ ID NO: 5891437 - DNA, 12 bp, Homo sapiens
ctgggggcctca

SEQ ID NO: 5891438 - DNA, 13 bp, Homo sapiens
ctgggggcctcac

SEQ ID NO: 5891439 - DNA, 16 bp, Homo sapiens
ctgggggcctcactcc

SEQ ID NO: 5891440 - DNA, 18 bp, Homo sapiens
ctgggggcctcagtgcca

SEQ ID NO: 5891441 - DNA, 22 bp, Homo sapiens
ctgggggcctgacctccccctc

SEQ ID NO: 5891442 - DNA, 13 bp, Homo sapiens
ctgggggcctggc

SEQ ID NO: 5891443 - DNA, 17 bp, Homo sapiens
ctgggggcctggctggc

SEQ ID NO: 5891444 - DNA, 22 bp, Homo sapiens
ctgggggcgggactcctccctg

SEQ ID NO: 5891445 - DNA, 23 bp, Homo sapiens
ctgggggcgggactcctccctgg

SEQ ID NO: 5891446 - DNA, 15 bp, Homo sapiens
ctgggggcggggcct

SEQ ID NO: 5891447 - DNA, 16 bp, Homo sapiens
ctgggggcggggcctg

SEQ ID NO: 5891448 - DNA, 15 bp, Homo sapiens
ctgggggctcccctt

SEQ ID NO: 5891449 - DNA, 18 bp, Homo sapiens
ctgggggctccccttgcc

SEQ ID NO: 5891450 - DNA, 14 bp, Homo sapiens
ctgggggctcctca

SEQ ID NO: 5891451 - DNA, 22 bp, Homo sapiens
ctgggggctctggccaagggcc

SEQ ID NO: 5891452 - DNA, 15 bp, Homo sapiens
ctgggggctgcaggg

SEQ ID NO: 5891453 - DNA, 14 bp, Homo sapiens
ctgggggctgcagt

SEQ ID NO: 5891454 - DNA, 15 bp, Homo sapiens
ctgggggctggacct

SEQ ID NO: 5891455 - DNA, 22 bp, Homo sapiens
ctgggggctggctcccagggtg

SEQ ID NO: 5891456 - DNA, 12 bp, Homo sapiens
ctgggggctggt

SEQ ID NO: 5891457 - DNA, 17 bp, Homo sapiens
ctgggggctttgggccg

SEQ ID NO: 5891458 - DNA, 19 bp, Homo sapiens
ctggggggaccaaatagcc

SEQ ID NO: 5891459 - DNA, 14 bp, Homo sapiens
ctggggggacccag

SEQ ID NO: 5891460 - DNA, 23 bp, Homo sapiens
ctggggggagggacagggcaggc

SEQ ID NO: 5891461 - DNA, 19 bp, Homo sapiens
ctggggggatgacggccag

SEQ ID NO: 5891462 - DNA, 12 bp, Homo sapiens
ctggggggcagg

SEQ ID NO: 5891463 - DNA, 15 bp, Homo sapiens
ctggggggcaggcct

SEQ ID NO: 5891464 - DNA, 16 bp, Homo sapiens
ctggggggcaggcctc

SEQ ID NO: 5891465 - DNA, 13 bp, Homo sapiens
ctggggggcagtg

SEQ ID NO: 5891466 - DNA, 14 bp, Homo sapiens
ctggggggccacca

SEQ ID NO: 5891467 - DNA, 22 bp, Homo sapiens
ctggggggccaccatgacccct

SEQ ID NO: 5891468 - DNA, 16 bp, Homo sapiens
ctggggggctgtcctg

SEQ ID NO: 5891469 - DNA, 13 bp, Homo sapiens
ctggggggtggcc

SEQ ID NO: 5891470 - DNA, 18 bp, Homo sapiens
ctgggggtcccttgctta

SEQ ID NO: 5891471 - DNA, 21 bp, Homo sapiens
ctgggggtcttttagctccat

SEQ ID NO: 5891472 - DNA, 14 bp, Homo sapiens
ctgggggtgggaag

SEQ ID NO: 5891473 - DNA, 15 bp, Homo sapiens
ctgggggtgggccag

SEQ ID NO: 5891474 - DNA, 17 bp, Homo sapiens
ctgggggtgggccaggc

SEQ ID NO: 5891475 - DNA, 19 bp, Homo sapiens
ctgggggtggggaggggcc

SEQ ID NO: 5891476 - DNA, 16 bp, Homo sapiens
ctgggggtggggctcc

SEQ ID NO: 5891477 - DNA, 18 bp, Homo sapiens
ctgggggtggggctccta

SEQ ID NO: 5891478 - DNA, 22 bp, Homo sapiens
ctgggggtggggctcctacctg

SEQ ID NO: 5891479 - DNA, 23 bp, Homo sapiens
ctgggggtggggctcctacctgg

SEQ ID NO: 5891480 - DNA, 18 bp, Homo sapiens
ctgggggttgttgggagg

SEQ ID NO: 5891481 - DNA, 21 bp, Homo sapiens
ctgggggtttaagctctgccc

SEQ ID NO: 5891482 - DNA, 22 bp, Homo sapiens
ctgggggtttaagctctgcccc

SEQ ID NO: 5891483 - DNA, 24 bp, Homo sapiens
ctggggtacaaggggcccagtgct

SEQ ID NO: 5891484 - DNA, 16 bp, Homo sapiens
ctggggtacacagtga

SEQ ID NO: 5891485 - DNA, 16 bp, Homo sapiens
ctggggtaccaagaga

SEQ ID NO: 5891486 - DNA, 21 bp, Homo sapiens
ctggggtaccaagagactcct

SEQ ID NO: 5891487 - DNA, 18 bp, Homo sapiens
ctggggtacttctgtgtt

SEQ ID NO: 5891488 - DNA, 14 bp, Homo sapiens
ctggggtaggagga

SEQ ID NO: 5891489 - DNA, 15 bp, Homo sapiens
ctggggtaggaggaa

SEQ ID NO: 5891490 - DNA, 17 bp, Homo sapiens
ctggggtatgtgtgtgt

SEQ ID NO: 5891491 - DNA, 18 bp, Homo sapiens
ctggggtatgttctgggc

SEQ ID NO: 5891492 - DNA, 19 bp, Homo sapiens
ctggggtcaccctctccag

SEQ ID NO: 5891493 - DNA, 13 bp, Homo sapiens
ctggggtccaggg

SEQ ID NO: 5891494 - DNA, 15 bp, Homo sapiens
ctggggtccagggct

SEQ ID NO: 5891495 - DNA, 16 bp, Homo sapiens
ctggggtccagggctg

SEQ ID NO: 5891496 - DNA, 15 bp, Homo sapiens
ctggggtcccagcag

SEQ ID NO: 5891497 - DNA, 18 bp, Homo sapiens
ctggggtcccagcagctg

SEQ ID NO: 5891498 - DNA, 22 bp, Homo sapiens
ctggggtcccagcagctgccag

SEQ ID NO: 5891499 - DNA, 16 bp, Homo sapiens
ctggggtccccactcc

SEQ ID NO: 5891500 - DNA, 17 bp, Homo sapiens
ctggggtccccactccc

SEQ ID NO: 5891501 - DNA, 22 bp, Homo sapiens
ctggggtccccactccctgtcc

SEQ ID NO: 5891502 - DNA, 13 bp, Homo sapiens
ctggggtccccca

SEQ ID NO: 5891503 - DNA, 15 bp, Homo sapiens
ctggggtccctctga

SEQ ID NO: 5891504 - DNA, 17 bp, Homo sapiens
ctggggtcctcctgtgc

SEQ ID NO: 5891505 - DNA, 19 bp, Homo sapiens
ctggggtcctcctgtgcta

SEQ ID NO: 5891506 - DNA, 19 bp, Homo sapiens
ctggggtctcaggtccagc

SEQ ID NO: 5891507 - DNA, 14 bp, Homo sapiens
ctggggtctctctc

SEQ ID NO: 5891508 - DNA, 18 bp, Homo sapiens
ctggggtctctctcccta

SEQ ID NO: 5891509 - DNA, 17 bp, Homo sapiens
ctggggtctctgagcag

SEQ ID NO: 5891510 - DNA, 19 bp, Homo sapiens
ctggggtctctgagcagtg

SEQ ID NO: 5891511 - DNA, 13 bp, Homo sapiens
ctggggtctgagc

SEQ ID NO: 5891512 - DNA, 14 bp, Homo sapiens
ctggggtctgagca

SEQ ID NO: 5891513 - DNA, 15 bp, Homo sapiens
ctggggtctgggcag

SEQ ID NO: 5891514 - DNA, 14 bp, Homo sapiens
ctggggtgagcctg

SEQ ID NO: 5891515 - DNA, 15 bp, Homo sapiens
ctggggtgagcctga

SEQ ID NO: 5891516 - DNA, 20 bp, Homo sapiens
ctggggtgagggagttaggg

SEQ ID NO: 5891517 - DNA, 20 bp, Homo sapiens
ctggggtgatgttttacttt

SEQ ID NO: 5891518 - DNA, 13 bp, Homo sapiens
ctggggtgcatcc

SEQ ID NO: 5891519 - DNA, 18 bp, Homo sapiens
ctggggtgcatctcctcc

SEQ ID NO: 5891520 - DNA, 21 bp, Homo sapiens
ctggggtgccctccactgccc

SEQ ID NO: 5891521 - DNA, 12 bp, Homo sapiens
ctggggtgcctt

SEQ ID NO: 5891522 - DNA, 22 bp, Homo sapiens
ctggggtggaggctaagcctgg

SEQ ID NO: 5891523 - DNA, 13 bp, Homo sapiens
ctggggtggagtg

SEQ ID NO: 5891524 - DNA, 15 bp, Homo sapiens
ctggggtggccacca

SEQ ID NO: 5891525 - DNA, 18 bp, Homo sapiens
ctggggtggccagggctt

SEQ ID NO: 5891526 - DNA, 12 bp, Homo sapiens
ctggggtggcct

SEQ ID NO: 5891527 - DNA, 18 bp, Homo sapiens
ctggggtggcctgtgtgg

SEQ ID NO: 5891528 - DNA, 23 bp, Homo sapiens
ctggggtggcgtctgcctaggag

SEQ ID NO: 5891529 - DNA, 14 bp, Homo sapiens
ctggggtgggacag

SEQ ID NO: 5891530 - DNA, 16 bp, Homo sapiens
ctggggtgggacaggg

SEQ ID NO: 5891531 - DNA, 14 bp, Homo sapiens
ctggggtgggaggg

SEQ ID NO: 5891532 - DNA, 15 bp, Homo sapiens
ctggggtgggagggt

SEQ ID NO: 5891533 - DNA, 21 bp, Homo sapiens
ctggggtggggacctcaggcc

SEQ ID NO: 5891534 - DNA, 17 bp, Homo sapiens
ctggggtggggaggcag

SEQ ID NO: 5891535 - DNA, 13 bp, Homo sapiens
ctggggtggggct

SEQ ID NO: 5891536 - DNA, 24 bp, Homo sapiens
ctggggtgggggtgggaggccagc

SEQ ID NO: 5891537 - DNA, 20 bp, Homo sapiens
ctggggtgggtttagcaggc

SEQ ID NO: 5891538 - DNA, 19 bp, Homo sapiens
ctggggtgtgggaggcccg

SEQ ID NO: 5891539 - DNA, 21 bp, Homo sapiens
ctggggttcaagcccaggctt

SEQ ID NO: 5891540 - DNA, 23 bp, Homo sapiens
ctggggttcaagcccaggcttcc

SEQ ID NO: 5891541 - DNA, 17 bp, Homo sapiens
ctggggttcagcccctc

SEQ ID NO: 5891542 - DNA, 21 bp, Homo sapiens
ctggggttcagcccctcctct

SEQ ID NO: 5891543 - DNA, 19 bp, Homo sapiens
ctggggttcccgagggagc

SEQ ID NO: 5891544 - DNA, 21 bp, Homo sapiens
ctggggttcccgagggagctg

SEQ ID NO: 5891545 - DNA, 16 bp, Homo sapiens
ctggggttctctacag

SEQ ID NO: 5891546 - DNA, 14 bp, Homo sapiens
ctggggttgagggc

SEQ ID NO: 5891547 - DNA, 20 bp, Homo sapiens
ctggggttgccctgggggat

SEQ ID NO: 5891548 - DNA, 22 bp, Homo sapiens
ctggggttgcgtctgaggcctg

SEQ ID NO: 5891549 - DNA, 24 bp, Homo sapiens
ctggggtttagaaccccaggtgag

SEQ ID NO: 5891550 - DNA, 23 bp, Homo sapiens
ctgggtaaaagcagggcagcagg

SEQ ID NO: 5891551 - DNA, 16 bp, Homo sapiens
ctgggtaaatgcaaag

SEQ ID NO: 5891552 - DNA, 16 bp, Homo sapiens
ctgggtaaatgcagcg

SEQ ID NO: 5891553 - DNA, 20 bp, Homo sapiens
ctgggtaactagggaagata

SEQ ID NO: 5891554 - DNA, 13 bp, Homo sapiens
ctgggtaactgtc

SEQ ID NO: 5891555 - DNA, 17 bp, Homo sapiens
ctgggtaagagcacagg

SEQ ID NO: 5891556 - DNA, 22 bp, Homo sapiens
ctgggtaataagcataagacca

SEQ ID NO: 5891557 - DNA, 23 bp, Homo sapiens
ctgggtaataagcataagaccaa

SEQ ID NO: 5891558 - DNA, 23 bp, Homo sapiens
ctgggtacaagagatgggatgct

SEQ ID NO: 5891559 - DNA, 16 bp, Homo sapiens
ctgggtacccaaaaca

SEQ ID NO: 5891560 - DNA, 17 bp, Homo sapiens
ctgggtacctgcaagca

SEQ ID NO: 5891561 - DNA, 17 bp, Homo sapiens
ctgggtactgaaagcct

SEQ ID NO: 5891562 - DNA, 15 bp, Homo sapiens
ctgggtacttcttga

SEQ ID NO: 5891563 - DNA, 17 bp, Homo sapiens
ctgggtacttcttgaag

SEQ ID NO: 5891564 - DNA, 23 bp, Homo sapiens
ctgggtacttcttgaaggtgctg

SEQ ID NO: 5891565 - DNA, 14 bp, Homo sapiens
ctgggtacttgtgg

SEQ ID NO: 5891566 - DNA, 16 bp, Homo sapiens
ctgggtacttgtggac

SEQ ID NO: 5891567 - DNA, 20 bp, Homo sapiens
ctgggtacttgtggacacag

SEQ ID NO: 5891568 - DNA, 13 bp, Homo sapiens
ctgggtagctgta

SEQ ID NO: 5891569 - DNA, 23 bp, Homo sapiens
ctgggtaggaaaagatgtatgtt

SEQ ID NO: 5891570 - DNA, 13 bp, Homo sapiens
ctgggtaggcccc

SEQ ID NO: 5891571 - DNA, 20 bp, Homo sapiens
ctgggtaggccccacaaggc

SEQ ID NO: 5891572 - DNA, 21 bp, Homo sapiens
ctgggtaggccccacaaggcc

SEQ ID NO: 5891573 - DNA, 23 bp, Homo sapiens
ctgggtaggccccacaaggcctg

SEQ ID NO: 5891574 - DNA, 16 bp, Homo sapiens
ctgggtagtcccctgt

SEQ ID NO: 5891575 - DNA, 16 bp, Homo sapiens
ctgggtatcccctgcc

SEQ ID NO: 5891576 - DNA, 21 bp, Homo sapiens
ctgggtatcccctgcctcctg

SEQ ID NO: 5891577 - DNA, 19 bp, Homo sapiens
ctgggtattaccatgtaaa

SEQ ID NO: 5891578 - DNA, 18 bp, Homo sapiens
ctgggtcaaaagagccct

SEQ ID NO: 5891579 - DNA, 19 bp, Homo sapiens
ctgggtcaaaagagccctg

SEQ ID NO: 5891580 - DNA, 14 bp, Homo sapiens
ctgggtcacacacg

SEQ ID NO: 5891581 - DNA, 15 bp, Homo sapiens
ctgggtcacaggaag

SEQ ID NO: 5891582 - DNA, 17 bp, Homo sapiens
ctgggtcacaggaagga

SEQ ID NO: 5891583 - DNA, 16 bp, Homo sapiens
ctgggtcaccttcctg

SEQ ID NO: 5891584 - DNA, 16 bp, Homo sapiens
ctgggtcaggggtaca

SEQ ID NO: 5891585 - DNA, 21 bp, Homo sapiens
ctgggtcaggggtacacagag

SEQ ID NO: 5891586 - DNA, 18 bp, Homo sapiens
ctgggtcagtctggtggg

SEQ ID NO: 5891587 - DNA, 14 bp, Homo sapiens
ctgggtcatgggcc

SEQ ID NO: 5891588 - DNA, 13 bp, Homo sapiens
ctgggtccaaata

SEQ ID NO: 5891589 - DNA, 14 bp, Homo sapiens
ctgggtccaaataa

SEQ ID NO: 5891590 - DNA, 21 bp, Homo sapiens
ctgggtccaaataaaaactaa

SEQ ID NO: 5891591 - DNA, 13 bp, Homo sapiens
ctgggtccaccct

SEQ ID NO: 5891592 - DNA, 13 bp, Homo sapiens
ctgggtccaggga

SEQ ID NO: 5891593 - DNA, 14 bp, Homo sapiens
ctgggtccagggga

SEQ ID NO: 5891594 - DNA, 15 bp, Homo sapiens
ctgggtccaggggag

SEQ ID NO: 5891595 - DNA, 17 bp, Homo sapiens
ctgggtccatatcacac

SEQ ID NO: 5891596 - DNA, 14 bp, Homo sapiens
ctgggtccatcctg

SEQ ID NO: 5891597 - DNA, 17 bp, Homo sapiens
ctgggtttggcccctgg

SEQ ID NO: 5891598 - DNA, 18 bp, Homo sapiens
ctgggtttggcccctgga

SEQ ID NO: 5891599 - DNA, 22 bp, Homo sapiens
ctgggtttggcccctggaacct

SEQ ID NO: 5891600 - DNA, 14 bp, Homo sapiens
ctgggtttgggcag

SEQ ID NO: 5891601 - DNA, 17 bp, Homo sapiens
ctgggtttgggcagtgg

SEQ ID NO: 5891602 - DNA, 22 bp, Homo sapiens
ctgggtttgtacttccacctcc

SEQ ID NO: 5891603 - DNA, 20 bp, Homo sapiens
ctgggttttcaggggctttg

SEQ ID NO: 5891604 - DNA, 19 bp, Homo sapiens
ctgggttttctaactgtaa

SEQ ID NO: 5891605 - DNA, 22 bp, Homo sapiens
ctgggttttctaactgtaaatc

SEQ ID NO: 5891606 - DNA, 23 bp, Homo sapiens
ctgggttttctaactgtaaatca

SEQ ID NO: 5891607 - DNA, 14 bp, Homo sapiens
ctgggttttctgaa

SEQ ID NO: 5891608 - DNA, 20 bp, Homo sapiens
ctgggttttgtattctctga

SEQ ID NO: 5891609 - DNA, 23 bp, Homo sapiens
ctgggttttgtctctgcatctca

SEQ ID NO: 5891610 - DNA, 18 bp, Homo sapiens
ctggtaaaaagatccagg

SEQ ID NO: 5891611 - DNA, 12 bp, Homo sapiens
ctggtaaaataa

SEQ ID NO: 5891612 - DNA, 15 bp, Homo sapiens
ctggtaaaatgaaga

SEQ ID NO: 5891613 - DNA, 17 bp, Homo sapiens
ctggtaaaatgaagaat

SEQ ID NO: 5891614 - DNA, 20 bp, Homo sapiens
ctggtaaacattcctccagc

SEQ ID NO: 5891615 - DNA, 23 bp, Homo sapiens
ctggtaaacattcctccagcctc

SEQ ID NO: 5891616 - DNA, 23 bp, Homo sapiens
ctggtaaaccaagcctcccacac

SEQ ID NO: 5891617 - DNA, 22 bp, Homo sapiens
ctggtaaagaaaagcctcagct

SEQ ID NO: 5891618 - DNA, 14 bp, Homo sapiens
ctggtaacagtggc

SEQ ID NO: 5891619 - DNA, 17 bp, Homo sapiens
ctggtaagaaaaagcaa

SEQ ID NO: 5891620 - DNA, 15 bp, Homo sapiens
ctggtaagattgtta

SEQ ID NO: 5891621 - DNA, 17 bp, Homo sapiens
ctggtaagattgttatt

SEQ ID NO: 5891622 - DNA, 23 bp, Homo sapiens
ctggtaagattgttattaaatgt

SEQ ID NO: 5891623 - DNA, 12 bp, Homo sapiens
ctggtaagcaaa

SEQ ID NO: 5891624 - DNA, 14 bp, Homo sapiens
ctggtaagcagagg

SEQ ID NO: 5891625 - DNA, 18 bp, Homo sapiens
ctggtaagcagaggcttt

SEQ ID NO: 5891626 - DNA, 20 bp, Homo sapiens
ctggtaagcgatttgaaaca

SEQ ID NO: 5891627 - DNA, 19 bp, Homo sapiens
ctggtaagggaccttcagg

SEQ ID NO: 5891628 - DNA, 15 bp, Homo sapiens
ctggtaagtggcttt

SEQ ID NO: 5891629 - DNA, 19 bp, Homo sapiens
ctggtaatattgacttgta

SEQ ID NO: 5891630 - DNA, 14 bp, Homo sapiens
ctggtaattaaaag

SEQ ID NO: 5891631 - DNA, 23 bp, Homo sapiens
ctggtaattatcctcaagttgtg

SEQ ID NO: 5891632 - DNA, 13 bp, Homo sapiens
ctggtaattttgg

SEQ ID NO: 5891633 - DNA, 19 bp, Homo sapiens
ctggtacaacggaggcctg

SEQ ID NO: 5891634 - DNA, 20 bp, Homo sapiens
ctggtacaatttcttttggt

SEQ ID NO: 5891635 - DNA, 21 bp, Homo sapiens
ctggtacaatttcttttggtt

SEQ ID NO: 5891636 - DNA, 23 bp, Homo sapiens
ctggtacagtatgggggttgtaa

SEQ ID NO: 5891637 - DNA, 17 bp, Homo sapiens
ctggtaccagttgaaat

SEQ ID NO: 5891638 - DNA, 19 bp, Homo sapiens
ctggtacccagccatctgc

SEQ ID NO: 5891639 - DNA, 14 bp, Homo sapiens
ctggtactcaagcc

SEQ ID NO: 5891640 - DNA, 22 bp, Homo sapiens
ctggtactcaagccagcctgta

SEQ ID NO: 5891641 - DNA, 20 bp, Homo sapiens
ctggtactccctctcaggat

SEQ ID NO: 5891642 - DNA, 17 bp, Homo sapiens
ctggtactgacccagga

SEQ ID NO: 5891643 - DNA, 18 bp, Homo sapiens
ctggtactgacccaggac

SEQ ID NO: 5891644 - DNA, 19 bp, Homo sapiens
ctggtacttagagtttctg

SEQ ID NO: 5891645 - DNA, 19 bp, Homo sapiens
ctggtacttcctttctccc

SEQ ID NO: 5891646 - DNA, 16 bp, Homo sapiens
ctggtactttctgtac

SEQ ID NO: 5891647 - DNA, 17 bp, Homo sapiens
ctggtactttctgtact

SEQ ID NO: 5891648 - DNA, 18 bp, Homo sapiens
ctggtagaattgggaagc

SEQ ID NO: 5891649 - DNA, 18 bp, Homo sapiens
ctggtagagacccccagg

SEQ ID NO: 5891650 - DNA, 19 bp, Homo sapiens
ctggtagagacccccaggc

SEQ ID NO: 5891651 - DNA, 22 bp, Homo sapiens
ctggtagagacccccaggcctg

SEQ ID NO: 5891652 - DNA, 13 bp, Homo sapiens
ctggtagagacta

SEQ ID NO: 5891653 - DNA, 17 bp, Homo sapiens
ctggtagaggggccggc

SEQ ID NO: 5891654 - DNA, 14 bp, Homo sapiens
ctggtagatagaaa

SEQ ID NO: 5891655 - DNA, 23 bp, Homo sapiens
ctggtagatagaaataaatagct

SEQ ID NO: 5891656 - DNA, 20 bp, Homo sapiens
ctggtagatgctgaggcccc

SEQ ID NO: 5891657 - DNA, 21 bp, Homo sapiens
ctggtagatgctgaggcccct

SEQ ID NO: 5891658 - DNA, 20 bp, Homo sapiens
ctggtagcacatgtctgtcc

SEQ ID NO: 5891659 - DNA, 13 bp, Homo sapiens
ctggtagcagaat

SEQ ID NO: 5891660 - DNA, 13 bp, Homo sapiens
ctggtagcagcag

SEQ ID NO: 5891661 - DNA, 18 bp, Homo sapiens
ctggtagcagcaggctca

SEQ ID NO: 5891662 - DNA, 20 bp, Homo sapiens
ctggtagcagcaggctcagg

SEQ ID NO: 5891663 - DNA, 14 bp, Homo sapiens
ctggtagcatgacc

SEQ ID NO: 5891664 - DNA, 16 bp, Homo sapiens
ctggtagcatgacctt

SEQ ID NO: 5891665 - DNA, 18 bp, Homo sapiens
ctggtagcatgacctttt

SEQ ID NO: 5891666 - DNA, 17 bp, Homo sapiens
ctggtagcctgcagaag

SEQ ID NO: 5891667 - DNA, 15 bp, Homo sapiens
ctggtagctcaggtg

SEQ ID NO: 5891668 - DNA, 15 bp, Homo sapiens
ctggtagctgagggg

SEQ ID NO: 5891669 - DNA, 21 bp, Homo sapiens
ctggtagctgaggggacgggc

SEQ ID NO: 5891670 - DNA, 21 bp, Homo sapiens
ctggtaggaaaaagctttact

SEQ ID NO: 5891671 - DNA, 22 bp, Homo sapiens
ctggtaggaatagcatgtcact

SEQ ID NO: 5891672 - DNA, 23 bp, Homo sapiens
ctggtaggaggaggcatggaaac

SEQ ID NO: 5891673 - DNA, 17 bp, Homo sapiens
ctggtaggttgggacac

SEQ ID NO: 5891674 - DNA, 20 bp, Homo sapiens
ctggtaggttgggacaccag

SEQ ID NO: 5891675 - DNA, 20 bp, Homo sapiens
ctggtaggtttggtgtgtgt

SEQ ID NO: 5891676 - DNA, 20 bp, Homo sapiens
ctggtagtgtagctgtgtgg

SEQ ID NO: 5891677 - DNA, 19 bp, Homo sapiens
ctggtagttagtagcatgt

SEQ ID NO: 5891678 - DNA, 23 bp, Homo sapiens
ctggtagttcattgtaaatgaac

SEQ ID NO: 5891679 - DNA, 21 bp, Homo sapiens
ctggtatacattgaattcatt

SEQ ID NO: 5891680 - DNA, 17 bp, Homo sapiens
ctggtatatgtcattat

SEQ ID NO: 5891681 - DNA, 23 bp, Homo sapiens
ctggtatattattgcttcatgtt

SEQ ID NO: 5891682 - DNA, 23 bp, Homo sapiens
ctggtatctgcatgtaaaatctt

SEQ ID NO: 5891683 - DNA, 18 bp, Homo sapiens
ctggtatgaacttgagga

SEQ ID NO: 5891684 - DNA, 23 bp, Homo sapiens
ctggtatgaacttgaggacacat

SEQ ID NO: 5891685 - DNA, 17 bp, Homo sapiens
ctggtatgaataattgc

SEQ ID NO: 5891686 - DNA, 21 bp, Homo sapiens
ctggtatgcattctttatagt

SEQ ID NO: 5891687 - DNA, 13 bp, Homo sapiens
ctggtatggctgc

SEQ ID NO: 5891688 - DNA, 15 bp, Homo sapiens
ctggtatggctgcag

SEQ ID NO: 5891689 - DNA, 16 bp, Homo sapiens
ctggtatggctgcagt

SEQ ID NO: 5891690 - DNA, 16 bp, Homo sapiens
ctggtatggtgctaat

SEQ ID NO: 5891691 - DNA, 18 bp, Homo sapiens
ctggtatggtgctaatat

SEQ ID NO: 5891692 - DNA, 22 bp, Homo sapiens
ctggtatgtaaaagaaaatcca

SEQ ID NO: 5891693 - DNA, 11 bp, Homo sapiens
ctggtattaaa

SEQ ID NO: 5891694 - DNA, 16 bp, Homo sapiens
ctggtattaaatgcca

SEQ ID NO: 5891695 - DNA, 21 bp, Homo sapiens
ctggtattagttaaaacacat

SEQ ID NO: 5891696 - DNA, 19 bp, Homo sapiens
ctggtattatttacaatgc

SEQ ID NO: 5891697 - DNA, 13 bp, Homo sapiens
ctggtattctctc

SEQ ID NO: 5891698 - DNA, 15 bp, Homo sapiens
ctggtattctgttct

SEQ ID NO: 5891699 - DNA, 18 bp, Homo sapiens
ctggtattgtaatattaa

SEQ ID NO: 5891700 - DNA, 15 bp, Homo sapiens
ctggtattgtttacg

SEQ ID NO: 5891701 - DNA, 18 bp, Homo sapiens
ctggtatttatatttcaa

SEQ ID NO: 5891702 - DNA, 18 bp, Homo sapiens
ctggtatttatctgcaag

SEQ ID NO: 5891703 - DNA, 13 bp, Homo sapiens
ctggtatttctaa

SEQ ID NO: 5891704 - DNA, 14 bp, Homo sapiens
ctggtatttctaat

SEQ ID NO: 5891705 - DNA, 18 bp, Homo sapiens
ctggtcaaacaaactctc

SEQ ID NO: 5891706 - DNA, 15 bp, Homo sapiens
ctggtcaaccccaca

SEQ ID NO: 5891707 - DNA, 17 bp, Homo sapiens
ctggtcaacccgctgct

SEQ ID NO: 5891708 - DNA, 15 bp, Homo sapiens
ctggtcaacctcctg

SEQ ID NO: 5891709 - DNA, 16 bp, Homo sapiens
ctggtcaacctcctgg

SEQ ID NO: 5891710 - DNA, 17 bp, Homo sapiens
ctggtcaacctcctgga

SEQ ID NO: 5891711 - DNA, 19 bp, Homo sapiens
ctggtcaacctcctggaca

SEQ ID NO: 5891712 - DNA, 19 bp, Homo sapiens
ctggtcaataaaccactgt

SEQ ID NO: 5891713 - DNA, 19 bp, Homo sapiens
ctggtcaatcaacactacc

SEQ ID NO: 5891714 - DNA, 16 bp, Homo sapiens
ctggtcacacacaggt

SEQ ID NO: 5891715 - DNA, 16 bp, Homo sapiens
ctggtcacagcctcct

SEQ ID NO: 5891716 - DNA, 18 bp, Homo sapiens
ctggtcacagcctcctct

SEQ ID NO: 5891717 - DNA, 18 bp, Homo sapiens
ctggtcacaggactctgc

SEQ ID NO: 5891718 - DNA, 19 bp, Homo sapiens
ctggtcacaggactctgcc

SEQ ID NO: 5891719 - DNA, 20 bp, Homo sapiens
ctggtcacaggactctgcct

SEQ ID NO: 5891720 - DNA, 21 bp, Homo sapiens
ctggtcaccaaggcagtgcat

SEQ ID NO: 5891721 - DNA, 23 bp, Homo sapiens
ctggtcaccaaggcagtgcatgc

SEQ ID NO: 5891722 - DNA, 16 bp, Homo sapiens
ctggtcacccccaccc

SEQ ID NO: 5891723 - DNA, 22 bp, Homo sapiens
ctggtcacctaggaagcctcag

SEQ ID NO: 5891724 - DNA, 14 bp, Homo sapiens
ctggtcacctccca

SEQ ID NO: 5891725 - DNA, 17 bp, Homo sapiens
ctggtcacctcccatcc

SEQ ID NO: 5891726 - DNA, 18 bp, Homo sapiens
ctggtcaccttgcactcc

SEQ ID NO: 5891727 - DNA, 15 bp, Homo sapiens
ctggtcactctgccc

SEQ ID NO: 5891728 - DNA, 22 bp, Homo sapiens
ctggtcactctgccctctgctg

SEQ ID NO: 5891729 - DNA, 16 bp, Homo sapiens
ctggtcacttcttctg

SEQ ID NO: 5891730 - DNA, 16 bp, Homo sapiens
ctggtcagagccacag

SEQ ID NO: 5891731 - DNA, 15 bp, Homo sapiens
ctggtcagcagagcc

SEQ ID NO: 5891732 - DNA, 12 bp, Homo sapiens
ctggtcagccca

SEQ ID NO: 5891733 - DNA, 20 bp, Homo sapiens
ctggtcaggcaatgccctgc

SEQ ID NO: 5891734 - DNA, 23 bp, Homo sapiens
ctggtcaggcaatgccctgcggc

SEQ ID NO: 5891735 - DNA, 22 bp, Homo sapiens
ctggtcaggcccactgcagaga

SEQ ID NO: 5891736 - DNA, 19 bp, Homo sapiens
ctggtcagggcagtggcca

SEQ ID NO: 5891737 - DNA, 20 bp, Homo sapiens
ctggtcaggtccccatggct

SEQ ID NO: 5891738 - DNA, 20 bp, Homo sapiens
ctggtcagtcgtggagcgcc

SEQ ID NO: 5891739 - DNA, 23 bp, Homo sapiens
ctggtcagtgaagcccaggagga

SEQ ID NO: 5891740 - DNA, 20 bp, Homo sapiens
ctggtcagttttcacagagg

SEQ ID NO: 5891741 - DNA, 22 bp, Homo sapiens
ctggtcagttttcacagaggcg

SEQ ID NO: 5891742 - DNA, 14 bp, Homo sapiens
ctggtcatcctggg

SEQ ID NO: 5891743 - DNA, 24 bp, Homo sapiens
ctggtcatccttggtgctcttgct

SEQ ID NO: 5891744 - DNA, 16 bp, Homo sapiens
ctggtcatttccccca

SEQ ID NO: 5891745 - DNA, 18 bp, Homo sapiens
ctggtccactcagggctg

SEQ ID NO: 5891746 - DNA, 17 bp, Homo sapiens
ctggtccagctctgaca

SEQ ID NO: 5891747 - DNA, 21 bp, Homo sapiens
ctggtccagctctgacatccc

SEQ ID NO: 5891748 - DNA, 19 bp, Homo sapiens
ctggtccaggcatgggtcc

SEQ ID NO: 5891749 - DNA, 17 bp, Homo sapiens
ctggtccagggaagctg

SEQ ID NO: 5891750 - DNA, 19 bp, Homo sapiens
ctggtccagggcctgggaa

SEQ ID NO: 5891751 - DNA, 13 bp, Homo sapiens
ctggtccagggct

SEQ ID NO: 5891752 - DNA, 14 bp, Homo sapiens
ctggtccagggcta

SEQ ID NO: 5891753 - DNA, 20 bp, Homo sapiens
ctggtccagtggggaacagg

SEQ ID NO: 5891754 - DNA, 18 bp, Homo sapiens
ctggtccatatttacatt

SEQ ID NO: 5891755 - DNA, 19 bp, Homo sapiens
ctggtccatgatggagtca

SEQ ID NO: 5891756 - DNA, 18 bp, Homo sapiens
ctggtccatgcagggggc

SEQ ID NO: 5891757 - DNA, 14 bp, Homo sapiens
ctggtcccacgagg

SEQ ID NO: 5891758 - DNA, 17 bp, Homo sapiens
ctggtcccacgagggtg

SEQ ID NO: 5891759 - DNA, 17 bp, Homo sapiens
ctggtcccacttcacag

SEQ ID NO: 5891760 - DNA, 20 bp, Homo sapiens
ctggtcccacttcacagctg

SEQ ID NO: 5891761 - DNA, 17 bp, Homo sapiens
ctggtccccactgctga

SEQ ID NO: 5891762 - DNA, 19 bp, Homo sapiens
ctggtccccactgctgagc

SEQ ID NO: 5891763 - DNA, 21 bp, Homo sapiens
ctggtccccactgctgagctg

SEQ ID NO: 5891764 - DNA, 15 bp, Homo sapiens
ctggtcccccatggg

SEQ ID NO: 5891765 - DNA, 18 bp, Homo sapiens
ctggtcccccatgggctg

SEQ ID NO: 5891766 - DNA, 19 bp, Homo sapiens
ctggtcccctccctctgtc

SEQ ID NO: 5891767 - DNA, 21 bp, Homo sapiens
ctggtcccctccctctgtctt

SEQ ID NO: 5891768 - DNA, 19 bp, Homo sapiens
ctggtcccctcctcagtga

SEQ ID NO: 5891769 - DNA, 20 bp, Homo sapiens
ctggtcccggggccagcact

SEQ ID NO: 5891770 - DNA, 17 bp, Homo sapiens
ctggtccctatgtcatg

SEQ ID NO: 5891771 - DNA, 23 bp, Homo sapiens
ctggtccctcgtccacaggggca

SEQ ID NO: 5891772 - DNA, 16 bp, Homo sapiens
ctggtgtggtacagag

SEQ ID NO: 5891773 - DNA, 17 bp, Homo sapiens
ctggtgtggtacagaga

SEQ ID NO: 5891774 - DNA, 21 bp, Homo sapiens
ctggtgtggtacagagaagcc

SEQ ID NO: 5891775 - DNA, 22 bp, Homo sapiens
ctggtgtggtacagagaagcca

SEQ ID NO: 5891776 - DNA, 14 bp, Homo sapiens
ctggtgtgtccctc

SEQ ID NO: 5891777 - DNA, 14 bp, Homo sapiens
ctggtgtgtggtga

SEQ ID NO: 5891778 - DNA, 21 bp, Homo sapiens
ctggtgtgtggtgaggggctt

SEQ ID NO: 5891779 - DNA, 23 bp, Homo sapiens
ctggtgtgtggtgaggggctttc

SEQ ID NO: 5891780 - DNA, 12 bp, Homo sapiens
ctggtgttaaca

SEQ ID NO: 5891781 - DNA, 17 bp, Homo sapiens
ctggtgttaacagaagg

SEQ ID NO: 5891782 - DNA, 22 bp, Homo sapiens
ctggtgttaacagaagggaggg

SEQ ID NO: 5891783 - DNA, 15 bp, Homo sapiens
ctggtgttacacata

SEQ ID NO: 5891784 - DNA, 15 bp, Homo sapiens
ctggtgttataatac

SEQ ID NO: 5891785 - DNA, 14 bp, Homo sapiens
ctggtgttctgaag

SEQ ID NO: 5891786 - DNA, 20 bp, Homo sapiens
ctggtgttggacaagcttct

SEQ ID NO: 5891787 - DNA, 22 bp, Homo sapiens
ctggtgttggacaagcttctga

SEQ ID NO: 5891788 - DNA, 22 bp, Homo sapiens
ctggtgtttaggtgaattaatt

SEQ ID NO: 5891789 - DNA, 13 bp, Homo sapiens
ctggtgtttatgt

SEQ ID NO: 5891790 - DNA, 16 bp, Homo sapiens
ctggtgtttatgtgaa

SEQ ID NO: 5891791 - DNA, 23 bp, Homo sapiens
ctggtgtttctagcactggcctg

SEQ ID NO: 5891792 - DNA, 14 bp, Homo sapiens
ctggtgtttcttga

SEQ ID NO: 5891793 - DNA, 15 bp, Homo sapiens
ctggtgtttgtagtt

SEQ ID NO: 5891794 - DNA, 13 bp, Homo sapiens
ctggtgtttgtca

SEQ ID NO: 5891795 - DNA, 21 bp, Homo sapiens
ctggtgtttttctctctggac

SEQ ID NO: 5891796 - DNA, 22 bp, Homo sapiens
ctggttaaatagtatgggaaaa

SEQ ID NO: 5891797 - DNA, 23 bp, Homo sapiens
ctggttaaattaacattgcataa

SEQ ID NO: 5891798 - DNA, 21 bp, Homo sapiens
ctggttaagcaggcattgctt

SEQ ID NO: 5891799 - DNA, 19 bp, Homo sapiens
ctggttaattccataaccc

SEQ ID NO: 5891800 - DNA, 17 bp, Homo sapiens
ctggttacctggagaag

SEQ ID NO: 5891801 - DNA, 14 bp, Homo sapiens
ctggttactcaggg

SEQ ID NO: 5891802 - DNA, 16 bp, Homo sapiens
ctggttactcagggtt

SEQ ID NO: 5891803 - DNA, 14 bp, Homo sapiens
ctggttagaaatgc

SEQ ID NO: 5891804 - DNA, 23 bp, Homo sapiens
ctggttagaaatgcagaatccta

SEQ ID NO: 5891805 - DNA, 22 bp, Homo sapiens
ctggttagaggttccctttgac

SEQ ID NO: 5891806 - DNA, 15 bp, Homo sapiens
ctggttagctcagcc

SEQ ID NO: 5891807 - DNA, 21 bp, Homo sapiens
ctggttagctcagccccagcc

SEQ ID NO: 5891808 - DNA, 19 bp, Homo sapiens
ctggttaggacaaaaagac

SEQ ID NO: 5891809 - DNA, 18 bp, Homo sapiens
ctggttaggatggcagga

SEQ ID NO: 5891810 - DNA, 19 bp, Homo sapiens
ctggttaggatggcaggac

SEQ ID NO: 5891811 - DNA, 22 bp, Homo sapiens
ctggttaggttaggacttgccc

SEQ ID NO: 5891812 - DNA, 22 bp, Homo sapiens
ctggttatcctgtatgctgtaa

SEQ ID NO: 5891813 - DNA, 19 bp, Homo sapiens
ctggttatcctgtgctaca

SEQ ID NO: 5891814 - DNA, 16 bp, Homo sapiens
ctggttatcttgttat

SEQ ID NO: 5891815 - DNA, 17 bp, Homo sapiens
ctggttatttaaaatgt

SEQ ID NO: 5891816 - DNA, 17 bp, Homo sapiens
ctggttatttttctctt

SEQ ID NO: 5891817 - DNA, 20 bp, Homo sapiens
ctggttcaagagacactgct

SEQ ID NO: 5891818 - DNA, 19 bp, Homo sapiens
ctggttcaagcgattctca

SEQ ID NO: 5891819 - DNA, 19 bp, Homo sapiens
ctggttcaagcgattctct

SEQ ID NO: 5891820 - DNA, 14 bp, Homo sapiens
ctggttcacagttt

SEQ ID NO: 5891821 - DNA, 17 bp, Homo sapiens
ctggttcagacacagct

SEQ ID NO: 5891822 - DNA, 21 bp, Homo sapiens
ctggttcaggctcaaccttcc

SEQ ID NO: 5891823 - DNA, 12 bp, Homo sapiens
ctggttcattgt

SEQ ID NO: 5891824 - DNA, 12 bp, Homo sapiens
ctggttccaaac

SEQ ID NO: 5891825 - DNA, 13 bp, Homo sapiens
ctggttccactca

SEQ ID NO: 5891826 - DNA, 14 bp, Homo sapiens
ctggttccagggtc

SEQ ID NO: 5891827 - DNA, 16 bp, Homo sapiens
ctggttccatggcctc

SEQ ID NO: 5891828 - DNA, 20 bp, Homo sapiens
ctggttccatttttcctctg

SEQ ID NO: 5891829 - DNA, 19 bp, Homo sapiens
ctggttcccccaggaccct

SEQ ID NO: 5891830 - DNA, 23 bp, Homo sapiens
ctggttcccccaggaccctgagg

SEQ ID NO: 5891831 - DNA, 21 bp, Homo sapiens
ctggttcccgtttctccacct

SEQ ID NO: 5891832 - DNA, 13 bp, Homo sapiens
ctggttccctctt

SEQ ID NO: 5891833 - DNA, 16 bp, Homo sapiens
ctggttccctgctgcg

SEQ ID NO: 5891834 - DNA, 17 bp, Homo sapiens
ctggttccctgctgcgc

SEQ ID NO: 5891835 - DNA, 20 bp, Homo sapiens
ctggttcctgctagaaatgg

SEQ ID NO: 5891836 - DNA, 15 bp, Homo sapiens
ctggttcctgctgtc

SEQ ID NO: 5891837 - DNA, 16 bp, Homo sapiens
ctggttcctgctgtcc

SEQ ID NO: 5891838 - DNA, 21 bp, Homo sapiens
ctggttcctgctgtcctggtg

SEQ ID NO: 5891839 - DNA, 13 bp, Homo sapiens
ctggttccttcct

SEQ ID NO: 5891840 - DNA, 19 bp, Homo sapiens
ctggttccttcctatgccc

SEQ ID NO: 5891841 - DNA, 23 bp, Homo sapiens
ctggttcggatttggggtggatt

SEQ ID NO: 5891842 - DNA, 20 bp, Homo sapiens
ctggttcggctctagggcct

SEQ ID NO: 5891843 - DNA, 17 bp, Homo sapiens
ctggttcgtgccatgcc

SEQ ID NO: 5891844 - DNA, 20 bp, Homo sapiens
ctggttctacaaatttttac

SEQ ID NO: 5891845 - DNA, 14 bp, Homo sapiens
ctggttctaggctg

SEQ ID NO: 5891846 - DNA, 16 bp, Homo sapiens
ctggttctatttaatg

SEQ ID NO: 5891847 - DNA, 12 bp, Homo sapiens
ctggttctcatc

SEQ ID NO: 5891848 - DNA, 20 bp, Homo sapiens
ctggttctcatctttcttga

SEQ ID NO: 5891849 - DNA, 19 bp, Homo sapiens
ctggttctccatccccatg

SEQ ID NO: 5891850 - DNA, 20 bp, Homo sapiens
ctggttctccatccccatgt

SEQ ID NO: 5891851 - DNA, 19 bp, Homo sapiens
ctggttctgaggccagaaa

SEQ ID NO: 5891852 - DNA, 22 bp, Homo sapiens
ctggttctgtacatgtggaaaa

SEQ ID NO: 5891853 - DNA, 20 bp, Homo sapiens
ctggttctgtctagactggc

SEQ ID NO: 5891854 - DNA, 19 bp, Homo sapiens
ctggttctgtgttgaaata

SEQ ID NO: 5891855 - DNA, 22 bp, Homo sapiens
ctggttcttcatttattgagca

SEQ ID NO: 5891856 - DNA, 13 bp, Homo sapiens
ctggttcttgaaa

SEQ ID NO: 5891857 - DNA, 13 bp, Homo sapiens
ctggttcttgcct

SEQ ID NO: 5891858 - DNA, 20 bp, Homo sapiens
ctggttcttgccttcccctt

SEQ ID NO: 5891859 - DNA, 21 bp, Homo sapiens
ctggttcttttaaaattaatt

SEQ ID NO: 5891860 - DNA, 17 bp, Homo sapiens
ctggttgaagctttgct

SEQ ID NO: 5891861 - DNA, 14 bp, Homo sapiens
ctggttgcctcatg

SEQ ID NO: 5891862 - DNA, 17 bp, Homo sapiens
ctggttgcctctcttgc

SEQ ID NO: 5891863 - DNA, 16 bp, Homo sapiens
ctggttgctgggcctc

SEQ ID NO: 5891864 - DNA, 15 bp, Homo sapiens
ctggttgctgtgtgg

SEQ ID NO: 5891865 - DNA, 18 bp, Homo sapiens
ctggttgctgtgtggttt

SEQ ID NO: 5891866 - DNA, 17 bp, Homo sapiens
ctggttggagagctaga

SEQ ID NO: 5891867 - DNA, 17 bp, Homo sapiens
ctggttggattaatctt

SEQ ID NO: 5891868 - DNA, 18 bp, Homo sapiens
ctggttggattaatcttt

SEQ ID NO: 5891869 - DNA, 17 bp, Homo sapiens
ctggttggcatttgctg

SEQ ID NO: 5891870 - DNA, 19 bp, Homo sapiens
ctggttggccgtggtccag

SEQ ID NO: 5891871 - DNA, 13 bp, Homo sapiens
ctggttgggcagc

SEQ ID NO: 5891872 - DNA, 15 bp, Homo sapiens
ctggttgtatttcta

SEQ ID NO: 5891873 - DNA, 13 bp, Homo sapiens
ctggttgtcagaa

SEQ ID NO: 5891874 - DNA, 14 bp, Homo sapiens
ctggttgtcagaat

SEQ ID NO: 5891875 - DNA, 14 bp, Homo sapiens
ctggttgtccaggt

SEQ ID NO: 5891876 - DNA, 17 bp, Homo sapiens
ctggttgtccaggtcta

SEQ ID NO: 5891877 - DNA, 18 bp, Homo sapiens
ctggttgtccaggtctag

SEQ ID NO: 5891878 - DNA, 15 bp, Homo sapiens
ctggttgtctctctt

SEQ ID NO: 5891879 - DNA, 18 bp, Homo sapiens
ctggttgtctgaacccag

SEQ ID NO: 5891880 - DNA, 22 bp, Homo sapiens
ctggttgtctgaacccaggcag

SEQ ID NO: 5891881 - DNA, 23 bp, Homo sapiens
ctggttgtctgaacccaggcagc

SEQ ID NO: 5891882 - DNA, 21 bp, Homo sapiens
ctggttgttgcaccatctgct

SEQ ID NO: 5891883 - DNA, 19 bp, Homo sapiens
ctggttgtttctgttccaa

SEQ ID NO: 5891884 - DNA, 20 bp, Homo sapiens
ctggttgtttttgttctttg

SEQ ID NO: 5891885 - DNA, 18 bp, Homo sapiens
ctggtttaattcagcaga

SEQ ID NO: 5891886 - DNA, 21 bp, Homo sapiens
ctggtttagcacaatttatat

SEQ ID NO: 5891887 - DNA, 21 bp, Homo sapiens
ctggtttagtgttctgtattt

SEQ ID NO: 5891888 - DNA, 21 bp, Homo sapiens
ctggtttcaaactcctgacct

SEQ ID NO: 5891889 - DNA, 17 bp, Homo sapiens
ctggtttcactggccca

SEQ ID NO: 5891890 - DNA, 18 bp, Homo sapiens
ctggtttcactggcccaa

SEQ ID NO: 5891891 - DNA, 23 bp, Homo sapiens
ctggtttcctatttgcagttact

SEQ ID NO: 5891892 - DNA, 14 bp, Homo sapiens
ctggtttcctgccc

SEQ ID NO: 5891893 - DNA, 21 bp, Homo sapiens
ctggtttcctgcccagcctgg

SEQ ID NO: 5891894 - DNA, 18 bp, Homo sapiens
ctggtttcctgccctggg

SEQ ID NO: 5891895 - DNA, 14 bp, Homo sapiens
ctggtttcctttct

SEQ ID NO: 5891896 - DNA, 19 bp, Homo sapiens
ctggtttctcagaatccaa

SEQ ID NO: 5891897 - DNA, 14 bp, Homo sapiens
ctggtttctcctgg

SEQ ID NO: 5891898 - DNA, 14 bp, Homo sapiens
ctggtttctgccct

SEQ ID NO: 5891899 - DNA, 14 bp, Homo sapiens
ctggtttctgtgtg

SEQ ID NO: 5891900 - DNA, 15 bp, Homo sapiens
ctggtttctgtgtgt

SEQ ID NO: 5891901 - DNA, 14 bp, Homo sapiens
ctggtttgactcag

SEQ ID NO: 5891902 - DNA, 19 bp, Homo sapiens
ctggtttgactcattaatt

SEQ ID NO: 5891903 - DNA, 22 bp, Homo sapiens
ctggtttgactccgctggaggt

SEQ ID NO: 5891904 - DNA, 21 bp, Homo sapiens
ctggtttgatttttttaaagt

SEQ ID NO: 5891905 - DNA, 13 bp, Homo sapiens
ctggtttgcaaga

SEQ ID NO: 5891906 - DNA, 14 bp, Homo sapiens
ctggtttgccaggc

SEQ ID NO: 5891907 - DNA, 20 bp, Homo sapiens
ctggtttggtggccaggctg

SEQ ID NO: 5891908 - DNA, 22 bp, Homo sapiens
ctggtttggtggccaggctggt

SEQ ID NO: 5891909 - DNA, 21 bp, Homo sapiens
ctggtttgtcaaacaacatgt

SEQ ID NO: 5891910 - DNA, 22 bp, Homo sapiens
ctggtttgtggggcacagatgc

SEQ ID NO: 5891911 - DNA, 16 bp, Homo sapiens
ctggtttgtttgctta

SEQ ID NO: 5891912 - DNA, 21 bp, Homo sapiens
ctggtttgtttgcttaatttc

SEQ ID NO: 5891913 - DNA, 21 bp, Homo sapiens
ctggttttaagtggaactgcc

SEQ ID NO: 5891914 - DNA, 19 bp, Homo sapiens
ctggttttacacagagaaa

SEQ ID NO: 5891915 - DNA, 20 bp, Homo sapiens
ctggttttcattattttccc

SEQ ID NO: 5891916 - DNA, 18 bp, Homo sapiens
ctggttttcctaaatgca

SEQ ID NO: 5891917 - DNA, 22 bp, Homo sapiens
ctggttttcgtcatcttccctg

SEQ ID NO: 5891918 - DNA, 22 bp, Homo sapiens
ctggttttctcttactgcagta

SEQ ID NO: 5891919 - DNA, 20 bp, Homo sapiens
ctggttttctggatggttcc

SEQ ID NO: 5891920 - DNA, 15 bp, Homo sapiens
ctggttttcttgcca

SEQ ID NO: 5891921 - DNA, 23 bp, Homo sapiens
ctggttttgatggctgggtcctt

SEQ ID NO: 5891922 - DNA, 13 bp, Homo sapiens
ctggttttgctat

SEQ ID NO: 5891923 - DNA, 15 bp, Homo sapiens
ctggttttgcttccc

SEQ ID NO: 5891924 - DNA, 14 bp, Homo sapiens
ctggttttggcatc

SEQ ID NO: 5891925 - DNA, 21 bp, Homo sapiens
ctggttttggcatctctgtcc

SEQ ID NO: 5891926 - DNA, 14 bp, Homo sapiens
ctggttttggtttc

SEQ ID NO: 5891927 - DNA, 22 bp, Homo sapiens
ctggttttgtaagatgctgggt

SEQ ID NO: 5891928 - DNA, 19 bp, Homo sapiens
ctggttttgtacactgctg

SEQ ID NO: 5891929 - DNA, 20 bp, Homo sapiens
ctggttttgtacactgctgt

SEQ ID NO: 5891930 - DNA, 22 bp, Homo sapiens
ctggttttgtacactgctgtac

SEQ ID NO: 5891931 - DNA, 23 bp, Homo sapiens
ctggttttgtacactgctgtacc

SEQ ID NO: 5891932 - DNA, 15 bp, Homo sapiens
ctggtttttcagttt

SEQ ID NO: 5891933 - DNA, 16 bp, Homo sapiens
ctggtttttcagtttt

SEQ ID NO: 5891934 - DNA, 20 bp, Homo sapiens
ctggtttttcatttccattg

SEQ ID NO: 5891935 - DNA, 13 bp, Homo sapiens
ctggttttttcca

SEQ ID NO: 5891936 - DNA, 22 bp, Homo sapiens
ctgtaaaacacaccaatcagcg

SEQ ID NO: 5891937 - DNA, 15 bp, Homo sapiens
ctgtaaaacaggtta

SEQ ID NO: 5891938 - DNA, 13 bp, Homo sapiens
ctgtaaaacgctg

SEQ ID NO: 5891939 - DNA, 13 bp, Homo sapiens
ctgtaaaactaag

SEQ ID NO: 5891940 - DNA, 20 bp, Homo sapiens
ctgtaaaactttattttata

SEQ ID NO: 5891941 - DNA, 20 bp, Homo sapiens
ctgtaaaagcaagtcctgca

SEQ ID NO: 5891942 - DNA, 22 bp, Homo sapiens
ctgtaaaagtgtacagactctt

SEQ ID NO: 5891943 - DNA, 20 bp, Homo sapiens
ctgtaaaagttactaatata

SEQ ID NO: 5891944 - DNA, 23 bp, Homo sapiens
ctgtaaaagttactaatatatct

SEQ ID NO: 5891945 - DNA, 16 bp, Homo sapiens
ctgtaaaagttataat

SEQ ID NO: 5891946 - DNA, 19 bp, Homo sapiens
ctgtaaaagttataataac

SEQ ID NO: 5891947 - DNA, 20 bp, Homo sapiens
ctgtaaaagttataataact

SEQ ID NO: 5891948 - DNA, 20 bp, Homo sapiens
ctgtaattttgtttgtaatc

SEQ ID NO: 5891949 - DNA, 19 bp, Homo sapiens
ctgtaatttttctgggaag

SEQ ID NO: 5891950 - DNA, 16 bp, Homo sapiens
ctgtacaaaaacaaaa

SEQ ID NO: 5891951 - DNA, 15 bp, Homo sapiens
ctgtacaaaagcaat

SEQ ID NO: 5891952 - DNA, 21 bp, Homo sapiens
ctgtacaaatcctctgttttc

SEQ ID NO: 5891953 - DNA, 12 bp, Homo sapiens
ctgtacaaatga

SEQ ID NO: 5891954 - DNA, 14 bp, Homo sapiens
ctgtacaaatgaaa

SEQ ID NO: 5891955 - DNA, 14 bp, Homo sapiens
ctgtacaacttctg

SEQ ID NO: 5891956 - DNA, 23 bp, Homo sapiens
ctgtacaacttctgggcctctct

SEQ ID NO: 5891957 - DNA, 14 bp, Homo sapiens
ctgtacaagtgctc

SEQ ID NO: 5891958 - DNA, 18 bp, Homo sapiens
ctgtacaataagttactt

SEQ ID NO: 5891959 - DNA, 14 bp, Homo sapiens
ctgtacaatattta

SEQ ID NO: 5891960 - DNA, 17 bp, Homo sapiens
ctgtacaatatttaaaa

SEQ ID NO: 5891961 - DNA, 16 bp, Homo sapiens
ctgtacacaactcact

SEQ ID NO: 5891962 - DNA, 14 bp, Homo sapiens
ctgtacacacacag

SEQ ID NO: 5891963 - DNA, 12 bp, Homo sapiens
ctgtacacaccc

SEQ ID NO: 5891964 - DNA, 18 bp, Homo sapiens
ctgtacacacccgcctga

SEQ ID NO: 5891965 - DNA, 17 bp, Homo sapiens
ctgtacacaccctccag

SEQ ID NO: 5891966 - DNA, 15 bp, Homo sapiens
ctgtacacagtgccc

SEQ ID NO: 5891967 - DNA, 21 bp, Homo sapiens
ctgtacacattcctgcattca

SEQ ID NO: 5891968 - DNA, 23 bp, Homo sapiens
ctgtacacattcctgcattcatg

SEQ ID NO: 5891969 - DNA, 17 bp, Homo sapiens
ctgtacaccatagttta

SEQ ID NO: 5891970 - DNA, 17 bp, Homo sapiens
ctgtacacgtgtcctgt

SEQ ID NO: 5891971 - DNA, 17 bp, Homo sapiens
ctgtacactgacttgag

SEQ ID NO: 5891972 - DNA, 15 bp, Homo sapiens
ctgtacactgcacga

SEQ ID NO: 5891973 - DNA, 17 bp, Homo sapiens
ctgtacagaatttccac

SEQ ID NO: 5891974 - DNA, 13 bp, Homo sapiens
ctgtacagagact

SEQ ID NO: 5891975 - DNA, 17 bp, Homo sapiens
ctgtacagcaagatgtt

SEQ ID NO: 5891976 - DNA, 15 bp, Homo sapiens
ctgtacagctggctc

SEQ ID NO: 5891977 - DNA, 13 bp, Homo sapiens
ctgtacaggaaaa

SEQ ID NO: 5891978 - DNA, 19 bp, Homo sapiens
ctgtacaggaaggtgcctg

SEQ ID NO: 5891979 - DNA, 23 bp, Homo sapiens
ctgtacagtaccttgttgcagat

SEQ ID NO: 5891980 - DNA, 11 bp, Homo sapiens
ctgtacagtct

SEQ ID NO: 5891981 - DNA, 16 bp, Homo sapiens
ctgtacagtctgtctt

SEQ ID NO: 5891982 - DNA, 17 bp, Homo sapiens
ctgtacagtctgtcttc

SEQ ID NO: 5891983 - DNA, 19 bp, Homo sapiens
ctgtacagtctgtcttctg

SEQ ID NO: 5891984 - DNA, 15 bp, Homo sapiens
ctgtacagtgtcttt

SEQ ID NO: 5891985 - DNA, 17 bp, Homo sapiens
ctgtacagttttgtgga

SEQ ID NO: 5891986 - DNA, 22 bp, Homo sapiens
ctgtacataattgcatgaaaat

SEQ ID NO: 5891987 - DNA, 14 bp, Homo sapiens
ctgtacatactggc

SEQ ID NO: 5891988 - DNA, 16 bp, Homo sapiens
ctgtacatactggcct

SEQ ID NO: 5891989 - DNA, 20 bp, Homo sapiens
ctgtacatactggcctctgt

SEQ ID NO: 5891990 - DNA, 21 bp, Homo sapiens
ctgtacatactggcctctgtg

SEQ ID NO: 5891991 - DNA, 15 bp, Homo sapiens
ctgtacatactgttt

SEQ ID NO: 5891992 - DNA, 17 bp, Homo sapiens
ctgtacatagcctatat

SEQ ID NO: 5891993 - DNA, 22 bp, Homo sapiens
ctgtacatatatatgccttatg

SEQ ID NO: 5891994 - DNA, 15 bp, Homo sapiens
ctgtacatatgtaaa

SEQ ID NO: 5891995 - DNA, 16 bp, Homo sapiens
ctgtacatatgtaaac

SEQ ID NO: 5891996 - DNA, 21 bp, Homo sapiens
ctgtacatgaaaacacatttt

SEQ ID NO: 5891997 - DNA, 21 bp, Homo sapiens
ctgtacatgacatcaaaatga

SEQ ID NO: 5891998 - DNA, 16 bp, Homo sapiens
ctgtacattactgtat

SEQ ID NO: 5891999 - DNA, 20 bp, Homo sapiens
ctgtacattgtgagctctgg

SEQ ID NO: 5892000 - DNA, 16 bp, Homo sapiens
ctgtacattttgttgt

SEQ ID NO: 5892001 - DNA, 12 bp, Homo sapiens
ctgtacattttt

SEQ ID NO: 5892002 - DNA, 13 bp, Homo sapiens
ctgtaccaaatct

SEQ ID NO: 5892003 - DNA, 17 bp, Homo sapiens
ctgtaccaaatctgaca

SEQ ID NO: 5892004 - DNA, 20 bp, Homo sapiens
ctgtaccaaatctgacatat

SEQ ID NO: 5892005 - DNA, 15 bp, Homo sapiens
ctgtaccaagcccct

SEQ ID NO: 5892006 - DNA, 22 bp, Homo sapiens
ctgtaccaagccccttggccct

SEQ ID NO: 5892007 - DNA, 16 bp, Homo sapiens
ctgtaccacagacaca

SEQ ID NO: 5892008 - DNA, 23 bp, Homo sapiens
ctgtaccacagacacaatatgta

SEQ ID NO: 5892009 - DNA, 13 bp, Homo sapiens
ctgtaccacatct

SEQ ID NO: 5892010 - DNA, 14 bp, Homo sapiens
ctgtaccacatctg

SEQ ID NO: 5892011 - DNA, 19 bp, Homo sapiens
ctgtaccacatctgctcta

SEQ ID NO: 5892012 - DNA, 12 bp, Homo sapiens
ctgtaccagtta

SEQ ID NO: 5892013 - DNA, 17 bp, Homo sapiens
ctgtaccagttaatttt

SEQ ID NO: 5892014 - DNA, 18 bp, Homo sapiens
ctgtaccagttaattttt

SEQ ID NO: 5892015 - DNA, 23 bp, Homo sapiens
ctgtaccatatagcaaaactttt

SEQ ID NO: 5892016 - DNA, 19 bp, Homo sapiens
ctgtaccatccatggagca

SEQ ID NO: 5892017 - DNA, 14 bp, Homo sapiens
ctgtacccacccca

SEQ ID NO: 5892018 - DNA, 14 bp, Homo sapiens
ctgtacccagatgc

SEQ ID NO: 5892019 - DNA, 19 bp, Homo sapiens
ctgtacccagatgcctaca

SEQ ID NO: 5892020 - DNA, 13 bp, Homo sapiens
ctgtacccagctc

SEQ ID NO: 5892021 - DNA, 22 bp, Homo sapiens
ctgtaccctgcttcccaaactc

SEQ ID NO: 5892022 - DNA, 22 bp, Homo sapiens
ctgtacccttcgggagggcact

SEQ ID NO: 5892023 - DNA, 16 bp, Homo sapiens
ctgtaccggccactgc

SEQ ID NO: 5892024 - DNA, 18 bp, Homo sapiens
ctgtaccgtcgacaagaa

SEQ ID NO: 5892025 - DNA, 16 bp, Homo sapiens
ctgtacctcaaatgaa

SEQ ID NO: 5892026 - DNA, 23 bp, Homo sapiens
ctgtacctcagtggatcttcaga

SEQ ID NO: 5892027 - DNA, 16 bp, Homo sapiens
ctgtacctctctctgc

SEQ ID NO: 5892028 - DNA, 17 bp, Homo sapiens
ctgtacctctctctgct

SEQ ID NO: 5892029 - DNA, 21 bp, Homo sapiens
ctgtacctctctctgctcctc

SEQ ID NO: 5892030 - DNA, 22 bp, Homo sapiens
ctgtacctctctctgctcctca

SEQ ID NO: 5892031 - DNA, 21 bp, Homo sapiens
ctgtacctcttgagccttgaa

SEQ ID NO: 5892032 - DNA, 18 bp, Homo sapiens
ctgtacctgtaggaaaca

SEQ ID NO: 5892033 - DNA, 19 bp, Homo sapiens
ctgtacctgtaggaaacag

SEQ ID NO: 5892034 - DNA, 23 bp, Homo sapiens
ctgtacctttctgacaataaata

SEQ ID NO: 5892035 - DNA, 22 bp, Homo sapiens
ctgtaccttttgcgatttcaca

SEQ ID NO: 5892036 - DNA, 17 bp, Homo sapiens
ctgtacgacacgggtgg

SEQ ID NO: 5892037 - DNA, 15 bp, Homo sapiens
ctgtacgtctgacag

SEQ ID NO: 5892038 - DNA, 16 bp, Homo sapiens
ctgtactaaacatttc

SEQ ID NO: 5892039 - DNA, 17 bp, Homo sapiens
ctgtactaattcttaca

SEQ ID NO: 5892040 - DNA, 13 bp, Homo sapiens
ctgtactagagat

SEQ ID NO: 5892041 - DNA, 21 bp, Homo sapiens
ctgtactagagatctggtttt

SEQ ID NO: 5892042 - DNA, 15 bp, Homo sapiens
ctgtactataagtag

SEQ ID NO: 5892043 - DNA, 23 bp, Homo sapiens
ctgtactattgcagacctgtcac

SEQ ID NO: 5892044 - DNA, 18 bp, Homo sapiens
ctgtactatttaaaatgc

SEQ ID NO: 5892045 - DNA, 14 bp, Homo sapiens
ctgtactcagagca

SEQ ID NO: 5892046 - DNA, 20 bp, Homo sapiens
ctgtactcagagcagagcaa

SEQ ID NO: 5892047 - DNA, 13 bp, Homo sapiens
ctgtactcaggag

SEQ ID NO: 5892048 - DNA, 15 bp, Homo sapiens
ctgtactcctcccag

SEQ ID NO: 5892049 - DNA, 19 bp, Homo sapiens
ctgtactcctcccaggcgc

SEQ ID NO: 5892050 - DNA, 18 bp, Homo sapiens
ctgtactcgcttgtgcag

SEQ ID NO: 5892051 - DNA, 16 bp, Homo sapiens
ctgtactgaagaacag

SEQ ID NO: 5892052 - DNA, 13 bp, Homo sapiens
ctgtactgattca

SEQ ID NO: 5892053 - DNA, 17 bp, Homo sapiens
ctgtactgattcaattt

SEQ ID NO: 5892054 - DNA, 21 bp, Homo sapiens
ctgtactgattcaatttgatg

SEQ ID NO: 5892055 - DNA, 13 bp, Homo sapiens
ctgtactgcatgt

SEQ ID NO: 5892056 - DNA, 17 bp, Homo sapiens
ctgtactgcctgcttgg

SEQ ID NO: 5892057 - DNA, 22 bp, Homo sapiens
ctgtactgctcaggctgcagct

SEQ ID NO: 5892058 - DNA, 15 bp, Homo sapiens
ctgtactggagagca

SEQ ID NO: 5892059 - DNA, 18 bp, Homo sapiens
ctgtactgttactgggcc

SEQ ID NO: 5892060 - DNA, 20 bp, Homo sapiens
ctgtactgttttctgggcca

SEQ ID NO: 5892061 - DNA, 13 bp, Homo sapiens
ctgtacttaataa

SEQ ID NO: 5892062 - DNA, 16 bp, Homo sapiens
ctgtacttattttcca

SEQ ID NO: 5892063 - DNA, 14 bp, Homo sapiens
ctgtacttcactgt

SEQ ID NO: 5892064 - DNA, 23 bp, Homo sapiens
ctgtacttcagtatgtgtcaact

SEQ ID NO: 5892065 - DNA, 19 bp, Homo sapiens
ctgtacttcagttctcatc

SEQ ID NO: 5892066 - DNA, 21 bp, Homo sapiens
ctgtacttccaatttataatg

SEQ ID NO: 5892067 - DNA, 16 bp, Homo sapiens
ctgtacttcttgaata

SEQ ID NO: 5892068 - DNA, 22 bp, Homo sapiens
ctgtacttgaagtctaaaagca

SEQ ID NO: 5892069 - DNA, 23 bp, Homo sapiens
ctgtacttgatttttcaaagact

SEQ ID NO: 5892070 - DNA, 20 bp, Homo sapiens
ctgtacttggtccaactgca

SEQ ID NO: 5892071 - DNA, 16 bp, Homo sapiens
ctgtacttgtcctcag

SEQ ID NO: 5892072 - DNA, 21 bp, Homo sapiens
ctgtacttgtcctcagcttgg

SEQ ID NO: 5892073 - DNA, 13 bp, Homo sapiens
ctgtactttccca

SEQ ID NO: 5892074 - DNA, 17 bp, Homo sapiens
ctgtactttctatttta

SEQ ID NO: 5892075 - DNA, 21 bp, Homo sapiens
ctgtactttgattcacatgtt

SEQ ID NO: 5892076 - DNA, 18 bp, Homo sapiens
ctgtacttttcattctct

SEQ ID NO: 5892077 - DNA, 14 bp, Homo sapiens
ctgtactttttggc

SEQ ID NO: 5892078 - DNA, 17 bp, Homo sapiens
ctgtacttttttcaaat

SEQ ID NO: 5892079 - DNA, 23 bp, Homo sapiens
ctgtacttttttcaaatattgaa

SEQ ID NO: 5892080 - DNA, 19 bp, Homo sapiens
ctgtagaaaagaaaacatt

SEQ ID NO: 5892081 - DNA, 15 bp, Homo sapiens
ctgtagaaaggaaat

SEQ ID NO: 5892082 - DNA, 20 bp, Homo sapiens
ctgtagaaaggaaatagact

SEQ ID NO: 5892083 - DNA, 22 bp, Homo sapiens
ctgtagaaaggggagaatgtca

SEQ ID NO: 5892084 - DNA, 22 bp, Homo sapiens
ctgtagaactgcaatttccatt

SEQ ID NO: 5892085 - DNA, 20 bp, Homo sapiens
ctgtagaagaagtgaacact

SEQ ID NO: 5892086 - DNA, 21 bp, Homo sapiens
ctgtagaagaagtgaacactt

SEQ ID NO: 5892087 - DNA, 15 bp, Homo sapiens
ctgtagaagagggat

SEQ ID NO: 5892088 - DNA, 15 bp, Homo sapiens
ctgtagaagatgacc

SEQ ID NO: 5892089 - DNA, 17 bp, Homo sapiens
ctgtagaaggaaatata

SEQ ID NO: 5892090 - DNA, 22 bp, Homo sapiens
ctgtagaagtgagtttgtaaat

SEQ ID NO: 5892091 - DNA, 23 bp, Homo sapiens
ctgtagaagtgagtttgtaaata

SEQ ID NO: 5892092 - DNA, 14 bp, Homo sapiens
ctgtagaatcaatt

SEQ ID NO: 5892093 - DNA, 17 bp, Homo sapiens
ctgtagacatctgtcct

SEQ ID NO: 5892094 - DNA, 18 bp, Homo sapiens
ctgtagacggctcagtat

SEQ ID NO: 5892095 - DNA, 14 bp, Homo sapiens
ctgtagagacttcc

SEQ ID NO: 5892096 - DNA, 17 bp, Homo sapiens
ctgtagagacttccgtc

SEQ ID NO: 5892097 - DNA, 18 bp, Homo sapiens
ctgtagagacttccgtca

SEQ ID NO: 5892098 - DNA, 23 bp, Homo sapiens
ctgtagagatttttatgtgtttg

SEQ ID NO: 5892099 - DNA, 22 bp, Homo sapiens
ctgtagagcagggcaagtaaca

SEQ ID NO: 5892100 - DNA, 16 bp, Homo sapiens
ctgtagagccagcctt

SEQ ID NO: 5892101 - DNA, 18 bp, Homo sapiens
ctgtagagccttctgatg

SEQ ID NO: 5892102 - DNA, 21 bp, Homo sapiens
ctgtagagctagaacatggag

SEQ ID NO: 5892103 - DNA, 16 bp, Homo sapiens
ctgtagaggagcctgg

SEQ ID NO: 5892104 - DNA, 17 bp, Homo sapiens
ctgtagagggccctggt

SEQ ID NO: 5892105 - DNA, 19 bp, Homo sapiens
ctgtagagtcactgaccct

SEQ ID NO: 5892106 - DNA, 19 bp, Homo sapiens
ctgtagagtcctatttcag

SEQ ID NO: 5892107 - DNA, 13 bp, Homo sapiens
ctgtagagtggga

SEQ ID NO: 5892108 - DNA, 16 bp, Homo sapiens
ctgtagataaataatg

SEQ ID NO: 5892109 - DNA, 18 bp, Homo sapiens
ctgtagatatgtattctt

SEQ ID NO: 5892110 - DNA, 15 bp, Homo sapiens
ctgtagatcaggttt

SEQ ID NO: 5892111 - DNA, 14 bp, Homo sapiens
ctgtagatgaagag

SEQ ID NO: 5892112 - DNA, 19 bp, Homo sapiens
ctgtagatgcagaaaaaga

SEQ ID NO: 5892113 - DNA, 19 bp, Homo sapiens
ctgtagatggtgacctggg

SEQ ID NO: 5892114 - DNA, 20 bp, Homo sapiens
ctgtagattctgtggaacaa

SEQ ID NO: 5892115 - DNA, 17 bp, Homo sapiens
ctgtagcaatatatttg

SEQ ID NO: 5892116 - DNA, 20 bp, Homo sapiens
ctgtagcaatatatttgtag

SEQ ID NO: 5892117 - DNA, 20 bp, Homo sapiens
ctgtagcaatggccagagcc

SEQ ID NO: 5892118 - DNA, 18 bp, Homo sapiens
ctgtagcacgctgcctgc

SEQ ID NO: 5892119 - DNA, 20 bp, Homo sapiens
ctgtagcagtgagaaaaagc

SEQ ID NO: 5892120 - DNA, 21 bp, Homo sapiens
ctgtagcagtgagaaaaagct

SEQ ID NO: 5892121 - DNA, 12 bp, Homo sapiens
ctgtagcatctt

SEQ ID NO: 5892122 - DNA, 19 bp, Homo sapiens
ctgtagcatcttctggagt

SEQ ID NO: 5892123 - DNA, 17 bp, Homo sapiens
ctgtagcattacagtgg

SEQ ID NO: 5892124 - DNA, 14 bp, Homo sapiens
ctgtagccacagct

SEQ ID NO: 5892125 - DNA, 14 bp, Homo sapiens
ctgtatctattttt

SEQ ID NO: 5892126 - DNA, 17 bp, Homo sapiens
ctgtatctgtagtgaga

SEQ ID NO: 5892127 - DNA, 23 bp, Homo sapiens
ctgtatctgtagtgagatagcat

SEQ ID NO: 5892128 - DNA, 13 bp, Homo sapiens
ctgtatctgtgct

SEQ ID NO: 5892129 - DNA, 13 bp, Homo sapiens
ctgtatctgtgta

SEQ ID NO: 5892130 - DNA, 14 bp, Homo sapiens
ctgtatcttccttt

SEQ ID NO: 5892131 - DNA, 18 bp, Homo sapiens
ctgtatcttgtttttcca

SEQ ID NO: 5892132 - DNA, 22 bp, Homo sapiens
ctgtatgaatattttatattaa

SEQ ID NO: 5892133 - DNA, 16 bp, Homo sapiens
ctgtatgaatgtgatt

SEQ ID NO: 5892134 - DNA, 20 bp, Homo sapiens
ctgtatgaggagagcttcag

SEQ ID NO: 5892135 - DNA, 17 bp, Homo sapiens
ctgtatgatcaaatgtt

SEQ ID NO: 5892136 - DNA, 23 bp, Homo sapiens
ctgtatgatttgttttgaatttt

SEQ ID NO: 5892137 - DNA, 14 bp, Homo sapiens
ctgtatgcaaagtc

SEQ ID NO: 5892138 - DNA, 16 bp, Homo sapiens
ctgtatgccttctgta

SEQ ID NO: 5892139 - DNA, 15 bp, Homo sapiens
ctgtatgcggtgacg

SEQ ID NO: 5892140 - DNA, 15 bp, Homo sapiens
ctgtatgctgatcat

SEQ ID NO: 5892141 - DNA, 15 bp, Homo sapiens
ctgtatggaaacact

SEQ ID NO: 5892142 - DNA, 17 bp, Homo sapiens
ctgtatggaaacactga

SEQ ID NO: 5892143 - DNA, 15 bp, Homo sapiens
ctgtatggcccaggc

SEQ ID NO: 5892144 - DNA, 16 bp, Homo sapiens
ctgtatggcccaggca

SEQ ID NO: 5892145 - DNA, 18 bp, Homo sapiens
ctgtatggcccaggcagc

SEQ ID NO: 5892146 - DNA, 21 bp, Homo sapiens
ctgtatggcccaggcagcctc

SEQ ID NO: 5892147 - DNA, 20 bp, Homo sapiens
ctgtatggctgtatttgctg

SEQ ID NO: 5892148 - DNA, 18 bp, Homo sapiens
ctgtatggtggaagctgg

SEQ ID NO: 5892149 - DNA, 20 bp, Homo sapiens
ctgtatgtattagtgatatt

SEQ ID NO: 5892150 - DNA, 20 bp, Homo sapiens
ctgtatgtctacctctgact

SEQ ID NO: 5892151 - DNA, 15 bp, Homo sapiens
ctgtatgtctgtcat

SEQ ID NO: 5892152 - DNA, 17 bp, Homo sapiens
ctgtatgtcttataaga

SEQ ID NO: 5892153 - DNA, 23 bp, Homo sapiens
ctgtatgtgagctgtaaaaatgt

SEQ ID NO: 5892154 - DNA, 18 bp, Homo sapiens
ctgtatgttatagaactt

SEQ ID NO: 5892155 - DNA, 16 bp, Homo sapiens
ctgtatgttcaactag

SEQ ID NO: 5892156 - DNA, 16 bp, Homo sapiens
ctgtatgttgtacaat

SEQ ID NO: 5892157 - DNA, 19 bp, Homo sapiens
ctgtatgttgtacaatcaa

SEQ ID NO: 5892158 - DNA, 15 bp, Homo sapiens
ctgtatgttgtccaa

SEQ ID NO: 5892159 - DNA, 20 bp, Homo sapiens
ctgtatgtttgatcacacag

SEQ ID NO: 5892160 - DNA, 21 bp, Homo sapiens
ctgtatgtttttactgaatga

SEQ ID NO: 5892161 - DNA, 20 bp, Homo sapiens
ctgtattaaatcttaaacaa

SEQ ID NO: 5892162 - DNA, 20 bp, Homo sapiens
ctgtattaactgaattctga

SEQ ID NO: 5892163 - DNA, 19 bp, Homo sapiens
ctgtattaagagtgaaaat

SEQ ID NO: 5892164 - DNA, 15 bp, Homo sapiens
ctgtattaagccact

SEQ ID NO: 5892165 - DNA, 22 bp, Homo sapiens
ctgtattaagctccagtgcttt

SEQ ID NO: 5892166 - DNA, 14 bp, Homo sapiens
ctgtattacagctt

SEQ ID NO: 5892167 - DNA, 20 bp, Homo sapiens
ctgtattactgaataatatc

SEQ ID NO: 5892168 - DNA, 21 bp, Homo sapiens
ctgtattagcagcaaaacaaa

SEQ ID NO: 5892169 - DNA, 17 bp, Homo sapiens
ctgtattagtcacagag

SEQ ID NO: 5892170 - DNA, 22 bp, Homo sapiens
ctgtattataataagcaaaaag

SEQ ID NO: 5892171 - DNA, 14 bp, Homo sapiens
ctgtattattgcaa

SEQ ID NO: 5892172 - DNA, 17 bp, Homo sapiens
ctgtattcagatcgtat

SEQ ID NO: 5892173 - DNA, 16 bp, Homo sapiens
ctgtattcatatattg

SEQ ID NO: 5892174 - DNA, 13 bp, Homo sapiens
ctgtattcccaca

SEQ ID NO: 5892175 - DNA, 18 bp, Homo sapiens
ctgtattcccatatcaaa

SEQ ID NO: 5892176 - DNA, 21 bp, Homo sapiens
ctgtattctcaaacacagtta

SEQ ID NO: 5892177 - DNA, 18 bp, Homo sapiens
ctgtattcttgttttaca

SEQ ID NO: 5892178 - DNA, 22 bp, Homo sapiens
ctgtattcttgttttacatttg

SEQ ID NO: 5892179 - DNA, 20 bp, Homo sapiens
ctgtattgaaaaaatattgt

SEQ ID NO: 5892180 - DNA, 14 bp, Homo sapiens
ctgtattgaatcat

SEQ ID NO: 5892181 - DNA, 20 bp, Homo sapiens
ctgtattgaatcatgtagta

SEQ ID NO: 5892182 - DNA, 20 bp, Homo sapiens
ctgtattgcagctaagctca

SEQ ID NO: 5892183 - DNA, 17 bp, Homo sapiens
ctgtattgtctgaactt

SEQ ID NO: 5892184 - DNA, 14 bp, Homo sapiens
ctgtatttaagcaa

SEQ ID NO: 5892185 - DNA, 23 bp, Homo sapiens
ctgtatttaggccatttgttaca

SEQ ID NO: 5892186 - DNA, 14 bp, Homo sapiens
ctgtatttattatt

SEQ ID NO: 5892187 - DNA, 22 bp, Homo sapiens
ctgtatttcactctttctccct

SEQ ID NO: 5892188 - DNA, 14 bp, Homo sapiens
ctgtatttcatgtg

SEQ ID NO: 5892189 - DNA, 17 bp, Homo sapiens
ctgtatttcatgtggct

SEQ ID NO: 5892190 - DNA, 17 bp, Homo sapiens
ctgtatttcattatctg

SEQ ID NO: 5892191 - DNA, 13 bp, Homo sapiens
ctgtatttcctgc

SEQ ID NO: 5892192 - DNA, 12 bp, Homo sapiens
ctgtatttcctt

SEQ ID NO: 5892193 - DNA, 13 bp, Homo sapiens
ctgtatttgaaag

SEQ ID NO: 5892194 - DNA, 14 bp, Homo sapiens
ctgtatttgaaagt

SEQ ID NO: 5892195 - DNA, 16 bp, Homo sapiens
ctgtatttgaaagtgc

SEQ ID NO: 5892196 - DNA, 17 bp, Homo sapiens
ctgtatttgaaagtgcc

SEQ ID NO: 5892197 - DNA, 20 bp, Homo sapiens
ctgtatttgaaagtgccttt

SEQ ID NO: 5892198 - DNA, 22 bp, Homo sapiens
ctgtatttgaaataagaattca

SEQ ID NO: 5892199 - DNA, 18 bp, Homo sapiens
ctgtatttgaatcagcct

SEQ ID NO: 5892200 - DNA, 17 bp, Homo sapiens
ctgtatttgagagactg

SEQ ID NO: 5892201 - DNA, 17 bp, Homo sapiens
ctgtatttgaggaaact

SEQ ID NO: 5892202 - DNA, 22 bp, Homo sapiens
ctgtatttgctgccagacactg

SEQ ID NO: 5892203 - DNA, 12 bp, Homo sapiens
ctgtatttgtga

SEQ ID NO: 5892204 - DNA, 16 bp, Homo sapiens
ctgtatttgtgactaa

SEQ ID NO: 5892205 - DNA, 20 bp, Homo sapiens
ctgtatttgttaatttcttg

SEQ ID NO: 5892206 - DNA, 15 bp, Homo sapiens
ctgtatttgttccca

SEQ ID NO: 5892207 - DNA, 11 bp, Homo sapiens
ctgtattttaa

SEQ ID NO: 5892208 - DNA, 20 bp, Homo sapiens
ctgtattttaaaagaatgat

SEQ ID NO: 5892209 - DNA, 19 bp, Homo sapiens
ctgtattttaacactttgt

SEQ ID NO: 5892210 - DNA, 22 bp, Homo sapiens
ctgtattttaacactttgtatt

SEQ ID NO: 5892211 - DNA, 14 bp, Homo sapiens
ctgtattttaatgt

SEQ ID NO: 5892212 - DNA, 10 bp, Homo sapiens
ctgtattttc

SEQ ID NO: 5892213 - DNA, 20 bp, Homo sapiens
ctgtattttcttttatatct

SEQ ID NO: 5892214 - DNA, 16 bp, Homo sapiens
ctgtattttcttttta

SEQ ID NO: 5892215 - DNA, 21 bp, Homo sapiens
ctgtattttgagtttcagctg

SEQ ID NO: 5892216 - DNA, 23 bp, Homo sapiens
ctgtattttgagtttcagctgga

SEQ ID NO: 5892217 - DNA, 14 bp, Homo sapiens
ctgtattttgatat

SEQ ID NO: 5892218 - DNA, 16 bp, Homo sapiens
ctgtattttgccagac

SEQ ID NO: 5892219 - DNA, 18 bp, Homo sapiens
ctgtattttggctttctc

SEQ ID NO: 5892220 - DNA, 21 bp, Homo sapiens
ctgtattttggctttctccct

SEQ ID NO: 5892221 - DNA, 19 bp, Homo sapiens
ctgtatttttaaattctgc

SEQ ID NO: 5892222 - DNA, 18 bp, Homo sapiens
ctgtatttttgttagttt

SEQ ID NO: 5892223 - DNA, 20 bp, Homo sapiens
ctgtatttttgttagtttac

SEQ ID NO: 5892224 - DNA, 21 bp, Homo sapiens
ctgtattttttcttgcattga

SEQ ID NO: 5892225 - DNA, 20 bp, Homo sapiens
ctgtattttttgtttgtatt

SEQ ID NO: 5892226 - DNA, 20 bp, Homo sapiens
ctgtattttttttttccatt

SEQ ID NO: 5892227 - DNA, 14 bp, Homo sapiens
ctgtcaaaacactg

SEQ ID NO: 5892228 - DNA, 16 bp, Homo sapiens
ctgtcaaaacactgtg

SEQ ID NO: 5892229 - DNA, 20 bp, Homo sapiens
ctgtcaaaacactgtggaac

SEQ ID NO: 5892230 - DNA, 21 bp, Homo sapiens
ctgtcaaaagttggactaaat

SEQ ID NO: 5892231 - DNA, 21 bp, Homo sapiens
ctgtcaaacattagtacttta

SEQ ID NO: 5892232 - DNA, 23 bp, Homo sapiens
ctgtcaaacattagtactttata

SEQ ID NO: 5892233 - DNA, 18 bp, Homo sapiens
ctgtcaaatccatgtgtc

SEQ ID NO: 5892234 - DNA, 19 bp, Homo sapiens
ctgtcaaatccatgtgtcc

SEQ ID NO: 5892235 - DNA, 19 bp, Homo sapiens
ctgtcaaatctagtttcct

SEQ ID NO: 5892236 - DNA, 22 bp, Homo sapiens
ctgtcaaatgaacttttacaga

SEQ ID NO: 5892237 - DNA, 12 bp, Homo sapiens
ctgtcaaatgtg

SEQ ID NO: 5892238 - DNA, 17 bp, Homo sapiens
ctgtcaaattttcaaat

SEQ ID NO: 5892239 - DNA, 21 bp, Homo sapiens
ctgtcaacctgaattaaagtc

SEQ ID NO: 5892240 - DNA, 14 bp, Homo sapiens
ctgtcaagaagatg

SEQ ID NO: 5892241 - DNA, 19 bp, Homo sapiens
ctgtcaagagtagttatat

SEQ ID NO: 5892242 - DNA, 22 bp, Homo sapiens
ctgtcaagagtagttatataat

SEQ ID NO: 5892243 - DNA, 13 bp, Homo sapiens
ctgtcaaggccga

SEQ ID NO: 5892244 - DNA, 13 bp, Homo sapiens
ctgtcaaggctca

SEQ ID NO: 5892245 - DNA, 14 bp, Homo sapiens
ctgtcaaggctcag

SEQ ID NO: 5892246 - DNA, 21 bp, Homo sapiens
ctgtcaagtcccccagcagaa

SEQ ID NO: 5892247 - DNA, 20 bp, Homo sapiens
ctgtcaagttaacaaggaat

SEQ ID NO: 5892248 - DNA, 19 bp, Homo sapiens
ctgtcaagttcctttgggt

SEQ ID NO: 5892249 - DNA, 13 bp, Homo sapiens
ctgtcaataaatg

SEQ ID NO: 5892250 - DNA, 22 bp, Homo sapiens
ctgtcaataaatgacacccaga

SEQ ID NO: 5892251 - DNA, 15 bp, Homo sapiens
ctgtcaataaatgtt

SEQ ID NO: 5892252 - DNA, 20 bp, Homo sapiens
ctgtcaataaatgttgaaaa

SEQ ID NO: 5892253 - DNA, 23 bp, Homo sapiens
ctgtcaatatcgtacctgtccct

SEQ ID NO: 5892254 - DNA, 15 bp, Homo sapiens
ctgtcaatcacagtc

SEQ ID NO: 5892255 - DNA, 17 bp, Homo sapiens
ctgtcaatggactgcac

SEQ ID NO: 5892256 - DNA, 20 bp, Homo sapiens
ctgtcaatggactgcacctt

SEQ ID NO: 5892257 - DNA, 19 bp, Homo sapiens
ctgtcaatgggacctgtgg

SEQ ID NO: 5892258 - DNA, 13 bp, Homo sapiens
ctgtcaattacag

SEQ ID NO: 5892259 - DNA, 20 bp, Homo sapiens
ctgtcaattacaggaagtac

SEQ ID NO: 5892260 - DNA, 13 bp, Homo sapiens
ctgtcaattgtac

SEQ ID NO: 5892261 - DNA, 21 bp, Homo sapiens
ctgtcaattgtacgcgccacc

SEQ ID NO: 5892262 - DNA, 16 bp, Homo sapiens
ctgtcacaaccaagaa

SEQ ID NO: 5892263 - DNA, 11 bp, Homo sapiens
ctgtcacaata

SEQ ID NO: 5892264 - DNA, 16 bp, Homo sapiens
ctgtcacaataaatgg

SEQ ID NO: 5892265 - DNA, 23 bp, Homo sapiens
ctgtcacaataaatggccagtgc

SEQ ID NO: 5892266 - DNA, 22 bp, Homo sapiens
ctgtcacaattcttagatctgg

SEQ ID NO: 5892267 - DNA, 17 bp, Homo sapiens
ctgtcacacactggacc

SEQ ID NO: 5892268 - DNA, 18 bp, Homo sapiens
ctgtcacacactggaccc

SEQ ID NO: 5892269 - DNA, 16 bp, Homo sapiens
ctgtcacactaaactt

SEQ ID NO: 5892270 - DNA, 17 bp, Homo sapiens
ctgtcacaggctgggtc

SEQ ID NO: 5892271 - DNA, 18 bp, Homo sapiens
ctgtcacaggctgggtca

SEQ ID NO: 5892272 - DNA, 22 bp, Homo sapiens
ctgtcacaggttttcagagaat

SEQ ID NO: 5892273 - DNA, 24 bp, Homo sapiens
ctgtcacaggttttcagagaatta

SEQ ID NO: 5892274 - DNA, 14 bp, Homo sapiens
ctgtcacatagttt

SEQ ID NO: 5892275 - DNA, 16 bp, Homo sapiens
ctgtcacatccaactg

SEQ ID NO: 5892276 - DNA, 13 bp, Homo sapiens
ctgtcacattgca

SEQ ID NO: 5892277 - DNA, 14 bp, Homo sapiens
ctgtcacattgcat

SEQ ID NO: 5892278 - DNA, 23 bp, Homo sapiens
ctgtcaccaagctcacagttcct

SEQ ID NO: 5892279 - DNA, 16 bp, Homo sapiens
ctgtcaccaaggaaac

SEQ ID NO: 5892280 - DNA, 14 bp, Homo sapiens
ctgtcaccagagct

SEQ ID NO: 5892281 - DNA, 23 bp, Homo sapiens
ctgtcaccagagcttctctgggc

SEQ ID NO: 5892282 - DNA, 15 bp, Homo sapiens
ctgtcacccacagac

SEQ ID NO: 5892283 - DNA, 15 bp, Homo sapiens
ctgtcacccagcaag

SEQ ID NO: 5892284 - DNA, 13 bp, Homo sapiens
ctgtcacccaggc

SEQ ID NO: 5892285 - DNA, 21 bp, Homo sapiens
ctgtcacccaggctgcagtgc

SEQ ID NO: 5892286 - DNA, 21 bp, Homo sapiens
ctgtcacccaggctggagtga

SEQ ID NO: 5892287 - DNA, 15 bp, Homo sapiens
ctgtcacccccactc

SEQ ID NO: 5892288 - DNA, 14 bp, Homo sapiens
ctgtcaccctgagg

SEQ ID NO: 5892289 - DNA, 15 bp, Homo sapiens
ctgtcaccctgaggt

SEQ ID NO: 5892290 - DNA, 16 bp, Homo sapiens
ctgtcaccctggccac

SEQ ID NO: 5892291 - DNA, 17 bp, Homo sapiens
ctgtcaccctggcccca

SEQ ID NO: 5892292 - DNA, 19 bp, Homo sapiens
ctgtcacctcgctgggctc

SEQ ID NO: 5892293 - DNA, 16 bp, Homo sapiens
ctgtcacctctcagct

SEQ ID NO: 5892294 - DNA, 17 bp, Homo sapiens
ctgtcacctctcccacg

SEQ ID NO: 5892295 - DNA, 13 bp, Homo sapiens
ctgtcacctcttc

SEQ ID NO: 5892296 - DNA, 17 bp, Homo sapiens
ctgtcacctgctcacag

SEQ ID NO: 5892297 - DNA, 19 bp, Homo sapiens
ctgtcacctggcctgccac

SEQ ID NO: 5892298 - DNA, 23 bp, Homo sapiens
ctgtcacgctcatgtcctgtcct

SEQ ID NO: 5892299 - DNA, 15 bp, Homo sapiens
ctgtcacggaacaga

SEQ ID NO: 5892300 - DNA, 14 bp, Homo sapiens
ctgtcacggaggga

SEQ ID NO: 5892301 - DNA, 21 bp, Homo sapiens
ctgtcacggggttccctccta

SEQ ID NO: 5892302 - DNA, 17 bp, Homo sapiens
ctgtcctaaggaacctt

SEQ ID NO: 5892303 - DNA, 17 bp, Homo sapiens
ctgtcctaccatcagct

SEQ ID NO: 5892304 - DNA, 12 bp, Homo sapiens
ctgtcctacctt

SEQ ID NO: 5892305 - DNA, 14 bp, Homo sapiens
ctgtcctagccagg

SEQ ID NO: 5892306 - DNA, 18 bp, Homo sapiens
ctgtcctagccaggtctc

SEQ ID NO: 5892307 - DNA, 23 bp, Homo sapiens
ctgtcctatgaatgctttgcatt

SEQ ID NO: 5892308 - DNA, 21 bp, Homo sapiens
ctgtcctcaaaataaggggca

SEQ ID NO: 5892309 - DNA, 16 bp, Homo sapiens
ctgtcctcaccctgtg

SEQ ID NO: 5892310 - DNA, 22 bp, Homo sapiens
ctgtcctcaccctgtgggaccg

SEQ ID NO: 5892311 - DNA, 14 bp, Homo sapiens
ctgtcctcagagca

SEQ ID NO: 5892312 - DNA, 15 bp, Homo sapiens
ctgtcctcagagcag

SEQ ID NO: 5892313 - DNA, 13 bp, Homo sapiens
ctgtcctcagcct

SEQ ID NO: 5892314 - DNA, 22 bp, Homo sapiens
ctgtcctcagccttgccagaga

SEQ ID NO: 5892315 - DNA, 15 bp, Homo sapiens
ctgtcctcagcttct

SEQ ID NO: 5892316 - DNA, 17 bp, Homo sapiens
ctgtcctcaggtggcca

SEQ ID NO: 5892317 - DNA, 23 bp, Homo sapiens
ctgtcctccaacaccaagcacag

SEQ ID NO: 5892318 - DNA, 13 bp, Homo sapiens
ctgtcctccagag

SEQ ID NO: 5892319 - DNA, 15 bp, Homo sapiens
ctgtcctccagaggg

SEQ ID NO: 5892320 - DNA, 14 bp, Homo sapiens
ctgtcctccagggc

SEQ ID NO: 5892321 - DNA, 11 bp, Homo sapiens
ctgtcctccca

SEQ ID NO: 5892322 - DNA, 21 bp, Homo sapiens
ctgtcctcccacagacctgca

SEQ ID NO: 5892323 - DNA, 22 bp, Homo sapiens
ctgtcctcccacagacctgcag

SEQ ID NO: 5892324 - DNA, 23 bp, Homo sapiens
ctgtcctcccacagacctgcagt

SEQ ID NO: 5892325 - DNA, 16 bp, Homo sapiens
ctgtcctcccatcccc

SEQ ID NO: 5892326 - DNA, 22 bp, Homo sapiens
ctgtcctcccctattgcgctct

SEQ ID NO: 5892327 - DNA, 21 bp, Homo sapiens
ctgtcctcccgagctcctctt

SEQ ID NO: 5892328 - DNA, 14 bp, Homo sapiens
ctgtcctccctcca

SEQ ID NO: 5892329 - DNA, 14 bp, Homo sapiens
ctgtcctccctctg

SEQ ID NO: 5892330 - DNA, 12 bp, Homo sapiens
ctgtcctcctcg

SEQ ID NO: 5892331 - DNA, 17 bp, Homo sapiens
ctgtcctcctggcacct

SEQ ID NO: 5892332 - DNA, 19 bp, Homo sapiens
ctgtcctcctggcacctga

SEQ ID NO: 5892333 - DNA, 13 bp, Homo sapiens
ctgtcctccttcc

SEQ ID NO: 5892334 - DNA, 18 bp, Homo sapiens
ctgtcctccttcctggga

SEQ ID NO: 5892335 - DNA, 18 bp, Homo sapiens
ctgtcctccttggcggca

SEQ ID NO: 5892336 - DNA, 14 bp, Homo sapiens
ctgtcctcgcagag

SEQ ID NO: 5892337 - DNA, 17 bp, Homo sapiens
ctgtcctctcccccttc

SEQ ID NO: 5892338 - DNA, 19 bp, Homo sapiens
ctgtcctctcccccttcag

SEQ ID NO: 5892339 - DNA, 20 bp, Homo sapiens
ctgtcctctcccctccagcc

SEQ ID NO: 5892340 - DNA, 21 bp, Homo sapiens
ctgtcctctcccctccagcct

SEQ ID NO: 5892341 - DNA, 19 bp, Homo sapiens
ctgtcctctcgagcccaga

SEQ ID NO: 5892342 - DNA, 12 bp, Homo sapiens
ctgtcctctctg

SEQ ID NO: 5892343 - DNA, 12 bp, Homo sapiens
ctgtcctctgta

SEQ ID NO: 5892344 - DNA, 15 bp, Homo sapiens
ctgtcctcttggcca

SEQ ID NO: 5892345 - DNA, 21 bp, Homo sapiens
ctgtcctctttcagctcctga

SEQ ID NO: 5892346 - DNA, 22 bp, Homo sapiens
ctgtcctgaaagcggctgcctc

SEQ ID NO: 5892347 - DNA, 23 bp, Homo sapiens
ctgtcctgaaagcggctgcctcc

SEQ ID NO: 5892348 - DNA, 20 bp, Homo sapiens
ctgtcctgaaggcctgaggt

SEQ ID NO: 5892349 - DNA, 13 bp, Homo sapiens
ctgtcctgagccc

SEQ ID NO: 5892350 - DNA, 17 bp, Homo sapiens
ctgtcctgagccccctg

SEQ ID NO: 5892351 - DNA, 19 bp, Homo sapiens
ctgtcctgagccccctgca

SEQ ID NO: 5892352 - DNA, 21 bp, Homo sapiens
ctgtcctgagccccctgcacc

SEQ ID NO: 5892353 - DNA, 17 bp, Homo sapiens
ctgtcctgatctgtgat

SEQ ID NO: 5892354 - DNA, 17 bp, Homo sapiens
ctgtcctgatggtcagc

SEQ ID NO: 5892355 - DNA, 21 bp, Homo sapiens
ctgtcctgatggtcagctccc

SEQ ID NO: 5892356 - DNA, 20 bp, Homo sapiens
ctgtcctgcacaccctgggc

SEQ ID NO: 5892357 - DNA, 15 bp, Homo sapiens
ctgtcctgcagcaaa

SEQ ID NO: 5892358 - DNA, 20 bp, Homo sapiens
ctgtcctgcagtcccacact

SEQ ID NO: 5892359 - DNA, 20 bp, Homo sapiens
ctgtcctgccatgcaagaac

SEQ ID NO: 5892360 - DNA, 14 bp, Homo sapiens
ctgtcctgcctcct

SEQ ID NO: 5892361 - DNA, 16 bp, Homo sapiens
ctgtcctgcctcctca

SEQ ID NO: 5892362 - DNA, 13 bp, Homo sapiens
ctgtcctgcctct

SEQ ID NO: 5892363 - DNA, 20 bp, Homo sapiens
ctgtcctgcgcctgcgcctc

SEQ ID NO: 5892364 - DNA, 18 bp, Homo sapiens
ctgtcctgcgttcagccc

SEQ ID NO: 5892365 - DNA, 19 bp, Homo sapiens
ctgtcctgcgttcagcccc

SEQ ID NO: 5892366 - DNA, 10 bp, Homo sapiens
ctgtcctgct

SEQ ID NO: 5892367 - DNA, 16 bp, Homo sapiens
ctgtcctgctcacctg

SEQ ID NO: 5892368 - DNA, 19 bp, Homo sapiens
ctgtcctgctcacctgtgt

SEQ ID NO: 5892369 - DNA, 15 bp, Homo sapiens
ctgtcctgctcacgt

SEQ ID NO: 5892370 - DNA, 22 bp, Homo sapiens
ctgtcctgctcacgtctgtgag

SEQ ID NO: 5892371 - DNA, 15 bp, Homo sapiens
ctgtcctgctccaca

SEQ ID NO: 5892372 - DNA, 17 bp, Homo sapiens
ctgtcctgctccacagt

SEQ ID NO: 5892373 - DNA, 18 bp, Homo sapiens
ctgtcctgctccacagtg

SEQ ID NO: 5892374 - DNA, 11 bp, Homo sapiens
ctgtcctgctg

SEQ ID NO: 5892375 - DNA, 14 bp, Homo sapiens
ctgtcctgctgccc

SEQ ID NO: 5892376 - DNA, 20 bp, Homo sapiens
ctgtcctgctgccctcccac

SEQ ID NO: 5892377 - DNA, 13 bp, Homo sapiens
ctgtcctgcttct

SEQ ID NO: 5892378 - DNA, 14 bp, Homo sapiens
ctgtcctgcttctg

SEQ ID NO: 5892379 - DNA, 15 bp, Homo sapiens
ctgtcctgcttctga

SEQ ID NO: 5892380 - DNA, 21 bp, Homo sapiens
ctgtcctggaaccaggcttgc

SEQ ID NO: 5892381 - DNA, 13 bp, Homo sapiens
ctgtcctggaggt

SEQ ID NO: 5892382 - DNA, 18 bp, Homo sapiens
ctgtcctggcccgggagc

SEQ ID NO: 5892383 - DNA, 20 bp, Homo sapiens
ctgtcctggcccgggagccg

SEQ ID NO: 5892384 - DNA, 16 bp, Homo sapiens
ctgtcctggctgctct

SEQ ID NO: 5892385 - DNA, 14 bp, Homo sapiens
ctgtcctggctgtg

SEQ ID NO: 5892386 - DNA, 22 bp, Homo sapiens
ctgtcctggcttttatttaaag

SEQ ID NO: 5892387 - DNA, 14 bp, Homo sapiens
ctgtcctgggagtg

SEQ ID NO: 5892388 - DNA, 21 bp, Homo sapiens
ctgtcctgggagtgagctggt

SEQ ID NO: 5892389 - DNA, 14 bp, Homo sapiens
ctgtcctgggcatg

SEQ ID NO: 5892390 - DNA, 22 bp, Homo sapiens
ctgtcctgggcatgggtccagg

SEQ ID NO: 5892391 - DNA, 13 bp, Homo sapiens
ctgtcctgggcct

SEQ ID NO: 5892392 - DNA, 14 bp, Homo sapiens
ctgtcctgggcctg

SEQ ID NO: 5892393 - DNA, 18 bp, Homo sapiens
ctgtcctgggcctgcaga

SEQ ID NO: 5892394 - DNA, 14 bp, Homo sapiens
ctgtcctgggctgg

SEQ ID NO: 5892395 - DNA, 18 bp, Homo sapiens
ctgtcctgggctggtggc

SEQ ID NO: 5892396 - DNA, 11 bp, Homo sapiens
ctgtcctgggg

SEQ ID NO: 5892397 - DNA, 12 bp, Homo sapiens
ctgtcctggggg

SEQ ID NO: 5892398 - DNA, 14 bp, Homo sapiens
ctgtcctgggggat

SEQ ID NO: 5892399 - DNA, 17 bp, Homo sapiens
ctgtcctgggggatgca

SEQ ID NO: 5892400 - DNA, 23 bp, Homo sapiens
ctgtcctgggggatgcaaataaa

SEQ ID NO: 5892401 - DNA, 14 bp, Homo sapiens
ctgtcctggtacag

SEQ ID NO: 5892402 - DNA, 21 bp, Homo sapiens
ctgtcctggtggctgggccca

SEQ ID NO: 5892403 - DNA, 22 bp, Homo sapiens
ctgtcctggtggctgggcccag

SEQ ID NO: 5892404 - DNA, 23 bp, Homo sapiens
ctgtcctggtggctgggcccagc

SEQ ID NO: 5892405 - DNA, 14 bp, Homo sapiens
ctgtcctggtggta

SEQ ID NO: 5892406 - DNA, 17 bp, Homo sapiens
ctgtcctgtaactgtta

SEQ ID NO: 5892407 - DNA, 21 bp, Homo sapiens
ctgtcctgtcatcatcatggc

SEQ ID NO: 5892408 - DNA, 16 bp, Homo sapiens
ctgtcctgtcctgctc

SEQ ID NO: 5892409 - DNA, 12 bp, Homo sapiens
ctgtcctgtctt

SEQ ID NO: 5892410 - DNA, 14 bp, Homo sapiens
ctgtcctgtctttg

SEQ ID NO: 5892411 - DNA, 14 bp, Homo sapiens
ctgtcctgtgaatg

SEQ ID NO: 5892412 - DNA, 12 bp, Homo sapiens
ctgtcctgtgac

SEQ ID NO: 5892413 - DNA, 14 bp, Homo sapiens
ctgtcctgtgaggt

SEQ ID NO: 5892414 - DNA, 22 bp, Homo sapiens
ctgtcctgtggcatgcaaaaga

SEQ ID NO: 5892415 - DNA, 18 bp, Homo sapiens
ctgtcctgtgtagtgatt

SEQ ID NO: 5892416 - DNA, 11 bp, Homo sapiens
ctgtccttaac

SEQ ID NO: 5892417 - DNA, 20 bp, Homo sapiens
ctgtccttaacccacctctc

SEQ ID NO: 5892418 - DNA, 16 bp, Homo sapiens
ctgtccttactcagag

SEQ ID NO: 5892419 - DNA, 18 bp, Homo sapiens
ctgtccttactcagagct

SEQ ID NO: 5892420 - DNA, 19 bp, Homo sapiens
ctgtccttactcagagctg

SEQ ID NO: 5892421 - DNA, 21 bp, Homo sapiens
ctgtccttactcagagctgcg

SEQ ID NO: 5892422 - DNA, 24 bp, Homo sapiens
ctgtccttactcagagctgcgggc

SEQ ID NO: 5892423 - DNA, 18 bp, Homo sapiens
ctgtccttagactccttc

SEQ ID NO: 5892424 - DNA, 15 bp, Homo sapiens
ctgtccttccaacct

SEQ ID NO: 5892425 - DNA, 21 bp, Homo sapiens
ctgtccttccattttcattct

SEQ ID NO: 5892426 - DNA, 17 bp, Homo sapiens
ctgtccttcccacggcc

SEQ ID NO: 5892427 - DNA, 19 bp, Homo sapiens
ctgtccttcccacggccac

SEQ ID NO: 5892428 - DNA, 23 bp, Homo sapiens
ctgtccttcccacggccactgca

SEQ ID NO: 5892429 - DNA, 16 bp, Homo sapiens
ctgtccttcccccagc

SEQ ID NO: 5892430 - DNA, 16 bp, Homo sapiens
ctgtccttccccttcc

SEQ ID NO: 5892431 - DNA, 12 bp, Homo sapiens
ctgtccttccct

SEQ ID NO: 5892432 - DNA, 14 bp, Homo sapiens
ctgtccttccctgc

SEQ ID NO: 5892433 - DNA, 18 bp, Homo sapiens
ctgtccttccctgccact

SEQ ID NO: 5892434 - DNA, 15 bp, Homo sapiens
ctgtccttccttcca

SEQ ID NO: 5892435 - DNA, 16 bp, Homo sapiens
ctgtccttccttccat

SEQ ID NO: 5892436 - DNA, 20 bp, Homo sapiens
ctgtccttctacagaacctg

SEQ ID NO: 5892437 - DNA, 23 bp, Homo sapiens
ctgtccttctcaggctggcatct

SEQ ID NO: 5892438 - DNA, 20 bp, Homo sapiens
ctgtccttctctcacctcct

SEQ ID NO: 5892439 - DNA, 17 bp, Homo sapiens
ctgtccttgaaaaacaa

SEQ ID NO: 5892440 - DNA, 18 bp, Homo sapiens
ctgtccttgaacccaaca

SEQ ID NO: 5892441 - DNA, 20 bp, Homo sapiens
ctgtccttgaacccaacagt

SEQ ID NO: 5892442 - DNA, 16 bp, Homo sapiens
ctgtccttgcacactc

SEQ ID NO: 5892443 - DNA, 20 bp, Homo sapiens
ctgtccttgtgtaatggaat

SEQ ID NO: 5892444 - DNA, 16 bp, Homo sapiens
ctgtcctttcagtctg

SEQ ID NO: 5892445 - DNA, 21 bp, Homo sapiens
ctgtcctttcagtctgatcca

SEQ ID NO: 5892446 - DNA, 22 bp, Homo sapiens
ctgtcctttccagtggcctggc

SEQ ID NO: 5892447 - DNA, 13 bp, Homo sapiens
ctgtcctttccca

SEQ ID NO: 5892448 - DNA, 21 bp, Homo sapiens
ctgtcctttctagagcactgc

SEQ ID NO: 5892449 - DNA, 23 bp, Homo sapiens
ctgtcctttctagagcactgcca

SEQ ID NO: 5892450 - DNA, 23 bp, Homo sapiens
ctgtcctttgcaattgctcttct

SEQ ID NO: 5892451 - DNA, 20 bp, Homo sapiens
ctgtcctttttcctctccac

SEQ ID NO: 5892452 - DNA, 20 bp, Homo sapiens
ctgtcgaaggggaggcacac

SEQ ID NO: 5892453 - DNA, 13 bp, Homo sapiens
ctgtcgagacact

SEQ ID NO: 5892454 - DNA, 14 bp, Homo sapiens
ctgtcgagacactt

SEQ ID NO: 5892455 - DNA, 18 bp, Homo sapiens
ctgtcgagacacttgcct

SEQ ID NO: 5892456 - DNA, 15 bp, Homo sapiens
ctgtcgatgtaggca

SEQ ID NO: 5892457 - DNA, 17 bp, Homo sapiens
ctgtcgattagactgga

SEQ ID NO: 5892458 - DNA, 17 bp, Homo sapiens
ctgtcgcatttcatcaa

SEQ ID NO: 5892459 - DNA, 21 bp, Homo sapiens
ctgtcgccacacgcctctgtg

SEQ ID NO: 5892460 - DNA, 16 bp, Homo sapiens
ctgtcgcccacccagc

SEQ ID NO: 5892461 - DNA, 19 bp, Homo sapiens
ctgtcgcccacccagctgg

SEQ ID NO: 5892462 - DNA, 14 bp, Homo sapiens
ctgtcgcccaggct

SEQ ID NO: 5892463 - DNA, 17 bp, Homo sapiens
ctgtcgcccaggctgga

SEQ ID NO: 5892464 - DNA, 22 bp, Homo sapiens
ctgtcgcgtctcattttgtcca

SEQ ID NO: 5892465 - DNA, 17 bp, Homo sapiens
ctgtcgctcaggctgga

SEQ ID NO: 5892466 - DNA, 20 bp, Homo sapiens
ctgtcgctcaggctggagtg

SEQ ID NO: 5892467 - DNA, 15 bp, Homo sapiens
ctgtcgctctcagtt

SEQ ID NO: 5892468 - DNA, 16 bp, Homo sapiens
ctgtcgctctcagttc

SEQ ID NO: 5892469 - DNA, 13 bp, Homo sapiens
ctgtcgctgcctc

SEQ ID NO: 5892470 - DNA, 15 bp, Homo sapiens
ctgtcgctgcctcca

SEQ ID NO: 5892471 - DNA, 18 bp, Homo sapiens
ctgtcgctgcctccatgg

SEQ ID NO: 5892472 - DNA, 14 bp, Homo sapiens
ctgtcgctgcttcg

SEQ ID NO: 5892473 - DNA, 23 bp, Homo sapiens
ctgtcggagaggctgtctggggc

SEQ ID NO: 5892474 - DNA, 15 bp, Homo sapiens
ctgtcggaggaaaga

SEQ ID NO: 5892475 - DNA, 14 bp, Homo sapiens
ctgtcggagggctg

SEQ ID NO: 5892476 - DNA, 13 bp, Homo sapiens
ctgtcggccacac

SEQ ID NO: 5892477 - DNA, 18 bp, Homo sapiens
ctgtcggccacaccccag

SEQ ID NO: 5892478 - DNA, 19 bp, Homo sapiens
ctgtcggccacaccccaga

SEQ ID NO: 5892479 - DNA, 17 bp, Homo sapiens
ctgtcgggaccacatct

SEQ ID NO: 5892480 - DNA, 21 bp, Homo sapiens
ctgtgaacaccaggactttaa

SEQ ID NO: 5892481 - DNA, 19 bp, Homo sapiens
ctgtgaacagcttgctgtc

SEQ ID NO: 5892482 - DNA, 21 bp, Homo sapiens
ctgtgaacatgcctcctcctg

SEQ ID NO: 5892483 - DNA, 22 bp, Homo sapiens
ctgtgaaccaacccccatctcc

SEQ ID NO: 5892484 - DNA, 15 bp, Homo sapiens
ctgtgaacccaggac

SEQ ID NO: 5892485 - DNA, 18 bp, Homo sapiens
ctgtgaaccggctcccac

SEQ ID NO: 5892486 - DNA, 21 bp, Homo sapiens
ctgtgaactatcccctgcgct

SEQ ID NO: 5892487 - DNA, 22 bp, Homo sapiens
ctgtgaactattttgaagaaaa

SEQ ID NO: 5892488 - DNA, 19 bp, Homo sapiens
ctgtgaactcaatctccag

SEQ ID NO: 5892489 - DNA, 15 bp, Homo sapiens
ctgtgaactcagagc

SEQ ID NO: 5892490 - DNA, 16 bp, Homo sapiens
ctgtgaacttgaaatt

SEQ ID NO: 5892491 - DNA, 17 bp, Homo sapiens
ctgtgaacttgactggg

SEQ ID NO: 5892492 - DNA, 19 bp, Homo sapiens
ctgtgaacttgactgggtg

SEQ ID NO: 5892493 - DNA, 14 bp, Homo sapiens
ctgtgaacttgggg

SEQ ID NO: 5892494 - DNA, 16 bp, Homo sapiens
ctgtgaacttggggaa

SEQ ID NO: 5892495 - DNA, 11 bp, Homo sapiens
ctgtgaagaag

SEQ ID NO: 5892496 - DNA, 17 bp, Homo sapiens
ctgtgaagaagccctgt

SEQ ID NO: 5892497 - DNA, 22 bp, Homo sapiens
ctgtgaagaagccctgttctcg

SEQ ID NO: 5892498 - DNA, 16 bp, Homo sapiens
ctgtgaagaatgaagt

SEQ ID NO: 5892499 - DNA, 19 bp, Homo sapiens
ctgtgaagaatgaagtgga

SEQ ID NO: 5892500 - DNA, 15 bp, Homo sapiens
ctgtgaagacccagc

SEQ ID NO: 5892501 - DNA, 16 bp, Homo sapiens
ctgtgaagacccagca

SEQ ID NO: 5892502 - DNA, 21 bp, Homo sapiens
ctgtgaagagaatgtattctg

SEQ ID NO: 5892503 - DNA, 16 bp, Homo sapiens
ctgtgaagagactctg

SEQ ID NO: 5892504 - DNA, 21 bp, Homo sapiens
ctgtgaagagccggtggtgcc

SEQ ID NO: 5892505 - DNA, 14 bp, Homo sapiens
ctgtgaagatctca

SEQ ID NO: 5892506 - DNA, 21 bp, Homo sapiens
ctgtgaagatctcactctgcc

SEQ ID NO: 5892507 - DNA, 14 bp, Homo sapiens
ctgtgaagcaaaaa

SEQ ID NO: 5892508 - DNA, 16 bp, Homo sapiens
ctgtgaagcaaaaaga

SEQ ID NO: 5892509 - DNA, 21 bp, Homo sapiens
ctgtgaagcattcgagacaga

SEQ ID NO: 5892510 - DNA, 23 bp, Homo sapiens
ctgtgaagcattcgagacagaac

SEQ ID NO: 5892511 - DNA, 14 bp, Homo sapiens
ctgtgaagcccttt

SEQ ID NO: 5892512 - DNA, 17 bp, Homo sapiens
ctgtgaagccctttgcc

SEQ ID NO: 5892513 - DNA, 20 bp, Homo sapiens
ctgtgaagccctttgcctgt

SEQ ID NO: 5892514 - DNA, 16 bp, Homo sapiens
ctgtgaagcctttatc

SEQ ID NO: 5892515 - DNA, 21 bp, Homo sapiens
ctgtgaagctattggaatttt

SEQ ID NO: 5892516 - DNA, 21 bp, Homo sapiens
ctgtgaagtaacccctcctgg

SEQ ID NO: 5892517 - DNA, 21 bp, Homo sapiens
ctgtgaagtgatctaaaattt

SEQ ID NO: 5892518 - DNA, 17 bp, Homo sapiens
ctgtgaagttacatgca

SEQ ID NO: 5892519 - DNA, 18 bp, Homo sapiens
ctgtgaagtttacattgt

SEQ ID NO: 5892520 - DNA, 23 bp, Homo sapiens
ctgtgaagtttacattgtaaata

SEQ ID NO: 5892521 - DNA, 15 bp, Homo sapiens
ctgtgaataaaaaga

SEQ ID NO: 5892522 - DNA, 16 bp, Homo sapiens
ctgtgaataaagccac

SEQ ID NO: 5892523 - DNA, 18 bp, Homo sapiens
ctgtgaataaagccacat

SEQ ID NO: 5892524 - DNA, 19 bp, Homo sapiens
ctgtgaataaagccacata

SEQ ID NO: 5892525 - DNA, 18 bp, Homo sapiens
ctgtgaatacaattaaag

SEQ ID NO: 5892526 - DNA, 20 bp, Homo sapiens
ctgtgaatacaattaaaggt

SEQ ID NO: 5892527 - DNA, 15 bp, Homo sapiens
ctgtgaatacttgaa

SEQ ID NO: 5892528 - DNA, 17 bp, Homo sapiens
ctgtgaatatgagaaat

SEQ ID NO: 5892529 - DNA, 21 bp, Homo sapiens
ctgtgaatatgagaaatacag

SEQ ID NO: 5892530 - DNA, 17 bp, Homo sapiens
ctgtgaatccagtgaaa

SEQ ID NO: 5892531 - DNA, 16 bp, Homo sapiens
ctgtgaatcctggcaa

SEQ ID NO: 5892532 - DNA, 16 bp, Homo sapiens
ctgtgaatgccactgc

SEQ ID NO: 5892533 - DNA, 13 bp, Homo sapiens
ctgtgaatgctaa

SEQ ID NO: 5892534 - DNA, 23 bp, Homo sapiens
ctgtgaatgctaagtccatcacc

SEQ ID NO: 5892535 - DNA, 13 bp, Homo sapiens
ctgtgaatggaag

SEQ ID NO: 5892536 - DNA, 16 bp, Homo sapiens
ctgtgaatggaagcaa

SEQ ID NO: 5892537 - DNA, 17 bp, Homo sapiens
ctgtgaatggaagcaaa

SEQ ID NO: 5892538 - DNA, 12 bp, Homo sapiens
ctgtgaatggag

SEQ ID NO: 5892539 - DNA, 15 bp, Homo sapiens
ctgtgaatggaggca

SEQ ID NO: 5892540 - DNA, 17 bp, Homo sapiens
ctgtgaatggaggcaga

SEQ ID NO: 5892541 - DNA, 17 bp, Homo sapiens
ctgtgaatggctgtgcc

SEQ ID NO: 5892542 - DNA, 20 bp, Homo sapiens
ctgtgaatgtaaaacagagc

SEQ ID NO: 5892543 - DNA, 14 bp, Homo sapiens
ctgtgaattcagat

SEQ ID NO: 5892544 - DNA, 20 bp, Homo sapiens
ctgtgaattgtggctgttca

SEQ ID NO: 5892545 - DNA, 21 bp, Homo sapiens
ctgtgaattgtttttgtacag

SEQ ID NO: 5892546 - DNA, 16 bp, Homo sapiens
ctgtgaatttcaaaaa

SEQ ID NO: 5892547 - DNA, 13 bp, Homo sapiens
ctgtgacaaaatg

SEQ ID NO: 5892548 - DNA, 18 bp, Homo sapiens
ctgtgacaataagtttga

SEQ ID NO: 5892549 - DNA, 19 bp, Homo sapiens
ctgtgacaatgactaagcc

SEQ ID NO: 5892550 - DNA, 21 bp, Homo sapiens
ctgtgacaatgactaagccaa

SEQ ID NO: 5892551 - DNA, 14 bp, Homo sapiens
ctgtgacacactac

SEQ ID NO: 5892552 - DNA, 21 bp, Homo sapiens
ctgtgacacactacaccacac

SEQ ID NO: 5892553 - DNA, 18 bp, Homo sapiens
ctgtgacacagctgagct

SEQ ID NO: 5892554 - DNA, 22 bp, Homo sapiens
ctgtgacaccagaataatgagt

SEQ ID NO: 5892555 - DNA, 21 bp, Homo sapiens
ctgtgacaccccccttctgaa

SEQ ID NO: 5892556 - DNA, 14 bp, Homo sapiens
ctgtgacagacttt

SEQ ID NO: 5892557 - DNA, 18 bp, Homo sapiens
ctgtgacagcagctctgt

SEQ ID NO: 5892558 - DNA, 22 bp, Homo sapiens
ctgtgacaggaagcccaaggca

SEQ ID NO: 5892559 - DNA, 15 bp, Homo sapiens
ctgtgacaggcagca

SEQ ID NO: 5892560 - DNA, 16 bp, Homo sapiens
ctgtgacaggcagcag

SEQ ID NO: 5892561 - DNA, 18 bp, Homo sapiens
ctgtgacaggcagcagag

SEQ ID NO: 5892562 - DNA, 21 bp, Homo sapiens
ctgtgacatctctattcccca

SEQ ID NO: 5892563 - DNA, 15 bp, Homo sapiens
ctgtgacattgctgg

SEQ ID NO: 5892564 - DNA, 15 bp, Homo sapiens
ctgtgacatttatgt

SEQ ID NO: 5892565 - DNA, 12 bp, Homo sapiens
ctgtgacatttt

SEQ ID NO: 5892566 - DNA, 13 bp, Homo sapiens
ctgtgaccaaagc

SEQ ID NO: 5892567 - DNA, 16 bp, Homo sapiens
ctgtgaccaatgtctt

SEQ ID NO: 5892568 - DNA, 17 bp, Homo sapiens
ctgtgaccaatgtcttg

SEQ ID NO: 5892569 - DNA, 14 bp, Homo sapiens
ctgtgaccacaaca

SEQ ID NO: 5892570 - DNA, 19 bp, Homo sapiens
ctgtgaccaccttctgtcc

SEQ ID NO: 5892571 - DNA, 22 bp, Homo sapiens
ctgtgaccaccttctgtcccca

SEQ ID NO: 5892572 - DNA, 14 bp, Homo sapiens
ctgtgaccagcact

SEQ ID NO: 5892573 - DNA, 13 bp, Homo sapiens
ctgtgaccatccc

SEQ ID NO: 5892574 - DNA, 15 bp, Homo sapiens
ctgtgacccacttct

SEQ ID NO: 5892575 - DNA, 21 bp, Homo sapiens
ctgtgacccacttctcatcac

SEQ ID NO: 5892576 - DNA, 14 bp, Homo sapiens
ctgtgacccatctg

SEQ ID NO: 5892577 - DNA, 18 bp, Homo sapiens
ctgtgacccccagctccg

SEQ ID NO: 5892578 - DNA, 21 bp, Homo sapiens
ctgtgacccccagctccggcc

SEQ ID NO: 5892579 - DNA, 22 bp, Homo sapiens
ctgtgacccccatgtccttgga

SEQ ID NO: 5892580 - DNA, 14 bp, Homo sapiens
ctgtgaccctcttt

SEQ ID NO: 5892581 - DNA, 15 bp, Homo sapiens
ctgtgaccctctttg

SEQ ID NO: 5892582 - DNA, 19 bp, Homo sapiens
ctgtgaccctctttgctga

SEQ ID NO: 5892583 - DNA, 15 bp, Homo sapiens
ctgtgaccctgggtc

SEQ ID NO: 5892584 - DNA, 22 bp, Homo sapiens
ctgtgaccggggtcctgaggct

SEQ ID NO: 5892585 - DNA, 16 bp, Homo sapiens
ctgtgacctaagaaca

SEQ ID NO: 5892586 - DNA, 17 bp, Homo sapiens
ctgtgacctaagaacaa

SEQ ID NO: 5892587 - DNA, 14 bp, Homo sapiens
ctgtgacctcaggc

SEQ ID NO: 5892588 - DNA, 22 bp, Homo sapiens
ctgtgacctcaggcactagcct

SEQ ID NO: 5892589 - DNA, 17 bp, Homo sapiens
ctgtgacctctcccctg

SEQ ID NO: 5892590 - DNA, 14 bp, Homo sapiens
ctgtgacctgctga

SEQ ID NO: 5892591 - DNA, 15 bp, Homo sapiens
ctgtgacctgctgag

SEQ ID NO: 5892592 - DNA, 19 bp, Homo sapiens
ctgtgacctgctgagctct

SEQ ID NO: 5892593 - DNA, 13 bp, Homo sapiens
ctgtgacctggtc

SEQ ID NO: 5892594 - DNA, 20 bp, Homo sapiens
ctgtgacctgtcagaataaa

SEQ ID NO: 5892595 - DNA, 16 bp, Homo sapiens
ctgtgacctgtgggga

SEQ ID NO: 5892596 - DNA, 18 bp, Homo sapiens
ctgtgacgcagacagagg

SEQ ID NO: 5892597 - DNA, 16 bp, Homo sapiens
ctgtgactataaagct

SEQ ID NO: 5892598 - DNA, 17 bp, Homo sapiens
ctgtgactataaagctg

SEQ ID NO: 5892599 - DNA, 18 bp, Homo sapiens
ctgtgactataaagctgt

SEQ ID NO: 5892600 - DNA, 15 bp, Homo sapiens
ctgtgactcctccct

SEQ ID NO: 5892601 - DNA, 22 bp, Homo sapiens
ctgtgactcctcccttccccac

SEQ ID NO: 5892602 - DNA, 21 bp, Homo sapiens
ctgtgactcctgttgccatgg

SEQ ID NO: 5892603 - DNA, 22 bp, Homo sapiens
ctgtgactcctgttgccatgga

SEQ ID NO: 5892604 - DNA, 22 bp, Homo sapiens
ctgtgactcttagccctcacca

SEQ ID NO: 5892605 - DNA, 15 bp, Homo sapiens
ctgtgactcttctct

SEQ ID NO: 5892606 - DNA, 14 bp, Homo sapiens
ctgtgactgagggc

SEQ ID NO: 5892607 - DNA, 22 bp, Homo sapiens
ctgtgactgatgttaggctggg

SEQ ID NO: 5892608 - DNA, 16 bp, Homo sapiens
ctgtgactgtgtcccc

SEQ ID NO: 5892609 - DNA, 18 bp, Homo sapiens
ctgtgacttatctaccat

SEQ ID NO: 5892610 - DNA, 14 bp, Homo sapiens
ctgtgagaactgtg

SEQ ID NO: 5892611 - DNA, 19 bp, Homo sapiens
ctgtgagaaggtttattgt

SEQ ID NO: 5892612 - DNA, 22 bp, Homo sapiens
ctgtgagaaggtttattgttaa

SEQ ID NO: 5892613 - DNA, 17 bp, Homo sapiens
ctgtgagaagtcactca

SEQ ID NO: 5892614 - DNA, 13 bp, Homo sapiens
ctgtgagaagttt

SEQ ID NO: 5892615 - DNA, 18 bp, Homo sapiens
ctgtgagaatagtggagg

SEQ ID NO: 5892616 - DNA, 12 bp, Homo sapiens
ctgtgagacagt

SEQ ID NO: 5892617 - DNA, 20 bp, Homo sapiens
ctgtgagacccccacacctc

SEQ ID NO: 5892618 - DNA, 17 bp, Homo sapiens
ctgtgagacgaggcagg

SEQ ID NO: 5892619 - DNA, 20 bp, Homo sapiens
ctgtgagactcgagaacttt

SEQ ID NO: 5892620 - DNA, 22 bp, Homo sapiens
ctgtgagagagttgctcctcag

SEQ ID NO: 5892621 - DNA, 20 bp, Homo sapiens
ctgtgagagccacgctggcc

SEQ ID NO: 5892622 - DNA, 16 bp, Homo sapiens
ctgtgagaggcagcta

SEQ ID NO: 5892623 - DNA, 17 bp, Homo sapiens
ctgtgagagttgtctct

SEQ ID NO: 5892624 - DNA, 19 bp, Homo sapiens
ctgtgagataaatatcatt

SEQ ID NO: 5892625 - DNA, 21 bp, Homo sapiens
ctgtgagataaatatcattat

SEQ ID NO: 5892626 - DNA, 15 bp, Homo sapiens
ctgtgagatggatgt

SEQ ID NO: 5892627 - DNA, 19 bp, Homo sapiens
ctgtgagatggatgtattt

SEQ ID NO: 5892628 - DNA, 21 bp, Homo sapiens
ctgtgagatggatgtatttgt

SEQ ID NO: 5892629 - DNA, 22 bp, Homo sapiens
ctgtgagatggctggctggtga

SEQ ID NO: 5892630 - DNA, 15 bp, Homo sapiens
ctgtgagcaaagtgc

SEQ ID NO: 5892631 - DNA, 15 bp, Homo sapiens
ctgtgagcaagagcc

SEQ ID NO: 5892632 - DNA, 23 bp, Homo sapiens
ctgtgagcacaaagaagaaagct

SEQ ID NO: 5892633 - DNA, 16 bp, Homo sapiens
ctgtgagcagcctcca

SEQ ID NO: 5892634 - DNA, 17 bp, Homo sapiens
ctgtgagcagcctccac

SEQ ID NO: 5892635 - DNA, 19 bp, Homo sapiens
ctgtgagcagcctccactg

SEQ ID NO: 5892636 - DNA, 14 bp, Homo sapiens
ctgtgagccagtct

SEQ ID NO: 5892637 - DNA, 18 bp, Homo sapiens
ctgtgagccatgcctccc

SEQ ID NO: 5892638 - DNA, 21 bp, Homo sapiens
ctgtgagccatgcctccctgg

SEQ ID NO: 5892639 - DNA, 16 bp, Homo sapiens
ctgtgagccccacagc

SEQ ID NO: 5892640 - DNA, 20 bp, Homo sapiens
ctgtgagccccacagccctg

SEQ ID NO: 5892641 - DNA, 18 bp, Homo sapiens
ctgtgagccgccaggaac

SEQ ID NO: 5892642 - DNA, 17 bp, Homo sapiens
ctgtgagccttgcatga

SEQ ID NO: 5892643 - DNA, 15 bp, Homo sapiens
ctgtgagccttggct

SEQ ID NO: 5892644 - DNA, 14 bp, Homo sapiens
ctgtgagctcccca

SEQ ID NO: 5892645 - DNA, 22 bp, Homo sapiens
ctgtgagctccccaatccaacc

SEQ ID NO: 5892646 - DNA, 12 bp, Homo sapiens
ctgtgaggaaga

SEQ ID NO: 5892647 - DNA, 13 bp, Homo sapiens
ctgtgaggaagag

SEQ ID NO: 5892648 - DNA, 17 bp, Homo sapiens
ctgtgaggaagaggttg

SEQ ID NO: 5892649 - DNA, 20 bp, Homo sapiens
ctgtgaggaagaggttgcag

SEQ ID NO: 5892650 - DNA, 17 bp, Homo sapiens
ctgtgaggacagggccc

SEQ ID NO: 5892651 - DNA, 13 bp, Homo sapiens
ctgtgaggactgg

SEQ ID NO: 5892652 - DNA, 18 bp, Homo sapiens
ctgtgaggatagagactt

SEQ ID NO: 5892653 - DNA, 23 bp, Homo sapiens
ctgtgaggccatacttgtgaaac

SEQ ID NO: 5892654 - DNA, 18 bp, Homo sapiens
ctgtgaggcccctggaca

SEQ ID NO: 5892655 - DNA, 17 bp, Homo sapiens
ctgtgaggcggcagctg

SEQ ID NO: 5892656 - DNA, 19 bp, Homo sapiens
ctgtgaggcgggtggctgg

SEQ ID NO: 5892657 - DNA, 13 bp, Homo sapiens
ctgtgctctggca

SEQ ID NO: 5892658 - DNA, 21 bp, Homo sapiens
ctgtgctctggcaccatcagc

SEQ ID NO: 5892659 - DNA, 18 bp, Homo sapiens
ctgtgctctggggatttc

SEQ ID NO: 5892660 - DNA, 22 bp, Homo sapiens
ctgtgctctggggatttctggg

SEQ ID NO: 5892661 - DNA, 17 bp, Homo sapiens
ctgtgctcttcctctgg

SEQ ID NO: 5892662 - DNA, 16 bp, Homo sapiens
ctgtgctcttttggtg

SEQ ID NO: 5892663 - DNA, 13 bp, Homo sapiens
ctgtgctgaggcc

SEQ ID NO: 5892664 - DNA, 16 bp, Homo sapiens
ctgtgctgaggcctta

SEQ ID NO: 5892665 - DNA, 12 bp, Homo sapiens
ctgtgctgagtc

SEQ ID NO: 5892666 - DNA, 16 bp, Homo sapiens
ctgtgctgatcctgct

SEQ ID NO: 5892667 - DNA, 17 bp, Homo sapiens
ctgtgctgatcctgctg

SEQ ID NO: 5892668 - DNA, 18 bp, Homo sapiens
ctgtgctgatcctgctga

SEQ ID NO: 5892669 - DNA, 19 bp, Homo sapiens
ctgtgctgcatgcgacagc

SEQ ID NO: 5892670 - DNA, 18 bp, Homo sapiens
ctgtgctgccctgcccac

SEQ ID NO: 5892671 - DNA, 22 bp, Homo sapiens
ctgtgctgccctgctctgggga

SEQ ID NO: 5892672 - DNA, 13 bp, Homo sapiens
ctgtgctgctgca

SEQ ID NO: 5892673 - DNA, 20 bp, Homo sapiens
ctgtgctgctgttactgtta

SEQ ID NO: 5892674 - DNA, 21 bp, Homo sapiens
ctgtgctgcttttgagcctca

SEQ ID NO: 5892675 - DNA, 20 bp, Homo sapiens
ctgtgctggaattccacagg

SEQ ID NO: 5892676 - DNA, 22 bp, Homo sapiens
ctgtgctggaccagctggcctg

SEQ ID NO: 5892677 - DNA, 21 bp, Homo sapiens
ctgtgctggactttaaaaaaa

SEQ ID NO: 5892678 - DNA, 22 bp, Homo sapiens
ctgtgctggactttaaaaaaac

SEQ ID NO: 5892679 - DNA, 14 bp, Homo sapiens
ctgtgctggagaat

SEQ ID NO: 5892680 - DNA, 13 bp, Homo sapiens
ctgtgctggagcc

SEQ ID NO: 5892681 - DNA, 22 bp, Homo sapiens
ctgtgctgggaagcccggactg

SEQ ID NO: 5892682 - DNA, 19 bp, Homo sapiens
ctgtgctgggaggtcccag

SEQ ID NO: 5892683 - DNA, 14 bp, Homo sapiens
ctgtgctgggccag

SEQ ID NO: 5892684 - DNA, 21 bp, Homo sapiens
ctgtgctgggccagtggctgg

SEQ ID NO: 5892685 - DNA, 13 bp, Homo sapiens
ctgtgctggggca

SEQ ID NO: 5892686 - DNA, 13 bp, Homo sapiens
ctgtgctggggga

SEQ ID NO: 5892687 - DNA, 19 bp, Homo sapiens
ctgtgctggtattggaata

SEQ ID NO: 5892688 - DNA, 17 bp, Homo sapiens
ctgtgctggtctctagg

SEQ ID NO: 5892689 - DNA, 20 bp, Homo sapiens
ctgtgctggtctctaggcct

SEQ ID NO: 5892690 - DNA, 12 bp, Homo sapiens
ctgtgctggtga

SEQ ID NO: 5892691 - DNA, 21 bp, Homo sapiens
ctgtgctggtgtcctgaccac

SEQ ID NO: 5892692 - DNA, 14 bp, Homo sapiens
ctgtgctgtgcctg

SEQ ID NO: 5892693 - DNA, 15 bp, Homo sapiens
ctgtgctgtgcctgc

SEQ ID NO: 5892694 - DNA, 17 bp, Homo sapiens
ctgtgctgtgcctgcta

SEQ ID NO: 5892695 - DNA, 18 bp, Homo sapiens
ctgtgctgtgcctgctag

SEQ ID NO: 5892696 - DNA, 17 bp, Homo sapiens
ctgtgctgtgtttaatc

SEQ ID NO: 5892697 - DNA, 16 bp, Homo sapiens
ctgtgctgttgtctgc

SEQ ID NO: 5892698 - DNA, 19 bp, Homo sapiens
ctgtgctgtttcaaagttc

SEQ ID NO: 5892699 - DNA, 14 bp, Homo sapiens
ctgtgcttaattta

SEQ ID NO: 5892700 - DNA, 13 bp, Homo sapiens
ctgtgcttacagt

SEQ ID NO: 5892701 - DNA, 18 bp, Homo sapiens
ctgtgcttcaattaataa

SEQ ID NO: 5892702 - DNA, 17 bp, Homo sapiens
ctgtgcttcctcctgcc

SEQ ID NO: 5892703 - DNA, 14 bp, Homo sapiens
ctgtgcttccttgg

SEQ ID NO: 5892704 - DNA, 17 bp, Homo sapiens
ctgtgcttcgactactg

SEQ ID NO: 5892705 - DNA, 21 bp, Homo sapiens
ctgtgcttcgactactgctcc

SEQ ID NO: 5892706 - DNA, 22 bp, Homo sapiens
ctgtgcttcgactactgctcct

SEQ ID NO: 5892707 - DNA, 19 bp, Homo sapiens
ctgtgcttcgggcccttcc

SEQ ID NO: 5892708 - DNA, 21 bp, Homo sapiens
ctgtgcttcgggcccttccca

SEQ ID NO: 5892709 - DNA, 22 bp, Homo sapiens
ctgtgcttctctatgataatta

SEQ ID NO: 5892710 - DNA, 15 bp, Homo sapiens
ctgtgcttgaaggcc

SEQ ID NO: 5892711 - DNA, 16 bp, Homo sapiens
ctgtgcttgaaggccc

SEQ ID NO: 5892712 - DNA, 20 bp, Homo sapiens
ctgtgcttgaaggccctgct

SEQ ID NO: 5892713 - DNA, 14 bp, Homo sapiens
ctgtgcttgctcct

SEQ ID NO: 5892714 - DNA, 12 bp, Homo sapiens
ctgtgcttggag

SEQ ID NO: 5892715 - DNA, 17 bp, Homo sapiens
ctgtgcttggaggcctc

SEQ ID NO: 5892716 - DNA, 18 bp, Homo sapiens
ctgtgcttggaggcctca

SEQ ID NO: 5892717 - DNA, 20 bp, Homo sapiens
ctgtgcttggaggcctcaga

SEQ ID NO: 5892718 - DNA, 15 bp, Homo sapiens
ctgtgctttccagct

SEQ ID NO: 5892719 - DNA, 16 bp, Homo sapiens
ctgtgctttccagctc

SEQ ID NO: 5892720 - DNA, 12 bp, Homo sapiens
ctgtgctttccg

SEQ ID NO: 5892721 - DNA, 12 bp, Homo sapiens
ctgtgctttcta

SEQ ID NO: 5892722 - DNA, 22 bp, Homo sapiens
ctgtgctttctattgtacagaa

SEQ ID NO: 5892723 - DNA, 14 bp, Homo sapiens
ctgtgctttctgca

SEQ ID NO: 5892724 - DNA, 18 bp, Homo sapiens
ctgtgctttctgcatgct

SEQ ID NO: 5892725 - DNA, 16 bp, Homo sapiens
ctgtgctttgactcac

SEQ ID NO: 5892726 - DNA, 12 bp, Homo sapiens
ctgtgctttgga

SEQ ID NO: 5892727 - DNA, 17 bp, Homo sapiens
ctgtgcttttaaatgca

SEQ ID NO: 5892728 - DNA, 19 bp, Homo sapiens
ctgtggaaaaatatttaag

SEQ ID NO: 5892729 - DNA, 19 bp, Homo sapiens
ctgtggaaaagaaacacgc

SEQ ID NO: 5892730 - DNA, 16 bp, Homo sapiens
ctgtggaaaagccatc

SEQ ID NO: 5892731 - DNA, 18 bp, Homo sapiens
ctgtggaaaagccatctc

SEQ ID NO: 5892732 - DNA, 19 bp, Homo sapiens
ctgtggaaaagccatctca

SEQ ID NO: 5892733 - DNA, 22 bp, Homo sapiens
ctgtggaaaagccatctcaggt

SEQ ID NO: 5892734 - DNA, 17 bp, Homo sapiens
ctgtggaaagtgtaaag

SEQ ID NO: 5892735 - DNA, 20 bp, Homo sapiens
ctgtggaaagtgtaaagcat

SEQ ID NO: 5892736 - DNA, 16 bp, Homo sapiens
ctgtggaaatatgcaa

SEQ ID NO: 5892737 - DNA, 17 bp, Homo sapiens
ctgtggaaatatgcaac

SEQ ID NO: 5892738 - DNA, 20 bp, Homo sapiens
ctgtggaaatatgcaacctg

SEQ ID NO: 5892739 - DNA, 21 bp, Homo sapiens
ctgtggaaatatgcaacctgt

SEQ ID NO: 5892740 - DNA, 21 bp, Homo sapiens
ctgtggaacataaaaaggaca

SEQ ID NO: 5892741 - DNA, 23 bp, Homo sapiens
ctgtggaacccagcagttctgtt

SEQ ID NO: 5892742 - DNA, 18 bp, Homo sapiens
ctgtggaactaataaata

SEQ ID NO: 5892743 - DNA, 19 bp, Homo sapiens
ctgtggaaggcagagaaat

SEQ ID NO: 5892744 - DNA, 15 bp, Homo sapiens
ctgtggaagtccctc

SEQ ID NO: 5892745 - DNA, 15 bp, Homo sapiens
ctgtggaataaagat

SEQ ID NO: 5892746 - DNA, 20 bp, Homo sapiens
ctgtggaataaagatggtcc

SEQ ID NO: 5892747 - DNA, 19 bp, Homo sapiens
ctgtggaatgagtgtgcat

SEQ ID NO: 5892748 - DNA, 19 bp, Homo sapiens
ctgtggacactgtggaaag

SEQ ID NO: 5892749 - DNA, 21 bp, Homo sapiens
ctgtggacaggatgaggacag

SEQ ID NO: 5892750 - DNA, 23 bp, Homo sapiens
ctgtggacaggatgaggacagag

SEQ ID NO: 5892751 - DNA, 16 bp, Homo sapiens
ctgtggaccctcgctc

SEQ ID NO: 5892752 - DNA, 18 bp, Homo sapiens
ctgtggaccctcgctctc

SEQ ID NO: 5892753 - DNA, 19 bp, Homo sapiens
ctgtggaccgtggacaggc

SEQ ID NO: 5892754 - DNA, 24 bp, Homo sapiens
ctgtggaccgtggacaggcccagc

SEQ ID NO: 5892755 - DNA, 13 bp, Homo sapiens
ctgtggactgtcc

SEQ ID NO: 5892756 - DNA, 22 bp, Homo sapiens
ctgtggactgtcctgaggagcc

SEQ ID NO: 5892757 - DNA, 14 bp, Homo sapiens
ctgtggagacactg

SEQ ID NO: 5892758 - DNA, 15 bp, Homo sapiens
ctgtggagacagccc

SEQ ID NO: 5892759 - DNA, 19 bp, Homo sapiens
ctgtggagacagccctgcc

SEQ ID NO: 5892760 - DNA, 20 bp, Homo sapiens
ctgtggagacagccctgcct

SEQ ID NO: 5892761 - DNA, 17 bp, Homo sapiens
ctgtggagactgctcct

SEQ ID NO: 5892762 - DNA, 21 bp, Homo sapiens
ctgtggagactgctcctgagc

SEQ ID NO: 5892763 - DNA, 14 bp, Homo sapiens
ctgtggagagaaag

SEQ ID NO: 5892764 - DNA, 16 bp, Homo sapiens
ctgtggagagtgagaa

SEQ ID NO: 5892765 - DNA, 21 bp, Homo sapiens
ctgtggagcaaaaggcagctc

SEQ ID NO: 5892766 - DNA, 22 bp, Homo sapiens
ctgtggagctccactgccatgt

SEQ ID NO: 5892767 - DNA, 11 bp, Homo sapiens
ctgtggagctg

SEQ ID NO: 5892768 - DNA, 16 bp, Homo sapiens
ctgtggagctgccaca

SEQ ID NO: 5892769 - DNA, 20 bp, Homo sapiens
ctgtggagctgccacagaga

SEQ ID NO: 5892770 - DNA, 23 bp, Homo sapiens
ctgtggagctgccacagagaagt

SEQ ID NO: 5892771 - DNA, 23 bp, Homo sapiens
ctgtggaggaaggattgtaaaaa

SEQ ID NO: 5892772 - DNA, 15 bp, Homo sapiens
ctgtggaggacagac

SEQ ID NO: 5892773 - DNA, 14 bp, Homo sapiens
ctgtggaggcctga

SEQ ID NO: 5892774 - DNA, 23 bp, Homo sapiens
ctgtggagggagggcagctggcc

SEQ ID NO: 5892775 - DNA, 17 bp, Homo sapiens
ctgtggaggggagctgc

SEQ ID NO: 5892776 - DNA, 16 bp, Homo sapiens
ctgtggaggggcttgg

SEQ ID NO: 5892777 - DNA, 16 bp, Homo sapiens
ctgtggagtccagctc

SEQ ID NO: 5892778 - DNA, 21 bp, Homo sapiens
ctgtggagtcccaaccccagc

SEQ ID NO: 5892779 - DNA, 21 bp, Homo sapiens
ctgtggagttcctgctccgtg

SEQ ID NO: 5892780 - DNA, 21 bp, Homo sapiens
ctgtggataaattttggaaga

SEQ ID NO: 5892781 - DNA, 17 bp, Homo sapiens
ctgtggatacagtgccc

SEQ ID NO: 5892782 - DNA, 18 bp, Homo sapiens
ctgtggatacagtgccca

SEQ ID NO: 5892783 - DNA, 19 bp, Homo sapiens
ctgtggatacagtgcccac

SEQ ID NO: 5892784 - DNA, 20 bp, Homo sapiens
ctgtggatacagtgcccacc

SEQ ID NO: 5892785 - DNA, 19 bp, Homo sapiens
ctgtggatgagccctcaga

SEQ ID NO: 5892786 - DNA, 18 bp, Homo sapiens
ctgtggatgctgctgccc

SEQ ID NO: 5892787 - DNA, 21 bp, Homo sapiens
ctgtggatgggaggggtcccc

SEQ ID NO: 5892788 - DNA, 19 bp, Homo sapiens
ctgtggatgggatcctctc

SEQ ID NO: 5892789 - DNA, 16 bp, Homo sapiens
ctgtggattctatatt

SEQ ID NO: 5892790 - DNA, 17 bp, Homo sapiens
ctgtggattctatattt

SEQ ID NO: 5892791 - DNA, 23 bp, Homo sapiens
ctgtggattttttccttcaaagt

SEQ ID NO: 5892792 - DNA, 13 bp, Homo sapiens
ctgtggcaaaaag

SEQ ID NO: 5892793 - DNA, 22 bp, Homo sapiens
ctgtggcaaaaagagtcagaca

SEQ ID NO: 5892794 - DNA, 22 bp, Homo sapiens
ctgtggcacagacttctggaag

SEQ ID NO: 5892795 - DNA, 18 bp, Homo sapiens
ctgtggcacagccctgag

SEQ ID NO: 5892796 - DNA, 21 bp, Homo sapiens
ctgtggcacagccctgagtgt

SEQ ID NO: 5892797 - DNA, 14 bp, Homo sapiens
ctgtggcactgcca

SEQ ID NO: 5892798 - DNA, 17 bp, Homo sapiens
ctgtggcactgccacca

SEQ ID NO: 5892799 - DNA, 23 bp, Homo sapiens
ctgtggcactgccaccagcaatg

SEQ ID NO: 5892800 - DNA, 21 bp, Homo sapiens
ctgtggcacttgcctgggtca

SEQ ID NO: 5892801 - DNA, 16 bp, Homo sapiens
ctgtggcagaaaagag

SEQ ID NO: 5892802 - DNA, 17 bp, Homo sapiens
ctgtggcagagttacag

SEQ ID NO: 5892803 - DNA, 18 bp, Homo sapiens
ctgtggcagagttacagt

SEQ ID NO: 5892804 - DNA, 19 bp, Homo sapiens
ctgtggcagagttacagtt

SEQ ID NO: 5892805 - DNA, 11 bp, Homo sapiens
ctgtggcagca

SEQ ID NO: 5892806 - DNA, 14 bp, Homo sapiens
ctgtggcagcagga

SEQ ID NO: 5892807 - DNA, 21 bp, Homo sapiens
ctgtggcagccgtcccaggcc

SEQ ID NO: 5892808 - DNA, 13 bp, Homo sapiens
ctgtggcagctgc

SEQ ID NO: 5892809 - DNA, 14 bp, Homo sapiens
ctgtggcagctgcc

SEQ ID NO: 5892810 - DNA, 21 bp, Homo sapiens
ctgtggcagctgcccctggca

SEQ ID NO: 5892811 - DNA, 17 bp, Homo sapiens
ctgtggcaggaggagct

SEQ ID NO: 5892812 - DNA, 18 bp, Homo sapiens
ctgtggcaggaggagctg

SEQ ID NO: 5892813 - DNA, 23 bp, Homo sapiens
ctgtggcaggcagcgccaagcaa

SEQ ID NO: 5892814 - DNA, 21 bp, Homo sapiens
ctgtggcaggcctaggacctc

SEQ ID NO: 5892815 - DNA, 21 bp, Homo sapiens
ctgtggcagtaaagagaaact

SEQ ID NO: 5892816 - DNA, 17 bp, Homo sapiens
ctgtggcataaattgca

SEQ ID NO: 5892817 - DNA, 13 bp, Homo sapiens
ctgtggccaaagg

SEQ ID NO: 5892818 - DNA, 18 bp, Homo sapiens
ctgtggccaagttcttag

SEQ ID NO: 5892819 - DNA, 15 bp, Homo sapiens
ctgtggccacagccc

SEQ ID NO: 5892820 - DNA, 18 bp, Homo sapiens
ctgtggccacagccccct

SEQ ID NO: 5892821 - DNA, 19 bp, Homo sapiens
ctgtggccacagccccctt

SEQ ID NO: 5892822 - DNA, 12 bp, Homo sapiens
ctgtggccagag

SEQ ID NO: 5892823 - DNA, 14 bp, Homo sapiens
ctgtggccagagca

SEQ ID NO: 5892824 - DNA, 17 bp, Homo sapiens
ctgtggccagagcacct

SEQ ID NO: 5892825 - DNA, 14 bp, Homo sapiens
ctgtggccagagct

SEQ ID NO: 5892826 - DNA, 19 bp, Homo sapiens
ctgtggccagcctggcatc

SEQ ID NO: 5892827 - DNA, 15 bp, Homo sapiens
ctgtggccagctgca

SEQ ID NO: 5892828 - DNA, 13 bp, Homo sapiens
ctgtggccaggag

SEQ ID NO: 5892829 - DNA, 16 bp, Homo sapiens
ctgtggccaggagccc

SEQ ID NO: 5892830 - DNA, 23 bp, Homo sapiens
ctgtggccatggtccccaagacc

SEQ ID NO: 5892831 - DNA, 12 bp, Homo sapiens
ctgtggcccagt

SEQ ID NO: 5892832 - DNA, 17 bp, Homo sapiens
ctgtggccccaccctgg

SEQ ID NO: 5892833 - DNA, 18 bp, Homo sapiens
ctgtggccccaccctggg

SEQ ID NO: 5892834 - DNA, 16 bp, Homo sapiens
ctgtgtccttcctcca

SEQ ID NO: 5892835 - DNA, 14 bp, Homo sapiens
ctgtgtccttgcac

SEQ ID NO: 5892836 - DNA, 19 bp, Homo sapiens
ctgtgtccttgcacctgca

SEQ ID NO: 5892837 - DNA, 22 bp, Homo sapiens
ctgtgtcggggggcgagggagg

SEQ ID NO: 5892838 - DNA, 12 bp, Homo sapiens
ctgtgtctaaac

SEQ ID NO: 5892839 - DNA, 15 bp, Homo sapiens
ctgtgtctaaactgc

SEQ ID NO: 5892840 - DNA, 16 bp, Homo sapiens
ctgtgtctaaactgca

SEQ ID NO: 5892841 - DNA, 13 bp, Homo sapiens
ctgtgtctcatgg

SEQ ID NO: 5892842 - DNA, 22 bp, Homo sapiens
ctgtgtctcatggtcccacttc

SEQ ID NO: 5892843 - DNA, 14 bp, Homo sapiens
ctgtgtctcccttc

SEQ ID NO: 5892844 - DNA, 15 bp, Homo sapiens
ctgtgtctcctctca

SEQ ID NO: 5892845 - DNA, 14 bp, Homo sapiens
ctgtgtctctatgt

SEQ ID NO: 5892846 - DNA, 15 bp, Homo sapiens
ctgtgtctctatgtg

SEQ ID NO: 5892847 - DNA, 18 bp, Homo sapiens
ctgtgtctctatgtgaat

SEQ ID NO: 5892848 - DNA, 13 bp, Homo sapiens
ctgtgtctctccc

SEQ ID NO: 5892849 - DNA, 23 bp, Homo sapiens
ctgtgtctctgtatatagctcta

SEQ ID NO: 5892850 - DNA, 17 bp, Homo sapiens
ctgtgtctcttttctct

SEQ ID NO: 5892851 - DNA, 18 bp, Homo sapiens
ctgtgtctgaatcatgtc

SEQ ID NO: 5892852 - DNA, 22 bp, Homo sapiens
ctgtgtctgaatcatgtctgta

SEQ ID NO: 5892853 - DNA, 11 bp, Homo sapiens
ctgtgtctgag

SEQ ID NO: 5892854 - DNA, 14 bp, Homo sapiens
ctgtgtctgagccc

SEQ ID NO: 5892855 - DNA, 16 bp, Homo sapiens
ctgtgtctgagcccaa

SEQ ID NO: 5892856 - DNA, 17 bp, Homo sapiens
ctgtgtctgagcccaac

SEQ ID NO: 5892857 - DNA, 18 bp, Homo sapiens
ctgtgtctgccaaacaca

SEQ ID NO: 5892858 - DNA, 21 bp, Homo sapiens
ctgtgtctgccaaacacattt

SEQ ID NO: 5892859 - DNA, 19 bp, Homo sapiens
ctgtgtctgcctgtcccca

SEQ ID NO: 5892860 - DNA, 16 bp, Homo sapiens
ctgtgtctgctctcat

SEQ ID NO: 5892861 - DNA, 14 bp, Homo sapiens
ctgtgtctgctgta

SEQ ID NO: 5892862 - DNA, 12 bp, Homo sapiens
ctgtgtctggca

SEQ ID NO: 5892863 - DNA, 13 bp, Homo sapiens
ctgtgtctggcag

SEQ ID NO: 5892864 - DNA, 15 bp, Homo sapiens
ctgtgtctggcaggc

SEQ ID NO: 5892865 - DNA, 13 bp, Homo sapiens
ctgtgtctggccc

SEQ ID NO: 5892866 - DNA, 15 bp, Homo sapiens
ctgtgtctggcccct

SEQ ID NO: 5892867 - DNA, 16 bp, Homo sapiens
ctgtgtctgtcacagg

SEQ ID NO: 5892868 - DNA, 16 bp, Homo sapiens
ctgtgtcttcattttc

SEQ ID NO: 5892869 - DNA, 20 bp, Homo sapiens
ctgtgtcttgcaatggcagc

SEQ ID NO: 5892870 - DNA, 20 bp, Homo sapiens
ctgtgtctttagacaaccct

SEQ ID NO: 5892871 - DNA, 12 bp, Homo sapiens
ctgtgtcttttt

SEQ ID NO: 5892872 - DNA, 13 bp, Homo sapiens
ctgtgtgaaaatg

SEQ ID NO: 5892873 - DNA, 18 bp, Homo sapiens
ctgtgtgaaacatggttg

SEQ ID NO: 5892874 - DNA, 20 bp, Homo sapiens
ctgtgtgaaactttcattcc

SEQ ID NO: 5892875 - DNA, 21 bp, Homo sapiens
ctgtgtgaaataccagtgtgg

SEQ ID NO: 5892876 - DNA, 17 bp, Homo sapiens
ctgtgtgaagaaagcct

SEQ ID NO: 5892877 - DNA, 14 bp, Homo sapiens
ctgtgtgaatgtgg

SEQ ID NO: 5892878 - DNA, 17 bp, Homo sapiens
ctgtgtgaatgtgggca

SEQ ID NO: 5892879 - DNA, 22 bp, Homo sapiens
ctgtgtgacatcacagggcctc

SEQ ID NO: 5892880 - DNA, 14 bp, Homo sapiens
ctgtgtgagagaga

SEQ ID NO: 5892881 - DNA, 15 bp, Homo sapiens
ctgtgtgagagagag

SEQ ID NO: 5892882 - DNA, 23 bp, Homo sapiens
ctgtgtgagaggggcgccttttc

SEQ ID NO: 5892883 - DNA, 21 bp, Homo sapiens
ctgtgtgagcgtgtccacaga

SEQ ID NO: 5892884 - DNA, 22 bp, Homo sapiens
ctgtgtgaggattaagggacgg

SEQ ID NO: 5892885 - DNA, 17 bp, Homo sapiens
ctgtgtgagtgagcaca

SEQ ID NO: 5892886 - DNA, 21 bp, Homo sapiens
ctgtgtgattgacagctttgc

SEQ ID NO: 5892887 - DNA, 21 bp, Homo sapiens
ctgtgtgcaactaactgactc

SEQ ID NO: 5892888 - DNA, 16 bp, Homo sapiens
ctgtgtgcacaaatat

SEQ ID NO: 5892889 - DNA, 13 bp, Homo sapiens
ctgtgtgcaccca

SEQ ID NO: 5892890 - DNA, 21 bp, Homo sapiens
ctgtgtgcaccttaccaactt

SEQ ID NO: 5892891 - DNA, 14 bp, Homo sapiens
ctgtgtgcagcaac

SEQ ID NO: 5892892 - DNA, 18 bp, Homo sapiens
ctgtgtgcagtctctctt

SEQ ID NO: 5892893 - DNA, 17 bp, Homo sapiens
ctgtgtgcagtgaaggt

SEQ ID NO: 5892894 - DNA, 17 bp, Homo sapiens
ctgtgtgcagtggagct

SEQ ID NO: 5892895 - DNA, 18 bp, Homo sapiens
ctgtgtgcagtggagctg

SEQ ID NO: 5892896 - DNA, 23 bp, Homo sapiens
ctgtgtgcagtggagctggcacc

SEQ ID NO: 5892897 - DNA, 12 bp, Homo sapiens
ctgtgtgcccaa

SEQ ID NO: 5892898 - DNA, 16 bp, Homo sapiens
ctgtgtgcccaagtgg

SEQ ID NO: 5892899 - DNA, 19 bp, Homo sapiens
ctgtgtgcccaagtgggca

SEQ ID NO: 5892900 - DNA, 23 bp, Homo sapiens
ctgtgtgcccaagtgggcagtca

SEQ ID NO: 5892901 - DNA, 18 bp, Homo sapiens
ctgtgtgcccagcacctg

SEQ ID NO: 5892902 - DNA, 19 bp, Homo sapiens
ctgtgtgcccagcacctgg

SEQ ID NO: 5892903 - DNA, 20 bp, Homo sapiens
ctgtgtgcccagcacctgga

SEQ ID NO: 5892904 - DNA, 13 bp, Homo sapiens
ctgtgtgccccac

SEQ ID NO: 5892905 - DNA, 14 bp, Homo sapiens
ctgtgtgccctagg

SEQ ID NO: 5892906 - DNA, 16 bp, Homo sapiens
ctgtgtgccctagggc

SEQ ID NO: 5892907 - DNA, 21 bp, Homo sapiens
ctgtgtgccctagggctcaga

SEQ ID NO: 5892908 - DNA, 17 bp, Homo sapiens
ctgtgtgccctgaaaat

SEQ ID NO: 5892909 - DNA, 18 bp, Homo sapiens
ctgtgtgcctgggggagt

SEQ ID NO: 5892910 - DNA, 14 bp, Homo sapiens
ctgtgtgccttcgc

SEQ ID NO: 5892911 - DNA, 17 bp, Homo sapiens
ctgtgtgcgagtctgag

SEQ ID NO: 5892912 - DNA, 21 bp, Homo sapiens
ctgtgtgcgtggcgtggcccg

SEQ ID NO: 5892913 - DNA, 19 bp, Homo sapiens
ctgtgtgcgtggtgtggcc

SEQ ID NO: 5892914 - DNA, 19 bp, Homo sapiens
ctgtgtgctactaacagat

SEQ ID NO: 5892915 - DNA, 20 bp, Homo sapiens
ctgtgtgctcaggagccctg

SEQ ID NO: 5892916 - DNA, 13 bp, Homo sapiens
ctgtgtgctgtaa

SEQ ID NO: 5892917 - DNA, 14 bp, Homo sapiens
ctgtgtgctgtttg

SEQ ID NO: 5892918 - DNA, 12 bp, Homo sapiens
ctgtgtgcttgt

SEQ ID NO: 5892919 - DNA, 15 bp, Homo sapiens
ctgtgtggaaccacc

SEQ ID NO: 5892920 - DNA, 17 bp, Homo sapiens
ctgtgtggatgctgagc

SEQ ID NO: 5892921 - DNA, 20 bp, Homo sapiens
ctgtgtggatgctgagctgt

SEQ ID NO: 5892922 - DNA, 13 bp, Homo sapiens
ctgtgtggcaaac

SEQ ID NO: 5892923 - DNA, 16 bp, Homo sapiens
ctgtgtggcaaacatt

SEQ ID NO: 5892924 - DNA, 14 bp, Homo sapiens
ctgtgtggccaacc

SEQ ID NO: 5892925 - DNA, 21 bp, Homo sapiens
ctgtgtggccaaccaggaccc

SEQ ID NO: 5892926 - DNA, 22 bp, Homo sapiens
ctgtgtggccaaccaggaccca

SEQ ID NO: 5892927 - DNA, 21 bp, Homo sapiens
ctgtgtggcccagttctgaaa

SEQ ID NO: 5892928 - DNA, 16 bp, Homo sapiens
ctgtgtggccctggac

SEQ ID NO: 5892929 - DNA, 19 bp, Homo sapiens
ctgtgtggccctggacaag

SEQ ID NO: 5892930 - DNA, 19 bp, Homo sapiens
ctgtgtgggactgtacaca

SEQ ID NO: 5892931 - DNA, 21 bp, Homo sapiens
ctgtgtgggactgtacacact

SEQ ID NO: 5892932 - DNA, 15 bp, Homo sapiens
ctgtgtgggatactt

SEQ ID NO: 5892933 - DNA, 20 bp, Homo sapiens
ctgtgtgggatacttagtgg

SEQ ID NO: 5892934 - DNA, 14 bp, Homo sapiens
ctgtgtgggctgca

SEQ ID NO: 5892935 - DNA, 23 bp, Homo sapiens
ctgtgtgggctgcagatttcctg

SEQ ID NO: 5892936 - DNA, 16 bp, Homo sapiens
ctgtgtgggtctgggg

SEQ ID NO: 5892937 - DNA, 19 bp, Homo sapiens
ctgtgtgggtctggggagg

SEQ ID NO: 5892938 - DNA, 16 bp, Homo sapiens
ctgtgtggtctccagc

SEQ ID NO: 5892939 - DNA, 18 bp, Homo sapiens
ctgtgtggtctccagctc

SEQ ID NO: 5892940 - DNA, 18 bp, Homo sapiens
ctgtgtggtgcattcctg

SEQ ID NO: 5892941 - DNA, 22 bp, Homo sapiens
ctgtgtggtgcattcctgaagt

SEQ ID NO: 5892942 - DNA, 20 bp, Homo sapiens
ctgtgtggtttagtgtaaaa

SEQ ID NO: 5892943 - DNA, 12 bp, Homo sapiens
ctgtgtggtttg

SEQ ID NO: 5892944 - DNA, 16 bp, Homo sapiens
ctgtgtgtacatgtac

SEQ ID NO: 5892945 - DNA, 13 bp, Homo sapiens
ctgtgtgtacctg

SEQ ID NO: 5892946 - DNA, 19 bp, Homo sapiens
ctgtgtgtatattgagaat

SEQ ID NO: 5892947 - DNA, 18 bp, Homo sapiens
ctgtgtgtcagttttcat

SEQ ID NO: 5892948 - DNA, 15 bp, Homo sapiens
ctgtgtgtccaaaac

SEQ ID NO: 5892949 - DNA, 19 bp, Homo sapiens
ctgtgtgtccaaaactgcc

SEQ ID NO: 5892950 - DNA, 14 bp, Homo sapiens
ctgtgtgtctccat

SEQ ID NO: 5892951 - DNA, 12 bp, Homo sapiens
ctgtgtgtctgg

SEQ ID NO: 5892952 - DNA, 16 bp, Homo sapiens
ctgtgtgtctggtggg

SEQ ID NO: 5892953 - DNA, 13 bp, Homo sapiens
ctgtgtgtctgtc

SEQ ID NO: 5892954 - DNA, 18 bp, Homo sapiens
ctgtgtgtcttctgcccc

SEQ ID NO: 5892955 - DNA, 12 bp, Homo sapiens
ctgtgtgtgaat

SEQ ID NO: 5892956 - DNA, 13 bp, Homo sapiens
ctgtgtgtgaatt

SEQ ID NO: 5892957 - DNA, 14 bp, Homo sapiens
ctgtgtgtgacacc

SEQ ID NO: 5892958 - DNA, 19 bp, Homo sapiens
ctgtgtgtgacaccaccac

SEQ ID NO: 5892959 - DNA, 23 bp, Homo sapiens
ctgtgtgtgacaccaccactgtg

SEQ ID NO: 5892960 - DNA, 20 bp, Homo sapiens
ctgtgtgtgacccctcctgg

SEQ ID NO: 5892961 - DNA, 13 bp, Homo sapiens
ctgtgtgtgagct

SEQ ID NO: 5892962 - DNA, 16 bp, Homo sapiens
ctgtgtgtgagtgtga

SEQ ID NO: 5892963 - DNA, 17 bp, Homo sapiens
ctgtgtgtgatgtgcat

SEQ ID NO: 5892964 - DNA, 18 bp, Homo sapiens
ctgtgtgtgccctctggg

SEQ ID NO: 5892965 - DNA, 19 bp, Homo sapiens
ctgtgtgtgccctctgggc

SEQ ID NO: 5892966 - DNA, 20 bp, Homo sapiens
ctgtgtgtgccctctgggct

SEQ ID NO: 5892967 - DNA, 23 bp, Homo sapiens
ctgtgtgtgccctctgggctctg

SEQ ID NO: 5892968 - DNA, 14 bp, Homo sapiens
ctgtgtgtgccctg

SEQ ID NO: 5892969 - DNA, 13 bp, Homo sapiens
ctgtgtgtggaaa

SEQ ID NO: 5892970 - DNA, 20 bp, Homo sapiens
ctgtgtgtggggcccaagca

SEQ ID NO: 5892971 - DNA, 16 bp, Homo sapiens
ctgtgtgtgggtgggg

SEQ ID NO: 5892972 - DNA, 15 bp, Homo sapiens
ctgtgtgtgtatgag

SEQ ID NO: 5892973 - DNA, 12 bp, Homo sapiens
ctgtgtgtgtga

SEQ ID NO: 5892974 - DNA, 20 bp, Homo sapiens
ctgtgtgtgtgtatgtgggg

SEQ ID NO: 5892975 - DNA, 23 bp, Homo sapiens
ctgtgtgtgtgtgtgtgcgtgtg

SEQ ID NO: 5892976 - DNA, 13 bp, Homo sapiens
ctgtgtgtgttct

SEQ ID NO: 5892977 - DNA, 20 bp, Homo sapiens
ctgtgtgtgttcttcaagcc

SEQ ID NO: 5892978 - DNA, 23 bp, Homo sapiens
ctgtgtgtgttcttcaagccagc

SEQ ID NO: 5892979 - DNA, 17 bp, Homo sapiens
ctgtgtgttaaaatgag

SEQ ID NO: 5892980 - DNA, 16 bp, Homo sapiens
ctgtgtgttagttccc

SEQ ID NO: 5892981 - DNA, 12 bp, Homo sapiens
ctgtgtgttcct

SEQ ID NO: 5892982 - DNA, 13 bp, Homo sapiens
ctgtgtgttcctg

SEQ ID NO: 5892983 - DNA, 17 bp, Homo sapiens
ctgtgtgttcttttgat

SEQ ID NO: 5892984 - DNA, 16 bp, Homo sapiens
ctgtgtgttgacactg

SEQ ID NO: 5892985 - DNA, 19 bp, Homo sapiens
ctgtgtgttgccacaggac

SEQ ID NO: 5892986 - DNA, 18 bp, Homo sapiens
ctgtgtgtttatgtgtgt

SEQ ID NO: 5892987 - DNA, 19 bp, Homo sapiens
ctgtgtgttttcataataa

SEQ ID NO: 5892988 - DNA, 13 bp, Homo sapiens
ctgtgttaaacac

SEQ ID NO: 5892989 - DNA, 15 bp, Homo sapiens
ctgtgttacccaggc

SEQ ID NO: 5892990 - DNA, 21 bp, Homo sapiens
ctgtgttacccaggctggtct

SEQ ID NO: 5892991 - DNA, 14 bp, Homo sapiens
ctgtgttactgctt

SEQ ID NO: 5892992 - DNA, 15 bp, Homo sapiens
ctgtgttactgcttt

SEQ ID NO: 5892993 - DNA, 22 bp, Homo sapiens
ctgtgttactgctttgcaaaga

SEQ ID NO: 5892994 - DNA, 12 bp, Homo sapiens
ctgtgttacttg

SEQ ID NO: 5892995 - DNA, 15 bp, Homo sapiens
ctgtgttacttgaag

SEQ ID NO: 5892996 - DNA, 17 bp, Homo sapiens
ctgtgttacttgaagta

SEQ ID NO: 5892997 - DNA, 18 bp, Homo sapiens
ctgtgttacttgaagtaa

SEQ ID NO: 5892998 - DNA, 19 bp, Homo sapiens
ctgtgttacttgaagtaac

SEQ ID NO: 5892999 - DNA, 22 bp, Homo sapiens
ctgtgttaggatgcggctttct

SEQ ID NO: 5893000 - DNA, 16 bp, Homo sapiens
ctgtgttagtgtctgt

SEQ ID NO: 5893001 - DNA, 18 bp, Homo sapiens
ctgtgttagtgtctgtcc

SEQ ID NO: 5893002 - DNA, 17 bp, Homo sapiens
ctgtgttatgcaaaagc

SEQ ID NO: 5893003 - DNA, 23 bp, Homo sapiens
ctgtgttattatagagcagaaat

SEQ ID NO: 5893004 - DNA, 22 bp, Homo sapiens
ctgtgttatttggaccactcca

SEQ ID NO: 5893005 - DNA, 16 bp, Homo sapiens
ctgtgttcaatattta

SEQ ID NO: 5893006 - DNA, 15 bp, Homo sapiens
ctgtgttcagtgcct

SEQ ID NO: 5893007 - DNA, 16 bp, Homo sapiens
ctgtgttcagtgcctt

SEQ ID NO: 5893008 - DNA, 23 bp, Homo sapiens
ctgtgttcattcttaccgagaaa

SEQ ID NO: 5893009 - DNA, 16 bp, Homo sapiens
ctgtgttcccagaggc

SEQ ID NO: 5893010 - DNA, 13 bp, Homo sapiens
ctgtgttcctggc

SEQ ID NO: 5893011 - DNA, 23 bp, Homo sapiens
ctgtgttcgggggagcagagaga

SEQ ID NO: 5893012 - DNA, 17 bp, Homo sapiens
ctgtgttctatgcaaag

SEQ ID NO: 5893013 - DNA, 13 bp, Homo sapiens
ctgttatgctgtt

SEQ ID NO: 5893014 - DNA, 19 bp, Homo sapiens
ctgttatgctgtttcctag

SEQ ID NO: 5893015 - DNA, 12 bp, Homo sapiens
ctgttatgtact

SEQ ID NO: 5893016 - DNA, 16 bp, Homo sapiens
ctgttatgtactgtac

SEQ ID NO: 5893017 - DNA, 12 bp, Homo sapiens
ctgttatgtcat

SEQ ID NO: 5893018 - DNA, 20 bp, Homo sapiens
ctgttatgtctgtttaagaa

SEQ ID NO: 5893019 - DNA, 22 bp, Homo sapiens
ctgttatgtctgtttaagaaaa

SEQ ID NO: 5893020 - DNA, 17 bp, Homo sapiens
ctgttattatgaaggaa

SEQ ID NO: 5893021 - DNA, 14 bp, Homo sapiens
ctgttattctttgc

SEQ ID NO: 5893022 - DNA, 16 bp, Homo sapiens
ctgttattgaaaatat

SEQ ID NO: 5893023 - DNA, 20 bp, Homo sapiens
ctgttattgccaatgttcct

SEQ ID NO: 5893024 - DNA, 18 bp, Homo sapiens
ctgttattgttttgttaa

SEQ ID NO: 5893025 - DNA, 21 bp, Homo sapiens
ctgttattgttttgttaacaa

SEQ ID NO: 5893026 - DNA, 20 bp, Homo sapiens
ctgttatttataatcacttt

SEQ ID NO: 5893027 - DNA, 21 bp, Homo sapiens
ctgttatttatccctcattca

SEQ ID NO: 5893028 - DNA, 22 bp, Homo sapiens
ctgttatttatccctcattcat

SEQ ID NO: 5893029 - DNA, 15 bp, Homo sapiens
ctgttatttatttca

SEQ ID NO: 5893030 - DNA, 16 bp, Homo sapiens
ctgttatttctatttt

SEQ ID NO: 5893031 - DNA, 18 bp, Homo sapiens
ctgttatttcttccctgc

SEQ ID NO: 5893032 - DNA, 19 bp, Homo sapiens
ctgttattttttatttcca

SEQ ID NO: 5893033 - DNA, 18 bp, Homo sapiens
ctgttcaaagatgcattt

SEQ ID NO: 5893034 - DNA, 16 bp, Homo sapiens
ctgttcaaagctgcct

SEQ ID NO: 5893035 - DNA, 23 bp, Homo sapiens
ctgttcaacaatcagtcatcatg

SEQ ID NO: 5893036 - DNA, 21 bp, Homo sapiens
ctgttcaagagcacacttggc

SEQ ID NO: 5893037 - DNA, 14 bp, Homo sapiens
ctgttcaagcaaaa

SEQ ID NO: 5893038 - DNA, 18 bp, Homo sapiens
ctgttcaagtgtccccag

SEQ ID NO: 5893039 - DNA, 17 bp, Homo sapiens
ctgttcaatgtttaatg

SEQ ID NO: 5893040 - DNA, 22 bp, Homo sapiens
ctgttcaatgtttttaaaaatc

SEQ ID NO: 5893041 - DNA, 12 bp, Homo sapiens
ctgttcacagcc

SEQ ID NO: 5893042 - DNA, 16 bp, Homo sapiens
ctgttcacagcttttc

SEQ ID NO: 5893043 - DNA, 19 bp, Homo sapiens
ctgttcacagtctctggaa

SEQ ID NO: 5893044 - DNA, 18 bp, Homo sapiens
ctgttcaccttatgtatt

SEQ ID NO: 5893045 - DNA, 19 bp, Homo sapiens
ctgttcaccttatgtatta

SEQ ID NO: 5893046 - DNA, 15 bp, Homo sapiens
ctgttcacgctcacc

SEQ ID NO: 5893047 - DNA, 21 bp, Homo sapiens
ctgttcacgctcacccagtca

SEQ ID NO: 5893048 - DNA, 15 bp, Homo sapiens
ctgttcacggcagac

SEQ ID NO: 5893049 - DNA, 18 bp, Homo sapiens
ctgttcacggtgacacag

SEQ ID NO: 5893050 - DNA, 22 bp, Homo sapiens
ctgttcacggtgacacaggtca

SEQ ID NO: 5893051 - DNA, 15 bp, Homo sapiens
ctgttcacgtgactc

SEQ ID NO: 5893052 - DNA, 21 bp, Homo sapiens
ctgttcacgtgactcctcaat

SEQ ID NO: 5893053 - DNA, 16 bp, Homo sapiens
ctgttcactgcattca

SEQ ID NO: 5893054 - DNA, 18 bp, Homo sapiens
ctgttcagatgtgcattt

SEQ ID NO: 5893055 - DNA, 14 bp, Homo sapiens
ctgttcagattaaa

SEQ ID NO: 5893056 - DNA, 13 bp, Homo sapiens
ctgttcagcaaac

SEQ ID NO: 5893057 - DNA, 15 bp, Homo sapiens
ctgttcagcaaacta

SEQ ID NO: 5893058 - DNA, 12 bp, Homo sapiens
ctgttcagcatt

SEQ ID NO: 5893059 - DNA, 13 bp, Homo sapiens
ctgttcagctcca

SEQ ID NO: 5893060 - DNA, 15 bp, Homo sapiens
ctgttcagctccagc

SEQ ID NO: 5893061 - DNA, 22 bp, Homo sapiens
ctgttcagctccagctcaccag

SEQ ID NO: 5893062 - DNA, 12 bp, Homo sapiens
ctgttcagctgg

SEQ ID NO: 5893063 - DNA, 17 bp, Homo sapiens
ctgttcagcttttattc

SEQ ID NO: 5893064 - DNA, 23 bp, Homo sapiens
ctgttcaggagtccaaaccttct

SEQ ID NO: 5893065 - DNA, 16 bp, Homo sapiens
ctgttcagtgtcccgg

SEQ ID NO: 5893066 - DNA, 12 bp, Homo sapiens
ctgttcagttac

SEQ ID NO: 5893067 - DNA, 17 bp, Homo sapiens
ctgttcagttacagaaa

SEQ ID NO: 5893068 - DNA, 18 bp, Homo sapiens
ctgttcagttacagaaag

SEQ ID NO: 5893069 - DNA, 19 bp, Homo sapiens
ctgttcagttacagaaagt

SEQ ID NO: 5893070 - DNA, 17 bp, Homo sapiens
ctgttcagtttccccat

SEQ ID NO: 5893071 - DNA, 21 bp, Homo sapiens
ctgttcataaaacggtgcttt

SEQ ID NO: 5893072 - DNA, 21 bp, Homo sapiens
ctgttcatcaccagtctgtaa

SEQ ID NO: 5893073 - DNA, 14 bp, Homo sapiens
ctgttcatctcttt

SEQ ID NO: 5893074 - DNA, 17 bp, Homo sapiens
ctgttcatgaaagattc

SEQ ID NO: 5893075 - DNA, 18 bp, Homo sapiens
ctgttcatgaaagattca

SEQ ID NO: 5893076 - DNA, 23 bp, Homo sapiens
ctgttcatgaaagattcaatgcc

SEQ ID NO: 5893077 - DNA, 16 bp, Homo sapiens
ctgttcatgacagcta

SEQ ID NO: 5893078 - DNA, 15 bp, Homo sapiens
ctgttcatgctccaa

SEQ ID NO: 5893079 - DNA, 22 bp, Homo sapiens
ctgttcatggcaagtggggctg

SEQ ID NO: 5893080 - DNA, 22 bp, Homo sapiens
ctgttcatggggtttttgccct

SEQ ID NO: 5893081 - DNA, 19 bp, Homo sapiens
ctgttcatgtgcctctgcg

SEQ ID NO: 5893082 - DNA, 12 bp, Homo sapiens
ctgttcattgta

SEQ ID NO: 5893083 - DNA, 13 bp, Homo sapiens
ctgttcatttcca

SEQ ID NO: 5893084 - DNA, 18 bp, Homo sapiens
ctgttccaaagccagtga

SEQ ID NO: 5893085 - DNA, 11 bp, Homo sapiens
ctgttccaaat

SEQ ID NO: 5893086 - DNA, 14 bp, Homo sapiens
ctgttccaaattca

SEQ ID NO: 5893087 - DNA, 17 bp, Homo sapiens
ctgttccaaattcagtt

SEQ ID NO: 5893088 - DNA, 16 bp, Homo sapiens
ctgttccaacctcctg

SEQ ID NO: 5893089 - DNA, 18 bp, Homo sapiens
ctgttccaacctcctgct

SEQ ID NO: 5893090 - DNA, 10 bp, Homo sapiens
ctgttccaag

SEQ ID NO: 5893091 - DNA, 17 bp, Homo sapiens
ctgttccaagtgtgtgt

SEQ ID NO: 5893092 - DNA, 19 bp, Homo sapiens
ctgttccaagtgtgtgtgc

SEQ ID NO: 5893093 - DNA, 12 bp, Homo sapiens
ctgttccacaaa

SEQ ID NO: 5893094 - DNA, 17 bp, Homo sapiens
ctgttccacaaagcagt

SEQ ID NO: 5893095 - DNA, 21 bp, Homo sapiens
ctgttccacacccaatgctgc

SEQ ID NO: 5893096 - DNA, 23 bp, Homo sapiens
ctgttccacacccaatgctgctc

SEQ ID NO: 5893097 - DNA, 19 bp, Homo sapiens
ctgttccaccaaatacaat

SEQ ID NO: 5893098 - DNA, 22 bp, Homo sapiens
ctgttccaccaaatacaattca

SEQ ID NO: 5893099 - DNA, 14 bp, Homo sapiens
ctgttccacttctc

SEQ ID NO: 5893100 - DNA, 23 bp, Homo sapiens
ctgttccagcccaggcagagatc

SEQ ID NO: 5893101 - DNA, 20 bp, Homo sapiens
ctgttccaggccctccagtg

SEQ ID NO: 5893102 - DNA, 20 bp, Homo sapiens
ctgttccagtggtaagctat

SEQ ID NO: 5893103 - DNA, 19 bp, Homo sapiens
ctgttccattacaccacag

SEQ ID NO: 5893104 - DNA, 18 bp, Homo sapiens
ctgttcccaaattttcta

SEQ ID NO: 5893105 - DNA, 17 bp, Homo sapiens
ctgttcccaatatgtag

SEQ ID NO: 5893106 - DNA, 21 bp, Homo sapiens
ctgttcccagcccctgcagat

SEQ ID NO: 5893107 - DNA, 14 bp, Homo sapiens
ctgttccccacagg

SEQ ID NO: 5893108 - DNA, 21 bp, Homo sapiens
ctgttccccacaggtcctcca

SEQ ID NO: 5893109 - DNA, 23 bp, Homo sapiens
ctgttcccccgccgcttttctcc

SEQ ID NO: 5893110 - DNA, 21 bp, Homo sapiens
ctgttcccccgctggcagcca

SEQ ID NO: 5893111 - DNA, 22 bp, Homo sapiens
ctgttcccctcactggatgaaa

SEQ ID NO: 5893112 - DNA, 18 bp, Homo sapiens
ctgttcccctctcccttc

SEQ ID NO: 5893113 - DNA, 20 bp, Homo sapiens
ctgttcccctgtcctgtgaa

SEQ ID NO: 5893114 - DNA, 13 bp, Homo sapiens
ctgttccctagag

SEQ ID NO: 5893115 - DNA, 17 bp, Homo sapiens
ctgttccctagagagaa

SEQ ID NO: 5893116 - DNA, 22 bp, Homo sapiens
ctgttccctagagagaataaat

SEQ ID NO: 5893117 - DNA, 23 bp, Homo sapiens
ctgttccctatggagaggcttcc

SEQ ID NO: 5893118 - DNA, 15 bp, Homo sapiens
ctgttccctcctggt

SEQ ID NO: 5893119 - DNA, 21 bp, Homo sapiens
ctgttccctcctggtcctgga

SEQ ID NO: 5893120 - DNA, 13 bp, Homo sapiens
ctgttccctctgg

SEQ ID NO: 5893121 - DNA, 17 bp, Homo sapiens
ctgttccctctggcttc

SEQ ID NO: 5893122 - DNA, 15 bp, Homo sapiens
ctgttccctctttct

SEQ ID NO: 5893123 - DNA, 13 bp, Homo sapiens
ctgttccctgagg

SEQ ID NO: 5893124 - DNA, 19 bp, Homo sapiens
ctgttccctgaggacctgc

SEQ ID NO: 5893125 - DNA, 12 bp, Homo sapiens
ctgttccctgct

SEQ ID NO: 5893126 - DNA, 14 bp, Homo sapiens
ctgttccctgctgg

SEQ ID NO: 5893127 - DNA, 18 bp, Homo sapiens
ctgttccctggagtcagg

SEQ ID NO: 5893128 - DNA, 12 bp, Homo sapiens
ctgttccctggg

SEQ ID NO: 5893129 - DNA, 15 bp, Homo sapiens
ctgttccctttgcct

SEQ ID NO: 5893130 - DNA, 17 bp, Homo sapiens
ctgttccgcctcactgg

SEQ ID NO: 5893131 - DNA, 18 bp, Homo sapiens
ctgttccgcctcactggg

SEQ ID NO: 5893132 - DNA, 14 bp, Homo sapiens
ctgttcctcatgtt

SEQ ID NO: 5893133 - DNA, 23 bp, Homo sapiens
ctgttcctcgggatgaaaagcca

SEQ ID NO: 5893134 - DNA, 21 bp, Homo sapiens
ctgttcctctcttttcctgtt

SEQ ID NO: 5893135 - DNA, 16 bp, Homo sapiens
ctgttcctgactgttc

SEQ ID NO: 5893136 - DNA, 14 bp, Homo sapiens
ctgttcctgatttt

SEQ ID NO: 5893137 - DNA, 16 bp, Homo sapiens
ctgttcctgctccatg

SEQ ID NO: 5893138 - DNA, 16 bp, Homo sapiens
ctgttcctgctgctgt

SEQ ID NO: 5893139 - DNA, 18 bp, Homo sapiens
ctgttcctgctgctgtct

SEQ ID NO: 5893140 - DNA, 21 bp, Homo sapiens
ctgttcctgctgctgtctggg

SEQ ID NO: 5893141 - DNA, 21 bp, Homo sapiens
ctgttccttatttctctctcc

SEQ ID NO: 5893142 - DNA, 13 bp, Homo sapiens
ctgttccttccct

SEQ ID NO: 5893143 - DNA, 22 bp, Homo sapiens
ctgttccttccctgtgcctcct

SEQ ID NO: 5893144 - DNA, 18 bp, Homo sapiens
ctgttccttcctccactg

SEQ ID NO: 5893145 - DNA, 17 bp, Homo sapiens
ctgttccttcctgcaga

SEQ ID NO: 5893146 - DNA, 19 bp, Homo sapiens
ctgttccttcctgcagacc

SEQ ID NO: 5893147 - DNA, 22 bp, Homo sapiens
ctgttccttcctgcagacctgg

SEQ ID NO: 5893148 - DNA, 17 bp, Homo sapiens
ctgttcctttcagatga

SEQ ID NO: 5893149 - DNA, 17 bp, Homo sapiens
ctgttcgctcctcccag

SEQ ID NO: 5893150 - DNA, 22 bp, Homo sapiens
ctgttcggaaggggttcctcaa

SEQ ID NO: 5893151 - DNA, 15 bp, Homo sapiens
ctgttctaacatgta

SEQ ID NO: 5893152 - DNA, 15 bp, Homo sapiens
ctgttctaactagta

SEQ ID NO: 5893153 - DNA, 17 bp, Homo sapiens
ctgttctactcttaatg

SEQ ID NO: 5893154 - DNA, 17 bp, Homo sapiens
ctgttctacttgatatt

SEQ ID NO: 5893155 - DNA, 21 bp, Homo sapiens
ctgttctagcaagatagtctt

SEQ ID NO: 5893156 - DNA, 12 bp, Homo sapiens
ctgttctagttt

SEQ ID NO: 5893157 - DNA, 14 bp, Homo sapiens
ctgttctagttttt

SEQ ID NO: 5893158 - DNA, 18 bp, Homo sapiens
ctgttctatcccacccaa

SEQ ID NO: 5893159 - DNA, 16 bp, Homo sapiens
ctgttctatgccttta

SEQ ID NO: 5893160 - DNA, 12 bp, Homo sapiens
ctgttctcaaat

SEQ ID NO: 5893161 - DNA, 19 bp, Homo sapiens
ctgttctcaacatactgta

SEQ ID NO: 5893162 - DNA, 11 bp, Homo sapiens
ctgttctcagc

SEQ ID NO: 5893163 - DNA, 14 bp, Homo sapiens
ctgttctcagcgtt

SEQ ID NO: 5893164 - DNA, 13 bp, Homo sapiens
ctgttctcagctc

SEQ ID NO: 5893165 - DNA, 19 bp, Homo sapiens
ctgttctcaggacagcatc

SEQ ID NO: 5893166 - DNA, 20 bp, Homo sapiens
ctgttctccaggcttcacag

SEQ ID NO: 5893167 - DNA, 14 bp, Homo sapiens
ctgttctccctggg

SEQ ID NO: 5893168 - DNA, 14 bp, Homo sapiens
ctgttctccctttc

SEQ ID NO: 5893169 - DNA, 16 bp, Homo sapiens
ctgttctcctgtccct

SEQ ID NO: 5893170 - DNA, 21 bp, Homo sapiens
ctgttctcctgtccctccatc

SEQ ID NO: 5893171 - DNA, 22 bp, Homo sapiens
ctgttctcgaactcctgacctc

SEQ ID NO: 5893172 - DNA, 17 bp, Homo sapiens
ctgttctcgttgcccta

SEQ ID NO: 5893173 - DNA, 22 bp, Homo sapiens
ctgttctctcccctcacatcct

SEQ ID NO: 5893174 - DNA, 13 bp, Homo sapiens
ctgttctctgccc

SEQ ID NO: 5893175 - DNA, 15 bp, Homo sapiens
ctgttctctgccctc

SEQ ID NO: 5893176 - DNA, 19 bp, Homo sapiens
ctgttctctgccctccaag

SEQ ID NO: 5893177 - DNA, 17 bp, Homo sapiens
ctgttctctgctgaggg

SEQ ID NO: 5893178 - DNA, 15 bp, Homo sapiens
ctgttctcttcttca

SEQ ID NO: 5893179 - DNA, 16 bp, Homo sapiens
ctgttctcttcttcat

SEQ ID NO: 5893180 - DNA, 21 bp, Homo sapiens
ctgttctcttgggaactgaac

SEQ ID NO: 5893181 - DNA, 14 bp, Homo sapiens
ctgttctcttgtat

SEQ ID NO: 5893182 - DNA, 19 bp, Homo sapiens
ctgttctctttgctgacac

SEQ ID NO: 5893183 - DNA, 18 bp, Homo sapiens
ctgttctgaaagggatgg

SEQ ID NO: 5893184 - DNA, 15 bp, Homo sapiens
ctgttctgatttact

SEQ ID NO: 5893185 - DNA, 13 bp, Homo sapiens
ctgttctgcaaag

SEQ ID NO: 5893186 - DNA, 15 bp, Homo sapiens
ctgttctgcaactcc

SEQ ID NO: 5893187 - DNA, 16 bp, Homo sapiens
ctgttctgcacacagc

SEQ ID NO: 5893188 - DNA, 13 bp, Homo sapiens
ctgttctgcttcg

SEQ ID NO: 5893189 - DNA, 13 bp, Homo sapiens
ctgttctggagga

SEQ ID NO: 5893190 - DNA, 23 bp, Homo sapiens
ctgttctggaggaaagggaggag

SEQ ID NO: 5893191 - DNA, 20 bp, Homo sapiens
ctgttgtaacttatgtagat

SEQ ID NO: 5893192 - DNA, 21 bp, Homo sapiens
ctgttgtaagaattctgattg

SEQ ID NO: 5893193 - DNA, 17 bp, Homo sapiens
ctgttgtaatttaatga

SEQ ID NO: 5893194 - DNA, 19 bp, Homo sapiens
ctgttgtaatttaatgact

SEQ ID NO: 5893195 - DNA, 12 bp, Homo sapiens
ctgttgtacatt

SEQ ID NO: 5893196 - DNA, 14 bp, Homo sapiens
ctgttgtacattta

SEQ ID NO: 5893197 - DNA, 18 bp, Homo sapiens
ctgttgtacatttatgat

SEQ ID NO: 5893198 - DNA, 17 bp, Homo sapiens
ctgttgtcaataaattt

SEQ ID NO: 5893199 - DNA, 18 bp, Homo sapiens
ctgttgtcaataaatttt

SEQ ID NO: 5893200 - DNA, 14 bp, Homo sapiens
ctgttgtcacatct

SEQ ID NO: 5893201 - DNA, 14 bp, Homo sapiens
ctgttgtcattgct

SEQ ID NO: 5893202 - DNA, 15 bp, Homo sapiens
ctgttgtcctgaact

SEQ ID NO: 5893203 - DNA, 22 bp, Homo sapiens
ctgttgtctagagctcatcagt

SEQ ID NO: 5893204 - DNA, 19 bp, Homo sapiens
ctgttgtctagtatacagt

SEQ ID NO: 5893205 - DNA, 18 bp, Homo sapiens
ctgttgtctcttctcctt

SEQ ID NO: 5893206 - DNA, 15 bp, Homo sapiens
ctgttgtctgaaaca

SEQ ID NO: 5893207 - DNA, 16 bp, Homo sapiens
ctgttgtctgaaacat

SEQ ID NO: 5893208 - DNA, 13 bp, Homo sapiens
ctgttgtctgcgc

SEQ ID NO: 5893209 - DNA, 20 bp, Homo sapiens
ctgttgtgagctttgaagta

SEQ ID NO: 5893210 - DNA, 15 bp, Homo sapiens
ctgttgtgcagtgtg

SEQ ID NO: 5893211 - DNA, 21 bp, Homo sapiens
ctgttgtggaaagtagctgct

SEQ ID NO: 5893212 - DNA, 19 bp, Homo sapiens
ctgttgtggtttttagtgc

SEQ ID NO: 5893213 - DNA, 22 bp, Homo sapiens
ctgttgtgtacgtggagaggga

SEQ ID NO: 5893214 - DNA, 17 bp, Homo sapiens
ctgttgtgtctggagcc

SEQ ID NO: 5893215 - DNA, 18 bp, Homo sapiens
ctgttgtgttcaccagag

SEQ ID NO: 5893216 - DNA, 17 bp, Homo sapiens
ctgttgtgttcgttctt

SEQ ID NO: 5893217 - DNA, 13 bp, Homo sapiens
ctgttgttatctg

SEQ ID NO: 5893218 - DNA, 19 bp, Homo sapiens
ctgttgttatgatgtgctt

SEQ ID NO: 5893219 - DNA, 22 bp, Homo sapiens
ctgttgttcagaagttgttagt

SEQ ID NO: 5893220 - DNA, 18 bp, Homo sapiens
ctgttgttccaaatgtgt

SEQ ID NO: 5893221 - DNA, 14 bp, Homo sapiens
ctgttgttcccgtg

SEQ ID NO: 5893222 - DNA, 15 bp, Homo sapiens
ctgttgttcccgtga

SEQ ID NO: 5893223 - DNA, 18 bp, Homo sapiens
ctgttgttgcagggaagt

SEQ ID NO: 5893224 - DNA, 22 bp, Homo sapiens
ctgttgttgttaatgaaaatgt

SEQ ID NO: 5893225 - DNA, 22 bp, Homo sapiens
ctgttgttgttacttccctcca

SEQ ID NO: 5893226 - DNA, 15 bp, Homo sapiens
ctgttgtttacctac

SEQ ID NO: 5893227 - DNA, 19 bp, Homo sapiens
ctgttgtttctataaatga

SEQ ID NO: 5893228 - DNA, 14 bp, Homo sapiens
ctgttgtttgaaga

SEQ ID NO: 5893229 - DNA, 13 bp, Homo sapiens
ctgttgttttaac

SEQ ID NO: 5893230 - DNA, 21 bp, Homo sapiens
ctgtttaaaaaaagtatatat

SEQ ID NO: 5893231 - DNA, 20 bp, Homo sapiens
ctgtttaaaaaaccacatgg

SEQ ID NO: 5893232 - DNA, 23 bp, Homo sapiens
ctgtttaaagtcacatccctgta

SEQ ID NO: 5893233 - DNA, 22 bp, Homo sapiens
ctgtttaaatatttcaagacat

SEQ ID NO: 5893234 - DNA, 11 bp, Homo sapiens
ctgtttaaatt

SEQ ID NO: 5893235 - DNA, 19 bp, Homo sapiens
ctgtttaacgtgaggtttc

SEQ ID NO: 5893236 - DNA, 22 bp, Homo sapiens
ctgtttaagaaaagtattttga

SEQ ID NO: 5893237 - DNA, 12 bp, Homo sapiens
ctgtttaagaga

SEQ ID NO: 5893238 - DNA, 19 bp, Homo sapiens
ctgtttaagctactaacga

SEQ ID NO: 5893239 - DNA, 22 bp, Homo sapiens
ctgtttaatcatagttactgtg

SEQ ID NO: 5893240 - DNA, 23 bp, Homo sapiens
ctgtttaatcatagttactgtgt

SEQ ID NO: 5893241 - DNA, 21 bp, Homo sapiens
ctgtttaattcctggaaaact

SEQ ID NO: 5893242 - DNA, 14 bp, Homo sapiens
ctgtttacaacatc

SEQ ID NO: 5893243 - DNA, 16 bp, Homo sapiens
ctgtttacaagaaaaa

SEQ ID NO: 5893244 - DNA, 20 bp, Homo sapiens
ctgtttacaagaaaaaatga

SEQ ID NO: 5893245 - DNA, 19 bp, Homo sapiens
ctgtttacatatctgtccc

SEQ ID NO: 5893246 - DNA, 15 bp, Homo sapiens
ctgtttaccctccct

SEQ ID NO: 5893247 - DNA, 22 bp, Homo sapiens
ctgtttaccctccctgtcccct

SEQ ID NO: 5893248 - DNA, 22 bp, Homo sapiens
ctgtttaccgcccacccagcag

SEQ ID NO: 5893249 - DNA, 15 bp, Homo sapiens
ctgtttacctggcag

SEQ ID NO: 5893250 - DNA, 16 bp, Homo sapiens
ctgtttacctggcagt

SEQ ID NO: 5893251 - DNA, 23 bp, Homo sapiens
ctgtttactgacatggtgctgtg

SEQ ID NO: 5893252 - DNA, 14 bp, Homo sapiens
ctgtttactgcttt

SEQ ID NO: 5893253 - DNA, 15 bp, Homo sapiens
ctgtttactgctttt

SEQ ID NO: 5893254 - DNA, 14 bp, Homo sapiens
ctgtttagaacaca

SEQ ID NO: 5893255 - DNA, 17 bp, Homo sapiens
ctgtttagaacaccaaa

SEQ ID NO: 5893256 - DNA, 18 bp, Homo sapiens
ctgtttagataatacacc

SEQ ID NO: 5893257 - DNA, 19 bp, Homo sapiens
ctgtttagatttgccatag

SEQ ID NO: 5893258 - DNA, 14 bp, Homo sapiens
ctgtttagcagaac

SEQ ID NO: 5893259 - DNA, 17 bp, Homo sapiens
ctgtttagcttcctcca

SEQ ID NO: 5893260 - DNA, 13 bp, Homo sapiens
ctgtttaggaaga

SEQ ID NO: 5893261 - DNA, 23 bp, Homo sapiens
ctgtttaggaagaagtggtacta

SEQ ID NO: 5893262 - DNA, 20 bp, Homo sapiens
ctgtttaggttcccctgtca

SEQ ID NO: 5893263 - DNA, 19 bp, Homo sapiens
ctgtttagtctccttttta

SEQ ID NO: 5893264 - DNA, 22 bp, Homo sapiens
ctgtttagtttgttaattgatt

SEQ ID NO: 5893265 - DNA, 17 bp, Homo sapiens
ctgtttataaaaacaaa

SEQ ID NO: 5893266 - DNA, 20 bp, Homo sapiens
ctgtttataaaaacaaaaac

SEQ ID NO: 5893267 - DNA, 12 bp, Homo sapiens
ctgtttataaat

SEQ ID NO: 5893268 - DNA, 11 bp, Homo sapiens
ctgtttataat

SEQ ID NO: 5893269 - DNA, 18 bp, Homo sapiens
ctgtttatataaaggttt

SEQ ID NO: 5893270 - DNA, 15 bp, Homo sapiens
ctgtttatatatata

SEQ ID NO: 5893271 - DNA, 20 bp, Homo sapiens
ctgtttatatgtgttgaaaa

SEQ ID NO: 5893272 - DNA, 24 bp, Homo sapiens
ctgtttatattggtataattattt

SEQ ID NO: 5893273 - DNA, 14 bp, Homo sapiens
ctgtttatggaaat

SEQ ID NO: 5893274 - DNA, 16 bp, Homo sapiens
ctgtttatggcctcag

SEQ ID NO: 5893275 - DNA, 18 bp, Homo sapiens
ctgtttatggtattttcg

SEQ ID NO: 5893276 - DNA, 14 bp, Homo sapiens
ctgtttatgttctt

SEQ ID NO: 5893277 - DNA, 19 bp, Homo sapiens
ctgtttattaccagattca

SEQ ID NO: 5893278 - DNA, 21 bp, Homo sapiens
ctgtttattacttccatgaat

SEQ ID NO: 5893279 - DNA, 22 bp, Homo sapiens
ctgtttattcttccagaatgct

SEQ ID NO: 5893280 - DNA, 16 bp, Homo sapiens
ctgtttatttaaggat

SEQ ID NO: 5893281 - DNA, 19 bp, Homo sapiens
ctgtttatttaaggatgga

SEQ ID NO: 5893282 - DNA, 23 bp, Homo sapiens
ctgtttatttaaggatggatggc

SEQ ID NO: 5893283 - DNA, 17 bp, Homo sapiens
ctgtttatttattcact

SEQ ID NO: 5893284 - DNA, 16 bp, Homo sapiens
ctgtttatttctgttt

SEQ ID NO: 5893285 - DNA, 18 bp, Homo sapiens
ctgtttattttttttggc

SEQ ID NO: 5893286 - DNA, 22 bp, Homo sapiens
ctgtttattttttttggcctgt

SEQ ID NO: 5893287 - DNA, 19 bp, Homo sapiens
ctgtttcaaaaaaatctat

SEQ ID NO: 5893288 - DNA, 18 bp, Homo sapiens
ctgtttcaaaaataaaag

SEQ ID NO: 5893289 - DNA, 14 bp, Homo sapiens
ctgtttcaaactga

SEQ ID NO: 5893290 - DNA, 15 bp, Homo sapiens
ctgtttcaaacttta

SEQ ID NO: 5893291 - DNA, 16 bp, Homo sapiens
ctgtttcaaagcacaa

SEQ ID NO: 5893292 - DNA, 14 bp, Homo sapiens
ctgtttcaaagttc

SEQ ID NO: 5893293 - DNA, 15 bp, Homo sapiens
ctgtttcaaagttct

SEQ ID NO: 5893294 - DNA, 22 bp, Homo sapiens
ctgtttcaacagatgaccgtgt

SEQ ID NO: 5893295 - DNA, 13 bp, Homo sapiens
ctgtttcaagccc

SEQ ID NO: 5893296 - DNA, 17 bp, Homo sapiens
ctgtttcaagccctcct

SEQ ID NO: 5893297 - DNA, 22 bp, Homo sapiens
ctgtttcaaggcactctagatt

SEQ ID NO: 5893298 - DNA, 15 bp, Homo sapiens
ctgtttcaatcactg

SEQ ID NO: 5893299 - DNA, 11 bp, Homo sapiens
ctgtttcacaa

SEQ ID NO: 5893300 - DNA, 22 bp, Homo sapiens
ctgtttcactgaaatgtttgga

SEQ ID NO: 5893301 - DNA, 13 bp, Homo sapiens
ctgtttcagaccc

SEQ ID NO: 5893302 - DNA, 19 bp, Homo sapiens
ctgtttcagacccccccat

SEQ ID NO: 5893303 - DNA, 18 bp, Homo sapiens
ctgtttcatctcagcttt

SEQ ID NO: 5893304 - DNA, 20 bp, Homo sapiens
ctgtttcatctcagcttttg

SEQ ID NO: 5893305 - DNA, 16 bp, Homo sapiens
ctgtttcatgagccca

SEQ ID NO: 5893306 - DNA, 18 bp, Homo sapiens
ctgtttcatgagcccaaa

SEQ ID NO: 5893307 - DNA, 13 bp, Homo sapiens
ctgtttcattcac

SEQ ID NO: 5893308 - DNA, 14 bp, Homo sapiens
ctgtttcattcact

SEQ ID NO: 5893309 - DNA, 13 bp, Homo sapiens
ctgtttcatttgt

SEQ ID NO: 5893310 - DNA, 13 bp, Homo sapiens
ctgtttccatggg

SEQ ID NO: 5893311 - DNA, 14 bp, Homo sapiens
ctgtttcccaagct

SEQ ID NO: 5893312 - DNA, 13 bp, Homo sapiens
ctgtttccccaat

SEQ ID NO: 5893313 - DNA, 19 bp, Homo sapiens
ctgtttcccgtaaggctgt

SEQ ID NO: 5893314 - DNA, 13 bp, Homo sapiens
ctgtttccctgct

SEQ ID NO: 5893315 - DNA, 16 bp, Homo sapiens
ctgtttccctgctgaa

SEQ ID NO: 5893316 - DNA, 17 bp, Homo sapiens
ctgtttccctgctgaat

SEQ ID NO: 5893317 - DNA, 16 bp, Homo sapiens
ctgtttcctagctgtg

SEQ ID NO: 5893318 - DNA, 17 bp, Homo sapiens
ctgtttcctagctgtgt

SEQ ID NO: 5893319 - DNA, 19 bp, Homo sapiens
ctgtttcctatttaataca

SEQ ID NO: 5893320 - DNA, 11 bp, Homo sapiens
ctgtttcctca

SEQ ID NO: 5893321 - DNA, 14 bp, Homo sapiens
ctgtttcctcttga

SEQ ID NO: 5893322 - DNA, 13 bp, Homo sapiens
ctgtttcctggcc

SEQ ID NO: 5893323 - DNA, 16 bp, Homo sapiens
ctgtttcctggcctca

SEQ ID NO: 5893324 - DNA, 21 bp, Homo sapiens
ctgtttcctggcctcagagct

SEQ ID NO: 5893325 - DNA, 22 bp, Homo sapiens
ctgtttcctggcctcagagctt

SEQ ID NO: 5893326 - DNA, 13 bp, Homo sapiens
ctgtttcctgggc

SEQ ID NO: 5893327 - DNA, 11 bp, Homo sapiens
ctgtttcctgt

SEQ ID NO: 5893328 - DNA, 16 bp, Homo sapiens
ctgtttcctgtgtctc

SEQ ID NO: 5893329 - DNA, 14 bp, Homo sapiens
ctgtttccttctct

SEQ ID NO: 5893330 - DNA, 16 bp, Homo sapiens
ctgtttccttctcttt

SEQ ID NO: 5893331 - DNA, 15 bp, Homo sapiens
ctgtttccttgcctg

SEQ ID NO: 5893332 - DNA, 22 bp, Homo sapiens
ctgtttcgtgtagtggaagagc

SEQ ID NO: 5893333 - DNA, 14 bp, Homo sapiens
ctgtttctaagaaa

SEQ ID NO: 5893334 - DNA, 20 bp, Homo sapiens
ctgtttctaatttgctgctg

SEQ ID NO: 5893335 - DNA, 18 bp, Homo sapiens
ctgtttctacctatatgc

SEQ ID NO: 5893336 - DNA, 13 bp, Homo sapiens
ctgtttctcaagt

SEQ ID NO: 5893337 - DNA, 21 bp, Homo sapiens
ctgtttctcaagtgttttgga

SEQ ID NO: 5893338 - DNA, 11 bp, Homo sapiens
ctgtttctcag

SEQ ID NO: 5893339 - DNA, 11 bp, Homo sapiens
ctgtttctcat

SEQ ID NO: 5893340 - DNA, 13 bp, Homo sapiens
ctgtttctcatga

SEQ ID NO: 5893341 - DNA, 14 bp, Homo sapiens
ctgtttctcatgaa

SEQ ID NO: 5893342 - DNA, 16 bp, Homo sapiens
ctgtttctctttcctt

SEQ ID NO: 5893343 - DNA, 13 bp, Homo sapiens
ctgtttctctttg

SEQ ID NO: 5893344 - DNA, 22 bp, Homo sapiens
ctgtttctctttgtctgccttc

SEQ ID NO: 5893345 - DNA, 15 bp, Homo sapiens
ctgtttctgaaaaga

SEQ ID NO: 5893346 - DNA, 21 bp, Homo sapiens
ctgtttctgaaaagaaataat

SEQ ID NO: 5893347 - DNA, 16 bp, Homo sapiens
ctgtttctgcagccct

SEQ ID NO: 5893348 - DNA, 17 bp, Homo sapiens
ctgtttctgcttgctct

SEQ ID NO: 5893349 - DNA, 20 bp, Homo sapiens
ctgtttctggaaatgttctt

SEQ ID NO: 5893350 - DNA, 20 bp, Homo sapiens
ctgtttctggaagactgctc

SEQ ID NO: 5893351 - DNA, 12 bp, Homo sapiens
ctgtttctgtag

SEQ ID NO: 5893352 - DNA, 16 bp, Homo sapiens
ctgtttctgtcaggag

SEQ ID NO: 5893353 - DNA, 17 bp, Homo sapiens
ctgtttcttaagggcac

SEQ ID NO: 5893354 - DNA, 15 bp, Homo sapiens
ctgtttcttacctta

SEQ ID NO: 5893355 - DNA, 13 bp, Homo sapiens
ctgtttcttagct

SEQ ID NO: 5893356 - DNA, 20 bp, Homo sapiens
ctgtttcttagctgcactgt

SEQ ID NO: 5893357 - DNA, 22 bp, Homo sapiens
ctgtttcttgcactgaatatat

SEQ ID NO: 5893358 - DNA, 12 bp, Homo sapiens
ctgtttcttgct

SEQ ID NO: 5893359 - DNA, 15 bp, Homo sapiens
ctgtttcttgctctc

SEQ ID NO: 5893360 - DNA, 16 bp, Homo sapiens
ctgtttcttgctctct

SEQ ID NO: 5893361 - DNA, 13 bp, Homo sapiens
ctgtttcttgctt

SEQ ID NO: 5893362 - DNA, 14 bp, Homo sapiens
ctgtttcttgcttg

SEQ ID NO: 5893363 - DNA, 19 bp, Homo sapiens
ctgtttgaaaacttcagaa

SEQ ID NO: 5893364 - DNA, 16 bp, Homo sapiens
ctgtttgaaatgctta

SEQ ID NO: 5893365 - DNA, 20 bp, Homo sapiens
ctgtttgaagaaaaaggaca

SEQ ID NO: 5893366 - DNA, 15 bp, Homo sapiens
ctgtttgacaaacct

SEQ ID NO: 5893367 - DNA, 23 bp, Homo sapiens
ctgtttgacacctcttttttcgt

SEQ ID NO: 5893368 - DNA, 12 bp, Homo sapiens
ctgtttgagaaa

SEQ ID NO: 5893369 - DNA, 16 bp, Homo sapiens
ctgtttgagatgtgat

SEQ ID NO: 5893370 - DNA, 16 bp, Homo sapiens
cttaacagatcacatg

SEQ ID NO: 5893371 - DNA, 19 bp, Homo sapiens
cttaacagggaacgtgatt

SEQ ID NO: 5893372 - DNA, 16 bp, Homo sapiens
cttaacagttgtattt

SEQ ID NO: 5893373 - DNA, 17 bp, Homo sapiens
cttaacagttgtattta

SEQ ID NO: 5893374 - DNA, 12 bp, Homo sapiens
cttaacagtttt

SEQ ID NO: 5893375 - DNA, 20 bp, Homo sapiens
cttaacataaacttgtactt

SEQ ID NO: 5893376 - DNA, 21 bp, Homo sapiens
cttaacataaacttgtactta

SEQ ID NO: 5893377 - DNA, 23 bp, Homo sapiens
cttaacatacacgttaactgcag

SEQ ID NO: 5893378 - DNA, 23 bp, Homo sapiens
cttaacatcatataaaaagcagc

SEQ ID NO: 5893379 - DNA, 15 bp, Homo sapiens
cttaacatccctcct

SEQ ID NO: 5893380 - DNA, 18 bp, Homo sapiens
cttaacatccctcctgct

SEQ ID NO: 5893381 - DNA, 20 bp, Homo sapiens
cttaacattagatgtcatga

SEQ ID NO: 5893382 - DNA, 16 bp, Homo sapiens
cttaacattcctaaaa

SEQ ID NO: 5893383 - DNA, 14 bp, Homo sapiens
cttaacattgattt

SEQ ID NO: 5893384 - DNA, 15 bp, Homo sapiens
cttaacattgattta

SEQ ID NO: 5893385 - DNA, 20 bp, Homo sapiens
cttaacatttctaactctga

SEQ ID NO: 5893386 - DNA, 22 bp, Homo sapiens
cttaaccaccgcatatgcatgc

SEQ ID NO: 5893387 - DNA, 17 bp, Homo sapiens
cttaaccagatcattgt

SEQ ID NO: 5893388 - DNA, 18 bp, Homo sapiens
cttaaccagatggttgtg

SEQ ID NO: 5893389 - DNA, 12 bp, Homo sapiens
cttaaccatctt

SEQ ID NO: 5893390 - DNA, 13 bp, Homo sapiens
cttaacccaagga

SEQ ID NO: 5893391 - DNA, 14 bp, Homo sapiens
cttaacccaaggag

SEQ ID NO: 5893392 - DNA, 14 bp, Homo sapiens
cttaacccacctct

SEQ ID NO: 5893393 - DNA, 22 bp, Homo sapiens
cttaacccacctctcctgccct

SEQ ID NO: 5893394 - DNA, 21 bp, Homo sapiens
cttaaccccaaggactgaggg

SEQ ID NO: 5893395 - DNA, 20 bp, Homo sapiens
cttaaccccagtaagccact

SEQ ID NO: 5893396 - DNA, 12 bp, Homo sapiens
cttaaccctcaa

SEQ ID NO: 5893397 - DNA, 12 bp, Homo sapiens
cttaaccctgtg

SEQ ID NO: 5893398 - DNA, 13 bp, Homo sapiens
cttaacctcaggg

SEQ ID NO: 5893399 - DNA, 15 bp, Homo sapiens
cttaacctgcttttg

SEQ ID NO: 5893400 - DNA, 12 bp, Homo sapiens
cttaaccttaaa

SEQ ID NO: 5893401 - DNA, 14 bp, Homo sapiens
cttaaccttctggg

SEQ ID NO: 5893402 - DNA, 21 bp, Homo sapiens
cttaaccttgaaatggaaagt

SEQ ID NO: 5893403 - DNA, 11 bp, Homo sapiens
cttaacctttg

SEQ ID NO: 5893404 - DNA, 18 bp, Homo sapiens
cttaacctttgctatgta

SEQ ID NO: 5893405 - DNA, 17 bp, Homo sapiens
cttaacggaccaaagca

SEQ ID NO: 5893406 - DNA, 15 bp, Homo sapiens
cttaacggctccagg

SEQ ID NO: 5893407 - DNA, 13 bp, Homo sapiens
cttaactaagact

SEQ ID NO: 5893408 - DNA, 12 bp, Homo sapiens
cttaactaattt

SEQ ID NO: 5893409 - DNA, 17 bp, Homo sapiens
cttaactataaggtgcc

SEQ ID NO: 5893410 - DNA, 19 bp, Homo sapiens
cttaactatcaccagtgca

SEQ ID NO: 5893411 - DNA, 12 bp, Homo sapiens
cttaactccaag

SEQ ID NO: 5893412 - DNA, 17 bp, Homo sapiens
cttaactctaaccctgt

SEQ ID NO: 5893413 - DNA, 20 bp, Homo sapiens
cttaactctaaccctgtgga

SEQ ID NO: 5893414 - DNA, 17 bp, Homo sapiens
cttaactctcaagctaa

SEQ ID NO: 5893415 - DNA, 17 bp, Homo sapiens
cttaactctgcaggaaa

SEQ ID NO: 5893416 - DNA, 19 bp, Homo sapiens
cttaactggactgaattca

SEQ ID NO: 5893417 - DNA, 18 bp, Homo sapiens
cttaactggcctaaattt

SEQ ID NO: 5893418 - DNA, 17 bp, Homo sapiens
cttaactgtatagctct

SEQ ID NO: 5893419 - DNA, 15 bp, Homo sapiens
cttaactgtatttca

SEQ ID NO: 5893420 - DNA, 18 bp, Homo sapiens
cttaactgtatttcagta

SEQ ID NO: 5893421 - DNA, 21 bp, Homo sapiens
cttaactgtatttcagtattt

SEQ ID NO: 5893422 - DNA, 18 bp, Homo sapiens
cttaactgtgtgaagaaa

SEQ ID NO: 5893423 - DNA, 21 bp, Homo sapiens
cttaactgtgtgaagaaatgg

SEQ ID NO: 5893424 - DNA, 22 bp, Homo sapiens
cttaactgtgtgaagaaatgga

SEQ ID NO: 5893425 - DNA, 19 bp, Homo sapiens
cttaacttacttttgtaag

SEQ ID NO: 5893426 - DNA, 17 bp, Homo sapiens
cttaacttcacatattg

SEQ ID NO: 5893427 - DNA, 12 bp, Homo sapiens
cttaacttgttt

SEQ ID NO: 5893428 - DNA, 17 bp, Homo sapiens
cttaactttactaagta

SEQ ID NO: 5893429 - DNA, 11 bp, Homo sapiens
cttaactttat

SEQ ID NO: 5893430 - DNA, 12 bp, Homo sapiens
cttaagaaacta

SEQ ID NO: 5893431 - DNA, 16 bp, Homo sapiens
cttaagaactgctttc

SEQ ID NO: 5893432 - DNA, 15 bp, Homo sapiens
cttaagaactgtgtc

SEQ ID NO: 5893433 - DNA, 23 bp, Homo sapiens
cttaagaagactgcattatattt

SEQ ID NO: 5893434 - DNA, 16 bp, Homo sapiens
cttaagaattcaaatt

SEQ ID NO: 5893435 - DNA, 17 bp, Homo sapiens
cttaagaattcaaattt

SEQ ID NO: 5893436 - DNA, 18 bp, Homo sapiens
cttaagaattcaaatttg

SEQ ID NO: 5893437 - DNA, 13 bp, Homo sapiens
cttaagaattgaa

SEQ ID NO: 5893438 - DNA, 18 bp, Homo sapiens
cttaagacaaatgggact

SEQ ID NO: 5893439 - DNA, 21 bp, Homo sapiens
cttaagacaaatgggactgat

SEQ ID NO: 5893440 - DNA, 13 bp, Homo sapiens
cttaagacactag

SEQ ID NO: 5893441 - DNA, 14 bp, Homo sapiens
cttaagacactgtg

SEQ ID NO: 5893442 - DNA, 15 bp, Homo sapiens
cttaagacactgtga

SEQ ID NO: 5893443 - DNA, 23 bp, Homo sapiens
cttaagacagagtcttgctctgt

SEQ ID NO: 5893444 - DNA, 19 bp, Homo sapiens
cttaagaccacctcaaatt

SEQ ID NO: 5893445 - DNA, 22 bp, Homo sapiens
cttaagacctactgttctaaag

SEQ ID NO: 5893446 - DNA, 23 bp, Homo sapiens
cttaagacctactgttctaaagc

SEQ ID NO: 5893447 - DNA, 15 bp, Homo sapiens
cttaagacttaatga

SEQ ID NO: 5893448 - DNA, 12 bp, Homo sapiens
cttaagagaaat

SEQ ID NO: 5893449 - DNA, 13 bp, Homo sapiens
cttaagagaatat

SEQ ID NO: 5893450 - DNA, 18 bp, Homo sapiens
cttaagagagagagcctt

SEQ ID NO: 5893451 - DNA, 23 bp, Homo sapiens
cttaagagagagagccttaatgg

SEQ ID NO: 5893452 - DNA, 18 bp, Homo sapiens
cttaagagcttgatctgt

SEQ ID NO: 5893453 - DNA, 20 bp, Homo sapiens
cttaagagcttgatctgtga

SEQ ID NO: 5893454 - DNA, 21 bp, Homo sapiens
cttaagagcttgatctgtgat

SEQ ID NO: 5893455 - DNA, 21 bp, Homo sapiens
cttaagaggcctgtgattatt

SEQ ID NO: 5893456 - DNA, 22 bp, Homo sapiens
cttaagagtccaactcacttcc

SEQ ID NO: 5893457 - DNA, 14 bp, Homo sapiens
cttaagatattgaa

SEQ ID NO: 5893458 - DNA, 16 bp, Homo sapiens
cttaagatctgactgc

SEQ ID NO: 5893459 - DNA, 14 bp, Homo sapiens
cttaagatgggcct

SEQ ID NO: 5893460 - DNA, 21 bp, Homo sapiens
cttaagatgtccagggcccca

SEQ ID NO: 5893461 - DNA, 16 bp, Homo sapiens
cttaagattaaattat

SEQ ID NO: 5893462 - DNA, 17 bp, Homo sapiens
cttaagattacaagata

SEQ ID NO: 5893463 - DNA, 21 bp, Homo sapiens
cttaagattccattttggaaa

SEQ ID NO: 5893464 - DNA, 18 bp, Homo sapiens
cttaagattctttgtgat

SEQ ID NO: 5893465 - DNA, 14 bp, Homo sapiens
cttaagcaaaagaa

SEQ ID NO: 5893466 - DNA, 17 bp, Homo sapiens
cttaagcaaaagaaaaa

SEQ ID NO: 5893467 - DNA, 13 bp, Homo sapiens
cttaagcacaatt

SEQ ID NO: 5893468 - DNA, 18 bp, Homo sapiens
cttaagcactttgaaaat

SEQ ID NO: 5893469 - DNA, 19 bp, Homo sapiens
cttaagcactttgaaaata

SEQ ID NO: 5893470 - DNA, 21 bp, Homo sapiens
cttaagcagaacaaatgtgtt

SEQ ID NO: 5893471 - DNA, 18 bp, Homo sapiens
cttaagcagagataaata

SEQ ID NO: 5893472 - DNA, 21 bp, Homo sapiens
cttaagcagagcagaactttt

SEQ ID NO: 5893473 - DNA, 15 bp, Homo sapiens
cttaagcagcaacag

SEQ ID NO: 5893474 - DNA, 17 bp, Homo sapiens
cttaagcagtaatctgt

SEQ ID NO: 5893475 - DNA, 13 bp, Homo sapiens
cttaagcataaaa

SEQ ID NO: 5893476 - DNA, 19 bp, Homo sapiens
cttaagcatccgtgtattt

SEQ ID NO: 5893477 - DNA, 23 bp, Homo sapiens
cttaagcatctggctctaattca

SEQ ID NO: 5893478 - DNA, 22 bp, Homo sapiens
cttaagccaaactcaggcccag

SEQ ID NO: 5893479 - DNA, 22 bp, Homo sapiens
cttaagccactgcctctccctc

SEQ ID NO: 5893480 - DNA, 15 bp, Homo sapiens
cttaagccatcttgg

SEQ ID NO: 5893481 - DNA, 20 bp, Homo sapiens
cttaagccatcttggtaaat

SEQ ID NO: 5893482 - DNA, 23 bp, Homo sapiens
cttaagccatcttggtaaatttc

SEQ ID NO: 5893483 - DNA, 13 bp, Homo sapiens
cttaagcccagga

SEQ ID NO: 5893484 - DNA, 16 bp, Homo sapiens
cttaagcctgtgtata

SEQ ID NO: 5893485 - DNA, 23 bp, Homo sapiens
cttaagcgaagtctttgccttct

SEQ ID NO: 5893486 - DNA, 17 bp, Homo sapiens
cttaagctcccctgcct

SEQ ID NO: 5893487 - DNA, 12 bp, Homo sapiens
cttaagcttccg

SEQ ID NO: 5893488 - DNA, 23 bp, Homo sapiens
cttaagctttggacccaaggaaa

SEQ ID NO: 5893489 - DNA, 17 bp, Homo sapiens
cttaagctttggggaat

SEQ ID NO: 5893490 - DNA, 15 bp, Homo sapiens
cttaaggaaaagtaa

SEQ ID NO: 5893491 - DNA, 20 bp, Homo sapiens
cttaaggacaaaaatgaact

SEQ ID NO: 5893492 - DNA, 18 bp, Homo sapiens
cttaaggacagtgttcaa

SEQ ID NO: 5893493 - DNA, 20 bp, Homo sapiens
cttaaggacagtgttcaaat

SEQ ID NO: 5893494 - DNA, 23 bp, Homo sapiens
cttaaggacagtgttcaaattct

SEQ ID NO: 5893495 - DNA, 12 bp, Homo sapiens
cttaaggagact

SEQ ID NO: 5893496 - DNA, 22 bp, Homo sapiens
cttaaggagactggtaggagga

SEQ ID NO: 5893497 - DNA, 19 bp, Homo sapiens
cttaaggagaggagaaact

SEQ ID NO: 5893498 - DNA, 22 bp, Homo sapiens
cttaaggatcaccccagccccc

SEQ ID NO: 5893499 - DNA, 16 bp, Homo sapiens
cttaaggccacactgg

SEQ ID NO: 5893500 - DNA, 16 bp, Homo sapiens
cttaaggcctaaggaa

SEQ ID NO: 5893501 - DNA, 15 bp, Homo sapiens
cttaaggctcttttg

SEQ ID NO: 5893502 - DNA, 22 bp, Homo sapiens
cttaagggaatatgcattgtct

SEQ ID NO: 5893503 - DNA, 16 bp, Homo sapiens
cttaagggagtttaat

SEQ ID NO: 5893504 - DNA, 14 bp, Homo sapiens
cttaaggggcagct

SEQ ID NO: 5893505 - DNA, 15 bp, Homo sapiens
cttaaggggcagctt

SEQ ID NO: 5893506 - DNA, 20 bp, Homo sapiens
cttaaggggggcagggagtg

SEQ ID NO: 5893507 - DNA, 20 bp, Homo sapiens
cttaaggggtatcatgtatg

SEQ ID NO: 5893508 - DNA, 17 bp, Homo sapiens
cttaagggttgaaggca

SEQ ID NO: 5893509 - DNA, 18 bp, Homo sapiens
cttaagggttttttagaa

SEQ ID NO: 5893510 - DNA, 20 bp, Homo sapiens
cttaaggtactctggacttt

SEQ ID NO: 5893511 - DNA, 21 bp, Homo sapiens
cttaaggtactctggactttc

SEQ ID NO: 5893512 - DNA, 15 bp, Homo sapiens
cttaaggtccctgct

SEQ ID NO: 5893513 - DNA, 17 bp, Homo sapiens
cttaaggtctaactgtg

SEQ ID NO: 5893514 - DNA, 17 bp, Homo sapiens
cttaaggtgaggcctgt

SEQ ID NO: 5893515 - DNA, 18 bp, Homo sapiens
cttaaggtgaggcctgtc

SEQ ID NO: 5893516 - DNA, 19 bp, Homo sapiens
cttaaggtgaggcctgtct

SEQ ID NO: 5893517 - DNA, 22 bp, Homo sapiens
cttaaggtgaggcctgtctgtg

SEQ ID NO: 5893518 - DNA, 19 bp, Homo sapiens
cttaaggtggaaagtgttc

SEQ ID NO: 5893519 - DNA, 16 bp, Homo sapiens
cttaaggtttgttttc

SEQ ID NO: 5893520 - DNA, 15 bp, Homo sapiens
cttaagtataaacct

SEQ ID NO: 5893521 - DNA, 21 bp, Homo sapiens
cttaagtataactaatttgct

SEQ ID NO: 5893522 - DNA, 19 bp, Homo sapiens
cttaagtatatcatgtaaa

SEQ ID NO: 5893523 - DNA, 15 bp, Homo sapiens
cttaagtatcagaaa

SEQ ID NO: 5893524 - DNA, 17 bp, Homo sapiens
cttaagtcagaacagca

SEQ ID NO: 5893525 - DNA, 20 bp, Homo sapiens
cttaagtcataatgaataaa

SEQ ID NO: 5893526 - DNA, 12 bp, Homo sapiens
cttaagtcccag

SEQ ID NO: 5893527 - DNA, 18 bp, Homo sapiens
cttaagtcttccttaaat

SEQ ID NO: 5893528 - DNA, 19 bp, Homo sapiens
cttaagtgagcagaacagg

SEQ ID NO: 5893529 - DNA, 22 bp, Homo sapiens
cttaagtgagcagaacaggtag

SEQ ID NO: 5893530 - DNA, 19 bp, Homo sapiens
cttaagtgaggaaatcaaa

SEQ ID NO: 5893531 - DNA, 14 bp, Homo sapiens
cttaagtgcacttt

SEQ ID NO: 5893532 - DNA, 15 bp, Homo sapiens
cttaagtgctgcagc

SEQ ID NO: 5893533 - DNA, 16 bp, Homo sapiens
cttaagtgtaaatgaa

SEQ ID NO: 5893534 - DNA, 22 bp, Homo sapiens
cttaagtgttcattttaagtaa

SEQ ID NO: 5893535 - DNA, 14 bp, Homo sapiens
cttaagtgtttctc

SEQ ID NO: 5893536 - DNA, 20 bp, Homo sapiens
cttaagtgtttctcaaaaga

SEQ ID NO: 5893537 - DNA, 19 bp, Homo sapiens
cttaagttagttccactga

SEQ ID NO: 5893538 - DNA, 17 bp, Homo sapiens
cttaagttctatgaaga

SEQ ID NO: 5893539 - DNA, 12 bp, Homo sapiens
cttaagttcttt

SEQ ID NO: 5893540 - DNA, 16 bp, Homo sapiens
cttaagtttagaaatt

SEQ ID NO: 5893541 - DNA, 15 bp, Homo sapiens
cttaagttttacttg

SEQ ID NO: 5893542 - DNA, 17 bp, Homo sapiens
cttaagttttagtcttt

SEQ ID NO: 5893543 - DNA, 14 bp, Homo sapiens
cttaagtttttcca

SEQ ID NO: 5893544 - DNA, 18 bp, Homo sapiens
cttaataaaaatgacaga

SEQ ID NO: 5893545 - DNA, 19 bp, Homo sapiens
cttaataaaagaacatgct

SEQ ID NO: 5893546 - DNA, 20 bp, Homo sapiens
cttaataaaagaacatgctt

SEQ ID NO: 5893547 - DNA, 17 bp, Homo sapiens
cttaataaaataaacta

SEQ ID NO: 5893548 - DNA, 14 bp, Homo sapiens
cttacagctgggtg

SEQ ID NO: 5893549 - DNA, 23 bp, Homo sapiens
cttacagctgggtggcactgcca

SEQ ID NO: 5893550 - DNA, 20 bp, Homo sapiens
cttacaggaaaacctgcaga

SEQ ID NO: 5893551 - DNA, 15 bp, Homo sapiens
cttacaggagccagc

SEQ ID NO: 5893552 - DNA, 18 bp, Homo sapiens
cttacaggagccagcctg

SEQ ID NO: 5893553 - DNA, 20 bp, Homo sapiens
cttacaggagccagcctgct

SEQ ID NO: 5893554 - DNA, 23 bp, Homo sapiens
cttacaggagccagcctgcttcc

SEQ ID NO: 5893555 - DNA, 19 bp, Homo sapiens
cttacaggtatcaggcaca

SEQ ID NO: 5893556 - DNA, 15 bp, Homo sapiens
cttacaggtcctgct

SEQ ID NO: 5893557 - DNA, 22 bp, Homo sapiens
cttacagtaaagtatagaaata

SEQ ID NO: 5893558 - DNA, 17 bp, Homo sapiens
cttacagtaaatgaact

SEQ ID NO: 5893559 - DNA, 17 bp, Homo sapiens
cttacagtaactaattt

SEQ ID NO: 5893560 - DNA, 23 bp, Homo sapiens
cttacagtaggagcccagctctg

SEQ ID NO: 5893561 - DNA, 15 bp, Homo sapiens
cttacagtaggagtg

SEQ ID NO: 5893562 - DNA, 15 bp, Homo sapiens
cttacagtgaagatg

SEQ ID NO: 5893563 - DNA, 15 bp, Homo sapiens
cttacagtgactgtg

SEQ ID NO: 5893564 - DNA, 23 bp, Homo sapiens
cttacagtgagggctatacatgg

SEQ ID NO: 5893565 - DNA, 18 bp, Homo sapiens
cttacagtgatgccatga

SEQ ID NO: 5893566 - DNA, 21 bp, Homo sapiens
cttacagtttattttctgtgt

SEQ ID NO: 5893567 - DNA, 18 bp, Homo sapiens
cttacataaagctccctt

SEQ ID NO: 5893568 - DNA, 19 bp, Homo sapiens
cttacataaagctcccttg

SEQ ID NO: 5893569 - DNA, 19 bp, Homo sapiens
cttacataatttgcaattt

SEQ ID NO: 5893570 - DNA, 16 bp, Homo sapiens
cttacataatttttta

SEQ ID NO: 5893571 - DNA, 20 bp, Homo sapiens
cttacatagctcaaatattg

SEQ ID NO: 5893572 - DNA, 16 bp, Homo sapiens
cttacatatgttaata

SEQ ID NO: 5893573 - DNA, 20 bp, Homo sapiens
cttacatctggaatctgagg

SEQ ID NO: 5893574 - DNA, 22 bp, Homo sapiens
cttacatctggaatctgaggca

SEQ ID NO: 5893575 - DNA, 16 bp, Homo sapiens
cttacatctgtaaaga

SEQ ID NO: 5893576 - DNA, 19 bp, Homo sapiens
cttacatctttgtttacca

SEQ ID NO: 5893577 - DNA, 16 bp, Homo sapiens
cttacatgagaacaga

SEQ ID NO: 5893578 - DNA, 12 bp, Homo sapiens
cttacatgattc

SEQ ID NO: 5893579 - DNA, 14 bp, Homo sapiens
cttacatgcatttg

SEQ ID NO: 5893580 - DNA, 22 bp, Homo sapiens
cttacatgtataaagtgattga

SEQ ID NO: 5893581 - DNA, 20 bp, Homo sapiens
cttacatgtgtaaaggtttc

SEQ ID NO: 5893582 - DNA, 12 bp, Homo sapiens
cttacattaaaa

SEQ ID NO: 5893583 - DNA, 18 bp, Homo sapiens
cttacattaaaaagcctt

SEQ ID NO: 5893584 - DNA, 22 bp, Homo sapiens
cttacattaaaaagccttacag

SEQ ID NO: 5893585 - DNA, 12 bp, Homo sapiens
cttacattctct

SEQ ID NO: 5893586 - DNA, 16 bp, Homo sapiens
cttacattgcctgact

SEQ ID NO: 5893587 - DNA, 20 bp, Homo sapiens
cttacattgttcaattagaa

SEQ ID NO: 5893588 - DNA, 18 bp, Homo sapiens
cttacatttaaaagacag

SEQ ID NO: 5893589 - DNA, 22 bp, Homo sapiens
cttacatttcagacatatccaa

SEQ ID NO: 5893590 - DNA, 13 bp, Homo sapiens
cttacatttcctg

SEQ ID NO: 5893591 - DNA, 14 bp, Homo sapiens
cttacatttgctaa

SEQ ID NO: 5893592 - DNA, 12 bp, Homo sapiens
cttacatttgta

SEQ ID NO: 5893593 - DNA, 16 bp, Homo sapiens
cttacatttgtacttt

SEQ ID NO: 5893594 - DNA, 17 bp, Homo sapiens
cttacatttttgtggtt

SEQ ID NO: 5893595 - DNA, 22 bp, Homo sapiens
cttacatttttgtggttttgag

SEQ ID NO: 5893596 - DNA, 13 bp, Homo sapiens
cttaccaaaacag

SEQ ID NO: 5893597 - DNA, 15 bp, Homo sapiens
cttaccaaaagctca

SEQ ID NO: 5893598 - DNA, 19 bp, Homo sapiens
cttaccaaaagctcagggc

SEQ ID NO: 5893599 - DNA, 21 bp, Homo sapiens
cttaccaaaagctcagggccc

SEQ ID NO: 5893600 - DNA, 16 bp, Homo sapiens
cttaccaatagcaggg

SEQ ID NO: 5893601 - DNA, 16 bp, Homo sapiens
cttaccagagacgccc

SEQ ID NO: 5893602 - DNA, 21 bp, Homo sapiens
cttaccagataatgctacttt

SEQ ID NO: 5893603 - DNA, 15 bp, Homo sapiens
cttaccagcagagca

SEQ ID NO: 5893604 - DNA, 13 bp, Homo sapiens
cttaccaggaagc

SEQ ID NO: 5893605 - DNA, 15 bp, Homo sapiens
cttaccatatgtgct

SEQ ID NO: 5893606 - DNA, 23 bp, Homo sapiens
cttaccatctctaccatcatccg

SEQ ID NO: 5893607 - DNA, 16 bp, Homo sapiens
cttaccatgcatttct

SEQ ID NO: 5893608 - DNA, 19 bp, Homo sapiens
cttaccattaacatttttt

SEQ ID NO: 5893609 - DNA, 22 bp, Homo sapiens
cttaccattcctatagtacttt

SEQ ID NO: 5893610 - DNA, 23 bp, Homo sapiens
cttaccatttgctactgtacata

SEQ ID NO: 5893611 - DNA, 22 bp, Homo sapiens
cttacccaaactgttcaagaaa

SEQ ID NO: 5893612 - DNA, 15 bp, Homo sapiens
cttacccaatttccc

SEQ ID NO: 5893613 - DNA, 22 bp, Homo sapiens
cttacccacactacgcagaaga

SEQ ID NO: 5893614 - DNA, 23 bp, Homo sapiens
cttacccagattgtgtacataga

SEQ ID NO: 5893615 - DNA, 19 bp, Homo sapiens
cttaccccaaagagaaaga

SEQ ID NO: 5893616 - DNA, 15 bp, Homo sapiens
cttaccccagctgcg

SEQ ID NO: 5893617 - DNA, 19 bp, Homo sapiens
cttaccccgtccctttccc

SEQ ID NO: 5893618 - DNA, 20 bp, Homo sapiens
cttaccccgtccctttccct

SEQ ID NO: 5893619 - DNA, 13 bp, Homo sapiens
cttacccctgcct

SEQ ID NO: 5893620 - DNA, 20 bp, Homo sapiens
cttaccccttagcctccctg

SEQ ID NO: 5893621 - DNA, 20 bp, Homo sapiens
cttacccgaaagcatcactg

SEQ ID NO: 5893622 - DNA, 22 bp, Homo sapiens
cttacccgaaagcatcactgcc

SEQ ID NO: 5893623 - DNA, 17 bp, Homo sapiens
cttaccctcatgttctt

SEQ ID NO: 5893624 - DNA, 14 bp, Homo sapiens
cttaccctcctctg

SEQ ID NO: 5893625 - DNA, 20 bp, Homo sapiens
cttaccctcctctgctggga

SEQ ID NO: 5893626 - DNA, 15 bp, Homo sapiens
cttaccctctctttc

SEQ ID NO: 5893627 - DNA, 16 bp, Homo sapiens
cttacccttcaatgtt

SEQ ID NO: 5893628 - DNA, 13 bp, Homo sapiens
cttacccttctgt

SEQ ID NO: 5893629 - DNA, 17 bp, Homo sapiens
cttacccttctgtgccc

SEQ ID NO: 5893630 - DNA, 21 bp, Homo sapiens
cttacccttctgtgcccagct

SEQ ID NO: 5893631 - DNA, 16 bp, Homo sapiens
cttaccgaaatgaaaa

SEQ ID NO: 5893632 - DNA, 17 bp, Homo sapiens
cttaccgagagccaaac

SEQ ID NO: 5893633 - DNA, 21 bp, Homo sapiens
cttaccgagagccaaacagag

SEQ ID NO: 5893634 - DNA, 15 bp, Homo sapiens
cttacctaacatctg

SEQ ID NO: 5893635 - DNA, 19 bp, Homo sapiens
cttacctaagtgacatttg

SEQ ID NO: 5893636 - DNA, 18 bp, Homo sapiens
cttacctaccacatgcca

SEQ ID NO: 5893637 - DNA, 15 bp, Homo sapiens
cttacctcatttgca

SEQ ID NO: 5893638 - DNA, 16 bp, Homo sapiens
cttacctcatttgcat

SEQ ID NO: 5893639 - DNA, 17 bp, Homo sapiens
cttacctcatttgcatc

SEQ ID NO: 5893640 - DNA, 14 bp, Homo sapiens
cttacctcccacct

SEQ ID NO: 5893641 - DNA, 18 bp, Homo sapiens
cttacctcccctgccagg

SEQ ID NO: 5893642 - DNA, 20 bp, Homo sapiens
cttacctcctgcccaggaga

SEQ ID NO: 5893643 - DNA, 21 bp, Homo sapiens
cttacctcggggagaggggga

SEQ ID NO: 5893644 - DNA, 19 bp, Homo sapiens
cttacctcggtgccttcct

SEQ ID NO: 5893645 - DNA, 13 bp, Homo sapiens
cttacctctggaa

SEQ ID NO: 5893646 - DNA, 14 bp, Homo sapiens
cttacctctggaac

SEQ ID NO: 5893647 - DNA, 15 bp, Homo sapiens
cttacctctggaacc

SEQ ID NO: 5893648 - DNA, 15 bp, Homo sapiens
cttacctcttccgga

SEQ ID NO: 5893649 - DNA, 12 bp, Homo sapiens
cttacctgacac

SEQ ID NO: 5893650 - DNA, 18 bp, Homo sapiens
cttacctgacctcttgct

SEQ ID NO: 5893651 - DNA, 11 bp, Homo sapiens
cttacctgacg

SEQ ID NO: 5893652 - DNA, 12 bp, Homo sapiens
cttacctgacgg

SEQ ID NO: 5893653 - DNA, 13 bp, Homo sapiens
cttacctgccagg

SEQ ID NO: 5893654 - DNA, 16 bp, Homo sapiens
cttacctgcttgagct

SEQ ID NO: 5893655 - DNA, 13 bp, Homo sapiens
cttacctgggcac

SEQ ID NO: 5893656 - DNA, 18 bp, Homo sapiens
cttacctgggcacaaaca

SEQ ID NO: 5893657 - DNA, 22 bp, Homo sapiens
cttacctgggcacaaacagaat

SEQ ID NO: 5893658 - DNA, 20 bp, Homo sapiens
cttacctgtatgtctccagt

SEQ ID NO: 5893659 - DNA, 20 bp, Homo sapiens
cttacctgtctctctcttct

SEQ ID NO: 5893660 - DNA, 12 bp, Homo sapiens
cttacctgtgac

SEQ ID NO: 5893661 - DNA, 13 bp, Homo sapiens
cttacctgtgacc

SEQ ID NO: 5893662 - DNA, 15 bp, Homo sapiens
cttaccttcaataaa

SEQ ID NO: 5893663 - DNA, 21 bp, Homo sapiens
cttaccttcaataaagtatct

SEQ ID NO: 5893664 - DNA, 22 bp, Homo sapiens
cttaccttcaataaagtatcta

SEQ ID NO: 5893665 - DNA, 15 bp, Homo sapiens
cttaccttctgctgt

SEQ ID NO: 5893666 - DNA, 13 bp, Homo sapiens
cttaccttgtttt

SEQ ID NO: 5893667 - DNA, 18 bp, Homo sapiens
cttacctttcctgatgcc

SEQ ID NO: 5893668 - DNA, 19 bp, Homo sapiens
cttaccttttcctattctg

SEQ ID NO: 5893669 - DNA, 20 bp, Homo sapiens
cttacctttttatttgcatg

SEQ ID NO: 5893670 - DNA, 23 bp, Homo sapiens
cttacgaatacttttgccctttg

SEQ ID NO: 5893671 - DNA, 20 bp, Homo sapiens
cttacgaatattttcagtaa

SEQ ID NO: 5893672 - DNA, 14 bp, Homo sapiens
cttacgacactttg

SEQ ID NO: 5893673 - DNA, 19 bp, Homo sapiens
cttacgacactttggttta

SEQ ID NO: 5893674 - DNA, 15 bp, Homo sapiens
cttacgatcaggcac

SEQ ID NO: 5893675 - DNA, 22 bp, Homo sapiens
cttacgccctgttcccttcctg

SEQ ID NO: 5893676 - DNA, 21 bp, Homo sapiens
cttacgctatccagttgcagg

SEQ ID NO: 5893677 - DNA, 20 bp, Homo sapiens
cttacgctgctctcctgaca

SEQ ID NO: 5893678 - DNA, 15 bp, Homo sapiens
cttacggccctggcc

SEQ ID NO: 5893679 - DNA, 16 bp, Homo sapiens
cttacggccctggcct

SEQ ID NO: 5893680 - DNA, 15 bp, Homo sapiens
cttacggtgcacagt

SEQ ID NO: 5893681 - DNA, 15 bp, Homo sapiens
cttacgtgagtcctg

SEQ ID NO: 5893682 - DNA, 23 bp, Homo sapiens
cttacgtgttagacaagaactat

SEQ ID NO: 5893683 - DNA, 17 bp, Homo sapiens
cttactaaaaagtataa

SEQ ID NO: 5893684 - DNA, 18 bp, Homo sapiens
cttactaaaaagtataaa

SEQ ID NO: 5893685 - DNA, 14 bp, Homo sapiens
cttactaaaatata

SEQ ID NO: 5893686 - DNA, 21 bp, Homo sapiens
cttactaaacattttgttatt

SEQ ID NO: 5893687 - DNA, 15 bp, Homo sapiens
cttactaataaaatg

SEQ ID NO: 5893688 - DNA, 16 bp, Homo sapiens
cttactaataaaatgt

SEQ ID NO: 5893689 - DNA, 17 bp, Homo sapiens
cttactaataaaatgtg

SEQ ID NO: 5893690 - DNA, 19 bp, Homo sapiens
cttactaataaaatgtgaa

SEQ ID NO: 5893691 - DNA, 16 bp, Homo sapiens
cttactaataggtctg

SEQ ID NO: 5893692 - DNA, 18 bp, Homo sapiens
cttactacagaaagcaaa

SEQ ID NO: 5893693 - DNA, 21 bp, Homo sapiens
cttactacagaaagcaaatca

SEQ ID NO: 5893694 - DNA, 15 bp, Homo sapiens
cttactacagaaatg

SEQ ID NO: 5893695 - DNA, 18 bp, Homo sapiens
cttactactttaaatcct

SEQ ID NO: 5893696 - DNA, 22 bp, Homo sapiens
cttactagaaatatattcataa

SEQ ID NO: 5893697 - DNA, 23 bp, Homo sapiens
cttactagaaatatattcataat

SEQ ID NO: 5893698 - DNA, 14 bp, Homo sapiens
cttactagccctgc

SEQ ID NO: 5893699 - DNA, 22 bp, Homo sapiens
cttactataatggttggaacta

SEQ ID NO: 5893700 - DNA, 15 bp, Homo sapiens
cttactataatttga

SEQ ID NO: 5893701 - DNA, 17 bp, Homo sapiens
cttactatccatttctt

SEQ ID NO: 5893702 - DNA, 18 bp, Homo sapiens
cttactatgatctcagga

SEQ ID NO: 5893703 - DNA, 23 bp, Homo sapiens
cttactattcattaaatgtttga

SEQ ID NO: 5893704 - DNA, 12 bp, Homo sapiens
cttactattccc

SEQ ID NO: 5893705 - DNA, 15 bp, Homo sapiens
cttactattcccact

SEQ ID NO: 5893706 - DNA, 20 bp, Homo sapiens
cttactattcccactttcat

SEQ ID NO: 5893707 - DNA, 21 bp, Homo sapiens
cttactattcccactttcatt

SEQ ID NO: 5893708 - DNA, 12 bp, Homo sapiens
cttactattttg

SEQ ID NO: 5893709 - DNA, 24 bp, Homo sapiens
cttactcccccaccactcaggcca

SEQ ID NO: 5893710 - DNA, 17 bp, Homo sapiens
cttactcgtataccgtg

SEQ ID NO: 5893711 - DNA, 13 bp, Homo sapiens
cttactctaagat

SEQ ID NO: 5893712 - DNA, 13 bp, Homo sapiens
cttactctctgct

SEQ ID NO: 5893713 - DNA, 17 bp, Homo sapiens
cttactctgagcccagg

SEQ ID NO: 5893714 - DNA, 19 bp, Homo sapiens
cttactctgagcccaggcc

SEQ ID NO: 5893715 - DNA, 21 bp, Homo sapiens
cttactctgagcccaggccgt

SEQ ID NO: 5893716 - DNA, 14 bp, Homo sapiens
cttactctgagctc

SEQ ID NO: 5893717 - DNA, 20 bp, Homo sapiens
cttactctgagctcattaat

SEQ ID NO: 5893718 - DNA, 12 bp, Homo sapiens
cttactctttcc

SEQ ID NO: 5893719 - DNA, 22 bp, Homo sapiens
cttactgaaaaaaaaaaaagaa

SEQ ID NO: 5893720 - DNA, 15 bp, Homo sapiens
cttactgaaagacag

SEQ ID NO: 5893721 - DNA, 23 bp, Homo sapiens
cttactgagcgcaagccacagcc

SEQ ID NO: 5893722 - DNA, 19 bp, Homo sapiens
cttactgataaacctaata

SEQ ID NO: 5893723 - DNA, 14 bp, Homo sapiens
cttactgatattat

SEQ ID NO: 5893724 - DNA, 12 bp, Homo sapiens
cttactgcaaat

SEQ ID NO: 5893725 - DNA, 10 bp, Homo sapiens
cttagcctgc

SEQ ID NO: 5893726 - DNA, 13 bp, Homo sapiens
cttagcctggacc

SEQ ID NO: 5893727 - DNA, 19 bp, Homo sapiens
cttagcctggacctctgac

SEQ ID NO: 5893728 - DNA, 21 bp, Homo sapiens
cttagcctggacctctgacag

SEQ ID NO: 5893729 - DNA, 15 bp, Homo sapiens
cttagcctggagcac

SEQ ID NO: 5893730 - DNA, 14 bp, Homo sapiens
cttagcctgggcct

SEQ ID NO: 5893731 - DNA, 16 bp, Homo sapiens
cttagcctgggcctcc

SEQ ID NO: 5893732 - DNA, 17 bp, Homo sapiens
cttagcctgggcctcct

SEQ ID NO: 5893733 - DNA, 23 bp, Homo sapiens
cttagcctgggcctcctcctagc

SEQ ID NO: 5893734 - DNA, 14 bp, Homo sapiens
cttagccttgctgt

SEQ ID NO: 5893735 - DNA, 15 bp, Homo sapiens
cttagccttgctgta

SEQ ID NO: 5893736 - DNA, 23 bp, Homo sapiens
cttagccttgctgtagagacttc

SEQ ID NO: 5893737 - DNA, 11 bp, Homo sapiens
cttagccttgt

SEQ ID NO: 5893738 - DNA, 18 bp, Homo sapiens
cttagccttgtgccctgc

SEQ ID NO: 5893739 - DNA, 19 bp, Homo sapiens
cttagcctttaataggctt

SEQ ID NO: 5893740 - DNA, 18 bp, Homo sapiens
cttagcgtcaagacattt

SEQ ID NO: 5893741 - DNA, 19 bp, Homo sapiens
cttagcgttctggactctg

SEQ ID NO: 5893742 - DNA, 24 bp, Homo sapiens
cttagcgttctggactctgcccca

SEQ ID NO: 5893743 - DNA, 15 bp, Homo sapiens
cttagcgttctgttt

SEQ ID NO: 5893744 - DNA, 19 bp, Homo sapiens
cttagctagttttattctt

SEQ ID NO: 5893745 - DNA, 13 bp, Homo sapiens
cttagctatttat

SEQ ID NO: 5893746 - DNA, 13 bp, Homo sapiens
cttagctccctcc

SEQ ID NO: 5893747 - DNA, 19 bp, Homo sapiens
cttagctctcccaactctt

SEQ ID NO: 5893748 - DNA, 12 bp, Homo sapiens
cttagctctgga

SEQ ID NO: 5893749 - DNA, 19 bp, Homo sapiens
cttagctctggacgtgaaa

SEQ ID NO: 5893750 - DNA, 17 bp, Homo sapiens
cttagctcttaattgtt

SEQ ID NO: 5893751 - DNA, 19 bp, Homo sapiens
cttagctgaacaatgaatg

SEQ ID NO: 5893752 - DNA, 20 bp, Homo sapiens
cttagctgaacaatgaatgc

SEQ ID NO: 5893753 - DNA, 21 bp, Homo sapiens
cttagctgaggctgagaaagc

SEQ ID NO: 5893754 - DNA, 16 bp, Homo sapiens
cttagctgcactgttt

SEQ ID NO: 5893755 - DNA, 15 bp, Homo sapiens
cttagctgccaagcc

SEQ ID NO: 5893756 - DNA, 18 bp, Homo sapiens
cttagctgccccttctga

SEQ ID NO: 5893757 - DNA, 21 bp, Homo sapiens
cttagctgccccttctgagga

SEQ ID NO: 5893758 - DNA, 14 bp, Homo sapiens
cttagctgccttga

SEQ ID NO: 5893759 - DNA, 13 bp, Homo sapiens
cttagctggagaa

SEQ ID NO: 5893760 - DNA, 13 bp, Homo sapiens
cttagctgtacta

SEQ ID NO: 5893761 - DNA, 16 bp, Homo sapiens
cttagcttacaggaag

SEQ ID NO: 5893762 - DNA, 18 bp, Homo sapiens
cttagcttagacctcagc

SEQ ID NO: 5893763 - DNA, 19 bp, Homo sapiens
cttagcttagacctcagcc

SEQ ID NO: 5893764 - DNA, 17 bp, Homo sapiens
cttagcttatctttctt

SEQ ID NO: 5893765 - DNA, 18 bp, Homo sapiens
cttagcttcactcagctg

SEQ ID NO: 5893766 - DNA, 11 bp, Homo sapiens
cttagcttcag

SEQ ID NO: 5893767 - DNA, 13 bp, Homo sapiens
cttagcttcagga

SEQ ID NO: 5893768 - DNA, 14 bp, Homo sapiens
cttagcttcaggaa

SEQ ID NO: 5893769 - DNA, 15 bp, Homo sapiens
cttagcttcaggaac

SEQ ID NO: 5893770 - DNA, 16 bp, Homo sapiens
cttagcttcaggaacc

SEQ ID NO: 5893771 - DNA, 13 bp, Homo sapiens
cttagctttacat

SEQ ID NO: 5893772 - DNA, 20 bp, Homo sapiens
cttagctttagaaacagtgc

SEQ ID NO: 5893773 - DNA, 14 bp, Homo sapiens
cttagctttccaca

SEQ ID NO: 5893774 - DNA, 19 bp, Homo sapiens
cttagctttccacaggagg

SEQ ID NO: 5893775 - DNA, 18 bp, Homo sapiens
cttagctttgctctgcca

SEQ ID NO: 5893776 - DNA, 14 bp, Homo sapiens
cttagcttttaata

SEQ ID NO: 5893777 - DNA, 20 bp, Homo sapiens
cttagcttttagcctggctg

SEQ ID NO: 5893778 - DNA, 13 bp, Homo sapiens
cttagcttttctg

SEQ ID NO: 5893779 - DNA, 14 bp, Homo sapiens
cttagcttttgatg

SEQ ID NO: 5893780 - DNA, 14 bp, Homo sapiens
cttagctttttaat

SEQ ID NO: 5893781 - DNA, 16 bp, Homo sapiens
cttagctttttaattg

SEQ ID NO: 5893782 - DNA, 15 bp, Homo sapiens
cttaggaaaggagat

SEQ ID NO: 5893783 - DNA, 17 bp, Homo sapiens
cttaggaaccttctccc

SEQ ID NO: 5893784 - DNA, 14 bp, Homo sapiens
cttaggaagaaatc

SEQ ID NO: 5893785 - DNA, 11 bp, Homo sapiens
cttaggaagga

SEQ ID NO: 5893786 - DNA, 20 bp, Homo sapiens
cttaggacagggtccctgct

SEQ ID NO: 5893787 - DNA, 23 bp, Homo sapiens
cttaggagaagtcttctatttat

SEQ ID NO: 5893788 - DNA, 22 bp, Homo sapiens
cttaggagacagatcactcctg

SEQ ID NO: 5893789 - DNA, 19 bp, Homo sapiens
cttaggagacgctgcactt

SEQ ID NO: 5893790 - DNA, 14 bp, Homo sapiens
cttaggagatgtca

SEQ ID NO: 5893791 - DNA, 13 bp, Homo sapiens
cttaggagcaaaa

SEQ ID NO: 5893792 - DNA, 14 bp, Homo sapiens
cttaggagcaaaat

SEQ ID NO: 5893793 - DNA, 15 bp, Homo sapiens
cttaggaggctgagg

SEQ ID NO: 5893794 - DNA, 20 bp, Homo sapiens
cttaggatggggctcccagc

SEQ ID NO: 5893795 - DNA, 22 bp, Homo sapiens
cttaggatggggctcccagctc

SEQ ID NO: 5893796 - DNA, 22 bp, Homo sapiens
cttaggatgtgtgcatgtgtgt

SEQ ID NO: 5893797 - DNA, 13 bp, Homo sapiens
cttaggattctaa

SEQ ID NO: 5893798 - DNA, 14 bp, Homo sapiens
cttaggcactaaag

SEQ ID NO: 5893799 - DNA, 12 bp, Homo sapiens
cttaggccttcc

SEQ ID NO: 5893800 - DNA, 17 bp, Homo sapiens
cttaggccttcctctct

SEQ ID NO: 5893801 - DNA, 13 bp, Homo sapiens
cttaggccttttt

SEQ ID NO: 5893802 - DNA, 16 bp, Homo sapiens
cttaggctgctgggat

SEQ ID NO: 5893803 - DNA, 13 bp, Homo sapiens
cttaggctttgta

SEQ ID NO: 5893804 - DNA, 14 bp, Homo sapiens
cttagggaaagatg

SEQ ID NO: 5893805 - DNA, 22 bp, Homo sapiens
cttagggaaagatgtagaaaga

SEQ ID NO: 5893806 - DNA, 20 bp, Homo sapiens
cttagggaagaaaaagcaag

SEQ ID NO: 5893807 - DNA, 22 bp, Homo sapiens
cttagggaagttgtctccttcc

SEQ ID NO: 5893808 - DNA, 20 bp, Homo sapiens
cttagggacaggaccccagc

SEQ ID NO: 5893809 - DNA, 13 bp, Homo sapiens
cttagggagcccc

SEQ ID NO: 5893810 - DNA, 15 bp, Homo sapiens
cttaggggaaggaga

SEQ ID NO: 5893811 - DNA, 17 bp, Homo sapiens
cttagggtacagcccag

SEQ ID NO: 5893812 - DNA, 11 bp, Homo sapiens
cttagggtctc

SEQ ID NO: 5893813 - DNA, 17 bp, Homo sapiens
cttagggtctcagggtg

SEQ ID NO: 5893814 - DNA, 16 bp, Homo sapiens
cttagggtgaaccact

SEQ ID NO: 5893815 - DNA, 22 bp, Homo sapiens
cttagggtgaaccacttcattc

SEQ ID NO: 5893816 - DNA, 21 bp, Homo sapiens
cttagggtggctttaattgta

SEQ ID NO: 5893817 - DNA, 20 bp, Homo sapiens
cttaggtaattgtagggcga

SEQ ID NO: 5893818 - DNA, 14 bp, Homo sapiens
cttaggtcaggagt

SEQ ID NO: 5893819 - DNA, 17 bp, Homo sapiens
cttaggtcccgggagga

SEQ ID NO: 5893820 - DNA, 19 bp, Homo sapiens
cttaggtcgcgctcttgca

SEQ ID NO: 5893821 - DNA, 21 bp, Homo sapiens
cttaggtcttcctgtggctcc

SEQ ID NO: 5893822 - DNA, 18 bp, Homo sapiens
cttaggtgaaggcagaag

SEQ ID NO: 5893823 - DNA, 15 bp, Homo sapiens
cttaggtgccaggct

SEQ ID NO: 5893824 - DNA, 18 bp, Homo sapiens
cttaggtgccaggctgta

SEQ ID NO: 5893825 - DNA, 17 bp, Homo sapiens
cttaggttggcaaaaag

SEQ ID NO: 5893826 - DNA, 14 bp, Homo sapiens
cttaggtttactgt

SEQ ID NO: 5893827 - DNA, 14 bp, Homo sapiens
cttaggttttgtcc

SEQ ID NO: 5893828 - DNA, 19 bp, Homo sapiens
cttagtaaaatttatttca

SEQ ID NO: 5893829 - DNA, 16 bp, Homo sapiens
cttagtaactttttat

SEQ ID NO: 5893830 - DNA, 18 bp, Homo sapiens
cttagtaagtaatatcaa

SEQ ID NO: 5893831 - DNA, 13 bp, Homo sapiens
cttagtaatagca

SEQ ID NO: 5893832 - DNA, 19 bp, Homo sapiens
cttagtacaaagtttcaat

SEQ ID NO: 5893833 - DNA, 18 bp, Homo sapiens
cttagtacctttttaaca

SEQ ID NO: 5893834 - DNA, 18 bp, Homo sapiens
cttagtacggctgctgca

SEQ ID NO: 5893835 - DNA, 15 bp, Homo sapiens
cttagtactcttcta

SEQ ID NO: 5893836 - DNA, 18 bp, Homo sapiens
cttagtagtttttacaaa

SEQ ID NO: 5893837 - DNA, 18 bp, Homo sapiens
cttagtatagtagaaaga

SEQ ID NO: 5893838 - DNA, 21 bp, Homo sapiens
cttagtatgcagttgataaga

SEQ ID NO: 5893839 - DNA, 17 bp, Homo sapiens
cttagtatggttctcag

SEQ ID NO: 5893840 - DNA, 16 bp, Homo sapiens
cttagtattgacaact

SEQ ID NO: 5893841 - DNA, 14 bp, Homo sapiens
cttagtattttacc

SEQ ID NO: 5893842 - DNA, 13 bp, Homo sapiens
cttagtcactgcc

SEQ ID NO: 5893843 - DNA, 15 bp, Homo sapiens
cttagtcatggtgtt

SEQ ID NO: 5893844 - DNA, 12 bp, Homo sapiens
cttagtccacaa

SEQ ID NO: 5893845 - DNA, 16 bp, Homo sapiens
cttagtccagttgtgt

SEQ ID NO: 5893846 - DNA, 12 bp, Homo sapiens
cttagtccccca

SEQ ID NO: 5893847 - DNA, 17 bp, Homo sapiens
cttagtcccccaactct

SEQ ID NO: 5893848 - DNA, 23 bp, Homo sapiens
cttagtcccccaactctgagccc

SEQ ID NO: 5893849 - DNA, 22 bp, Homo sapiens
cttagtccgcaagttcagggaa

SEQ ID NO: 5893850 - DNA, 14 bp, Homo sapiens
cttagtcctccctg

SEQ ID NO: 5893851 - DNA, 12 bp, Homo sapiens
cttagtcctggg

SEQ ID NO: 5893852 - DNA, 13 bp, Homo sapiens
cttagtcctggga

SEQ ID NO: 5893853 - DNA, 17 bp, Homo sapiens
cttagtcctgggagagg

SEQ ID NO: 5893854 - DNA, 20 bp, Homo sapiens
cttagtcctgggagaggaca

SEQ ID NO: 5893855 - DNA, 19 bp, Homo sapiens
cttagtctcagtttgtgtg

SEQ ID NO: 5893856 - DNA, 15 bp, Homo sapiens
cttagtgactcttga

SEQ ID NO: 5893857 - DNA, 19 bp, Homo sapiens
cttagtgatcatttaaaaa

SEQ ID NO: 5893858 - DNA, 16 bp, Homo sapiens
cttagtgcaaaaaaca

SEQ ID NO: 5893859 - DNA, 18 bp, Homo sapiens
cttagtgcaaaaaacata

SEQ ID NO: 5893860 - DNA, 19 bp, Homo sapiens
cttagtgcagttatttgct

SEQ ID NO: 5893861 - DNA, 16 bp, Homo sapiens
cttagtgccacccacc

SEQ ID NO: 5893862 - DNA, 21 bp, Homo sapiens
cttagtgcccgcctaggagtt

SEQ ID NO: 5893863 - DNA, 20 bp, Homo sapiens
cttagtgcggacaagtttta

SEQ ID NO: 5893864 - DNA, 17 bp, Homo sapiens
cttagtgctgctttgct

SEQ ID NO: 5893865 - DNA, 22 bp, Homo sapiens
cttagtgcttcagagtttgtgt

SEQ ID NO: 5893866 - DNA, 12 bp, Homo sapiens
cttagtggacag

SEQ ID NO: 5893867 - DNA, 22 bp, Homo sapiens
cttagtggcttttttcctcctg

SEQ ID NO: 5893868 - DNA, 13 bp, Homo sapiens
cttagtgggccag

SEQ ID NO: 5893869 - DNA, 20 bp, Homo sapiens
cttagtggtatgtctcttta

SEQ ID NO: 5893870 - DNA, 17 bp, Homo sapiens
cttagtgtcacctttct

SEQ ID NO: 5893871 - DNA, 22 bp, Homo sapiens
cttagtgtttagcattaaaaat

SEQ ID NO: 5893872 - DNA, 21 bp, Homo sapiens
cttagtgttttaaaacacctc

SEQ ID NO: 5893873 - DNA, 22 bp, Homo sapiens
cttagttaaaattgatttcttc

SEQ ID NO: 5893874 - DNA, 15 bp, Homo sapiens
cttagttctcactgt

SEQ ID NO: 5893875 - DNA, 16 bp, Homo sapiens
cttagttctcactgtt

SEQ ID NO: 5893876 - DNA, 18 bp, Homo sapiens
cttagttcttaccttttg

SEQ ID NO: 5893877 - DNA, 12 bp, Homo sapiens
cttagttcttga

SEQ ID NO: 5893878 - DNA, 16 bp, Homo sapiens
cttagttcttgaattg

SEQ ID NO: 5893879 - DNA, 18 bp, Homo sapiens
cttagttcttgaattgtt

SEQ ID NO: 5893880 - DNA, 20 bp, Homo sapiens
cttagttgacaacctagaat

SEQ ID NO: 5893881 - DNA, 22 bp, Homo sapiens
cttagttgacaacctagaatgt

SEQ ID NO: 5893882 - DNA, 23 bp, Homo sapiens
cttagttgacaacctagaatgtc

SEQ ID NO: 5893883 - DNA, 15 bp, Homo sapiens
cttagttgatattca

SEQ ID NO: 5893884 - DNA, 23 bp, Homo sapiens
cttagttgatattcaaggcttta

SEQ ID NO: 5893885 - DNA, 19 bp, Homo sapiens
cttagttggctggaaactg

SEQ ID NO: 5893886 - DNA, 17 bp, Homo sapiens
cttagttggctttgccc

SEQ ID NO: 5893887 - DNA, 17 bp, Homo sapiens
cttagtttcagaagtac

SEQ ID NO: 5893888 - DNA, 17 bp, Homo sapiens
cttagtttcagagacct

SEQ ID NO: 5893889 - DNA, 16 bp, Homo sapiens
cttagtttcagctgac

SEQ ID NO: 5893890 - DNA, 19 bp, Homo sapiens
cttagtttggattcttatg

SEQ ID NO: 5893891 - DNA, 13 bp, Homo sapiens
cttagtttgtgaa

SEQ ID NO: 5893892 - DNA, 15 bp, Homo sapiens
cttagttttgggagg

SEQ ID NO: 5893893 - DNA, 13 bp, Homo sapiens
cttagtttttaaa

SEQ ID NO: 5893894 - DNA, 16 bp, Homo sapiens
cttagtttttaaaaag

SEQ ID NO: 5893895 - DNA, 21 bp, Homo sapiens
cttagtttttaaaatttattt

SEQ ID NO: 5893896 - DNA, 16 bp, Homo sapiens
cttagttttttttaaa

SEQ ID NO: 5893897 - DNA, 19 bp, Homo sapiens
cttagttttttttaaaaaa

SEQ ID NO: 5893898 - DNA, 14 bp, Homo sapiens
cttataaaacagag

SEQ ID NO: 5893899 - DNA, 22 bp, Homo sapiens
cttataaaataacttgcatcta

SEQ ID NO: 5893900 - DNA, 14 bp, Homo sapiens
cttataaaatcaat

SEQ ID NO: 5893901 - DNA, 19 bp, Homo sapiens
cttataaaatcctgtgcaa

SEQ ID NO: 5893902 - DNA, 20 bp, Homo sapiens
cttataaacacattgaatgc

SEQ ID NO: 5893903 - DNA, 19 bp, Homo sapiens
cttataaaccaatcttaaa

SEQ ID NO: 5893904 - DNA, 17 bp, Homo sapiens
cttataaatatgaagct

SEQ ID NO: 5893905 - DNA, 16 bp, Homo sapiens
cttattttccaataaa

SEQ ID NO: 5893906 - DNA, 14 bp, Homo sapiens
cttattttctctgt

SEQ ID NO: 5893907 - DNA, 11 bp, Homo sapiens
cttattttctg

SEQ ID NO: 5893908 - DNA, 16 bp, Homo sapiens
cttattttcttggaat

SEQ ID NO: 5893909 - DNA, 20 bp, Homo sapiens
cttattttgcattccagaat

SEQ ID NO: 5893910 - DNA, 12 bp, Homo sapiens
cttattttgctt

SEQ ID NO: 5893911 - DNA, 21 bp, Homo sapiens
cttattttgggttcaggcctg

SEQ ID NO: 5893912 - DNA, 21 bp, Homo sapiens
cttattttgtaataaactctc

SEQ ID NO: 5893913 - DNA, 14 bp, Homo sapiens
cttattttgtctta

SEQ ID NO: 5893914 - DNA, 19 bp, Homo sapiens
cttattttgtcttattctt

SEQ ID NO: 5893915 - DNA, 20 bp, Homo sapiens
cttattttgttggtgctttg

SEQ ID NO: 5893916 - DNA, 22 bp, Homo sapiens
cttattttgtttcaatctctga

SEQ ID NO: 5893917 - DNA, 21 bp, Homo sapiens
cttatttttaaaattttaata

SEQ ID NO: 5893918 - DNA, 18 bp, Homo sapiens
cttatttttagccataat

SEQ ID NO: 5893919 - DNA, 16 bp, Homo sapiens
cttatttttataatta

SEQ ID NO: 5893920 - DNA, 19 bp, Homo sapiens
cttatttttataattaaag

SEQ ID NO: 5893921 - DNA, 22 bp, Homo sapiens
cttatttttatttatttttgta

SEQ ID NO: 5893922 - DNA, 17 bp, Homo sapiens
cttatttttcaccaggt

SEQ ID NO: 5893923 - DNA, 16 bp, Homo sapiens
cttatttttcctgtcc

SEQ ID NO: 5893924 - DNA, 18 bp, Homo sapiens
cttatttttcctgtcctg

SEQ ID NO: 5893925 - DNA, 14 bp, Homo sapiens
cttatttttctgag

SEQ ID NO: 5893926 - DNA, 22 bp, Homo sapiens
cttatttttctgaggtccttat

SEQ ID NO: 5893927 - DNA, 22 bp, Homo sapiens
cttatttttgaattctttagat

SEQ ID NO: 5893928 - DNA, 17 bp, Homo sapiens
cttatttttgacagtgt

SEQ ID NO: 5893929 - DNA, 13 bp, Homo sapiens
cttatttttgtac

SEQ ID NO: 5893930 - DNA, 14 bp, Homo sapiens
cttatttttgtacc

SEQ ID NO: 5893931 - DNA, 15 bp, Homo sapiens
cttattttttcccaa

SEQ ID NO: 5893932 - DNA, 17 bp, Homo sapiens
cttattttttctttctt

SEQ ID NO: 5893933 - DNA, 14 bp, Homo sapiens
cttcaaaaactaaa

SEQ ID NO: 5893934 - DNA, 17 bp, Homo sapiens
cttcaaaaactaaaatc

SEQ ID NO: 5893935 - DNA, 21 bp, Homo sapiens
cttcaaaaactgtcaaagaat

SEQ ID NO: 5893936 - DNA, 14 bp, Homo sapiens
cttcaaaaataatg

SEQ ID NO: 5893937 - DNA, 13 bp, Homo sapiens
cttcaaaaataca

SEQ ID NO: 5893938 - DNA, 19 bp, Homo sapiens
cttcaaaaatacagaattt

SEQ ID NO: 5893939 - DNA, 13 bp, Homo sapiens
cttcaaaacagaa

SEQ ID NO: 5893940 - DNA, 12 bp, Homo sapiens
cttcaaaacatt

SEQ ID NO: 5893941 - DNA, 21 bp, Homo sapiens
cttcaaaagtattttcctgta

SEQ ID NO: 5893942 - DNA, 21 bp, Homo sapiens
cttcaaaatataaaatgccaa

SEQ ID NO: 5893943 - DNA, 22 bp, Homo sapiens
cttcaaaatattgagcagaatt

SEQ ID NO: 5893944 - DNA, 15 bp, Homo sapiens
cttcaaaatgtatat

SEQ ID NO: 5893945 - DNA, 20 bp, Homo sapiens
cttcaaaatgttatcttctc

SEQ ID NO: 5893946 - DNA, 19 bp, Homo sapiens
cttcaaacaggaatttctg

SEQ ID NO: 5893947 - DNA, 18 bp, Homo sapiens
cttcaaacatgccctcag

SEQ ID NO: 5893948 - DNA, 20 bp, Homo sapiens
cttcaaacatgccctcaggc

SEQ ID NO: 5893949 - DNA, 18 bp, Homo sapiens
cttcaaacctaaaaatca

SEQ ID NO: 5893950 - DNA, 13 bp, Homo sapiens
cttcaaacctcat

SEQ ID NO: 5893951 - DNA, 16 bp, Homo sapiens
cttcaaacgaaatggc

SEQ ID NO: 5893952 - DNA, 23 bp, Homo sapiens
cttcaaactagggccaagcccag

SEQ ID NO: 5893953 - DNA, 16 bp, Homo sapiens
cttcaaagaaacttga

SEQ ID NO: 5893954 - DNA, 18 bp, Homo sapiens
cttcaaagaagctgtctt

SEQ ID NO: 5893955 - DNA, 13 bp, Homo sapiens
cttcaaagattat

SEQ ID NO: 5893956 - DNA, 21 bp, Homo sapiens
cttcaaagattatctgattcc

SEQ ID NO: 5893957 - DNA, 23 bp, Homo sapiens
cttcaaagccatatggacactgt

SEQ ID NO: 5893958 - DNA, 15 bp, Homo sapiens
cttcaaagccttctc

SEQ ID NO: 5893959 - DNA, 11 bp, Homo sapiens
cttcaaagctg

SEQ ID NO: 5893960 - DNA, 17 bp, Homo sapiens
cttcaaagcttttgtaa

SEQ ID NO: 5893961 - DNA, 22 bp, Homo sapiens
cttcaaagcttttgtaaaataa

SEQ ID NO: 5893962 - DNA, 21 bp, Homo sapiens
cttcaaaggattttggaaaag

SEQ ID NO: 5893963 - DNA, 16 bp, Homo sapiens
cttcaaagtctcaatg

SEQ ID NO: 5893964 - DNA, 14 bp, Homo sapiens
cttcaaagtgcctg

SEQ ID NO: 5893965 - DNA, 17 bp, Homo sapiens
cttcaaagtgcctgggc

SEQ ID NO: 5893966 - DNA, 19 bp, Homo sapiens
cttcaaagtgcctgggctc

SEQ ID NO: 5893967 - DNA, 20 bp, Homo sapiens
cttcaaagtggcaagtattt

SEQ ID NO: 5893968 - DNA, 13 bp, Homo sapiens
cttcaaagtgtgt

SEQ ID NO: 5893969 - DNA, 20 bp, Homo sapiens
cttcaaagtgtgtctgggat

SEQ ID NO: 5893970 - DNA, 15 bp, Homo sapiens
cttcaaagtttaata

SEQ ID NO: 5893971 - DNA, 14 bp, Homo sapiens
cttcaaataattaa

SEQ ID NO: 5893972 - DNA, 15 bp, Homo sapiens
cttcaaatacaaagt

SEQ ID NO: 5893973 - DNA, 15 bp, Homo sapiens
cttcaaatatttccc

SEQ ID NO: 5893974 - DNA, 13 bp, Homo sapiens
cttcaaatcagag

SEQ ID NO: 5893975 - DNA, 16 bp, Homo sapiens
cttcaaatcagagcag

SEQ ID NO: 5893976 - DNA, 17 bp, Homo sapiens
cttcaaatccatccaga

SEQ ID NO: 5893977 - DNA, 18 bp, Homo sapiens
cttcaaatccttccaaaa

SEQ ID NO: 5893978 - DNA, 17 bp, Homo sapiens
cttcaaatgatccttcc

SEQ ID NO: 5893979 - DNA, 13 bp, Homo sapiens
cttcaaatgcctg

SEQ ID NO: 5893980 - DNA, 14 bp, Homo sapiens
cttcaaatgtgtaa

SEQ ID NO: 5893981 - DNA, 13 bp, Homo sapiens
cttcaaattagaa

SEQ ID NO: 5893982 - DNA, 19 bp, Homo sapiens
cttcaaattagaagacatt

SEQ ID NO: 5893983 - DNA, 18 bp, Homo sapiens
cttcaaattatagaaaca

SEQ ID NO: 5893984 - DNA, 15 bp, Homo sapiens
cttcaaatttgattc

SEQ ID NO: 5893985 - DNA, 21 bp, Homo sapiens
cttcaaattttttaaaagaga

SEQ ID NO: 5893986 - DNA, 22 bp, Homo sapiens
cttcaacaaggcttgctgcaga

SEQ ID NO: 5893987 - DNA, 16 bp, Homo sapiens
cttcaacacagcttgt

SEQ ID NO: 5893988 - DNA, 13 bp, Homo sapiens
cttcaacatcctg

SEQ ID NO: 5893989 - DNA, 16 bp, Homo sapiens
cttcaacatcctgcca

SEQ ID NO: 5893990 - DNA, 17 bp, Homo sapiens
cttcaacatcctgccag

SEQ ID NO: 5893991 - DNA, 21 bp, Homo sapiens
cttcaacatcctgccagcccc

SEQ ID NO: 5893992 - DNA, 12 bp, Homo sapiens
cttcaacatgtg

SEQ ID NO: 5893993 - DNA, 16 bp, Homo sapiens
cttcaacatgtgtgac

SEQ ID NO: 5893994 - DNA, 15 bp, Homo sapiens
cttcaacatttacat

SEQ ID NO: 5893995 - DNA, 14 bp, Homo sapiens
cttcaaccagggat

SEQ ID NO: 5893996 - DNA, 16 bp, Homo sapiens
cttcaaccattcccca

SEQ ID NO: 5893997 - DNA, 16 bp, Homo sapiens
cttcaacccccagcta

SEQ ID NO: 5893998 - DNA, 21 bp, Homo sapiens
cttcaaccccgaggtccctgt

SEQ ID NO: 5893999 - DNA, 14 bp, Homo sapiens
cttcaaccctcagc

SEQ ID NO: 5894000 - DNA, 15 bp, Homo sapiens
cttcaaccctcagcc

SEQ ID NO: 5894001 - DNA, 17 bp, Homo sapiens
cttcaaccctgccctgc

SEQ ID NO: 5894002 - DNA, 18 bp, Homo sapiens
cttcaaccctgccctgca

SEQ ID NO: 5894003 - DNA, 17 bp, Homo sapiens
cttcaaccttgagacag

SEQ ID NO: 5894004 - DNA, 19 bp, Homo sapiens
cttcaacgtttcttcactt

SEQ ID NO: 5894005 - DNA, 16 bp, Homo sapiens
cttcaactcctgggct

SEQ ID NO: 5894006 - DNA, 14 bp, Homo sapiens
cttcaactctgtga

SEQ ID NO: 5894007 - DNA, 15 bp, Homo sapiens
cttcaactctgtgag

SEQ ID NO: 5894008 - DNA, 17 bp, Homo sapiens
cttcaactgaccagcct

SEQ ID NO: 5894009 - DNA, 20 bp, Homo sapiens
cttcaactgaccagcctcca

SEQ ID NO: 5894010 - DNA, 23 bp, Homo sapiens
cttcaactgaccagcctccatgc

SEQ ID NO: 5894011 - DNA, 17 bp, Homo sapiens
cttcaactgtctgtctt

SEQ ID NO: 5894012 - DNA, 18 bp, Homo sapiens
cttcaacttgtgcctggg

SEQ ID NO: 5894013 - DNA, 16 bp, Homo sapiens
cttcaacttttctctt

SEQ ID NO: 5894014 - DNA, 21 bp, Homo sapiens
cttcaagaaagaattcctgca

SEQ ID NO: 5894015 - DNA, 17 bp, Homo sapiens
cttcaagaccttcacca

SEQ ID NO: 5894016 - DNA, 19 bp, Homo sapiens
cttcaagacgaggggcagg

SEQ ID NO: 5894017 - DNA, 18 bp, Homo sapiens
cttcaagatcatgtaccc

SEQ ID NO: 5894018 - DNA, 22 bp, Homo sapiens
cttcaagatcctcttgccacat

SEQ ID NO: 5894019 - DNA, 19 bp, Homo sapiens
cttcaagatgagcctgggc

SEQ ID NO: 5894020 - DNA, 21 bp, Homo sapiens
cttcaagatgagcctgggctc

SEQ ID NO: 5894021 - DNA, 19 bp, Homo sapiens
cttcaagcaccctgttccc

SEQ ID NO: 5894022 - DNA, 21 bp, Homo sapiens
cttcaagcagaatcctcagtt

SEQ ID NO: 5894023 - DNA, 20 bp, Homo sapiens
cttcaagcatcctcagaagc

SEQ ID NO: 5894024 - DNA, 22 bp, Homo sapiens
cttcaagcctggcccagtgaga

SEQ ID NO: 5894025 - DNA, 16 bp, Homo sapiens
cttcaagcgctccagg

SEQ ID NO: 5894026 - DNA, 13 bp, Homo sapiens
cttcaagctctct

SEQ ID NO: 5894027 - DNA, 16 bp, Homo sapiens
cttcaagctctctgtt

SEQ ID NO: 5894028 - DNA, 17 bp, Homo sapiens
cttcaagctctgaggga

SEQ ID NO: 5894029 - DNA, 18 bp, Homo sapiens
cttcaaggaaaataagtg

SEQ ID NO: 5894030 - DNA, 22 bp, Homo sapiens
cttcaaggaaaataagtgaaat

SEQ ID NO: 5894031 - DNA, 16 bp, Homo sapiens
cttcaaggaggcccac

SEQ ID NO: 5894032 - DNA, 18 bp, Homo sapiens
cttcaaggaggcccactg

SEQ ID NO: 5894033 - DNA, 22 bp, Homo sapiens
cttcaaggatcctgagccagat

SEQ ID NO: 5894034 - DNA, 13 bp, Homo sapiens
cttcaaggcctcc

SEQ ID NO: 5894035 - DNA, 13 bp, Homo sapiens
cttcaaggcttca

SEQ ID NO: 5894036 - DNA, 17 bp, Homo sapiens
cttcaaggcttcagtct

SEQ ID NO: 5894037 - DNA, 16 bp, Homo sapiens
cttcaagggctgcttc

SEQ ID NO: 5894038 - DNA, 15 bp, Homo sapiens
cttcaagggtaatct

SEQ ID NO: 5894039 - DNA, 23 bp, Homo sapiens
cttcaaggtgacagaaggaccag

SEQ ID NO: 5894040 - DNA, 20 bp, Homo sapiens
cttcaaggtgtaaaatatct

SEQ ID NO: 5894041 - DNA, 14 bp, Homo sapiens
cttcaagtctgtgc

SEQ ID NO: 5894042 - DNA, 22 bp, Homo sapiens
cttcaagtgcatgctctctgca

SEQ ID NO: 5894043 - DNA, 13 bp, Homo sapiens
cttcaagtgccaa

SEQ ID NO: 5894044 - DNA, 19 bp, Homo sapiens
cttcaagtgccaaacagag

SEQ ID NO: 5894045 - DNA, 19 bp, Homo sapiens
cttcaagttagctcaggag

SEQ ID NO: 5894046 - DNA, 20 bp, Homo sapiens
cttcaagttagctcaggagg

SEQ ID NO: 5894047 - DNA, 12 bp, Homo sapiens
cttcaagttgta

SEQ ID NO: 5894048 - DNA, 22 bp, Homo sapiens
cttcaagttgtaaaaatgaaag

SEQ ID NO: 5894049 - DNA, 20 bp, Homo sapiens
cttcaataaaatggttcata

SEQ ID NO: 5894050 - DNA, 23 bp, Homo sapiens
cttcaataaaccacaagcatctc

SEQ ID NO: 5894051 - DNA, 12 bp, Homo sapiens
cttcaataaagt

SEQ ID NO: 5894052 - DNA, 14 bp, Homo sapiens
cttcaataaagtat

SEQ ID NO: 5894053 - DNA, 12 bp, Homo sapiens
cttcaatacaaa

SEQ ID NO: 5894054 - DNA, 14 bp, Homo sapiens
cttcaatagaactg

SEQ ID NO: 5894055 - DNA, 14 bp, Homo sapiens
cttcaatataagaa

SEQ ID NO: 5894056 - DNA, 18 bp, Homo sapiens
cttcaatataagaagcaa

SEQ ID NO: 5894057 - DNA, 22 bp, Homo sapiens
cttcaatataagaagcaatctt

SEQ ID NO: 5894058 - DNA, 15 bp, Homo sapiens
cttcaatatgaagga

SEQ ID NO: 5894059 - DNA, 18 bp, Homo sapiens
cttcaatatgaatctata

SEQ ID NO: 5894060 - DNA, 17 bp, Homo sapiens
cttcaatcactagtcaa

SEQ ID NO: 5894061 - DNA, 22 bp, Homo sapiens
cttcaatcactagtcaagaaaa

SEQ ID NO: 5894062 - DNA, 18 bp, Homo sapiens
cttcaatcctgtcaatgt

SEQ ID NO: 5894063 - DNA, 16 bp, Homo sapiens
cttcaatctacgatgt

SEQ ID NO: 5894064 - DNA, 13 bp, Homo sapiens
cttcaatctctgt

SEQ ID NO: 5894065 - DNA, 16 bp, Homo sapiens
cttcaatgaaaaaatc

SEQ ID NO: 5894066 - DNA, 20 bp, Homo sapiens
cttcaatgtgtcatttccgg

SEQ ID NO: 5894067 - DNA, 17 bp, Homo sapiens
cttcaattagttcccct

SEQ ID NO: 5894068 - DNA, 15 bp, Homo sapiens
cttcaattatttccc

SEQ ID NO: 5894069 - DNA, 15 bp, Homo sapiens
cttcaattcctgggc

SEQ ID NO: 5894070 - DNA, 15 bp, Homo sapiens
cttcaatttcaaact

SEQ ID NO: 5894071 - DNA, 20 bp, Homo sapiens
cttcaatttcaaacttttga

SEQ ID NO: 5894072 - DNA, 21 bp, Homo sapiens
cttcaatttcaaacttttgaa

SEQ ID NO: 5894073 - DNA, 22 bp, Homo sapiens
cttcaatttcaaacttttgaaa

SEQ ID NO: 5894074 - DNA, 14 bp, Homo sapiens
cttcaatttcccac

SEQ ID NO: 5894075 - DNA, 16 bp, Homo sapiens
cttcaatttcccaccc

SEQ ID NO: 5894076 - DNA, 18 bp, Homo sapiens
cttcaatttcccacccat

SEQ ID NO: 5894077 - DNA, 19 bp, Homo sapiens
cttcaatttctagtacctg

SEQ ID NO: 5894078 - DNA, 12 bp, Homo sapiens
cttcaatttgga

SEQ ID NO: 5894079 - DNA, 15 bp, Homo sapiens
cttcacaaaatgcac

SEQ ID NO: 5894080 - DNA, 14 bp, Homo sapiens
cttcacaaagccca

SEQ ID NO: 5894081 - DNA, 12 bp, Homo sapiens
cttcacaaatgt

SEQ ID NO: 5894082 - DNA, 14 bp, Homo sapiens
cttcacaaatgtca

SEQ ID NO: 5894083 - DNA, 20 bp, Homo sapiens
cttcacaaatgtcattgtct

SEQ ID NO: 5894084 - DNA, 22 bp, Homo sapiens
cttcagtgaatatttttgtatt

SEQ ID NO: 5894085 - DNA, 15 bp, Homo sapiens
cttcagtgactcctg

SEQ ID NO: 5894086 - DNA, 23 bp, Homo sapiens
cttcagtgactcctgctggtacc

SEQ ID NO: 5894087 - DNA, 15 bp, Homo sapiens
cttcagtgagcccct

SEQ ID NO: 5894088 - DNA, 17 bp, Homo sapiens
cttcagtgagcccctcc

SEQ ID NO: 5894089 - DNA, 18 bp, Homo sapiens
cttcagtgagcccctccc

SEQ ID NO: 5894090 - DNA, 13 bp, Homo sapiens
cttcagtgcccac

SEQ ID NO: 5894091 - DNA, 17 bp, Homo sapiens
cttcagtgcccaccaac

SEQ ID NO: 5894092 - DNA, 18 bp, Homo sapiens
cttcagtgccttatggaa

SEQ ID NO: 5894093 - DNA, 17 bp, Homo sapiens
cttcagtgctacatttt

SEQ ID NO: 5894094 - DNA, 17 bp, Homo sapiens
cttcagtggagaattat

SEQ ID NO: 5894095 - DNA, 13 bp, Homo sapiens
cttcagtggcagc

SEQ ID NO: 5894096 - DNA, 15 bp, Homo sapiens
cttcagtggcagctg

SEQ ID NO: 5894097 - DNA, 16 bp, Homo sapiens
cttcagtggcagctgc

SEQ ID NO: 5894098 - DNA, 15 bp, Homo sapiens
cttcagtgggagaaa

SEQ ID NO: 5894099 - DNA, 16 bp, Homo sapiens
cttcagtgtaatgtga

SEQ ID NO: 5894100 - DNA, 14 bp, Homo sapiens
cttcagtgtctctg

SEQ ID NO: 5894101 - DNA, 19 bp, Homo sapiens
cttcagttcagctttaaag

SEQ ID NO: 5894102 - DNA, 13 bp, Homo sapiens
cttcagttctcat

SEQ ID NO: 5894103 - DNA, 15 bp, Homo sapiens
cttcagttctctact

SEQ ID NO: 5894104 - DNA, 18 bp, Homo sapiens
cttcagttctctactccc

SEQ ID NO: 5894105 - DNA, 21 bp, Homo sapiens
cttcagttctgcttgctccca

SEQ ID NO: 5894106 - DNA, 14 bp, Homo sapiens
cttcagttgcttgt

SEQ ID NO: 5894107 - DNA, 17 bp, Homo sapiens
cttcagttggtgtgttt

SEQ ID NO: 5894108 - DNA, 21 bp, Homo sapiens
cttcagttgtggcctcattca

SEQ ID NO: 5894109 - DNA, 13 bp, Homo sapiens
cttcagtttaatg

SEQ ID NO: 5894110 - DNA, 15 bp, Homo sapiens
cttcagtttaatgca

SEQ ID NO: 5894111 - DNA, 22 bp, Homo sapiens
cttcagtttaatgcaagagaac

SEQ ID NO: 5894112 - DNA, 13 bp, Homo sapiens
cttcagtttagaa

SEQ ID NO: 5894113 - DNA, 17 bp, Homo sapiens
cttcagtttagaaccta

SEQ ID NO: 5894114 - DNA, 17 bp, Homo sapiens
cttcagtttcacagaaa

SEQ ID NO: 5894115 - DNA, 16 bp, Homo sapiens
cttcagtttttcactt

SEQ ID NO: 5894116 - DNA, 16 bp, Homo sapiens
cttcataaattatttc

SEQ ID NO: 5894117 - DNA, 18 bp, Homo sapiens
cttcataaattatttcta

SEQ ID NO: 5894118 - DNA, 19 bp, Homo sapiens
cttcataacaattttagga

SEQ ID NO: 5894119 - DNA, 12 bp, Homo sapiens
cttcataatttg

SEQ ID NO: 5894120 - DNA, 12 bp, Homo sapiens
cttcataatttt

SEQ ID NO: 5894121 - DNA, 19 bp, Homo sapiens
cttcataccgcctcgtgcc

SEQ ID NO: 5894122 - DNA, 21 bp, Homo sapiens
cttcataccgcctcgtgccag

SEQ ID NO: 5894123 - DNA, 22 bp, Homo sapiens
cttcataccgcctcgtgccagc

SEQ ID NO: 5894124 - DNA, 23 bp, Homo sapiens
cttcataccgcctcgtgccagca

SEQ ID NO: 5894125 - DNA, 20 bp, Homo sapiens
cttcatacctacatgtattt

SEQ ID NO: 5894126 - DNA, 13 bp, Homo sapiens
cttcatacttgaa

SEQ ID NO: 5894127 - DNA, 16 bp, Homo sapiens
cttcatacttgaacgt

SEQ ID NO: 5894128 - DNA, 15 bp, Homo sapiens
cttcatagaaacctc

SEQ ID NO: 5894129 - DNA, 19 bp, Homo sapiens
cttcatagagacttgggaa

SEQ ID NO: 5894130 - DNA, 15 bp, Homo sapiens
cttcataggcagagc

SEQ ID NO: 5894131 - DNA, 13 bp, Homo sapiens
cttcatataaact

SEQ ID NO: 5894132 - DNA, 20 bp, Homo sapiens
cttcatatcatactgttttg

SEQ ID NO: 5894133 - DNA, 17 bp, Homo sapiens
cttcatatcatccacac

SEQ ID NO: 5894134 - DNA, 20 bp, Homo sapiens
cttcatatcatccacacatg

SEQ ID NO: 5894135 - DNA, 21 bp, Homo sapiens
cttcatatcatccacacatga

SEQ ID NO: 5894136 - DNA, 13 bp, Homo sapiens
cttcatatctctc

SEQ ID NO: 5894137 - DNA, 16 bp, Homo sapiens
cttcatatctctccct

SEQ ID NO: 5894138 - DNA, 17 bp, Homo sapiens
cttcatatctctccctt

SEQ ID NO: 5894139 - DNA, 15 bp, Homo sapiens
cttcatattaatata

SEQ ID NO: 5894140 - DNA, 16 bp, Homo sapiens
cttcatcaatttttat

SEQ ID NO: 5894141 - DNA, 17 bp, Homo sapiens
cttcatcaatttttata

SEQ ID NO: 5894142 - DNA, 24 bp, Homo sapiens
cttcatcaatttttatacatatca

SEQ ID NO: 5894143 - DNA, 22 bp, Homo sapiens
cttcatcagaactcttcctcct

SEQ ID NO: 5894144 - DNA, 18 bp, Homo sapiens
cttcatccatagacacag

SEQ ID NO: 5894145 - DNA, 14 bp, Homo sapiens
cttcatccatcctg

SEQ ID NO: 5894146 - DNA, 15 bp, Homo sapiens
cttcatccatcctga

SEQ ID NO: 5894147 - DNA, 23 bp, Homo sapiens
cttcatccatttgttttcacact

SEQ ID NO: 5894148 - DNA, 22 bp, Homo sapiens
cttcatcccaacagcccagcaa

SEQ ID NO: 5894149 - DNA, 17 bp, Homo sapiens
cttcatcccacaatctt

SEQ ID NO: 5894150 - DNA, 16 bp, Homo sapiens
cttcatcccagctgct

SEQ ID NO: 5894151 - DNA, 18 bp, Homo sapiens
cttcatcccagctgctga

SEQ ID NO: 5894152 - DNA, 14 bp, Homo sapiens
cttcatcccagggt

SEQ ID NO: 5894153 - DNA, 15 bp, Homo sapiens
cttcatcccagggta

SEQ ID NO: 5894154 - DNA, 22 bp, Homo sapiens
cttcatcccggagcgcacctgc

SEQ ID NO: 5894155 - DNA, 22 bp, Homo sapiens
cttcatcccttgcttaagaatc

SEQ ID NO: 5894156 - DNA, 17 bp, Homo sapiens
cttcatccgttgtgact

SEQ ID NO: 5894157 - DNA, 17 bp, Homo sapiens
cttcatcctcctcccca

SEQ ID NO: 5894158 - DNA, 19 bp, Homo sapiens
cttcatcctgtaaaggtca

SEQ ID NO: 5894159 - DNA, 19 bp, Homo sapiens
cttcatccttagcaacagc

SEQ ID NO: 5894160 - DNA, 22 bp, Homo sapiens
cttcatcgacttagcctgagtc

SEQ ID NO: 5894161 - DNA, 16 bp, Homo sapiens
cttcatcgcagtggac

SEQ ID NO: 5894162 - DNA, 19 bp, Homo sapiens
cttcatcggggtggtgcag

SEQ ID NO: 5894163 - DNA, 20 bp, Homo sapiens
cttcatctcaatagtgattt

SEQ ID NO: 5894164 - DNA, 19 bp, Homo sapiens
cttcatctcccacctagca

SEQ ID NO: 5894165 - DNA, 14 bp, Homo sapiens
cttcatctccctgc

SEQ ID NO: 5894166 - DNA, 16 bp, Homo sapiens
cttcatctccctgcca

SEQ ID NO: 5894167 - DNA, 18 bp, Homo sapiens
cttcatctccctgccatc

SEQ ID NO: 5894168 - DNA, 20 bp, Homo sapiens
cttcatctccctgccatccc

SEQ ID NO: 5894169 - DNA, 14 bp, Homo sapiens
cttcatctcctttt

SEQ ID NO: 5894170 - DNA, 16 bp, Homo sapiens
cttcatctctaaggct

SEQ ID NO: 5894171 - DNA, 12 bp, Homo sapiens
cttcatctgact

SEQ ID NO: 5894172 - DNA, 16 bp, Homo sapiens
cttcatctgccactgg

SEQ ID NO: 5894173 - DNA, 15 bp, Homo sapiens
cttcatctgcctgcg

SEQ ID NO: 5894174 - DNA, 14 bp, Homo sapiens
cttcatctggaagt

SEQ ID NO: 5894175 - DNA, 15 bp, Homo sapiens
cttcatctggagtcc

SEQ ID NO: 5894176 - DNA, 13 bp, Homo sapiens
cttcatctggcaa

SEQ ID NO: 5894177 - DNA, 13 bp, Homo sapiens
cttcatctgggac

SEQ ID NO: 5894178 - DNA, 19 bp, Homo sapiens
cttcatctgtgtagctgct

SEQ ID NO: 5894179 - DNA, 20 bp, Homo sapiens
cttcatcttcctgtgtcctg

SEQ ID NO: 5894180 - DNA, 15 bp, Homo sapiens
cttcatcttctcagc

SEQ ID NO: 5894181 - DNA, 20 bp, Homo sapiens
cttcatcttctcagctccca

SEQ ID NO: 5894182 - DNA, 17 bp, Homo sapiens
cttcatcttgagcctga

SEQ ID NO: 5894183 - DNA, 12 bp, Homo sapiens
cttcatgaaatg

SEQ ID NO: 5894184 - DNA, 14 bp, Homo sapiens
cttcatgaaatgct

SEQ ID NO: 5894185 - DNA, 23 bp, Homo sapiens
cttcatgaaatgctatgtcattt

SEQ ID NO: 5894186 - DNA, 13 bp, Homo sapiens
cttcatgaaatgt

SEQ ID NO: 5894187 - DNA, 21 bp, Homo sapiens
cttcatgaatctttcatacat

SEQ ID NO: 5894188 - DNA, 12 bp, Homo sapiens
cttcatgacatt

SEQ ID NO: 5894189 - DNA, 15 bp, Homo sapiens
cttcatgaccttaca

SEQ ID NO: 5894190 - DNA, 17 bp, Homo sapiens
cttcatgaccttacata

SEQ ID NO: 5894191 - DNA, 13 bp, Homo sapiens
cttcatgcaatga

SEQ ID NO: 5894192 - DNA, 23 bp, Homo sapiens
cttcatgcatggaaattcccttc

SEQ ID NO: 5894193 - DNA, 12 bp, Homo sapiens
cttcatgcccac

SEQ ID NO: 5894194 - DNA, 15 bp, Homo sapiens
cttcatgcccttctg

SEQ ID NO: 5894195 - DNA, 13 bp, Homo sapiens
cttcatgctgtct

SEQ ID NO: 5894196 - DNA, 23 bp, Homo sapiens
cttcatgctgtctacactaagag

SEQ ID NO: 5894197 - DNA, 16 bp, Homo sapiens
cttcatgctgtctgtg

SEQ ID NO: 5894198 - DNA, 19 bp, Homo sapiens
cttcatgctgtctgtgtga

SEQ ID NO: 5894199 - DNA, 22 bp, Homo sapiens
cttcatgcttgatttgaccact

SEQ ID NO: 5894200 - DNA, 12 bp, Homo sapiens
cttcatgctttt

SEQ ID NO: 5894201 - DNA, 16 bp, Homo sapiens
cttcatgcttttctca

SEQ ID NO: 5894202 - DNA, 18 bp, Homo sapiens
cttcatggaccaagaatg

SEQ ID NO: 5894203 - DNA, 23 bp, Homo sapiens
cttcatggcatcttcaatatgaa

SEQ ID NO: 5894204 - DNA, 17 bp, Homo sapiens
cttcatgggcccacagg

SEQ ID NO: 5894205 - DNA, 17 bp, Homo sapiens
cttcatgtaaagtgtca

SEQ ID NO: 5894206 - DNA, 20 bp, Homo sapiens
cttcatgtcaacttctggct

SEQ ID NO: 5894207 - DNA, 23 bp, Homo sapiens
cttcatgtcaacttctggctcct

SEQ ID NO: 5894208 - DNA, 17 bp, Homo sapiens
cttcatgtccagtgagc

SEQ ID NO: 5894209 - DNA, 23 bp, Homo sapiens
cttcatgtccagtgagcagtgtt

SEQ ID NO: 5894210 - DNA, 21 bp, Homo sapiens
cttcatgtcctaaagaagaca

SEQ ID NO: 5894211 - DNA, 13 bp, Homo sapiens
cttcatgtgaaca

SEQ ID NO: 5894212 - DNA, 17 bp, Homo sapiens
cttcatgtgcaaagtga

SEQ ID NO: 5894213 - DNA, 15 bp, Homo sapiens
cttcatgtgtcccag

SEQ ID NO: 5894214 - DNA, 16 bp, Homo sapiens
cttcatgtgtcccaga

SEQ ID NO: 5894215 - DNA, 17 bp, Homo sapiens
cttcatgtgtcccagaa

SEQ ID NO: 5894216 - DNA, 22 bp, Homo sapiens
cttcatgttcaattatttcccc

SEQ ID NO: 5894217 - DNA, 16 bp, Homo sapiens
cttcatgttcagtcac

SEQ ID NO: 5894218 - DNA, 15 bp, Homo sapiens
cttcatgtttggaaa

SEQ ID NO: 5894219 - DNA, 13 bp, Homo sapiens
cttcatgttttaa

SEQ ID NO: 5894220 - DNA, 22 bp, Homo sapiens
cttcatgtttttcacctataaa

SEQ ID NO: 5894221 - DNA, 13 bp, Homo sapiens
cttcattaaaaca

SEQ ID NO: 5894222 - DNA, 15 bp, Homo sapiens
cttcattaaaacaag

SEQ ID NO: 5894223 - DNA, 16 bp, Homo sapiens
cttcattaataataaa

SEQ ID NO: 5894224 - DNA, 15 bp, Homo sapiens
cttcattagagcagg

SEQ ID NO: 5894225 - DNA, 17 bp, Homo sapiens
cttcattatctgagttg

SEQ ID NO: 5894226 - DNA, 17 bp, Homo sapiens
cttcattattcaagaat

SEQ ID NO: 5894227 - DNA, 14 bp, Homo sapiens
cttcattattctct

SEQ ID NO: 5894228 - DNA, 14 bp, Homo sapiens
cttcattattttaa

SEQ ID NO: 5894229 - DNA, 21 bp, Homo sapiens
cttcattcaaactgcactttt

SEQ ID NO: 5894230 - DNA, 20 bp, Homo sapiens
cttcattcaacccacctgcg

SEQ ID NO: 5894231 - DNA, 16 bp, Homo sapiens
cttcattccagcagct

SEQ ID NO: 5894232 - DNA, 18 bp, Homo sapiens
cttcattccagcagctgc

SEQ ID NO: 5894233 - DNA, 22 bp, Homo sapiens
cttcattccagcagctgcaccc

SEQ ID NO: 5894234 - DNA, 23 bp, Homo sapiens
cttcattccggactggcagaagc

SEQ ID NO: 5894235 - DNA, 16 bp, Homo sapiens
cttcattccgttagga

SEQ ID NO: 5894236 - DNA, 19 bp, Homo sapiens
cttcattccgttaggaata

SEQ ID NO: 5894237 - DNA, 13 bp, Homo sapiens
cttcattctatca

SEQ ID NO: 5894238 - DNA, 16 bp, Homo sapiens
cttcattctcactctg

SEQ ID NO: 5894239 - DNA, 22 bp, Homo sapiens
cttcattctcgtgagtcattta

SEQ ID NO: 5894240 - DNA, 18 bp, Homo sapiens
cttcattctggaaacttt

SEQ ID NO: 5894241 - DNA, 17 bp, Homo sapiens
cttcattctttactgca

SEQ ID NO: 5894242 - DNA, 20 bp, Homo sapiens
cttcattctttactgcactc

SEQ ID NO: 5894243 - DNA, 14 bp, Homo sapiens
cttcattctttata

SEQ ID NO: 5894244 - DNA, 16 bp, Homo sapiens
cttcattgaccaagat

SEQ ID NO: 5894245 - DNA, 17 bp, Homo sapiens
cttcattgacctctact

SEQ ID NO: 5894246 - DNA, 14 bp, Homo sapiens
cttcattgagagtt

SEQ ID NO: 5894247 - DNA, 21 bp, Homo sapiens
cttcattgatttcctgtgtca

SEQ ID NO: 5894248 - DNA, 20 bp, Homo sapiens
cttcattgcagcctgaaatt

SEQ ID NO: 5894249 - DNA, 19 bp, Homo sapiens
cttcattgggaagtatgat

SEQ ID NO: 5894250 - DNA, 16 bp, Homo sapiens
cttcattgtccctctt

SEQ ID NO: 5894251 - DNA, 20 bp, Homo sapiens
cttcattgtccctcttcact

SEQ ID NO: 5894252 - DNA, 14 bp, Homo sapiens
cttcattgtttgga

SEQ ID NO: 5894253 - DNA, 14 bp, Homo sapiens
cttcatttaaacta

SEQ ID NO: 5894254 - DNA, 17 bp, Homo sapiens
cttcatttaaactaaat

SEQ ID NO: 5894255 - DNA, 16 bp, Homo sapiens
cttcatttaacactga

SEQ ID NO: 5894256 - DNA, 14 bp, Homo sapiens
cttcatttcaatca

SEQ ID NO: 5894257 - DNA, 15 bp, Homo sapiens
cttcatttcaatcat

SEQ ID NO: 5894258 - DNA, 12 bp, Homo sapiens
cttcatttcaga

SEQ ID NO: 5894259 - DNA, 19 bp, Homo sapiens
cttcatttcatcctgttgg

SEQ ID NO: 5894260 - DNA, 14 bp, Homo sapiens
cttcatttcattgt

SEQ ID NO: 5894261 - DNA, 15 bp, Homo sapiens
cttcatttcattgta

SEQ ID NO: 5894262 - DNA, 17 bp, Homo sapiens
cttcatttcattgtatg

SEQ ID NO: 5894263 - DNA, 13 bp, Homo sapiens
cttcccaggccag

SEQ ID NO: 5894264 - DNA, 13 bp, Homo sapiens
cttcccaggccct

SEQ ID NO: 5894265 - DNA, 14 bp, Homo sapiens
cttcccaggccctt

SEQ ID NO: 5894266 - DNA, 21 bp, Homo sapiens
cttcccaggccctttggcttc

SEQ ID NO: 5894267 - DNA, 12 bp, Homo sapiens
cttcccaggcct

SEQ ID NO: 5894268 - DNA, 22 bp, Homo sapiens
cttcccaggctggggctgacct

SEQ ID NO: 5894269 - DNA, 12 bp, Homo sapiens
cttcccagggag

SEQ ID NO: 5894270 - DNA, 20 bp, Homo sapiens
cttcccagggagaaacccac

SEQ ID NO: 5894271 - DNA, 11 bp, Homo sapiens
cttcccagggc

SEQ ID NO: 5894272 - DNA, 12 bp, Homo sapiens
cttcccagggca

SEQ ID NO: 5894273 - DNA, 13 bp, Homo sapiens
cttcccagggcac

SEQ ID NO: 5894274 - DNA, 18 bp, Homo sapiens
cttcccagggcacccagg

SEQ ID NO: 5894275 - DNA, 18 bp, Homo sapiens
cttcccaggttcaagcga

SEQ ID NO: 5894276 - DNA, 18 bp, Homo sapiens
cttcccagtggctgctgc

SEQ ID NO: 5894277 - DNA, 19 bp, Homo sapiens
cttcccagtggctgctgcc

SEQ ID NO: 5894278 - DNA, 18 bp, Homo sapiens
cttcccataataaagcaa

SEQ ID NO: 5894279 - DNA, 20 bp, Homo sapiens
cttcccataccacccaatgc

SEQ ID NO: 5894280 - DNA, 22 bp, Homo sapiens
cttcccatagtggggcctggga

SEQ ID NO: 5894281 - DNA, 23 bp, Homo sapiens
cttcccatagtggggcctgggag

SEQ ID NO: 5894282 - DNA, 17 bp, Homo sapiens
cttcccatcactggagc

SEQ ID NO: 5894283 - DNA, 17 bp, Homo sapiens
cttcccatccccagcga

SEQ ID NO: 5894284 - DNA, 15 bp, Homo sapiens
cttcccatcctaccc

SEQ ID NO: 5894285 - DNA, 22 bp, Homo sapiens
cttcccatgatgccgctcttct

SEQ ID NO: 5894286 - DNA, 18 bp, Homo sapiens
cttcccatgcattctggt

SEQ ID NO: 5894287 - DNA, 15 bp, Homo sapiens
cttcccatgcctgtc

SEQ ID NO: 5894288 - DNA, 14 bp, Homo sapiens
cttcccatggccat

SEQ ID NO: 5894289 - DNA, 12 bp, Homo sapiens
cttcccattcca

SEQ ID NO: 5894290 - DNA, 16 bp, Homo sapiens
cttcccattccatggc

SEQ ID NO: 5894291 - DNA, 21 bp, Homo sapiens
cttcccattctgccccagagt

SEQ ID NO: 5894292 - DNA, 15 bp, Homo sapiens
cttcccattggcttt

SEQ ID NO: 5894293 - DNA, 19 bp, Homo sapiens
cttcccattggctttctct

SEQ ID NO: 5894294 - DNA, 15 bp, Homo sapiens
cttcccatttctcta

SEQ ID NO: 5894295 - DNA, 18 bp, Homo sapiens
cttcccatttctctacac

SEQ ID NO: 5894296 - DNA, 22 bp, Homo sapiens
cttcccatttctctacactaag

SEQ ID NO: 5894297 - DNA, 13 bp, Homo sapiens
cttcccatttctt

SEQ ID NO: 5894298 - DNA, 16 bp, Homo sapiens
cttcccatttcttccc

SEQ ID NO: 5894299 - DNA, 15 bp, Homo sapiens
cttcccatttgtaat

SEQ ID NO: 5894300 - DNA, 14 bp, Homo sapiens
cttccccaaaggaa

SEQ ID NO: 5894301 - DNA, 22 bp, Homo sapiens
cttccccaaaggccaacagcat

SEQ ID NO: 5894302 - DNA, 23 bp, Homo sapiens
cttccccaaaggccaacagcatt

SEQ ID NO: 5894303 - DNA, 23 bp, Homo sapiens
cttccccaacgaaaagcacatcc

SEQ ID NO: 5894304 - DNA, 19 bp, Homo sapiens
cttccccaacttccctagt

SEQ ID NO: 5894305 - DNA, 20 bp, Homo sapiens
cttccccaagatctgccaga

SEQ ID NO: 5894306 - DNA, 18 bp, Homo sapiens
cttccccaagcctggcag

SEQ ID NO: 5894307 - DNA, 16 bp, Homo sapiens
cttccccaaggcactg

SEQ ID NO: 5894308 - DNA, 17 bp, Homo sapiens
cttccccaaggcactga

SEQ ID NO: 5894309 - DNA, 21 bp, Homo sapiens
cttccccaagggccaaaccca

SEQ ID NO: 5894310 - DNA, 15 bp, Homo sapiens
cttccccacagaact

SEQ ID NO: 5894311 - DNA, 17 bp, Homo sapiens
cttccccacagaactgc

SEQ ID NO: 5894312 - DNA, 16 bp, Homo sapiens
cttccccacaggtgaa

SEQ ID NO: 5894313 - DNA, 15 bp, Homo sapiens
cttccccaccctcag

SEQ ID NO: 5894314 - DNA, 21 bp, Homo sapiens
cttccccaccgcagtcaccac

SEQ ID NO: 5894315 - DNA, 10 bp, Homo sapiens
cttccccact

SEQ ID NO: 5894316 - DNA, 16 bp, Homo sapiens
cttccccactctgctc

SEQ ID NO: 5894317 - DNA, 17 bp, Homo sapiens
cttccccactctgctcc

SEQ ID NO: 5894318 - DNA, 20 bp, Homo sapiens
cttccccactctgctcccag

SEQ ID NO: 5894319 - DNA, 23 bp, Homo sapiens
cttccccactctgctcccagccc

SEQ ID NO: 5894320 - DNA, 23 bp, Homo sapiens
cttccccactgcacacacctcag

SEQ ID NO: 5894321 - DNA, 14 bp, Homo sapiens
cttccccactgcct

SEQ ID NO: 5894322 - DNA, 15 bp, Homo sapiens
cttccccagacccag

SEQ ID NO: 5894323 - DNA, 13 bp, Homo sapiens
cttccccagactc

SEQ ID NO: 5894324 - DNA, 19 bp, Homo sapiens
cttccccagactcagctcc

SEQ ID NO: 5894325 - DNA, 23 bp, Homo sapiens
cttccccagagaggcactcagtg

SEQ ID NO: 5894326 - DNA, 17 bp, Homo sapiens
cttccccagagatggct

SEQ ID NO: 5894327 - DNA, 20 bp, Homo sapiens
cttccccagctcccccaggc

SEQ ID NO: 5894328 - DNA, 21 bp, Homo sapiens
cttccccaggagctctctgct

SEQ ID NO: 5894329 - DNA, 15 bp, Homo sapiens
cttccccaggcccac

SEQ ID NO: 5894330 - DNA, 19 bp, Homo sapiens
cttccccagggttctgtat

SEQ ID NO: 5894331 - DNA, 20 bp, Homo sapiens
cttccccagggttctgtatt

SEQ ID NO: 5894332 - DNA, 14 bp, Homo sapiens
cttccccatcagct

SEQ ID NO: 5894333 - DNA, 22 bp, Homo sapiens
cttccccatctttgatccttct

SEQ ID NO: 5894334 - DNA, 21 bp, Homo sapiens
cttccccatggccctgagcga

SEQ ID NO: 5894335 - DNA, 19 bp, Homo sapiens
cttccccattgccttctgg

SEQ ID NO: 5894336 - DNA, 13 bp, Homo sapiens
cttcccccaccac

SEQ ID NO: 5894337 - DNA, 17 bp, Homo sapiens
cttcccccacttcacct

SEQ ID NO: 5894338 - DNA, 19 bp, Homo sapiens
cttcccccagcaaggcaga

SEQ ID NO: 5894339 - DNA, 14 bp, Homo sapiens
cttcccccagccca

SEQ ID NO: 5894340 - DNA, 15 bp, Homo sapiens
cttcccccagcccaa

SEQ ID NO: 5894341 - DNA, 16 bp, Homo sapiens
cttcccccagcccaat

SEQ ID NO: 5894342 - DNA, 20 bp, Homo sapiens
cttcccccagggtcccctgc

SEQ ID NO: 5894343 - DNA, 16 bp, Homo sapiens
cttcccccatagccac

SEQ ID NO: 5894344 - DNA, 23 bp, Homo sapiens
cttcccccatcccctttcctccc

SEQ ID NO: 5894345 - DNA, 15 bp, Homo sapiens
cttcccccatcccta

SEQ ID NO: 5894346 - DNA, 15 bp, Homo sapiens
cttccccccatctct

SEQ ID NO: 5894347 - DNA, 17 bp, Homo sapiens
cttccccccatctctga

SEQ ID NO: 5894348 - DNA, 19 bp, Homo sapiens
cttccccccatctctgagt

SEQ ID NO: 5894349 - DNA, 19 bp, Homo sapiens
cttcccccctctcctccca

SEQ ID NO: 5894350 - DNA, 24 bp, Homo sapiens
cttcccccctctcctcccagctgc

SEQ ID NO: 5894351 - DNA, 15 bp, Homo sapiens
cttccccctccaatc

SEQ ID NO: 5894352 - DNA, 13 bp, Homo sapiens
cttccccctcccc

SEQ ID NO: 5894353 - DNA, 19 bp, Homo sapiens
cttccccctccccctcctg

SEQ ID NO: 5894354 - DNA, 22 bp, Homo sapiens
cttccccctccccctcctgctg

SEQ ID NO: 5894355 - DNA, 16 bp, Homo sapiens
cttccccctctcccag

SEQ ID NO: 5894356 - DNA, 18 bp, Homo sapiens
cttccccctgcttccacc

SEQ ID NO: 5894357 - DNA, 14 bp, Homo sapiens
cttcccccttcccg

SEQ ID NO: 5894358 - DNA, 20 bp, Homo sapiens
cttccccctttctctgcctg

SEQ ID NO: 5894359 - DNA, 22 bp, Homo sapiens
cttccccgagggatgatgccac

SEQ ID NO: 5894360 - DNA, 23 bp, Homo sapiens
cttccccgagggatgatgccaca

SEQ ID NO: 5894361 - DNA, 17 bp, Homo sapiens
cttccccgagtgactct

SEQ ID NO: 5894362 - DNA, 21 bp, Homo sapiens
cttccccgatgtgagccgcct

SEQ ID NO: 5894363 - DNA, 18 bp, Homo sapiens
cttccccggagggctgcg

SEQ ID NO: 5894364 - DNA, 21 bp, Homo sapiens
cttccccgtcccctgcagcct

SEQ ID NO: 5894365 - DNA, 23 bp, Homo sapiens
cttccccgtcccctgcagcctgg

SEQ ID NO: 5894366 - DNA, 19 bp, Homo sapiens
cttccccgtgcggcccgtg

SEQ ID NO: 5894367 - DNA, 18 bp, Homo sapiens
cttcccctacacctccct

SEQ ID NO: 5894368 - DNA, 16 bp, Homo sapiens
cttcccctccacccta

SEQ ID NO: 5894369 - DNA, 13 bp, Homo sapiens
cttcccctccagg

SEQ ID NO: 5894370 - DNA, 14 bp, Homo sapiens
cttcccctcccctc

SEQ ID NO: 5894371 - DNA, 13 bp, Homo sapiens
cttcccctccctg

SEQ ID NO: 5894372 - DNA, 18 bp, Homo sapiens
cttcccctccctggctcc

SEQ ID NO: 5894373 - DNA, 13 bp, Homo sapiens
cttcccctcctgt

SEQ ID NO: 5894374 - DNA, 18 bp, Homo sapiens
cttcccctcgctgtcctg

SEQ ID NO: 5894375 - DNA, 20 bp, Homo sapiens
cttcccctcgctgtcctgct

SEQ ID NO: 5894376 - DNA, 23 bp, Homo sapiens
cttcccctctaactggacagcct

SEQ ID NO: 5894377 - DNA, 20 bp, Homo sapiens
cttcccctctctcctcctgc

SEQ ID NO: 5894378 - DNA, 13 bp, Homo sapiens
cttcccctgagag

SEQ ID NO: 5894379 - DNA, 21 bp, Homo sapiens
cttcccctgaggacctttctg

SEQ ID NO: 5894380 - DNA, 12 bp, Homo sapiens
cttcccctgcac

SEQ ID NO: 5894381 - DNA, 19 bp, Homo sapiens
cttcccctgcacctggcct

SEQ ID NO: 5894382 - DNA, 14 bp, Homo sapiens
cttcccctgcctcc

SEQ ID NO: 5894383 - DNA, 14 bp, Homo sapiens
cttcccctgcctgg

SEQ ID NO: 5894384 - DNA, 17 bp, Homo sapiens
cttcccctgcgccctcc

SEQ ID NO: 5894385 - DNA, 14 bp, Homo sapiens
cttcccctgctgac

SEQ ID NO: 5894386 - DNA, 17 bp, Homo sapiens
cttcccctggcactggc

SEQ ID NO: 5894387 - DNA, 13 bp, Homo sapiens
cttcccctgggat

SEQ ID NO: 5894388 - DNA, 15 bp, Homo sapiens
cttcccctgggccct

SEQ ID NO: 5894389 - DNA, 14 bp, Homo sapiens
cttccccttagagt

SEQ ID NO: 5894390 - DNA, 21 bp, Homo sapiens
cttccccttatcctccctgta

SEQ ID NO: 5894391 - DNA, 13 bp, Homo sapiens
cttccccttccaa

SEQ ID NO: 5894392 - DNA, 15 bp, Homo sapiens
cttccccttcctgtt

SEQ ID NO: 5894393 - DNA, 14 bp, Homo sapiens
cttccccttctgtg

SEQ ID NO: 5894394 - DNA, 18 bp, Homo sapiens
cttccccttctgtgtcac

SEQ ID NO: 5894395 - DNA, 19 bp, Homo sapiens
cttccccttgcccagggct

SEQ ID NO: 5894396 - DNA, 14 bp, Homo sapiens
cttccccttgccct

SEQ ID NO: 5894397 - DNA, 17 bp, Homo sapiens
cttccccttgcccttgc

SEQ ID NO: 5894398 - DNA, 17 bp, Homo sapiens
cttccccttgtccctgg

SEQ ID NO: 5894399 - DNA, 19 bp, Homo sapiens
cttcccctttactcagccc

SEQ ID NO: 5894400 - DNA, 16 bp, Homo sapiens
cttccccttttgcctg

SEQ ID NO: 5894401 - DNA, 17 bp, Homo sapiens
cttccccttttgcctgg

SEQ ID NO: 5894402 - DNA, 19 bp, Homo sapiens
cttccccttttgcctggct

SEQ ID NO: 5894403 - DNA, 16 bp, Homo sapiens
cttcccgacccagcca

SEQ ID NO: 5894404 - DNA, 18 bp, Homo sapiens
cttcccgacccagccagc

SEQ ID NO: 5894405 - DNA, 19 bp, Homo sapiens
cttcccgcaaggcctctca

SEQ ID NO: 5894406 - DNA, 22 bp, Homo sapiens
cttcccgcagcaccagcctgag

SEQ ID NO: 5894407 - DNA, 20 bp, Homo sapiens
cttcccgccgcccagcccac

SEQ ID NO: 5894408 - DNA, 23 bp, Homo sapiens
cttcccgccgcccagcccacccc

SEQ ID NO: 5894409 - DNA, 20 bp, Homo sapiens
cttcccgccggaggccagct

SEQ ID NO: 5894410 - DNA, 22 bp, Homo sapiens
cttcccgccggaggccagctat

SEQ ID NO: 5894411 - DNA, 18 bp, Homo sapiens
cttcccgcctcagcctct

SEQ ID NO: 5894412 - DNA, 19 bp, Homo sapiens
cttcccgcctccctctcag

SEQ ID NO: 5894413 - DNA, 15 bp, Homo sapiens
cttcccgctgcacat

SEQ ID NO: 5894414 - DNA, 22 bp, Homo sapiens
cttcccgggatcacttaatgaa

SEQ ID NO: 5894415 - DNA, 17 bp, Homo sapiens
cttcccgtagctgccag

SEQ ID NO: 5894416 - DNA, 14 bp, Homo sapiens
cttcccgtcccata

SEQ ID NO: 5894417 - DNA, 20 bp, Homo sapiens
cttcccgtcccatatcctgc

SEQ ID NO: 5894418 - DNA, 21 bp, Homo sapiens
cttcccgtcccatatcctgcc

SEQ ID NO: 5894419 - DNA, 18 bp, Homo sapiens
cttccctaaactgcagcc

SEQ ID NO: 5894420 - DNA, 22 bp, Homo sapiens
cttccctaaactgcagcctctc

SEQ ID NO: 5894421 - DNA, 20 bp, Homo sapiens
cttccctaatagctttttaa

SEQ ID NO: 5894422 - DNA, 17 bp, Homo sapiens
cttccctacagttgaaa

SEQ ID NO: 5894423 - DNA, 15 bp, Homo sapiens
cttccctacccttcc

SEQ ID NO: 5894424 - DNA, 17 bp, Homo sapiens
cttccctacccttcctg

SEQ ID NO: 5894425 - DNA, 15 bp, Homo sapiens
cttccctacctcagg

SEQ ID NO: 5894426 - DNA, 19 bp, Homo sapiens
cttccctagatggttccct

SEQ ID NO: 5894427 - DNA, 23 bp, Homo sapiens
cttccctagctttagaccctggg

SEQ ID NO: 5894428 - DNA, 18 bp, Homo sapiens
cttccctagggctgggtg

SEQ ID NO: 5894429 - DNA, 21 bp, Homo sapiens
cttccctatacttcacactga

SEQ ID NO: 5894430 - DNA, 16 bp, Homo sapiens
cttccctataggaaca

SEQ ID NO: 5894431 - DNA, 21 bp, Homo sapiens
cttccctataggaacagccca

SEQ ID NO: 5894432 - DNA, 22 bp, Homo sapiens
cttccctataggaacagcccag

SEQ ID NO: 5894433 - DNA, 16 bp, Homo sapiens
cttccctatctttgcc

SEQ ID NO: 5894434 - DNA, 23 bp, Homo sapiens
cttccctattttgaatgcagaaa

SEQ ID NO: 5894435 - DNA, 21 bp, Homo sapiens
cttccctcaaagcttccattc

SEQ ID NO: 5894436 - DNA, 15 bp, Homo sapiens
cttccctcaccccca

SEQ ID NO: 5894437 - DNA, 17 bp, Homo sapiens
cttccctcacccctgac

SEQ ID NO: 5894438 - DNA, 11 bp, Homo sapiens
cttccctcaga

SEQ ID NO: 5894439 - DNA, 12 bp, Homo sapiens
cttccctcaggc

SEQ ID NO: 5894440 - DNA, 15 bp, Homo sapiens
cttccctcagtccca

SEQ ID NO: 5894441 - DNA, 17 bp, Homo sapiens
cttccctcatctctcct

SEQ ID NO: 5894442 - DNA, 19 bp, Homo sapiens
cttccctccacctgcttgt

SEQ ID NO: 5894443 - DNA, 17 bp, Homo sapiens
cttccctccatccaccc

SEQ ID NO: 5894444 - DNA, 19 bp, Homo sapiens
cttccctccccacagtcct

SEQ ID NO: 5894445 - DNA, 20 bp, Homo sapiens
cttccctccccacagtcctc

SEQ ID NO: 5894446 - DNA, 11 bp, Homo sapiens
cttccctcctc

SEQ ID NO: 5894447 - DNA, 13 bp, Homo sapiens
cttccctcctgct

SEQ ID NO: 5894448 - DNA, 16 bp, Homo sapiens
cttccctcctgctttg

SEQ ID NO: 5894449 - DNA, 13 bp, Homo sapiens
cttccctcctttg

SEQ ID NO: 5894450 - DNA, 14 bp, Homo sapiens
cttccctcctttta

SEQ ID NO: 5894451 - DNA, 20 bp, Homo sapiens
cttccctcgtgacagtggtg

SEQ ID NO: 5894452 - DNA, 16 bp, Homo sapiens
cttccctctccccaag

SEQ ID NO: 5894453 - DNA, 12 bp, Homo sapiens
cttccctctcct

SEQ ID NO: 5894454 - DNA, 13 bp, Homo sapiens
cttccctctcgct

SEQ ID NO: 5894455 - DNA, 22 bp, Homo sapiens
cttccctctcgctcccctctgc

SEQ ID NO: 5894456 - DNA, 13 bp, Homo sapiens
cttccctctctcc

SEQ ID NO: 5894457 - DNA, 18 bp, Homo sapiens
cttccctctctccctgcc

SEQ ID NO: 5894458 - DNA, 16 bp, Homo sapiens
cttccctctctgaaat

SEQ ID NO: 5894459 - DNA, 21 bp, Homo sapiens
cttccctctgcattgacctgg

SEQ ID NO: 5894460 - DNA, 15 bp, Homo sapiens
cttccctctgcctgt

SEQ ID NO: 5894461 - DNA, 16 bp, Homo sapiens
cttccctctgcctgtc

SEQ ID NO: 5894462 - DNA, 12 bp, Homo sapiens
cttccctctggg

SEQ ID NO: 5894463 - DNA, 13 bp, Homo sapiens
cttccctctgggc

SEQ ID NO: 5894464 - DNA, 16 bp, Homo sapiens
cttccctctgggcacg

SEQ ID NO: 5894465 - DNA, 21 bp, Homo sapiens
cttccctctgtttctctttcc

SEQ ID NO: 5894466 - DNA, 12 bp, Homo sapiens
cttccctcttcc

SEQ ID NO: 5894467 - DNA, 14 bp, Homo sapiens
cttccctcttccct

SEQ ID NO: 5894468 - DNA, 17 bp, Homo sapiens
cttccctcttccctctc

SEQ ID NO: 5894469 - DNA, 19 bp, Homo sapiens
cttccctcttccctctccc

SEQ ID NO: 5894470 - DNA, 22 bp, Homo sapiens
cttccctctttcatctcctgag

SEQ ID NO: 5894471 - DNA, 21 bp, Homo sapiens
cttccctctttccccacctct

SEQ ID NO: 5894472 - DNA, 22 bp, Homo sapiens
cttccctctttccccacctctt

SEQ ID NO: 5894473 - DNA, 16 bp, Homo sapiens
cttccctgaacactca

SEQ ID NO: 5894474 - DNA, 23 bp, Homo sapiens
cttccctgaacttcctgcttcct

SEQ ID NO: 5894475 - DNA, 13 bp, Homo sapiens
cttccctgaagct

SEQ ID NO: 5894476 - DNA, 18 bp, Homo sapiens
cttccctgaagctcccac

SEQ ID NO: 5894477 - DNA, 16 bp, Homo sapiens
cttccctgacactgtc

SEQ ID NO: 5894478 - DNA, 23 bp, Homo sapiens
cttccctgacactgtctgctgcc

SEQ ID NO: 5894479 - DNA, 19 bp, Homo sapiens
cttccctgattgacctgct

SEQ ID NO: 5894480 - DNA, 21 bp, Homo sapiens
cttccctgattgacctgctcc

SEQ ID NO: 5894481 - DNA, 12 bp, Homo sapiens
cttccctgcagc

SEQ ID NO: 5894482 - DNA, 13 bp, Homo sapiens
cttccctgcagct

SEQ ID NO: 5894483 - DNA, 14 bp, Homo sapiens
cttccctgcagctg

SEQ ID NO: 5894484 - DNA, 16 bp, Homo sapiens
cttccctgcagctgac

SEQ ID NO: 5894485 - DNA, 17 bp, Homo sapiens
cttccctgcagctgacc

SEQ ID NO: 5894486 - DNA, 19 bp, Homo sapiens
cttccctgccacttcaacc

SEQ ID NO: 5894487 - DNA, 12 bp, Homo sapiens
cttccctgccca

SEQ ID NO: 5894488 - DNA, 13 bp, Homo sapiens
cttccctgcccaa

SEQ ID NO: 5894489 - DNA, 23 bp, Homo sapiens
cttccctgcccaatcctccctgg

SEQ ID NO: 5894490 - DNA, 11 bp, Homo sapiens
cttccctgcct

SEQ ID NO: 5894491 - DNA, 14 bp, Homo sapiens
cttccctgcctcca

SEQ ID NO: 5894492 - DNA, 19 bp, Homo sapiens
cttccctgcctccagctgt

SEQ ID NO: 5894493 - DNA, 12 bp, Homo sapiens
cttccctgcctg

SEQ ID NO: 5894494 - DNA, 16 bp, Homo sapiens
cttccctgcctgtggc

SEQ ID NO: 5894495 - DNA, 18 bp, Homo sapiens
cttccctgcgcctgtgat

SEQ ID NO: 5894496 - DNA, 19 bp, Homo sapiens
cttccctgctgtgaaagaa

SEQ ID NO: 5894497 - DNA, 20 bp, Homo sapiens
cttccctgcttcacgattct

SEQ ID NO: 5894498 - DNA, 22 bp, Homo sapiens
cttccctgcttttctcccagaa

SEQ ID NO: 5894499 - DNA, 22 bp, Homo sapiens
cttccctggaaaccttccaccc

SEQ ID NO: 5894500 - DNA, 23 bp, Homo sapiens
cttccctggaaaccttccaccca

SEQ ID NO: 5894501 - DNA, 11 bp, Homo sapiens
cttccctggcg

SEQ ID NO: 5894502 - DNA, 21 bp, Homo sapiens
cttccctggctacttcccttc

SEQ ID NO: 5894503 - DNA, 16 bp, Homo sapiens
cttccctgggaactca

SEQ ID NO: 5894504 - DNA, 17 bp, Homo sapiens
cttccctgggctgtgct

SEQ ID NO: 5894505 - DNA, 23 bp, Homo sapiens
cttccctggggagccctcaggct

SEQ ID NO: 5894506 - DNA, 16 bp, Homo sapiens
cttccctggggcccca

SEQ ID NO: 5894507 - DNA, 20 bp, Homo sapiens
cttccctgggggtcccagga

SEQ ID NO: 5894508 - DNA, 22 bp, Homo sapiens
cttccctgggggtcccaggatc

SEQ ID NO: 5894509 - DNA, 22 bp, Homo sapiens
cttccctgggttagactgccag

SEQ ID NO: 5894510 - DNA, 20 bp, Homo sapiens
cttccctggtcaccaaggca

SEQ ID NO: 5894511 - DNA, 18 bp, Homo sapiens
cttccctggtccagattg

SEQ ID NO: 5894512 - DNA, 20 bp, Homo sapiens
cttccctggtccagattgta

SEQ ID NO: 5894513 - DNA, 17 bp, Homo sapiens
cttccctgtcagcctga

SEQ ID NO: 5894514 - DNA, 13 bp, Homo sapiens
cttccctgtccca

SEQ ID NO: 5894515 - DNA, 16 bp, Homo sapiens
cttccctgtccctcta

SEQ ID NO: 5894516 - DNA, 14 bp, Homo sapiens
cttccctgtgcctc

SEQ ID NO: 5894517 - DNA, 16 bp, Homo sapiens
cttccctgttctccct

SEQ ID NO: 5894518 - DNA, 15 bp, Homo sapiens
cttccctgttttaaa

SEQ ID NO: 5894519 - DNA, 18 bp, Homo sapiens
cttccctgttttaaatta

SEQ ID NO: 5894520 - DNA, 16 bp, Homo sapiens
cttcccttaaaattta

SEQ ID NO: 5894521 - DNA, 15 bp, Homo sapiens
cttcccttacctcaa

SEQ ID NO: 5894522 - DNA, 17 bp, Homo sapiens
cttcccttacctcaaag

SEQ ID NO: 5894523 - DNA, 17 bp, Homo sapiens
cttcccttagcctctcc

SEQ ID NO: 5894524 - DNA, 19 bp, Homo sapiens
cttcccttagcctctccca

SEQ ID NO: 5894525 - DNA, 21 bp, Homo sapiens
cttcccttatttttatttatt

SEQ ID NO: 5894526 - DNA, 22 bp, Homo sapiens
cttcccttccactgcctctgcc

SEQ ID NO: 5894527 - DNA, 23 bp, Homo sapiens
cttcccttccatctcttcctttc

SEQ ID NO: 5894528 - DNA, 16 bp, Homo sapiens
cttcccttcccttccc

SEQ ID NO: 5894529 - DNA, 11 bp, Homo sapiens
cttcccttcct

SEQ ID NO: 5894530 - DNA, 13 bp, Homo sapiens
cttcccttcctca

SEQ ID NO: 5894531 - DNA, 17 bp, Homo sapiens
cttcccttcctcagcag

SEQ ID NO: 5894532 - DNA, 18 bp, Homo sapiens
cttcccttctccccagcc

SEQ ID NO: 5894533 - DNA, 19 bp, Homo sapiens
cttcccttctccccagcca

SEQ ID NO: 5894534 - DNA, 16 bp, Homo sapiens
cttcccttctctcctt

SEQ ID NO: 5894535 - DNA, 21 bp, Homo sapiens
cttcccttctctggtctcctt

SEQ ID NO: 5894536 - DNA, 13 bp, Homo sapiens
cttcccttctctt

SEQ ID NO: 5894537 - DNA, 15 bp, Homo sapiens
cttcccttctcttgg

SEQ ID NO: 5894538 - DNA, 14 bp, Homo sapiens
cttcccttcttttc

SEQ ID NO: 5894539 - DNA, 21 bp, Homo sapiens
cttcccttgagatgagtttct

SEQ ID NO: 5894540 - DNA, 22 bp, Homo sapiens
cttcccttgagatgagtttctg

SEQ ID NO: 5894541 - DNA, 16 bp, Homo sapiens
cttcccttgagccctc

SEQ ID NO: 5894542 - DNA, 18 bp, Homo sapiens
cttcccttgccactttgc

SEQ ID NO: 5894543 - DNA, 19 bp, Homo sapiens
cttcccttgccactttgca

SEQ ID NO: 5894544 - DNA, 20 bp, Homo sapiens
cttcccttgccactttgcac

SEQ ID NO: 5894545 - DNA, 22 bp, Homo sapiens
cttcccttgctcatgagctcct

SEQ ID NO: 5894546 - DNA, 13 bp, Homo sapiens
cttcccttggagg

SEQ ID NO: 5894547 - DNA, 22 bp, Homo sapiens
cttccctttgattttttgctgc

SEQ ID NO: 5894548 - DNA, 15 bp, Homo sapiens
cttccctttgtgtat

SEQ ID NO: 5894549 - DNA, 22 bp, Homo sapiens
cttccgaaaaatcctcttcctc

SEQ ID NO: 5894550 - DNA, 18 bp, Homo sapiens
cttccgacaccactggga

SEQ ID NO: 5894551 - DNA, 17 bp, Homo sapiens
cttccgaccctctggga

SEQ ID NO: 5894552 - DNA, 19 bp, Homo sapiens
cttccgagattcagactgc

SEQ ID NO: 5894553 - DNA, 23 bp, Homo sapiens
cttccgagattcagactgcttca

SEQ ID NO: 5894554 - DNA, 17 bp, Homo sapiens
cttccgcagtgtggcca

SEQ ID NO: 5894555 - DNA, 18 bp, Homo sapiens
cttccgcatcctagtctc

SEQ ID NO: 5894556 - DNA, 15 bp, Homo sapiens
cttccgccactgggg

SEQ ID NO: 5894557 - DNA, 14 bp, Homo sapiens
cttccgcccctgcc

SEQ ID NO: 5894558 - DNA, 15 bp, Homo sapiens
cttccgcccctgcct

SEQ ID NO: 5894559 - DNA, 16 bp, Homo sapiens
cttccgcccctgcctg

SEQ ID NO: 5894560 - DNA, 20 bp, Homo sapiens
cttccgcccctgcctgccat

SEQ ID NO: 5894561 - DNA, 22 bp, Homo sapiens
cttccgcccctgcctgccatgt

SEQ ID NO: 5894562 - DNA, 16 bp, Homo sapiens
cttccgctccctggat

SEQ ID NO: 5894563 - DNA, 14 bp, Homo sapiens
cttccgctccttta

SEQ ID NO: 5894564 - DNA, 16 bp, Homo sapiens
cttccgctcctttacc

SEQ ID NO: 5894565 - DNA, 16 bp, Homo sapiens
cttccgctctgaggca

SEQ ID NO: 5894566 - DNA, 13 bp, Homo sapiens
cttccgctgaggg

SEQ ID NO: 5894567 - DNA, 17 bp, Homo sapiens
cttccgctttgaaagaa

SEQ ID NO: 5894568 - DNA, 21 bp, Homo sapiens
cttccggaagaaaaagagcca

SEQ ID NO: 5894569 - DNA, 17 bp, Homo sapiens
cttccggcccctcccct

SEQ ID NO: 5894570 - DNA, 18 bp, Homo sapiens
cttccggctgagctgtgc

SEQ ID NO: 5894571 - DNA, 20 bp, Homo sapiens
cttccggctgagctgtgcca

SEQ ID NO: 5894572 - DNA, 19 bp, Homo sapiens
cttccgggttcaagtgact

SEQ ID NO: 5894573 - DNA, 19 bp, Homo sapiens
cttccggtagggaggcagc

SEQ ID NO: 5894574 - DNA, 17 bp, Homo sapiens
cttccgtaacccaactc

SEQ ID NO: 5894575 - DNA, 13 bp, Homo sapiens
cttccgtagtttg

SEQ ID NO: 5894576 - DNA, 15 bp, Homo sapiens
cttccgtattttaat

SEQ ID NO: 5894577 - DNA, 23 bp, Homo sapiens
cttccgtcacccttggtagagtt

SEQ ID NO: 5894578 - DNA, 16 bp, Homo sapiens
cttccgtgagacacaa

SEQ ID NO: 5894579 - DNA, 17 bp, Homo sapiens
cttccgtgcatcccaga

SEQ ID NO: 5894580 - DNA, 18 bp, Homo sapiens
cttccgtgcatcccagat

SEQ ID NO: 5894581 - DNA, 16 bp, Homo sapiens
cttccgtgggtcatcc

SEQ ID NO: 5894582 - DNA, 22 bp, Homo sapiens
cttccgtgggtcatcccagcac

SEQ ID NO: 5894583 - DNA, 14 bp, Homo sapiens
cttccgttcctccc

SEQ ID NO: 5894584 - DNA, 22 bp, Homo sapiens
cttccgttggaaagaacattta

SEQ ID NO: 5894585 - DNA, 19 bp, Homo sapiens
cttcctaaattttcctgtc

SEQ ID NO: 5894586 - DNA, 14 bp, Homo sapiens
cttcctaacttatt

SEQ ID NO: 5894587 - DNA, 23 bp, Homo sapiens
cttcctaacttattgcctgggca

SEQ ID NO: 5894588 - DNA, 15 bp, Homo sapiens
cttcctaagcctgtg

SEQ ID NO: 5894589 - DNA, 16 bp, Homo sapiens
cttcctaagcctgtgg

SEQ ID NO: 5894590 - DNA, 17 bp, Homo sapiens
cttcctaagttcccttc

SEQ ID NO: 5894591 - DNA, 18 bp, Homo sapiens
cttcctaagttcccttct

SEQ ID NO: 5894592 - DNA, 22 bp, Homo sapiens
cttcctaatgccctatgtgtat

SEQ ID NO: 5894593 - DNA, 23 bp, Homo sapiens
cttcctaatgccctatgtgtata

SEQ ID NO: 5894594 - DNA, 16 bp, Homo sapiens
cttcctacagtaaagg

SEQ ID NO: 5894595 - DNA, 17 bp, Homo sapiens
cttcctacatcttcttc

SEQ ID NO: 5894596 - DNA, 17 bp, Homo sapiens
cttcctaccaaatataa

SEQ ID NO: 5894597 - DNA, 18 bp, Homo sapiens
cttcctacccacacctct

SEQ ID NO: 5894598 - DNA, 22 bp, Homo sapiens
cttcctacccacacctctgcca

SEQ ID NO: 5894599 - DNA, 16 bp, Homo sapiens
cttcctaccctcctgc

SEQ ID NO: 5894600 - DNA, 16 bp, Homo sapiens
cttcctactcttctct

SEQ ID NO: 5894601 - DNA, 21 bp, Homo sapiens
cttcctactcttctctctgct

SEQ ID NO: 5894602 - DNA, 23 bp, Homo sapiens
cttcctactcttctctctgctct

SEQ ID NO: 5894603 - DNA, 22 bp, Homo sapiens
cttcctagaagttactgaatgc

SEQ ID NO: 5894604 - DNA, 17 bp, Homo sapiens
cttcctagatgtttccc

SEQ ID NO: 5894605 - DNA, 22 bp, Homo sapiens
cttcctagattttgttgtttaa

SEQ ID NO: 5894606 - DNA, 19 bp, Homo sapiens
cttcctagcttatctccct

SEQ ID NO: 5894607 - DNA, 22 bp, Homo sapiens
cttcctagcttatctccctgct

SEQ ID NO: 5894608 - DNA, 20 bp, Homo sapiens
cttcctaggccacgtccagg

SEQ ID NO: 5894609 - DNA, 17 bp, Homo sapiens
cttcctaggtccaagcc

SEQ ID NO: 5894610 - DNA, 22 bp, Homo sapiens
cttcctagtaagtcaggacagc

SEQ ID NO: 5894611 - DNA, 17 bp, Homo sapiens
cttcctataacttcttc

SEQ ID NO: 5894612 - DNA, 14 bp, Homo sapiens
cttcctataacttg

SEQ ID NO: 5894613 - DNA, 22 bp, Homo sapiens
cttcctataacttgatgcatgt

SEQ ID NO: 5894614 - DNA, 18 bp, Homo sapiens
cttcctatcccatcccat

SEQ ID NO: 5894615 - DNA, 15 bp, Homo sapiens
cttcctatgcccagg

SEQ ID NO: 5894616 - DNA, 20 bp, Homo sapiens
cttcctatgcccaggtacca

SEQ ID NO: 5894617 - DNA, 19 bp, Homo sapiens
cttcctttcccaagccttc

SEQ ID NO: 5894618 - DNA, 15 bp, Homo sapiens
cttcctttccctgga

SEQ ID NO: 5894619 - DNA, 18 bp, Homo sapiens
cttcctttccctggagct

SEQ ID NO: 5894620 - DNA, 15 bp, Homo sapiens
cttcctttcctactg

SEQ ID NO: 5894621 - DNA, 20 bp, Homo sapiens
cttcctttcctactgtcctg

SEQ ID NO: 5894622 - DNA, 16 bp, Homo sapiens
cttcctttctccagga

SEQ ID NO: 5894623 - DNA, 19 bp, Homo sapiens
cttcctttctccaggacca

SEQ ID NO: 5894624 - DNA, 12 bp, Homo sapiens
cttcctttctct

SEQ ID NO: 5894625 - DNA, 13 bp, Homo sapiens
cttcctttctctc

SEQ ID NO: 5894626 - DNA, 14 bp, Homo sapiens
cttcctttctctcc

SEQ ID NO: 5894627 - DNA, 15 bp, Homo sapiens
cttcctttctctcct

SEQ ID NO: 5894628 - DNA, 15 bp, Homo sapiens
cttcctttgaaagac

SEQ ID NO: 5894629 - DNA, 19 bp, Homo sapiens
cttcctttgcccttcctcc

SEQ ID NO: 5894630 - DNA, 20 bp, Homo sapiens
cttcctttgcccttcctcct

SEQ ID NO: 5894631 - DNA, 11 bp, Homo sapiens
cttcctttggg

SEQ ID NO: 5894632 - DNA, 16 bp, Homo sapiens
cttcctttggtgcctc

SEQ ID NO: 5894633 - DNA, 14 bp, Homo sapiens
cttcctttgtgttt

SEQ ID NO: 5894634 - DNA, 20 bp, Homo sapiens
cttccttttacttttcttct

SEQ ID NO: 5894635 - DNA, 15 bp, Homo sapiens
cttccttttccctgc

SEQ ID NO: 5894636 - DNA, 22 bp, Homo sapiens
cttccttttccctgcttccagg

SEQ ID NO: 5894637 - DNA, 16 bp, Homo sapiens
cttccttttgaggagc

SEQ ID NO: 5894638 - DNA, 20 bp, Homo sapiens
cttccttttttagttcttca

SEQ ID NO: 5894639 - DNA, 20 bp, Homo sapiens
cttccttttttctttcttta

SEQ ID NO: 5894640 - DNA, 13 bp, Homo sapiens
cttcgaaaacaga

SEQ ID NO: 5894641 - DNA, 16 bp, Homo sapiens
cttcgaaaacagatga

SEQ ID NO: 5894642 - DNA, 21 bp, Homo sapiens
cttcgaaaacagatgagaaga

SEQ ID NO: 5894643 - DNA, 16 bp, Homo sapiens
cttcgaaaagaaattg

SEQ ID NO: 5894644 - DNA, 15 bp, Homo sapiens
cttcgaaaggccttc

SEQ ID NO: 5894645 - DNA, 22 bp, Homo sapiens
cttcgaatatatctgtaaagat

SEQ ID NO: 5894646 - DNA, 23 bp, Homo sapiens
cttcgaattagtttgcacttcct

SEQ ID NO: 5894647 - DNA, 17 bp, Homo sapiens
cttcgacactgttctta

SEQ ID NO: 5894648 - DNA, 17 bp, Homo sapiens
cttcgacagcattttcc

SEQ ID NO: 5894649 - DNA, 21 bp, Homo sapiens
cttcgacagcattttcctctg

SEQ ID NO: 5894650 - DNA, 19 bp, Homo sapiens
cttcgacagctgggctgga

SEQ ID NO: 5894651 - DNA, 23 bp, Homo sapiens
cttcgaccacagcaagccatcat

SEQ ID NO: 5894652 - DNA, 19 bp, Homo sapiens
cttcgactactgctcctgt

SEQ ID NO: 5894653 - DNA, 16 bp, Homo sapiens
cttcgactcaggatcc

SEQ ID NO: 5894654 - DNA, 14 bp, Homo sapiens
cttcgagccaactc

SEQ ID NO: 5894655 - DNA, 22 bp, Homo sapiens
cttcgaggagataaactgaaat

SEQ ID NO: 5894656 - DNA, 22 bp, Homo sapiens
cttcgagggttccaggctgtgt

SEQ ID NO: 5894657 - DNA, 21 bp, Homo sapiens
cttcgaggttgccccttcccc

SEQ ID NO: 5894658 - DNA, 14 bp, Homo sapiens
cttcgattttaaat

SEQ ID NO: 5894659 - DNA, 12 bp, Homo sapiens
cttcgcacacac

SEQ ID NO: 5894660 - DNA, 23 bp, Homo sapiens
cttcgcacacacccatgtaacca

SEQ ID NO: 5894661 - DNA, 12 bp, Homo sapiens
cttcgcagaggc

SEQ ID NO: 5894662 - DNA, 15 bp, Homo sapiens
cttcgcataaagaag

SEQ ID NO: 5894663 - DNA, 17 bp, Homo sapiens
cttcgcataaagaagaa

SEQ ID NO: 5894664 - DNA, 15 bp, Homo sapiens
cttcgcatcaaaaga

SEQ ID NO: 5894665 - DNA, 19 bp, Homo sapiens
cttcgcatcaaaagacaat

SEQ ID NO: 5894666 - DNA, 21 bp, Homo sapiens
cttcgcatcaaaagacaattc

SEQ ID NO: 5894667 - DNA, 22 bp, Homo sapiens
cttcgcatcaaaagacaattct

SEQ ID NO: 5894668 - DNA, 23 bp, Homo sapiens
cttcgcatcaaaagacaattctt

SEQ ID NO: 5894669 - DNA, 14 bp, Homo sapiens
cttcgcctttccca

SEQ ID NO: 5894670 - DNA, 24 bp, Homo sapiens
cttcgcgctggaatccagaaggaa

SEQ ID NO: 5894671 - DNA, 19 bp, Homo sapiens
cttcgcgtgccctcgctgc

SEQ ID NO: 5894672 - DNA, 13 bp, Homo sapiens
cttcgctagaaaa

SEQ ID NO: 5894673 - DNA, 17 bp, Homo sapiens
cttcgctattcccaggc

SEQ ID NO: 5894674 - DNA, 18 bp, Homo sapiens
cttcgctattcccaggca

SEQ ID NO: 5894675 - DNA, 15 bp, Homo sapiens
cttcgctcctcctct

SEQ ID NO: 5894676 - DNA, 16 bp, Homo sapiens
cttcgctcctcctctc

SEQ ID NO: 5894677 - DNA, 13 bp, Homo sapiens
cttcgctcctgtg

SEQ ID NO: 5894678 - DNA, 16 bp, Homo sapiens
cttcgctcctgtgtct

SEQ ID NO: 5894679 - DNA, 17 bp, Homo sapiens
cttcgctgccaggacac

SEQ ID NO: 5894680 - DNA, 13 bp, Homo sapiens
cttcgctgctcta

SEQ ID NO: 5894681 - DNA, 15 bp, Homo sapiens
cttcgctgctctagc

SEQ ID NO: 5894682 - DNA, 13 bp, Homo sapiens
cttcgctggacta

SEQ ID NO: 5894683 - DNA, 20 bp, Homo sapiens
cttcgcttcttgcctctgtg

SEQ ID NO: 5894684 - DNA, 13 bp, Homo sapiens
cttcggaagacct

SEQ ID NO: 5894685 - DNA, 17 bp, Homo sapiens
cttcggacagacatatg

SEQ ID NO: 5894686 - DNA, 23 bp, Homo sapiens
cttcggagaggccaagtctaatg

SEQ ID NO: 5894687 - DNA, 16 bp, Homo sapiens
cttcggaggaccaggg

SEQ ID NO: 5894688 - DNA, 16 bp, Homo sapiens
cttcggaggaggtgga

SEQ ID NO: 5894689 - DNA, 19 bp, Homo sapiens
cttcggagggccgcagggc

SEQ ID NO: 5894690 - DNA, 20 bp, Homo sapiens
cttcggagggccgcagggcc

SEQ ID NO: 5894691 - DNA, 13 bp, Homo sapiens
cttcggaggtggc

SEQ ID NO: 5894692 - DNA, 17 bp, Homo sapiens
cttcggataattttcat

SEQ ID NO: 5894693 - DNA, 23 bp, Homo sapiens
cttcggataattttcatttttaa

SEQ ID NO: 5894694 - DNA, 15 bp, Homo sapiens
cttcggatttattcc

SEQ ID NO: 5894695 - DNA, 14 bp, Homo sapiens
cttcggcagggagg

SEQ ID NO: 5894696 - DNA, 21 bp, Homo sapiens
cttcggcattggttccctttg

SEQ ID NO: 5894697 - DNA, 18 bp, Homo sapiens
cttcggccaaacagacag

SEQ ID NO: 5894698 - DNA, 16 bp, Homo sapiens
cttcggccacaggcag

SEQ ID NO: 5894699 - DNA, 16 bp, Homo sapiens
cttcggccagagctga

SEQ ID NO: 5894700 - DNA, 17 bp, Homo sapiens
cttcggcctccatcctg

SEQ ID NO: 5894701 - DNA, 15 bp, Homo sapiens
cttcgggaagagagg

SEQ ID NO: 5894702 - DNA, 18 bp, Homo sapiens
cttcgggaagagaggagt

SEQ ID NO: 5894703 - DNA, 22 bp, Homo sapiens
cttcgggaagagaggagttcaa

SEQ ID NO: 5894704 - DNA, 14 bp, Homo sapiens
cttcgggaccagga

SEQ ID NO: 5894705 - DNA, 22 bp, Homo sapiens
cttcgggagcagggctgtgtcc

SEQ ID NO: 5894706 - DNA, 20 bp, Homo sapiens
cttcgggaggtcgaggcagg

SEQ ID NO: 5894707 - DNA, 21 bp, Homo sapiens
cttcgggaggtcgaggcagga

SEQ ID NO: 5894708 - DNA, 16 bp, Homo sapiens
cttcgggcccttccca

SEQ ID NO: 5894709 - DNA, 17 bp, Homo sapiens
cttcgggcccttcccac

SEQ ID NO: 5894710 - DNA, 18 bp, Homo sapiens
cttcggggcgatgctccc

SEQ ID NO: 5894711 - DNA, 21 bp, Homo sapiens
cttcggggcgatgctccctca

SEQ ID NO: 5894712 - DNA, 22 bp, Homo sapiens
cttcggggtagaggctgggagg

SEQ ID NO: 5894713 - DNA, 14 bp, Homo sapiens
cttcgggtgtgatc

SEQ ID NO: 5894714 - DNA, 14 bp, Homo sapiens
cttcggtggccttg

SEQ ID NO: 5894715 - DNA, 16 bp, Homo sapiens
cttcggtggccttgag

SEQ ID NO: 5894716 - DNA, 23 bp, Homo sapiens
cttcggtgtgcagatcatccgtc

SEQ ID NO: 5894717 - DNA, 21 bp, Homo sapiens
cttcggtgtttaaagtcaaca

SEQ ID NO: 5894718 - DNA, 13 bp, Homo sapiens
cttcgtacagttc

SEQ ID NO: 5894719 - DNA, 14 bp, Homo sapiens
cttcgtacagttct

SEQ ID NO: 5894720 - DNA, 16 bp, Homo sapiens
cttcgtacagttcttc

SEQ ID NO: 5894721 - DNA, 21 bp, Homo sapiens
cttcgtatcccgagtctggga

SEQ ID NO: 5894722 - DNA, 23 bp, Homo sapiens
cttcgtatcccgagtctgggaca

SEQ ID NO: 5894723 - DNA, 14 bp, Homo sapiens
cttcgtcctgatcc

SEQ ID NO: 5894724 - DNA, 18 bp, Homo sapiens
cttcgtccttttggttta

SEQ ID NO: 5894725 - DNA, 14 bp, Homo sapiens
cttcgtctcagaag

SEQ ID NO: 5894726 - DNA, 18 bp, Homo sapiens
cttcgtctccatctctgg

SEQ ID NO: 5894727 - DNA, 22 bp, Homo sapiens
cttcgtctttcccatggggagg

SEQ ID NO: 5894728 - DNA, 16 bp, Homo sapiens
cttcgtgctggaggaa

SEQ ID NO: 5894729 - DNA, 21 bp, Homo sapiens
cttcgtgggatctgcccctcc

SEQ ID NO: 5894730 - DNA, 22 bp, Homo sapiens
cttcgtggttgtgtttctcgtg

SEQ ID NO: 5894731 - DNA, 16 bp, Homo sapiens
cttcgtgtctctccca

SEQ ID NO: 5894732 - DNA, 17 bp, Homo sapiens
cttcgtgtctctcccac

SEQ ID NO: 5894733 - DNA, 22 bp, Homo sapiens
cttcgtgtctctcccaccccgg

SEQ ID NO: 5894734 - DNA, 18 bp, Homo sapiens
cttcgtgtgctgctgctg

SEQ ID NO: 5894735 - DNA, 18 bp, Homo sapiens
cttcgtgtggctcctggt

SEQ ID NO: 5894736 - DNA, 17 bp, Homo sapiens
cttcgttaatagattat

SEQ ID NO: 5894737 - DNA, 13 bp, Homo sapiens
cttcgttcctgcg

SEQ ID NO: 5894738 - DNA, 13 bp, Homo sapiens
cttcgttcgcaga

SEQ ID NO: 5894739 - DNA, 18 bp, Homo sapiens
cttcgttctttttaagtt

SEQ ID NO: 5894740 - DNA, 19 bp, Homo sapiens
cttcgttctttttaagtta

SEQ ID NO: 5894741 - DNA, 23 bp, Homo sapiens
cttcgttggtgaccagtttctta

SEQ ID NO: 5894742 - DNA, 15 bp, Homo sapiens
cttcgtttaatgaat

SEQ ID NO: 5894743 - DNA, 19 bp, Homo sapiens
cttcgtttactatgcctgt

SEQ ID NO: 5894744 - DNA, 21 bp, Homo sapiens
cttcgtttactatgcctgtgt

SEQ ID NO: 5894745 - DNA, 17 bp, Homo sapiens
cttcgtttgcctccaga

SEQ ID NO: 5894746 - DNA, 12 bp, Homo sapiens
cttctaaaaact

SEQ ID NO: 5894747 - DNA, 14 bp, Homo sapiens
cttctaaaaatgaa

SEQ ID NO: 5894748 - DNA, 18 bp, Homo sapiens
cttctaaaactgtacttt

SEQ ID NO: 5894749 - DNA, 21 bp, Homo sapiens
cttctaaaacttgtatgttta

SEQ ID NO: 5894750 - DNA, 14 bp, Homo sapiens
cttctaaaagccat

SEQ ID NO: 5894751 - DNA, 15 bp, Homo sapiens
cttctaaaataaatg

SEQ ID NO: 5894752 - DNA, 21 bp, Homo sapiens
cttctaaaataaatgttttgg

SEQ ID NO: 5894753 - DNA, 23 bp, Homo sapiens
cttctaaaataaatgttttggaa

SEQ ID NO: 5894754 - DNA, 15 bp, Homo sapiens
cttctaaaatagcaa

SEQ ID NO: 5894755 - DNA, 18 bp, Homo sapiens
cttctaaaatagcaataa

SEQ ID NO: 5894756 - DNA, 17 bp, Homo sapiens
cttctaaaatgctttta

SEQ ID NO: 5894757 - DNA, 20 bp, Homo sapiens
cttctaaaatgcttttaatt

SEQ ID NO: 5894758 - DNA, 21 bp, Homo sapiens
cttctaaaatgcttttaatta

SEQ ID NO: 5894759 - DNA, 15 bp, Homo sapiens
cttctaaacacttca

SEQ ID NO: 5894760 - DNA, 22 bp, Homo sapiens
cttctaaacgtgaactaagatt

SEQ ID NO: 5894761 - DNA, 16 bp, Homo sapiens
cttctaaactgaagct

SEQ ID NO: 5894762 - DNA, 18 bp, Homo sapiens
cttctaaacttccccatc

SEQ ID NO: 5894763 - DNA, 23 bp, Homo sapiens
cttctaaaggtttcactgttcat

SEQ ID NO: 5894764 - DNA, 15 bp, Homo sapiens
cttctaaagtgctgg

SEQ ID NO: 5894765 - DNA, 16 bp, Homo sapiens
cttctaaagtgctggg

SEQ ID NO: 5894766 - DNA, 23 bp, Homo sapiens
cttctaaataaggtgtgaaatca

SEQ ID NO: 5894767 - DNA, 13 bp, Homo sapiens
cttctaaatgcat

SEQ ID NO: 5894768 - DNA, 15 bp, Homo sapiens
cttctaaattcccaa

SEQ ID NO: 5894769 - DNA, 17 bp, Homo sapiens
cttctaacccaactgac

SEQ ID NO: 5894770 - DNA, 23 bp, Homo sapiens
cttctaacctcagccaaacacag

SEQ ID NO: 5894771 - DNA, 17 bp, Homo sapiens
cttctaactggtaaaaa

SEQ ID NO: 5894772 - DNA, 17 bp, Homo sapiens
cttctaagaagacattt

SEQ ID NO: 5894773 - DNA, 20 bp, Homo sapiens
cttctaagaagacattttgt

SEQ ID NO: 5894774 - DNA, 12 bp, Homo sapiens
cttctaagagcg

SEQ ID NO: 5894775 - DNA, 19 bp, Homo sapiens
cttctaagaggatacaaat

SEQ ID NO: 5894776 - DNA, 15 bp, Homo sapiens
cttctaagataaaaa

SEQ ID NO: 5894777 - DNA, 15 bp, Homo sapiens
cttctaagatgccag

SEQ ID NO: 5894778 - DNA, 22 bp, Homo sapiens
cttctaagtaaaaccacagcag

SEQ ID NO: 5894779 - DNA, 17 bp, Homo sapiens
cttctaagtaaatacaa

SEQ ID NO: 5894780 - DNA, 21 bp, Homo sapiens
cttctaagtaaatacaatttt

SEQ ID NO: 5894781 - DNA, 21 bp, Homo sapiens
cttctaagttgagtatattat

SEQ ID NO: 5894782 - DNA, 21 bp, Homo sapiens
cttctaataaattatacaaat

SEQ ID NO: 5894783 - DNA, 18 bp, Homo sapiens
cttctaatatatttttat

SEQ ID NO: 5894784 - DNA, 17 bp, Homo sapiens
cttctaatatttattgc

SEQ ID NO: 5894785 - DNA, 20 bp, Homo sapiens
cttctaatatttattgcttt

SEQ ID NO: 5894786 - DNA, 22 bp, Homo sapiens
cttctaatcataacatagttga

SEQ ID NO: 5894787 - DNA, 14 bp, Homo sapiens
cttctaatctgcta

SEQ ID NO: 5894788 - DNA, 16 bp, Homo sapiens
cttctaatctgctatg

SEQ ID NO: 5894789 - DNA, 13 bp, Homo sapiens
cttctaatgaccc

SEQ ID NO: 5894790 - DNA, 20 bp, Homo sapiens
cttctaatgacccagatatg

SEQ ID NO: 5894791 - DNA, 13 bp, Homo sapiens
cttctaatgtaaa

SEQ ID NO: 5894792 - DNA, 15 bp, Homo sapiens
cttctaattgctgtg

SEQ ID NO: 5894793 - DNA, 20 bp, Homo sapiens
cttctaattttgtgctcttt

SEQ ID NO: 5894794 - DNA, 22 bp, Homo sapiens
cttctaattttgtgctctttcc

SEQ ID NO: 5894795 - DNA, 15 bp, Homo sapiens
cttctacaaccagag

SEQ ID NO: 5894796 - DNA, 16 bp, Homo sapiens
cttctacaaccagagc

SEQ ID NO: 5894797 - DNA, 20 bp, Homo sapiens
cttctacaaccagagccccc

SEQ ID NO: 5894798 - DNA, 17 bp, Homo sapiens
cttctacactctcctgg

SEQ ID NO: 5894799 - DNA, 18 bp, Homo sapiens
cttctacactctcctggg

SEQ ID NO: 5894800 - DNA, 19 bp, Homo sapiens
cttctacatgatgctaaag

SEQ ID NO: 5894801 - DNA, 18 bp, Homo sapiens
cttctacatttgagggcc

SEQ ID NO: 5894802 - DNA, 13 bp, Homo sapiens
cttctaccagacc

SEQ ID NO: 5894803 - DNA, 12 bp, Homo sapiens
cttctacccaga

SEQ ID NO: 5894804 - DNA, 17 bp, Homo sapiens
cttctaccccacctgac

SEQ ID NO: 5894805 - DNA, 15 bp, Homo sapiens
cttctaccctgggtc

SEQ ID NO: 5894806 - DNA, 17 bp, Homo sapiens
cttctacccttttcctt

SEQ ID NO: 5894807 - DNA, 15 bp, Homo sapiens
cttctacctgcagga

SEQ ID NO: 5894808 - DNA, 18 bp, Homo sapiens
cttctacctgcaggactc

SEQ ID NO: 5894809 - DNA, 23 bp, Homo sapiens
cttctacctgcaggcggggctcc

SEQ ID NO: 5894810 - DNA, 14 bp, Homo sapiens
cttctacctgccac

SEQ ID NO: 5894811 - DNA, 19 bp, Homo sapiens
cttctactcacttttccca

SEQ ID NO: 5894812 - DNA, 15 bp, Homo sapiens
cttctactcccctta

SEQ ID NO: 5894813 - DNA, 15 bp, Homo sapiens
cttctactcttgaga

SEQ ID NO: 5894814 - DNA, 19 bp, Homo sapiens
cttctacttgtaaaatgct

SEQ ID NO: 5894815 - DNA, 19 bp, Homo sapiens
cttctactttcatcttaaa

SEQ ID NO: 5894816 - DNA, 17 bp, Homo sapiens
cttctacttttaactaa

SEQ ID NO: 5894817 - DNA, 20 bp, Homo sapiens
cttctactttttccttcctg

SEQ ID NO: 5894818 - DNA, 17 bp, Homo sapiens
cttctagaacctgggct

SEQ ID NO: 5894819 - DNA, 22 bp, Homo sapiens
cttctagaagataacattttca

SEQ ID NO: 5894820 - DNA, 22 bp, Homo sapiens
cttctagaatacatattacaag

SEQ ID NO: 5894821 - DNA, 17 bp, Homo sapiens
cttctagaatccccaca

SEQ ID NO: 5894822 - DNA, 19 bp, Homo sapiens
cttctagaatgtctgaagt

SEQ ID NO: 5894823 - DNA, 9 bp, Homo sapiens
cttctagag

SEQ ID NO: 5894824 - DNA, 12 bp, Homo sapiens
cttctagagcct

SEQ ID NO: 5894825 - DNA, 13 bp, Homo sapiens
cttctagagctta

SEQ ID NO: 5894826 - DNA, 20 bp, Homo sapiens
cttctagaggctcatggccc

SEQ ID NO: 5894827 - DNA, 18 bp, Homo sapiens
cttctagagtaattatct

SEQ ID NO: 5894828 - DNA, 13 bp, Homo sapiens
cttctagagttca

SEQ ID NO: 5894829 - DNA, 15 bp, Homo sapiens
cttctagagttttat

SEQ ID NO: 5894830 - DNA, 13 bp, Homo sapiens
cttctagcagaga

SEQ ID NO: 5894831 - DNA, 14 bp, Homo sapiens
cttctagcagagac

SEQ ID NO: 5894832 - DNA, 14 bp, Homo sapiens
cttctagcatatag

SEQ ID NO: 5894833 - DNA, 22 bp, Homo sapiens
cttctagctcggaacttactgt

SEQ ID NO: 5894834 - DNA, 16 bp, Homo sapiens
cttctagctgtctgtg

SEQ ID NO: 5894835 - DNA, 19 bp, Homo sapiens
cttctagctgtctgtgaat

SEQ ID NO: 5894836 - DNA, 13 bp, Homo sapiens
cttctagctttgt

SEQ ID NO: 5894837 - DNA, 19 bp, Homo sapiens
cttctagctttgttgtcct

SEQ ID NO: 5894838 - DNA, 20 bp, Homo sapiens
cttctagctttgttgtcctc

SEQ ID NO: 5894839 - DNA, 16 bp, Homo sapiens
cttctaggacgccacc

SEQ ID NO: 5894840 - DNA, 16 bp, Homo sapiens
cttctaggagaacttt

SEQ ID NO: 5894841 - DNA, 19 bp, Homo sapiens
cttctaggagtcaactggc

SEQ ID NO: 5894842 - DNA, 20 bp, Homo sapiens
cttctaggagtcaactggct

SEQ ID NO: 5894843 - DNA, 21 bp, Homo sapiens
cttctaggagtcaactggctg

SEQ ID NO: 5894844 - DNA, 22 bp, Homo sapiens
cttctaggagtcaactggctgg

SEQ ID NO: 5894845 - DNA, 23 bp, Homo sapiens
cttctaggcatctcctctcccca

SEQ ID NO: 5894846 - DNA, 17 bp, Homo sapiens
cttctaggggtagctgg

SEQ ID NO: 5894847 - DNA, 14 bp, Homo sapiens
cttctaggtaattt

SEQ ID NO: 5894848 - DNA, 22 bp, Homo sapiens
cttctaggtggcaaggctgtgc

SEQ ID NO: 5894849 - DNA, 23 bp, Homo sapiens
cttctagtctggaactgctgctg

SEQ ID NO: 5894850 - DNA, 24 bp, Homo sapiens
cttctagtctggaactgctgctga

SEQ ID NO: 5894851 - DNA, 19 bp, Homo sapiens
cttctagtctggtgttctg

SEQ ID NO: 5894852 - DNA, 16 bp, Homo sapiens
cttctagtcttggcca

SEQ ID NO: 5894853 - DNA, 17 bp, Homo sapiens
cttctagtgagcctggg

SEQ ID NO: 5894854 - DNA, 23 bp, Homo sapiens
cttctagtgagcctgggccagga

SEQ ID NO: 5894855 - DNA, 18 bp, Homo sapiens
cttctagtgatgatggtt

SEQ ID NO: 5894856 - DNA, 20 bp, Homo sapiens
cttctagtgcttttcagtga

SEQ ID NO: 5894857 - DNA, 16 bp, Homo sapiens
cttctagtggccttag

SEQ ID NO: 5894858 - DNA, 19 bp, Homo sapiens
cttctagttagctgcttta

SEQ ID NO: 5894859 - DNA, 17 bp, Homo sapiens
cttctagttctgccagg

SEQ ID NO: 5894860 - DNA, 13 bp, Homo sapiens
cttctagttgccc

SEQ ID NO: 5894861 - DNA, 23 bp, Homo sapiens
cttctagttgcccccattcccag

SEQ ID NO: 5894862 - DNA, 16 bp, Homo sapiens
cttctagttgctcttg

SEQ ID NO: 5894863 - DNA, 16 bp, Homo sapiens
cttctagtttcccaca

SEQ ID NO: 5894864 - DNA, 22 bp, Homo sapiens
cttctatacatgtttgcagtgt

SEQ ID NO: 5894865 - DNA, 23 bp, Homo sapiens
cttctatagtgatgatgatctca

SEQ ID NO: 5894866 - DNA, 17 bp, Homo sapiens
cttctatattaaggcag

SEQ ID NO: 5894867 - DNA, 14 bp, Homo sapiens
cttctatcagactc

SEQ ID NO: 5894868 - DNA, 16 bp, Homo sapiens
cttctatcagactcag

SEQ ID NO: 5894869 - DNA, 16 bp, Homo sapiens
cttctatcattccaat

SEQ ID NO: 5894870 - DNA, 14 bp, Homo sapiens
cttctatcctgcaa

SEQ ID NO: 5894871 - DNA, 15 bp, Homo sapiens
cttctatcctttctt

SEQ ID NO: 5894872 - DNA, 13 bp, Homo sapiens
cttctatgaccca

SEQ ID NO: 5894873 - DNA, 13 bp, Homo sapiens
cttctatgatcag

SEQ ID NO: 5894874 - DNA, 15 bp, Homo sapiens
cttctatgcagtatt

SEQ ID NO: 5894875 - DNA, 22 bp, Homo sapiens
cttctatgtccaacagagtgga

SEQ ID NO: 5894876 - DNA, 21 bp, Homo sapiens
cttctatgttggtttcagtgg

SEQ ID NO: 5894877 - DNA, 16 bp, Homo sapiens
cttctattaaatgtat

SEQ ID NO: 5894878 - DNA, 18 bp, Homo sapiens
cttctattaacaaattat

SEQ ID NO: 5894879 - DNA, 16 bp, Homo sapiens
cttctattaatcaaga

SEQ ID NO: 5894880 - DNA, 20 bp, Homo sapiens
cttctatttaaaaaataaaa

SEQ ID NO: 5894881 - DNA, 23 bp, Homo sapiens
cttctatttggggcttgatgact

SEQ ID NO: 5894882 - DNA, 13 bp, Homo sapiens
cttctattttatt

SEQ ID NO: 5894883 - DNA, 20 bp, Homo sapiens
cttctatttttatcatgaat

SEQ ID NO: 5894884 - DNA, 16 bp, Homo sapiens
cttctcaaaagaactt

SEQ ID NO: 5894885 - DNA, 16 bp, Homo sapiens
cttctcaaaccttgat

SEQ ID NO: 5894886 - DNA, 20 bp, Homo sapiens
cttctcaaatgctactcagt

SEQ ID NO: 5894887 - DNA, 21 bp, Homo sapiens
cttctcaaatgctactcagta

SEQ ID NO: 5894888 - DNA, 19 bp, Homo sapiens
cttctcaaccttatcaagg

SEQ ID NO: 5894889 - DNA, 19 bp, Homo sapiens
cttctcaacttttttccct

SEQ ID NO: 5894890 - DNA, 22 bp, Homo sapiens
cttctcaaggacacatttggaa

SEQ ID NO: 5894891 - DNA, 12 bp, Homo sapiens
cttctcaagtgc

SEQ ID NO: 5894892 - DNA, 15 bp, Homo sapiens
cttctcaagttctaa

SEQ ID NO: 5894893 - DNA, 23 bp, Homo sapiens
cttctcaagttctaagattctaa

SEQ ID NO: 5894894 - DNA, 15 bp, Homo sapiens
cttctcacagcacat

SEQ ID NO: 5894895 - DNA, 19 bp, Homo sapiens
cttctcacagcacatgctg

SEQ ID NO: 5894896 - DNA, 20 bp, Homo sapiens
cttctcaccaaacttcatgt

SEQ ID NO: 5894897 - DNA, 14 bp, Homo sapiens
cttctcaccagcag

SEQ ID NO: 5894898 - DNA, 14 bp, Homo sapiens
cttctcaccagctg

SEQ ID NO: 5894899 - DNA, 16 bp, Homo sapiens
cttctcaccagctgca

SEQ ID NO: 5894900 - DNA, 17 bp, Homo sapiens
cttctcaccagctgcaa

SEQ ID NO: 5894901 - DNA, 22 bp, Homo sapiens
cttctcaccagctgcaaagtgt

SEQ ID NO: 5894902 - DNA, 22 bp, Homo sapiens
cttctcaccgtgcagagctgca

SEQ ID NO: 5894903 - DNA, 16 bp, Homo sapiens
cttctcacgctttgtt

SEQ ID NO: 5894904 - DNA, 14 bp, Homo sapiens
cttctcacggcctg

SEQ ID NO: 5894905 - DNA, 15 bp, Homo sapiens
cttctcactcaccac

SEQ ID NO: 5894906 - DNA, 16 bp, Homo sapiens
cttctcactgccatgc

SEQ ID NO: 5894907 - DNA, 14 bp, Homo sapiens
cttctcactttcct

SEQ ID NO: 5894908 - DNA, 13 bp, Homo sapiens
cttctcagaagca

SEQ ID NO: 5894909 - DNA, 16 bp, Homo sapiens
cttctcagaagcacag

SEQ ID NO: 5894910 - DNA, 22 bp, Homo sapiens
cttctcagaagcacagaatatt

SEQ ID NO: 5894911 - DNA, 19 bp, Homo sapiens
cttctcagagcagcactgg

SEQ ID NO: 5894912 - DNA, 22 bp, Homo sapiens
cttctcagagcagcactggggt

SEQ ID NO: 5894913 - DNA, 23 bp, Homo sapiens
cttctcagagcagcactggggtt

SEQ ID NO: 5894914 - DNA, 13 bp, Homo sapiens
cttctcagcccct

SEQ ID NO: 5894915 - DNA, 17 bp, Homo sapiens
cttctcagctccactct

SEQ ID NO: 5894916 - DNA, 19 bp, Homo sapiens
cttctcagctccactctga

SEQ ID NO: 5894917 - DNA, 17 bp, Homo sapiens
cttctcagctcttccat

SEQ ID NO: 5894918 - DNA, 22 bp, Homo sapiens
cttctcaggacacaggcctgtg

SEQ ID NO: 5894919 - DNA, 23 bp, Homo sapiens
cttctcaggacacaggcctgtgt

SEQ ID NO: 5894920 - DNA, 22 bp, Homo sapiens
cttctcaggcatgaacatgtac

SEQ ID NO: 5894921 - DNA, 13 bp, Homo sapiens
cttctcaggcccc

SEQ ID NO: 5894922 - DNA, 18 bp, Homo sapiens
cttctcaggccccgggct

SEQ ID NO: 5894923 - DNA, 23 bp, Homo sapiens
cttctcaggccccgggcttccct

SEQ ID NO: 5894924 - DNA, 21 bp, Homo sapiens
cttctcaggctctgccctgcc

SEQ ID NO: 5894925 - DNA, 15 bp, Homo sapiens
cttctcaggctggca

SEQ ID NO: 5894926 - DNA, 23 bp, Homo sapiens
cttctcagtccagcagtttccag

SEQ ID NO: 5894927 - DNA, 14 bp, Homo sapiens
cttctcagtttctg

SEQ ID NO: 5894928 - DNA, 15 bp, Homo sapiens
cttctcagtttctgc

SEQ ID NO: 5894929 - DNA, 14 bp, Homo sapiens
cttctcataaatct

SEQ ID NO: 5894930 - DNA, 16 bp, Homo sapiens
cttctcatacgtccac

SEQ ID NO: 5894931 - DNA, 13 bp, Homo sapiens
cttctcatagcat

SEQ ID NO: 5894932 - DNA, 13 bp, Homo sapiens
cttctcatcactc

SEQ ID NO: 5894933 - DNA, 18 bp, Homo sapiens
cttctcatcactcccctc

SEQ ID NO: 5894934 - DNA, 16 bp, Homo sapiens
cttctcatcctgcagg

SEQ ID NO: 5894935 - DNA, 12 bp, Homo sapiens
cttctcatctgt

SEQ ID NO: 5894936 - DNA, 16 bp, Homo sapiens
cttctcatcttaaaaa

SEQ ID NO: 5894937 - DNA, 16 bp, Homo sapiens
cttctcatgctatttc

SEQ ID NO: 5894938 - DNA, 13 bp, Homo sapiens
cttctcattaccc

SEQ ID NO: 5894939 - DNA, 21 bp, Homo sapiens
cttctcattccaacagtgagt

SEQ ID NO: 5894940 - DNA, 17 bp, Homo sapiens
cttctcattgctgcccg

SEQ ID NO: 5894941 - DNA, 14 bp, Homo sapiens
cttctcatttcacc

SEQ ID NO: 5894942 - DNA, 17 bp, Homo sapiens
cttctcatttcacccct

SEQ ID NO: 5894943 - DNA, 21 bp, Homo sapiens
cttctcatttcacccctccct

SEQ ID NO: 5894944 - DNA, 18 bp, Homo sapiens
cttctcattttttcctga

SEQ ID NO: 5894945 - DNA, 20 bp, Homo sapiens
cttctccaaaaatctgcctg

SEQ ID NO: 5894946 - DNA, 18 bp, Homo sapiens
cttctccaacactgaagt

SEQ ID NO: 5894947 - DNA, 22 bp, Homo sapiens
cttctccaagaatggaagcctg

SEQ ID NO: 5894948 - DNA, 14 bp, Homo sapiens
cttctccaaggaaa

SEQ ID NO: 5894949 - DNA, 17 bp, Homo sapiens
cttctccaatgctctgg

SEQ ID NO: 5894950 - DNA, 16 bp, Homo sapiens
cttctccaattctgaa

SEQ ID NO: 5894951 - DNA, 14 bp, Homo sapiens
cttctccaccagcc

SEQ ID NO: 5894952 - DNA, 17 bp, Homo sapiens
cttctccaccctgctct

SEQ ID NO: 5894953 - DNA, 16 bp, Homo sapiens
cttctccacctccccc

SEQ ID NO: 5894954 - DNA, 17 bp, Homo sapiens
cttctccacgtctttcc

SEQ ID NO: 5894955 - DNA, 13 bp, Homo sapiens
cttctccactgga

SEQ ID NO: 5894956 - DNA, 15 bp, Homo sapiens
cttctccactggatg

SEQ ID NO: 5894957 - DNA, 17 bp, Homo sapiens
cttctccagcaagcagt

SEQ ID NO: 5894958 - DNA, 16 bp, Homo sapiens
cttctccaggcagagg

SEQ ID NO: 5894959 - DNA, 12 bp, Homo sapiens
cttctccagtgg

SEQ ID NO: 5894960 - DNA, 22 bp, Homo sapiens
cttctccatcctttctgcctct

SEQ ID NO: 5894961 - DNA, 15 bp, Homo sapiens
cttctccatgctgca

SEQ ID NO: 5894962 - DNA, 15 bp, Homo sapiens
cttctccattcccta

SEQ ID NO: 5894963 - DNA, 16 bp, Homo sapiens
cttctccattccctag

SEQ ID NO: 5894964 - DNA, 22 bp, Homo sapiens
cttctccattccctccacccac

SEQ ID NO: 5894965 - DNA, 20 bp, Homo sapiens
cttctcccaaatgtctattt

SEQ ID NO: 5894966 - DNA, 14 bp, Homo sapiens
cttctcccaactca

SEQ ID NO: 5894967 - DNA, 15 bp, Homo sapiens
cttctcccaactcag

SEQ ID NO: 5894968 - DNA, 14 bp, Homo sapiens
cttctcccacccct

SEQ ID NO: 5894969 - DNA, 15 bp, Homo sapiens
cttctcccacccctt

SEQ ID NO: 5894970 - DNA, 16 bp, Homo sapiens
cttctcccactctcct

SEQ ID NO: 5894971 - DNA, 20 bp, Homo sapiens
cttctcccactctcctaggc

SEQ ID NO: 5894972 - DNA, 23 bp, Homo sapiens
cttctgggacaggcaccatgctg

SEQ ID NO: 5894973 - DNA, 17 bp, Homo sapiens
cttctgggactggacag

SEQ ID NO: 5894974 - DNA, 20 bp, Homo sapiens
cttctgggcaagggctccta

SEQ ID NO: 5894975 - DNA, 18 bp, Homo sapiens
cttctgggcagagcctgt

SEQ ID NO: 5894976 - DNA, 21 bp, Homo sapiens
cttctgggcagagcctgtccc

SEQ ID NO: 5894977 - DNA, 21 bp, Homo sapiens
cttctgggcatctgttctggt

SEQ ID NO: 5894978 - DNA, 15 bp, Homo sapiens
cttctgggcctctct

SEQ ID NO: 5894979 - DNA, 18 bp, Homo sapiens
cttctgggcctgatggag

SEQ ID NO: 5894980 - DNA, 16 bp, Homo sapiens
cttctggggagggaca

SEQ ID NO: 5894981 - DNA, 22 bp, Homo sapiens
cttctggggctccctgcctgga

SEQ ID NO: 5894982 - DNA, 16 bp, Homo sapiens
cttctggggtccccag

SEQ ID NO: 5894983 - DNA, 17 bp, Homo sapiens
cttctggggtccccagg

SEQ ID NO: 5894984 - DNA, 23 bp, Homo sapiens
cttctggggttggaagtgtgact

SEQ ID NO: 5894985 - DNA, 18 bp, Homo sapiens
cttctgggtagtcccctg

SEQ ID NO: 5894986 - DNA, 16 bp, Homo sapiens
cttctgggtccaggga

SEQ ID NO: 5894987 - DNA, 19 bp, Homo sapiens
cttctgggtccagggaggg

SEQ ID NO: 5894988 - DNA, 17 bp, Homo sapiens
cttctgggtggctcctg

SEQ ID NO: 5894989 - DNA, 18 bp, Homo sapiens
cttctgggtggctcctgc

SEQ ID NO: 5894990 - DNA, 22 bp, Homo sapiens
cttctgggtggctcctgccact

SEQ ID NO: 5894991 - DNA, 23 bp, Homo sapiens
cttctgggtggctcctgccactg

SEQ ID NO: 5894992 - DNA, 15 bp, Homo sapiens
cttctgggtggggca

SEQ ID NO: 5894993 - DNA, 15 bp, Homo sapiens
cttctgggtgtgctt

SEQ ID NO: 5894994 - DNA, 15 bp, Homo sapiens
cttctggtactctcc

SEQ ID NO: 5894995 - DNA, 17 bp, Homo sapiens
cttctggtactctccta

SEQ ID NO: 5894996 - DNA, 15 bp, Homo sapiens
cttctggtcccctgt

SEQ ID NO: 5894997 - DNA, 16 bp, Homo sapiens
cttctggtcccctgtg

SEQ ID NO: 5894998 - DNA, 20 bp, Homo sapiens
cttctggtctggtaaatatg

SEQ ID NO: 5894999 - DNA, 16 bp, Homo sapiens
cttctggtctgtgtgt

SEQ ID NO: 5895000 - DNA, 18 bp, Homo sapiens
cttctggtgaccttccaa

SEQ ID NO: 5895001 - DNA, 19 bp, Homo sapiens
cttctggtgctactccatg

SEQ ID NO: 5895002 - DNA, 21 bp, Homo sapiens
cttctggtgctactccatgca

SEQ ID NO: 5895003 - DNA, 14 bp, Homo sapiens
cttctggtgctgct

SEQ ID NO: 5895004 - DNA, 21 bp, Homo sapiens
cttctggtgttgactggactg

SEQ ID NO: 5895005 - DNA, 16 bp, Homo sapiens
cttctggttgtatttc

SEQ ID NO: 5895006 - DNA, 19 bp, Homo sapiens
cttctggtttaaacttgtt

SEQ ID NO: 5895007 - DNA, 14 bp, Homo sapiens
cttctggtttccct

SEQ ID NO: 5895008 - DNA, 21 bp, Homo sapiens
cttctggttttctagcccctc

SEQ ID NO: 5895009 - DNA, 21 bp, Homo sapiens
cttctgtaacgggtcgtgctc

SEQ ID NO: 5895010 - DNA, 22 bp, Homo sapiens
cttctgtaacgggtcgtgctca

SEQ ID NO: 5895011 - DNA, 14 bp, Homo sapiens
cttctgtaatcaat

SEQ ID NO: 5895012 - DNA, 20 bp, Homo sapiens
cttctgtaattgtgtggatt

SEQ ID NO: 5895013 - DNA, 15 bp, Homo sapiens
cttctgtacgtctga

SEQ ID NO: 5895014 - DNA, 21 bp, Homo sapiens
cttctgtacgtctgacaggca

SEQ ID NO: 5895015 - DNA, 19 bp, Homo sapiens
cttctgtagcctgaagagt

SEQ ID NO: 5895016 - DNA, 23 bp, Homo sapiens
cttctgtagcctgaagagtttgt

SEQ ID NO: 5895017 - DNA, 18 bp, Homo sapiens
cttctgtagtactcctta

SEQ ID NO: 5895018 - DNA, 21 bp, Homo sapiens
cttctgtagttttatcacatg

SEQ ID NO: 5895019 - DNA, 15 bp, Homo sapiens
cttctgtatgcatca

SEQ ID NO: 5895020 - DNA, 22 bp, Homo sapiens
cttctgtatgtgacaacatttt

SEQ ID NO: 5895021 - DNA, 15 bp, Homo sapiens
cttctgtattttaat

SEQ ID NO: 5895022 - DNA, 21 bp, Homo sapiens
cttctgtattttcaaagactg

SEQ ID NO: 5895023 - DNA, 21 bp, Homo sapiens
cttctgtcatcccgctcctgc

SEQ ID NO: 5895024 - DNA, 22 bp, Homo sapiens
cttctgtcatcccgctcctgct

SEQ ID NO: 5895025 - DNA, 23 bp, Homo sapiens
cttctgtcatcccgctcctgctg

SEQ ID NO: 5895026 - DNA, 15 bp, Homo sapiens
cttctgtccaaggca

SEQ ID NO: 5895027 - DNA, 19 bp, Homo sapiens
cttctgtccaccagaccca

SEQ ID NO: 5895028 - DNA, 15 bp, Homo sapiens
cttctgtccaggaca

SEQ ID NO: 5895029 - DNA, 16 bp, Homo sapiens
cttctgtccccagccc

SEQ ID NO: 5895030 - DNA, 22 bp, Homo sapiens
cttctgtccccagccctgtcct

SEQ ID NO: 5895031 - DNA, 21 bp, Homo sapiens
cttctgtcccttgtttttgat

SEQ ID NO: 5895032 - DNA, 19 bp, Homo sapiens
cttctgtcctactctgtgt

SEQ ID NO: 5895033 - DNA, 14 bp, Homo sapiens
cttctgtcctgccc

SEQ ID NO: 5895034 - DNA, 15 bp, Homo sapiens
cttctgtcgtcccca

SEQ ID NO: 5895035 - DNA, 20 bp, Homo sapiens
cttctgtcgtccccagacca

SEQ ID NO: 5895036 - DNA, 10 bp, Homo sapiens
cttctgtctc

SEQ ID NO: 5895037 - DNA, 21 bp, Homo sapiens
cttctgtcttcacaacagatt

SEQ ID NO: 5895038 - DNA, 17 bp, Homo sapiens
cttctgtcttgtcccca

SEQ ID NO: 5895039 - DNA, 12 bp, Homo sapiens
cttctgtgaaga

SEQ ID NO: 5895040 - DNA, 19 bp, Homo sapiens
cttctgtgaagaagccctg

SEQ ID NO: 5895041 - DNA, 21 bp, Homo sapiens
cttctgtgagacccccacacc

SEQ ID NO: 5895042 - DNA, 22 bp, Homo sapiens
cttctgtgagacccccacacct

SEQ ID NO: 5895043 - DNA, 15 bp, Homo sapiens
cttctgtgatgagct

SEQ ID NO: 5895044 - DNA, 23 bp, Homo sapiens
cttctgtgcactagcctgtgatt

SEQ ID NO: 5895045 - DNA, 21 bp, Homo sapiens
cttctgtgcatttgtgtctgc

SEQ ID NO: 5895046 - DNA, 13 bp, Homo sapiens
cttctgtgcccag

SEQ ID NO: 5895047 - DNA, 14 bp, Homo sapiens
cttctgtgcccaga

SEQ ID NO: 5895048 - DNA, 14 bp, Homo sapiens
cttctgtgcccagc

SEQ ID NO: 5895049 - DNA, 15 bp, Homo sapiens
cttctgtgcccaggg

SEQ ID NO: 5895050 - DNA, 11 bp, Homo sapiens
cttctgtgcct

SEQ ID NO: 5895051 - DNA, 23 bp, Homo sapiens
cttctgtggaagtagctttgaac

SEQ ID NO: 5895052 - DNA, 20 bp, Homo sapiens
cttctgtggggcccctcacc

SEQ ID NO: 5895053 - DNA, 15 bp, Homo sapiens
cttctgtggggctgg

SEQ ID NO: 5895054 - DNA, 19 bp, Homo sapiens
cttctgtggggctgggcac

SEQ ID NO: 5895055 - DNA, 21 bp, Homo sapiens
cttctgtgggtgacccaggtc

SEQ ID NO: 5895056 - DNA, 17 bp, Homo sapiens
cttctgtggtccctctg

SEQ ID NO: 5895057 - DNA, 16 bp, Homo sapiens
cttctgtgtaccactt

SEQ ID NO: 5895058 - DNA, 19 bp, Homo sapiens
cttctgtgtaccacttctg

SEQ ID NO: 5895059 - DNA, 13 bp, Homo sapiens
cttctgtgtcaca

SEQ ID NO: 5895060 - DNA, 12 bp, Homo sapiens
cttctgtgtctg

SEQ ID NO: 5895061 - DNA, 16 bp, Homo sapiens
cttctgtgtctgtcac

SEQ ID NO: 5895062 - DNA, 14 bp, Homo sapiens
cttctgtgtgtgag

SEQ ID NO: 5895063 - DNA, 12 bp, Homo sapiens
cttctgtgttca

SEQ ID NO: 5895064 - DNA, 19 bp, Homo sapiens
cttctgtgtttctggagtg

SEQ ID NO: 5895065 - DNA, 14 bp, Homo sapiens
cttctgttaagaaa

SEQ ID NO: 5895066 - DNA, 18 bp, Homo sapiens
cttctgttaagaaaggat

SEQ ID NO: 5895067 - DNA, 12 bp, Homo sapiens
cttctgttctca

SEQ ID NO: 5895068 - DNA, 14 bp, Homo sapiens
cttctgttctctgc

SEQ ID NO: 5895069 - DNA, 19 bp, Homo sapiens
cttctgttgtcaccttcac

SEQ ID NO: 5895070 - DNA, 20 bp, Homo sapiens
cttctgttgtcaccttcacc

SEQ ID NO: 5895071 - DNA, 16 bp, Homo sapiens
cttctgtttagtctcc

SEQ ID NO: 5895072 - DNA, 12 bp, Homo sapiens
cttctgtttcta

SEQ ID NO: 5895073 - DNA, 15 bp, Homo sapiens
cttctgttttataat

SEQ ID NO: 5895074 - DNA, 20 bp, Homo sapiens
cttctgttttataattttgt

SEQ ID NO: 5895075 - DNA, 14 bp, Homo sapiens
cttctgttttctgt

SEQ ID NO: 5895076 - DNA, 15 bp, Homo sapiens
cttctgttttctgtt

SEQ ID NO: 5895077 - DNA, 21 bp, Homo sapiens
cttctgttttgagttttgtag

SEQ ID NO: 5895078 - DNA, 16 bp, Homo sapiens
cttcttaaaaactgtg

SEQ ID NO: 5895079 - DNA, 21 bp, Homo sapiens
cttcttaaaagaaatcttgct

SEQ ID NO: 5895080 - DNA, 15 bp, Homo sapiens
cttcttaaaaggagc

SEQ ID NO: 5895081 - DNA, 22 bp, Homo sapiens
cttcttaaaatcaaatgtaaat

SEQ ID NO: 5895082 - DNA, 19 bp, Homo sapiens
cttcttaaaggcctggaac

SEQ ID NO: 5895083 - DNA, 23 bp, Homo sapiens
cttcttaaaggggaactgtcaag

SEQ ID NO: 5895084 - DNA, 21 bp, Homo sapiens
cttcttaaatacaatcacatt

SEQ ID NO: 5895085 - DNA, 13 bp, Homo sapiens
cttcttaaatatc

SEQ ID NO: 5895086 - DNA, 15 bp, Homo sapiens
cttcttaatgtacat

SEQ ID NO: 5895087 - DNA, 16 bp, Homo sapiens
cttcttaatgtacata

SEQ ID NO: 5895088 - DNA, 12 bp, Homo sapiens
cttcttaattaa

SEQ ID NO: 5895089 - DNA, 14 bp, Homo sapiens
cttcttaattaatt

SEQ ID NO: 5895090 - DNA, 22 bp, Homo sapiens
cttcttaattaatttgattaac

SEQ ID NO: 5895091 - DNA, 23 bp, Homo sapiens
cttcttacaaaaagaaatgtcaa

SEQ ID NO: 5895092 - DNA, 22 bp, Homo sapiens
cttcttacaccgtgaggccaag

SEQ ID NO: 5895093 - DNA, 22 bp, Homo sapiens
cttcttacacttcttaccccag

SEQ ID NO: 5895094 - DNA, 15 bp, Homo sapiens
cttcttacatgcatt

SEQ ID NO: 5895095 - DNA, 20 bp, Homo sapiens
cttcttactcattactgcaa

SEQ ID NO: 5895096 - DNA, 15 bp, Homo sapiens
cttcttactgtattt

SEQ ID NO: 5895097 - DNA, 22 bp, Homo sapiens
cttcttacttggaactgaaggg

SEQ ID NO: 5895098 - DNA, 23 bp, Homo sapiens
cttcttagagttttattcctttc

SEQ ID NO: 5895099 - DNA, 22 bp, Homo sapiens
cttcttagctatcattgcttcc

SEQ ID NO: 5895100 - DNA, 16 bp, Homo sapiens
cttcttataacttgta

SEQ ID NO: 5895101 - DNA, 17 bp, Homo sapiens
cttcttatatctgaaga

SEQ ID NO: 5895102 - DNA, 19 bp, Homo sapiens
cttcttatatctgaagatt

SEQ ID NO: 5895103 - DNA, 15 bp, Homo sapiens
cttcttatccttaca

SEQ ID NO: 5895104 - DNA, 15 bp, Homo sapiens
cttcttatctaaacc

SEQ ID NO: 5895105 - DNA, 19 bp, Homo sapiens
cttcttatggaattgattt

SEQ ID NO: 5895106 - DNA, 22 bp, Homo sapiens
cttcttatggaattgatttgca

SEQ ID NO: 5895107 - DNA, 14 bp, Homo sapiens
cttcttattctcac

SEQ ID NO: 5895108 - DNA, 21 bp, Homo sapiens
cttcttatttatgtgaacaac

SEQ ID NO: 5895109 - DNA, 16 bp, Homo sapiens
cttcttcacatccatt

SEQ ID NO: 5895110 - DNA, 13 bp, Homo sapiens
cttcttcaccatt

SEQ ID NO: 5895111 - DNA, 18 bp, Homo sapiens
cttcttcacccagctaat

SEQ ID NO: 5895112 - DNA, 23 bp, Homo sapiens
cttcttcacccagctaatctgta

SEQ ID NO: 5895113 - DNA, 19 bp, Homo sapiens
cttcttcacccgctgcagc

SEQ ID NO: 5895114 - DNA, 13 bp, Homo sapiens
cttcttcacctct

SEQ ID NO: 5895115 - DNA, 20 bp, Homo sapiens
cttcttcagaagacactgca

SEQ ID NO: 5895116 - DNA, 14 bp, Homo sapiens
cttcttcagagact

SEQ ID NO: 5895117 - DNA, 21 bp, Homo sapiens
cttcttcagagactcctgcag

SEQ ID NO: 5895118 - DNA, 21 bp, Homo sapiens
cttcttcagcaggaagggtgg

SEQ ID NO: 5895119 - DNA, 17 bp, Homo sapiens
cttcttcagccacctct

SEQ ID NO: 5895120 - DNA, 21 bp, Homo sapiens
cttcttcagccacctctcttt

SEQ ID NO: 5895121 - DNA, 12 bp, Homo sapiens
cttcttcagggc

SEQ ID NO: 5895122 - DNA, 16 bp, Homo sapiens
cttcttcagggcctgg

SEQ ID NO: 5895123 - DNA, 19 bp, Homo sapiens
cttcttcataattttagta

SEQ ID NO: 5895124 - DNA, 16 bp, Homo sapiens
cttcttcatattctaa

SEQ ID NO: 5895125 - DNA, 23 bp, Homo sapiens
cttcttcatccatagacacagta

SEQ ID NO: 5895126 - DNA, 21 bp, Homo sapiens
cttcttccaatgatgcttact

SEQ ID NO: 5895127 - DNA, 14 bp, Homo sapiens
cttcttccacttct

SEQ ID NO: 5895128 - DNA, 15 bp, Homo sapiens
cttcttccacttctc

SEQ ID NO: 5895129 - DNA, 17 bp, Homo sapiens
cttcttccacttctcca

SEQ ID NO: 5895130 - DNA, 21 bp, Homo sapiens
cttcttccactttttccagaa

SEQ ID NO: 5895131 - DNA, 15 bp, Homo sapiens
cttcttccatcccag

SEQ ID NO: 5895132 - DNA, 18 bp, Homo sapiens
cttcttccatcccaggac

SEQ ID NO: 5895133 - DNA, 17 bp, Homo sapiens
cttcttccccagggttc

SEQ ID NO: 5895134 - DNA, 20 bp, Homo sapiens
cttcttccccaggtccttcc

SEQ ID NO: 5895135 - DNA, 21 bp, Homo sapiens
cttcttcccctttgtcctgcg

SEQ ID NO: 5895136 - DNA, 20 bp, Homo sapiens
cttcttcccgccccacctcc

SEQ ID NO: 5895137 - DNA, 20 bp, Homo sapiens
cttcttccctgtcagcctga

SEQ ID NO: 5895138 - DNA, 12 bp, Homo sapiens
cttcttccctta

SEQ ID NO: 5895139 - DNA, 23 bp, Homo sapiens
cttcttcctacatcttcttccca

SEQ ID NO: 5895140 - DNA, 14 bp, Homo sapiens
cttcttcctcaagt

SEQ ID NO: 5895141 - DNA, 15 bp, Homo sapiens
cttcttcctcacact

SEQ ID NO: 5895142 - DNA, 20 bp, Homo sapiens
cttcttcctcacactgctgt

SEQ ID NO: 5895143 - DNA, 23 bp, Homo sapiens
cttcttcctcacactgctgtcct

SEQ ID NO: 5895144 - DNA, 23 bp, Homo sapiens
cttcttcctgaatactgaaacta

SEQ ID NO: 5895145 - DNA, 13 bp, Homo sapiens
cttcttcctgctg

SEQ ID NO: 5895146 - DNA, 19 bp, Homo sapiens
cttcttcctttctctttct

SEQ ID NO: 5895147 - DNA, 19 bp, Homo sapiens
cttcttcgctgctagagaa

SEQ ID NO: 5895148 - DNA, 16 bp, Homo sapiens
cttgacacagtcagca

SEQ ID NO: 5895149 - DNA, 20 bp, Homo sapiens
cttgacacatagtttttcag

SEQ ID NO: 5895150 - DNA, 13 bp, Homo sapiens
cttgacaccacta

SEQ ID NO: 5895151 - DNA, 16 bp, Homo sapiens
cttgacaccactaaga

SEQ ID NO: 5895152 - DNA, 15 bp, Homo sapiens
cttgacacctgctga

SEQ ID NO: 5895153 - DNA, 15 bp, Homo sapiens
cttgacacggtgaaa

SEQ ID NO: 5895154 - DNA, 13 bp, Homo sapiens
cttgacagaaagc

SEQ ID NO: 5895155 - DNA, 18 bp, Homo sapiens
cttgacagaaagcagttc

SEQ ID NO: 5895156 - DNA, 22 bp, Homo sapiens
cttgacagaaagcagttctgat

SEQ ID NO: 5895157 - DNA, 23 bp, Homo sapiens
cttgacagaaagcagttctgatg

SEQ ID NO: 5895158 - DNA, 13 bp, Homo sapiens
cttgacagactgt

SEQ ID NO: 5895159 - DNA, 16 bp, Homo sapiens
cttgacagagcctgcc

SEQ ID NO: 5895160 - DNA, 12 bp, Homo sapiens
cttgacagctca

SEQ ID NO: 5895161 - DNA, 18 bp, Homo sapiens
cttgacaggcgccgcctc

SEQ ID NO: 5895162 - DNA, 13 bp, Homo sapiens
cttgacagggcac

SEQ ID NO: 5895163 - DNA, 20 bp, Homo sapiens
cttgacagtggaactacatt

SEQ ID NO: 5895164 - DNA, 19 bp, Homo sapiens
cttgacataatttcactga

SEQ ID NO: 5895165 - DNA, 15 bp, Homo sapiens
cttgacatacctacc

SEQ ID NO: 5895166 - DNA, 19 bp, Homo sapiens
cttgacatacctaccagta

SEQ ID NO: 5895167 - DNA, 16 bp, Homo sapiens
cttgacatcaactgca

SEQ ID NO: 5895168 - DNA, 19 bp, Homo sapiens
cttgacatctggaaacctc

SEQ ID NO: 5895169 - DNA, 14 bp, Homo sapiens
cttgacatgtaatg

SEQ ID NO: 5895170 - DNA, 16 bp, Homo sapiens
cttgacattatgtttt

SEQ ID NO: 5895171 - DNA, 17 bp, Homo sapiens
cttgacattatgtttta

SEQ ID NO: 5895172 - DNA, 22 bp, Homo sapiens
cttgacattccttgtcaccagc

SEQ ID NO: 5895173 - DNA, 20 bp, Homo sapiens
cttgacatttatcacctctg

SEQ ID NO: 5895174 - DNA, 19 bp, Homo sapiens
cttgaccaagcaggaagct

SEQ ID NO: 5895175 - DNA, 11 bp, Homo sapiens
cttgaccagca

SEQ ID NO: 5895176 - DNA, 21 bp, Homo sapiens
cttgaccagcagatcccagct

SEQ ID NO: 5895177 - DNA, 17 bp, Homo sapiens
cttgaccaggcttggcc

SEQ ID NO: 5895178 - DNA, 22 bp, Homo sapiens
cttgaccatcgtccttcctctc

SEQ ID NO: 5895179 - DNA, 22 bp, Homo sapiens
cttgaccattctccacctgcca

SEQ ID NO: 5895180 - DNA, 16 bp, Homo sapiens
cttgacccatctcccc

SEQ ID NO: 5895181 - DNA, 14 bp, Homo sapiens
cttgaccctgagct

SEQ ID NO: 5895182 - DNA, 14 bp, Homo sapiens
cttgaccctgcacc

SEQ ID NO: 5895183 - DNA, 22 bp, Homo sapiens
cttgaccctgcaccctcctagg

SEQ ID NO: 5895184 - DNA, 14 bp, Homo sapiens
cttgaccctttcct

SEQ ID NO: 5895185 - DNA, 17 bp, Homo sapiens
cttgaccgtgaggccag

SEQ ID NO: 5895186 - DNA, 20 bp, Homo sapiens
cttgaccgtgaggccagaga

SEQ ID NO: 5895187 - DNA, 21 bp, Homo sapiens
cttgaccgtttttatattact

SEQ ID NO: 5895188 - DNA, 14 bp, Homo sapiens
cttgacctctgtga

SEQ ID NO: 5895189 - DNA, 19 bp, Homo sapiens
cttgacctctgtgaccaac

SEQ ID NO: 5895190 - DNA, 15 bp, Homo sapiens
cttgacctgaactct

SEQ ID NO: 5895191 - DNA, 20 bp, Homo sapiens
cttgaccttctgtcgtcccc

SEQ ID NO: 5895192 - DNA, 21 bp, Homo sapiens
cttgaccttctgtcgtcccca

SEQ ID NO: 5895193 - DNA, 22 bp, Homo sapiens
cttgaccttctgtcgtccccag

SEQ ID NO: 5895194 - DNA, 14 bp, Homo sapiens
cttgacctttccag

SEQ ID NO: 5895195 - DNA, 16 bp, Homo sapiens
cttgacctttgtacag

SEQ ID NO: 5895196 - DNA, 22 bp, Homo sapiens
cttgacctttgtacagcccaga

SEQ ID NO: 5895197 - DNA, 18 bp, Homo sapiens
cttgaccttttcgacgct

SEQ ID NO: 5895198 - DNA, 14 bp, Homo sapiens
cttgacgaatattg

SEQ ID NO: 5895199 - DNA, 17 bp, Homo sapiens
cttgacgcagcccccca

SEQ ID NO: 5895200 - DNA, 22 bp, Homo sapiens
cttgacgggagcattggcccct

SEQ ID NO: 5895201 - DNA, 19 bp, Homo sapiens
cttgacgtattattgtcct

SEQ ID NO: 5895202 - DNA, 15 bp, Homo sapiens
cttgacgtttcttct

SEQ ID NO: 5895203 - DNA, 17 bp, Homo sapiens
cttgactaataccttgt

SEQ ID NO: 5895204 - DNA, 18 bp, Homo sapiens
cttgactatcacatacaa

SEQ ID NO: 5895205 - DNA, 21 bp, Homo sapiens
cttgactatgtctagagcctc

SEQ ID NO: 5895206 - DNA, 12 bp, Homo sapiens
cttgactattac

SEQ ID NO: 5895207 - DNA, 15 bp, Homo sapiens
cttgactcaggattt

SEQ ID NO: 5895208 - DNA, 16 bp, Homo sapiens
cttgactcaggattta

SEQ ID NO: 5895209 - DNA, 19 bp, Homo sapiens
cttgactcatggcagctgt

SEQ ID NO: 5895210 - DNA, 21 bp, Homo sapiens
cttgactcccaagtttccata

SEQ ID NO: 5895211 - DNA, 13 bp, Homo sapiens
cttgactccttgt

SEQ ID NO: 5895212 - DNA, 14 bp, Homo sapiens
cttgactctaaatg

SEQ ID NO: 5895213 - DNA, 13 bp, Homo sapiens
cttgactctaata

SEQ ID NO: 5895214 - DNA, 11 bp, Homo sapiens
cttgactgaag

SEQ ID NO: 5895215 - DNA, 18 bp, Homo sapiens
cttgactgcattgccgct

SEQ ID NO: 5895216 - DNA, 21 bp, Homo sapiens
cttgactgttagttgtccaca

SEQ ID NO: 5895217 - DNA, 17 bp, Homo sapiens
cttgacttcacagcagc

SEQ ID NO: 5895218 - DNA, 15 bp, Homo sapiens
cttgacttctgccca

SEQ ID NO: 5895219 - DNA, 17 bp, Homo sapiens
cttgacttgattagtgc

SEQ ID NO: 5895220 - DNA, 22 bp, Homo sapiens
cttgacttgcaatttctaccta

SEQ ID NO: 5895221 - DNA, 14 bp, Homo sapiens
cttgacttgccatg

SEQ ID NO: 5895222 - DNA, 24 bp, Homo sapiens
cttgacttgccatgaaggcacctg

SEQ ID NO: 5895223 - DNA, 13 bp, Homo sapiens
cttgactttccag

SEQ ID NO: 5895224 - DNA, 14 bp, Homo sapiens
cttgactttccaga

SEQ ID NO: 5895225 - DNA, 21 bp, Homo sapiens
cttgactttccagaatgacct

SEQ ID NO: 5895226 - DNA, 19 bp, Homo sapiens
cttgagaaaatgcaggaga

SEQ ID NO: 5895227 - DNA, 11 bp, Homo sapiens
cttgagaaacc

SEQ ID NO: 5895228 - DNA, 19 bp, Homo sapiens
cttgagaaatactatatat

SEQ ID NO: 5895229 - DNA, 19 bp, Homo sapiens
cttgagaaccagtctcctc

SEQ ID NO: 5895230 - DNA, 13 bp, Homo sapiens
cttgagaaccttt

SEQ ID NO: 5895231 - DNA, 18 bp, Homo sapiens
cttgagaaccttttcaaa

SEQ ID NO: 5895232 - DNA, 13 bp, Homo sapiens
cttgagaagacat

SEQ ID NO: 5895233 - DNA, 17 bp, Homo sapiens
cttgagaagattcttcc

SEQ ID NO: 5895234 - DNA, 20 bp, Homo sapiens
cttgagaataaatgagcatt

SEQ ID NO: 5895235 - DNA, 16 bp, Homo sapiens
cttgagaattccctgt

SEQ ID NO: 5895236 - DNA, 21 bp, Homo sapiens
cttgagacaaatcctttctgc

SEQ ID NO: 5895237 - DNA, 16 bp, Homo sapiens
cttgagacaatgtttt

SEQ ID NO: 5895238 - DNA, 17 bp, Homo sapiens
cttgagacacggagccc

SEQ ID NO: 5895239 - DNA, 22 bp, Homo sapiens
cttgagaccaagccggtgccca

SEQ ID NO: 5895240 - DNA, 23 bp, Homo sapiens
cttgagaccaagccggtgcccac

SEQ ID NO: 5895241 - DNA, 22 bp, Homo sapiens
cttgagaccagcctgccaggcc

SEQ ID NO: 5895242 - DNA, 21 bp, Homo sapiens
cttgagacccccaagcttcca

SEQ ID NO: 5895243 - DNA, 21 bp, Homo sapiens
cttgagaccctcttctctggg

SEQ ID NO: 5895244 - DNA, 14 bp, Homo sapiens
cttgagacctcagc

SEQ ID NO: 5895245 - DNA, 19 bp, Homo sapiens
cttgagacctggaaccaga

SEQ ID NO: 5895246 - DNA, 16 bp, Homo sapiens
cttgagactccccaat

SEQ ID NO: 5895247 - DNA, 21 bp, Homo sapiens
cttgagagaaaagaaaaatat

SEQ ID NO: 5895248 - DNA, 13 bp, Homo sapiens
cttgagagcccca

SEQ ID NO: 5895249 - DNA, 19 bp, Homo sapiens
cttgagagcgctggcctct

SEQ ID NO: 5895250 - DNA, 13 bp, Homo sapiens
cttgagagctcag

SEQ ID NO: 5895251 - DNA, 15 bp, Homo sapiens
cttgagagctcaggc

SEQ ID NO: 5895252 - DNA, 14 bp, Homo sapiens
cttgagagggtgga

SEQ ID NO: 5895253 - DNA, 22 bp, Homo sapiens
cttgagagtatcaggtctccca

SEQ ID NO: 5895254 - DNA, 18 bp, Homo sapiens
cttgagagtgggggagaa

SEQ ID NO: 5895255 - DNA, 19 bp, Homo sapiens
cttgagagttccggggaga

SEQ ID NO: 5895256 - DNA, 20 bp, Homo sapiens
cttgagatctgtataaataa

SEQ ID NO: 5895257 - DNA, 16 bp, Homo sapiens
cttgagatgggaaagc

SEQ ID NO: 5895258 - DNA, 16 bp, Homo sapiens
cttgagatggtgaggc

SEQ ID NO: 5895259 - DNA, 18 bp, Homo sapiens
cttgagatggtgaggctg

SEQ ID NO: 5895260 - DNA, 22 bp, Homo sapiens
cttgagatggtgaggctgtcag

SEQ ID NO: 5895261 - DNA, 14 bp, Homo sapiens
cttgagatgtatta

SEQ ID NO: 5895262 - DNA, 15 bp, Homo sapiens
cttgagatgtgggta

SEQ ID NO: 5895263 - DNA, 14 bp, Homo sapiens
cttgagattcaaga

SEQ ID NO: 5895264 - DNA, 19 bp, Homo sapiens
cttgagattcaagacaaga

SEQ ID NO: 5895265 - DNA, 20 bp, Homo sapiens
cttgagattcaagacaagag

SEQ ID NO: 5895266 - DNA, 19 bp, Homo sapiens
cttgagcaaagaactaagg

SEQ ID NO: 5895267 - DNA, 21 bp, Homo sapiens
cttgagcaaggcaagaagtgg

SEQ ID NO: 5895268 - DNA, 22 bp, Homo sapiens
cttgagcaaggcaagaagtggg

SEQ ID NO: 5895269 - DNA, 19 bp, Homo sapiens
cttgagcaagttccttctg

SEQ ID NO: 5895270 - DNA, 20 bp, Homo sapiens
cttgagcaagttccttctgg

SEQ ID NO: 5895271 - DNA, 21 bp, Homo sapiens
cttgagcaagttccttctggt

SEQ ID NO: 5895272 - DNA, 18 bp, Homo sapiens
cttgagcaataaagtgga

SEQ ID NO: 5895273 - DNA, 13 bp, Homo sapiens
cttgagcaatgtt

SEQ ID NO: 5895274 - DNA, 20 bp, Homo sapiens
cttgagcacaaaatttggtc

SEQ ID NO: 5895275 - DNA, 14 bp, Homo sapiens
cttgagcagctgaa

SEQ ID NO: 5895276 - DNA, 14 bp, Homo sapiens
cttgagcaggatta

SEQ ID NO: 5895277 - DNA, 16 bp, Homo sapiens
cttgagcatcaatctt

SEQ ID NO: 5895278 - DNA, 23 bp, Homo sapiens
cttgagcatcaatcttgttactg

SEQ ID NO: 5895279 - DNA, 12 bp, Homo sapiens
cttgagcatctg

SEQ ID NO: 5895280 - DNA, 16 bp, Homo sapiens
cttgagcatgttactg

SEQ ID NO: 5895281 - DNA, 22 bp, Homo sapiens
cttgagcatgttactgacagag

SEQ ID NO: 5895282 - DNA, 16 bp, Homo sapiens
cttgagcattcaaatg

SEQ ID NO: 5895283 - DNA, 15 bp, Homo sapiens
cttgagccactcctt

SEQ ID NO: 5895284 - DNA, 13 bp, Homo sapiens
cttgagccagtaa

SEQ ID NO: 5895285 - DNA, 18 bp, Homo sapiens
cttgagccagtaatcttt

SEQ ID NO: 5895286 - DNA, 23 bp, Homo sapiens
cttgagccagttacctttgctgt

SEQ ID NO: 5895287 - DNA, 14 bp, Homo sapiens
cttgagccatccaa

SEQ ID NO: 5895288 - DNA, 12 bp, Homo sapiens
cttgagcccaga

SEQ ID NO: 5895289 - DNA, 14 bp, Homo sapiens
cttgagcccaggag

SEQ ID NO: 5895290 - DNA, 15 bp, Homo sapiens
cttgagcccaggagt

SEQ ID NO: 5895291 - DNA, 23 bp, Homo sapiens
cttgagcccaggagttcaagacc

SEQ ID NO: 5895292 - DNA, 20 bp, Homo sapiens
cttgagccgggcccctgggc

SEQ ID NO: 5895293 - DNA, 19 bp, Homo sapiens
cttgagcctcccccaaagc

SEQ ID NO: 5895294 - DNA, 11 bp, Homo sapiens
cttgagcctgt

SEQ ID NO: 5895295 - DNA, 19 bp, Homo sapiens
cttgagcctgtcaagaggc

SEQ ID NO: 5895296 - DNA, 15 bp, Homo sapiens
cttgagccttgaact

SEQ ID NO: 5895297 - DNA, 14 bp, Homo sapiens
cttgagcggagccc

SEQ ID NO: 5895298 - DNA, 12 bp, Homo sapiens
cttgagctcagg

SEQ ID NO: 5895299 - DNA, 19 bp, Homo sapiens
cttgagctcccctggagcc

SEQ ID NO: 5895300 - DNA, 11 bp, Homo sapiens
cttgagctcta

SEQ ID NO: 5895301 - DNA, 12 bp, Homo sapiens
cttgagctctat

SEQ ID NO: 5895302 - DNA, 15 bp, Homo sapiens
cttgagctctattat

SEQ ID NO: 5895303 - DNA, 10 bp, Homo sapiens
cttgagctga

SEQ ID NO: 5895304 - DNA, 21 bp, Homo sapiens
cttgagctgcctgctctgcag

SEQ ID NO: 5895305 - DNA, 23 bp, Homo sapiens
cttgagctggcctctctagcaca

SEQ ID NO: 5895306 - DNA, 15 bp, Homo sapiens
cttgagctggttttc

SEQ ID NO: 5895307 - DNA, 18 bp, Homo sapiens
cttgagctggttttctct

SEQ ID NO: 5895308 - DNA, 14 bp, Homo sapiens
cttgagctgtctga

SEQ ID NO: 5895309 - DNA, 20 bp, Homo sapiens
cttgagctgttgtgagcttt

SEQ ID NO: 5895310 - DNA, 14 bp, Homo sapiens
cttgagcttgacct

SEQ ID NO: 5895311 - DNA, 13 bp, Homo sapiens
cttgagcttggga

SEQ ID NO: 5895312 - DNA, 14 bp, Homo sapiens
cttgagctttctgt

SEQ ID NO: 5895313 - DNA, 16 bp, Homo sapiens
cttgagctttctgtgc

SEQ ID NO: 5895314 - DNA, 17 bp, Homo sapiens
cttgagctttctgtgca

SEQ ID NO: 5895315 - DNA, 18 bp, Homo sapiens
cttgagctttctgtgcat

SEQ ID NO: 5895316 - DNA, 19 bp, Homo sapiens
cttgagctttctgtgcatg

SEQ ID NO: 5895317 - DNA, 20 bp, Homo sapiens
cttgagctttctgtgcatgt

SEQ ID NO: 5895318 - DNA, 18 bp, Homo sapiens
cttgaggaaacaacagct

SEQ ID NO: 5895319 - DNA, 21 bp, Homo sapiens
cttgaggaaacaacagcttta

SEQ ID NO: 5895320 - DNA, 18 bp, Homo sapiens
cttgaggaagcccaggct

SEQ ID NO: 5895321 - DNA, 19 bp, Homo sapiens
cttgaggaagcccaggctc

SEQ ID NO: 5895322 - DNA, 12 bp, Homo sapiens
cttgaggacaca

SEQ ID NO: 5895323 - DNA, 14 bp, Homo sapiens
cttgaggacacatg

SEQ ID NO: 5895324 - DNA, 15 bp, Homo sapiens
cttgaggacctccac

SEQ ID NO: 5895325 - DNA, 13 bp, Homo sapiens
cttgaggagctca

SEQ ID NO: 5895326 - DNA, 20 bp, Homo sapiens
cttgaggagctcaacggtct

SEQ ID NO: 5895327 - DNA, 12 bp, Homo sapiens
cttgattggaag

SEQ ID NO: 5895328 - DNA, 17 bp, Homo sapiens
cttgatttcacatttct

SEQ ID NO: 5895329 - DNA, 13 bp, Homo sapiens
cttgatttcccaa

SEQ ID NO: 5895330 - DNA, 15 bp, Homo sapiens
cttgatttcccaaaa

SEQ ID NO: 5895331 - DNA, 21 bp, Homo sapiens
cttgatttcttctagaagata

SEQ ID NO: 5895332 - DNA, 24 bp, Homo sapiens
cttgatttgagttgattgagaaga

SEQ ID NO: 5895333 - DNA, 22 bp, Homo sapiens
cttgatttgatctttgtttaaa

SEQ ID NO: 5895334 - DNA, 13 bp, Homo sapiens
cttgatttgatgt

SEQ ID NO: 5895335 - DNA, 21 bp, Homo sapiens
cttgatttgggtggaaaacag

SEQ ID NO: 5895336 - DNA, 21 bp, Homo sapiens
cttgatttgttttagaatgat

SEQ ID NO: 5895337 - DNA, 20 bp, Homo sapiens
cttgattttaaaattccttc

SEQ ID NO: 5895338 - DNA, 16 bp, Homo sapiens
cttgattttaattcag

SEQ ID NO: 5895339 - DNA, 19 bp, Homo sapiens
cttgattttagccttctct

SEQ ID NO: 5895340 - DNA, 20 bp, Homo sapiens
cttgattttagccttctctg

SEQ ID NO: 5895341 - DNA, 14 bp, Homo sapiens
cttgattttccatc

SEQ ID NO: 5895342 - DNA, 14 bp, Homo sapiens
cttgattttcttct

SEQ ID NO: 5895343 - DNA, 17 bp, Homo sapiens
cttgatttttacataat

SEQ ID NO: 5895344 - DNA, 18 bp, Homo sapiens
cttgatttttcaaagact

SEQ ID NO: 5895345 - DNA, 18 bp, Homo sapiens
cttgatttttttaaacat

SEQ ID NO: 5895346 - DNA, 15 bp, Homo sapiens
cttgcaaaatcagtt

SEQ ID NO: 5895347 - DNA, 17 bp, Homo sapiens
cttgcaaaatcagtttt

SEQ ID NO: 5895348 - DNA, 23 bp, Homo sapiens
cttgcaaactatgagttcacatg

SEQ ID NO: 5895349 - DNA, 16 bp, Homo sapiens
cttgcaaactctataa

SEQ ID NO: 5895350 - DNA, 22 bp, Homo sapiens
cttgcaaagacctacctccaga

SEQ ID NO: 5895351 - DNA, 15 bp, Homo sapiens
cttgcaaagccttta

SEQ ID NO: 5895352 - DNA, 12 bp, Homo sapiens
cttgcaaagtat

SEQ ID NO: 5895353 - DNA, 15 bp, Homo sapiens
cttgcaacacacaga

SEQ ID NO: 5895354 - DNA, 17 bp, Homo sapiens
cttgcaacacacagaca

SEQ ID NO: 5895355 - DNA, 17 bp, Homo sapiens
cttgcaaccaggcagct

SEQ ID NO: 5895356 - DNA, 16 bp, Homo sapiens
cttgcaactaaggaca

SEQ ID NO: 5895357 - DNA, 19 bp, Homo sapiens
cttgcaactaaggacaaat

SEQ ID NO: 5895358 - DNA, 22 bp, Homo sapiens
cttgcaactaaggacaaattag

SEQ ID NO: 5895359 - DNA, 20 bp, Homo sapiens
cttgcaacttcatgtcaact

SEQ ID NO: 5895360 - DNA, 14 bp, Homo sapiens
cttgcaagaatcag

SEQ ID NO: 5895361 - DNA, 16 bp, Homo sapiens
cttgcaagcagcctcc

SEQ ID NO: 5895362 - DNA, 14 bp, Homo sapiens
cttgcaagccataa

SEQ ID NO: 5895363 - DNA, 21 bp, Homo sapiens
cttgcaagctccagtagctcc

SEQ ID NO: 5895364 - DNA, 22 bp, Homo sapiens
cttgcaagggcggcctttccca

SEQ ID NO: 5895365 - DNA, 21 bp, Homo sapiens
cttgcaataaagttattcaga

SEQ ID NO: 5895366 - DNA, 19 bp, Homo sapiens
cttgcaatataacattcta

SEQ ID NO: 5895367 - DNA, 19 bp, Homo sapiens
cttgcaatccaggctgttc

SEQ ID NO: 5895368 - DNA, 22 bp, Homo sapiens
cttgcaatctaatctgaactga

SEQ ID NO: 5895369 - DNA, 17 bp, Homo sapiens
cttgcaatgagccaaga

SEQ ID NO: 5895370 - DNA, 16 bp, Homo sapiens
cttgcaatttgaaggt

SEQ ID NO: 5895371 - DNA, 17 bp, Homo sapiens
cttgcacaagcttgtat

SEQ ID NO: 5895372 - DNA, 23 bp, Homo sapiens
cttgcacaagcttgtatatacat

SEQ ID NO: 5895373 - DNA, 23 bp, Homo sapiens
cttgcacacatcatctgtaagct

SEQ ID NO: 5895374 - DNA, 19 bp, Homo sapiens
cttgcacactcccctgcac

SEQ ID NO: 5895375 - DNA, 14 bp, Homo sapiens
cttgcacacttccc

SEQ ID NO: 5895376 - DNA, 22 bp, Homo sapiens
cttgcacagccaacgagacaca

SEQ ID NO: 5895377 - DNA, 12 bp, Homo sapiens
cttgcacaggcc

SEQ ID NO: 5895378 - DNA, 13 bp, Homo sapiens
cttgcacaggcca

SEQ ID NO: 5895379 - DNA, 18 bp, Homo sapiens
cttgcacaggccacttgc

SEQ ID NO: 5895380 - DNA, 19 bp, Homo sapiens
cttgcacaggccacttgct

SEQ ID NO: 5895381 - DNA, 20 bp, Homo sapiens
cttgcacagggattctcaca

SEQ ID NO: 5895382 - DNA, 12 bp, Homo sapiens
cttgcacatttg

SEQ ID NO: 5895383 - DNA, 18 bp, Homo sapiens
cttgcaccaaattatctt

SEQ ID NO: 5895384 - DNA, 22 bp, Homo sapiens
cttgcaccccaaagctttcctg

SEQ ID NO: 5895385 - DNA, 14 bp, Homo sapiens
cttgcaccccttcc

SEQ ID NO: 5895386 - DNA, 17 bp, Homo sapiens
cttgcaccccttcctcc

SEQ ID NO: 5895387 - DNA, 15 bp, Homo sapiens
cttgcacccgcctct

SEQ ID NO: 5895388 - DNA, 12 bp, Homo sapiens
cttgcacctgca

SEQ ID NO: 5895389 - DNA, 13 bp, Homo sapiens
cttgcacctgcat

SEQ ID NO: 5895390 - DNA, 22 bp, Homo sapiens
cttgcacgcgccctttctacca

SEQ ID NO: 5895391 - DNA, 21 bp, Homo sapiens
cttgcacggctgctcggcttg

SEQ ID NO: 5895392 - DNA, 16 bp, Homo sapiens
cttgcactcctcacac

SEQ ID NO: 5895393 - DNA, 17 bp, Homo sapiens
cttgcactcctcacaca

SEQ ID NO: 5895394 - DNA, 15 bp, Homo sapiens
cttgcactccttccc

SEQ ID NO: 5895395 - DNA, 16 bp, Homo sapiens
cttgcactccttccct

SEQ ID NO: 5895396 - DNA, 20 bp, Homo sapiens
cttgcactgatgtccctcct

SEQ ID NO: 5895397 - DNA, 17 bp, Homo sapiens
cttgcactgggggaaca

SEQ ID NO: 5895398 - DNA, 14 bp, Homo sapiens
cttgcactgtccag

SEQ ID NO: 5895399 - DNA, 12 bp, Homo sapiens
cttgcactgtgc

SEQ ID NO: 5895400 - DNA, 21 bp, Homo sapiens
cttgcactgtgcttgctccta

SEQ ID NO: 5895401 - DNA, 19 bp, Homo sapiens
cttgcacttctgttatcag

SEQ ID NO: 5895402 - DNA, 17 bp, Homo sapiens
cttgcagaactgccatt

SEQ ID NO: 5895403 - DNA, 12 bp, Homo sapiens
cttgcagaagct

SEQ ID NO: 5895404 - DNA, 15 bp, Homo sapiens
cttgcagagaagcct

SEQ ID NO: 5895405 - DNA, 13 bp, Homo sapiens
cttgcagaggagc

SEQ ID NO: 5895406 - DNA, 14 bp, Homo sapiens
cttgcagaggagcc

SEQ ID NO: 5895407 - DNA, 18 bp, Homo sapiens
cttgcagaggagcccagt

SEQ ID NO: 5895408 - DNA, 20 bp, Homo sapiens
cttgcagaggagcccagtgg

SEQ ID NO: 5895409 - DNA, 22 bp, Homo sapiens
cttgcagaggagcccagtgggc

SEQ ID NO: 5895410 - DNA, 18 bp, Homo sapiens
cttgcagcactcacacag

SEQ ID NO: 5895411 - DNA, 22 bp, Homo sapiens
cttgcagcactcacacaggacc

SEQ ID NO: 5895412 - DNA, 12 bp, Homo sapiens
cttgcagcaggg

SEQ ID NO: 5895413 - DNA, 14 bp, Homo sapiens
cttgcagcagggct

SEQ ID NO: 5895414 - DNA, 15 bp, Homo sapiens
cttgcagcagggctg

SEQ ID NO: 5895415 - DNA, 18 bp, Homo sapiens
cttgcagccacatggccc

SEQ ID NO: 5895416 - DNA, 20 bp, Homo sapiens
cttgcagccacatggcccca

SEQ ID NO: 5895417 - DNA, 15 bp, Homo sapiens
cttgcagcggctcct

SEQ ID NO: 5895418 - DNA, 17 bp, Homo sapiens
cttgcagcggctcctgc

SEQ ID NO: 5895419 - DNA, 18 bp, Homo sapiens
cttgcagcggctcctgca

SEQ ID NO: 5895420 - DNA, 19 bp, Homo sapiens
cttgcagcggctcctgcaa

SEQ ID NO: 5895421 - DNA, 20 bp, Homo sapiens
cttgcagctggcccactgct

SEQ ID NO: 5895422 - DNA, 15 bp, Homo sapiens
cttgcaggaggccaa

SEQ ID NO: 5895423 - DNA, 22 bp, Homo sapiens
cttgcaggaggccaaactgtcc

SEQ ID NO: 5895424 - DNA, 15 bp, Homo sapiens
cttgcaggcaaactt

SEQ ID NO: 5895425 - DNA, 19 bp, Homo sapiens
cttgcaggggtcccccctc

SEQ ID NO: 5895426 - DNA, 16 bp, Homo sapiens
cttgcaggggtccctg

SEQ ID NO: 5895427 - DNA, 19 bp, Homo sapiens
cttgcaggggtccctgcta

SEQ ID NO: 5895428 - DNA, 22 bp, Homo sapiens
cttgcagggtgggtgagctctc

SEQ ID NO: 5895429 - DNA, 20 bp, Homo sapiens
cttgcaggtctcaacccttt

SEQ ID NO: 5895430 - DNA, 20 bp, Homo sapiens
cttgcagtacatcaaaggaa

SEQ ID NO: 5895431 - DNA, 22 bp, Homo sapiens
cttgcagtagattttctttaaa

SEQ ID NO: 5895432 - DNA, 17 bp, Homo sapiens
cttgcagtgaagtgttc

SEQ ID NO: 5895433 - DNA, 17 bp, Homo sapiens
cttgcataagcctcagg

SEQ ID NO: 5895434 - DNA, 18 bp, Homo sapiens
cttgcataagcctcaggc

SEQ ID NO: 5895435 - DNA, 21 bp, Homo sapiens
cttgcataataagctaaagag

SEQ ID NO: 5895436 - DNA, 14 bp, Homo sapiens
cttgcatacaaaca

SEQ ID NO: 5895437 - DNA, 15 bp, Homo sapiens
cttgcatacaaacaa

SEQ ID NO: 5895438 - DNA, 21 bp, Homo sapiens
cttgcataggctcttaagcag

SEQ ID NO: 5895439 - DNA, 13 bp, Homo sapiens
cttgcatattttg

SEQ ID NO: 5895440 - DNA, 13 bp, Homo sapiens
cttgcatcaaggg

SEQ ID NO: 5895441 - DNA, 17 bp, Homo sapiens
cttgcatcaaggggtca

SEQ ID NO: 5895442 - DNA, 18 bp, Homo sapiens
cttgcatccattgttgtg

SEQ ID NO: 5895443 - DNA, 15 bp, Homo sapiens
cttgcatcctatttg

SEQ ID NO: 5895444 - DNA, 17 bp, Homo sapiens
cttgcatccttcctata

SEQ ID NO: 5895445 - DNA, 17 bp, Homo sapiens
cttgcatcgtggagaca

SEQ ID NO: 5895446 - DNA, 20 bp, Homo sapiens
cttgcatcgtggagacaggg

SEQ ID NO: 5895447 - DNA, 13 bp, Homo sapiens
cttgcatctaatg

SEQ ID NO: 5895448 - DNA, 15 bp, Homo sapiens
cttgcatctaatgaa

SEQ ID NO: 5895449 - DNA, 16 bp, Homo sapiens
cttgcatctaatgaaa

SEQ ID NO: 5895450 - DNA, 18 bp, Homo sapiens
cttgcatctaatgaaaaa

SEQ ID NO: 5895451 - DNA, 19 bp, Homo sapiens
cttgcatctacctgctcct

SEQ ID NO: 5895452 - DNA, 20 bp, Homo sapiens
cttgcatgaagagaagcaat

SEQ ID NO: 5895453 - DNA, 21 bp, Homo sapiens
cttgcatgaggctagtgtggt

SEQ ID NO: 5895454 - DNA, 13 bp, Homo sapiens
cttgcatgcttgc

SEQ ID NO: 5895455 - DNA, 13 bp, Homo sapiens
cttgcatggagaa

SEQ ID NO: 5895456 - DNA, 15 bp, Homo sapiens
cttgcatgtacttga

SEQ ID NO: 5895457 - DNA, 16 bp, Homo sapiens
cttgcatgtacttgaa

SEQ ID NO: 5895458 - DNA, 18 bp, Homo sapiens
cttgcattaaaggagatc

SEQ ID NO: 5895459 - DNA, 11 bp, Homo sapiens
cttgcattaga

SEQ ID NO: 5895460 - DNA, 16 bp, Homo sapiens
cttgcattcccagtgg

SEQ ID NO: 5895461 - DNA, 11 bp, Homo sapiens
cttgcattgac

SEQ ID NO: 5895462 - DNA, 22 bp, Homo sapiens
cttgcatttctgactttatcct

SEQ ID NO: 5895463 - DNA, 13 bp, Homo sapiens
cttgcatttttgc

SEQ ID NO: 5895464 - DNA, 12 bp, Homo sapiens
cttgcatttttt

SEQ ID NO: 5895465 - DNA, 15 bp, Homo sapiens
cttgccaaaatgttg

SEQ ID NO: 5895466 - DNA, 21 bp, Homo sapiens
cttgccaaaatgttggctgcg

SEQ ID NO: 5895467 - DNA, 13 bp, Homo sapiens
cttgccaaagcag

SEQ ID NO: 5895468 - DNA, 15 bp, Homo sapiens
cttgccaaagcagat

SEQ ID NO: 5895469 - DNA, 18 bp, Homo sapiens
cttgccaagctttcttct

SEQ ID NO: 5895470 - DNA, 14 bp, Homo sapiens
cttgccaaggcaga

SEQ ID NO: 5895471 - DNA, 17 bp, Homo sapiens
cttgccaaggcagaggc

SEQ ID NO: 5895472 - DNA, 19 bp, Homo sapiens
cttgccaaggcagaggcct

SEQ ID NO: 5895473 - DNA, 20 bp, Homo sapiens
cttgccaaggcagaggcctg

SEQ ID NO: 5895474 - DNA, 12 bp, Homo sapiens
cttgccaaggcc

SEQ ID NO: 5895475 - DNA, 18 bp, Homo sapiens
cttgccaaggccgcccac

SEQ ID NO: 5895476 - DNA, 19 bp, Homo sapiens
cttgccaagggtccctgtg

SEQ ID NO: 5895477 - DNA, 15 bp, Homo sapiens
cttgccacaatcact

SEQ ID NO: 5895478 - DNA, 20 bp, Homo sapiens
cttgccacaatcactaaata

SEQ ID NO: 5895479 - DNA, 23 bp, Homo sapiens
cttgccacaccccccacccctag

SEQ ID NO: 5895480 - DNA, 12 bp, Homo sapiens
cttgccacactc

SEQ ID NO: 5895481 - DNA, 14 bp, Homo sapiens
cttgccacagctct

SEQ ID NO: 5895482 - DNA, 19 bp, Homo sapiens
cttgccacatcttgaaaat

SEQ ID NO: 5895483 - DNA, 22 bp, Homo sapiens
cttgccacatggtgtctcccaa

SEQ ID NO: 5895484 - DNA, 14 bp, Homo sapiens
cttgccacatttct

SEQ ID NO: 5895485 - DNA, 16 bp, Homo sapiens
cttgccacatttctga

SEQ ID NO: 5895486 - DNA, 18 bp, Homo sapiens
cttgccaccccaccctcc

SEQ ID NO: 5895487 - DNA, 17 bp, Homo sapiens
cttgccaccctctggga

SEQ ID NO: 5895488 - DNA, 19 bp, Homo sapiens
cttgccaccctctgggagt

SEQ ID NO: 5895489 - DNA, 18 bp, Homo sapiens
cttgccacggtttatcct

SEQ ID NO: 5895490 - DNA, 15 bp, Homo sapiens
cttgccactgcactc

SEQ ID NO: 5895491 - DNA, 20 bp, Homo sapiens
cttgccagaagttgtggatt

SEQ ID NO: 5895492 - DNA, 16 bp, Homo sapiens
cttgccagacatgtgg

SEQ ID NO: 5895493 - DNA, 11 bp, Homo sapiens
cttgccagaga

SEQ ID NO: 5895494 - DNA, 14 bp, Homo sapiens
cttgccagatgctg

SEQ ID NO: 5895495 - DNA, 18 bp, Homo sapiens
cttgccagcctccttgct

SEQ ID NO: 5895496 - DNA, 20 bp, Homo sapiens
cttgccagcctccttgctga

SEQ ID NO: 5895497 - DNA, 16 bp, Homo sapiens
cttgccagctgctgag

SEQ ID NO: 5895498 - DNA, 13 bp, Homo sapiens
cttgccagggctc

SEQ ID NO: 5895499 - DNA, 17 bp, Homo sapiens
cttgccagggctctggg

SEQ ID NO: 5895500 - DNA, 19 bp, Homo sapiens
cttgccagggctctggggg

SEQ ID NO: 5895501 - DNA, 23 bp, Homo sapiens
cttgccagggctctgggggcaga

SEQ ID NO: 5895502 - DNA, 13 bp, Homo sapiens
cttgccagttttc

SEQ ID NO: 5895503 - DNA, 14 bp, Homo sapiens
cttgccatcactgg

SEQ ID NO: 5895504 - DNA, 17 bp, Homo sapiens
cttgccatccctccctc

SEQ ID NO: 5895505 - DNA, 16 bp, Homo sapiens
cttgccatcctgatgg

SEQ ID NO: 5895506 - DNA, 13 bp, Homo sapiens
cttgcttatgtgt

SEQ ID NO: 5895507 - DNA, 15 bp, Homo sapiens
cttgcttatttgaca

SEQ ID NO: 5895508 - DNA, 12 bp, Homo sapiens
cttgcttcagtg

SEQ ID NO: 5895509 - DNA, 13 bp, Homo sapiens
cttgcttcagtgg

SEQ ID NO: 5895510 - DNA, 13 bp, Homo sapiens
cttgcttcattgt

SEQ ID NO: 5895511 - DNA, 16 bp, Homo sapiens
cttgcttccaagacca

SEQ ID NO: 5895512 - DNA, 14 bp, Homo sapiens
cttgcttccttctc

SEQ ID NO: 5895513 - DNA, 19 bp, Homo sapiens
cttgcttctaaatgcccag

SEQ ID NO: 5895514 - DNA, 14 bp, Homo sapiens
cttgcttctcaact

SEQ ID NO: 5895515 - DNA, 12 bp, Homo sapiens
cttgcttctccc

SEQ ID NO: 5895516 - DNA, 15 bp, Homo sapiens
cttgcttctcccatt

SEQ ID NO: 5895517 - DNA, 18 bp, Homo sapiens
cttgcttctcccatttcc

SEQ ID NO: 5895518 - DNA, 19 bp, Homo sapiens
cttgcttctctagctctct

SEQ ID NO: 5895519 - DNA, 21 bp, Homo sapiens
cttgcttctcttctttccatt

SEQ ID NO: 5895520 - DNA, 23 bp, Homo sapiens
cttgcttctgcagcaactcccac

SEQ ID NO: 5895521 - DNA, 22 bp, Homo sapiens
cttgcttctggctttgttcttg

SEQ ID NO: 5895522 - DNA, 18 bp, Homo sapiens
cttgcttctgtatttcct

SEQ ID NO: 5895523 - DNA, 17 bp, Homo sapiens
cttgcttcttgtgtttg

SEQ ID NO: 5895524 - DNA, 19 bp, Homo sapiens
cttgcttcttgtgtttgaa

SEQ ID NO: 5895525 - DNA, 20 bp, Homo sapiens
cttgcttcttgtgtttgaaa

SEQ ID NO: 5895526 - DNA, 18 bp, Homo sapiens
cttgcttctttctagaaa

SEQ ID NO: 5895527 - DNA, 12 bp, Homo sapiens
cttgcttgcctg

SEQ ID NO: 5895528 - DNA, 17 bp, Homo sapiens
cttgcttgcctgcaggg

SEQ ID NO: 5895529 - DNA, 13 bp, Homo sapiens
cttgcttgctttt

SEQ ID NO: 5895530 - DNA, 14 bp, Homo sapiens
cttgcttggctgct

SEQ ID NO: 5895531 - DNA, 14 bp, Homo sapiens
cttgcttgtgaatc

SEQ ID NO: 5895532 - DNA, 13 bp, Homo sapiens
cttgcttgttaca

SEQ ID NO: 5895533 - DNA, 17 bp, Homo sapiens
cttgctttaccttttca

SEQ ID NO: 5895534 - DNA, 17 bp, Homo sapiens
cttgctttagaaaacat

SEQ ID NO: 5895535 - DNA, 17 bp, Homo sapiens
cttgctttatttttcat

SEQ ID NO: 5895536 - DNA, 15 bp, Homo sapiens
cttgctttcaattga

SEQ ID NO: 5895537 - DNA, 19 bp, Homo sapiens
cttgctttcaattgacaaa

SEQ ID NO: 5895538 - DNA, 16 bp, Homo sapiens
cttgctttcacaaata

SEQ ID NO: 5895539 - DNA, 14 bp, Homo sapiens
cttgctttcctgca

SEQ ID NO: 5895540 - DNA, 16 bp, Homo sapiens
cttgctttcctgggcc

SEQ ID NO: 5895541 - DNA, 18 bp, Homo sapiens
cttgctttcctgggcctt

SEQ ID NO: 5895542 - DNA, 15 bp, Homo sapiens
cttgctttcggagct

SEQ ID NO: 5895543 - DNA, 11 bp, Homo sapiens
cttgctttcta

SEQ ID NO: 5895544 - DNA, 17 bp, Homo sapiens
cttgctttctttagaat

SEQ ID NO: 5895545 - DNA, 21 bp, Homo sapiens
cttgctttctttgtttggctg

SEQ ID NO: 5895546 - DNA, 20 bp, Homo sapiens
cttgctttgagactcctcag

SEQ ID NO: 5895547 - DNA, 13 bp, Homo sapiens
cttgctttgattt

SEQ ID NO: 5895548 - DNA, 14 bp, Homo sapiens
cttgctttgattta

SEQ ID NO: 5895549 - DNA, 21 bp, Homo sapiens
cttgctttgatttacagcaag

SEQ ID NO: 5895550 - DNA, 19 bp, Homo sapiens
cttgctttgtctggcctca

SEQ ID NO: 5895551 - DNA, 19 bp, Homo sapiens
cttgctttgtgttctttgt

SEQ ID NO: 5895552 - DNA, 15 bp, Homo sapiens
cttgcttttccctct

SEQ ID NO: 5895553 - DNA, 18 bp, Homo sapiens
cttgcttttccctctttt

SEQ ID NO: 5895554 - DNA, 22 bp, Homo sapiens
cttgcttttccctcttttctta

SEQ ID NO: 5895555 - DNA, 12 bp, Homo sapiens
cttgctttttgc

SEQ ID NO: 5895556 - DNA, 17 bp, Homo sapiens
cttgctttttgctgtgt

SEQ ID NO: 5895557 - DNA, 20 bp, Homo sapiens
cttgcttttttgaaagatgc

SEQ ID NO: 5895558 - DNA, 22 bp, Homo sapiens
cttgcttttttgaaagatgctt

SEQ ID NO: 5895559 - DNA, 14 bp, Homo sapiens
cttggaaaaaaatt

SEQ ID NO: 5895560 - DNA, 16 bp, Homo sapiens
cttggaaaaaaattac

SEQ ID NO: 5895561 - DNA, 12 bp, Homo sapiens
cttggaaaaaca

SEQ ID NO: 5895562 - DNA, 18 bp, Homo sapiens
cttggaaaaagaaagaaa

SEQ ID NO: 5895563 - DNA, 12 bp, Homo sapiens
cttggaaaatgt

SEQ ID NO: 5895564 - DNA, 19 bp, Homo sapiens
cttggaaacagttggcact

SEQ ID NO: 5895565 - DNA, 22 bp, Homo sapiens
cttggaaacatttttgagatat

SEQ ID NO: 5895566 - DNA, 15 bp, Homo sapiens
cttggaaacctgccc

SEQ ID NO: 5895567 - DNA, 23 bp, Homo sapiens
cttggaaacctgccctgcctgag

SEQ ID NO: 5895568 - DNA, 21 bp, Homo sapiens
cttggaaactggatgaggtca

SEQ ID NO: 5895569 - DNA, 21 bp, Homo sapiens
cttggaaagcatcacctcagg

SEQ ID NO: 5895570 - DNA, 15 bp, Homo sapiens
cttggaaaggaccag

SEQ ID NO: 5895571 - DNA, 18 bp, Homo sapiens
cttggaaagttcagccag

SEQ ID NO: 5895572 - DNA, 14 bp, Homo sapiens
cttggaaataaacc

SEQ ID NO: 5895573 - DNA, 23 bp, Homo sapiens
cttggaaatagaaagaagccata

SEQ ID NO: 5895574 - DNA, 15 bp, Homo sapiens
cttggaaatattaaa

SEQ ID NO: 5895575 - DNA, 19 bp, Homo sapiens
cttggaaatattaaaagaa

SEQ ID NO: 5895576 - DNA, 15 bp, Homo sapiens
cttggaaatcaggta

SEQ ID NO: 5895577 - DNA, 23 bp, Homo sapiens
cttggaaatggcatgcaaaagca

SEQ ID NO: 5895578 - DNA, 24 bp, Homo sapiens
cttggaaatgtctgctggtatttc

SEQ ID NO: 5895579 - DNA, 20 bp, Homo sapiens
cttggaaattcctgtactgt

SEQ ID NO: 5895580 - DNA, 21 bp, Homo sapiens
cttggaaattccttgccccac

SEQ ID NO: 5895581 - DNA, 16 bp, Homo sapiens
cttggaacaccctgga

SEQ ID NO: 5895582 - DNA, 11 bp, Homo sapiens
cttggaactgc

SEQ ID NO: 5895583 - DNA, 23 bp, Homo sapiens
cttggaacttgcctgcctttcca

SEQ ID NO: 5895584 - DNA, 21 bp, Homo sapiens
cttggaagaaggaaacggaag

SEQ ID NO: 5895585 - DNA, 14 bp, Homo sapiens
cttggaagagctct

SEQ ID NO: 5895586 - DNA, 12 bp, Homo sapiens
cttggaagccag

SEQ ID NO: 5895587 - DNA, 14 bp, Homo sapiens
cttggaagctccgc

SEQ ID NO: 5895588 - DNA, 20 bp, Homo sapiens
cttggaagctccgctttcta

SEQ ID NO: 5895589 - DNA, 15 bp, Homo sapiens
cttggaagctgtttg

SEQ ID NO: 5895590 - DNA, 16 bp, Homo sapiens
cttggaagctgtttgg

SEQ ID NO: 5895591 - DNA, 19 bp, Homo sapiens
cttggaagctgtttggaaa

SEQ ID NO: 5895592 - DNA, 22 bp, Homo sapiens
cttggaagggcgttctaggtag

SEQ ID NO: 5895593 - DNA, 22 bp, Homo sapiens
cttggaagggggctcttttact

SEQ ID NO: 5895594 - DNA, 15 bp, Homo sapiens
cttggaagtctgtct

SEQ ID NO: 5895595 - DNA, 19 bp, Homo sapiens
cttggaagtctgtctcagg

SEQ ID NO: 5895596 - DNA, 22 bp, Homo sapiens
cttggaagtgtgtggaaggcag

SEQ ID NO: 5895597 - DNA, 18 bp, Homo sapiens
cttggaagtgtttcaaaa

SEQ ID NO: 5895598 - DNA, 23 bp, Homo sapiens
cttggaatagcttgtacacatat

SEQ ID NO: 5895599 - DNA, 18 bp, Homo sapiens
cttggaattacaagccct

SEQ ID NO: 5895600 - DNA, 18 bp, Homo sapiens
cttggaattactgaaagt

SEQ ID NO: 5895601 - DNA, 19 bp, Homo sapiens
cttggaattagatgtttat

SEQ ID NO: 5895602 - DNA, 17 bp, Homo sapiens
cttggaattccatttga

SEQ ID NO: 5895603 - DNA, 18 bp, Homo sapiens
cttggaattttgtaaaaa

SEQ ID NO: 5895604 - DNA, 21 bp, Homo sapiens
cttggacaacagctctcgttc

SEQ ID NO: 5895605 - DNA, 22 bp, Homo sapiens
cttggacaagacaaaccaagtc

SEQ ID NO: 5895606 - DNA, 19 bp, Homo sapiens
cttggacaggagtcagtgt

SEQ ID NO: 5895607 - DNA, 21 bp, Homo sapiens
cttggacaggagtcagtgtct

SEQ ID NO: 5895608 - DNA, 15 bp, Homo sapiens
cttggacagtctgag

SEQ ID NO: 5895609 - DNA, 21 bp, Homo sapiens
cttggacatcagtgtttgttg

SEQ ID NO: 5895610 - DNA, 15 bp, Homo sapiens
cttggacatcctcct

SEQ ID NO: 5895611 - DNA, 22 bp, Homo sapiens
cttggacatcctcctcccaccc

SEQ ID NO: 5895612 - DNA, 18 bp, Homo sapiens
cttggacatctctctggc

SEQ ID NO: 5895613 - DNA, 19 bp, Homo sapiens
cttggacatctctctggct

SEQ ID NO: 5895614 - DNA, 12 bp, Homo sapiens
cttggacattta

SEQ ID NO: 5895615 - DNA, 15 bp, Homo sapiens
cttggacatttatgt

SEQ ID NO: 5895616 - DNA, 16 bp, Homo sapiens
cttggacattttatgt

SEQ ID NO: 5895617 - DNA, 18 bp, Homo sapiens
cttggacattttatgtct

SEQ ID NO: 5895618 - DNA, 19 bp, Homo sapiens
cttggacattttatgtctt

SEQ ID NO: 5895619 - DNA, 20 bp, Homo sapiens
cttggacattttatgtcttt

SEQ ID NO: 5895620 - DNA, 18 bp, Homo sapiens
cttggaccactcctgtcc

SEQ ID NO: 5895621 - DNA, 23 bp, Homo sapiens
cttggaccactcctgtccctgta

SEQ ID NO: 5895622 - DNA, 18 bp, Homo sapiens
cttggaccagtttgcaga

SEQ ID NO: 5895623 - DNA, 20 bp, Homo sapiens
cttggaccagtttgcagagt

SEQ ID NO: 5895624 - DNA, 18 bp, Homo sapiens
cttggaccatgccagatt

SEQ ID NO: 5895625 - DNA, 19 bp, Homo sapiens
cttggaccatgccagattc

SEQ ID NO: 5895626 - DNA, 21 bp, Homo sapiens
cttggacccacctgaaatgca

SEQ ID NO: 5895627 - DNA, 22 bp, Homo sapiens
cttggacccacctgtggggcct

SEQ ID NO: 5895628 - DNA, 16 bp, Homo sapiens
cttggacccttggaaa

SEQ ID NO: 5895629 - DNA, 13 bp, Homo sapiens
cttggacctccag

SEQ ID NO: 5895630 - DNA, 22 bp, Homo sapiens
cttggacctccaggggctcctg

SEQ ID NO: 5895631 - DNA, 16 bp, Homo sapiens
cttggacctctccacg

SEQ ID NO: 5895632 - DNA, 12 bp, Homo sapiens
cttggacctctg

SEQ ID NO: 5895633 - DNA, 19 bp, Homo sapiens
cttggacggggacacggcc

SEQ ID NO: 5895634 - DNA, 13 bp, Homo sapiens
cttggactacaca

SEQ ID NO: 5895635 - DNA, 18 bp, Homo sapiens
cttggactacacaataca

SEQ ID NO: 5895636 - DNA, 21 bp, Homo sapiens
cttggactacacaatacagta

SEQ ID NO: 5895637 - DNA, 19 bp, Homo sapiens
cttggactacctataaatg

SEQ ID NO: 5895638 - DNA, 22 bp, Homo sapiens
cttggactattataatttaatg

SEQ ID NO: 5895639 - DNA, 13 bp, Homo sapiens
cttggactcctcc

SEQ ID NO: 5895640 - DNA, 15 bp, Homo sapiens
cttggactcttgctc

SEQ ID NO: 5895641 - DNA, 20 bp, Homo sapiens
cttggactgttttgaaaagt

SEQ ID NO: 5895642 - DNA, 13 bp, Homo sapiens
cttggacttcctg

SEQ ID NO: 5895643 - DNA, 16 bp, Homo sapiens
cttggacttcctgggg

SEQ ID NO: 5895644 - DNA, 19 bp, Homo sapiens
cttggacttctaaaggcgg

SEQ ID NO: 5895645 - DNA, 14 bp, Homo sapiens
cttggagaaaataa

SEQ ID NO: 5895646 - DNA, 16 bp, Homo sapiens
cttggagaactcggtt

SEQ ID NO: 5895647 - DNA, 17 bp, Homo sapiens
cttggagaagtctcagc

SEQ ID NO: 5895648 - DNA, 18 bp, Homo sapiens
cttggagaatactgccaa

SEQ ID NO: 5895649 - DNA, 14 bp, Homo sapiens
cttggagaccttac

SEQ ID NO: 5895650 - DNA, 16 bp, Homo sapiens
cttggagaccttaccc

SEQ ID NO: 5895651 - DNA, 14 bp, Homo sapiens
cttggagactcctg

SEQ ID NO: 5895652 - DNA, 16 bp, Homo sapiens
cttggagactcctggt

SEQ ID NO: 5895653 - DNA, 16 bp, Homo sapiens
cttggagagcaaaggc

SEQ ID NO: 5895654 - DNA, 13 bp, Homo sapiens
cttggagagcagc

SEQ ID NO: 5895655 - DNA, 20 bp, Homo sapiens
cttggagagcagctggctct

SEQ ID NO: 5895656 - DNA, 22 bp, Homo sapiens
cttggagagcagctggctctcc

SEQ ID NO: 5895657 - DNA, 13 bp, Homo sapiens
cttggagaggagg

SEQ ID NO: 5895658 - DNA, 22 bp, Homo sapiens
cttggagagggacgaagaaagg

SEQ ID NO: 5895659 - DNA, 19 bp, Homo sapiens
cttggagagggggccggac

SEQ ID NO: 5895660 - DNA, 22 bp, Homo sapiens
cttggagagtcttgggcctggc

SEQ ID NO: 5895661 - DNA, 23 bp, Homo sapiens
cttggagagtcttgggcctggcc

SEQ ID NO: 5895662 - DNA, 18 bp, Homo sapiens
cttggagcaccgaggcca

SEQ ID NO: 5895663 - DNA, 13 bp, Homo sapiens
cttggagcaggca

SEQ ID NO: 5895664 - DNA, 11 bp, Homo sapiens
cttggagcatt

SEQ ID NO: 5895665 - DNA, 12 bp, Homo sapiens
cttggagcattt

SEQ ID NO: 5895666 - DNA, 22 bp, Homo sapiens
cttggagccaatggagactgtc

SEQ ID NO: 5895667 - DNA, 14 bp, Homo sapiens
cttggagccggact

SEQ ID NO: 5895668 - DNA, 16 bp, Homo sapiens
cttggagcctgaacat

SEQ ID NO: 5895669 - DNA, 16 bp, Homo sapiens
cttggagccttccacc

SEQ ID NO: 5895670 - DNA, 19 bp, Homo sapiens
cttggagctattttccagg

SEQ ID NO: 5895671 - DNA, 20 bp, Homo sapiens
cttggagctattttccaggc

SEQ ID NO: 5895672 - DNA, 17 bp, Homo sapiens
cttggagctgagcaaat

SEQ ID NO: 5895673 - DNA, 15 bp, Homo sapiens
cttggagctgagcct

SEQ ID NO: 5895674 - DNA, 13 bp, Homo sapiens
cttggagctgtcc

SEQ ID NO: 5895675 - DNA, 23 bp, Homo sapiens
cttggagctgtgagttctccctg

SEQ ID NO: 5895676 - DNA, 18 bp, Homo sapiens
cttggagctttggaatat

SEQ ID NO: 5895677 - DNA, 19 bp, Homo sapiens
cttggagctttttcaaaag

SEQ ID NO: 5895678 - DNA, 17 bp, Homo sapiens
cttggaggaaacttaag

SEQ ID NO: 5895679 - DNA, 13 bp, Homo sapiens
cttggaggaagga

SEQ ID NO: 5895680 - DNA, 14 bp, Homo sapiens
cttggaggacagtg

SEQ ID NO: 5895681 - DNA, 16 bp, Homo sapiens
cttggaggacagtggg

SEQ ID NO: 5895682 - DNA, 21 bp, Homo sapiens
cttggaggacctggcgtgctc

SEQ ID NO: 5895683 - DNA, 19 bp, Homo sapiens
cttggaggagagagacccc

SEQ ID NO: 5895684 - DNA, 21 bp, Homo sapiens
cttggctgcctgtgggcttcc

SEQ ID NO: 5895685 - DNA, 12 bp, Homo sapiens
cttggctgctca

SEQ ID NO: 5895686 - DNA, 13 bp, Homo sapiens
cttggctggaatt

SEQ ID NO: 5895687 - DNA, 16 bp, Homo sapiens
cttggctggacccagc

SEQ ID NO: 5895688 - DNA, 18 bp, Homo sapiens
cttggctggactgtagaa

SEQ ID NO: 5895689 - DNA, 11 bp, Homo sapiens
cttggctgggc

SEQ ID NO: 5895690 - DNA, 20 bp, Homo sapiens
cttggctggtgtggtacaga

SEQ ID NO: 5895691 - DNA, 22 bp, Homo sapiens
cttggctggtgtggtacagaga

SEQ ID NO: 5895692 - DNA, 23 bp, Homo sapiens
cttggctggtgtggtacagagaa

SEQ ID NO: 5895693 - DNA, 13 bp, Homo sapiens
cttggctgtcccc

SEQ ID NO: 5895694 - DNA, 14 bp, Homo sapiens
cttggctgtcccct

SEQ ID NO: 5895695 - DNA, 12 bp, Homo sapiens
cttggctgtctg

SEQ ID NO: 5895696 - DNA, 14 bp, Homo sapiens
cttggctgtctgac

SEQ ID NO: 5895697 - DNA, 13 bp, Homo sapiens
cttggctgtgagg

SEQ ID NO: 5895698 - DNA, 14 bp, Homo sapiens
cttggcttaatcat

SEQ ID NO: 5895699 - DNA, 19 bp, Homo sapiens
cttggcttaatcattttca

SEQ ID NO: 5895700 - DNA, 19 bp, Homo sapiens
cttggcttacctgacctct

SEQ ID NO: 5895701 - DNA, 21 bp, Homo sapiens
cttggcttccagaaggcagca

SEQ ID NO: 5895702 - DNA, 15 bp, Homo sapiens
cttggcttcccctcc

SEQ ID NO: 5895703 - DNA, 23 bp, Homo sapiens
cttggcttcctccgtccacccag

SEQ ID NO: 5895704 - DNA, 13 bp, Homo sapiens
cttggcttcctgg

SEQ ID NO: 5895705 - DNA, 18 bp, Homo sapiens
cttggcttctcagcccct

SEQ ID NO: 5895706 - DNA, 16 bp, Homo sapiens
cttggcttctcatacg

SEQ ID NO: 5895707 - DNA, 23 bp, Homo sapiens
cttggcttctcatacgtccacca

SEQ ID NO: 5895708 - DNA, 17 bp, Homo sapiens
cttggcttctgtgatga

SEQ ID NO: 5895709 - DNA, 14 bp, Homo sapiens
cttggcttgcccac

SEQ ID NO: 5895710 - DNA, 20 bp, Homo sapiens
cttggctttatgcaaataca

SEQ ID NO: 5895711 - DNA, 17 bp, Homo sapiens
cttggctttcagagttt

SEQ ID NO: 5895712 - DNA, 22 bp, Homo sapiens
cttggctttcattattagtact

SEQ ID NO: 5895713 - DNA, 14 bp, Homo sapiens
cttggctttgttga

SEQ ID NO: 5895714 - DNA, 16 bp, Homo sapiens
cttggcttttctagcc

SEQ ID NO: 5895715 - DNA, 20 bp, Homo sapiens
cttggcttttgcttggcaga

SEQ ID NO: 5895716 - DNA, 12 bp, Homo sapiens
cttgggaaatat

SEQ ID NO: 5895717 - DNA, 20 bp, Homo sapiens
cttgggaagactcctagctg

SEQ ID NO: 5895718 - DNA, 18 bp, Homo sapiens
cttgggaagtcgaggctg

SEQ ID NO: 5895719 - DNA, 20 bp, Homo sapiens
cttgggaatcattctggctt

SEQ ID NO: 5895720 - DNA, 10 bp, Homo sapiens
cttgggaatg

SEQ ID NO: 5895721 - DNA, 18 bp, Homo sapiens
cttgggaatggatcctgg

SEQ ID NO: 5895722 - DNA, 15 bp, Homo sapiens
cttgggacagccaga

SEQ ID NO: 5895723 - DNA, 19 bp, Homo sapiens
cttgggacatggcacaggc

SEQ ID NO: 5895724 - DNA, 20 bp, Homo sapiens
cttgggaccaaaactgccta

SEQ ID NO: 5895725 - DNA, 18 bp, Homo sapiens
cttgggaccaaaggggga

SEQ ID NO: 5895726 - DNA, 18 bp, Homo sapiens
cttgggaccccagagaaa

SEQ ID NO: 5895727 - DNA, 22 bp, Homo sapiens
cttgggacgtgtacagcacaga

SEQ ID NO: 5895728 - DNA, 19 bp, Homo sapiens
cttgggactagatcacaac

SEQ ID NO: 5895729 - DNA, 16 bp, Homo sapiens
cttgggactcaggtct

SEQ ID NO: 5895730 - DNA, 22 bp, Homo sapiens
cttgggactcaggtctgtaact

SEQ ID NO: 5895731 - DNA, 15 bp, Homo sapiens
cttgggactgctgtg

SEQ ID NO: 5895732 - DNA, 22 bp, Homo sapiens
cttgggagaactaagtaagaaa

SEQ ID NO: 5895733 - DNA, 10 bp, Homo sapiens
cttgggagcc

SEQ ID NO: 5895734 - DNA, 16 bp, Homo sapiens
cttgggagccactgcc

SEQ ID NO: 5895735 - DNA, 22 bp, Homo sapiens
cttgggagccactgccactcca

SEQ ID NO: 5895736 - DNA, 20 bp, Homo sapiens
cttgggagcctgtggccagc

SEQ ID NO: 5895737 - DNA, 19 bp, Homo sapiens
cttgggagctcatccctct

SEQ ID NO: 5895738 - DNA, 21 bp, Homo sapiens
cttgggagctcatccctctca

SEQ ID NO: 5895739 - DNA, 18 bp, Homo sapiens
cttgggagctgctgggct

SEQ ID NO: 5895740 - DNA, 17 bp, Homo sapiens
cttgggaggaagcagaa

SEQ ID NO: 5895741 - DNA, 19 bp, Homo sapiens
cttgggaggaagcagaata

SEQ ID NO: 5895742 - DNA, 20 bp, Homo sapiens
cttgggaggaagcagaataa

SEQ ID NO: 5895743 - DNA, 19 bp, Homo sapiens
cttgggaggccccactggg

SEQ ID NO: 5895744 - DNA, 14 bp, Homo sapiens
cttgggaggctgag

SEQ ID NO: 5895745 - DNA, 17 bp, Homo sapiens
cttgggaggctgaggca

SEQ ID NO: 5895746 - DNA, 18 bp, Homo sapiens
cttgggaggggccggagg

SEQ ID NO: 5895747 - DNA, 16 bp, Homo sapiens
cttgggagtcttgggt

SEQ ID NO: 5895748 - DNA, 14 bp, Homo sapiens
cttgggagttttga

SEQ ID NO: 5895749 - DNA, 19 bp, Homo sapiens
cttgggatgggcacaggct

SEQ ID NO: 5895750 - DNA, 22 bp, Homo sapiens
cttgggatggggagtcccaaag

SEQ ID NO: 5895751 - DNA, 23 bp, Homo sapiens
cttgggatggggagtcccaaagc

SEQ ID NO: 5895752 - DNA, 13 bp, Homo sapiens
cttgggattctga

SEQ ID NO: 5895753 - DNA, 18 bp, Homo sapiens
cttgggcaactgcagtga

SEQ ID NO: 5895754 - DNA, 13 bp, Homo sapiens
cttgggcaatatt

SEQ ID NO: 5895755 - DNA, 20 bp, Homo sapiens
cttgggcaatattctctgta

SEQ ID NO: 5895756 - DNA, 23 bp, Homo sapiens
cttgggcaccagcttctttctcg

SEQ ID NO: 5895757 - DNA, 13 bp, Homo sapiens
cttgggcaccccc

SEQ ID NO: 5895758 - DNA, 18 bp, Homo sapiens
cttgggcacccccagcct

SEQ ID NO: 5895759 - DNA, 17 bp, Homo sapiens
cttgggcacgggagagc

SEQ ID NO: 5895760 - DNA, 23 bp, Homo sapiens
cttgggcacgggagagcgccacc

SEQ ID NO: 5895761 - DNA, 22 bp, Homo sapiens
cttgggcactttttaattcacc

SEQ ID NO: 5895762 - DNA, 14 bp, Homo sapiens
cttgggcagagctg

SEQ ID NO: 5895763 - DNA, 15 bp, Homo sapiens
cttgggcagagctgg

SEQ ID NO: 5895764 - DNA, 18 bp, Homo sapiens
cttgggcagagctggctc

SEQ ID NO: 5895765 - DNA, 12 bp, Homo sapiens
cttgggcagagt

SEQ ID NO: 5895766 - DNA, 13 bp, Homo sapiens
cttgggcaggcag

SEQ ID NO: 5895767 - DNA, 14 bp, Homo sapiens
cttgggcaggcaga

SEQ ID NO: 5895768 - DNA, 19 bp, Homo sapiens
cttgggcagggtctctgct

SEQ ID NO: 5895769 - DNA, 20 bp, Homo sapiens
cttgggcagtctttcttgaa

SEQ ID NO: 5895770 - DNA, 13 bp, Homo sapiens
cttgggcagttct

SEQ ID NO: 5895771 - DNA, 23 bp, Homo sapiens
cttgggcagttctcactcctagg

SEQ ID NO: 5895772 - DNA, 24 bp, Homo sapiens
cttgggcatccacccagtgctgcc

SEQ ID NO: 5895773 - DNA, 13 bp, Homo sapiens
cttgggcatttat

SEQ ID NO: 5895774 - DNA, 17 bp, Homo sapiens
cttgggccaagccagct

SEQ ID NO: 5895775 - DNA, 19 bp, Homo sapiens
cttgggccaagccagctgc

SEQ ID NO: 5895776 - DNA, 22 bp, Homo sapiens
cttgggccaagccagctgccta

SEQ ID NO: 5895777 - DNA, 21 bp, Homo sapiens
cttgggccacgctcttgagga

SEQ ID NO: 5895778 - DNA, 14 bp, Homo sapiens
cttgggccactgtg

SEQ ID NO: 5895779 - DNA, 18 bp, Homo sapiens
cttgggccactgtgaaga

SEQ ID NO: 5895780 - DNA, 20 bp, Homo sapiens
cttgggccactgtgaagaga

SEQ ID NO: 5895781 - DNA, 15 bp, Homo sapiens
cttgggccagaagta

SEQ ID NO: 5895782 - DNA, 16 bp, Homo sapiens
cttgggccatagctcc

SEQ ID NO: 5895783 - DNA, 15 bp, Homo sapiens
cttgggcccacacct

SEQ ID NO: 5895784 - DNA, 16 bp, Homo sapiens
cttgggcccacacctc

SEQ ID NO: 5895785 - DNA, 14 bp, Homo sapiens
cttgggcccagctg

SEQ ID NO: 5895786 - DNA, 15 bp, Homo sapiens
cttgggcccagctgg

SEQ ID NO: 5895787 - DNA, 17 bp, Homo sapiens
cttgggcccagtagccc

SEQ ID NO: 5895788 - DNA, 20 bp, Homo sapiens
cttgggcccggtccacaggt

SEQ ID NO: 5895789 - DNA, 12 bp, Homo sapiens
cttgggccctcc

SEQ ID NO: 5895790 - DNA, 15 bp, Homo sapiens
cttgggccctgcaca

SEQ ID NO: 5895791 - DNA, 16 bp, Homo sapiens
cttgggccctgcacag

SEQ ID NO: 5895792 - DNA, 17 bp, Homo sapiens
cttgggccctgcacaga

SEQ ID NO: 5895793 - DNA, 14 bp, Homo sapiens
cttgggccctgcat

SEQ ID NO: 5895794 - DNA, 17 bp, Homo sapiens
cttgggccctggaagag

SEQ ID NO: 5895795 - DNA, 14 bp, Homo sapiens
cttgggccctttga

SEQ ID NO: 5895796 - DNA, 20 bp, Homo sapiens
cttgggcctcaggctctgca

SEQ ID NO: 5895797 - DNA, 12 bp, Homo sapiens
cttgggcctccc

SEQ ID NO: 5895798 - DNA, 14 bp, Homo sapiens
cttgggcctcccac

SEQ ID NO: 5895799 - DNA, 15 bp, Homo sapiens
cttgggcctggccag

SEQ ID NO: 5895800 - DNA, 17 bp, Homo sapiens
cttgggcctggccagtc

SEQ ID NO: 5895801 - DNA, 12 bp, Homo sapiens
cttgggcctggg

SEQ ID NO: 5895802 - DNA, 21 bp, Homo sapiens
cttgggcctgggcctctgccc

SEQ ID NO: 5895803 - DNA, 16 bp, Homo sapiens
cttgggccttgctgct

SEQ ID NO: 5895804 - DNA, 16 bp, Homo sapiens
cttgggcgctctgccc

SEQ ID NO: 5895805 - DNA, 19 bp, Homo sapiens
cttgggcgcttcccacctg

SEQ ID NO: 5895806 - DNA, 14 bp, Homo sapiens
cttgggcggctgag

SEQ ID NO: 5895807 - DNA, 15 bp, Homo sapiens
cttgggcggctgaga

SEQ ID NO: 5895808 - DNA, 19 bp, Homo sapiens
cttgggctactggcagctc

SEQ ID NO: 5895809 - DNA, 21 bp, Homo sapiens
cttgggctccgctgtgcccgc

SEQ ID NO: 5895810 - DNA, 12 bp, Homo sapiens
cttgggctcctg

SEQ ID NO: 5895811 - DNA, 15 bp, Homo sapiens
cttgggctcctggct

SEQ ID NO: 5895812 - DNA, 16 bp, Homo sapiens
cttgggctcctggctg

SEQ ID NO: 5895813 - DNA, 20 bp, Homo sapiens
cttgggctcctggctgccag

SEQ ID NO: 5895814 - DNA, 23 bp, Homo sapiens
cttgggctcctggctgccaggcg

SEQ ID NO: 5895815 - DNA, 16 bp, Homo sapiens
cttgggctctgatgaa

SEQ ID NO: 5895816 - DNA, 14 bp, Homo sapiens
cttgggctgaccca

SEQ ID NO: 5895817 - DNA, 17 bp, Homo sapiens
cttgggctgacccagca

SEQ ID NO: 5895818 - DNA, 19 bp, Homo sapiens
cttgggctgacccagcatc

SEQ ID NO: 5895819 - DNA, 14 bp, Homo sapiens
cttgggctgagact

SEQ ID NO: 5895820 - DNA, 18 bp, Homo sapiens
cttgggctggcacccact

SEQ ID NO: 5895821 - DNA, 13 bp, Homo sapiens
cttgggcttcatc

SEQ ID NO: 5895822 - DNA, 19 bp, Homo sapiens
cttgggcttcttcctcctc

SEQ ID NO: 5895823 - DNA, 21 bp, Homo sapiens
cttggggaaaatggccatgca

SEQ ID NO: 5895824 - DNA, 13 bp, Homo sapiens
cttggggaaatgt

SEQ ID NO: 5895825 - DNA, 15 bp, Homo sapiens
cttggggaaggggca

SEQ ID NO: 5895826 - DNA, 16 bp, Homo sapiens
cttggggaaggggcct

SEQ ID NO: 5895827 - DNA, 21 bp, Homo sapiens
cttggggaaggggcctgggct

SEQ ID NO: 5895828 - DNA, 22 bp, Homo sapiens
cttggggaaggggcctgggctg

SEQ ID NO: 5895829 - DNA, 16 bp, Homo sapiens
cttggggaagggtggg

SEQ ID NO: 5895830 - DNA, 23 bp, Homo sapiens
cttggggaagggtggggagaaat

SEQ ID NO: 5895831 - DNA, 18 bp, Homo sapiens
cttggggaatttcctcta

SEQ ID NO: 5895832 - DNA, 20 bp, Homo sapiens
cttggggaccagagctgcca

SEQ ID NO: 5895833 - DNA, 12 bp, Homo sapiens
cttggggagagg

SEQ ID NO: 5895834 - DNA, 22 bp, Homo sapiens
cttggggagcaggtctctggca

SEQ ID NO: 5895835 - DNA, 19 bp, Homo sapiens
cttggggagttaagacctg

SEQ ID NO: 5895836 - DNA, 20 bp, Homo sapiens
cttggggagtttagggtggg

SEQ ID NO: 5895837 - DNA, 16 bp, Homo sapiens
cttggggatttctggt

SEQ ID NO: 5895838 - DNA, 15 bp, Homo sapiens
cttggggcaggcagt

SEQ ID NO: 5895839 - DNA, 17 bp, Homo sapiens
cttggggcagggcctgg

SEQ ID NO: 5895840 - DNA, 18 bp, Homo sapiens
cttggggcagggcctggg

SEQ ID NO: 5895841 - DNA, 21 bp, Homo sapiens
cttggggccaccaaagctgcc

SEQ ID NO: 5895842 - DNA, 23 bp, Homo sapiens
cttggggccaccaaagctgccca

SEQ ID NO: 5895843 - DNA, 22 bp, Homo sapiens
cttggggccactttcagagccc

SEQ ID NO: 5895844 - DNA, 12 bp, Homo sapiens
cttggggcccag

SEQ ID NO: 5895845 - DNA, 16 bp, Homo sapiens
cttggggcccagtgca

SEQ ID NO: 5895846 - DNA, 19 bp, Homo sapiens
cttggggcctggcttgctc

SEQ ID NO: 5895847 - DNA, 14 bp, Homo sapiens
cttggggccttccc

SEQ ID NO: 5895848 - DNA, 18 bp, Homo sapiens
cttggggctcacacacct

SEQ ID NO: 5895849 - DNA, 22 bp, Homo sapiens
cttggggctcgccccacccagg

SEQ ID NO: 5895850 - DNA, 15 bp, Homo sapiens
cttggggctgatgaa

SEQ ID NO: 5895851 - DNA, 18 bp, Homo sapiens
cttggggctggggggcac

SEQ ID NO: 5895852 - DNA, 15 bp, Homo sapiens
cttgggggaaaatac

SEQ ID NO: 5895853 - DNA, 21 bp, Homo sapiens
cttgggggaagggcttgaatt

SEQ ID NO: 5895854 - DNA, 18 bp, Homo sapiens
cttgggggacagggctgg

SEQ ID NO: 5895855 - DNA, 21 bp, Homo sapiens
cttgggggacagggctggccc

SEQ ID NO: 5895856 - DNA, 22 bp, Homo sapiens
cttgggggacagggctggccca

SEQ ID NO: 5895857 - DNA, 16 bp, Homo sapiens
cttgggggcactgctc

SEQ ID NO: 5895858 - DNA, 17 bp, Homo sapiens
cttgggggcagagcagc

SEQ ID NO: 5895859 - DNA, 21 bp, Homo sapiens
cttgggggctcagcaaggcca

SEQ ID NO: 5895860 - DNA, 22 bp, Homo sapiens
cttggggggccaaagaaggcag

SEQ ID NO: 5895861 - DNA, 15 bp, Homo sapiens
cttggggggctgagg

SEQ ID NO: 5895862 - DNA, 15 bp, Homo sapiens
cttgtcctctcagag

SEQ ID NO: 5895863 - DNA, 17 bp, Homo sapiens
cttgtcctcttctgctc

SEQ ID NO: 5895864 - DNA, 18 bp, Homo sapiens
cttgtcctcttgccagct

SEQ ID NO: 5895865 - DNA, 19 bp, Homo sapiens
cttgtcctcttgccagctc

SEQ ID NO: 5895866 - DNA, 13 bp, Homo sapiens
cttgtcctgccag

SEQ ID NO: 5895867 - DNA, 14 bp, Homo sapiens
cttgtcctgccagc

SEQ ID NO: 5895868 - DNA, 15 bp, Homo sapiens
cttgtcctgccagct

SEQ ID NO: 5895869 - DNA, 16 bp, Homo sapiens
cttgtcctgccagctg

SEQ ID NO: 5895870 - DNA, 19 bp, Homo sapiens
cttgtcctgccagctgcct

SEQ ID NO: 5895871 - DNA, 20 bp, Homo sapiens
cttgtcctgccagctgcctt

SEQ ID NO: 5895872 - DNA, 22 bp, Homo sapiens
cttgtcctgccagctgccttcc

SEQ ID NO: 5895873 - DNA, 19 bp, Homo sapiens
cttgtcctgctctcttcag

SEQ ID NO: 5895874 - DNA, 19 bp, Homo sapiens
cttgtcctggcccttcagt

SEQ ID NO: 5895875 - DNA, 14 bp, Homo sapiens
cttgtccttagcct

SEQ ID NO: 5895876 - DNA, 15 bp, Homo sapiens
cttgtccttgctcct

SEQ ID NO: 5895877 - DNA, 18 bp, Homo sapiens
cttgtccttgctcctgga

SEQ ID NO: 5895878 - DNA, 19 bp, Homo sapiens
cttgtccttgctcctggaa

SEQ ID NO: 5895879 - DNA, 23 bp, Homo sapiens
cttgtcctttatattttttgtct

SEQ ID NO: 5895880 - DNA, 14 bp, Homo sapiens
cttgtcctttccct

SEQ ID NO: 5895881 - DNA, 21 bp, Homo sapiens
cttgtcctttgaggccccaac

SEQ ID NO: 5895882 - DNA, 16 bp, Homo sapiens
cttgtcgcgcgtctcc

SEQ ID NO: 5895883 - DNA, 18 bp, Homo sapiens
cttgtcgcgcgtctccca

SEQ ID NO: 5895884 - DNA, 14 bp, Homo sapiens
cttgtcgctttctc

SEQ ID NO: 5895885 - DNA, 20 bp, Homo sapiens
cttgtcgctttctcagtgtg

SEQ ID NO: 5895886 - DNA, 22 bp, Homo sapiens
cttgtcggccccaccagtgcct

SEQ ID NO: 5895887 - DNA, 23 bp, Homo sapiens
cttgtcggccccaccagtgcctc

SEQ ID NO: 5895888 - DNA, 15 bp, Homo sapiens
cttgtcgggggccca

SEQ ID NO: 5895889 - DNA, 21 bp, Homo sapiens
cttgtcgtagagccctccaca

SEQ ID NO: 5895890 - DNA, 15 bp, Homo sapiens
cttgtcgtgggatgg

SEQ ID NO: 5895891 - DNA, 16 bp, Homo sapiens
cttgtctaagaccccc

SEQ ID NO: 5895892 - DNA, 18 bp, Homo sapiens
cttgtctaagacccccat

SEQ ID NO: 5895893 - DNA, 21 bp, Homo sapiens
cttgtctaagacccccattat

SEQ ID NO: 5895894 - DNA, 15 bp, Homo sapiens
cttgtctattattga

SEQ ID NO: 5895895 - DNA, 18 bp, Homo sapiens
cttgtctcacgcagccag

SEQ ID NO: 5895896 - DNA, 19 bp, Homo sapiens
cttgtctcagatggtgtgt

SEQ ID NO: 5895897 - DNA, 13 bp, Homo sapiens
cttgtctcagatt

SEQ ID NO: 5895898 - DNA, 18 bp, Homo sapiens
cttgtctcagattttatt

SEQ ID NO: 5895899 - DNA, 19 bp, Homo sapiens
cttgtctcaggactctgaa

SEQ ID NO: 5895900 - DNA, 21 bp, Homo sapiens
cttgtctcaggactctgaaaa

SEQ ID NO: 5895901 - DNA, 15 bp, Homo sapiens
cttgtctcattttaa

SEQ ID NO: 5895902 - DNA, 23 bp, Homo sapiens
cttgtctcattttaatgtaaaga

SEQ ID NO: 5895903 - DNA, 20 bp, Homo sapiens
cttgtctccactaaatgagc

SEQ ID NO: 5895904 - DNA, 12 bp, Homo sapiens
cttgtctcccag

SEQ ID NO: 5895905 - DNA, 12 bp, Homo sapiens
cttgtctcccct

SEQ ID NO: 5895906 - DNA, 19 bp, Homo sapiens
cttgtctccctggttgcct

SEQ ID NO: 5895907 - DNA, 18 bp, Homo sapiens
cttgtctcctcctccagg

SEQ ID NO: 5895908 - DNA, 13 bp, Homo sapiens
cttgtctcctttc

SEQ ID NO: 5895909 - DNA, 14 bp, Homo sapiens
cttgtctcctttct

SEQ ID NO: 5895910 - DNA, 19 bp, Homo sapiens
cttgtctcctttctgactg

SEQ ID NO: 5895911 - DNA, 15 bp, Homo sapiens
cttgtctctcactgc

SEQ ID NO: 5895912 - DNA, 12 bp, Homo sapiens
cttgtctctcat

SEQ ID NO: 5895913 - DNA, 21 bp, Homo sapiens
cttgtctctcattctctttct

SEQ ID NO: 5895914 - DNA, 13 bp, Homo sapiens
cttgtctctgagg

SEQ ID NO: 5895915 - DNA, 21 bp, Homo sapiens
cttgtctctgaggctctccaa

SEQ ID NO: 5895916 - DNA, 13 bp, Homo sapiens
cttgtctctgtag

SEQ ID NO: 5895917 - DNA, 18 bp, Homo sapiens
cttgtctcttgcctgcca

SEQ ID NO: 5895918 - DNA, 12 bp, Homo sapiens
cttgtctgagat

SEQ ID NO: 5895919 - DNA, 16 bp, Homo sapiens
cttgtctgaggcctca

SEQ ID NO: 5895920 - DNA, 22 bp, Homo sapiens
cttgtctgaggcctcatccctc

SEQ ID NO: 5895921 - DNA, 23 bp, Homo sapiens
cttgtctgattggctcacccaag

SEQ ID NO: 5895922 - DNA, 18 bp, Homo sapiens
cttgtctgcctcctgctt

SEQ ID NO: 5895923 - DNA, 12 bp, Homo sapiens
cttgtctgctgc

SEQ ID NO: 5895924 - DNA, 13 bp, Homo sapiens
cttgtctgctgct

SEQ ID NO: 5895925 - DNA, 12 bp, Homo sapiens
cttgtctggctg

SEQ ID NO: 5895926 - DNA, 14 bp, Homo sapiens
cttgtctggctttg

SEQ ID NO: 5895927 - DNA, 14 bp, Homo sapiens
cttgtctgggtgca

SEQ ID NO: 5895928 - DNA, 22 bp, Homo sapiens
cttgtctggtgacccagagatc

SEQ ID NO: 5895929 - DNA, 17 bp, Homo sapiens
cttgtctgtcaaatgtt

SEQ ID NO: 5895930 - DNA, 20 bp, Homo sapiens
cttgtctgtgatctctgctg

SEQ ID NO: 5895931 - DNA, 16 bp, Homo sapiens
cttgtctgtgtatttc

SEQ ID NO: 5895932 - DNA, 12 bp, Homo sapiens
cttgtctgtgtg

SEQ ID NO: 5895933 - DNA, 16 bp, Homo sapiens
cttgtcttagctctgg

SEQ ID NO: 5895934 - DNA, 18 bp, Homo sapiens
cttgtcttagctctggac

SEQ ID NO: 5895935 - DNA, 19 bp, Homo sapiens
cttgtcttcccccctctcc

SEQ ID NO: 5895936 - DNA, 17 bp, Homo sapiens
cttgtcttcctatttca

SEQ ID NO: 5895937 - DNA, 14 bp, Homo sapiens
cttgtcttcgctgg

SEQ ID NO: 5895938 - DNA, 16 bp, Homo sapiens
cttgtcttctagttta

SEQ ID NO: 5895939 - DNA, 14 bp, Homo sapiens
cttgtcttgttcac

SEQ ID NO: 5895940 - DNA, 17 bp, Homo sapiens
cttgtctttactgacaa

SEQ ID NO: 5895941 - DNA, 15 bp, Homo sapiens
cttgtctttcctcct

SEQ ID NO: 5895942 - DNA, 21 bp, Homo sapiens
cttgtctttcctcctaccttt

SEQ ID NO: 5895943 - DNA, 13 bp, Homo sapiens
cttgtctttgatt

SEQ ID NO: 5895944 - DNA, 15 bp, Homo sapiens
cttgtctttggaccc

SEQ ID NO: 5895945 - DNA, 19 bp, Homo sapiens
cttgtctttggaccctgag

SEQ ID NO: 5895946 - DNA, 22 bp, Homo sapiens
cttgtctttggaccctgaggcc

SEQ ID NO: 5895947 - DNA, 17 bp, Homo sapiens
cttgtcttttcaaaata

SEQ ID NO: 5895948 - DNA, 18 bp, Homo sapiens
cttgtcttttcaaaatat

SEQ ID NO: 5895949 - DNA, 14 bp, Homo sapiens
cttgtcttttcaga

SEQ ID NO: 5895950 - DNA, 18 bp, Homo sapiens
cttgtcttttcagaagca

SEQ ID NO: 5895951 - DNA, 14 bp, Homo sapiens
cttgtcttttcccc

SEQ ID NO: 5895952 - DNA, 17 bp, Homo sapiens
cttgtcttttctgctga

SEQ ID NO: 5895953 - DNA, 20 bp, Homo sapiens
cttgtcttttctgctgagga

SEQ ID NO: 5895954 - DNA, 12 bp, Homo sapiens
cttgtcttttga

SEQ ID NO: 5895955 - DNA, 15 bp, Homo sapiens
cttgtctttttgtta

SEQ ID NO: 5895956 - DNA, 18 bp, Homo sapiens
cttgtgaaaataattgac

SEQ ID NO: 5895957 - DNA, 18 bp, Homo sapiens
cttgtgaaaatgtgttct

SEQ ID NO: 5895958 - DNA, 16 bp, Homo sapiens
cttgtgaaacacagct

SEQ ID NO: 5895959 - DNA, 18 bp, Homo sapiens
cttgtgaaacacagctgt

SEQ ID NO: 5895960 - DNA, 20 bp, Homo sapiens
cttgtgaaacacagctgttc

SEQ ID NO: 5895961 - DNA, 17 bp, Homo sapiens
cttgtgaaaccacaggc

SEQ ID NO: 5895962 - DNA, 16 bp, Homo sapiens
cttgtgaaattgtgta

SEQ ID NO: 5895963 - DNA, 15 bp, Homo sapiens
cttgtgaacatcaga

SEQ ID NO: 5895964 - DNA, 16 bp, Homo sapiens
cttgtgaactttgaat

SEQ ID NO: 5895965 - DNA, 16 bp, Homo sapiens
cttgtgaaggccatga

SEQ ID NO: 5895966 - DNA, 22 bp, Homo sapiens
cttgtgaatattgtggctccct

SEQ ID NO: 5895967 - DNA, 23 bp, Homo sapiens
cttgtgaatattgtggctccctg

SEQ ID NO: 5895968 - DNA, 20 bp, Homo sapiens
cttgtgaatcaagggtcagg

SEQ ID NO: 5895969 - DNA, 15 bp, Homo sapiens
cttgtgaatgcttct

SEQ ID NO: 5895970 - DNA, 17 bp, Homo sapiens
cttgtgaatgcttctca

SEQ ID NO: 5895971 - DNA, 22 bp, Homo sapiens
cttgtgacagctctttttgtga

SEQ ID NO: 5895972 - DNA, 13 bp, Homo sapiens
cttgtgacagtgc

SEQ ID NO: 5895973 - DNA, 19 bp, Homo sapiens
cttgtgacagtgcctcttc

SEQ ID NO: 5895974 - DNA, 16 bp, Homo sapiens
cttgtgacattcactc

SEQ ID NO: 5895975 - DNA, 22 bp, Homo sapiens
cttgtgaccttgacttgccatg

SEQ ID NO: 5895976 - DNA, 20 bp, Homo sapiens
cttgtgactaagttgcaaga

SEQ ID NO: 5895977 - DNA, 15 bp, Homo sapiens
cttgtgactagtgct

SEQ ID NO: 5895978 - DNA, 18 bp, Homo sapiens
cttgtgactagtgctgaa

SEQ ID NO: 5895979 - DNA, 20 bp, Homo sapiens
cttgtgactagtgctgaagc

SEQ ID NO: 5895980 - DNA, 18 bp, Homo sapiens
cttgtgactcagcagagg

SEQ ID NO: 5895981 - DNA, 17 bp, Homo sapiens
cttgtgacttttgcttt

SEQ ID NO: 5895982 - DNA, 19 bp, Homo sapiens
cttgtgagagcccattccc

SEQ ID NO: 5895983 - DNA, 22 bp, Homo sapiens
cttgtgagagcccattcccacc

SEQ ID NO: 5895984 - DNA, 14 bp, Homo sapiens
cttgtgagagctgg

SEQ ID NO: 5895985 - DNA, 16 bp, Homo sapiens
cttgtgagagctggtt

SEQ ID NO: 5895986 - DNA, 19 bp, Homo sapiens
cttgtgagcatcagagggc

SEQ ID NO: 5895987 - DNA, 22 bp, Homo sapiens
cttgtgagcatcagagggctga

SEQ ID NO: 5895988 - DNA, 18 bp, Homo sapiens
cttgtgagggttgcttca

SEQ ID NO: 5895989 - DNA, 19 bp, Homo sapiens
cttgtgatcctttggggct

SEQ ID NO: 5895990 - DNA, 16 bp, Homo sapiens
cttgtgatctgggaac

SEQ ID NO: 5895991 - DNA, 16 bp, Homo sapiens
cttgtgatgtattctt

SEQ ID NO: 5895992 - DNA, 16 bp, Homo sapiens
cttgtgattcctaccc

SEQ ID NO: 5895993 - DNA, 22 bp, Homo sapiens
cttgtgattcctacccctcttc

SEQ ID NO: 5895994 - DNA, 14 bp, Homo sapiens
cttgtgattggctg

SEQ ID NO: 5895995 - DNA, 15 bp, Homo sapiens
cttgtgattggctgc

SEQ ID NO: 5895996 - DNA, 18 bp, Homo sapiens
cttgtgattggctgcagg

SEQ ID NO: 5895997 - DNA, 15 bp, Homo sapiens
cttgtgatttccatt

SEQ ID NO: 5895998 - DNA, 23 bp, Homo sapiens
cttgtgatttctttaaaagaatg

SEQ ID NO: 5895999 - DNA, 21 bp, Homo sapiens
cttgtgatttggttgcacttt

SEQ ID NO: 5896000 - DNA, 18 bp, Homo sapiens
cttgtgcaattgtctttt

SEQ ID NO: 5896001 - DNA, 23 bp, Homo sapiens
cttgtgcaccctctatcccaata

SEQ ID NO: 5896002 - DNA, 21 bp, Homo sapiens
cttgtgcactttatcttggga

SEQ ID NO: 5896003 - DNA, 16 bp, Homo sapiens
cttgtgcagaaaacat

SEQ ID NO: 5896004 - DNA, 18 bp, Homo sapiens
cttgtgcagaaaacattg

SEQ ID NO: 5896005 - DNA, 20 bp, Homo sapiens
cttgtgcataattcttccaa

SEQ ID NO: 5896006 - DNA, 19 bp, Homo sapiens
cttgtgcatgtttacttta

SEQ ID NO: 5896007 - DNA, 11 bp, Homo sapiens
cttgtgccata

SEQ ID NO: 5896008 - DNA, 20 bp, Homo sapiens
cttgtgccctccctgtcctt

SEQ ID NO: 5896009 - DNA, 16 bp, Homo sapiens
cttgtgccctgccccc

SEQ ID NO: 5896010 - DNA, 21 bp, Homo sapiens
cttgtgccctgcccccatctc

SEQ ID NO: 5896011 - DNA, 13 bp, Homo sapiens
cttgtgcctcagc

SEQ ID NO: 5896012 - DNA, 17 bp, Homo sapiens
cttgtgcctcccttccc

SEQ ID NO: 5896013 - DNA, 15 bp, Homo sapiens
cttgtgcctgctcct

SEQ ID NO: 5896014 - DNA, 17 bp, Homo sapiens
cttgtgcctgctcctgt

SEQ ID NO: 5896015 - DNA, 14 bp, Homo sapiens
cttgtgcctggctc

SEQ ID NO: 5896016 - DNA, 16 bp, Homo sapiens
cttgtgcctggctcag

SEQ ID NO: 5896017 - DNA, 14 bp, Homo sapiens
cttgtgcctggggt

SEQ ID NO: 5896018 - DNA, 16 bp, Homo sapiens
cttgtgctcacgctcc

SEQ ID NO: 5896019 - DNA, 23 bp, Homo sapiens
cttgtgctcacgctcccccgcag

SEQ ID NO: 5896020 - DNA, 15 bp, Homo sapiens
cttgtgctcatgtgt

SEQ ID NO: 5896021 - DNA, 18 bp, Homo sapiens
cttgtgctcctgccagct

SEQ ID NO: 5896022 - DNA, 18 bp, Homo sapiens
cttgtgctgagcctgccc

SEQ ID NO: 5896023 - DNA, 23 bp, Homo sapiens
cttgtgctggatggagcccaggc

SEQ ID NO: 5896024 - DNA, 22 bp, Homo sapiens
cttgtgcttttttgattttgct

SEQ ID NO: 5896025 - DNA, 13 bp, Homo sapiens
cttgtggaagaca

SEQ ID NO: 5896026 - DNA, 15 bp, Homo sapiens
cttgtggaagacaag

SEQ ID NO: 5896027 - DNA, 20 bp, Homo sapiens
cttgtggaagacacttgctg

SEQ ID NO: 5896028 - DNA, 21 bp, Homo sapiens
cttgtggaagcaaaaatctga

SEQ ID NO: 5896029 - DNA, 14 bp, Homo sapiens
cttgtggacacagc

SEQ ID NO: 5896030 - DNA, 18 bp, Homo sapiens
cttgtggacacagctctt

SEQ ID NO: 5896031 - DNA, 17 bp, Homo sapiens
cttgtggaccccgcctg

SEQ ID NO: 5896032 - DNA, 18 bp, Homo sapiens
cttgtggactctctgcct

SEQ ID NO: 5896033 - DNA, 22 bp, Homo sapiens
cttgtggactctctgcctgctt

SEQ ID NO: 5896034 - DNA, 24 bp, Homo sapiens
cttgtggactggctgtgcccctga

SEQ ID NO: 5896035 - DNA, 17 bp, Homo sapiens
cttgtggagatcacagc

SEQ ID NO: 5896036 - DNA, 14 bp, Homo sapiens
cttgtggagcccca

SEQ ID NO: 5896037 - DNA, 16 bp, Homo sapiens
cttgtggataagtggc

SEQ ID NO: 5896038 - DNA, 16 bp, Homo sapiens
cttgtggcagcaacgg

SEQ ID NO: 5896039 - DNA, 23 bp, Homo sapiens
cttgtggcagcctgattcggggc

SEQ ID NO: 5896040 - DNA, 23 bp, Homo sapiens
cttgtttaaaaaaacaaataaat

SEQ ID NO: 5896041 - DNA, 18 bp, Homo sapiens
cttgtttaaaaaaagaaa

SEQ ID NO: 5896042 - DNA, 19 bp, Homo sapiens
cttgtttaacatatatatt

SEQ ID NO: 5896043 - DNA, 14 bp, Homo sapiens
cttgtttaatgtta

SEQ ID NO: 5896044 - DNA, 14 bp, Homo sapiens
cttgtttaattcta

SEQ ID NO: 5896045 - DNA, 23 bp, Homo sapiens
cttgtttacaacatttttgcaaa

SEQ ID NO: 5896046 - DNA, 13 bp, Homo sapiens
cttgtttacaata

SEQ ID NO: 5896047 - DNA, 18 bp, Homo sapiens
cttgtttacatgcttatt

SEQ ID NO: 5896048 - DNA, 22 bp, Homo sapiens
cttgtttacatgcttattccat

SEQ ID NO: 5896049 - DNA, 21 bp, Homo sapiens
cttgtttaccaaagaagagtt

SEQ ID NO: 5896050 - DNA, 18 bp, Homo sapiens
cttgtttagagagcctgt

SEQ ID NO: 5896051 - DNA, 19 bp, Homo sapiens
cttgtttatgatatttctt

SEQ ID NO: 5896052 - DNA, 14 bp, Homo sapiens
cttgtttattaaat

SEQ ID NO: 5896053 - DNA, 12 bp, Homo sapiens
cttgtttcaatt

SEQ ID NO: 5896054 - DNA, 22 bp, Homo sapiens
cttgtttcaattccacctgcaa

SEQ ID NO: 5896055 - DNA, 17 bp, Homo sapiens
cttgtttcactccacca

SEQ ID NO: 5896056 - DNA, 16 bp, Homo sapiens
cttgtttcatctggtt

SEQ ID NO: 5896057 - DNA, 18 bp, Homo sapiens
cttgtttcatctggtttt

SEQ ID NO: 5896058 - DNA, 14 bp, Homo sapiens
cttgtttccctgct

SEQ ID NO: 5896059 - DNA, 17 bp, Homo sapiens
cttgtttccctgctggc

SEQ ID NO: 5896060 - DNA, 20 bp, Homo sapiens
cttgtttccttagcttggta

SEQ ID NO: 5896061 - DNA, 20 bp, Homo sapiens
cttgtttctgcatctttttg

SEQ ID NO: 5896062 - DNA, 22 bp, Homo sapiens
cttgtttctgggtccctgctcc

SEQ ID NO: 5896063 - DNA, 14 bp, Homo sapiens
cttgtttctgtgcc

SEQ ID NO: 5896064 - DNA, 18 bp, Homo sapiens
cttgtttgagtttttcct

SEQ ID NO: 5896065 - DNA, 20 bp, Homo sapiens
cttgtttgagtttttcctcc

SEQ ID NO: 5896066 - DNA, 17 bp, Homo sapiens
cttgtttgctatgacta

SEQ ID NO: 5896067 - DNA, 18 bp, Homo sapiens
cttgtttgctcacctggg

SEQ ID NO: 5896068 - DNA, 22 bp, Homo sapiens
cttgtttgctttgaaaatattt

SEQ ID NO: 5896069 - DNA, 18 bp, Homo sapiens
cttgtttggggcaggagt

SEQ ID NO: 5896070 - DNA, 16 bp, Homo sapiens
cttgtttgtcagcatc

SEQ ID NO: 5896071 - DNA, 18 bp, Homo sapiens
cttgtttgtcagcatctg

SEQ ID NO: 5896072 - DNA, 19 bp, Homo sapiens
cttgtttgtcagcatctga

SEQ ID NO: 5896073 - DNA, 19 bp, Homo sapiens
cttgtttgtgcatcctgtg

SEQ ID NO: 5896074 - DNA, 13 bp, Homo sapiens
cttgtttgttttg

SEQ ID NO: 5896075 - DNA, 13 bp, Homo sapiens
cttgttttataaa

SEQ ID NO: 5896076 - DNA, 21 bp, Homo sapiens
cttgttttcaggacaacactt

SEQ ID NO: 5896077 - DNA, 14 bp, Homo sapiens
cttgttttcagttt

SEQ ID NO: 5896078 - DNA, 11 bp, Homo sapiens
cttgttttcca

SEQ ID NO: 5896079 - DNA, 12 bp, Homo sapiens
cttgttttccaa

SEQ ID NO: 5896080 - DNA, 13 bp, Homo sapiens
cttgttttccaaa

SEQ ID NO: 5896081 - DNA, 14 bp, Homo sapiens
cttgttttctctgt

SEQ ID NO: 5896082 - DNA, 22 bp, Homo sapiens
cttgttttctttctttaaatgt

SEQ ID NO: 5896083 - DNA, 22 bp, Homo sapiens
cttgttttgacttgaataaagt

SEQ ID NO: 5896084 - DNA, 22 bp, Homo sapiens
cttgttttgaggtagaaatgca

SEQ ID NO: 5896085 - DNA, 14 bp, Homo sapiens
cttgttttgcttcc

SEQ ID NO: 5896086 - DNA, 23 bp, Homo sapiens
cttgttttgcttcccctcccccc

SEQ ID NO: 5896087 - DNA, 21 bp, Homo sapiens
cttgttttggactttgttaca

SEQ ID NO: 5896088 - DNA, 14 bp, Homo sapiens
cttgttttggatgc

SEQ ID NO: 5896089 - DNA, 21 bp, Homo sapiens
cttgttttggatggcttgtct

SEQ ID NO: 5896090 - DNA, 19 bp, Homo sapiens
cttgttttgtttgcttcca

SEQ ID NO: 5896091 - DNA, 23 bp, Homo sapiens
cttgttttgtttgtctctccttt

SEQ ID NO: 5896092 - DNA, 14 bp, Homo sapiens
cttgtttttaagtt

SEQ ID NO: 5896093 - DNA, 16 bp, Homo sapiens
cttgtttttaagtttg

SEQ ID NO: 5896094 - DNA, 20 bp, Homo sapiens
cttgtttttaagtttgcact

SEQ ID NO: 5896095 - DNA, 19 bp, Homo sapiens
cttgtttttaatctcctgt

SEQ ID NO: 5896096 - DNA, 20 bp, Homo sapiens
cttgtttttaatctcctgtt

SEQ ID NO: 5896097 - DNA, 23 bp, Homo sapiens
cttgtttttataataaaaagctt

SEQ ID NO: 5896098 - DNA, 16 bp, Homo sapiens
cttgtttttcttcagc

SEQ ID NO: 5896099 - DNA, 18 bp, Homo sapiens
cttgtttttcttcagcat

SEQ ID NO: 5896100 - DNA, 13 bp, Homo sapiens
cttgtttttgatg

SEQ ID NO: 5896101 - DNA, 16 bp, Homo sapiens
cttgtttttgtaaaga

SEQ ID NO: 5896102 - DNA, 17 bp, Homo sapiens
cttgtttttgtttttgt

SEQ ID NO: 5896103 - DNA, 23 bp, Homo sapiens
cttgtttttgtttttgttttgtt

SEQ ID NO: 5896104 - DNA, 19 bp, Homo sapiens
cttgttttttttttccact

SEQ ID NO: 5896105 - DNA, 20 bp, Homo sapiens
cttgttttttttttccactt

SEQ ID NO: 5896106 - DNA, 16 bp, Homo sapiens
ctttaaaaaaaatcct

SEQ ID NO: 5896107 - DNA, 17 bp, Homo sapiens
ctttaaaaaaatttaag

SEQ ID NO: 5896108 - DNA, 19 bp, Homo sapiens
ctttaaaaaacacagtcac

SEQ ID NO: 5896109 - DNA, 23 bp, Homo sapiens
ctttaaaaaagaaaagtgcatat

SEQ ID NO: 5896110 - DNA, 22 bp, Homo sapiens
ctttaaaaaagctataaattat

SEQ ID NO: 5896111 - DNA, 19 bp, Homo sapiens
ctttaaaaaataaagctgt

SEQ ID NO: 5896112 - DNA, 18 bp, Homo sapiens
ctttaaaaaatatttatt

SEQ ID NO: 5896113 - DNA, 19 bp, Homo sapiens
ctttaaaaaatatttatta

SEQ ID NO: 5896114 - DNA, 23 bp, Homo sapiens
ctttaaaaactatttaacttgag

SEQ ID NO: 5896115 - DNA, 15 bp, Homo sapiens
ctttaaaaagaaaaa

SEQ ID NO: 5896116 - DNA, 15 bp, Homo sapiens
ctttaaaaagcagga

SEQ ID NO: 5896117 - DNA, 16 bp, Homo sapiens
ctttaaaaagcaggaa

SEQ ID NO: 5896118 - DNA, 22 bp, Homo sapiens
ctttaaaaagcagtttttgaaa

SEQ ID NO: 5896119 - DNA, 16 bp, Homo sapiens
ctttaaaaataaaagc

SEQ ID NO: 5896120 - DNA, 15 bp, Homo sapiens
ctttaaaaatacata

SEQ ID NO: 5896121 - DNA, 12 bp, Homo sapiens
ctttaaaaatgt

SEQ ID NO: 5896122 - DNA, 14 bp, Homo sapiens
ctttaaaaatgtat

SEQ ID NO: 5896123 - DNA, 18 bp, Homo sapiens
ctttaaaaatgtcttatt

SEQ ID NO: 5896124 - DNA, 20 bp, Homo sapiens
ctttaaaaattattatatat

SEQ ID NO: 5896125 - DNA, 22 bp, Homo sapiens
ctttaaaacaaagggaaaaaag

SEQ ID NO: 5896126 - DNA, 19 bp, Homo sapiens
ctttaaaacaagtgtgatg

SEQ ID NO: 5896127 - DNA, 14 bp, Homo sapiens
ctttaaaaccagta

SEQ ID NO: 5896128 - DNA, 23 bp, Homo sapiens
ctttaaaacgcgtctgcctgggc

SEQ ID NO: 5896129 - DNA, 11 bp, Homo sapiens
ctttaaaagaa

SEQ ID NO: 5896130 - DNA, 15 bp, Homo sapiens
ctttaaaagaaaata

SEQ ID NO: 5896131 - DNA, 13 bp, Homo sapiens
ctttaaaagagag

SEQ ID NO: 5896132 - DNA, 16 bp, Homo sapiens
ctttaaaagagagaga

SEQ ID NO: 5896133 - DNA, 22 bp, Homo sapiens
ctttaaaagagagagagagaaa

SEQ ID NO: 5896134 - DNA, 18 bp, Homo sapiens
ctttaaaagcgacctctc

SEQ ID NO: 5896135 - DNA, 16 bp, Homo sapiens
ctttaaaaggaaagaa

SEQ ID NO: 5896136 - DNA, 17 bp, Homo sapiens
ctttaaaaggaaagaaa

SEQ ID NO: 5896137 - DNA, 18 bp, Homo sapiens
ctttaaaaggattaatct

SEQ ID NO: 5896138 - DNA, 13 bp, Homo sapiens
ctttaaaaggcaa

SEQ ID NO: 5896139 - DNA, 14 bp, Homo sapiens
ctttaaaaggcaac

SEQ ID NO: 5896140 - DNA, 21 bp, Homo sapiens
ctttaaaaggcaactcaaaga

SEQ ID NO: 5896141 - DNA, 15 bp, Homo sapiens
ctttaaaagtatctt

SEQ ID NO: 5896142 - DNA, 21 bp, Homo sapiens
ctttaaaagtatctttaacaa

SEQ ID NO: 5896143 - DNA, 19 bp, Homo sapiens
ctttaaaagtcattattcc

SEQ ID NO: 5896144 - DNA, 20 bp, Homo sapiens
ctttaaaagtcattattcct

SEQ ID NO: 5896145 - DNA, 22 bp, Homo sapiens
ctttaaaataaggataataatc

SEQ ID NO: 5896146 - DNA, 21 bp, Homo sapiens
ctttaaaataataatagtact

SEQ ID NO: 5896147 - DNA, 12 bp, Homo sapiens
ctttaaaatgcg

SEQ ID NO: 5896148 - DNA, 14 bp, Homo sapiens
ctttaaaatgcgaa

SEQ ID NO: 5896149 - DNA, 21 bp, Homo sapiens
ctttaaaatgtaaagccatgc

SEQ ID NO: 5896150 - DNA, 20 bp, Homo sapiens
ctttaaaattacaactaagt

SEQ ID NO: 5896151 - DNA, 21 bp, Homo sapiens
ctttaaaatttttttagaaag

SEQ ID NO: 5896152 - DNA, 19 bp, Homo sapiens
ctttaaacaaatatgaaaa

SEQ ID NO: 5896153 - DNA, 21 bp, Homo sapiens
ctttaaacaaatatgaaaaat

SEQ ID NO: 5896154 - DNA, 17 bp, Homo sapiens
ctttaaacagtatttca

SEQ ID NO: 5896155 - DNA, 19 bp, Homo sapiens
ctttaaacatgattatctt

SEQ ID NO: 5896156 - DNA, 22 bp, Homo sapiens
ctttaaacctgtagaatcaatt

SEQ ID NO: 5896157 - DNA, 17 bp, Homo sapiens
ctttaaacctttcataa

SEQ ID NO: 5896158 - DNA, 19 bp, Homo sapiens
ctttaaacctttcataatt

SEQ ID NO: 5896159 - DNA, 19 bp, Homo sapiens
ctttaaactacattaggtt

SEQ ID NO: 5896160 - DNA, 21 bp, Homo sapiens
ctttaaactaccctccagagt

SEQ ID NO: 5896161 - DNA, 16 bp, Homo sapiens
ctttaaactcagggac

SEQ ID NO: 5896162 - DNA, 14 bp, Homo sapiens
ctttaaactgtcgt

SEQ ID NO: 5896163 - DNA, 20 bp, Homo sapiens
ctttaaactgtcgtgtcata

SEQ ID NO: 5896164 - DNA, 16 bp, Homo sapiens
ctttaaagacttaaga

SEQ ID NO: 5896165 - DNA, 21 bp, Homo sapiens
ctttaaagacttaagattaaa

SEQ ID NO: 5896166 - DNA, 15 bp, Homo sapiens
ctttaaagacttgat

SEQ ID NO: 5896167 - DNA, 23 bp, Homo sapiens
ctttaaagagcaggatagctctt

SEQ ID NO: 5896168 - DNA, 19 bp, Homo sapiens
ctttaaagaggctgtgtgg

SEQ ID NO: 5896169 - DNA, 23 bp, Homo sapiens
ctttaaagagtcctccttcccag

SEQ ID NO: 5896170 - DNA, 15 bp, Homo sapiens
ctttaaagccagtca

SEQ ID NO: 5896171 - DNA, 21 bp, Homo sapiens
ctttaaagccagtcatcatct

SEQ ID NO: 5896172 - DNA, 13 bp, Homo sapiens
ctttaaagccttt

SEQ ID NO: 5896173 - DNA, 21 bp, Homo sapiens
ctttaaaggcatctacacaat

SEQ ID NO: 5896174 - DNA, 18 bp, Homo sapiens
ctttaaagggatggcaag

SEQ ID NO: 5896175 - DNA, 23 bp, Homo sapiens
ctttaaaggtcgcacctccttgg

SEQ ID NO: 5896176 - DNA, 24 bp, Homo sapiens
ctttaaaggtcgcacctccttgga

SEQ ID NO: 5896177 - DNA, 16 bp, Homo sapiens
ctttaaagtacctgta

SEQ ID NO: 5896178 - DNA, 18 bp, Homo sapiens
ctttaaagtacctgtagt

SEQ ID NO: 5896179 - DNA, 22 bp, Homo sapiens
ctttaaagtatgaatctatgcc

SEQ ID NO: 5896180 - DNA, 20 bp, Homo sapiens
ctttaaagtatgtcttgttt

SEQ ID NO: 5896181 - DNA, 21 bp, Homo sapiens
ctttaaagtgagtactgttaa

SEQ ID NO: 5896182 - DNA, 17 bp, Homo sapiens
ctttaaagtgtaataat

SEQ ID NO: 5896183 - DNA, 13 bp, Homo sapiens
ctttaaagttctt

SEQ ID NO: 5896184 - DNA, 13 bp, Homo sapiens
ctttaaataaaaa

SEQ ID NO: 5896185 - DNA, 14 bp, Homo sapiens
ctttaaataaaaat

SEQ ID NO: 5896186 - DNA, 14 bp, Homo sapiens
ctttaaataaaaga

SEQ ID NO: 5896187 - DNA, 13 bp, Homo sapiens
ctttaaataaatg

SEQ ID NO: 5896188 - DNA, 21 bp, Homo sapiens
ctttaaataaattaagatcct

SEQ ID NO: 5896189 - DNA, 18 bp, Homo sapiens
ctttaaataatttaacta

SEQ ID NO: 5896190 - DNA, 16 bp, Homo sapiens
ctttaaatatatatta

SEQ ID NO: 5896191 - DNA, 15 bp, Homo sapiens
ctttaaatatcattc

SEQ ID NO: 5896192 - DNA, 17 bp, Homo sapiens
ctttaaatatcattctt

SEQ ID NO: 5896193 - DNA, 14 bp, Homo sapiens
ctttaaatcaaaag

SEQ ID NO: 5896194 - DNA, 20 bp, Homo sapiens
ctttaaatcaaaagctgctt

SEQ ID NO: 5896195 - DNA, 18 bp, Homo sapiens
ctttaaatccttaatggc

SEQ ID NO: 5896196 - DNA, 19 bp, Homo sapiens
ctttaaatgaaacaagtct

SEQ ID NO: 5896197 - DNA, 18 bp, Homo sapiens
ctttaaatgacagtaata

SEQ ID NO: 5896198 - DNA, 21 bp, Homo sapiens
ctttaaatgacagtaatattg

SEQ ID NO: 5896199 - DNA, 15 bp, Homo sapiens
ctttaaatgctgctt

SEQ ID NO: 5896200 - DNA, 21 bp, Homo sapiens
ctttaaatggggacgcagatg

SEQ ID NO: 5896201 - DNA, 15 bp, Homo sapiens
ctttaaatgttttat

SEQ ID NO: 5896202 - DNA, 13 bp, Homo sapiens
ctttaaattaaaa

SEQ ID NO: 5896203 - DNA, 15 bp, Homo sapiens
ctttaaattaaaatt

SEQ ID NO: 5896204 - DNA, 13 bp, Homo sapiens
ctttaaattatat

SEQ ID NO: 5896205 - DNA, 22 bp, Homo sapiens
ctttaaattatatgatatgcat

SEQ ID NO: 5896206 - DNA, 14 bp, Homo sapiens
ctttaaattctcca

SEQ ID NO: 5896207 - DNA, 16 bp, Homo sapiens
ctttaaattctccaac

SEQ ID NO: 5896208 - DNA, 14 bp, Homo sapiens
ctttaaattgtgga

SEQ ID NO: 5896209 - DNA, 18 bp, Homo sapiens
ctttaaattgttcctctt

SEQ ID NO: 5896210 - DNA, 14 bp, Homo sapiens
ctttaaatttaggt

SEQ ID NO: 5896211 - DNA, 21 bp, Homo sapiens
ctttaacaaaacaagaaagaa

SEQ ID NO: 5896212 - DNA, 18 bp, Homo sapiens
ctttaacaacctctgagc

SEQ ID NO: 5896213 - DNA, 15 bp, Homo sapiens
ctttaacagctttct

SEQ ID NO: 5896214 - DNA, 19 bp, Homo sapiens
ctttaacaggttttcttct

SEQ ID NO: 5896215 - DNA, 21 bp, Homo sapiens
ctttaacatacaagaaaatgt

SEQ ID NO: 5896216 - DNA, 19 bp, Homo sapiens
ctttactggtgatttctga

SEQ ID NO: 5896217 - DNA, 15 bp, Homo sapiens
ctttactgtcaaaat

SEQ ID NO: 5896218 - DNA, 20 bp, Homo sapiens
ctttactgtgcttatttttt

SEQ ID NO: 5896219 - DNA, 12 bp, Homo sapiens
ctttactgtttg

SEQ ID NO: 5896220 - DNA, 14 bp, Homo sapiens
ctttactgtttgtt

SEQ ID NO: 5896221 - DNA, 15 bp, Homo sapiens
ctttactgtttgtta

SEQ ID NO: 5896222 - DNA, 18 bp, Homo sapiens
ctttacttagcttatcaa

SEQ ID NO: 5896223 - DNA, 17 bp, Homo sapiens
ctttacttatctctcaa

SEQ ID NO: 5896224 - DNA, 16 bp, Homo sapiens
ctttacttgtctttct

SEQ ID NO: 5896225 - DNA, 15 bp, Homo sapiens
ctttacttgtggtgt

SEQ ID NO: 5896226 - DNA, 14 bp, Homo sapiens
ctttactttaaaat

SEQ ID NO: 5896227 - DNA, 18 bp, Homo sapiens
ctttactttagaatttag

SEQ ID NO: 5896228 - DNA, 16 bp, Homo sapiens
ctttactttcaagtaa

SEQ ID NO: 5896229 - DNA, 20 bp, Homo sapiens
ctttactttcaagtaatatt

SEQ ID NO: 5896230 - DNA, 17 bp, Homo sapiens
ctttactttcccttgct

SEQ ID NO: 5896231 - DNA, 16 bp, Homo sapiens
ctttactttttccatt

SEQ ID NO: 5896232 - DNA, 18 bp, Homo sapiens
ctttactttttccatttg

SEQ ID NO: 5896233 - DNA, 21 bp, Homo sapiens
ctttactttttccatttggca

SEQ ID NO: 5896234 - DNA, 18 bp, Homo sapiens
ctttagaaacacataatt

SEQ ID NO: 5896235 - DNA, 15 bp, Homo sapiens
ctttagaaagaaatt

SEQ ID NO: 5896236 - DNA, 15 bp, Homo sapiens
ctttagaaataaatg

SEQ ID NO: 5896237 - DNA, 20 bp, Homo sapiens
ctttagaaattaataccact

SEQ ID NO: 5896238 - DNA, 23 bp, Homo sapiens
ctttagaacaacataaaattaaa

SEQ ID NO: 5896239 - DNA, 14 bp, Homo sapiens
ctttagaactctag

SEQ ID NO: 5896240 - DNA, 15 bp, Homo sapiens
ctttagaagcctgca

SEQ ID NO: 5896241 - DNA, 13 bp, Homo sapiens
ctttagaatatta

SEQ ID NO: 5896242 - DNA, 23 bp, Homo sapiens
ctttagaatgttttccttctact

SEQ ID NO: 5896243 - DNA, 13 bp, Homo sapiens
ctttagacaaatt

SEQ ID NO: 5896244 - DNA, 19 bp, Homo sapiens
ctttagacatttttgtgcc

SEQ ID NO: 5896245 - DNA, 23 bp, Homo sapiens
ctttagaccctgggtgggctctg

SEQ ID NO: 5896246 - DNA, 22 bp, Homo sapiens
ctttagactaattgtgtttgtc

SEQ ID NO: 5896247 - DNA, 17 bp, Homo sapiens
ctttagacttgaaaaga

SEQ ID NO: 5896248 - DNA, 20 bp, Homo sapiens
ctttagagaactgaaaagag

SEQ ID NO: 5896249 - DNA, 20 bp, Homo sapiens
ctttagagaagatggatatg

SEQ ID NO: 5896250 - DNA, 21 bp, Homo sapiens
ctttagatagccctgtcctgg

SEQ ID NO: 5896251 - DNA, 17 bp, Homo sapiens
ctttagatgctgatgat

SEQ ID NO: 5896252 - DNA, 23 bp, Homo sapiens
ctttagatgggaagcctgtgtat

SEQ ID NO: 5896253 - DNA, 20 bp, Homo sapiens
ctttagatgtgtatacagaa

SEQ ID NO: 5896254 - DNA, 20 bp, Homo sapiens
ctttagattgaaatttatga

SEQ ID NO: 5896255 - DNA, 16 bp, Homo sapiens
ctttagatttttaaat

SEQ ID NO: 5896256 - DNA, 18 bp, Homo sapiens
ctttagatttttaaattg

SEQ ID NO: 5896257 - DNA, 16 bp, Homo sapiens
ctttagcaaagaactc

SEQ ID NO: 5896258 - DNA, 13 bp, Homo sapiens
ctttagcacgttt

SEQ ID NO: 5896259 - DNA, 17 bp, Homo sapiens
ctttagcacgtttaaag

SEQ ID NO: 5896260 - DNA, 19 bp, Homo sapiens
ctttagcacgtttaaagtt

SEQ ID NO: 5896261 - DNA, 20 bp, Homo sapiens
ctttagcagtttcctcagtg

SEQ ID NO: 5896262 - DNA, 23 bp, Homo sapiens
ctttagcagtttcctcagtgatg

SEQ ID NO: 5896263 - DNA, 21 bp, Homo sapiens
ctttagcatttttatgcagac

SEQ ID NO: 5896264 - DNA, 15 bp, Homo sapiens
ctttagccaaaccct

SEQ ID NO: 5896265 - DNA, 16 bp, Homo sapiens
ctttagccaaaccctt

SEQ ID NO: 5896266 - DNA, 14 bp, Homo sapiens
ctttagcgcccagt

SEQ ID NO: 5896267 - DNA, 15 bp, Homo sapiens
ctttagcgctggctt

SEQ ID NO: 5896268 - DNA, 20 bp, Homo sapiens
ctttagcgggactcagtgag

SEQ ID NO: 5896269 - DNA, 11 bp, Homo sapiens
ctttagctaag

SEQ ID NO: 5896270 - DNA, 12 bp, Homo sapiens
ctttagctctct

SEQ ID NO: 5896271 - DNA, 14 bp, Homo sapiens
ctttagctgacaga

SEQ ID NO: 5896272 - DNA, 13 bp, Homo sapiens
ctttagctgtcac

SEQ ID NO: 5896273 - DNA, 21 bp, Homo sapiens
ctttagctgtgaatggctgtg

SEQ ID NO: 5896274 - DNA, 18 bp, Homo sapiens
ctttagcttacctgggca

SEQ ID NO: 5896275 - DNA, 18 bp, Homo sapiens
ctttagcttatttttaca

SEQ ID NO: 5896276 - DNA, 15 bp, Homo sapiens
ctttagctttctgag

SEQ ID NO: 5896277 - DNA, 12 bp, Homo sapiens
ctttaggagaaa

SEQ ID NO: 5896278 - DNA, 21 bp, Homo sapiens
ctttaggagggagttatctaa

SEQ ID NO: 5896279 - DNA, 15 bp, Homo sapiens
ctttaggcagcctgc

SEQ ID NO: 5896280 - DNA, 19 bp, Homo sapiens
ctttaggcagcctgccgcc

SEQ ID NO: 5896281 - DNA, 22 bp, Homo sapiens
ctttaggcaggttacagttaac

SEQ ID NO: 5896282 - DNA, 15 bp, Homo sapiens
ctttaggcattaaat

SEQ ID NO: 5896283 - DNA, 23 bp, Homo sapiens
ctttaggcattaaattttagcaa

SEQ ID NO: 5896284 - DNA, 22 bp, Homo sapiens
ctttaggccatgggtggaaagt

SEQ ID NO: 5896285 - DNA, 14 bp, Homo sapiens
ctttaggctttcaa

SEQ ID NO: 5896286 - DNA, 21 bp, Homo sapiens
ctttagggactcaatttctcc

SEQ ID NO: 5896287 - DNA, 20 bp, Homo sapiens
ctttagggagacccaataaa

SEQ ID NO: 5896288 - DNA, 21 bp, Homo sapiens
ctttagggagacccaataaag

SEQ ID NO: 5896289 - DNA, 19 bp, Homo sapiens
ctttagggatctggggaag

SEQ ID NO: 5896290 - DNA, 15 bp, Homo sapiens
ctttagggcagcttg

SEQ ID NO: 5896291 - DNA, 19 bp, Homo sapiens
ctttagggggtgggagggg

SEQ ID NO: 5896292 - DNA, 21 bp, Homo sapiens
ctttaggtaaggagaagaggg

SEQ ID NO: 5896293 - DNA, 21 bp, Homo sapiens
ctttaggtcaaactccctagt

SEQ ID NO: 5896294 - DNA, 14 bp, Homo sapiens
ctttaggtctggtt

SEQ ID NO: 5896295 - DNA, 15 bp, Homo sapiens
ctttaggtctttgta

SEQ ID NO: 5896296 - DNA, 17 bp, Homo sapiens
ctttaggtgcctcctgt

SEQ ID NO: 5896297 - DNA, 18 bp, Homo sapiens
ctttaggtgcctcctgtc

SEQ ID NO: 5896298 - DNA, 13 bp, Homo sapiens
ctttaggtttttt

SEQ ID NO: 5896299 - DNA, 13 bp, Homo sapiens
ctttagtaaatga

SEQ ID NO: 5896300 - DNA, 21 bp, Homo sapiens
ctttagtacatggagctcagg

SEQ ID NO: 5896301 - DNA, 17 bp, Homo sapiens
ctttagtatgctggctt

SEQ ID NO: 5896302 - DNA, 17 bp, Homo sapiens
ctttagtattatattaa

SEQ ID NO: 5896303 - DNA, 22 bp, Homo sapiens
ctttagtattcctgtaatacta

SEQ ID NO: 5896304 - DNA, 15 bp, Homo sapiens
ctttagtctgcaaaa

SEQ ID NO: 5896305 - DNA, 20 bp, Homo sapiens
ctttagtgatcacagcagct

SEQ ID NO: 5896306 - DNA, 17 bp, Homo sapiens
ctttagtgattgctttt

SEQ ID NO: 5896307 - DNA, 18 bp, Homo sapiens
ctttagtgattgctttta

SEQ ID NO: 5896308 - DNA, 14 bp, Homo sapiens
ctttagtgccctgc

SEQ ID NO: 5896309 - DNA, 23 bp, Homo sapiens
ctttagtgccctgccccctggct

SEQ ID NO: 5896310 - DNA, 14 bp, Homo sapiens
ctttagtggcttca

SEQ ID NO: 5896311 - DNA, 17 bp, Homo sapiens
ctttagtggtggccatt

SEQ ID NO: 5896312 - DNA, 13 bp, Homo sapiens
ctttagtgtacat

SEQ ID NO: 5896313 - DNA, 18 bp, Homo sapiens
ctttagtgttcaaatact

SEQ ID NO: 5896314 - DNA, 13 bp, Homo sapiens
ctttagttagcat

SEQ ID NO: 5896315 - DNA, 19 bp, Homo sapiens
ctttagttataaaggaatc

SEQ ID NO: 5896316 - DNA, 15 bp, Homo sapiens
ctttagttatattca

SEQ ID NO: 5896317 - DNA, 14 bp, Homo sapiens
ctttagttctgctg

SEQ ID NO: 5896318 - DNA, 20 bp, Homo sapiens
ctttagttctgctgtctccc

SEQ ID NO: 5896319 - DNA, 21 bp, Homo sapiens
ctttagttctgctgtctccct

SEQ ID NO: 5896320 - DNA, 17 bp, Homo sapiens
ctttagttctgctttct

SEQ ID NO: 5896321 - DNA, 20 bp, Homo sapiens
ctttagtttgtgttattatt

SEQ ID NO: 5896322 - DNA, 13 bp, Homo sapiens
ctttagtttttgg

SEQ ID NO: 5896323 - DNA, 22 bp, Homo sapiens
ctttataaaaaaaagttgttta

SEQ ID NO: 5896324 - DNA, 23 bp, Homo sapiens
ctttataaaaaaaagttgtttat

SEQ ID NO: 5896325 - DNA, 17 bp, Homo sapiens
ctttataaaaagtgaaa

SEQ ID NO: 5896326 - DNA, 18 bp, Homo sapiens
ctttataaaaagtgaaat

SEQ ID NO: 5896327 - DNA, 14 bp, Homo sapiens
ctttataaaatgta

SEQ ID NO: 5896328 - DNA, 9 bp, Homo sapiens
ctttataac

SEQ ID NO: 5896329 - DNA, 19 bp, Homo sapiens
ctttataacttaaatattg

SEQ ID NO: 5896330 - DNA, 16 bp, Homo sapiens
ctttataagaaagcct

SEQ ID NO: 5896331 - DNA, 17 bp, Homo sapiens
ctttataagccaatgaa

SEQ ID NO: 5896332 - DNA, 13 bp, Homo sapiens
ctttataatggct

SEQ ID NO: 5896333 - DNA, 17 bp, Homo sapiens
ctttataatggctctgg

SEQ ID NO: 5896334 - DNA, 18 bp, Homo sapiens
ctttataattctttcttt

SEQ ID NO: 5896335 - DNA, 16 bp, Homo sapiens
ctttataatttctacc

SEQ ID NO: 5896336 - DNA, 21 bp, Homo sapiens
ctttataatttctacccatgt

SEQ ID NO: 5896337 - DNA, 18 bp, Homo sapiens
ctttatacaacagtgcta

SEQ ID NO: 5896338 - DNA, 12 bp, Homo sapiens
ctttatacaatt

SEQ ID NO: 5896339 - DNA, 15 bp, Homo sapiens
ctttatacacagtgg

SEQ ID NO: 5896340 - DNA, 15 bp, Homo sapiens
ctttatacagatttt

SEQ ID NO: 5896341 - DNA, 14 bp, Homo sapiens
ctttatacagctgt

SEQ ID NO: 5896342 - DNA, 18 bp, Homo sapiens
ctttatacagttgaattt

SEQ ID NO: 5896343 - DNA, 14 bp, Homo sapiens
ctttatacattagt

SEQ ID NO: 5896344 - DNA, 18 bp, Homo sapiens
ctttatactgtgaagtta

SEQ ID NO: 5896345 - DNA, 16 bp, Homo sapiens
ctttatacttaaacag

SEQ ID NO: 5896346 - DNA, 14 bp, Homo sapiens
ctttatagctctca

SEQ ID NO: 5896347 - DNA, 15 bp, Homo sapiens
ctttatagctctcat

SEQ ID NO: 5896348 - DNA, 13 bp, Homo sapiens
ctttatagtaaaa

SEQ ID NO: 5896349 - DNA, 23 bp, Homo sapiens
ctttatagtgaagtgttaataca

SEQ ID NO: 5896350 - DNA, 16 bp, Homo sapiens
ctttatataaggtcat

SEQ ID NO: 5896351 - DNA, 20 bp, Homo sapiens
ctttatataaggtcatagat

SEQ ID NO: 5896352 - DNA, 22 bp, Homo sapiens
ctttatataaggtcatagattc

SEQ ID NO: 5896353 - DNA, 16 bp, Homo sapiens
ctttatatacaataat

SEQ ID NO: 5896354 - DNA, 22 bp, Homo sapiens
ctttatatacaataatggaaaa

SEQ ID NO: 5896355 - DNA, 23 bp, Homo sapiens
ctttatatacaataatggaaaaa

SEQ ID NO: 5896356 - DNA, 17 bp, Homo sapiens
ctttatatcttgtttac

SEQ ID NO: 5896357 - DNA, 19 bp, Homo sapiens
ctttatatggaacgcattt

SEQ ID NO: 5896358 - DNA, 13 bp, Homo sapiens
ctttatatgtaat

SEQ ID NO: 5896359 - DNA, 12 bp, Homo sapiens
ctttatatttag

SEQ ID NO: 5896360 - DNA, 13 bp, Homo sapiens
ctttatatttagt

SEQ ID NO: 5896361 - DNA, 15 bp, Homo sapiens
ctttatatttatcca

SEQ ID NO: 5896362 - DNA, 18 bp, Homo sapiens
ctttatatttatccacta

SEQ ID NO: 5896363 - DNA, 11 bp, Homo sapiens
ctttatatttc

SEQ ID NO: 5896364 - DNA, 14 bp, Homo sapiens
ctttatatttcaat

SEQ ID NO: 5896365 - DNA, 16 bp, Homo sapiens
ctttatatttcaataa

SEQ ID NO: 5896366 - DNA, 20 bp, Homo sapiens
ctttatatttcaataaatga

SEQ ID NO: 5896367 - DNA, 15 bp, Homo sapiens
ctttatattttctat

SEQ ID NO: 5896368 - DNA, 17 bp, Homo sapiens
ctttatattttgttgtt

SEQ ID NO: 5896369 - DNA, 21 bp, Homo sapiens
ctttatcaaaaaaagactcag

SEQ ID NO: 5896370 - DNA, 14 bp, Homo sapiens
ctttatcaaaatgg

SEQ ID NO: 5896371 - DNA, 12 bp, Homo sapiens
ctttatcacctc

SEQ ID NO: 5896372 - DNA, 20 bp, Homo sapiens
ctttatcacctcattctgaa

SEQ ID NO: 5896373 - DNA, 19 bp, Homo sapiens
ctttatcacctggcttgtt

SEQ ID NO: 5896374 - DNA, 19 bp, Homo sapiens
ctttatcattaaacatgaa

SEQ ID NO: 5896375 - DNA, 22 bp, Homo sapiens
ctttatcattaaacatgaattt

SEQ ID NO: 5896376 - DNA, 15 bp, Homo sapiens
ctttatcattgctaa

SEQ ID NO: 5896377 - DNA, 19 bp, Homo sapiens
ctttatccaatcctcagga

SEQ ID NO: 5896378 - DNA, 17 bp, Homo sapiens
ctttatccccgtttctt

SEQ ID NO: 5896379 - DNA, 21 bp, Homo sapiens
ctttatccccgtttcttgcaa

SEQ ID NO: 5896380 - DNA, 13 bp, Homo sapiens
ctttatcccctcc

SEQ ID NO: 5896381 - DNA, 14 bp, Homo sapiens
ctttatcccctcct

SEQ ID NO: 5896382 - DNA, 15 bp, Homo sapiens
ctttatccctgctta

SEQ ID NO: 5896383 - DNA, 16 bp, Homo sapiens
ctttatccctgcttat

SEQ ID NO: 5896384 - DNA, 19 bp, Homo sapiens
ctttatccctgcttatctg

SEQ ID NO: 5896385 - DNA, 16 bp, Homo sapiens
ctttatcctctttaga

SEQ ID NO: 5896386 - DNA, 22 bp, Homo sapiens
ctttatctaatacctctgtgtg

SEQ ID NO: 5896387 - DNA, 22 bp, Homo sapiens
ctttatctaccaactttcaaga

SEQ ID NO: 5896388 - DNA, 14 bp, Homo sapiens
ctttatctcagcca

SEQ ID NO: 5896389 - DNA, 13 bp, Homo sapiens
ctttatctcctgg

SEQ ID NO: 5896390 - DNA, 16 bp, Homo sapiens
ctttatctctgaggct

SEQ ID NO: 5896391 - DNA, 13 bp, Homo sapiens
ctttatctgcacc

SEQ ID NO: 5896392 - DNA, 13 bp, Homo sapiens
ctttatctgtaat

SEQ ID NO: 5896393 - DNA, 14 bp, Homo sapiens
ctttatctgtcaca

SEQ ID NO: 5896394 - DNA, 13 bp, Homo sapiens
ctttatctgttct

SEQ ID NO: 5896395 - DNA, 15 bp, Homo sapiens
ctttcaccccatcca

SEQ ID NO: 5896396 - DNA, 16 bp, Homo sapiens
ctttcaccccatccac

SEQ ID NO: 5896397 - DNA, 12 bp, Homo sapiens
ctttcacccctc

SEQ ID NO: 5896398 - DNA, 17 bp, Homo sapiens
ctttcacccctcttccc

SEQ ID NO: 5896399 - DNA, 13 bp, Homo sapiens
ctttcacctgggt

SEQ ID NO: 5896400 - DNA, 22 bp, Homo sapiens
ctttcacctgggtgtctgggct

SEQ ID NO: 5896401 - DNA, 16 bp, Homo sapiens
ctttcacctttgtgta

SEQ ID NO: 5896402 - DNA, 15 bp, Homo sapiens
ctttcacgggcccca

SEQ ID NO: 5896403 - DNA, 20 bp, Homo sapiens
ctttcactaaaacacacagg

SEQ ID NO: 5896404 - DNA, 21 bp, Homo sapiens
ctttcactatgtccatgaaaa

SEQ ID NO: 5896405 - DNA, 13 bp, Homo sapiens
ctttcactgaagt

SEQ ID NO: 5896406 - DNA, 14 bp, Homo sapiens
ctttcactggaatg

SEQ ID NO: 5896407 - DNA, 15 bp, Homo sapiens
ctttcactggaatga

SEQ ID NO: 5896408 - DNA, 18 bp, Homo sapiens
ctttcactggaatgaaga

SEQ ID NO: 5896409 - DNA, 16 bp, Homo sapiens
ctttcacttcttccta

SEQ ID NO: 5896410 - DNA, 17 bp, Homo sapiens
ctttcacttcttcctat

SEQ ID NO: 5896411 - DNA, 13 bp, Homo sapiens
ctttcacttcttt

SEQ ID NO: 5896412 - DNA, 15 bp, Homo sapiens
ctttcacttctttcc

SEQ ID NO: 5896413 - DNA, 18 bp, Homo sapiens
ctttcacttctttccctt

SEQ ID NO: 5896414 - DNA, 20 bp, Homo sapiens
ctttcacttctttcccttcc

SEQ ID NO: 5896415 - DNA, 15 bp, Homo sapiens
ctttcacttgatgtt

SEQ ID NO: 5896416 - DNA, 21 bp, Homo sapiens
ctttcagaaatataacacatt

SEQ ID NO: 5896417 - DNA, 21 bp, Homo sapiens
ctttcagaactgctaccatga

SEQ ID NO: 5896418 - DNA, 21 bp, Homo sapiens
ctttcagaagtgcccttcctg

SEQ ID NO: 5896419 - DNA, 15 bp, Homo sapiens
ctttcagaatacaat

SEQ ID NO: 5896420 - DNA, 16 bp, Homo sapiens
ctttcagaatatgtca

SEQ ID NO: 5896421 - DNA, 22 bp, Homo sapiens
ctttcagaatattttcaaaata

SEQ ID NO: 5896422 - DNA, 20 bp, Homo sapiens
ctttcagaatcttttcaatg

SEQ ID NO: 5896423 - DNA, 15 bp, Homo sapiens
ctttcagaatgttgt

SEQ ID NO: 5896424 - DNA, 22 bp, Homo sapiens
ctttcagactctctctgggagg

SEQ ID NO: 5896425 - DNA, 15 bp, Homo sapiens
ctttcagagccagcc

SEQ ID NO: 5896426 - DNA, 19 bp, Homo sapiens
ctttcagagccagcctggc

SEQ ID NO: 5896427 - DNA, 22 bp, Homo sapiens
ctttcagagccagcctggctct

SEQ ID NO: 5896428 - DNA, 14 bp, Homo sapiens
ctttcagagccagt

SEQ ID NO: 5896429 - DNA, 15 bp, Homo sapiens
ctttcagagccagtg

SEQ ID NO: 5896430 - DNA, 13 bp, Homo sapiens
ctttcagagtttt

SEQ ID NO: 5896431 - DNA, 15 bp, Homo sapiens
ctttcagatactgga

SEQ ID NO: 5896432 - DNA, 17 bp, Homo sapiens
ctttcagatgtcttctg

SEQ ID NO: 5896433 - DNA, 21 bp, Homo sapiens
ctttcagatgtcttctgcctg

SEQ ID NO: 5896434 - DNA, 20 bp, Homo sapiens
ctttcagcaagacttctctt

SEQ ID NO: 5896435 - DNA, 21 bp, Homo sapiens
ctttcagcattaggcttttaa

SEQ ID NO: 5896436 - DNA, 12 bp, Homo sapiens
ctttcagccaca

SEQ ID NO: 5896437 - DNA, 20 bp, Homo sapiens
ctttcagccacatgccccag

SEQ ID NO: 5896438 - DNA, 22 bp, Homo sapiens
ctttcagccacatgccccaggc

SEQ ID NO: 5896439 - DNA, 22 bp, Homo sapiens
ctttcagccgactcagcaactt

SEQ ID NO: 5896440 - DNA, 16 bp, Homo sapiens
ctttcagcgcccccag

SEQ ID NO: 5896441 - DNA, 20 bp, Homo sapiens
ctttcagcgcccccaggcct

SEQ ID NO: 5896442 - DNA, 22 bp, Homo sapiens
ctttcagctcatttaatcccag

SEQ ID NO: 5896443 - DNA, 21 bp, Homo sapiens
ctttcagctcctgaccagttg

SEQ ID NO: 5896444 - DNA, 17 bp, Homo sapiens
ctttcagctggcagagt

SEQ ID NO: 5896445 - DNA, 12 bp, Homo sapiens
ctttcagctgtc

SEQ ID NO: 5896446 - DNA, 14 bp, Homo sapiens
ctttcagctgtgct

SEQ ID NO: 5896447 - DNA, 12 bp, Homo sapiens
ctttcaggaagg

SEQ ID NO: 5896448 - DNA, 20 bp, Homo sapiens
ctttcaggaagggagaggag

SEQ ID NO: 5896449 - DNA, 17 bp, Homo sapiens
ctttcaggaagttgctg

SEQ ID NO: 5896450 - DNA, 21 bp, Homo sapiens
ctttcaggatctatttttgga

SEQ ID NO: 5896451 - DNA, 12 bp, Homo sapiens
ctttcaggccta

SEQ ID NO: 5896452 - DNA, 20 bp, Homo sapiens
ctttcaggctacctttttct

SEQ ID NO: 5896453 - DNA, 14 bp, Homo sapiens
ctttcaggctactg

SEQ ID NO: 5896454 - DNA, 16 bp, Homo sapiens
ctttcagggcagcccc

SEQ ID NO: 5896455 - DNA, 13 bp, Homo sapiens
ctttcagggcctc

SEQ ID NO: 5896456 - DNA, 21 bp, Homo sapiens
ctttcaggggggttgtgaggc

SEQ ID NO: 5896457 - DNA, 16 bp, Homo sapiens
ctttcaggtccaggcc

SEQ ID NO: 5896458 - DNA, 14 bp, Homo sapiens
ctttcagtactttt

SEQ ID NO: 5896459 - DNA, 15 bp, Homo sapiens
ctttcagtgaaagca

SEQ ID NO: 5896460 - DNA, 22 bp, Homo sapiens
ctttcagtgatatctttctcat

SEQ ID NO: 5896461 - DNA, 21 bp, Homo sapiens
ctttcagtgcagtttcttttc

SEQ ID NO: 5896462 - DNA, 22 bp, Homo sapiens
ctttcagtgcagtttcttttca

SEQ ID NO: 5896463 - DNA, 17 bp, Homo sapiens
ctttcagtgcctgctgt

SEQ ID NO: 5896464 - DNA, 20 bp, Homo sapiens
ctttcagtgcctgctgttcg

SEQ ID NO: 5896465 - DNA, 20 bp, Homo sapiens
ctttcagttcgtttgtattc

SEQ ID NO: 5896466 - DNA, 22 bp, Homo sapiens
ctttcagtttgtccacacaaga

SEQ ID NO: 5896467 - DNA, 18 bp, Homo sapiens
ctttcataatctttgctt

SEQ ID NO: 5896468 - DNA, 16 bp, Homo sapiens
ctttcataatttttaa

SEQ ID NO: 5896469 - DNA, 11 bp, Homo sapiens
ctttcatacca

SEQ ID NO: 5896470 - DNA, 19 bp, Homo sapiens
ctttcatacgtaaaggtgc

SEQ ID NO: 5896471 - DNA, 17 bp, Homo sapiens
ctttcatagcactgcag

SEQ ID NO: 5896472 - DNA, 15 bp, Homo sapiens
ctttcatagttctgt

SEQ ID NO: 5896473 - DNA, 23 bp, Homo sapiens
ctttcatagttctgttaaatatt

SEQ ID NO: 5896474 - DNA, 14 bp, Homo sapiens
ctttcatagtttat

SEQ ID NO: 5896475 - DNA, 20 bp, Homo sapiens
ctttcatatgaggggaccca

SEQ ID NO: 5896476 - DNA, 22 bp, Homo sapiens
ctttcatatgaggggacccagc

SEQ ID NO: 5896477 - DNA, 16 bp, Homo sapiens
ctttcatattttaaac

SEQ ID NO: 5896478 - DNA, 18 bp, Homo sapiens
ctttcatcacactgggtg

SEQ ID NO: 5896479 - DNA, 19 bp, Homo sapiens
ctttcatcacactgggtgg

SEQ ID NO: 5896480 - DNA, 15 bp, Homo sapiens
ctttcatccaactct

SEQ ID NO: 5896481 - DNA, 19 bp, Homo sapiens
ctttcatccagccactgcc

SEQ ID NO: 5896482 - DNA, 14 bp, Homo sapiens
ctttcatcctcagc

SEQ ID NO: 5896483 - DNA, 20 bp, Homo sapiens
ctttcatcctgactctgccc

SEQ ID NO: 5896484 - DNA, 12 bp, Homo sapiens
ctttcatcctgt

SEQ ID NO: 5896485 - DNA, 14 bp, Homo sapiens
ctttcatcctgtgt

SEQ ID NO: 5896486 - DNA, 16 bp, Homo sapiens
ctttcatccttgacta

SEQ ID NO: 5896487 - DNA, 18 bp, Homo sapiens
ctttcatctcctgagtat

SEQ ID NO: 5896488 - DNA, 16 bp, Homo sapiens
ctttcatcttaaacta

SEQ ID NO: 5896489 - DNA, 16 bp, Homo sapiens
ctttcatcttgaagtt

SEQ ID NO: 5896490 - DNA, 22 bp, Homo sapiens
ctttcatgaccactgggcctgc

SEQ ID NO: 5896491 - DNA, 18 bp, Homo sapiens
ctttcatgagtttttccc

SEQ ID NO: 5896492 - DNA, 22 bp, Homo sapiens
ctttcatgagtttttcccagct

SEQ ID NO: 5896493 - DNA, 13 bp, Homo sapiens
ctttcatgctaca

SEQ ID NO: 5896494 - DNA, 20 bp, Homo sapiens
ctttcatgtaaactgtgcac

SEQ ID NO: 5896495 - DNA, 17 bp, Homo sapiens
ctttcatgtcttgtcat

SEQ ID NO: 5896496 - DNA, 22 bp, Homo sapiens
ctttcatgtcttgtcatacaaa

SEQ ID NO: 5896497 - DNA, 24 bp, Homo sapiens
ctttcattaccctacagacagctt

SEQ ID NO: 5896498 - DNA, 19 bp, Homo sapiens
ctttcattacttttaaaaa

SEQ ID NO: 5896499 - DNA, 16 bp, Homo sapiens
ctttcattaggcaaag

SEQ ID NO: 5896500 - DNA, 15 bp, Homo sapiens
ctttcattcagctaa

SEQ ID NO: 5896501 - DNA, 16 bp, Homo sapiens
ctttcattccctttca

SEQ ID NO: 5896502 - DNA, 17 bp, Homo sapiens
ctttcattgctaagact

SEQ ID NO: 5896503 - DNA, 16 bp, Homo sapiens
ctttcatttactgtgg

SEQ ID NO: 5896504 - DNA, 20 bp, Homo sapiens
ctttcatttcgtatttctca

SEQ ID NO: 5896505 - DNA, 14 bp, Homo sapiens
ctttcatttgctat

SEQ ID NO: 5896506 - DNA, 14 bp, Homo sapiens
ctttcatttgcttt

SEQ ID NO: 5896507 - DNA, 17 bp, Homo sapiens
ctttcattttctgtttg

SEQ ID NO: 5896508 - DNA, 15 bp, Homo sapiens
ctttcattttctttc

SEQ ID NO: 5896509 - DNA, 17 bp, Homo sapiens
ctttcattttctttcct

SEQ ID NO: 5896510 - DNA, 15 bp, Homo sapiens
ctttcattttgcttt

SEQ ID NO: 5896511 - DNA, 21 bp, Homo sapiens
ctttcattttgctttaatttt

SEQ ID NO: 5896512 - DNA, 14 bp, Homo sapiens
ctttcatttttgac

SEQ ID NO: 5896513 - DNA, 16 bp, Homo sapiens
ctttcatttttttcca

SEQ ID NO: 5896514 - DNA, 17 bp, Homo sapiens
ctttccaaaacatttct

SEQ ID NO: 5896515 - DNA, 17 bp, Homo sapiens
ctttccaaaatttttca

SEQ ID NO: 5896516 - DNA, 22 bp, Homo sapiens
ctttccaaagtacactgtttca

SEQ ID NO: 5896517 - DNA, 22 bp, Homo sapiens
ctttccaaatacccaaatgtcc

SEQ ID NO: 5896518 - DNA, 13 bp, Homo sapiens
ctttccaaattaa

SEQ ID NO: 5896519 - DNA, 14 bp, Homo sapiens
ctttccaaattaaa

SEQ ID NO: 5896520 - DNA, 19 bp, Homo sapiens
ctttccaaattaaaacaaa

SEQ ID NO: 5896521 - DNA, 20 bp, Homo sapiens
ctttccaaattatttcttaa

SEQ ID NO: 5896522 - DNA, 15 bp, Homo sapiens
ctttccaacctcact

SEQ ID NO: 5896523 - DNA, 18 bp, Homo sapiens
ctttccaacttttcatcc

SEQ ID NO: 5896524 - DNA, 16 bp, Homo sapiens
ctttccaatagaaaga

SEQ ID NO: 5896525 - DNA, 22 bp, Homo sapiens
ctttccaatagaaagaaactaa

SEQ ID NO: 5896526 - DNA, 15 bp, Homo sapiens
ctttccaatgccaca

SEQ ID NO: 5896527 - DNA, 17 bp, Homo sapiens
ctttccaatgccacaga

SEQ ID NO: 5896528 - DNA, 16 bp, Homo sapiens
ctttccaattctcctt

SEQ ID NO: 5896529 - DNA, 17 bp, Homo sapiens
ctttccaattctccttt

SEQ ID NO: 5896530 - DNA, 18 bp, Homo sapiens
ctttccaattctccttta

SEQ ID NO: 5896531 - DNA, 23 bp, Homo sapiens
ctttccaccaactttttccaagt

SEQ ID NO: 5896532 - DNA, 21 bp, Homo sapiens
ctttccaccacagccagcacc

SEQ ID NO: 5896533 - DNA, 19 bp, Homo sapiens
ctttccacccagaccctcc

SEQ ID NO: 5896534 - DNA, 23 bp, Homo sapiens
ctttccacccagaccctccttcc

SEQ ID NO: 5896535 - DNA, 24 bp, Homo sapiens
ctttccacccagaccctccttccc

SEQ ID NO: 5896536 - DNA, 17 bp, Homo sapiens
ctttccaccctattccc

SEQ ID NO: 5896537 - DNA, 15 bp, Homo sapiens
ctttccaccttctca

SEQ ID NO: 5896538 - DNA, 18 bp, Homo sapiens
ctttccactcctcctagc

SEQ ID NO: 5896539 - DNA, 21 bp, Homo sapiens
ctttccactcctcctagccac

SEQ ID NO: 5896540 - DNA, 11 bp, Homo sapiens
ctttccactgc

SEQ ID NO: 5896541 - DNA, 19 bp, Homo sapiens
ctttccacttccagagggg

SEQ ID NO: 5896542 - DNA, 16 bp, Homo sapiens
ctttccacttctctgg

SEQ ID NO: 5896543 - DNA, 9 bp, Homo sapiens
ctttccaga

SEQ ID NO: 5896544 - DNA, 19 bp, Homo sapiens
ctttccagaaggccacagg

SEQ ID NO: 5896545 - DNA, 20 bp, Homo sapiens
ctttccagaaggccacaggc

SEQ ID NO: 5896546 - DNA, 17 bp, Homo sapiens
ctttccagaatgacctt

SEQ ID NO: 5896547 - DNA, 21 bp, Homo sapiens
ctttccagaatgaccttgagt

SEQ ID NO: 5896548 - DNA, 18 bp, Homo sapiens
ctttccagagaactgcag

SEQ ID NO: 5896549 - DNA, 22 bp, Homo sapiens
ctttccagcctatatttcctct

SEQ ID NO: 5896550 - DNA, 16 bp, Homo sapiens
ctttccagctactttt

SEQ ID NO: 5896551 - DNA, 13 bp, Homo sapiens
ctttccagctcac

SEQ ID NO: 5896552 - DNA, 16 bp, Homo sapiens
ctttccagcttagaat

SEQ ID NO: 5896553 - DNA, 14 bp, Homo sapiens
ctttccaggaaggc

SEQ ID NO: 5896554 - DNA, 12 bp, Homo sapiens
ctttccaggcac

SEQ ID NO: 5896555 - DNA, 18 bp, Homo sapiens
ctttccaggcaccctcag

SEQ ID NO: 5896556 - DNA, 20 bp, Homo sapiens
ctttccaggcaccctcaggg

SEQ ID NO: 5896557 - DNA, 23 bp, Homo sapiens
ctttccaggctatgtataaaata

SEQ ID NO: 5896558 - DNA, 23 bp, Homo sapiens
ctttccaggggccaattttggat

SEQ ID NO: 5896559 - DNA, 18 bp, Homo sapiens
ctttccagggtcaaagta

SEQ ID NO: 5896560 - DNA, 14 bp, Homo sapiens
ctttccagggtctt

SEQ ID NO: 5896561 - DNA, 17 bp, Homo sapiens
ctttccagggttattta

SEQ ID NO: 5896562 - DNA, 16 bp, Homo sapiens
ctttccagtatgaaaa

SEQ ID NO: 5896563 - DNA, 20 bp, Homo sapiens
ctttccataaatccttgatg

SEQ ID NO: 5896564 - DNA, 15 bp, Homo sapiens
ctttccatcacccca

SEQ ID NO: 5896565 - DNA, 19 bp, Homo sapiens
ctttccatcagctttataa

SEQ ID NO: 5896566 - DNA, 17 bp, Homo sapiens
ctttccatctctgcctg

SEQ ID NO: 5896567 - DNA, 14 bp, Homo sapiens
ctttccatctgctt

SEQ ID NO: 5896568 - DNA, 14 bp, Homo sapiens
ctttccatctgtcc

SEQ ID NO: 5896569 - DNA, 15 bp, Homo sapiens
ctttccatctgtcca

SEQ ID NO: 5896570 - DNA, 19 bp, Homo sapiens
ctttccatgacacccaagg

SEQ ID NO: 5896571 - DNA, 14 bp, Homo sapiens
ctttccatgacagt

SEQ ID NO: 5896572 - DNA, 19 bp, Homo sapiens
ctttccatgacagtagcat

SEQ ID NO: 5896573 - DNA, 21 bp, Homo sapiens
ctttctgaaaatttatataac

SEQ ID NO: 5896574 - DNA, 13 bp, Homo sapiens
ctttctgaaactc

SEQ ID NO: 5896575 - DNA, 13 bp, Homo sapiens
ctttctgaaattc

SEQ ID NO: 5896576 - DNA, 13 bp, Homo sapiens
ctttctgaacagc

SEQ ID NO: 5896577 - DNA, 14 bp, Homo sapiens
ctttctgaacagct

SEQ ID NO: 5896578 - DNA, 17 bp, Homo sapiens
ctttctgaacagctggt

SEQ ID NO: 5896579 - DNA, 18 bp, Homo sapiens
ctttctgaagatcaattt

SEQ ID NO: 5896580 - DNA, 21 bp, Homo sapiens
ctttctgaaggaagagaagac

SEQ ID NO: 5896581 - DNA, 22 bp, Homo sapiens
ctttctgaatttcattctcttg

SEQ ID NO: 5896582 - DNA, 22 bp, Homo sapiens
ctttctgacaataaataatatt

SEQ ID NO: 5896583 - DNA, 15 bp, Homo sapiens
ctttctgacatcagc

SEQ ID NO: 5896584 - DNA, 19 bp, Homo sapiens
ctttctgactctaaaatat

SEQ ID NO: 5896585 - DNA, 23 bp, Homo sapiens
ctttctgactgcaacttctgtcc

SEQ ID NO: 5896586 - DNA, 17 bp, Homo sapiens
ctttctgagcacacttt

SEQ ID NO: 5896587 - DNA, 17 bp, Homo sapiens
ctttctgagtgacatgg

SEQ ID NO: 5896588 - DNA, 19 bp, Homo sapiens
ctttctgagtgagttttac

SEQ ID NO: 5896589 - DNA, 20 bp, Homo sapiens
ctttctgagtgagttttact

SEQ ID NO: 5896590 - DNA, 23 bp, Homo sapiens
ctttctgagtgagttttactctt

SEQ ID NO: 5896591 - DNA, 21 bp, Homo sapiens
ctttctgataactagatggtg

SEQ ID NO: 5896592 - DNA, 16 bp, Homo sapiens
ctttctgatacatctg

SEQ ID NO: 5896593 - DNA, 17 bp, Homo sapiens
ctttctgatcaaggcct

SEQ ID NO: 5896594 - DNA, 14 bp, Homo sapiens
ctttctgatgtctt

SEQ ID NO: 5896595 - DNA, 20 bp, Homo sapiens
ctttctgattccgcaccctg

SEQ ID NO: 5896596 - DNA, 19 bp, Homo sapiens
ctttctgcacacaaatatt

SEQ ID NO: 5896597 - DNA, 14 bp, Homo sapiens
ctttctgcagaaaa

SEQ ID NO: 5896598 - DNA, 15 bp, Homo sapiens
ctttctgcagaaaca

SEQ ID NO: 5896599 - DNA, 14 bp, Homo sapiens
ctttctgcagactg

SEQ ID NO: 5896600 - DNA, 15 bp, Homo sapiens
ctttctgcagttttt

SEQ ID NO: 5896601 - DNA, 12 bp, Homo sapiens
ctttctgcccag

SEQ ID NO: 5896602 - DNA, 18 bp, Homo sapiens
ctttctgccccccagggc

SEQ ID NO: 5896603 - DNA, 18 bp, Homo sapiens
ctttctgccgacccctag

SEQ ID NO: 5896604 - DNA, 15 bp, Homo sapiens
ctttctgcctctcaa

SEQ ID NO: 5896605 - DNA, 12 bp, Homo sapiens
ctttctgcctgg

SEQ ID NO: 5896606 - DNA, 15 bp, Homo sapiens
ctttctgcctggagt

SEQ ID NO: 5896607 - DNA, 16 bp, Homo sapiens
ctttctgccttggcct

SEQ ID NO: 5896608 - DNA, 19 bp, Homo sapiens
ctttctgctatgtgtggta

SEQ ID NO: 5896609 - DNA, 16 bp, Homo sapiens
ctttctgctcagcttc

SEQ ID NO: 5896610 - DNA, 19 bp, Homo sapiens
ctttctgctcagcttctcc

SEQ ID NO: 5896611 - DNA, 21 bp, Homo sapiens
ctttctgctcctttctccaca

SEQ ID NO: 5896612 - DNA, 19 bp, Homo sapiens
ctttctgctctgccatctt

SEQ ID NO: 5896613 - DNA, 22 bp, Homo sapiens
ctttctgctctgccatcttcag

SEQ ID NO: 5896614 - DNA, 19 bp, Homo sapiens
ctttctgctggaagctgtc

SEQ ID NO: 5896615 - DNA, 20 bp, Homo sapiens
ctttctggaaaaacaggata

SEQ ID NO: 5896616 - DNA, 22 bp, Homo sapiens
ctttctggaaattcttccctgg

SEQ ID NO: 5896617 - DNA, 23 bp, Homo sapiens
ctttctggaaattcttccctggg

SEQ ID NO: 5896618 - DNA, 13 bp, Homo sapiens
ctttctggactgg

SEQ ID NO: 5896619 - DNA, 23 bp, Homo sapiens
ctttctggattattctgggggct

SEQ ID NO: 5896620 - DNA, 11 bp, Homo sapiens
ctttctggcaa

SEQ ID NO: 5896621 - DNA, 14 bp, Homo sapiens
ctttctggcctgtt

SEQ ID NO: 5896622 - DNA, 17 bp, Homo sapiens
ctttctggctatgcatt

SEQ ID NO: 5896623 - DNA, 18 bp, Homo sapiens
ctttctggctatgcattt

SEQ ID NO: 5896624 - DNA, 14 bp, Homo sapiens
ctttctgggagcag

SEQ ID NO: 5896625 - DNA, 15 bp, Homo sapiens
ctttctgggagcaga

SEQ ID NO: 5896626 - DNA, 17 bp, Homo sapiens
ctttctgggagcagaaa

SEQ ID NO: 5896627 - DNA, 12 bp, Homo sapiens
ctttctgggagg

SEQ ID NO: 5896628 - DNA, 12 bp, Homo sapiens
ctttctgggatg

SEQ ID NO: 5896629 - DNA, 13 bp, Homo sapiens
ctttctgggctct

SEQ ID NO: 5896630 - DNA, 18 bp, Homo sapiens
ctttctgggctctggact

SEQ ID NO: 5896631 - DNA, 12 bp, Homo sapiens
ctttctgggctt

SEQ ID NO: 5896632 - DNA, 13 bp, Homo sapiens
ctttctgggcttt

SEQ ID NO: 5896633 - DNA, 20 bp, Homo sapiens
ctttctggggcctaataaaa

SEQ ID NO: 5896634 - DNA, 23 bp, Homo sapiens
ctttctggggcctaataaaactg

SEQ ID NO: 5896635 - DNA, 22 bp, Homo sapiens
ctttctggggggatatttccta

SEQ ID NO: 5896636 - DNA, 19 bp, Homo sapiens
ctttctggtgttttatttc

SEQ ID NO: 5896637 - DNA, 20 bp, Homo sapiens
ctttctgtaaacagaataaa

SEQ ID NO: 5896638 - DNA, 17 bp, Homo sapiens
ctttctgtaccatttat

SEQ ID NO: 5896639 - DNA, 20 bp, Homo sapiens
ctttctgtactaaacatttc

SEQ ID NO: 5896640 - DNA, 16 bp, Homo sapiens
ctttctgtattgagta

SEQ ID NO: 5896641 - DNA, 18 bp, Homo sapiens
ctttctgtcccttctgtc

SEQ ID NO: 5896642 - DNA, 23 bp, Homo sapiens
ctttctgtctaggttaaagctaa

SEQ ID NO: 5896643 - DNA, 20 bp, Homo sapiens
ctttctgtctcccttctctc

SEQ ID NO: 5896644 - DNA, 13 bp, Homo sapiens
ctttctgtcttgt

SEQ ID NO: 5896645 - DNA, 15 bp, Homo sapiens
ctttctgtcttgtta

SEQ ID NO: 5896646 - DNA, 21 bp, Homo sapiens
ctttctgtgaagctaatacaa

SEQ ID NO: 5896647 - DNA, 12 bp, Homo sapiens
ctttctgtgcat

SEQ ID NO: 5896648 - DNA, 23 bp, Homo sapiens
ctttctgtggctaaacagatgta

SEQ ID NO: 5896649 - DNA, 19 bp, Homo sapiens
ctttctgtgtaccactggg

SEQ ID NO: 5896650 - DNA, 15 bp, Homo sapiens
ctttctgtgtgcacc

SEQ ID NO: 5896651 - DNA, 19 bp, Homo sapiens
ctttctgtgtttattcaaa

SEQ ID NO: 5896652 - DNA, 15 bp, Homo sapiens
ctttctgttaaaatg

SEQ ID NO: 5896653 - DNA, 16 bp, Homo sapiens
ctttctgttaaaatgc

SEQ ID NO: 5896654 - DNA, 15 bp, Homo sapiens
ctttctgttatcaag

SEQ ID NO: 5896655 - DNA, 14 bp, Homo sapiens
ctttctgttcatct

SEQ ID NO: 5896656 - DNA, 22 bp, Homo sapiens
ctttctgttcatctctttgtcc

SEQ ID NO: 5896657 - DNA, 15 bp, Homo sapiens
ctttctgttccaaat

SEQ ID NO: 5896658 - DNA, 21 bp, Homo sapiens
ctttctgttccttcctccact

SEQ ID NO: 5896659 - DNA, 23 bp, Homo sapiens
ctttctgttccttcctccactgc

SEQ ID NO: 5896660 - DNA, 16 bp, Homo sapiens
ctttctgttgaaaagc

SEQ ID NO: 5896661 - DNA, 21 bp, Homo sapiens
ctttctgttgaaaagcacaca

SEQ ID NO: 5896662 - DNA, 16 bp, Homo sapiens
ctttctgttgagagaa

SEQ ID NO: 5896663 - DNA, 14 bp, Homo sapiens
ctttctgttgtcat

SEQ ID NO: 5896664 - DNA, 21 bp, Homo sapiens
ctttctgttgtcattgctgtt

SEQ ID NO: 5896665 - DNA, 22 bp, Homo sapiens
ctttctgttgtcattgctgttg

SEQ ID NO: 5896666 - DNA, 12 bp, Homo sapiens
ctttctgtttcc

SEQ ID NO: 5896667 - DNA, 16 bp, Homo sapiens
ctttctgtttcctggc

SEQ ID NO: 5896668 - DNA, 22 bp, Homo sapiens
ctttctgtttcctggcctcaga

SEQ ID NO: 5896669 - DNA, 22 bp, Homo sapiens
ctttcttaagccctttgctctg

SEQ ID NO: 5896670 - DNA, 21 bp, Homo sapiens
ctttcttaatatttttacatg

SEQ ID NO: 5896671 - DNA, 22 bp, Homo sapiens
ctttcttacaaggaaggtggtg

SEQ ID NO: 5896672 - DNA, 21 bp, Homo sapiens
ctttcttacacaagagctgga

SEQ ID NO: 5896673 - DNA, 23 bp, Homo sapiens
ctttcttacctactattggccct

SEQ ID NO: 5896674 - DNA, 13 bp, Homo sapiens
ctttcttagaaat

SEQ ID NO: 5896675 - DNA, 14 bp, Homo sapiens
ctttcttagaaatt

SEQ ID NO: 5896676 - DNA, 21 bp, Homo sapiens
ctttcttataatactctgttg

SEQ ID NO: 5896677 - DNA, 22 bp, Homo sapiens
ctttcttatcctagcacatgct

SEQ ID NO: 5896678 - DNA, 23 bp, Homo sapiens
ctttcttattcagtgaaaaagat

SEQ ID NO: 5896679 - DNA, 20 bp, Homo sapiens
ctttcttattttgtaataaa

SEQ ID NO: 5896680 - DNA, 15 bp, Homo sapiens
ctttcttcaaaatat

SEQ ID NO: 5896681 - DNA, 23 bp, Homo sapiens
ctttcttcaccaagtgcaataga

SEQ ID NO: 5896682 - DNA, 13 bp, Homo sapiens
ctttcttcatgtt

SEQ ID NO: 5896683 - DNA, 18 bp, Homo sapiens
ctttcttccacccacaaa

SEQ ID NO: 5896684 - DNA, 15 bp, Homo sapiens
ctttcttccattcct

SEQ ID NO: 5896685 - DNA, 14 bp, Homo sapiens
ctttcttccccacc

SEQ ID NO: 5896686 - DNA, 13 bp, Homo sapiens
ctttcttccgcac

SEQ ID NO: 5896687 - DNA, 12 bp, Homo sapiens
ctttcttcctca

SEQ ID NO: 5896688 - DNA, 17 bp, Homo sapiens
ctttcttcctcattccc

SEQ ID NO: 5896689 - DNA, 14 bp, Homo sapiens
ctttcttcctccag

SEQ ID NO: 5896690 - DNA, 17 bp, Homo sapiens
ctttcttcctccagtct

SEQ ID NO: 5896691 - DNA, 13 bp, Homo sapiens
ctttcttcctctg

SEQ ID NO: 5896692 - DNA, 13 bp, Homo sapiens
ctttcttcctgca

SEQ ID NO: 5896693 - DNA, 11 bp, Homo sapiens
ctttcttcctt

SEQ ID NO: 5896694 - DNA, 13 bp, Homo sapiens
ctttcttccttcc

SEQ ID NO: 5896695 - DNA, 14 bp, Homo sapiens
ctttcttccttcct

SEQ ID NO: 5896696 - DNA, 13 bp, Homo sapiens
ctttcttctaaat

SEQ ID NO: 5896697 - DNA, 20 bp, Homo sapiens
ctttcttctacaaccagagc

SEQ ID NO: 5896698 - DNA, 15 bp, Homo sapiens
ctttcttctagtatt

SEQ ID NO: 5896699 - DNA, 15 bp, Homo sapiens
ctttcttctcctgtg

SEQ ID NO: 5896700 - DNA, 16 bp, Homo sapiens
ctttcttctcctgtga

SEQ ID NO: 5896701 - DNA, 18 bp, Homo sapiens
ctttcttctcgcctagga

SEQ ID NO: 5896702 - DNA, 15 bp, Homo sapiens
ctttcttctctgcct

SEQ ID NO: 5896703 - DNA, 16 bp, Homo sapiens
ctttcttctctgcctc

SEQ ID NO: 5896704 - DNA, 18 bp, Homo sapiens
ctttcttctctgcctcct

SEQ ID NO: 5896705 - DNA, 19 bp, Homo sapiens
ctttcttctctgcctcctc

SEQ ID NO: 5896706 - DNA, 23 bp, Homo sapiens
ctttcttctctgcctcctcctca

SEQ ID NO: 5896707 - DNA, 15 bp, Homo sapiens
ctttcttctgccctt

SEQ ID NO: 5896708 - DNA, 13 bp, Homo sapiens
ctttcttctgtgt

SEQ ID NO: 5896709 - DNA, 16 bp, Homo sapiens
ctttcttctttccaga

SEQ ID NO: 5896710 - DNA, 11 bp, Homo sapiens
ctttcttgaaa

SEQ ID NO: 5896711 - DNA, 17 bp, Homo sapiens
ctttcttgagcaccagg

SEQ ID NO: 5896712 - DNA, 13 bp, Homo sapiens
ctttcttgcactg

SEQ ID NO: 5896713 - DNA, 18 bp, Homo sapiens
ctttcttgcactgtccag

SEQ ID NO: 5896714 - DNA, 20 bp, Homo sapiens
ctttcttgcatgaatcagat

SEQ ID NO: 5896715 - DNA, 19 bp, Homo sapiens
ctttcttgctcccttcagc

SEQ ID NO: 5896716 - DNA, 17 bp, Homo sapiens
ctttcttgctggctctg

SEQ ID NO: 5896717 - DNA, 21 bp, Homo sapiens
ctttcttgctggctctgagaa

SEQ ID NO: 5896718 - DNA, 16 bp, Homo sapiens
ctttcttgctggttgt

SEQ ID NO: 5896719 - DNA, 21 bp, Homo sapiens
ctttcttgggatagtgttctg

SEQ ID NO: 5896720 - DNA, 19 bp, Homo sapiens
ctttcttgtaaggcatact

SEQ ID NO: 5896721 - DNA, 20 bp, Homo sapiens
ctttcttgtctttcctccta

SEQ ID NO: 5896722 - DNA, 21 bp, Homo sapiens
ctttcttgtcttttcagaagc

SEQ ID NO: 5896723 - DNA, 11 bp, Homo sapiens
ctttcttgttt

SEQ ID NO: 5896724 - DNA, 12 bp, Homo sapiens
ctttcttgtttc

SEQ ID NO: 5896725 - DNA, 13 bp, Homo sapiens
ctttcttgtttct

SEQ ID NO: 5896726 - DNA, 23 bp, Homo sapiens
ctttcttgtttgtcagcatctga

SEQ ID NO: 5896727 - DNA, 18 bp, Homo sapiens
ctttctttaaaagaaact

SEQ ID NO: 5896728 - DNA, 19 bp, Homo sapiens
ctttctttaaaagaaactt

SEQ ID NO: 5896729 - DNA, 17 bp, Homo sapiens
ctttctttaaagttctt

SEQ ID NO: 5896730 - DNA, 16 bp, Homo sapiens
ctttctttaaatgttt

SEQ ID NO: 5896731 - DNA, 13 bp, Homo sapiens
ctttctttaaatt

SEQ ID NO: 5896732 - DNA, 14 bp, Homo sapiens
ctttctttaatagt

SEQ ID NO: 5896733 - DNA, 12 bp, Homo sapiens
ctttctttactc

SEQ ID NO: 5896734 - DNA, 19 bp, Homo sapiens
ctttctttactcctttggc

SEQ ID NO: 5896735 - DNA, 15 bp, Homo sapiens
ctttctttattttga

SEQ ID NO: 5896736 - DNA, 16 bp, Homo sapiens
ctttctttcagatgtt

SEQ ID NO: 5896737 - DNA, 21 bp, Homo sapiens
ctttctttccaaaacatttct

SEQ ID NO: 5896738 - DNA, 15 bp, Homo sapiens
ctttctttccaaagg

SEQ ID NO: 5896739 - DNA, 15 bp, Homo sapiens
ctttctttccttaat

SEQ ID NO: 5896740 - DNA, 14 bp, Homo sapiens
ctttctttcttaag

SEQ ID NO: 5896741 - DNA, 16 bp, Homo sapiens
ctttctttcttagaaa

SEQ ID NO: 5896742 - DNA, 17 bp, Homo sapiens
ctttctttcttagaaat

SEQ ID NO: 5896743 - DNA, 14 bp, Homo sapiens
ctttctttcttccc

SEQ ID NO: 5896744 - DNA, 16 bp, Homo sapiens
ctttctttcttttgca

SEQ ID NO: 5896745 - DNA, 12 bp, Homo sapiens
ctttctttgatt

SEQ ID NO: 5896746 - DNA, 19 bp, Homo sapiens
ctttctttgcaacagcagt

SEQ ID NO: 5896747 - DNA, 17 bp, Homo sapiens
ctttctttgcaccaaag

SEQ ID NO: 5896748 - DNA, 14 bp, Homo sapiens
ctttctttgcctct

SEQ ID NO: 5896749 - DNA, 16 bp, Homo sapiens
ctttctttgcctctgc

SEQ ID NO: 5896750 - DNA, 17 bp, Homo sapiens
ctttctttgcctctgca

SEQ ID NO: 5896751 - DNA, 18 bp, Homo sapiens
ctttctttgcctctgcag

SEQ ID NO: 5896752 - DNA, 22 bp, Homo sapiens
ctttgctcttgtcggggtgggg

SEQ ID NO: 5896753 - DNA, 18 bp, Homo sapiens
ctttgctgaagaatattt

SEQ ID NO: 5896754 - DNA, 22 bp, Homo sapiens
ctttgctgaagtctccccgcag

SEQ ID NO: 5896755 - DNA, 16 bp, Homo sapiens
ctttgctgaatgtcat

SEQ ID NO: 5896756 - DNA, 18 bp, Homo sapiens
ctttgctgaatgtcatta

SEQ ID NO: 5896757 - DNA, 19 bp, Homo sapiens
ctttgctgaatgtcattat

SEQ ID NO: 5896758 - DNA, 21 bp, Homo sapiens
ctttgctgacactgtgaccct

SEQ ID NO: 5896759 - DNA, 13 bp, Homo sapiens
ctttgctgaccct

SEQ ID NO: 5896760 - DNA, 14 bp, Homo sapiens
ctttgctgaccctc

SEQ ID NO: 5896761 - DNA, 17 bp, Homo sapiens
ctttgctgcacagcagg

SEQ ID NO: 5896762 - DNA, 11 bp, Homo sapiens
ctttgctgcag

SEQ ID NO: 5896763 - DNA, 15 bp, Homo sapiens
ctttgctgcagagaa

SEQ ID NO: 5896764 - DNA, 22 bp, Homo sapiens
ctttgctgcagagatcaagggt

SEQ ID NO: 5896765 - DNA, 19 bp, Homo sapiens
ctttgctgcattttacaca

SEQ ID NO: 5896766 - DNA, 20 bp, Homo sapiens
ctttgctgcccaatccatta

SEQ ID NO: 5896767 - DNA, 11 bp, Homo sapiens
ctttgctgcct

SEQ ID NO: 5896768 - DNA, 12 bp, Homo sapiens
ctttgctgcctt

SEQ ID NO: 5896769 - DNA, 17 bp, Homo sapiens
ctttgctgccttctgtc

SEQ ID NO: 5896770 - DNA, 18 bp, Homo sapiens
ctttgctgccttctgtct

SEQ ID NO: 5896771 - DNA, 13 bp, Homo sapiens
ctttgctgctaca

SEQ ID NO: 5896772 - DNA, 23 bp, Homo sapiens
ctttgctgctatgaaaatgagca

SEQ ID NO: 5896773 - DNA, 15 bp, Homo sapiens
ctttgctgctgctct

SEQ ID NO: 5896774 - DNA, 16 bp, Homo sapiens
ctttgctgctgtggaa

SEQ ID NO: 5896775 - DNA, 14 bp, Homo sapiens
ctttgctgctttgt

SEQ ID NO: 5896776 - DNA, 14 bp, Homo sapiens
ctttgctggaagaa

SEQ ID NO: 5896777 - DNA, 18 bp, Homo sapiens
ctttgctggaagaaacta

SEQ ID NO: 5896778 - DNA, 21 bp, Homo sapiens
ctttgctggaagaaactaaaa

SEQ ID NO: 5896779 - DNA, 22 bp, Homo sapiens
ctttgctggagtcctgttctca

SEQ ID NO: 5896780 - DNA, 12 bp, Homo sapiens
ctttgctggttc

SEQ ID NO: 5896781 - DNA, 19 bp, Homo sapiens
ctttgctgtactcttgctg

SEQ ID NO: 5896782 - DNA, 14 bp, Homo sapiens
ctttgctgttactg

SEQ ID NO: 5896783 - DNA, 13 bp, Homo sapiens
ctttgctgtttat

SEQ ID NO: 5896784 - DNA, 16 bp, Homo sapiens
ctttgcttaccttgtt

SEQ ID NO: 5896785 - DNA, 12 bp, Homo sapiens
ctttgcttcata

SEQ ID NO: 5896786 - DNA, 13 bp, Homo sapiens
ctttgcttcatag

SEQ ID NO: 5896787 - DNA, 14 bp, Homo sapiens
ctttgcttcattcc

SEQ ID NO: 5896788 - DNA, 15 bp, Homo sapiens
ctttgcttcccctcc

SEQ ID NO: 5896789 - DNA, 22 bp, Homo sapiens
ctttgcttccgccactcagcca

SEQ ID NO: 5896790 - DNA, 12 bp, Homo sapiens
ctttgcttctcc

SEQ ID NO: 5896791 - DNA, 15 bp, Homo sapiens
ctttgcttctctcca

SEQ ID NO: 5896792 - DNA, 20 bp, Homo sapiens
ctttgcttctttttcttacc

SEQ ID NO: 5896793 - DNA, 19 bp, Homo sapiens
ctttgcttgcagtagattt

SEQ ID NO: 5896794 - DNA, 20 bp, Homo sapiens
ctttgcttgcctctctgttt

SEQ ID NO: 5896795 - DNA, 18 bp, Homo sapiens
ctttgcttgctttgaagt

SEQ ID NO: 5896796 - DNA, 19 bp, Homo sapiens
ctttgcttgctttgaagta

SEQ ID NO: 5896797 - DNA, 16 bp, Homo sapiens
ctttgctttaatataa

SEQ ID NO: 5896798 - DNA, 18 bp, Homo sapiens
ctttgctttaatataaat

SEQ ID NO: 5896799 - DNA, 14 bp, Homo sapiens
ctttgctttctcgt

SEQ ID NO: 5896800 - DNA, 17 bp, Homo sapiens
ctttgctttctgaattg

SEQ ID NO: 5896801 - DNA, 14 bp, Homo sapiens
ctttgctttctgct

SEQ ID NO: 5896802 - DNA, 11 bp, Homo sapiens
ctttgctttgc

SEQ ID NO: 5896803 - DNA, 12 bp, Homo sapiens
ctttgctttgta

SEQ ID NO: 5896804 - DNA, 14 bp, Homo sapiens
ctttgctttgtagt

SEQ ID NO: 5896805 - DNA, 19 bp, Homo sapiens
ctttgctttgtagtttgct

SEQ ID NO: 5896806 - DNA, 18 bp, Homo sapiens
ctttgctttgtctggaag

SEQ ID NO: 5896807 - DNA, 14 bp, Homo sapiens
ctttggaaaattca

SEQ ID NO: 5896808 - DNA, 17 bp, Homo sapiens
ctttggaaacaacattt

SEQ ID NO: 5896809 - DNA, 20 bp, Homo sapiens
ctttggaaaccaccttaaaa

SEQ ID NO: 5896810 - DNA, 23 bp, Homo sapiens
ctttggaaagacttttccaaccc

SEQ ID NO: 5896811 - DNA, 16 bp, Homo sapiens
ctttggaaagccaagg

SEQ ID NO: 5896812 - DNA, 18 bp, Homo sapiens
ctttggaaagttactgta

SEQ ID NO: 5896813 - DNA, 20 bp, Homo sapiens
ctttggaaagttactgtaaa

SEQ ID NO: 5896814 - DNA, 16 bp, Homo sapiens
ctttggaaataaaaga

SEQ ID NO: 5896815 - DNA, 20 bp, Homo sapiens
ctttggaaatagcatgacag

SEQ ID NO: 5896816 - DNA, 18 bp, Homo sapiens
ctttggaacaagacagcc

SEQ ID NO: 5896817 - DNA, 16 bp, Homo sapiens
ctttggaacagatatt

SEQ ID NO: 5896818 - DNA, 16 bp, Homo sapiens
ctttggaaccagactc

SEQ ID NO: 5896819 - DNA, 23 bp, Homo sapiens
ctttggaaccagactcttgcctg

SEQ ID NO: 5896820 - DNA, 15 bp, Homo sapiens
ctttggaagaaaaaa

SEQ ID NO: 5896821 - DNA, 19 bp, Homo sapiens
ctttggaagatgcagaagc

SEQ ID NO: 5896822 - DNA, 21 bp, Homo sapiens
ctttggaagcactttttctgc

SEQ ID NO: 5896823 - DNA, 14 bp, Homo sapiens
ctttggaagcagca

SEQ ID NO: 5896824 - DNA, 21 bp, Homo sapiens
ctttggaagcagcaaggtggg

SEQ ID NO: 5896825 - DNA, 21 bp, Homo sapiens
ctttggaagtttagctctgag

SEQ ID NO: 5896826 - DNA, 22 bp, Homo sapiens
ctttggaagtttagctctgaga

SEQ ID NO: 5896827 - DNA, 17 bp, Homo sapiens
ctttggaagtttgtgtt

SEQ ID NO: 5896828 - DNA, 19 bp, Homo sapiens
ctttggaatattttatcct

SEQ ID NO: 5896829 - DNA, 20 bp, Homo sapiens
ctttggaatattttatcctg

SEQ ID NO: 5896830 - DNA, 23 bp, Homo sapiens
ctttggacaactgacaatatgat

SEQ ID NO: 5896831 - DNA, 20 bp, Homo sapiens
ctttggacagaagcagctct

SEQ ID NO: 5896832 - DNA, 21 bp, Homo sapiens
ctttggacagaagcagctctt

SEQ ID NO: 5896833 - DNA, 13 bp, Homo sapiens
ctttggacagctg

SEQ ID NO: 5896834 - DNA, 15 bp, Homo sapiens
ctttggacagtggcc

SEQ ID NO: 5896835 - DNA, 18 bp, Homo sapiens
ctttggacagtggcctct

SEQ ID NO: 5896836 - DNA, 20 bp, Homo sapiens
ctttggacccaaggaaaact

SEQ ID NO: 5896837 - DNA, 16 bp, Homo sapiens
ctttggacccagggcc

SEQ ID NO: 5896838 - DNA, 22 bp, Homo sapiens
ctttggacccagggcctgactt

SEQ ID NO: 5896839 - DNA, 24 bp, Homo sapiens
ctttggacccagggcctgacttga

SEQ ID NO: 5896840 - DNA, 17 bp, Homo sapiens
ctttggaccctgaggcc

SEQ ID NO: 5896841 - DNA, 20 bp, Homo sapiens
ctttggacctaaatggcctc

SEQ ID NO: 5896842 - DNA, 15 bp, Homo sapiens
ctttggacctattat

SEQ ID NO: 5896843 - DNA, 16 bp, Homo sapiens
ctttggacgcacacag

SEQ ID NO: 5896844 - DNA, 17 bp, Homo sapiens
ctttggacgcacacagc

SEQ ID NO: 5896845 - DNA, 17 bp, Homo sapiens
ctttggacttctgaaga

SEQ ID NO: 5896846 - DNA, 20 bp, Homo sapiens
ctttggagaactcatttcaa

SEQ ID NO: 5896847 - DNA, 19 bp, Homo sapiens
ctttggagaccattatcag

SEQ ID NO: 5896848 - DNA, 14 bp, Homo sapiens
ctttggagactggg

SEQ ID NO: 5896849 - DNA, 22 bp, Homo sapiens
ctttggagactggggtggcctc

SEQ ID NO: 5896850 - DNA, 16 bp, Homo sapiens
ctttggagatcaagga

SEQ ID NO: 5896851 - DNA, 23 bp, Homo sapiens
ctttggagcaaagaaggagctga

SEQ ID NO: 5896852 - DNA, 15 bp, Homo sapiens
ctttggaggaacagc

SEQ ID NO: 5896853 - DNA, 20 bp, Homo sapiens
ctttggatgacttgttcatt

SEQ ID NO: 5896854 - DNA, 14 bp, Homo sapiens
ctttggattctaaa

SEQ ID NO: 5896855 - DNA, 20 bp, Homo sapiens
ctttggattctaaatacatg

SEQ ID NO: 5896856 - DNA, 18 bp, Homo sapiens
ctttggattgctggggcc

SEQ ID NO: 5896857 - DNA, 20 bp, Homo sapiens
ctttggattgctggggccag

SEQ ID NO: 5896858 - DNA, 13 bp, Homo sapiens
ctttggatttgac

SEQ ID NO: 5896859 - DNA, 22 bp, Homo sapiens
ctttggcaaaggtccctgagct

SEQ ID NO: 5896860 - DNA, 17 bp, Homo sapiens
ctttggcaatttcctgg

SEQ ID NO: 5896861 - DNA, 19 bp, Homo sapiens
ctttggcactctctgccat

SEQ ID NO: 5896862 - DNA, 16 bp, Homo sapiens
ctttggcactctgact

SEQ ID NO: 5896863 - DNA, 17 bp, Homo sapiens
ctttggcactggggcac

SEQ ID NO: 5896864 - DNA, 21 bp, Homo sapiens
ctttggcagaccatctccagc

SEQ ID NO: 5896865 - DNA, 13 bp, Homo sapiens
ctttggcagtgtt

SEQ ID NO: 5896866 - DNA, 15 bp, Homo sapiens
ctttggcagtgtttt

SEQ ID NO: 5896867 - DNA, 12 bp, Homo sapiens
ctttggcagttg

SEQ ID NO: 5896868 - DNA, 13 bp, Homo sapiens
ctttggcccaggg

SEQ ID NO: 5896869 - DNA, 19 bp, Homo sapiens
ctttggccccactttgaag

SEQ ID NO: 5896870 - DNA, 17 bp, Homo sapiens
ctttggcctacattctt

SEQ ID NO: 5896871 - DNA, 18 bp, Homo sapiens
ctttggcctacattcttt

SEQ ID NO: 5896872 - DNA, 22 bp, Homo sapiens
ctttggcctgatgaccaatttt

SEQ ID NO: 5896873 - DNA, 17 bp, Homo sapiens
ctttggcctgtgagcca

SEQ ID NO: 5896874 - DNA, 16 bp, Homo sapiens
ctttggcgttggagac

SEQ ID NO: 5896875 - DNA, 19 bp, Homo sapiens
ctttggctatgagggcctt

SEQ ID NO: 5896876 - DNA, 19 bp, Homo sapiens
ctttggctattagagatca

SEQ ID NO: 5896877 - DNA, 15 bp, Homo sapiens
ctttggctcccctgt

SEQ ID NO: 5896878 - DNA, 21 bp, Homo sapiens
ctttggctgaaattcttcaac

SEQ ID NO: 5896879 - DNA, 13 bp, Homo sapiens
ctttggctgaggg

SEQ ID NO: 5896880 - DNA, 17 bp, Homo sapiens
ctttggctgaggggctt

SEQ ID NO: 5896881 - DNA, 20 bp, Homo sapiens
ctttggctgcacgtcaccct

SEQ ID NO: 5896882 - DNA, 14 bp, Homo sapiens
ctttggctgcaggt

SEQ ID NO: 5896883 - DNA, 15 bp, Homo sapiens
ctttggctggtagca

SEQ ID NO: 5896884 - DNA, 21 bp, Homo sapiens
ctttggcttaattccaatcat

SEQ ID NO: 5896885 - DNA, 18 bp, Homo sapiens
ctttggcttacatttgaa

SEQ ID NO: 5896886 - DNA, 18 bp, Homo sapiens
ctttggcttataattctt

SEQ ID NO: 5896887 - DNA, 22 bp, Homo sapiens
ctttggcttctgatttttctct

SEQ ID NO: 5896888 - DNA, 12 bp, Homo sapiens
ctttggcttttt

SEQ ID NO: 5896889 - DNA, 21 bp, Homo sapiens
ctttgggaaaacatgttaatg

SEQ ID NO: 5896890 - DNA, 22 bp, Homo sapiens
ctttgggaaacgggttgtgttt

SEQ ID NO: 5896891 - DNA, 18 bp, Homo sapiens
ctttgggaaagcccagac

SEQ ID NO: 5896892 - DNA, 22 bp, Homo sapiens
ctttgggaaaggagaagttaag

SEQ ID NO: 5896893 - DNA, 16 bp, Homo sapiens
ctttgggaacactggc

SEQ ID NO: 5896894 - DNA, 18 bp, Homo sapiens
ctttgggaacactggcct

SEQ ID NO: 5896895 - DNA, 20 bp, Homo sapiens
ctttgggaagactgaggcat

SEQ ID NO: 5896896 - DNA, 14 bp, Homo sapiens
ctttgggaagcctt

SEQ ID NO: 5896897 - DNA, 18 bp, Homo sapiens
ctttgggaatatttgaat

SEQ ID NO: 5896898 - DNA, 20 bp, Homo sapiens
ctttgggaatatttgaatct

SEQ ID NO: 5896899 - DNA, 22 bp, Homo sapiens
ctttgggagaaaacgtcttgct

SEQ ID NO: 5896900 - DNA, 13 bp, Homo sapiens
ctttgggagacca

SEQ ID NO: 5896901 - DNA, 13 bp, Homo sapiens
ctttgggaggcag

SEQ ID NO: 5896902 - DNA, 17 bp, Homo sapiens
ctttgggaggccaaggc

SEQ ID NO: 5896903 - DNA, 13 bp, Homo sapiens
ctttgggaggctg

SEQ ID NO: 5896904 - DNA, 11 bp, Homo sapiens
ctttgggatcc

SEQ ID NO: 5896905 - DNA, 15 bp, Homo sapiens
ctttgggatttaatt

SEQ ID NO: 5896906 - DNA, 20 bp, Homo sapiens
ctttgggatttaatttccag

SEQ ID NO: 5896907 - DNA, 21 bp, Homo sapiens
ctttgggcacaattcctgtgc

SEQ ID NO: 5896908 - DNA, 22 bp, Homo sapiens
ctttgggcacaattcctgtgct

SEQ ID NO: 5896909 - DNA, 23 bp, Homo sapiens
ctttgggcacaattcctgtgctc

SEQ ID NO: 5896910 - DNA, 17 bp, Homo sapiens
ctttgggcagatttgca

SEQ ID NO: 5896911 - DNA, 19 bp, Homo sapiens
ctttgggcagatttgcaac

SEQ ID NO: 5896912 - DNA, 19 bp, Homo sapiens
ctttgggcccaagaactgc

SEQ ID NO: 5896913 - DNA, 21 bp, Homo sapiens
ctttgggcccaagaactgcag

SEQ ID NO: 5896914 - DNA, 23 bp, Homo sapiens
ctttgggcccaagaactgcagat

SEQ ID NO: 5896915 - DNA, 13 bp, Homo sapiens
ctttgggccctgc

SEQ ID NO: 5896916 - DNA, 15 bp, Homo sapiens
ctttgggccctgcat

SEQ ID NO: 5896917 - DNA, 19 bp, Homo sapiens
ctttgggctgccctggtgc

SEQ ID NO: 5896918 - DNA, 16 bp, Homo sapiens
ctttgggcttgggcct

SEQ ID NO: 5896919 - DNA, 23 bp, Homo sapiens
ctttgggctttgcaggctctggg

SEQ ID NO: 5896920 - DNA, 15 bp, Homo sapiens
ctttggggacaccct

SEQ ID NO: 5896921 - DNA, 16 bp, Homo sapiens
ctttggggacaccctc

SEQ ID NO: 5896922 - DNA, 21 bp, Homo sapiens
ctttggggacaccctcctgcc

SEQ ID NO: 5896923 - DNA, 20 bp, Homo sapiens
ctttggggacagggggtggg

SEQ ID NO: 5896924 - DNA, 20 bp, Homo sapiens
ctttggggacagttggcaga

SEQ ID NO: 5896925 - DNA, 22 bp, Homo sapiens
ctttggggacagttggcagaga

SEQ ID NO: 5896926 - DNA, 23 bp, Homo sapiens
ctttggggacttccgctccctgg

SEQ ID NO: 5896927 - DNA, 23 bp, Homo sapiens
ctttggggagacggtgttgcaga

SEQ ID NO: 5896928 - DNA, 20 bp, Homo sapiens
ctttggggagcaggaggcca

SEQ ID NO: 5896929 - DNA, 20 bp, Homo sapiens
cttttaactcctcaattcca

SEQ ID NO: 5896930 - DNA, 15 bp, Homo sapiens
cttttaactgtgcaa

SEQ ID NO: 5896931 - DNA, 14 bp, Homo sapiens
cttttaacttcttt

SEQ ID NO: 5896932 - DNA, 20 bp, Homo sapiens
cttttaactttataaatcca

SEQ ID NO: 5896933 - DNA, 14 bp, Homo sapiens
cttttaagaaacac

SEQ ID NO: 5896934 - DNA, 14 bp, Homo sapiens
cttttaagaaagct

SEQ ID NO: 5896935 - DNA, 14 bp, Homo sapiens
cttttaagaatcaa

SEQ ID NO: 5896936 - DNA, 15 bp, Homo sapiens
cttttaagacatttt

SEQ ID NO: 5896937 - DNA, 17 bp, Homo sapiens
cttttaagattgtactt

SEQ ID NO: 5896938 - DNA, 17 bp, Homo sapiens
cttttaagcatgtgatg

SEQ ID NO: 5896939 - DNA, 16 bp, Homo sapiens
cttttaagcatttgta

SEQ ID NO: 5896940 - DNA, 18 bp, Homo sapiens
cttttaagcatttgtata

SEQ ID NO: 5896941 - DNA, 20 bp, Homo sapiens
cttttaagcatttgtatatt

SEQ ID NO: 5896942 - DNA, 14 bp, Homo sapiens
cttttaaggataaa

SEQ ID NO: 5896943 - DNA, 14 bp, Homo sapiens
cttttaaggtttca

SEQ ID NO: 5896944 - DNA, 18 bp, Homo sapiens
cttttaaggtttcaacaa

SEQ ID NO: 5896945 - DNA, 16 bp, Homo sapiens
cttttaagtaaggtcc

SEQ ID NO: 5896946 - DNA, 18 bp, Homo sapiens
cttttaagttaatgaaat

SEQ ID NO: 5896947 - DNA, 19 bp, Homo sapiens
cttttaagttgagcgtgcg

SEQ ID NO: 5896948 - DNA, 16 bp, Homo sapiens
cttttaataaaaagga

SEQ ID NO: 5896949 - DNA, 14 bp, Homo sapiens
cttttaataaaatt

SEQ ID NO: 5896950 - DNA, 19 bp, Homo sapiens
cttttaatcatgagcctgt

SEQ ID NO: 5896951 - DNA, 20 bp, Homo sapiens
cttttaatcatgagcctgtt

SEQ ID NO: 5896952 - DNA, 22 bp, Homo sapiens
cttttaatccctatgtttgtct

SEQ ID NO: 5896953 - DNA, 15 bp, Homo sapiens
cttttaatgaacaaa

SEQ ID NO: 5896954 - DNA, 12 bp, Homo sapiens
cttttaatgaat

SEQ ID NO: 5896955 - DNA, 23 bp, Homo sapiens
cttttaatggcatttctctttaa

SEQ ID NO: 5896956 - DNA, 11 bp, Homo sapiens
cttttaatggt

SEQ ID NO: 5896957 - DNA, 20 bp, Homo sapiens
cttttaattaaataaaagct

SEQ ID NO: 5896958 - DNA, 15 bp, Homo sapiens
cttttaattaaatgc

SEQ ID NO: 5896959 - DNA, 16 bp, Homo sapiens
cttttaattaatgaaa

SEQ ID NO: 5896960 - DNA, 17 bp, Homo sapiens
cttttaattacagaaga

SEQ ID NO: 5896961 - DNA, 17 bp, Homo sapiens
cttttaattactgtttt

SEQ ID NO: 5896962 - DNA, 20 bp, Homo sapiens
cttttaattactgttttctt

SEQ ID NO: 5896963 - DNA, 13 bp, Homo sapiens
cttttaattcatt

SEQ ID NO: 5896964 - DNA, 14 bp, Homo sapiens
cttttaattttcct

SEQ ID NO: 5896965 - DNA, 23 bp, Homo sapiens
cttttacaagtaacaaaaataaa

SEQ ID NO: 5896966 - DNA, 17 bp, Homo sapiens
cttttacagaatgcatt

SEQ ID NO: 5896967 - DNA, 19 bp, Homo sapiens
cttttacagaatgcattaa

SEQ ID NO: 5896968 - DNA, 18 bp, Homo sapiens
cttttacagcttttctct

SEQ ID NO: 5896969 - DNA, 13 bp, Homo sapiens
cttttacatactg

SEQ ID NO: 5896970 - DNA, 18 bp, Homo sapiens
cttttacattaaagaaat

SEQ ID NO: 5896971 - DNA, 17 bp, Homo sapiens
cttttacattctgtgtg

SEQ ID NO: 5896972 - DNA, 19 bp, Homo sapiens
cttttacatttttctgatg

SEQ ID NO: 5896973 - DNA, 14 bp, Homo sapiens
cttttaccactccc

SEQ ID NO: 5896974 - DNA, 15 bp, Homo sapiens
cttttaccagctttt

SEQ ID NO: 5896975 - DNA, 17 bp, Homo sapiens
cttttaccatgaattct

SEQ ID NO: 5896976 - DNA, 14 bp, Homo sapiens
cttttaccatgccc

SEQ ID NO: 5896977 - DNA, 16 bp, Homo sapiens
cttttaccattagcat

SEQ ID NO: 5896978 - DNA, 19 bp, Homo sapiens
cttttaccattagcataat

SEQ ID NO: 5896979 - DNA, 20 bp, Homo sapiens
cttttacccctgcacagttt

SEQ ID NO: 5896980 - DNA, 15 bp, Homo sapiens
cttttaccctggccc

SEQ ID NO: 5896981 - DNA, 16 bp, Homo sapiens
cttttaccctggcccc

SEQ ID NO: 5896982 - DNA, 19 bp, Homo sapiens
cttttaccctggcccctct

SEQ ID NO: 5896983 - DNA, 23 bp, Homo sapiens
cttttaccctggcccctctccct

SEQ ID NO: 5896984 - DNA, 15 bp, Homo sapiens
cttttacctgctgct

SEQ ID NO: 5896985 - DNA, 18 bp, Homo sapiens
cttttacctgctgcttct

SEQ ID NO: 5896986 - DNA, 15 bp, Homo sapiens
cttttacgagtgcta

SEQ ID NO: 5896987 - DNA, 22 bp, Homo sapiens
cttttacgtagtaaaagtcata

SEQ ID NO: 5896988 - DNA, 14 bp, Homo sapiens
cttttactaagaca

SEQ ID NO: 5896989 - DNA, 23 bp, Homo sapiens
cttttactacagctatgaagaaa

SEQ ID NO: 5896990 - DNA, 14 bp, Homo sapiens
cttttactcctttg

SEQ ID NO: 5896991 - DNA, 17 bp, Homo sapiens
cttttactcctttgcat

SEQ ID NO: 5896992 - DNA, 19 bp, Homo sapiens
cttttactggactgtctga

SEQ ID NO: 5896993 - DNA, 15 bp, Homo sapiens
cttttactggttgca

SEQ ID NO: 5896994 - DNA, 16 bp, Homo sapiens
cttttactggttgcat

SEQ ID NO: 5896995 - DNA, 22 bp, Homo sapiens
cttttactggttgcatggaaat

SEQ ID NO: 5896996 - DNA, 19 bp, Homo sapiens
cttttactgtctatatata

SEQ ID NO: 5896997 - DNA, 13 bp, Homo sapiens
cttttacttgaaa

SEQ ID NO: 5896998 - DNA, 23 bp, Homo sapiens
cttttacttgaaaagaaagtgtt

SEQ ID NO: 5896999 - DNA, 14 bp, Homo sapiens
cttttacttgttca

SEQ ID NO: 5897000 - DNA, 18 bp, Homo sapiens
cttttacttgttcatttc

SEQ ID NO: 5897001 - DNA, 18 bp, Homo sapiens
cttttactttaaagtagt

SEQ ID NO: 5897002 - DNA, 13 bp, Homo sapiens
cttttactttatt

SEQ ID NO: 5897003 - DNA, 17 bp, Homo sapiens
cttttactttttatgaa

SEQ ID NO: 5897004 - DNA, 23 bp, Homo sapiens
cttttagaaaagggagtttaaaa

SEQ ID NO: 5897005 - DNA, 23 bp, Homo sapiens
cttttagaaatactgcaagaaaa

SEQ ID NO: 5897006 - DNA, 14 bp, Homo sapiens
cttttagaaatgca

SEQ ID NO: 5897007 - DNA, 13 bp, Homo sapiens
cttttagaagcag

SEQ ID NO: 5897008 - DNA, 16 bp, Homo sapiens
cttttagacaactaga

SEQ ID NO: 5897009 - DNA, 19 bp, Homo sapiens
cttttagacaactagattt

SEQ ID NO: 5897010 - DNA, 21 bp, Homo sapiens
cttttagacaactagatttgt

SEQ ID NO: 5897011 - DNA, 19 bp, Homo sapiens
cttttagacagtggtaaat

SEQ ID NO: 5897012 - DNA, 23 bp, Homo sapiens
cttttagagccccccgtgtggct

SEQ ID NO: 5897013 - DNA, 13 bp, Homo sapiens
cttttagcctagt

SEQ ID NO: 5897014 - DNA, 15 bp, Homo sapiens
cttttagcctggctg

SEQ ID NO: 5897015 - DNA, 16 bp, Homo sapiens
cttttagcctggctgt

SEQ ID NO: 5897016 - DNA, 18 bp, Homo sapiens
cttttagcctggctgtca

SEQ ID NO: 5897017 - DNA, 20 bp, Homo sapiens
cttttaggagaaagtgtatt

SEQ ID NO: 5897018 - DNA, 20 bp, Homo sapiens
cttttaggagaattcacaga

SEQ ID NO: 5897019 - DNA, 13 bp, Homo sapiens
cttttaggtgagg

SEQ ID NO: 5897020 - DNA, 22 bp, Homo sapiens
cttttagtaaaaacatttaaat

SEQ ID NO: 5897021 - DNA, 20 bp, Homo sapiens
cttttagtacccacctgagc

SEQ ID NO: 5897022 - DNA, 16 bp, Homo sapiens
cttttagtagagacag

SEQ ID NO: 5897023 - DNA, 22 bp, Homo sapiens
cttttagtcacgtgtattttca

SEQ ID NO: 5897024 - DNA, 17 bp, Homo sapiens
cttttagtcagaaatga

SEQ ID NO: 5897025 - DNA, 22 bp, Homo sapiens
cttttagtcagaaatgattcag

SEQ ID NO: 5897026 - DNA, 21 bp, Homo sapiens
cttttagtggtggtgtctcac

SEQ ID NO: 5897027 - DNA, 21 bp, Homo sapiens
cttttagtggttctgtgcctc

SEQ ID NO: 5897028 - DNA, 21 bp, Homo sapiens
cttttagttacatgaattaag

SEQ ID NO: 5897029 - DNA, 18 bp, Homo sapiens
cttttagttcatatatac

SEQ ID NO: 5897030 - DNA, 20 bp, Homo sapiens
cttttagttccaacaaagaa

SEQ ID NO: 5897031 - DNA, 22 bp, Homo sapiens
cttttagttcctgtgcacagcc

SEQ ID NO: 5897032 - DNA, 21 bp, Homo sapiens
cttttagttttagttgcagaa

SEQ ID NO: 5897033 - DNA, 22 bp, Homo sapiens
cttttagttttagttgcagaaa

SEQ ID NO: 5897034 - DNA, 10 bp, Homo sapiens
cttttataaa

SEQ ID NO: 5897035 - DNA, 22 bp, Homo sapiens
cttttataaaaaaaatgaaatg

SEQ ID NO: 5897036 - DNA, 23 bp, Homo sapiens
cttttataaaaaaaatgaaatgt

SEQ ID NO: 5897037 - DNA, 14 bp, Homo sapiens
cttttataaacctc

SEQ ID NO: 5897038 - DNA, 15 bp, Homo sapiens
cttttataaacttta

SEQ ID NO: 5897039 - DNA, 20 bp, Homo sapiens
cttttataaactttaccttt

SEQ ID NO: 5897040 - DNA, 21 bp, Homo sapiens
cttttataaactttacctttt

SEQ ID NO: 5897041 - DNA, 14 bp, Homo sapiens
cttttataaagcat

SEQ ID NO: 5897042 - DNA, 16 bp, Homo sapiens
cttttataaagcatgt

SEQ ID NO: 5897043 - DNA, 11 bp, Homo sapiens
cttttataaat

SEQ ID NO: 5897044 - DNA, 12 bp, Homo sapiens
cttttataaatg

SEQ ID NO: 5897045 - DNA, 14 bp, Homo sapiens
cttttataaatgtt

SEQ ID NO: 5897046 - DNA, 21 bp, Homo sapiens
cttttataaatgttttaaaga

SEQ ID NO: 5897047 - DNA, 14 bp, Homo sapiens
cttttataaattaa

SEQ ID NO: 5897048 - DNA, 24 bp, Homo sapiens
cttttataaattaaatatatgtat

SEQ ID NO: 5897049 - DNA, 14 bp, Homo sapiens
cttttataataaaa

SEQ ID NO: 5897050 - DNA, 21 bp, Homo sapiens
cttttataataaaaggaaaag

SEQ ID NO: 5897051 - DNA, 13 bp, Homo sapiens
cttttataataat

SEQ ID NO: 5897052 - DNA, 17 bp, Homo sapiens
cttttataatgattcat

SEQ ID NO: 5897053 - DNA, 18 bp, Homo sapiens
cttttataatgattcata

SEQ ID NO: 5897054 - DNA, 19 bp, Homo sapiens
cttttataatgattcataa

SEQ ID NO: 5897055 - DNA, 20 bp, Homo sapiens
cttttataattaatgtttgt

SEQ ID NO: 5897056 - DNA, 12 bp, Homo sapiens
cttttataattc

SEQ ID NO: 5897057 - DNA, 21 bp, Homo sapiens
cttttatacaataattgaagt

SEQ ID NO: 5897058 - DNA, 12 bp, Homo sapiens
cttttatactct

SEQ ID NO: 5897059 - DNA, 20 bp, Homo sapiens
cttttatactctttctgtat

SEQ ID NO: 5897060 - DNA, 15 bp, Homo sapiens
cttttatactgacac

SEQ ID NO: 5897061 - DNA, 17 bp, Homo sapiens
cttttatagactgattt

SEQ ID NO: 5897062 - DNA, 19 bp, Homo sapiens
cttttatagagcatatttg

SEQ ID NO: 5897063 - DNA, 12 bp, Homo sapiens
cttttatagcta

SEQ ID NO: 5897064 - DNA, 20 bp, Homo sapiens
cttttataggtgagaaaaaa

SEQ ID NO: 5897065 - DNA, 21 bp, Homo sapiens
cttttatagtggaaaaacaca

SEQ ID NO: 5897066 - DNA, 12 bp, Homo sapiens
cttttatagttg

SEQ ID NO: 5897067 - DNA, 12 bp, Homo sapiens
cttttatataac

SEQ ID NO: 5897068 - DNA, 14 bp, Homo sapiens
cttttatatataaa

SEQ ID NO: 5897069 - DNA, 17 bp, Homo sapiens
cttttatatataaaata

SEQ ID NO: 5897070 - DNA, 20 bp, Homo sapiens
cttttatatataaaataaat

SEQ ID NO: 5897071 - DNA, 22 bp, Homo sapiens
cttttatatataaaataaatat

SEQ ID NO: 5897072 - DNA, 15 bp, Homo sapiens
cttttatatggccca

SEQ ID NO: 5897073 - DNA, 20 bp, Homo sapiens
cttttatatggcccagcctt

SEQ ID NO: 5897074 - DNA, 19 bp, Homo sapiens
cttttatattcaaattcat

SEQ ID NO: 5897075 - DNA, 13 bp, Homo sapiens
cttttatattcta

SEQ ID NO: 5897076 - DNA, 16 bp, Homo sapiens
cttttatattctaata

SEQ ID NO: 5897077 - DNA, 14 bp, Homo sapiens
cttttatatttgta

SEQ ID NO: 5897078 - DNA, 15 bp, Homo sapiens
cttttatatttgtat

SEQ ID NO: 5897079 - DNA, 17 bp, Homo sapiens
cttttatatttgtatcg

SEQ ID NO: 5897080 - DNA, 19 bp, Homo sapiens
cttttatcacgatattatt

SEQ ID NO: 5897081 - DNA, 17 bp, Homo sapiens
cttttatccacttacct

SEQ ID NO: 5897082 - DNA, 24 bp, Homo sapiens
cttttatctattctgagaaaacaa

SEQ ID NO: 5897083 - DNA, 15 bp, Homo sapiens
cttttatctccttgt

SEQ ID NO: 5897084 - DNA, 16 bp, Homo sapiens
cttttatctgcagaac

SEQ ID NO: 5897085 - DNA, 17 bp, Homo sapiens
cttttatctggtgcctc

SEQ ID NO: 5897086 - DNA, 20 bp, Homo sapiens
cttttatgaaattaacaaga

SEQ ID NO: 5897087 - DNA, 14 bp, Homo sapiens
cttttatgagctca

SEQ ID NO: 5897088 - DNA, 22 bp, Homo sapiens
cttttatgattgcctttttata

SEQ ID NO: 5897089 - DNA, 19 bp, Homo sapiens
cttttatgattttgtttat

SEQ ID NO: 5897090 - DNA, 21 bp, Homo sapiens
cttttatgcagatagaatcaa

SEQ ID NO: 5897091 - DNA, 17 bp, Homo sapiens
cttttatgcagcaaata

SEQ ID NO: 5897092 - DNA, 21 bp, Homo sapiens
cttttatgcgcaaatacaaaa

SEQ ID NO: 5897093 - DNA, 12 bp, Homo sapiens
cttttatggatg

SEQ ID NO: 5897094 - DNA, 13 bp, Homo sapiens
cttttatggcaaa

SEQ ID NO: 5897095 - DNA, 18 bp, Homo sapiens
cttttatggctctatctt

SEQ ID NO: 5897096 - DNA, 19 bp, Homo sapiens
cttttatggctctatcttt

SEQ ID NO: 5897097 - DNA, 14 bp, Homo sapiens
cttttatgtaaatt

SEQ ID NO: 5897098 - DNA, 15 bp, Homo sapiens
cttttatgtaaattt

SEQ ID NO: 5897099 - DNA, 23 bp, Homo sapiens
cttttatgtaaattttttacgta

SEQ ID NO: 5897100 - DNA, 21 bp, Homo sapiens
cttttatgtaatttctttaaa

SEQ ID NO: 5897101 - DNA, 23 bp, Homo sapiens
cttttatgtaatttctttaaatg

SEQ ID NO: 5897102 - DNA, 14 bp, Homo sapiens
cttttatgtagcac

SEQ ID NO: 5897103 - DNA, 13 bp, Homo sapiens
cttttatgtattt

SEQ ID NO: 5897104 - DNA, 18 bp, Homo sapiens
cttttatgtgaaacatgt

SEQ ID NO: 5897105 - DNA, 21 bp, Homo sapiens
cttttatgtgagatttcctta

SEQ ID NO: 5897106 - DNA, 13 bp, Homo sapiens
cttttatgtgata

SEQ ID NO: 5897107 - DNA, 14 bp, Homo sapiens
cttttatgtgatat

SEQ ID NO: 5897108 - DNA, 19 bp, Homo sapiens
cttttatgtgatatgtttt

SEQ ID NO: 5897109 - DNA, 17 bp, Homo sapiens
cttttatgtggtctctt

SEQ ID NO: 5897110 - DNA, 19 bp, Homo sapiens
cttttatgtggtctctttg

SEQ ID NO: 5897111 - DNA, 20 bp, Homo sapiens
cttttatgttatttatatat

SEQ ID NO: 5897112 - DNA, 13 bp, Homo sapiens
cttttatgtttga

SEQ ID NO: 5897113 - DNA, 18 bp, Homo sapiens
cttttatgtttgaatatg

SEQ ID NO: 5897114 - DNA, 21 bp, Homo sapiens
cttttatgtttgtaatctgta

SEQ ID NO: 5897115 - DNA, 14 bp, Homo sapiens
cttttattaataaa

SEQ ID NO: 5897116 - DNA, 13 bp, Homo sapiens
cttttattaatac

SEQ ID NO: 5897117 - DNA, 23 bp, Homo sapiens
cttttattaatggcatgtaatat

SEQ ID NO: 5897118 - DNA, 16 bp, Homo sapiens
cttttattacattagt

SEQ ID NO: 5897119 - DNA, 20 bp, Homo sapiens
cttttattacattagttaag

SEQ ID NO: 5897120 - DNA, 19 bp, Homo sapiens
cttttattacggtgatcct

SEQ ID NO: 5897121 - DNA, 22 bp, Homo sapiens
cttttattagccagtgaaacac

SEQ ID NO: 5897122 - DNA, 23 bp, Homo sapiens
cttttattattattattgctgaa

SEQ ID NO: 5897123 - DNA, 11 bp, Homo sapiens
cttttattctg

SEQ ID NO: 5897124 - DNA, 18 bp, Homo sapiens
cttttattcttctttctt

SEQ ID NO: 5897125 - DNA, 16 bp, Homo sapiens
cttttattgtataaac

SEQ ID NO: 5897126 - DNA, 19 bp, Homo sapiens
cttttattgtataaactat

SEQ ID NO: 5897127 - DNA, 21 bp, Homo sapiens
cttttattgtataaactatca

SEQ ID NO: 5897128 - DNA, 15 bp, Homo sapiens
cttttatttaacaaa

SEQ ID NO: 5897129 - DNA, 22 bp, Homo sapiens
cttttatttaacaaaaaatgta

SEQ ID NO: 5897130 - DNA, 19 bp, Homo sapiens
cttttatttagcaccaggg

SEQ ID NO: 5897131 - DNA, 23 bp, Homo sapiens
cttttatttagggccttttctgt

SEQ ID NO: 5897132 - DNA, 20 bp, Homo sapiens
cttttatttataacaatgtt

SEQ ID NO: 5897133 - DNA, 15 bp, Homo sapiens
cttttatttcctgta

SEQ ID NO: 5897134 - DNA, 13 bp, Homo sapiens
cttttatttctcc

SEQ ID NO: 5897135 - DNA, 18 bp, Homo sapiens
cttttatttctccatctt

SEQ ID NO: 5897136 - DNA, 13 bp, Homo sapiens
cttttatttggaa

SEQ ID NO: 5897137 - DNA, 18 bp, Homo sapiens
cttttatttggtgtgttc

SEQ ID NO: 5897138 - DNA, 16 bp, Homo sapiens
cttttattttaatatt

SEQ ID NO: 5897139 - DNA, 19 bp, Homo sapiens
cttttattttgaaaagctt

SEQ ID NO: 5897140 - DNA, 22 bp, Homo sapiens
cttttatttttatttctgactc

SEQ ID NO: 5897141 - DNA, 17 bp, Homo sapiens
cttttattttttaagtt

SEQ ID NO: 5897142 - DNA, 19 bp, Homo sapiens
cttttattttttaagttca

SEQ ID NO: 5897143 - DNA, 20 bp, Homo sapiens
cttttcaaaagtcagaccct

SEQ ID NO: 5897144 - DNA, 13 bp, Homo sapiens
cttttcaaaataa

SEQ ID NO: 5897145 - DNA, 17 bp, Homo sapiens
cttttcaaaataaagct

SEQ ID NO: 5897146 - DNA, 13 bp, Homo sapiens
cttttcaaacaca

SEQ ID NO: 5897147 - DNA, 19 bp, Homo sapiens
cttttcaaaggtacttgga

SEQ ID NO: 5897148 - DNA, 18 bp, Homo sapiens
cttttcaaatgcagcaat

SEQ ID NO: 5897149 - DNA, 13 bp, Homo sapiens
cttttcaaatgtt

SEQ ID NO: 5897150 - DNA, 23 bp, Homo sapiens
cttttcaacttggcttcctttct

SEQ ID NO: 5897151 - DNA, 13 bp, Homo sapiens
cttttcaaggctt

SEQ ID NO: 5897152 - DNA, 18 bp, Homo sapiens
cttttcaagtaattttca

SEQ ID NO: 5897153 - DNA, 14 bp, Homo sapiens
cttttcaagtattt

SEQ ID NO: 5897154 - DNA, 18 bp, Homo sapiens
cttttcaagttaaataaa

SEQ ID NO: 5897155 - DNA, 21 bp, Homo sapiens
cttttcaagttgagaacaaaa

SEQ ID NO: 5897156 - DNA, 16 bp, Homo sapiens
cttttcaatgcaatgc

SEQ ID NO: 5897157 - DNA, 18 bp, Homo sapiens
cttttcaatgtctaaaaa

SEQ ID NO: 5897158 - DNA, 18 bp, Homo sapiens
cttttcaatgtgattctt

SEQ ID NO: 5897159 - DNA, 21 bp, Homo sapiens
cttttcaatgtgattcttcta

SEQ ID NO: 5897160 - DNA, 17 bp, Homo sapiens
cttttcaattatattgt

SEQ ID NO: 5897161 - DNA, 19 bp, Homo sapiens
cttttcaattatattgtta

SEQ ID NO: 5897162 - DNA, 17 bp, Homo sapiens
cttttcaattatttcaa

SEQ ID NO: 5897163 - DNA, 18 bp, Homo sapiens
cttttcaattatttcaat

SEQ ID NO: 5897164 - DNA, 18 bp, Homo sapiens
cttttcaatttgtcatgt

SEQ ID NO: 5897165 - DNA, 19 bp, Homo sapiens
cttttcaatttgtcatgtt

SEQ ID NO: 5897166 - DNA, 20 bp, Homo sapiens
cttttcaatttgtcatgtta

SEQ ID NO: 5897167 - DNA, 15 bp, Homo sapiens
cttttcacactgtct

SEQ ID NO: 5897168 - DNA, 15 bp, Homo sapiens
cttttcacagcaaca

SEQ ID NO: 5897169 - DNA, 17 bp, Homo sapiens
cttttcacagcaacatt

SEQ ID NO: 5897170 - DNA, 19 bp, Homo sapiens
cttttcacatttttaaaag

SEQ ID NO: 5897171 - DNA, 21 bp, Homo sapiens
cttttcaccaaaatttctaca
